United States Patent 10,706,955 (BIOINFORMATIC PROCESSES FOR DETERMINATION OF PEPTIDE BINDING) - sequence listing, part 48

SEQ ID NO: 1826579 - protein, 17 aa, Staphylococcus epidermidis
EILTYFRNNPCPENIPV

SEQ ID NO: 1826580 - protein, 18 aa, Staphylococcus epidermidis
EILVAFDLYGGTFRLFDF

SEQ ID NO: 1826581 - protein, 17 aa, Staphylococcus epidermidis
EILVLLYTGNEELEYIK

SEQ ID NO: 1826582 - protein, 18 aa, Staphylococcus epidermidis
EIMPIYDAAMKYKEDGTG

SEQ ID NO: 1826583 - protein, 33 aa, Staphylococcus epidermidis
EINDFIIVHKKKGWEFSQLLHKIKLLNYDVQTS

SEQ ID NO: 1826584 - protein, 24 aa, Staphylococcus epidermidis
EINQNFINFDKWLNISFTEKYYSR

SEQ ID NO: 1826585 - protein, 18 aa, Staphylococcus epidermidis
EINSDFFIPGRKSFINEV

SEQ ID NO: 1826586 - protein, 30 aa, Staphylococcus epidermidis
EIPESYLRKFDYLVFPDNVAIVLGIAEAVG

SEQ ID NO: 1826587 - protein, 19 aa, Staphylococcus epidermidis
EIPFDVYPQDAIMPLPLEE

SEQ ID NO: 1826588 - protein, 31 aa, Staphylococcus epidermidis
EIPRLNVLDLQRLIRVIPKPVIAMVRGYAIG

SEQ ID NO: 1826589 - protein, 24 aa, Staphylococcus epidermidis
EIQFQYGLTLCHLEMFDQAINQLK

SEQ ID NO: 1826590 - protein, 25 aa, Staphylococcus epidermidis
EIQPKTMMSKIVPGLFLCGEVLDIH

SEQ ID NO: 1826591 - protein, 18 aa, Staphylococcus epidermidis
EIRGQRICLYYDEATFDS

SEQ ID NO: 1826592 - protein, 25 aa, Staphylococcus epidermidis
EIRQRIDYWLERFAITENRKKRIQS

SEQ ID NO: 1826593 - protein, 18 aa, Staphylococcus epidermidis
EISGWRYMLDKCEELLSE

SEQ ID NO: 1826594 - protein, 21 aa, Staphylococcus epidermidis
EISKRFSSIQDYLLEYCNFGC

SEQ ID NO: 1826595 - protein, 31 aa, Staphylococcus epidermidis
EISTQLLDRYLVIAHSYHLKPRILITKHDLA

SEQ ID NO: 1826596 - protein, 18 aa, Staphylococcus epidermidis
EITDIQWFDIKDTEYIAP

SEQ ID NO: 1826597 - protein, 34 aa, Staphylococcus epidermidis
EITLDHIKHFIAIYTQILVTPLIAYIQNYGIALE

SEQ ID NO: 1826598 - protein, 21 aa, Staphylococcus epidermidis
EIYEFVMSKDSFSPSEVTAIA

SEQ ID NO: 1826599 - protein, 29 aa, Staphylococcus epidermidis
EIYHQLQPDAFYFLPSYMAPLKEHDDFLD

SEQ ID NO: 1826600 - protein, 20 aa, Staphylococcus epidermidis
EIYPHHHPKFNISESSMLVA

SEQ ID NO: 1826601 - protein, 28 aa, Staphylococcus epidermidis
EKAEKIFVFNMYLLLKSGPPSRGEEVNG

SEQ ID NO: 1826602 - protein, 27 aa, Staphylococcus epidermidis
EKAHELKPDLILMDLLMDDMDGVEATT

SEQ ID NO: 1826603 - protein, 20 aa, Staphylococcus epidermidis
EKEFFDLYSKVVIEIPTHSP

SEQ ID NO: 1826604 - protein, 25 aa, Staphylococcus epidermidis
EKEFKSRILPTLTPLGIDAYHPFPK

SEQ ID NO: 1826605 - protein, 21 aa, Staphylococcus epidermidis
EKEIFAMYYDYSEPVKRVANH

SEQ ID NO: 1826606 - protein, 23 aa, Staphylococcus epidermidis
EKELFIEGAYIYYLGSFIDSDSS

SEQ ID NO: 1826607 - protein, 26 aa, Staphylococcus epidermidis
EKENGINYIKDNDYLKIIEKITKKEK

SEQ ID NO: 1826608 - protein, 29 aa, Staphylococcus epidermidis
EKEPIYGSTYLPRKFKIGIAVPPSNDIDV

SEQ ID NO: 1826609 - protein, 32 aa, Staphylococcus epidermidis
EKEPTYLPNSNLIRLIFDEGFIAIRPSGTEPK

SEQ ID NO: 1826610 - protein, 33 aa, Staphylococcus epidermidis
EKERLIPYFMYHNYWFLFYHDENYFAVKYKDDH

SEQ ID NO: 1826611 - protein, 24 aa, Staphylococcus epidermidis
EKEYLRVKNVLFGLLDSPVKYTQH

SEQ ID NO: 1826612 - protein, 18 aa, Staphylococcus epidermidis
EKFDKWIKSIDYSNLGYL

SEQ ID NO: 1826613 - protein, 22 aa, Staphylococcus epidermidis
EKFKTTMVTFKFMAPLDYETIT

SEQ ID NO: 1826614 - protein, 25 aa, Staphylococcus epidermidis
EKFNRPIFTFIDTKGAYPGKAAEER

SEQ ID NO: 1826615 - protein, 21 aa, Staphylococcus epidermidis
EKGLYRKRMLSYGGLLKQKGS

SEQ ID NO: 1826616 - protein, 22 aa, Staphylococcus epidermidis
EKGRSYLKYLKATYPNRHYITN

SEQ ID NO: 1826617 - protein, 17 aa, Staphylococcus epidermidis
EKGVYKGHLLLYSPNAK

SEQ ID NO: 1826618 - protein, 23 aa, Staphylococcus epidermidis
EKHQPILYSLNYIKSSLVKFTIT

SEQ ID NO: 1826619 - protein, 22 aa, Staphylococcus epidermidis
EKINMYFAPSYIQTTDHHTSDI

SEQ ID NO: 1826620 - protein, 36 aa, Staphylococcus epidermidis
EKIQSSILTSIPLWKNQMAIALTLMRQRNAVSAQRA

SEQ ID NO: 1826621 - protein, 30 aa, Staphylococcus epidermidis
EKIQTSFHYTPLHKFSYYKSKNLLPIVEEV

SEQ ID NO: 1826622 - protein, 26 aa, Staphylococcus epidermidis
EKKKPYAPYFDVKKFHETFGHPVAEV

SEQ ID NO: 1826623 - protein, 22 aa, Staphylococcus epidermidis
EKKQYLGIYKLSNAQNFQPILV

SEQ ID NO: 1826624 - protein, 21 aa, Staphylococcus epidermidis
EKLMMEGIYYYIHVDAAYGGY

SEQ ID NO: 1826625 - protein, 20 aa, Staphylococcus epidermidis
EKLNKHLPILLISGKEDPFG

SEQ ID NO: 1826626 - protein, 34 aa, Staphylococcus epidermidis; identical to SEQ ID NO: 1804202

SEQ ID NO: 1826627 - protein, 19 aa, Staphylococcus epidermidis
EKLSHLRPAFKKDGSVTAG

SEQ ID NO: 1826628 - protein, 21 aa, Staphylococcus epidermidis
EKLSPLLAMVTAKSTRHALQI

SEQ ID NO: 1826629 - protein, 25 aa, Staphylococcus epidermidis
EKLSQNMPIFFSANMSYGIHALTKI

SEQ ID NO: 1826630 - protein, 27 aa, Staphylococcus epidermidis
EKMENRLRYQYGRPSKLLAKSFELQNF

SEQ ID NO: 1826631 - protein, 21 aa, Staphylococcus epidermidis
EKMIHTIIFMLDDGGIRTQDI

SEQ ID NO: 1826632 - protein, 17 aa, Staphylococcus epidermidis
EKNAMGWYLDGRVSAVV

SEQ ID NO: 1826633 - protein, 19 aa, Staphylococcus epidermidis
EKNDVINNSQSINTDDDNQ

SEQ ID NO: 1826634 - protein, 21 aa, Staphylococcus epidermidis
EKNHHYLWRFAKEMPKSGHVE

SEQ ID NO: 1826635 - protein, 18 aa, Staphylococcus epidermidis
EKNLIKYSNWLNQLFHGI

SEQ ID NO: 1826636 - protein, 23 aa, Staphylococcus epidermidis
EKNLKLFSAFIVKGKKVIQEQLL

SEQ ID NO: 1826637 - protein, 19 aa, Staphylococcus epidermidis
EKNYKALHYISEGTDLTVG

SEQ ID NO: 1826638 - protein, 27 aa, Staphylococcus epidermidis
EKPKDIYIFEAPIDALSYRTLNQDKDG

SEQ ID NO: 1826639 - protein, 17 aa, Staphylococcus epidermidis
EKPRKILLMVKAGPATD

SEQ ID NO: 1826640 - protein, 23 aa, Staphylococcus epidermidis
EKQCPTCHMTLKDIAHVGKFGCA

SEQ ID NO: 1826641 - protein, 18 aa, Staphylococcus epidermidis
EKQFFVIENLAKTMSKEA

SEQ ID NO: 1826642 - protein, 24 aa, Staphylococcus epidermidis
EKQKSFFDYYLKKEDNDWKDTPHV

SEQ ID NO: 1826643 - protein, 23 aa, Staphylococcus epidermidis
EKQLKDHLSKMIGINSVDIDYQM

SEQ ID NO: 1826644 - protein, 25 aa, Staphylococcus epidermidis
EKQVKVLARGPVFKGLLTSNSVNAL

SEQ ID NO: 1826645 - protein, 23 aa, Staphylococcus epidermidis
EKRLNYAGFYRLHHSYKKKVVMA

SEQ ID NO: 1826646 - protein, 26 aa, Staphylococcus epidermidis
EKRMQLLHDALVYRIQRLQDAIPDNA

SEQ ID NO: 1826647 - protein, 27 aa, Staphylococcus epidermidis
EKRNDQTLLVKFLKPVQNEWSGMTVYY

SEQ ID NO: 1826648 - protein, 24 aa, Staphylococcus epidermidis
EKSQAFDFIIEGDTLIPPFVAVPG

SEQ ID NO: 1826649 - protein, 19 aa, Staphylococcus epidermidis
EKSVYFKIVLYKKNGEKIK

SEQ ID NO: 1826650 - protein, 24 aa, Staphylococcus epidermidis
EKTELPIEGILLFSPMLELKKDYK

SEQ ID NO: 1826651 - protein, 24 aa, Staphylococcus epidermidis
EKTGLLLDPYFAGTKVKWILDHVE

SEQ ID NO: 1826652 - protein, 24 aa, Staphylococcus epidermidis
EKTKVGPFAQLRPGSNLGADVKVG

SEQ ID NO: 1826653 - protein, 21 aa, Staphylococcus epidermidis
EKVATPFPRISYDDAIEFLKQ

SEQ ID NO: 1826654 - protein, 23 aa, Staphylococcus epidermidis
EKVQTLLPLYKEVLESLIHAGAE

SEQ ID NO: 1826655 - protein, 21 aa, Staphylococcus epidermidis
EKWPSFLEKELVDGIFTVADN

SEQ ID NO: 1826656 - protein, 24 aa, Staphylococcus epidermidis
EKWPTFLEKDLVDGIFTITDKDAF

SEQ ID NO: 1826657 - protein, 24 aa, Staphylococcus epidermidis
EKYDTPIVPVFWIAGEDHDFEEVN

SEQ ID NO: 1826658 - protein, 17 aa, Staphylococcus epidermidis
EKYFVSMMGYSPGFPYL

SEQ ID NO: 1826659 - protein, 25 aa, Staphylococcus epidermidis
EKYGAFVELFPGKDALLHISQISKD

SEQ ID NO: 1826660 - protein, 17 aa, Staphylococcus epidermidis
EKYIDLIEEYGFDLIRG

SEQ ID NO: 1826661 - protein, 24 aa, Staphylococcus epidermidis
EKYRNIDVLLIDDIQFIQNKEQTQ

SEQ ID NO: 1826662 - protein, 28 aa, Staphylococcus epidermidis
ELADEYQVLFILPLWHHDDAFPFELLKA

SEQ ID NO: 1826663 - protein, 18 aa, Staphylococcus epidermidis
ELAFAIGNAIKYISRANH

SEQ ID NO: 1826664 - protein, 18 aa, Staphylococcus epidermidis
ELAFAIGNAIKYISRANR

SEQ ID NO: 1826665 - protein, 26 aa, Staphylococcus epidermidis
ELAGIPHNKIWLDPGIGFAKTREEGN

SEQ ID NO: 1826666 - protein, 25 aa, Staphylococcus epidermidis
ELAGIPHNKIWLDPGIGFPKTREEE

SEQ ID NO: 1826667 - protein, 19 aa, Staphylococcus epidermidis
ELAKEKYFMTYKELSNYLN

SEQ ID NO: 1826668 - protein, 26 aa, Staphylococcus epidermidis
ELAKNYDIPLYLGRTLSNLKGTWIMS

SEQ ID NO: 1826669 - protein, 18 aa, Staphylococcus epidermidis
ELAPSYVFLATHADSSYI

SEQ ID NO: 1826670 - protein, 29 aa, Staphylococcus epidermidis
ELAQWFAKNDYFYIMHRFDEKARIPFIKK

SEQ ID NO: 1826671 - protein, 18 aa, Staphylococcus epidermidis
ELAQYSDVLYTFLKEWYA

SEQ ID NO: 1826672 - protein, 23 aa, Staphylococcus epidermidis
ELARDIQMQLLNLGVYSSIYQSE

SEQ ID NO: 1826673 - protein, 20 aa, Staphylococcus epidermidis
ELAWNKLIKKHLSLRTVIRK

SEQ ID NO: 1826674 - protein, 25 aa, Staphylococcus epidermidis
ELCVKIGMELFYQTGPEFIQSLKKR

SEQ ID NO: 1826675 - protein, 23 aa, Staphylococcus epidermidis
ELDEAVVLYYLKKWIHENDPILS

SEQ ID NO: 1826676 - protein, 25 aa, Staphylococcus epidermidis
ELDELPQRIVFVGGGYISFEFAHIA

SEQ ID NO: 1826677 - protein, 17 aa, Staphylococcus epidermidis
ELDFLDTAGKINYIDMW

SEQ ID NO: 1826678 - protein, 23 aa, Staphylococcus epidermidis
ELDGHDVILFCPQGVEAEGEKYR

SEQ ID NO: 1826679 - protein, 22 aa, Staphylococcus epidermidis
ELDTQLFGELPLEQPTWNPKDF

SEQ ID NO: 1826680 - protein, 27 aa, Staphylococcus epidermidis
ELDYFDWLVRQRLINFPAMPVKGEWKQ

SEQ ID NO: 1826681 - protein, 23 aa, Staphylococcus epidermidis
ELECPSIISQVKFYHVPEGIEIE

SEQ ID NO: 1826682 - protein, 28 aa, Staphylococcus epidermidis
ELEGTNYLKDAILKFGFYTNHQHVVINA

SEQ ID NO: 1826683 - protein, 26 aa, Staphylococcus epidermidis
ELEREGFHILAIKDMAGLLKPKAANE

SEQ ID NO: 1826684 - protein, 21 aa, Staphylococcus epidermidis
ELERFRATLFRQTMFAEFEHK

SEQ ID NO: 1826685 - protein, 20 aa, Staphylococcus epidermidis
ELERHWAVMKKSPGMPPGAN

SEQ ID NO: 1826686 - protein, 21 aa, Staphylococcus epidermidis
ELERHWGVMKKSPGMPPGANT

SEQ ID NO: 1826687 - protein, 19 aa, Staphylococcus epidermidis
ELESVVFTVLSLFGHDDEN

SEQ ID NO: 1826688 - protein, 26 aa, Staphylococcus epidermidis
ELEVAHYFKRLFSQYGIRSHIDTVTD

SEQ ID NO: 1826689 - protein, 25 aa, Staphylococcus epidermidis
ELEVAKYLQTWFDKYGIESELDEVS

SEQ ID NO: 1826690 - protein, 23 aa, Staphylococcus epidermidis
ELFNAMVMTPYFPKPDVLIYLEC

SEQ ID NO: 1826691 - protein, 24 aa, Staphylococcus epidermidis
ELGAKRVLPLAVSGPFHSSMMKVI

SEQ ID NO: 1826692 - protein, 18 aa, Staphylococcus epidermidis
ELHRLMYALLDVVQNQPV

SEQ ID NO: 1826693 - protein, 18 aa, Staphylococcus epidermidis
ELIKDFQQLITEAGFDYQ

SEQ ID NO: 1826694 - protein, 21 aa, Staphylococcus epidermidis
ELIKFNLLTQERVGLNKPNRL

SEQ ID NO: 1826695 - protein, 22 aa, Staphylococcus epidermidis
ELIKFNLLTQERVGLNKPNRLY

SEQ ID NO: 1826696 - protein, 18 aa, Staphylococcus epidermidis
ELINQDRLPLKGEFVILI

SEQ ID NO: 1826697 - protein, 22 aa, Staphylococcus epidermidis
ELINQNFVVIKILDEQLKQNKK

SEQ ID NO: 1826698 - protein, 33 aa, Staphylococcus epidermidis
ELIQRMYMPIIVQKILHLFGKRKFVEGLLAQNN

SEQ ID NO: 1826699 - protein, 20 aa, Staphylococcus epidermidis
ELKESFMWGLNQFSDKSSVI

SEQ ID NO: 1826700 - protein, 17 aa, Staphylococcus epidermidis
ELKFQERLYIKLSTTER

SEQ ID NO: 1826701 - protein, 25 aa, Staphylococcus epidermidis
ELKKLSINDLLRIKGIGLYKAITLK

SEQ ID NO: 1826702 - protein, 32 aa, Staphylococcus epidermidis
ELKNALNHQLFSKIEWIIVSLGANGAFAKHNQ

SEQ ID NO: 1826703 - protein, 17 aa, Staphylococcus epidermidis
ELKRKKPHLFTVPQKHP

SEQ ID NO: 1826704 - protein, 22 aa, Staphylococcus epidermidis
ELKYDYVRLQNDLDKRESLNQN

SEQ ID NO: 1826705 - protein, 18 aa, Staphylococcus epidermidis
ELLKAIKGGLELKGVELK

SEQ ID NO: 1826706 - protein, 25 aa, Staphylococcus epidermidis
ELLNFIGDYTIVTILTVVDIEESKT

SEQ ID NO: 1826707 - protein, 25 aa, Staphylococcus epidermidis
ELLTQINLLGWKIKEKMFLSHYTYR

SEQ ID NO: 1826708 - protein, 17 aa, Staphylococcus epidermidis
ELLVYLSSKDIYIGNEV

SEQ ID NO: 1826709 - protein, 18 aa, Staphylococcus epidermidis
ELNHASIIDGCRLSKAKI

SEQ ID NO: 1826710 - protein, 19 aa, Staphylococcus epidermidis
ELNHLIGHTLMVTDGTSLL

SEQ ID NO: 1826711 - protein, 20 aa, Staphylococcus epidermidis
ELNIPIAKLNRWGGAIASGH

SEQ ID NO: 1826712 - protein, 21 aa, Staphylococcus epidermidis
ELNPTPKWSISRYKGLGEMNA

SEQ ID NO: 1826713 - protein, 24 aa, Staphylococcus epidermidis
ELPLGKLSGKLAFAEKLKVLGYDI

SEQ ID NO: 1826714 - protein, 25 aa, Staphylococcus epidermidis
ELPQRESLFYALNKYEYAGCTGAEL

SEQ ID NO: 1826715 - protein, 18 aa, Staphylococcus epidermidis
ELQGRFPIRVELESLSVD

SEQ ID NO: 1826716 - protein, 29 aa, Staphylococcus epidermidis
ELQKQLYNQYPFQLLMRFQYELTELIKHI

SEQ ID NO: 1826717 - protein, 25 aa, Staphylococcus epidermidis
ELQLKTLYISVDPYMRGRMTNADSY

SEQ ID NO: 1826718 - protein, 29 aa, Staphylococcus epidermidis
ELQVDEKGLYFKCHLPNTSYARDIYENIK

SEQ ID NO: 1826719 - protein, 18 aa, Staphylococcus epidermidis
ELRQKMGMVFQSFNLFPH

SEQ ID NO: 1826720 - protein, 43 aa, Staphylococcus epidermidis
ELSAVQKSMYLLWSVNPEDTVYNIPFLWRLTSELNVAQLKRAL

SEQ ID NO: 1826721 - protein, 23 aa, Staphylococcus epidermidis
ELSGVQFFTLPFATVSEMQNYFK

SEQ ID NO: 1826722 - protein, 18 aa, Staphylococcus epidermidis
ELSLLNLLGSGISNITIV

SEQ ID NO: 1826723 - protein, 23 aa, Staphylococcus epidermidis
ELSYAVRYYGADGGIMITASHNP

SEQ ID NO: 1826724 - protein, 17 aa, Staphylococcus epidermidis
ELTEDLALKKCWMLNQM

SEQ ID NO: 1826725 - protein, 31 aa, Staphylococcus epidermidis; identical to SEQ ID NO: 1684055

SEQ ID NO: 1826726 - protein, 26 aa, Staphylococcus epidermidis
ELTIETKLPVLCKDFIIDKIQIDVAK

SEQ ID NO: 1826727 - protein, 24 aa, Staphylococcus epidermidis
ELTKDPKYLIGRIIARPYVGEPGN

SEQ ID NO: 1826728 - protein, 24 aa, Staphylococcus epidermidis
ELTPRNAKWFKERFNIDIYTKYEV

SEQ ID NO: 1826729 - protein, 25 aa, Staphylococcus epidermidis
ELVATEYPVLLATSRKSYIKEMMNQ

SEQ ID NO: 1826730 - protein, 27 aa, Staphylococcus epidermidis
ELVFERTRYVYNEQLQYFLKNFSTELN

SEQ ID NO: 1826731 - protein, 25 aa, Staphylococcus epidermidis
ELYNRVRNLLLDKTLRDTFSQECIK

SEQ ID NO: 1826732 - protein, 20 aa, Staphylococcus epidermidis
ELYVKPILELKKHINIKAMN

SEQ ID NO: 1826733 - protein, 23 aa, Staphylococcus epidermidis
EMDPQLVLLDINLPTLNGFHWCQ

SEQ ID NO: 1826734 - protein, 17 aa, Staphylococcus epidermidis
EMDYIRQIEDVNGRRMN

SEQ ID NO: 1826735 - protein, 24 aa, Staphylococcus epidermidis
EMGIDIDTLVKFNLKKDQILEAAD

SEQ ID NO: 1826736 - protein, 18 aa, Staphylococcus epidermidis
EMIESTVSELLPLGFSRK

SEQ ID NO: 1826737 - protein, 30 aa, Staphylococcus epidermidis
EMLGIELTRPARALKLWITLQVIGEDEIIE

SEQ ID NO: 1826738 - protein, 26 aa, Staphylococcus epidermidis
EMLNIDVELRLLKYKYQDENLVDSAQ

SEQ ID NO: 1826739 - protein, 23 aa, Staphylococcus epidermidis
EMMKVIHFFNKIENYYESSVKGD

SEQ ID NO: 1826740 - protein, 20 aa, Staphylococcus epidermidis
EMNLVPLRRFTSTEVDLFFT

SEQ ID NO: 1826741 - protein, 24 aa, Staphylococcus epidermidis
EMSNKLLELVKFDNIRLYPVADEE

SEQ ID NO: 1826742 - protein, 27 aa, Staphylococcus epidermidis
EMTIAILPIGYADGYLRSMQGAFVNVN

SEQ ID NO: 1826743 - protein, 17 aa, Staphylococcus epidermidis
EMYPEELGVHLKVGHLA

SEQ ID NO: 1826744 - protein, 20 aa, Staphylococcus epidermidis
ENAFKSGFKKGLNIDFKPLE

SEQ ID NO: 1826745 - protein, 23 aa, Staphylococcus epidermidis
ENDDLLIWLDKYVNDCSLDLPKN

SEQ ID NO: 1826746 - protein, 23 aa, Staphylococcus epidermidis
ENDLPEYMGADYHKLPISKVADV

SEQ ID NO: 1826747 - protein, 28 aa, Staphylococcus epidermidis
ENDSRVKYKFIKPLFYKSTDELHHKLKA

SEQ ID NO: 1826748 - protein, 17 aa, Staphylococcus epidermidis
ENDYLYFNSLKTFQKIE

SEQ ID NO: 1826749 - protein, 19 aa, Staphylococcus epidermidis
ENDYVYAFLDISQVSKGHT

SEQ ID NO: 1826750 - protein, 25 aa, Staphylococcus epidermidis
ENEEAFYRALGRYVNTLNGRYYTAE

SEQ ID NO: 1826751 - protein, 23 aa, Staphylococcus epidermidis
ENENQFVFIEDLNIQYVQNDESP

SEQ ID NO: 1826752 - protein, 25 aa, Staphylococcus epidermidis
ENENWTFTELLYEAPYLKSYQDEED

SEQ ID NO: 1826753 - protein, 24 aa, Staphylococcus epidermidis
ENEQSYSILFDRYQRDVGYSEAKE

SEQ ID NO: 1826754 - protein, 17 aa, Staphylococcus epidermidis
ENEVVILNLWHGVGIKP

SEQ ID NO: 1826755 - protein, 17 aa, Staphylococcus epidermidis
ENFGYLKGINLTYVGNG

SEQ ID NO: 1826756 - protein, 53 aa, Staphylococcus epidermidis
ENFIKFTEKWYFPLQSFQKFIVPFVFLFEKEGNFLFYEQFFITLGRGGGKNGL

SEQ ID NO: 1826757 - protein, 24 aa, Staphylococcus epidermidis
ENGQPILYSLNYLKSSLVKFKVNK

SEQ ID NO: 1826758 - protein, 23 aa, Staphylococcus epidermidis
ENGRLALDLIGGFHFNAIEGEYC

SEQ ID NO: 1826759 - protein, 23 aa, Staphylococcus epidermidis
ENHLKKVSGVGCLVINTIKSATS

SEQ ID NO: 1826760 - protein, 28 aa, Staphylococcus epidermidis
ENIAEYHGIFNEPIACSKINSGLFSQML

SEQ ID NO: 1826761 - protein, 32 aa, Staphylococcus epidermidis
ENIEKIIFEFAKKGIAILWITHSDDQSMRHFQ

SEQ ID NO: 1826762 - protein, 18 aa, Staphylococcus epidermidis
ENIHKALHMVWPDLIFPE

SEQ ID NO: 1826763 - protein, 18 aa, Staphylococcus epidermidis
ENIMAVPAVFLDGQEFGN

SEQ ID NO: 1826764 - protein, 19 aa, Staphylococcus epidermidis
ENKGKLILQVLSIDESGKL

SEQ ID NO: 1826765 - protein, 23 aa, Staphylococcus epidermidis
ENKKVRGRKLGEDYNKGGIEDGF

SEQ ID NO: 1826766 - protein, 19 aa, Staphylococcus epidermidis
ENKTVLANLMLPLNISKKD

SEQ ID NO: 1826767 - protein, 23 aa, Staphylococcus epidermidis
ENKTVLANLMLPLNISKKDMPKI

SEQ ID NO: 1826768 - protein, 20 aa, Staphylococcus epidermidis
ENLIIFEVYQNKLDERKKLT

SEQ ID NO: 1826769 - protein, 24 aa, Staphylococcus epidermidis
ENLIKKIYRMLKAGGNLVFTVEHP

SEQ ID NO: 1826770 - protein, 24 aa, Staphylococcus epidermidis
ENLRNLLLQPPMKGKQILGVDPAF

SEQ ID NO: 1826771 - protein, 24 aa, Staphylococcus epidermidis
ENMLMERLQNMIGVYNVAIDSKVG

SEQ ID NO: 1826772 - protein, 21 aa, Staphylococcus epidermidis
ENMLNQLLDGGWPQPIVEAYG

SEQ ID NO: 1826773 - protein, 19 aa, Staphylococcus epidermidis
ENNVFLRGFRRNLSAEIQD

SEQ ID NO: 1826774 - protein, 24 aa, Staphylococcus epidermidis
ENNVPDWYLDSCRKIKYMFPKAHA

SEQ ID NO: 1826775 - protein, 24 aa, Staphylococcus epidermidis
ENPGLYPFMSGYDNLKLLNESNST

SEQ ID NO: 1826776 - protein, 19 aa, Staphylococcus epidermidis
ENPIPMCGVPYHSADSYIE

SEQ ID NO: 1826777 - protein, 20 aa, Staphylococcus epidermidis
ENQHPLFRYLTDAAKGMLNE

SEQ ID NO: 1826778 - protein, 19 aa, Staphylococcus epidermidis
ENQILAVAYSFKDVRHKKE

SEQ ID NO: 1826779 - protein, 28 aa, Staphylococcus epidermidis
ENRGAIPYTVFIDPPLSRVGLIASEAKL

SEQ ID NO: 1826780 - protein, 25 aa, Staphylococcus epidermidis
ENSDKFMRYLIDAVNRYNMTIIFVT

SEQ ID NO: 1826781 - protein, 17 aa, Staphylococcus epidermidis
ENSDVLLNYKQARSFKS

SEQ ID NO: 1826782 - protein, 25 aa, Staphylococcus epidermidis
ENSIAHFQTISPYLSMLDGNIVLDQ

SEQ ID NO: 1826783 - protein, 25 aa, Staphylococcus epidermidis
ENSKWASVTFYIRTEKRMKKIYPNR

SEQ ID NO: 1826784 - protein, 28 aa, Staphylococcus epidermidis
ENSNFKLLLVHYLSQKIYYLELERIKEI

SEQ ID NO: 1826785 - protein, 25 aa, Staphylococcus epidermidis
ENTDQYYLYLYDWRVIESESNESDF

SEQ ID NO: 1826786 - protein, 17 aa, Staphylococcus epidermidis
ENTRVILMCPQGRPFTQ

SEQ ID NO: 1826787 - protein, 23 aa, Staphylococcus epidermidis
ENVNYFGTMLVYTGKAAGLVSGA

SEQ ID NO: 1826788 - protein, 21 aa, Staphylococcus epidermidis
EPAYSFMIRVRVPGGKATPDQ

SEQ ID NO: 1826789 - protein, 32 aa, Staphylococcus epidermidis
EPEAYPYPIYNNVLPHIDVFLQNGYTKEEQKM

SEQ ID NO: 1826790 - protein, 24 aa, Staphylococcus epidermidis
EPEFRTLIKRKYPDYLFTSQIIKE

SEQ ID NO: 1826791 - protein, 24 aa, Staphylococcus epidermidis
EPERFYQLTQILNALKARHVDSTY

SEQ ID NO: 1826792 - protein, 18 aa, Staphylococcus epidermidis
EPFIFVDSSTQKVLAIYI

SEQ ID NO: 1826793 - protein, 19 aa, Staphylococcus epidermidis
EPIIMNKAIEILGLDKSDV

SEQ ID NO: 1826794 - protein, 17 aa, Staphylococcus epidermidis
EPKVAMLSFSTKGSAKS

SEQ ID NO: 1826795 - protein, 27 aa, Staphylococcus epidermidis
EPLINKYLKMQSAQLAKIPLIGVGSIA

SEQ ID NO: 1826796 - protein, 26 aa, Staphylococcus epidermidis
EPLSVYHEMSFFILEKDGSYRRFDES

SEQ ID NO: 1826797 - protein, 17 aa, Staphylococcus epidermidis
EPQIRLWDILQTKFKAK

SEQ ID NO: 1826798 - protein, 26 aa, Staphylococcus epidermidis
EPQNFKPLYDLKQPLEAKIETIVKEI

SEQ ID NO: 1826799 - protein, 25 aa, Staphylococcus epidermidis
EPSHYDDMFILNKAAQGRLDQMSQQ

SEQ ID NO: 1826800 - protein, 27 aa, Staphylococcus epidermidis
EPSIPHNFTFNLLFSNNKLKINDPNIN

SEQ ID NO: 1826801 - protein, 21 aa, Staphylococcus epidermidis
EPSKLIEHLAERIAKRINSHY

SEQ ID NO: 1826802 - protein, 19 aa, Staphylococcus epidermidis
EPSYMPGYEDDVIMAAGTF

SEQ ID NO: 1826803 - protein, 23 aa, Staphylococcus epidermidis
EPTKLKNPPSNWPRTAKFEGLIH

SEQ ID NO: 1826804 - protein, 23 aa, Staphylococcus epidermidis
EPTKSMIFYAHKGSMDCKVSAKG

SEQ ID NO: 1826805 - protein, 21 aa, Staphylococcus epidermidis
EPYNDIRMWDYKSLPSVFGGD

SEQ ID NO: 1826806 - protein, 25 aa, Staphylococcus epidermidis
EQAKAQNLFARWRKEETLYSEDEKK

SEQ ID NO: 1826807 - protein, 17 aa, Staphylococcus epidermidis
EQALTELQHAREALHGE

SEQ ID NO: 1826808 - protein, 31 aa, Staphylococcus epidermidis
EQAQEQFGFLLDAFKYGAPPHGGIALGLDRL

SEQ ID NO: 1826809 - protein, 29 aa, Staphylococcus epidermidis
EQAQMLNERLLNMIGVHTVSIDIERNMVN

SEQ ID NO: 1826810 - protein, 29 aa, Staphylococcus epidermidis
EQASLIFLDSIVLPLMDAFHISEKAMQEN

SEQ ID NO: 1826811 - protein, 21 aa, Staphylococcus epidermidis
EQAVLCGGIHKLIQSGFETLV

SEQ ID NO: 1826812 - protein, 18 aa, Staphylococcus epidermidis
EQDVISYVLYPKVYEQYI

SEQ ID NO: 1826813 - protein, 17 aa, Staphylococcus epidermidis
EQEAVLRMLYNNLDPEV

SEQ ID NO: 1826814 - protein, 27 aa, Staphylococcus epidermidis
EQEGYNVIAMGYLFLPKTSIRQKKDED

SEQ ID NO: 1826815 - protein, 23 aa, Staphylococcus epidermidis
EQEKRMWFVQSLHIEDEWIRAND

SEQ ID NO: 1826816 - protein, 32 aa, Staphylococcus epidermidis; identical to SEQ ID NO: 1689622

SEQ ID NO: 1826817 - protein, 21 aa, Staphylococcus epidermidis
EQFMYTSNLLFYTVDYNHVQS

SEQ ID NO: 1826818 - protein, 17 aa, Staphylococcus epidermidis
EQGFVRRFQVLEPSLND

SEQ ID NO: 1826819 - protein, 24 aa, Staphylococcus epidermidis
EQGLKHHILDMSLLSQLTPNALTQ

SEQ ID NO: 1826820 - protein, 24 aa, Staphylococcus epidermidis
EQGLYRKRMLSYGGLLKKKHKLLN

SEQ ID NO: 1826821 - protein, 27 aa, Staphylococcus epidermidis
EQHGILQPIVLRKTIQGFYIVVGERRF

SEQ ID NO: 1826822 - protein, 27 aa, Staphylococcus epidermidis
EQHIDLIDMVVVNLYPFQKTVENPDVT

SEQ ID NO: 1826823 - protein, 35 aa, Staphylococcus epidermidis
EQHLLKLLSNEGVQWIVLAGYMRLVSEDLLHAYEG

SEQ ID NO: 1826824 - protein, 27 aa, Staphylococcus epidermidis
EQIFSYKDLILAIGSLPVELKSMPFDQ

SEQ ID NO: 1826825 - protein, 29 aa, Staphylococcus epidermidis
EQILTSSDLILYVSYFNHSFTDNDKAFIE

SEQ ID NO: 1826826 - protein, 23 aa, Staphylococcus epidermidis
EQINTLNRLLENQQILALESNKK

SEQ ID NO: 1826827 - protein, 19 aa, Staphylococcus epidermidis
EQIRLAIDSVESLALNSDI

SEQ ID NO: 1826828 - protein, 22 aa, Staphylococcus epidermidis
EQIRYLLFNIQMNVEQWLNLSS

SEQ ID NO: 1826829 - protein, 26 aa, Staphylococcus epidermidis
EQKLIVDYRYWEKDLTVYEWPDIAHE

SEQ ID NO: 1826830 - protein, 17 aa, Staphylococcus epidermidis
EQKVIILYALIQSKHAI

SEQ ID NO: 1826831 - protein, 17 aa, Staphylococcus epidermidis
EQKYRVTFPNDYKQFLL

SEQ ID NO: 1826832 - protein, 20 aa, Staphylococcus epidermidis
EQLANKLVFMRDGEIILKEN

SEQ ID NO: 1826833 - protein, 18 aa, Staphylococcus epidermidis
EQLDLLLLEIPKSRKIHS

SEQ ID NO: 1826834 - protein, 25 aa, Staphylococcus epidermidis
EQLKDLGITFTLLRPTVKADLEKMI

SEQ ID NO: 1826835 - protein, 23 aa, Staphylococcus epidermidis
EQLKNIPGIGPSKAKDILNYREK

SEQ ID NO: 1826836 - protein, 21 aa, Staphylococcus epidermidis
EQLLQPLFNHFKEEYPEIMEY

SEQ ID NO: 1826837 - protein, 20 aa, Staphylococcus epidermidis
EQLLSQIRRTTKDDIVIVAG

SEQ ID NO: 1826838 - protein, 19 aa, Staphylococcus epidermidis
EQLNINSLRYTGHPDAVIN

SEQ ID NO: 1826839 - protein, 21 aa, Staphylococcus epidermidis
EQLQYFLKNFSTELNNFGIQN

SEQ ID NO: 1826840 - protein, 20 aa, Staphylococcus epidermidis
EQMELEFFCKPGEEIEWQNF

SEQ ID NO: 1826841 - protein, 23 aa, Staphylococcus epidermidis
EQMNHEYFAAHAYMAMAAYCDKE

SEQ ID NO: 1826842 - protein, 27 aa, Staphylococcus epidermidis
EQNEDGDWGFSILDKEGNLEGSYIVTS

SEQ ID NO: 1826843 - protein, 25 aa, Staphylococcus epidermidis
EQNEMLFIRYPLKEQIFNVHVGVIN

SEQ ID NO: 1826844 - protein, 19 aa, Staphylococcus epidermidis
EQNVFLLTEYIQKGKKNKA

SEQ ID NO: 1826845 - protein, 22 aa, Staphylococcus epidermidis
EQPERGKIYDRNGKVLAEDVER

SEQ ID NO: 1826846 - protein, 19 aa, Staphylococcus epidermidis
EQPKDQVSVWIYALYSDVK

SEQ ID NO: 1826847 - protein, 19 aa, Staphylococcus epidermidis
EQPLFVNDKPKSIISEKFR

SEQ ID NO: 1826848 - protein, 23 aa, Staphylococcus epidermidis
EQPLTFPLMALIVSGGHTELVYM

SEQ ID NO: 1826849 - protein, 19 aa, Staphylococcus epidermidis
EQPTHLLIDAMKLDNDIPQ

SEQ ID NO: 1826850 - protein, 27 aa, Staphylococcus epidermidis
EQQAQLLKLLNDLAMIFLKAAHEEIQK

SEQ ID NO: 1826851 - protein, 23 aa, Staphylococcus epidermidis
EQQEIFLLTEILSGKNSHKLTLE

SEQ ID NO: 1826852 - protein, 21 aa, Staphylococcus epidermidis
EQQLHRVRVVRWGPRTLDVDI

SEQ ID NO: 1826853 - protein, 27 aa, Staphylococcus epidermidis
EQQPVPSKLFLISPLLDATLSNKDITE

SEQ ID NO: 1826854 - protein, 26 aa, Staphylococcus epidermidis
EQRIEDMYALHYPRMFIDPYTMQLSY

SEQ ID NO: 1826855 - protein, 22 aa, Staphylococcus epidermidis
EQRKKIFALCRDIELHWGEPVD

SEQ ID NO: 1826856 - protein, 22 aa, Staphylococcus epidermidis
EQRKKIFALCRDIELHWGEPVE

SEQ ID NO: 1826857 - protein, 22 aa, Staphylococcus epidermidis
EQRKRYHKLYAKGLMQEEELFE

SEQ ID NO: 1826858 - protein, 19 aa, Staphylococcus epidermidis
EQRVEDIFFEVFDVLQELG

SEQ ID NO: 1826859 - protein, 17 aa, Staphylococcus epidermidis
EQSILEMYDIILAGVEV

SEQ ID NO: 1826860 - protein, 25 aa, Staphylococcus epidermidis
EQSIQDFYKNYYDKWLVGFKETKGG

SEQ ID NO: 1826861 - protein, 23 aa, Staphylococcus epidermidis
EQSLDLHRLLDTNKVYLKDIFES

SEQ ID NO: 1826862 - protein, 22 aa, Staphylococcus epidermidis
EQSYSILFDRYQRDVGYSEAKE

SEQ ID NO: 1826863 - protein, 23 aa, Staphylococcus epidermidis
EQTETFLRGFLGRMLFSGEEVKK

SEQ ID NO: 1826864 - protein, 18 aa, Staphylococcus epidermidis
EQVKVFFKDNWAVCHMSG

SEQ ID NO: 1826865 - protein, 18 aa, Staphylococcus epidermidis
EQVLAYLINKGEKSNPHI

SEQ ID NO: 1826866 - protein, 22 aa, Staphylococcus epidermidis
EQVVNLFHRKGPFKDTPINPTV

SEQ ID NO: 1826867 - protein, 29 aa, Staphylococcus epidermidis
EQYAHIYHHLYNVPTVCLRFFNVYGPKQN

SEQ ID NO: 1826868 - protein, 29 aa, Staphylococcus epidermidis
EQYQERFYQLPKVFFTNEIYKKLSLEAKV

SEQ ID NO: 1826869 - protein, 24 aa, Staphylococcus epidermidis
ERAKAGLFLAMQYPSEITGVTNAD

SEQ ID NO: 1826870 - protein, 17 aa, Staphylococcus epidermidis
ERARVKNLRKSENYNYE

SEQ ID NO: 1826871 - protein, 23 aa, Staphylococcus epidermidis
EREKLALKYLPSLKLSDYEKDES

SEQ ID NO: 1826872 - protein, 27 aa, Staphylococcus epidermidis
ERELGFLALHGFLHLLGYDHMTEDDEK

SEQ ID NO: 1826873 - protein, 18 aa, Staphylococcus epidermidis
ERFVIVVQALEEKNGKLL

SEQ ID NO: 1826874 - protein, 18 aa, Staphylococcus epidermidis
ERGHEVYFITSNIPFRIR

SEQ ID NO: 1826875 - protein, 20 aa, Staphylococcus epidermidis
ERIKQLYEEINQLKNDRPVV

SEQ ID NO: 1826876 - protein, 20 aa, Staphylococcus epidermidis
ERILEKVPTYFVKLVQKLLK

SEQ ID NO: 1826877 - protein, 29 aa, Staphylococcus epidermidis
ERILTYFDEIYPKAWYQAGISLETMEKYQ

SEQ ID NO: 1826878 - protein, 18 aa, Staphylococcus epidermidis
ERKKIMMDVVKYITDLKT

SEQ ID NO: 1826879 - protein, 20 aa, Staphylococcus epidermidis
ERLEWIERLSKHPKIIGIGE

SEQ ID NO: 1826880 - protein, 23 aa, Staphylococcus epidermidis
ERLKGVFAWGFRIKSSEPEEGLP

SEQ ID NO: 1826881 - protein, 24 aa, Staphylococcus epidermidis
ERPTSLDYIPYIFDSFIELHGDRN

SEQ ID NO: 1826882 - protein, 23 aa, Staphylococcus epidermidis
ERQSEIWLKKQAALHNLDMLAGG

SEQ ID NO: 1826883 - protein, 21 aa, Staphylococcus epidermidis
ERRVQRLYKALDSLGDSKADW

SEQ ID NO: 1826884 - protein, 22 aa, Staphylococcus epidermidis
ERSAAFFALGLIKGSEKPVAIL

SEQ ID NO: 1826885 - protein, 25 aa, Staphylococcus epidermidis
ERSAAFFALGLIKGSGKPVAILCTS

SEQ ID NO: 1826886 - protein, 17 aa, Staphylococcus epidermidis
ERSFRLMSPTPLDDLQL

SEQ ID NO: 1826887 - protein, 25 aa, Staphylococcus epidermidis
ERSHRLIRKGAMLEKYFECEHLSPD

SEQ ID NO: 1826888 - protein, 25 aa, Staphylococcus epidermidis
ERSYYIKPYFSNQIFKIKLTEDILS

SEQ ID NO: 1826889 - protein, 21 aa, Staphylococcus epidermidis
ERSYYNLEKLYQDAPIKEYGQ

SEQ ID NO: 1826890 - protein, 18 aa, Staphylococcus epidermidis
ERVTPKSITYRHLAEDKK

SEQ ID NO: 1826891 - protein, 25 aa, Staphylococcus epidermidis
ERVTVYWHHFLRPEVKFEGIDPLVE

SEQ ID NO: 1826892 - protein, 23 aa, Staphylococcus epidermidis
ERWLRKVINSLVYDYAYPIGCSY

SEQ ID NO: 1826893 - protein, 17 aa, Staphylococcus epidermidis
ERYCDRFIILDKGEIVA

SEQ ID NO: 1826894 - protein, 17 aa, Staphylococcus epidermidis
ERYINEFLKKGSSNYPI

SEQ ID NO: 1826895 - protein, 19 aa, Staphylococcus epidermidis
ERYLNLLTIFYDLDKDIKA

SEQ ID NO: 1826896 - protein, 22 aa, Staphylococcus epidermidis
ERYSGFVLLPPQNGVYKGIKKH

SEQ ID NO: 1826897 - protein, 26 aa, Staphylococcus epidermidis
ESAPHMHLHFIPVNHQGRLSARTAMN

SEQ ID NO: 1826898 - protein, 23 aa, Staphylococcus epidermidis
ESATQNYFYSLDQNWYGGAQNNP

SEQ ID NO: 1826899 - protein, 23 aa, Staphylococcus epidermidis
ESDIKVSYIRMFDDLRTELEKKV

SEQ ID NO: 1826900 - protein, 23 aa, Staphylococcus epidermidis
ESDIKVSYIRMFDELRSELEKKV

SEQ ID NO: 1826901 - protein, 20 aa, Staphylococcus epidermidis
ESEFPQFFERAPFAREGEDP

SEQ ID NO: 1826902 - protein, 17 aa, Staphylococcus epidermidis
ESEIIGVELPKTVELEV

SEQ ID NO: 1826903 - protein, 19 aa, Staphylococcus epidermidis
ESELNGRVRILFQASEELG

SEQ ID NO: 1826904 - protein, 25 aa, Staphylococcus epidermidis
ESEVDLYRAMASSGSLPGVWPATTV

SEQ ID NO: 1826905 - protein, 31 aa, Staphylococcus epidermidis
ESEYQFFKEGLILFTYLHLANEEKLTQALVD

SEQ ID NO: 1826906 - protein, 23 aa, Staphylococcus epidermidis
ESFEAAQQFALEAGFPLMIKATS

SEQ ID NO: 1826907 - protein, 22 aa, Staphylococcus epidermidis
ESFFINGKFQHDLFAKFLISEY

SEQ ID NO: 1826908 - protein, 25 aa, Staphylococcus epidermidis
ESGYRSYHVIIKYPIETLSGQKHIL

SEQ ID NO: 1826909 - protein, 27 aa, Staphylococcus epidermidis
ESIGKATKFLLALYNVFIEKDCSIVEI

SEQ ID NO: 1826910 - protein, 25 aa, Staphylococcus epidermidis
ESIKKLLFPKKYLERFYYKAATIQT

SEQ ID NO: 1826911 - protein, 26 aa, Staphylococcus epidermidis
ESIKNCMLYTSLQLIWAQAIKNGRKY

SEQ ID NO: 1826912 - protein, 25 aa, Staphylococcus epidermidis
ESKYDVQIIELLEKQIDTLNKQLEK

SEQ ID NO: 1826913 - protein, 18 aa, Staphylococcus epidermidis
ESKYPFKELPLYEIGWRL

SEQ ID NO: 1826914 - protein, 17 aa, Staphylococcus epidermidis
ESLLITGQTYDCIQSFQ

SEQ ID NO: 1826915 - protein, 18 aa, Staphylococcus epidermidis
ESLTFDDVLLIPAESDVL

SEQ ID NO: 1826916 - protein, 26 aa, Staphylococcus epidermidis
ESMYQDRGFIFTNYRGNPMSLSTINR

SEQ ID NO: 1826917 - protein, 22 aa, Staphylococcus epidermidis
ESNTSWPLAMPVFKMDYAHKEC

SEQ ID NO: 1826918 - protein, 22 aa, Staphylococcus epidermidis
ESNTSWPLAMPVFKMDYAHKEY

SEQ ID NO: 1826919 - protein, 26 aa, Staphylococcus epidermidis
ESNVNTEYMYYYLNSINISTFGAQAV

SEQ ID NO: 1826920 - protein, 22 aa, Staphylococcus epidermidis
ESPMAIALIGKGLNDQVRVPLP

SEQ ID NO: 1826921 - protein, 17 aa, Staphylococcus epidermidis
ESQDWAGMLLRMYQRYC

SEQ ID NO: 1826922 - protein, 17 aa, Staphylococcus epidermidis
ESQDWASMLLRMYQRYG

SEQ ID NO: 1826923 - protein, 24 aa, Staphylococcus epidermidis
ESQDWVSMLLRMYQRYCEQNGFKV

SEQ ID NO: 1826924 - protein, 24 aa, Staphylococcus epidermidis
ESREIFNQIIFKLLELEEDKTYFI

SEQ ID NO: 1826925 - protein, 25 aa, Staphylococcus epidermidis
ESRHEITIEFYRKELQERSKLLENQ

SEQ ID NO: 1826926 - protein, 27 aa, Staphylococcus epidermidis
ESRPNGWFLHIPSCYLGIAQAARDYAV

SEQ ID NO: 1826927 - protein, 22 aa, Staphylococcus epidermidis
ESRVFFKGFKQYNDLVLDLAEE

SEQ ID NO: 1826928 - protein, 26 aa, Staphylococcus epidermidis
ESSNDPHIWLDPVLDRVFAKEIKDKL

SEQ ID NO: 1826929 - protein, 21 aa, Staphylococcus epidermidis
ESSNYWVWHERLIITKEYKHN

SEQ ID NO: 1826930 - protein, 25 aa, Staphylococcus epidermidis
ESSRDNHFAFKIYNDPFDMVYVMMN

SEQ ID NO: 1826931 - protein, 20 aa, Staphylococcus epidermidis
ESVFQNWRDVLDNEYIQWVE

SEQ ID NO: 1826932 - protein, 31 aa, Staphylococcus epidermidis
ESVHFESLIHFDLDMLYKMIDIINDTLVSIR

SEQ ID NO: 1826933 - protein, 26 aa, Staphylococcus epidermidis
ESVMPGFDFYFIPTVMNSKDTKYHNE

SEQ ID NO: 1826934 - protein, 23 aa, Staphylococcus epidermidis
ESVMPGFDFYFIPTVMNSNDTRF

SEQ ID NO: 1826935 - protein, 19 aa, Staphylococcus epidermidis
ESVYHKGQYLLNCLNKAFI

SEQ ID NO: 1826936 - protein, 20 aa, Staphylococcus epidermidis
ESYLDAFDIIINTTPAGMAE

SEQ ID NO: 1826937 - protein, 24 aa, Staphylococcus epidermidis
ETADVLLVYIFNGVEFIPDSYTRR

SEQ ID NO: 1826938 - protein, 28 aa, Staphylococcus epidermidis
ETADVMYHLFVLLHALDIPFSEVEKVLA

SEQ ID NO: 1826939 - protein, 27 aa, Staphylococcus epidermidis
ETAGPLYYRAEPVGCTATILYKMYKER

SEQ ID NO: 1826940 - protein, 18 aa, Staphylococcus epidermidis
ETAKWLQTTPLLKNREKE

SEQ ID NO: 1826941 - protein, 22 aa, Staphylococcus epidermidis
ETALDTLINLRSSGRMVGIISH

SEQ ID NO: 1826942 - protein, 18 aa, Staphylococcus epidermidis
ETALGYANKFKRKLHPYE

SEQ ID NO: 1826943 - protein, 18 aa, Staphylococcus epidermidis
ETALGYANKFNRKLHPYE

SEQ ID NO: 1826944 - protein, 25 aa, Staphylococcus epidermidis
ETANQLFIPLTIGGGIQTLDDITQL

SEQ ID NO: 1826945 - protein, 23 aa, Staphylococcus epidermidis
ETEGVFFHERKALSHFEKRYAKR

SEQ ID NO: 1826946 - protein, 24 aa, Staphylococcus epidermidis
ETEGVFFHERKALSHFEKRYATPS

SEQ ID NO: 1826947 - protein, 18 aa, Staphylococcus epidermidis
ETFIHPAFFFHPCYIVEA

SEQ ID NO: 1826948 - protein, 22 aa, Staphylococcus epidermidis
ETFKIVGRSWNGLIINYLSRCE

SEQ ID NO: 1826949 - protein, 20 aa, Staphylococcus epidermidis
ETFLKLYNKVLDYLGKKDEL

SEQ ID NO: 1826950 - protein, 20 aa, Staphylococcus epidermidis
ETFLKLYNKVLDYLNQKDEL

SEQ ID NO: 1826951 - protein, 22 aa, Staphylococcus epidermidis
ETFLNLIEVLGTSASDFFKEPS

SEQ ID NO: 1826952 - protein, 26 aa, Staphylococcus epidermidis
ETGKEDFYFMKLNQFYDDIVEYHSLH

SEQ ID NO: 1826953 - protein, 25 aa, Staphylococcus epidermidis
ETGKEDFYFMKLNQFYDDIVQYDSL

SEQ ID NO: 1826954 - protein, 18 aa, Staphylococcus epidermidis
ETGLWLEEAGEPYDILTQ

SEQ ID NO: 1826955 - protein, 25 aa, Staphylococcus epidermidis
ETHLRVMPLFEENYHMYVPKSHPLA

SEQ ID NO: 1826956 - protein, 24 aa, Staphylococcus epidermidis
ETHLSNGLVWSIPITLPVTESEAE

SEQ ID NO: 1826957 - protein, 25 aa, Staphylococcus epidermidis
ETINAPMVGTFYKSPSPEEDAYVQV

SEQ ID NO: 1826958 - protein, 24 aa, Staphylococcus epidermidis
ETIQINLKYFNNLEIRCIKGVMNK

SEQ ID NO: 1826959 - protein, 32 aa, Staphylococcus epidermidis
ETISYKPENANKWVRGRTLGSDYEKGAVDDEH

SEQ ID NO: 1826960 - protein, 20 aa, Staphylococcus epidermidis
ETIYLLKRKHFIQMDNNALF

SEQ ID NO: 1826961 - protein, 36 aa, Staphylococcus epidermidis; identical to SEQ ID NO: 1686100

SEQ ID NO: 1826962 - protein, 22 aa, Staphylococcus epidermidis
ETKIPRYFLLSETEDFEPGKNY

SEQ ID NO: 1826963 - protein, 17 aa, Staphylococcus epidermidis
ETKLRFPNLLKNATKNT

SEQ ID NO: 1826964 - protein, 24 aa, Staphylococcus epidermidis
ETKSMGFFLIPRSTKGVSIADNWD

SEQ ID NO: 1826965 - protein, 20 aa, Staphylococcus epidermidis
ETLEPVYKEIIRLIYREEIP

SEQ ID NO: 1826966 - protein, 22 aa, Staphylococcus epidermidis
ETLHSIFLEVVIAPKFTEEALE

SEQ ID NO: 1826967 - protein, 27 aa, Staphylococcus epidermidis
ETLKGRKAILYFYPRDNTPTCTTEACD

SEQ ID NO: 1826968 - protein, 22 aa, Staphylococcus epidermidis
ETLNMTVPAFVKKKAQGARLVA

SEQ ID NO: 1826969 - protein, 28 aa, Staphylococcus epidermidis
ETLTTQRYLDYLGLSRFITDSLGVCIKN

SEQ ID NO: 1826970 - protein, 26 aa, Staphylococcus epidermidis
ETQKSRIDLYFKYNLKKYTAMKITKV

SEQ ID NO: 1826971 - protein, 24 aa, Staphylococcus epidermidis
ETQMFFYYRSFIEKERRLTTLEYK

SEQ ID NO: 1826972 - protein, 20 aa, Staphylococcus epidermidis
ETQYALDYFKVDAPELLSED

SEQ ID NO: 1826973 - protein, 21 aa, Staphylococcus epidermidis
ETRIHLLKDYQVNRKMFNLTG

SEQ ID NO: 1826974 - protein, 18 aa, Staphylococcus epidermidis
ETRQLFHDLGWKTVVGFQ

SEQ ID NO: 1826975 - protein, 25 aa, Staphylococcus epidermidis
ETRTYKVNTALWLHLEEDYGIKQGN

SEQ ID NO: 1826976 - protein, 19 aa, Staphylococcus epidermidis
ETSFNQYIKKVYPDYVFTS

SEQ ID NO: 1826977 - protein, 28 aa, Staphylococcus epidermidis
ETTLLTVRLAELFRASTIPAGLIQIVPG

SEQ ID NO: 1826978 - protein, 25 aa, Staphylococcus epidermidis
ETTNEKIVFVNRYGKIIAMNDAAKD

SEQ ID NO: 1826979 - protein, 18 aa, Staphylococcus epidermidis
ETVSSRFPFQANARALSV

SEQ ID NO: 1826980 - protein, 22 aa, Staphylococcus epidermidis
ETVVYRVIQEAVLNSLKYAEVN

SEQ ID NO: 1826981 - protein, 25 aa, Staphylococcus epidermidis
ETYEKNLLFATLDPKTRQIQINEGF

SEQ ID NO: 1826982 - protein, 29 aa, Staphylococcus epidermidis
ETYFPDCEDYILLWKLEVLEKYQGRGYAK

SEQ ID NO: 1826983 - protein, 23 aa, Staphylococcus epidermidis
ETYKWMHPCYTLNGKNVVLIHGF

SEQ ID NO: 1826984 - protein, 31 aa, Staphylococcus epidermidis
EVANFRKQYLGFIFQDYSVLPTLTVKENIML

SEQ ID NO: 1826985 - protein, 23 aa, Staphylococcus epidermidis
EVAQYLEKLFNQYGIRSHIDTVT

SEQ ID NO: 1826986 - protein, 27 aa, Staphylococcus epidermidis
EVARQLNHYLPKYMIPKTLTAIDEIPL

SEQ ID NO: 1826987 - protein, 27 aa, Staphylococcus epidermidis
EVDEGLRTLLDFRYQRHFKAKKGENGQ

SEQ ID NO: 1826988 - protein, 17 aa, Staphylococcus epidermidis
EVDYIFCTFNTDLYYEK

SEQ ID NO: 1826989 - protein, 28 aa, Staphylococcus epidermidis
EVDYPNLMFHFLPIAVRYDGQKAPVAHG

SEQ ID NO: 1826990 - protein, 26 aa, Staphylococcus epidermidis
EVEEFIDIVEIGTPIVINEGLSAVEH

SEQ ID NO: 1826991 - protein, 24 aa, Staphylococcus epidermidis
EVEKKIIGLYLKRDKLLTETITTT

SEQ ID NO: 1826992 - protein, 20 aa, Staphylococcus epidermidis
EVERKLLVEGIIPIEDEDDP

SEQ ID NO: 1826993 - protein, 22 aa, Staphylococcus epidermidis
EVERLYVFTKAASSLTGDESTI

SEQ ID NO: 1826994 - protein, 23 aa, Staphylococcus epidermidis
EVERPIRHVYIKSIQRISELTFE

SEQ ID NO: 1826995 - protein, 27 aa, Staphylococcus epidermidis
EVFDENQLLFILILHSFANVHVTRSVW

SEQ ID NO: 1826996 - protein, 17 aa, Staphylococcus epidermidis
EVFKDYGILLIDAQYPE

SEQ ID NO: 1826997 - protein, 17 aa, Staphylococcus epidermidis
EVGYFLPCKVVRSQCVY

SEQ ID NO: 1826998 - protein, 18 aa, Staphylococcus epidermidis
EVHHIWEWENGENEPKME

SEQ ID NO: 1826999 - protein, 20 aa, Staphylococcus epidermidis
EVILRTWQVAHRMKAQRGFL

SEQ ID NO: 1827000 - protein, 27 aa, Staphylococcus epidermidis
EVIREREHFAIFPASHFVTREEKMKVA

SEQ ID NO: 1827001 - protein, 26 aa, Staphylococcus epidermidis
EVISNPLLDKFMKDLIVQILAMVSEQ

SEQ ID NO: 1827002 - protein, 18 aa, Staphylococcus epidermidis
EVKDIRIIKSVLLKGKKL

SEQ ID NO: 1827003 - protein, 23 aa, Staphylococcus epidermidis
EVKGLTFETLMKLFTKNPTVRAL

SEQ ID NO: 1827004 - protein, 17 aa, Staphylococcus epidermidis
EVLARRLVLPQTQYDYI

SEQ ID NO: 1827005 - protein, 24 aa, Staphylococcus epidermidis
EVLESFYIIGIPTEYTRWFMQSGS

SEQ ID NO: 1827006 - protein, 25 aa, Staphylococcus epidermidis
EVLKPAVMMNLLGRDLDLLENEFGN

SEQ ID NO: 1827007 - protein, 27 aa, Staphylococcus epidermidis
EVLNYLYRPNHPRSFSFIPGPASRLSW

SEQ ID NO: 1827008 - protein, 26 aa, Staphylococcus epidermidis
EVLSFYNINFKKYLFSISSLVTFEKC

SEQ ID NO: 1827009 - protein, 17 aa, Staphylococcus epidermidis
EVLSLYNTQFPNVEIQV

SEQ ID NO: 1827010 - protein, 21 aa, Staphylococcus epidermidis
EVLSVEGIIILVIYHGHEEGK

SEQ ID NO: 1827011 - protein, 26 aa, Staphylococcus epidermidis
EVLTSQLSIYLAYGVLDIIQIFNDLL

SEQ ID NO: 1827012 - protein, 31 aa, Staphylococcus epidermidis; identical to SEQ ID NO: 1690885

SEQ ID NO: 1827013 - protein, 33 aa, Staphylococcus epidermidis
EVLTTDITYLPFGHSMLYLSSIMDIYNREIVAY

SEQ ID NO: 1827014 - protein, 32 aa, Staphylococcus epidermidis
EVLTTDITYLPFGHSMLYLSSIMDLYNGEIVA

SEQ ID NO: 1827015 - protein, 18 aa, Staphylococcus epidermidis
EVLVQYHIPGISGVDTRS

SEQ ID NO: 1827016 - protein, 26 aa, Staphylococcus epidermidis
EVMAETLLAPVPLFHKNHETGKEDFY

SEQ ID NO: 1827017 - protein, 21 aa, Staphylococcus epidermidis
EVNKNIKIYAPLTGEYVKIED

SEQ ID NO: 1827018 - protein, 24 aa, Staphylococcus epidermidis
EVNYIMNLPVNFLKTFLPELIEKN

SEQ ID NO: 1827019 - protein, 25 aa, Staphylococcus epidermidis
EVPEGLVPLLKIQGLGSKKIAKLYQ

SEQ ID NO: 1827020 - protein, 17 aa, Staphylococcus epidermidis
EVPFEAIEQAFKIARKQ

SEQ ID NO: 1827021 - protein, 20 aa, Staphylococcus epidermidis
EVPIEWLKKYDKHLIIIFKE

SEQ ID NO: 1827022 - protein, 18 aa, Staphylococcus epidermidis
EVPQRLAVIGSGYIAAEL

SEQ ID NO: 1827023 - protein, 25 aa, Staphylococcus epidermidis
EVPRGLPIIPEAYSPKLKRVNRKPI

SEQ ID NO: 1827024 - protein, 26 aa, Staphylococcus epidermidis
EVQKNRIDLYFKYNLKNYHSLTIKDV

SEQ ID NO: 1827025 - protein, 26 aa, Staphylococcus epidermidis
EVQLETLYISVDPYMRGRMTNADSYV

SEQ ID NO: 1827026 - protein, 30 aa, Staphylococcus epidermidis
EVQTLNEFAINGLYPDLTIYLDVSAEVGRQ

SEQ ID NO: 1827027 - protein, 20 aa, Staphylococcus epidermidis
EVRKKFEMPIIMLTAKDSEI

SEQ ID NO: 1827028 - protein, 24 aa, Staphylococcus epidermidis
EVSPFLNMTINNHLFNMKIAGDFN

SEQ ID NO: 1827029 - protein, 25 aa, Staphylococcus epidermidis
EVTQLILDKFAIKPFYLENRETTEI

SEQ ID NO: 1827030 - protein, 23 aa, Staphylococcus epidermidis
EVVTKLLDIELSIGRTGVVTPTA

SEQ ID NO: 1827031 - protein, 21 aa, Staphylococcus epidermidis
EVYFITSNIPFRIRKPLPNMT

SEQ ID NO: 1827032 - protein, 27 aa, Staphylococcus epidermidis
EWFLNPDHLPLILGMEKGWFSEQNLEI

SEQ ID NO: 1827033 - protein, 19 aa, Staphylococcus epidermidis
EWFLNPDHMPLIIGIEKGW

SEQ ID NO: 1827034 - protein, 21 aa, Staphylococcus epidermidis
EWFLNPDHMPLILGIEKGWFK

SEQ ID NO: 1827035 - protein, 18 aa, Staphylococcus epidermidis
EWLDGKIDLGKKGIINVN

SEQ ID NO: 1827036 - protein, 17 aa, Staphylococcus epidermidis
EWLYCAKANLVLEPAYT

SEQ ID NO: 1827037 - protein, 27 aa, Staphylococcus epidermidis
EWSRIPHFYMNYYVYQYATGYSAAQSL

SEQ ID NO: 1827038 - protein, 20 aa, Staphylococcus epidermidis
EYAKQYLNIADDRIIAFGDE

SEQ ID NO: 1827039 - protein, 25 aa, Staphylococcus epidermidis
EYCNFGCPYFVLRHIPADELIEEVE

SEQ ID NO: 1827040 - protein, 19 aa, Staphylococcus epidermidis
EYEPKTKTFHLFDVVQRKA

SEQ ID NO: 1827041 - protein, 28 aa, Staphylococcus epidermidis
EYGRLLLGADYFLDNYTFTFGYFEVDEH

SEQ ID NO: 1827042 - protein, 29 aa, Staphylococcus epidermidis
EYGVKIYDVFTILYLLSPQAFNVIEADVQ

SEQ ID NO: 1827043 - protein, 27 aa, Staphylococcus epidermidis
EYHYSARIVLLAWNRYLTDTASNYITN

SEQ ID NO: 1827044 - protein, 19 aa, Staphylococcus epidermidis
EYIEEEMAFVIGNLKPRAV

SEQ ID NO: 1827045 - protein, 19 aa, Staphylococcus epidermidis
EYIGDFIKPIKPIFYKVKE

SEQ ID NO: 1827046 - protein, 17 aa, Staphylococcus epidermidis
EYIGLSYLTLNRVTTTL

SEQ ID NO: 1827047 - protein, 32 aa, Staphylococcus epidermidis
EYIMEMLKNVKTPIFLVLNKIDLVHPDALMPK

SEQ ID NO: 1827048 - protein, 23 aa, Staphylococcus epidermidis
EYISQFKAGYFSPLANLARMTEE

SEQ ID NO: 1827049 - protein, 24 aa, Staphylococcus epidermidis
EYIVLLRMHYFISDRLDISEYEGF

SEQ ID NO: 1827050 - protein, 25 aa, Staphylococcus epidermidis
EYKKDKVIMILNYPNNPTGYTPNKE

SEQ ID NO: 1827051 - protein, 17 aa, Staphylococcus epidermidis
EYLIEFRKRLIDLYKIA

SEQ ID NO: 1827052 - protein, 30 aa, Staphylococcus epidermidis
EYMDDKYPFYLDPMPNLYFTRDPQASIGKG

SEQ ID NO: 1827053 - protein, 30 aa, Staphylococcus epidermidis
EYMDDKYPFYLDPMPNLYFTRDPQASVGRG

SEQ ID NO: 1827054 - protein, 17 aa, Staphylococcus epidermidis
EYNGHLYYMYTGNHRDH

SEQ ID NO: 1827055 - protein, 22 aa, Staphylococcus epidermidis
EYNVGDTFPRKGLNVSDERLTE

SEQ ID NO: 1827056 - protein, 23 aa, Staphylococcus epidermidis
EYNVGDTFPRKGLNVSNERLTEL

SEQ ID NO: 1827057 - protein, 19 aa, Staphylococcus epidermidis
EYNVPLLMKFEVQGTNNDV

SEQ ID NO: 1827058 - protein, 23 aa, Staphylococcus epidermidis
EYQFGYFILMMRDNQKVVGIAGF

SEQ ID NO: 1827059 - protein, 23 aa, Staphylococcus epidermidis
EYRDCYVMGLLKRNWINKHDDDL

SEQ ID NO: 1827060 - protein, 23 aa, Staphylococcus epidermidis
EYRKRLIVKLKKPIGRDLYNRLY

SEQ ID NO: 1827061 - protein, 19 aa, Staphylococcus epidermidis
EYVDPFKGLVRLTVPDDYL

SEQ ID NO: 1827062 - protein, 25 aa, Staphylococcus epidermidis
EYVESFLDHMKKIMTMLDAKDIEAL

SEQ ID NO: 1827063 - protein, 17 aa, Staphylococcus epidermidis
EYVSILYQIWKKSIKKL

SEQ ID NO: 1827064 - protein, 28 aa, Staphylococcus epidermidis
FADHLEHPISYYFKNNFYITPSGMLTKP

SEQ ID NO: 1827065 - protein, 17 aa, Staphylococcus epidermidis
FAELERILGFSNGQIRR

SEQ ID NO: 1827066 - protein, 17 aa, Staphylococcus epidermidis
FAGYGVNVIAILEIYFP

SEQ ID NO: 1827067 - protein, 17 aa, Staphylococcus epidermidis
FAKSGMLDGIRMVTQLL

SEQ ID NO: 1827068 - protein, 26 aa, Staphylococcus epidermidis
FAMAYIYNRYMFPKIEHFFVKNGIEV

SEQ ID NO: 1827069 - protein, 29 aa, Staphylococcus epidermidis
FANIYRTWNSEEFFSLIKEFELPTQNKVN

SEQ ID NO: 1827070 - protein, 38 aa, Staphylococcus epidermidis
FAPNKRGYKMLPHFQIGLFRDQLFIMFGVMHEAKNKAE

SEQ ID NO: 1827071 - protein, 24 aa, Staphylococcus epidermidis
FAPTTNVIYFKVAKTDSLEKLFDQ

SEQ ID NO: 1827072 - protein, 25 aa, Staphylococcus epidermidis
FCDREYDDFIYNCKVLIQEGYLEGD

SEQ ID NO: 1827073 - protein, 19 aa, Staphylococcus epidermidis
FCEHTLSHILGRRVNPHIF

SEQ ID NO: 1827074 - protein, 25 aa, Staphylococcus epidermidis
FDCSPIPVNYDLIPKCVYTNPEIAS

SEQ ID NO: 1827075 - protein, 25 aa, Staphylococcus epidermidis
FDDIETRIYPVGRLDYDTSGILLLT

SEQ ID NO: 1827076 - protein, 29 aa, Staphylococcus epidermidis
FDDVISMVANWFPSQATLYRIKQLETKIE

SEQ ID NO: 1827077 - protein, 31 aa, Staphylococcus epidermidis
FDDYWKARQVPLSNIRIPLLTCASWSTQGLH

SEQ ID NO: 1827078 - protein, 19 aa, Staphylococcus epidermidis
FDFDVVVATPDMMGEVGKL

SEQ ID NO: 1827079 - protein, 18 aa, Staphylococcus epidermidis
FDFIKQLKAIDSNPSLTA

SEQ ID NO: 1827080 - protein, 21 aa, Staphylococcus epidermidis
FDHKIDYQFLNPYKITYKNND

SEQ ID NO: 1827081 - protein, 31 aa, Staphylococcus epidermidis
FDIGFKLYDVFTILYLLDPEAFNVKEAYTQI

SEQ ID NO: 1827082 - protein, 30 aa, Staphylococcus epidermidis
FDINQVDIFIGRIPVLIRSSPIKYDKEEIQ

SEQ ID NO: 1827083 - protein, 22 aa, Staphylococcus epidermidis
FDIRDYYAARQLLKESIMNLTE

SEQ ID NO: 1827084 - protein, 24 aa, Staphylococcus epidermidis
FDKLTDLLKFMIPGYKKEGKSQLV

SEQ ID NO: 1827085 - protein, 24 aa, Staphylococcus epidermidis
FDLGDIFHSVLKYISDRIYGNFKN

SEQ ID NO: 1827086 - protein, 19 aa, Staphylococcus epidermidis
FDLGHFRGAVRPDITRFRD

SEQ ID NO: 1827087 - protein, 26 aa, Staphylococcus epidermidis
FDLKGNRLFYLAMSPKFFGVATNHLK

SEQ ID NO: 1827088 - protein, 18 aa, Staphylococcus epidermidis
FDLNLNGGQMYLGDYQYY

SEQ ID NO: 1827089 - protein, 18 aa, Staphylococcus epidermidis
FDMNRLVISTYLANYFMS

SEQ ID NO: 1827090 - protein, 24 aa, Staphylococcus epidermidis
FDQEKPFVTSGIRLGTPAATTRGF

SEQ ID NO: 1827091 - protein, 29 aa, Staphylococcus epidermidis
FDQVIGVNIGGVFWGIQAALEQFDKLGHG

SEQ ID NO: 1827092 - protein, 29 aa, Staphylococcus epidermidis
FDQVIKKDGYWWIRFKYVQPGSSNKHFYC

SEQ ID NO: 1827093 - protein, 22 aa, Staphylococcus epidermidis
FDTKPRGLFRKKKFSPIVGDIV

SEQ ID NO: 1827094 - protein, 27 aa, Staphylococcus epidermidis
FDTQQQFLQPLIYIPEVQSLIWENSCG

SEQ ID NO: 1827095 - protein, 18 aa, Staphylococcus epidermidis
FDTQSINTFLFSGLKNIK

SEQ ID NO: 1827096 - protein, 26 aa, Staphylococcus epidermidis
FDTTDLRLITLYIMEAFKVLGREEML

SEQ ID NO: 1827097 - protein, 17 aa, Staphylococcus epidermidis
FDVIVTENLFGDILSDE

SEQ ID NO: 1827098 - protein, 17 aa, Staphylococcus epidermidis
FDWFKRKSNKKDTYEEE

SEQ ID NO: 1827099 - protein, 17 aa, Staphylococcus epidermidis
FDYIFFTGSEKVGKIVY

SEQ ID NO: 1827100 - protein, 26 aa, Staphylococcus epidermidis
FDYVLNQPLYQLIEQVKPRLTKAKIK

SEQ ID NO: 1827101 - protein, 19 aa, Staphylococcus epidermidis
FEAIVRFDSLVELDYYRHG

SEQ ID NO: 1827102 - protein, 19 aa, Staphylococcus epidermidis
FEASPFLKMIINQSEFNMK

SEQ ID NO: 1827103 - protein, 17 aa, Staphylococcus epidermidis
FEDCCTIFTPKNPVTEP

SEQ ID NO: 1827104 - protein, 19 aa, Staphylococcus epidermidis
FEEIFRLSQDRPTIVRLLD

SEQ ID NO: 1827105 - protein, 18 aa, Staphylococcus epidermidis
FEEPLVEFFYKNDDLNDP

SEQ ID NO: 1827106 - protein, 25 aa, Staphylococcus epidermidis
FEFCTPFGSFPVRSPYVGRFNISNI

SEQ ID NO: 1827107 - protein, 19 aa, Staphylococcus epidermidis
FEGCMPFEVMAERGRKTLL

SEQ ID NO: 1827108 - protein, 20 aa, Staphylococcus epidermidis
FEGMFTKEKLPFIDQEALKE

SEQ ID NO: 1827109 - protein, 28 aa, Staphylococcus epidermidis
FEHGIFVSYLRYPTVSQPTLRISLSYFH

SEQ ID NO: 1827110 - protein, 17 aa, Staphylococcus epidermidis
FEHNPINFDFTFDEEPN

SEQ ID NO: 1827111 - protein, 23 aa, Staphylococcus epidermidis
FEHYLECLTLKKYKNKPIKQTIL

SEQ ID NO: 1827112 - protein, 31 aa, Staphylococcus epidermidis
FEIGFKLYDVFTILYLLDPEAFNVKEAYTQI

SEQ ID NO: 1827113 - protein, 26 aa, Staphylococcus epidermidis
FEIKNGMYAGLFFNVKNVAPAKSPNY

SEQ ID NO: 1827114 - protein, 17 aa, Staphylococcus epidermidis
FEKILKRMHKRHVRIHP

SEQ ID NO: 1827115 - protein, 34 aa, Staphylococcus epidermidis
FEKNQRDLPWRETTNPYYIWLSEVMLQQTQVNTV

SEQ ID NO: 1827116 - protein, 27 aa, Staphylococcus epidermidis
FEKQLEYPLEILSANANLRVVYTRSSE

SEQ ID NO: 1827117 - protein, 17 aa, Staphylococcus epidermidis
FEKVIPLNIMLIEKNHI

SEQ ID NO: 1827118 - protein, 20 aa, Staphylococcus epidermidis
FEKVMLEMSANKKYDLFVLV

SEQ ID NO: 1827119 - protein, 21 aa, Staphylococcus epidermidis
FELPYMQLVVITERELFKTKQ

SEQ ID NO: 1827120 - protein, 17 aa, Staphylococcus epidermidis
FELRERVRFHLEIENEQ

SEQ ID NO: 1827121 - protein, 18 aa, Staphylococcus epidermidis
FELRKDFRKAIESCETQN

SEQ ID NO: 1827122 - protein, 18 aa, Staphylococcus epidermidis
FENKRYHTWNYHLKNKFG

SEQ ID NO: 1827123 - protein, 32 aa, Staphylococcus epidermidis
FENSRTTIFPILGGGERLGTLVLGRVQDDFNE

SEQ ID NO: 1827124 - protein, 17 aa, Staphylococcus epidermidis
FEPVVLPNGVELRNRFV

SEQ ID NO: 1827125 - protein, 30 aa, Staphylococcus epidermidis
FEQASLIFLDSIVLPLMDAFHISEKTMQEN

SEQ ID NO: 1827126 - protein, 39 aa, Staphylococcus epidermidis
FEQTEVRLVLSFLRTIDNPLQDIYLVGLMRSVIYQFTEE

SEQ ID NO: 1827127 - protein, 40 aa, Staphylococcus epidermidis
FEQTEVRLVLSFLRTIDNPLQDIYLVGLMRSVIYQFTEEE

SEQ ID NO: 1827128 - protein, 19 aa, Staphylococcus epidermidis
FERPFHMIHNEIVKTLFEK

SEQ ID NO: 1827129 - protein, 24 aa, Staphylococcus epidermidis
FESQDRVLMIFGPEGGLSDKEVSL

SEQ ID NO: 1827130 - protein, 28 aa, Staphylococcus epidermidis
FESTRAEWLFLDVFGWSKTDYLIHKDEQ

SEQ ID NO: 1827131 - protein, 18 aa, Staphylococcus epidermidis
FESYLLKRHRELKSKKFQ

SEQ ID NO: 1827132 - protein, 17 aa, Staphylococcus epidermidis
FETAINLMKRFDNFEFE

SEQ ID NO: 1827133 - protein, 18 aa, Staphylococcus epidermidis
FETIGIAGFFGLPIQKEA

SEQ ID NO: 1827134 - protein, 24 aa, Staphylococcus epidermidis
FEVRGEAYMPRRSFMNLNKQKEEN

SEQ ID NO: 1827135 - protein, 19 aa, Staphylococcus epidermidis
FFEKALKVIRPVYLNQSTI

SEQ ID NO: 1827136 - protein, 38 aa, Staphylococcus epidermidis
FFGAYDLALYKDNTFIGQPLWGSIGYTLPATLGTQIAN

SEQ ID NO: 1827137 - protein, 19 aa, Staphylococcus epidermidis
FFNSKSNILFIFEGVLMYF

SEQ ID NO: 1827138 - protein, 17 aa, Staphylococcus epidermidis
FFPPYTFENWEVESSVE

SEQ ID NO: 1827139 - protein, 18 aa, Staphylococcus epidermidis
FFSWGFRVGFMTFGINHE

SEQ ID NO: 1827140 - protein, 17 aa, Staphylococcus epidermidis
FFTGIEIHPGAKIGKRL

SEQ ID NO: 1827141 - protein, 24 aa, Staphylococcus epidermidis
FGFEFQSFMAASKFYDTYALKTRD

SEQ ID NO: 1827142 - protein, 18 aa, Staphylococcus epidermidis
FGFLVIHIPHISEEHFKQ

SEQ ID NO: 1827143 - protein, 18 aa, Staphylococcus epidermidis
FGGNPLACAVSIAAIDVI

SEQ ID NO: 1827144 - protein, 19 aa, Staphylococcus epidermidis
FGGNPLACAVSIAALDVIV

SEQ ID NO: 1827145 - protein, 17 aa, Staphylococcus epidermidis
FGIMKPILSFTRKSVRG

SEQ ID NO: 1827146 - protein, 19 aa, Staphylococcus epidermidis
FGIMYYKSIKTVDLSNYTI

SEQ ID NO: 1827147 - protein, 17 aa, Staphylococcus epidermidis
FGITLPDAITNKNKKYN

SEQ ID NO: 1827148 - protein, 22 aa, Staphylococcus epidermidis
FGKGIGYMPVRASKFNSVSSRK

SEQ ID NO: 1827149 - protein, 18 aa, Staphylococcus epidermidis
FGKSIILSQSGYTGEDGF

SEQ ID NO: 1827150 - protein, 18 aa, Staphylococcus epidermidis
FGLKNDVIFVLPSSDEKL

SEQ ID NO: 1827151 - protein, 17 aa, Staphylococcus epidermidis
FGLPVSKLGIETVNTSI

SEQ ID NO: 1827152 - protein, 19 aa, Staphylococcus epidermidis
FGMNLYQPYNVYPSLDNER

SEQ ID NO: 1827153 - protein, 17 aa, Staphylococcus epidermidis
FGMTETCSQFLTASPKM

SEQ ID NO: 1827154 - protein, 22 aa, Staphylococcus epidermidis
FGPAWIERFVRLQIEEAFAVAL

SEQ ID NO: 1827155 - protein, 17 aa, Staphylococcus epidermidis
FGPFAFDEWRYLPDGSD

SEQ ID NO: 1827156 - protein, 18 aa, Staphylococcus epidermidis
FGSPIKWNFTKFIIDRNG

SEQ ID NO: 1827157 - protein, 24 aa, Staphylococcus epidermidis
FGVEFKHKAYFNHRLRTTGGRYLL

SEQ ID NO: 1827158 - protein, 25 aa, Staphylococcus epidermidis
FGVFHDEALQPLYKDRIPVVIKNTN

SEQ ID NO: 1827159 - protein, 25 aa, Staphylococcus epidermidis
FGVKYILNNPVYKGFVRFNNHQNWS

SEQ ID NO: 1827160 - protein, 32 aa, Staphylococcus epidermidis
FHGGIPDTGFYRFWIQGIFARWPKNPNIEDLI

SEQ ID NO: 1827161 - protein, 29 aa, Staphylococcus epidermidis
FHGQSYLDTFLTPTELYVKPILELKKHIN

SEQ ID NO: 1827162 - protein, 19 aa, Staphylococcus epidermidis
FHHDALYSDYLIASDFSFV

SEQ ID NO: 1827163 - protein, 18 aa, Staphylococcus epidermidis
FHKEHFNDWTYFQIKLVI

SEQ ID NO: 1827164 - protein, 19 aa, Staphylococcus epidermidis
FHLHQSFYKNPISLPQFIN

SEQ ID NO: 1827165 - protein, 17 aa, Staphylococcus epidermidis
FHMIHNEIVKTLFEKYS

SEQ ID NO: 1827166 - protein, 19 aa, Staphylococcus epidermidis
FHNYAIYQILLPSRVNELL

SEQ ID NO: 1827167 - protein, 18 aa, Staphylococcus epidermidis
FHPERMASRILGMGDVLS

SEQ ID NO: 1827168 - protein, 18 aa, Staphylococcus epidermidis
FHQLIQTYPLVVIHVMRE

SEQ ID NO: 1827169 - protein, 26 aa, Staphylococcus epidermidis
FIADECRLWITVHYLPNESYESVVDE

SEQ ID NO: 1827170 - protein, 27 aa, Staphylococcus epidermidis
FIADECRLWITVHYLPYERYEDVVKEI

SEQ ID NO: 1827171 - protein, 18 aa, Staphylococcus epidermidis
FIDALKTHLSMYGSWNDP

SEQ ID NO: 1827172 - protein, 28 aa, Staphylococcus epidermidis
FIDETIEVLIPEIGLIKYDIPSNVIKHI

SEQ ID NO: 1827173 - protein, 19 aa, Staphylococcus epidermidis
FIEMCLLLPNLNEQQYNSL

SEQ ID NO: 1827174 - protein, 33 aa, Staphylococcus epidermidis
FIFGYPGGAVLPLYDIFYDGQIKHILARHEQGA

SEQ ID NO: 1827175 - protein, 17 aa, Staphylococcus epidermidis
FIFLDDVVLMQSTGLRD

SEQ ID NO: 1827176 - protein, 17 aa, Staphylococcus epidermidis
FIFPTDFSSRGKDLPMG

SEQ ID NO: 1827177 - protein, 18 aa, Staphylococcus epidermidis
FIGDVKRGVLFADRTDVS

SEQ ID NO: 1827178 - protein, 17 aa, Staphylococcus epidermidis
FIGFMGTGKTTIGQYLS

SEQ ID NO: 1827179 - protein, 19 aa, Staphylococcus epidermidis
FIGMNGIDLKYGFTTPDEQ

SEQ ID NO: 1827180 - protein, 17 aa, Staphylococcus epidermidis
FIHLMTQYGAHVEKIDV

SEQ ID NO: 1827181 - protein, 20 aa, Staphylococcus epidermidis
FIKELYKLLHFIADSNMSPI

SEQ ID NO: 1827182 - protein, 17 aa, Staphylococcus epidermidis
FIKQLDALNDAQTDALT

SEQ ID NO: 1827183 - protein, 17 aa, Staphylococcus epidermidis
FIKVIREVGRNGVIDLG

SEQ ID NO: 1827184 - protein, 24 aa, Staphylococcus epidermidis
FINDKYCNLSFLAKILYSILSKLQ

SEQ ID NO: 1827185 - protein, 17 aa, Staphylococcus epidermidis
FIREFRNVNVDEYELGQ

SEQ ID NO: 1827186 - protein, 23 aa, Staphylococcus epidermidis
FISHFSAFKNLKYFSIQRGISDE

SEQ ID NO: 1827187 - protein, 17 aa, Staphylococcus epidermidis
FISIMAGLSIDYIREQL

SEQ ID NO: 1827188 - protein, 17 aa, Staphylococcus epidermidis
FISIMAGLSIDYIRQQL

SEQ ID NO: 1827189 - protein, 18 aa, Staphylococcus epidermidis
FISLKHGFISDNLNITEF

SEQ ID NO: 1827190 - protein, 18 aa, Staphylococcus epidermidis
FISPYYHIFKTNYKNEKA

SEQ ID NO: 1827191 - protein, 20 aa, Staphylococcus epidermidis
FITINAAYNPDLHHLIDTAQ

SEQ ID NO: 1827192 - protein, 17 aa, Staphylococcus epidermidis
FITRRPVRIYTVRGLRL

SEQ ID NO: 1827193 - protein, 17 aa, Staphylococcus epidermidis
FITSKLWNDYQGYDSTI

SEQ ID NO: 1827194 - protein, 20 aa, Staphylococcus epidermidis
FIVITHRKGTMEFSDRLYGV

SEQ ID NO: 1827195 - protein, 18 aa, Staphylococcus epidermidis
FIVVDMPIGTVGLSDEED

SEQ ID NO: 1827196 - protein, 17 aa, Staphylococcus epidermidis
FIYLSPEYILQPQNFKL

SEQ ID NO: 1827197 - protein, 18 aa, Staphylococcus epidermidis
FKARVDSMLFRGVHYEIC

SEQ ID NO: 1827198 - protein, 19 aa, Staphylococcus epidermidis
FKDALRLADFFDAPYQMFL

SEQ ID NO: 1827199 - protein, 26 aa, Staphylococcus epidermidis
FKDDEVIWLYQYFSNIKIAPTTYTLD

SEQ ID NO: 1827200 - protein, 17 aa, Staphylococcus epidermidis
FKDDIIDIVRRVQGGQF

SEQ ID NO: 1827201 - protein, 26 aa, Staphylococcus epidermidis
FKDEEVIWLYQYFTDIKIAPTTYTVD

SEQ ID NO: 1827202 - protein, 24 aa, Staphylococcus epidermidis
FKDILINEYIYFASKNKKLIRIQH

SEQ ID NO: 1827203 - protein, 24 aa, Staphylococcus epidermidis
FKDILINEYIYFASKNKKLVRLNQ

SEQ ID NO: 1827204 - protein, 17 aa, Staphylococcus epidermidis
FKEDIIDIVQRVQGGQF

SEQ ID NO: 1827205 - protein, 27 aa, Staphylococcus epidermidis
FKEQVGYPLIVRPAFTMGGTGGGICYN

SEQ ID NO: 1827206 - protein, 19 aa, Staphylococcus epidermidis
FKERHNLKMITIESLIAYR

SEQ ID NO: 1827207 - protein, 22 aa, Staphylococcus epidermidis
FKEVYQIFSDVLGVPLKGKEAD

SEQ ID NO: 1827208 - protein, 17 aa, Staphylococcus epidermidis
FKFFVQYGNFKNLKHYK

SEQ ID NO: 1827209 - protein, 22 aa, Staphylococcus epidermidis
FKGKIVIIHQPAEEMPPGGAQG

SEQ ID NO: 1827210 - protein, 25 aa, Staphylococcus epidermidis
FKGQDAFEFKPYVKLIFASNELPMS

SEQ ID NO: 1827211 - protein, 24 aa, Staphylococcus epidermidis
FKIERILMDYLGELPYSLTESSYL

SEQ ID NO: 1827212 - protein, 31 aa, Staphylococcus epidermidis
FKIRDGSLKMLLSYQFPLILGNDFAGEISEV

SEQ ID NO: 1827213 - protein, 17 aa, Staphylococcus epidermidis
FKKLAHVEGFEKYLHKN

SEQ ID NO: 1827214 - protein, 55 aa, Staphylococcus epidermidis
FKKVVKQINVPGFRKGKVPRPIFEQRFGVEALYQDAVDILLPEAYGEAIDETGIN

SEQ ID NO: 1827215 - protein, 54 aa, Staphylococcus epidermidis
FKKVVKQINVPGFRKGKVPRPIFEQRFGVEALYQDAVDILLPEAYGEAIEETEI

SEQ ID NO: 1827216 - protein, 35 aa, Staphylococcus epidermidis
FKLFESTFFDHQLLRRFVSFMYEKPSTLIDYFQKN

SEQ ID NO: 1827217 - protein, 36 aa, Staphylococcus epidermidis
FKLFESTFFDHQLLRRLVAFMYEQPSTIIDYFRDDA

SEQ ID NO: 1827218 - protein, 35 aa, Staphylococcus epidermidis
FKLFESTFFDHQLLRRLVSFMYEKPSTLIDYFQKN

SEQ ID NO: 1827219 - protein, 20 aa, Staphylococcus epidermidis
FKMMIAELETKIFKFIDSGN

SEQ ID NO: 1827220 - protein, 18 aa, Staphylococcus epidermidis
FKNIVDLALQKEVDFIII

SEQ ID NO: 1827221 - protein, 17 aa, Staphylococcus epidermidis
FKNLGFETYFAIPRSKE

SEQ ID NO: 1827222 - protein, 23 aa, Staphylococcus epidermidis
FKNRFDLKCYLTLLDVLDSHNID

SEQ ID NO: 1827223 - protein, 22 aa, Staphylococcus epidermidis
FKPITLNPWGISDLELIGIGGF

SEQ ID NO: 1827224 - protein, 30 aa, Staphylococcus epidermidis
FKQAIDMIIKYHVPVCCFTFGIPDHETIQK

SEQ ID NO: 1827225 - protein, 29 aa, Staphylococcus epidermidis
FKQFKSKRMLLYAGLIPILRDHIAPVAVK

SEQ ID NO: 1827226 - protein, 23 aa, Staphylococcus epidermidis
FKREHMVFPGMVYISHPTEYGTL

SEQ ID NO: 1827227 - protein, 19 aa, Staphylococcus epidermidis
FKSFARALKVALMPSKDGL

SEQ ID NO: 1827228 - protein, 17 aa, Staphylococcus epidermidis
FKSIKVCPLIYWTEEEV

SEQ ID NO: 1827229 - protein, 18 aa, Staphylococcus epidermidis
FKSIKVCPLIYWTEEEVW

SEQ ID NO: 1827230 - protein, 20 aa, Staphylococcus epidermidis
FKSRITVWVLNYLKANQDKL

SEQ ID NO: 1827231 - protein, 17 aa, Staphylococcus epidermidis
FKSSEVPSAIFGTKKRR

SEQ ID NO: 1827232 - protein, 21 aa, Staphylococcus epidermidis
FKSTQLLLDYIHHTQKRDLSH

SEQ ID NO: 1827233 - protein, 25 aa, Staphylococcus epidermidis
FKTAYHILDIVFWFGHLDILTTNQY

SEQ ID NO: 1827234 - protein, 21 aa, Staphylococcus epidermidis
FKTISSERLMIGQIVFDDVED

SEQ ID NO: 1827235 - protein, 35 aa, Staphylococcus epidermidis
FKTTGNAIAMAWYRYPRGFKFYRNTRNFVPKPGDM

SEQ ID NO: 1827236 - protein, 18 aa, Staphylococcus epidermidis
FKVSNLSNEQLFLGSGIG

SEQ ID NO: 1827237 - protein, 18 aa, Staphylococcus epidermidis
FKYLKECLDIFDIISTGG

SEQ ID NO: 1827238 - protein, 20 aa, Staphylococcus epidermidis
FLAKYDVTPISHLKLLEGQK

SEQ ID NO: 1827239 - protein, 17 aa, Staphylococcus epidermidis
FLATKYNEKHQILFPFR

SEQ ID NO: 1827240 - protein, 18 aa, Staphylococcus epidermidis
FLCLLHNSNNFFIKKERK

SEQ ID NO: 1827241 - protein, 17 aa, Staphylococcus epidermidis
FLDTPGHAAFTTMRARG

SEQ ID NO: 1827242 - protein, 28 aa, Staphylococcus epidermidis
FLENLMNPYLYEVLTIHAQLKGYHFVLK

SEQ ID NO: 1827243 - protein, 17 aa, Staphylococcus epidermidis
FLEYLRELKFTGNIRSM

SEQ ID NO: 1827244 - protein, 17 aa, Staphylococcus epidermidis
FLFDDLIVTGISSKKIA

SEQ ID NO: 1827245 - protein, 17 aa, Staphylococcus epidermidis
FLGAELLKKTLPSIIDN

SEQ ID NO: 1827246 - protein, 25 aa, Staphylococcus epidermidis
FLGIGLRLIPKPLRDLGYRLFANNR

SEQ ID NO: 1827247 - protein, 19 aa, Staphylococcus epidermidis
FLGLAMRAGKIKSGESVIL

SEQ ID NO: 1827248 - protein, 17 aa, Staphylococcus epidermidis
FLILGTPNYHGSFSGIL

SEQ ID NO: 1827249 - protein, 23 aa, Staphylococcus epidermidis
FLKNLRLVKFRREGTTLFYSHDD

SEQ ID NO: 1827250 - protein, 17 aa, Staphylococcus epidermidis
FLKSKGGQLADFVRYEV

SEQ ID NO: 1827251 - protein, 27 aa, Staphylococcus epidermidis
FLLDEAFVYEYRSFIEITLRGLEFANT

SEQ ID NO: 1827252 - protein, 18 aa, Staphylococcus epidermidis
FLLDVFEGNIFKVNPATK

SEQ ID NO: 1827253 - protein, 17 aa, Staphylococcus epidermidis
FLNFVQKDKKSFVLFKV

SEQ ID NO: 1827254 - protein, 17 aa, Staphylococcus epidermidis
FLNHIQHQCEGEMLVGV

SEQ ID NO: 1827255 - protein, 18 aa, Staphylococcus epidermidis
FLNKKKYYKPRKMNKFLK

SEQ ID NO: 1827256 - protein, 26 aa, Staphylococcus epidermidis
FLNKVAQEYWYIHDGYMEKIIGTFED

SEQ ID NO: 1827257 - protein, 20 aa, Staphylococcus epidermidis
FLQRFNGGMGILLGGIPGVP

SEQ ID NO: 1827258 - protein, 28 aa, Staphylococcus epidermidis
FLQSDHLNELILYLAPKLIGGSGKHQFF

SEQ ID NO: 1827259 - protein, 18 aa, Staphylococcus epidermidis
FLQSYLNFNVNKWKRYAA

SEQ ID NO: 1827260 - protein, 17 aa, Staphylococcus epidermidis
FLRAFKKWTGQTITEFK

SEQ ID NO: 1827261 - protein, 17 aa, Staphylococcus epidermidis
FLRAPSIRQFSNRIKYI

SEQ ID NO: 1827262 - protein, 18 aa, Staphylococcus epidermidis
FLSDLVGNPSLLNRVGKL

SEQ ID NO: 1827263 - protein, 17 aa, Staphylococcus epidermidis
FLSIYYELKENIYLDES

SEQ ID NO: 1827264 - protein, 25 aa, Staphylococcus epidermidis
FLTGWSGASLFMSCLYRATNNEKWL

SEQ ID NO: 1827265 - protein, 17 aa, Staphylococcus epidermidis
FLTLLDFSQKEVEFLLN

SEQ ID NO: 1827266 - protein, 18 aa, Staphylococcus epidermidis
FLVANIINRAMYNQKIRK

SEQ ID NO: 1827267 - protein, 19 aa, Staphylococcus epidermidis
FMADLIKRIDTHLSIDFMD

SEQ ID NO: 1827268 - protein, 18 aa, Staphylococcus epidermidis
FMAGMPVIVVQYRAENVN

SEQ ID NO: 1827269 - protein, 19 aa, Staphylococcus epidermidis
FMAQSHLLALRSTCQRLSV

SEQ ID NO: 1827270 - protein, 20 aa, Staphylococcus epidermidis
FMAQSHLLALRSTCRRLSVG

SEQ ID NO: 1827271 - protein, 18 aa, Staphylococcus epidermidis
FMGILKFRYKETKVLMQM

SEQ ID NO: 1827272 - protein, 17 aa, Staphylococcus epidermidis
FMKHLLGTRSGLMAEPN

SEQ ID NO: 1827273 - protein, 24 aa, Staphylococcus epidermidis
FMKMDFYAKRNLELTESIRLKSKK

SEQ ID NO: 1827274 - protein, 28 aa, Staphylococcus epidermidis
FMSVEPQIRLWDILQTKFKAKALQEKVY

SEQ ID NO: 1827275 - protein, 17 aa, Staphylococcus epidermidis
FMVVQDEFLTFTATYAD

SEQ ID NO: 1827276 - protein, 17 aa, Staphylococcus epidermidis
FNDAWKKMGILGIEMES

SEQ ID NO: 1827277 - protein, 21 aa, Staphylococcus epidermidis
FNDLIDEKIERNYTGKRKIRK

SEQ ID NO: 1827278 - protein, 23 aa, Staphylococcus epidermidis
FNDVEFLPPVTPPNNVIAFGRNY

SEQ ID NO: 1827279 - protein, 21 aa, Staphylococcus epidermidis
FNDWTYFQIKLVIVGIERGDL

SEQ ID NO: 1827280 - protein, 28 aa, Staphylococcus epidermidis
FNDYTLREIFQYLKLPKKDLHQLNMSKE

SEQ ID NO: 1827281 - protein, 19 aa, Staphylococcus epidermidis
FNEASLQYEYTHPLADLIG

SEQ ID NO: 1827282 - protein, 19 aa, Staphylococcus epidermidis
FNGAFDLILKQNKVRDAEP

SEQ ID NO: 1827283 - protein, 26 aa, Staphylococcus epidermidis
FNGDIGIIVGIFWAKENALNKDVLVI

SEQ ID NO: 1827284 - protein, 18 aa, Staphylococcus epidermidis
FNHPIIQILKENTLNQLK

SEQ ID NO: 1827285 - protein, 19 aa, Staphylococcus epidermidis
FNIAILEKGNFLGTGNYIL

SEQ ID NO: 1827286 - protein, 18 aa, Staphylococcus epidermidis
FNIKEGEFFVLIGPSGCG

SEQ ID NO: 1827287 - protein, 17 aa, Staphylococcus epidermidis
FNKKFLGNIIAEVFNRF

SEQ ID NO: 1827288 - protein, 33 aa, Staphylococcus epidermidis
FNMNKVFINEPLSFEIWIALMLAQQPIEDSLKA

SEQ ID NO: 1827289 - protein, 28 aa, Staphylococcus epidermidis
FNNERHLAALSFLTFVALGEDGKPINVP

SEQ ID NO: 1827290 - protein, 17 aa, Staphylococcus epidermidis
FNNLFSVNQFCFDEQFI

SEQ ID NO: 1827291 - protein, 17 aa, Staphylococcus epidermidis
FNNPILQEVNYWGTFPS

SEQ ID NO: 1827292 - protein, 21 aa, Staphylococcus epidermidis
FNNQIPLFKICNHNLIQDVTI

SEQ ID NO: 1827293 - protein, 20 aa, Staphylococcus epidermidis
FNQVYFARVPKSEGIKIITS

SEQ ID NO: 1827294 - protein, 17 aa, Staphylococcus epidermidis
FNRDQFNIVDHYTYVLA

SEQ ID NO: 1827295 - protein, 19 aa, Staphylococcus epidermidis
FNSLTFISGTLTFNHSFDA

SEQ ID NO: 1827296 - protein, 18 aa, Staphylococcus epidermidis
FNYQMHFAISERAYALLT

SEQ ID NO: 1827297 - protein, 24 aa, Staphylococcus epidermidis
FNYYLSEYVGRETPLTFAESYTKL

SEQ ID NO: 1827298 - protein, 25 aa, Staphylococcus epidermidis
FPDKQTLKRLFFEAGLNDIKVRSFT

SEQ ID NO: 1827299 - protein, 29 aa, Staphylococcus epidermidis
FPENRARLVIYPAAMRYAGPREAILHATV

SEQ ID NO: 1827300 - protein, 25 aa, Staphylococcus epidermidis
FPETKILILTMFDDEEYLFHMLKSG

SEQ ID NO: 1827301 - protein, 25 aa, Staphylococcus epidermidis
FPETKILILTMFDDEEYLFHVLKSG

SEQ ID NO: 1827302 - protein, 25 aa, Staphylococcus epidermidis
FPETKILILTMYDDEEYLFHVLKSG

SEQ ID NO: 1827303 - protein, 17 aa, Staphylococcus epidermidis
FPHMTIKENIAQVPQMK

SEQ ID NO: 1827304 - protein, 18 aa, Staphylococcus epidermidis
FPKSADIFRNAGIDFCCG

SEQ ID NO: 1827305 - protein, 21 aa, Staphylococcus epidermidis
FPTFLEMLMATYRLVQKAKDT

SEQ ID NO: 1827306 - protein, 26 aa, Staphylococcus epidermidis
FQDFALWPHMSVFQNVAYPLKVKKDT

SEQ ID NO: 1827307 - protein, 40 aa, Staphylococcus epidermidis
FQDIAILYRDESYAYLFDSIFPLYDIPFNIDTKKSMSHHP

SEQ ID NO: 1827308 - protein, 25 aa, Staphylococcus epidermidis
FQEVWDNYITFDLIPMADGGEGTTE

SEQ ID NO: 1827309 - protein, 17 aa, Staphylococcus epidermidis
FQGTPGYEEQMFGEAQS

SEQ ID NO: 1827310 - protein, 26 aa, Staphylococcus epidermidis
FQHRKFFHQLFKLLEDVRIFDIIRNE

SEQ ID NO: 1827311 - protein, 18 aa, Staphylococcus epidermidis
FQILELFHQTFPGLERLF

SEQ ID NO: 1827312 - protein, 17 aa, Staphylococcus epidermidis
FQKLIDSFRSKGTLQGY

SEQ ID NO: 1827313 - protein, 17 aa, Staphylococcus epidermidis
FQMIFQDPYASLNPMQM

SEQ ID NO: 1827314 - protein, 17 aa, Staphylococcus epidermidis
FQMLLENMEYYKVIDID

SEQ ID NO: 1827315 - protein, 19 aa, Staphylococcus epidermidis
FQNEYWNHFDKGIYVDKLS

SEQ ID NO: 1827316 - protein, 23 aa, Staphylococcus epidermidis
FQPSRAMALPVYQKDKYPFLHQY

SEQ ID NO: 1827317 - protein, 30 aa, Staphylococcus epidermidis
FQQDKQFIYPLIHIPKIGSLIWENSCGSGA

SEQ ID NO: 1827318 - protein, 17 aa, Staphylococcus epidermidis
FQYFIQNVLHDDIQFVI

SEQ ID NO: 1827319 - protein, 18 aa, Staphylococcus epidermidis
FRDLKAPIRMHRLLQGDV

SEQ ID NO: 1827320 - protein, 17 aa, Staphylococcus epidermidis
FRDTMNVALLTGSVKGK

SEQ ID NO: 1827321 - protein, 21 aa, Staphylococcus epidermidis
FREEPPWYKVSPTHFVKSWLL

SEQ ID NO: 1827322 - protein, 19 aa, Staphylococcus epidermidis
FRELKYYFDEAKQKLIDHQ

SEQ ID NO: 1827323 - protein, 24 aa, Staphylococcus epidermidis
FRGAETPYFQLHKDIKIKVLVDYR

SEQ ID NO: 1827324 - protein, 18 aa, Staphylococcus epidermidis
FRHDYVNILSTLSEFIRE

SEQ ID NO: 1827325 - protein, 18 aa, Staphylococcus epidermidis
FRKEYQAYINVWKDMIEE

SEQ ID NO: 1827326 - protein, 21 aa, Staphylococcus epidermidis
FRLTIPFDFKSLGFNDYYIKK

SEQ ID NO: 1827327 - protein, 23 aa, Staphylococcus epidermidis
FRQFDLDGFLKDKIITVSDIKQS

SEQ ID NO: 1827328 - protein, 17 aa, Staphylococcus epidermidis
FRTTKKLQKITFKHKRY

SEQ ID NO: 1827329 - protein, 21 aa, Staphylococcus epidermidis
FSDLRGDLFGLFDKLRESFKG

SEQ ID NO: 1827330 - protein, 23 aa, Staphylococcus epidermidis
FSDLYIENSGLNYTIVHPGPLQD

SEQ ID NO: 1827331 - protein, 17 aa, Staphylococcus epidermidis
FSEKDPHNLPWKSLEID

SEQ ID NO: 1827332 - protein, 32 aa, Staphylococcus epidermidis
FSFETTEFILNQLPCWLTYTNGDTHQVIDDNL

SEQ ID NO: 1827333 - protein, 26 aa, Staphylococcus epidermidis
FSFIPGPASRLSWLGDILTTANNIHA

SEQ ID NO: 1827334 - protein, 17 aa, Staphylococcus epidermidis
FSFLMDMRILVEELFLK

SEQ ID NO: 1827335 - protein, 23 aa, Staphylococcus epidermidis
FSGQMHGLIILDKQGKPLRRAIL

SEQ ID NO: 1827336 - protein, 27 aa, Staphylococcus epidermidis
FSIGELEPRMFSFNSPFGACPTCDGLG

SEQ ID NO: 1827337 - protein, 21 aa, Staphylococcus epidermidis
FSINYFINEYLKQLKMENKLS

SEQ ID NO: 1827338 - protein, 19 aa, Staphylococcus epidermidis
FSKNWLHYWEEECGYTVRD

SEQ ID NO: 1827339 - protein, 20 aa, Staphylococcus epidermidis
FSKNWLHYWRDECGYTIKPV

SEQ ID NO: 1827340 - protein, 18 aa, Staphylococcus epidermidis
FSNSLLDSTKYLENITQV

SEQ ID NO: 1827341 - protein, 24 aa, Staphylococcus epidermidis
FSPDKILGAILFEQTMDREVEGKY

SEQ ID NO: 1827342 - protein, 17 aa, Staphylococcus epidermidis
FSRIVIHELRHSHASML

SEQ ID NO: 1827343 - protein, 21 aa, Staphylococcus epidermidis
FSTDALLLGYLTEVRKNDKVM

SEQ ID NO: 1827344 - protein, 19 aa, Staphylococcus epidermidis
FSTSLLPLNRGIVATIYCR

SEQ ID NO: 1827345 - protein, 18 aa, Staphylococcus epidermidis
FSYSNLFNYLVNFIAENS

SEQ ID NO: 1827346 - protein, 27 aa, Staphylococcus epidermidis
FSYYDRFRNRIMFPLKNAQGRIVGYSG

SEQ ID NO: 1827347 - protein, 17 aa, Staphylococcus epidermidis
FTCIQMVKLVQEEDLQL

SEQ ID NO: 1827348 - protein, 18 aa, Staphylococcus epidermidis
FTDKYGVRWMLNGQDYSK

SEQ ID NO: 1827349 - protein, 24 aa, Staphylococcus epidermidis
FTEKGILIWIDQEKVKYRAPKGIM

SEQ ID NO: 1827350 - protein, 29 aa, Staphylococcus epidermidis
FTGKVNLGNRYEGYSPDGVVGGDGIGFAF

SEQ ID NO: 1827351 - protein, 21 aa, Staphylococcus epidermidis
FTGQGIHYFKVNGLTIGTIGL

SEQ ID NO: 1827352 - protein, 26 aa, Staphylococcus epidermidis
FTKANPFTRFIRAKATLTPAGATVVP

SEQ ID NO: 1827353 - protein, 21 aa, Staphylococcus epidermidis
FTKGTPWFPVNPNYKTINVEK

SEQ ID NO: 1827354 - protein, 27 aa, Staphylococcus epidermidis
FTNLMTHPRYRIKKKYVAKLKGYLMRE

SEQ ID NO: 1827355 - protein, 28 aa, Staphylococcus epidermidis
FTNSQLVGAGLPLWLPNGATIRREIERY

SEQ ID NO: 1827356 - protein, 25 aa, Staphylococcus epidermidis
FTQEQLELLKPNWTDTDWQSLPLVN

SEQ ID NO: 1827357 - protein, 25 aa, Staphylococcus epidermidis
FTTDFLYQTEWQEWLNDGTLSKLDV

SEQ ID NO: 1827358 - protein, 20 aa, Staphylococcus epidermidis
FTTIIKHHGALLAKGRLTGI

SEQ ID NO: 1827359 - protein, 19 aa, Staphylococcus epidermidis
FTTVLKQLFGGGQAELRLT

SEQ ID NO: 1827360 - protein, 17 aa, Staphylococcus epidermidis
FTVPVDLIFFNGKEMHR

SEQ ID NO: 1827361 - protein, 17 aa, Staphylococcus epidermidis
FVAKFTETLLEDVSDSE

SEQ ID NO: 1827362 - protein, 22 aa, Staphylococcus epidermidis
FVANHFFTVEEWSIKDILDFQK

SEQ ID NO: 1827363 - protein, 19 aa, Staphylococcus epidermidis
FVANVIKKYSLDAQFIIVN

SEQ ID NO: 1827364 - protein, 23 aa, Staphylococcus epidermidis
FVDRLEKRIYDLQLSRQIAIQTA

SEQ ID NO: 1827365 - protein, 17 aa, Staphylococcus epidermidis
FVILIEGALPKSGESWF

SEQ ID NO: 1827366 - protein, 17 aa, Staphylococcus epidermidis
FVKLITLKEDDTIIGAQ

SEQ ID NO: 1827367 - protein, 27 aa, Staphylococcus epidermidis
FVKTVHLNLPLEWLKGKIVVDSLGLHS

SEQ ID NO: 1827368 - protein, 19 aa, Staphylococcus epidermidis
FVLEYMKYVNKFVRIFNFP

SEQ ID NO: 1827369 - protein, 23 aa, Staphylococcus epidermidis
FVNDWEKLPLFRSQYGLDAEVRK

SEQ ID NO: 1827370 - protein, 17 aa, Staphylococcus epidermidis
FVPFLQQYDQRVVNGTG

SEQ ID NO: 1827371 - protein, 18 aa, Staphylococcus epidermidis
FVRFYKDNVSPTKIDGHG

SEQ ID NO: 1827372 - protein, 17 aa, Staphylococcus epidermidis
FVSIQLYNALSFNFYYL

SEQ ID NO: 1827373 - protein, 25 aa, Staphylococcus epidermidis
FVSKDIVTRLYPFGQSGLTIQSVNP

SEQ ID NO: 1827374 - protein, 17 aa, Staphylococcus epidermidis
FVSPYYNRRNDVWADNL

SEQ ID NO: 1827375 - protein, 17 aa, Staphylococcus epidermidis
FVTLGFGLGTDELSRKI

SEQ ID NO: 1827376 - protein, 20 aa, Staphylococcus epidermidis
FVTMGEAEKFWDFMAKVEKE

SEQ ID NO: 1827377 - protein, 17 aa, Staphylococcus epidermidis
FVVLLLNSKNIVIKQSW

SEQ ID NO: 1827378 - protein, 18 aa, Staphylococcus epidermidis
FWDEVNGFNYDFFEAVDT

SEQ ID NO: 1827379 - protein, 18 aa, Staphylococcus epidermidis
FYAENIEHRRWGAPFPVI

SEQ ID NO: 1827380 - protein, 21 aa, Staphylococcus epidermidis
FYDVGVSGIHRLFNHIHEIRQ

SEQ ID NO: 1827381 - protein, 17 aa, Staphylococcus epidermidis
FYITTSSTKLRDYRKHF

SEQ ID NO: 1827382 - protein, 20 aa, Staphylococcus epidermidis
FYKEIHKIVKIIGGFFVEEN

SEQ ID NO: 1827383 - protein, 28 aa, Staphylococcus epidermidis
FYNERDNLRLIYYALRNPYLSPDRKEKL

SEQ ID NO: 1827384 - protein, 26 aa, Staphylococcus epidermidis
FYQPKPGTDLAWLSAVTKYIIDNNLH

SEQ ID NO: 1827385 - protein, 19 aa, Staphylococcus epidermidis
FYTHGHFYDVNRTRMKLAE

SEQ ID NO: 1827386 - protein, 20 aa, Staphylococcus epidermidis
FYYNGLPLSQAYDDVIERDL

SEQ ID NO: 1827387 - protein, 25 aa, Staphylococcus epidermidis
GADAVMLITPYYNKTNQRGLIKHFE

SEQ ID NO: 1827388 - protein, 21 aa, Staphylococcus epidermidis
GADFNILVALHMLADISEEKA

SEQ ID NO: 1827389 - protein, 28 aa, Staphylococcus epidermidis
GADIHCDQLIILTAIDYVYINYHTDKQQ

SEQ ID NO: 1827390 - protein, 28 aa, Staphylococcus epidermidis
GADIQCDQLIILTAIDYVYVNYNTENQK

SEQ ID NO: 1827391 - protein, 25 aa, Staphylococcus epidermidis
GADKMKSWYERFGFGKKTGGMFDGE

SEQ ID NO: 1827392 - protein, 24 aa, Staphylococcus epidermidis
GADVLGVVAIFTYGLKKADDVFKE

SEQ ID NO: 1827393 - protein, 24 aa, Staphylococcus epidermidis
GAEEFGFATAPLVVLGCIMMRVCH

SEQ ID NO: 1827394 - protein, 18 aa, Staphylococcus epidermidis
GAEFLQRFNGGMGILLGG

SEQ ID NO: 1827395 - protein, 18 aa, Staphylococcus epidermidis
GAFGLPITYAIIGGNPRR

SEQ ID NO: 1827396 - protein, 25 aa, Staphylococcus epidermidis
GAGPIGLLTVIAAKAAGASKIFVFD

SEQ ID NO: 1827397 - protein, 18 aa, Staphylococcus epidermidis
GAIPYEHPLFLGMGGMHG

SEQ ID NO: 1827398 - protein, 42 aa, Staphylococcus epidermidis
GAIQFLYVAPERFENTFFLNLLRKIEIPLIAFDEAHCISQWG

SEQ ID NO: 1827399 - protein, 41 aa, Staphylococcus epidermidis
GAIQFLYVAPERFENTFFLNLLRKIKIPLIAFDEAHCISKW

SEQ ID NO: 1827400 - protein, 22 aa, Staphylococcus epidermidis
GAKIVEFGGWAMPVQFSSIKEE

SEQ ID NO: 1827401 - protein, 26 aa, Staphylococcus epidermidis
GAKKVLILSTNLPISTPYRLDDAIKE

SEQ ID NO: 1827402 - protein, 28 aa, Staphylococcus epidermidis
GALGERALRYIIPDTTDFPYTIRIVSEV

SEQ ID NO: 1827403 - protein, 26 aa, Staphylococcus epidermidis
GALLTYKIMTMFEPYFREYQLIFVNC

SEQ ID NO: 1827404 - protein, 23 aa, Staphylococcus epidermidis
GANAVKFLLYYDVDDAEEINIQK

SEQ ID NO: 1827405 - protein, 26 aa, Staphylococcus epidermidis
GANVKGYFIWSLMDVFSWSNGYEKRY

SEQ ID NO: 1827406 - protein, 24 aa, Staphylococcus epidermidis
GAPKPRLPFEHIFHKNSYDASNDK

SEQ ID NO: 1827407 - protein, 17 aa, Staphylococcus epidermidis
GAPMVIKMGRYGKFMAC

SEQ ID NO: 1827408 - protein, 17 aa, Staphylococcus epidermidis
GAPPHGGIALGLDRLVM

SEQ ID NO: 1827409 - protein, 23 aa, Staphylococcus epidermidis
GAQAWVGTLLKMKPVLRFEEDGK

SEQ ID NO: 1827410 - protein, 19 aa, Staphylococcus epidermidis
GAQLLINYLSNNDLSHIPQ

SEQ ID NO: 1827411 - protein, 18 aa, Staphylococcus epidermidis
GAQVGWYIPNRFTEGYGP

SEQ ID NO: 1827412 - protein, 25 aa, Staphylococcus epidermidis
GAQVPMGLFSRDFIFVGDIGRPDLL

SEQ ID NO: 1827413 - protein, 23 aa, Staphylococcus epidermidis
GARGYIVFGHPLKIDKVAQSYST

SEQ ID NO: 1827414 - protein, 23 aa, Staphylococcus epidermidis
GARRLHTILEKMLEDLSFEAPNM

SEQ ID NO: 1827415 - protein, 17 aa, Staphylococcus epidermidis
GARSSIFAPFKNLGIII

SEQ ID NO: 1827416 - protein, 25 aa, Staphylococcus epidermidis
GASGPLYGFSFVKMASVVKDEIDND

SEQ ID NO: 1827417 - protein, 23 aa, Staphylococcus epidermidis
GASIILLIVNILSDDQLKELYSY

SEQ ID NO: 1827418 - protein, 23 aa, Staphylococcus epidermidis
GASKIFVFDLSEERLEKARSVGA

SEQ ID NO: 1827419 - protein, 26 aa, Staphylococcus epidermidis
GATLQEMAPLFKWLNSSFNDNGFSLS

SEQ ID NO: 1827420 - protein, 23 aa, Staphylococcus epidermidis
GAVPGLWPHIRVLEQDWIDGGMT

SEQ ID NO: 1827421 - protein, 19 aa, Staphylococcus epidermidis
GAYKIKYIRRMDLSNIHPQ

SEQ ID NO: 1827422 - protein, 21 aa, Staphylococcus epidermidis
GCDVFIIQPTSYPVNLHLMEL

SEQ ID NO: 1827423 - protein, 26 aa, Staphylococcus epidermidis
GCKTLEEFLVLNALHIPLHAGKIEEM

SEQ ID NO: 1827424 - protein, 35 aa, Staphylococcus epidermidis
GCMEELKMMLNIMKPEYFIPVQGEFKMQIAHAKLA

SEQ ID NO: 1827425 - protein, 26 aa, Staphylococcus epidermidis
GCPKCRPAINYYLNMVYPFEHQDEKE

SEQ ID NO: 1827426 - protein, 23 aa, Staphylococcus epidermidis
GCSPIGMKHLFKTTIDRSAQNLD

SEQ ID NO: 1827427 - protein, 26 aa, Staphylococcus epidermidis
GCTGAELELFRLLQQDLQFMETIMKE

SEQ ID NO: 1827428 - protein, 23 aa, Staphylococcus epidermidis
GDAELFLVKLEPKPVLEKINKDL

SEQ ID NO: 1827429 - protein, 20 aa, Staphylococcus epidermidis
GDALAFIGDVKRGVLFADRT

SEQ ID NO: 1827430 - protein, 26 aa, Staphylococcus epidermidis
GDCNLKFKAYLLENNIIDEQWLSELE

SEQ ID NO: 1827431 - protein, 25 aa, Staphylococcus epidermidis
GDDAILIRYQPYNSTVIYQKRFYKT

SEQ ID NO: 1827432 - protein, 31 aa, Staphylococcus epidermidis
GDDILIPGPIYAGYIPLIETLGGNPVYIDTT

SEQ ID NO: 1827433 - protein, 26 aa, Staphylococcus epidermidis
GDEAKEYWLCWVTTERSEQGPYYAGV

SEQ ID NO: 1827434 - protein, 20 aa, Staphylococcus epidermidis
GDEFTFKKLIRDSGQVFLQP

SEQ ID NO: 1827435 - protein, 28 aa, Staphylococcus epidermidis
GDEIGNFMKATLPKLYSGKGKSTIEGLG

SEQ ID NO: 1827436 - protein, 29 aa, Staphylococcus epidermidis
GDEILIPGPIYAGYIPLIETLGGSPIYMD

SEQ ID NO: 1827437 - protein, 21 aa, Staphylococcus epidermidis
GDFDYLPEIYKAINADVLFNK

SEQ ID NO: 1827438 - protein, 19 aa, Staphylococcus epidermidis
GDFFRQLNIAYNYGLFHEH

SEQ ID NO: 1827439 - protein, 18 aa, Staphylococcus epidermidis
GDFIKPIRPIFHKVYKLL

SEQ ID NO: 1827440 - protein, 21 aa, Staphylococcus epidermidis
GDFLTIVLSALLHDVIDDKLT

SEQ ID NO: 1827441 - protein, 22 aa, Staphylococcus epidermidis
GDGQYLVGKFPPGIKYDFEKVF

SEQ ID NO: 1827442 - protein, 37 aa, Staphylococcus epidermidis
GDIQFLYVAPERFENTFFLNLLRKIDIHLIAFDEAHC

SEQ ID NO: 1827443 - protein, 32 aa, Staphylococcus epidermidis
GDISSPYYRDLAFVTYMGITPLDTMLSAFGKR

SEQ ID NO: 1827444 - protein, 25 aa, Staphylococcus epidermidis
GDKVGWQLLYIANPDYRVKPPFFIQ

SEQ ID NO: 1827445 - protein, 17 aa, Staphylococcus epidermidis
GDLKPPLNVYFSGYRSL

SEQ ID NO: 1827446 - protein, 23 aa, Staphylococcus epidermidis
GDLKPYTIAKHYSDDYLRNSGLN

SEQ ID NO: 1827447 - protein, 21 aa, Staphylococcus epidermidis
GDLPLHAIPITHVSQPTVISD

SEQ ID NO: 1827448 - protein, 22 aa, Staphylococcus epidermidis
GDNQHPLFRFLTDAAKGMINEK

SEQ ID NO: 1827449 - protein, 26 aa, Staphylococcus epidermidis
GDRGDSRFYLSLQDELMVRFGSERLQ

SEQ ID NO: 1827450 - protein, 24 aa, Staphylococcus epidermidis
GDRHQAILLLHSFTGTVRDVKHLA

SEQ ID NO: 1827451 - protein, 29 aa, Staphylococcus epidermidis
GDRLGWIEGVNNWNFTLFIQNGRVKDTED

SEQ ID NO: 1827452 - protein, 25 aa, Staphylococcus epidermidis
GDSKPDWEIFQLIANRLGANWEYQH

SEQ ID NO: 1827453 - protein, 21 aa, Staphylococcus epidermidis
GDTIVVWRLDRLGRNMEDLIT

SEQ ID NO: 1827454 - protein, 22 aa, Staphylococcus epidermidis
GDTIVVWRLDRLGRNMEDLITL

SEQ ID NO: 1827455 - protein, 27 aa, Staphylococcus epidermidis
GDVKDVVLLDVTPLSLGIEIMGGRMNT

SEQ ID NO: 1827456 - protein, 28 aa, Staphylococcus epidermidis
GDVVMVEQIGDYFVWFNEPRGDFYTEQD

SEQ ID NO: 1827457 - protein, 19 aa, Staphylococcus epidermidis
GDWFAVLRIAKQMFIPIGS

SEQ ID NO: 1827458 - protein, 21 aa, Staphylococcus epidermidis
GDYDLLIIGSGGAAFSAAIKA

SEQ ID NO: 1827459 - protein, 22 aa, Staphylococcus epidermidis
GDYYTDRYVLAVPYTSIGEDGK

SEQ ID NO: 1827460 - protein, 24 aa, Staphylococcus epidermidis
GEALPRNYFLQNADDYLHVLENGV

SEQ ID NO: 1827461 - protein, 19 aa, Staphylococcus epidermidis
GEDAFKLYDTYGFPVELTE

SEQ ID NO: 1827462 - protein, 24 aa, Staphylococcus epidermidis
GEDCRRTMEIFKLLGVSITENEDT

SEQ ID NO: 1827463 - protein, 23 aa, Staphylococcus epidermidis
GEDIPQHILLRFIFVCQQAECSD

SEQ ID NO: 1827464 - protein, 28 aa, Staphylococcus epidermidis
GEDVQFKELKFYLAFKRIKNFACVEILP

SEQ ID NO: 1827465 - protein, 25 aa, Staphylococcus epidermidis
GEEGTSFILTKWLFNNEKELSSYDY

SEQ ID NO: 1827466 - protein, 17 aa, Staphylococcus epidermidis
GEEKFWTSPAHKTVRFK

SEQ ID NO: 1827467 - protein, 36 aa, Staphylococcus epidermidis
GEEQSLELYFTSLSKRTIVYKGWLRSDQIKGLYLDL

SEQ ID NO: 1827468 - protein, 24 aa, Staphylococcus epidermidis
GEEVPRKFWLNGEKDWVYIHSVIK

SEQ ID NO: 1827469 - protein, 23 aa, Staphylococcus epidermidis
GEEYSFFVYPNRSGELFATQNMP

SEQ ID NO: 1827470 - protein, 21 aa, Staphylococcus epidermidis
GEGHYAVGLFFSKEKVKDSAH

SEQ ID NO: 1827471 - protein, 20 aa, Staphylococcus epidermidis
GEGLIITGSLYFISEVKAKT

SEQ ID NO: 1827472 - protein, 32 aa, Staphylococcus epidermidis
GEGNDLYTPTYHQDFLLGCMRQSLLDQGRMIE

SEQ ID NO: 1827473 - protein, 27 aa, Staphylococcus epidermidis
GEGQSLYIRPFVFATEGILGVRASQQY

SEQ ID NO: 1827474 - protein, 25 aa, Staphylococcus epidermidis
GEHKGKFNMIFQFEHLGLWSTGDTQ

SEQ ID NO: 1827475 - protein, 26 aa, Staphylococcus epidermidis
GEIDPVIRFYTWDPATLSIGYFQRLQ

SEQ ID NO: 1827476 - protein, 27 aa, Staphylococcus epidermidis
GEIDPVIRFYTWNPATLSIGYFQRLQK

SEQ ID NO: 1827477 - protein, 18 aa, Staphylococcus epidermidis
GEIHLDINFALYGNGTDS

SEQ ID NO: 1827478 - protein, 19 aa, Staphylococcus epidermidis
GEIKLINSTVPFGVIPETN

SEQ ID NO: 1827479 - protein, 23 aa, Staphylococcus epidermidis
GEKLELALMLEKAGIETIETGFP

SEQ ID NO: 1827480 - protein, 17 aa, Staphylococcus epidermidis
GEKVTFLDKPPSAWVVL

SEQ ID NO: 1827481 - protein, 27 aa, Staphylococcus epidermidis
GEKYKQWIADKILIPTPFTLESKATLS

SEQ ID NO: 1827482 - protein, 23 aa, Staphylococcus epidermidis
GELPHNVVFIFQPAEETGGGANR

SEQ ID NO: 1827483 - protein, 17 aa, Staphylococcus epidermidis
GEMLDMLTTDNGLTRLI

SEQ ID NO: 1827484 - protein, 29 aa, Staphylococcus epidermidis
GEMTNQLLNNLRFSKMFFSSNGVKDGVAM

SEQ ID NO: 1827485 - protein, 22 aa, Staphylococcus epidermidis
GENNSIDGFFRIRRMAMTDTPN

SEQ ID NO: 1827486 - protein, 27 aa, Staphylococcus epidermidis
GENRLKLIHHWINGRMPLVGIGSVFTP

SEQ ID NO: 1827487 - protein, 28 aa, Staphylococcus epidermidis
GENRLKLIHQWINGRMPLIGIGSVFTAE

SEQ ID NO: 1827488 - protein, 26 aa, Staphylococcus epidermidis
GEPDEVWQERLKLLEPYRVNKELMEK

SEQ ID NO: 1827489 - protein, 20 aa, Staphylococcus epidermidis
GEPVYCALMKGTFSLDSMEF

SEQ ID NO: 1827490 - protein, 32 aa, Staphylococcus epidermidis
GEPYKVFTSFYKKWRPYLMKRSVFSYDIKDIA

SEQ ID NO: 1827491 - protein, 25 aa, Staphylococcus epidermidis
GEQFEEWIAKKILLPTPFTIESKAT

SEQ ID NO: 1827492 - protein, 23 aa, Staphylococcus epidermidis
GEQKLKYNPYNYGYAVALEDEQP

SEQ ID NO: 1827493 - protein, 29 aa, Staphylococcus epidermidis
GEQRLTEAKIKADKFIKQLDALNDAQTDA

SEQ ID NO: 1827494 - protein, 23 aa, Staphylococcus epidermidis
GETEYLELLYKLIQHAQFDMLDI

SEQ ID NO: 1827495 - protein, 19 aa, Staphylococcus epidermidis
GEVDKQIALAKQLNDDMGT

SEQ ID NO: 1827496 - protein, 17 aa, Staphylococcus epidermidis
GFAFLRPEDDEMDDIFI

SEQ ID NO: 1827497 - protein, 18 aa, Staphylococcus epidermidis
GFEDIFSSFFGGGSRQRD

SEQ ID NO: 1827498 - protein, 31 aa, Staphylococcus epidermidis
GFEQDTVWLSVLPIYHISGLSVILRAVIEGF

SEQ ID NO: 1827499 - protein, 25 aa, Staphylococcus epidermidis
GFESYPPFLEIAPEPFEEEALAHYL

SEQ ID NO: 1827500 - protein, 40 aa, Staphylococcus epidermidis
GFGDEVKRRIFLGTFALSSGYYDAFYKKSQKVRTLIKNDF

SEQ ID NO: 1827501 - protein, 20 aa, Staphylococcus epidermidis
GFGIHFAMDYLTEQTQYLNG

SEQ ID NO: 1827502 - protein, 20 aa, Staphylococcus epidermidis
GFGRIGRLAFRSMLDMENVE

SEQ ID NO: 1827503 - protein, 24 aa, Staphylococcus epidermidis
GFIVYNGIRIINVKDLVLPGEHNL

SEQ ID NO: 1827504 - protein, 26 aa, Staphylococcus epidermidis
GFKDSNIIFYFMPHLYEYSNDLTENE

SEQ ID NO: 1827505 - protein, 18 aa, Staphylococcus epidermidis
GFKDVYLGLPTLINQNGA

SEQ ID NO: 1827506 - protein, 18 aa, Staphylococcus epidermidis
GFKDYVALLFQKGAILED

SEQ ID NO: 1827507 - protein, 17 aa, Staphylococcus epidermidis
GFKGFWDEVNGFNYDFF

SEQ ID NO: 1827508 - protein, 18 aa, Staphylococcus epidermidis
GFLARPFVRDKDAIQIVP

SEQ ID NO: 1827509 - protein, 20 aa, Staphylococcus epidermidis
GFLDHMLTLFTFHSGLTLNI

SEQ ID NO: 1827510 - protein, 17 aa, Staphylococcus epidermidis
GFLFLDADDEFLPSRID

SEQ ID NO: 1827511 - protein, 19 aa, Staphylococcus epidermidis
GFLKHLNDLIPKAEAVVIS

SEQ ID NO: 1827512 - protein, 28 aa, Staphylococcus epidermidis
GFNKSEAMIILFPKLFHNQDKAMRWYQR

SEQ ID NO: 1827513 - protein, 21 aa, Staphylococcus epidermidis
GFNVAPTINAVFRMGTQDELT

SEQ ID NO: 1827514 - protein, 29 aa, Staphylococcus epidermidis
GFQCFDVANQYWLYLFGHTLKGVGAADIP

SEQ ID NO: 1827515 - protein, 30 aa, Staphylococcus epidermidis
GFQKFIAGSLNGWYDRHGYKRFTKAYISMS

SEQ ID NO: 1827516 - protein, 24 aa, Staphylococcus epidermidis
GFTRLLNNIFISRGDTRLLSNIFK

SEQ ID NO: 1827517 - protein, 43 aa, Staphylococcus epidermidis
GFVQKFTEGFTALPGWVRKSAIALTILTATIGPMLVAGGLLAG

SEQ ID NO: 1827518 - protein, 18 aa, Staphylococcus epidermidis
GFYWCRKMRQESNVPILF

SEQ ID NO: 1827519 - protein, 17 aa, Staphylococcus epidermidis
GGAIMLAARACVYSGSG

SEQ ID NO: 1827520 - protein, 20 aa, Staphylococcus epidermidis
GGAKSKFWLQLQADIFNMEV

SEQ ID NO: 1827521 - protein, 24 aa, Staphylococcus epidermidis
GGDDYQLIDILSETLQDIGIKVEG

SEQ ID NO: 1827522 - protein, 69 aa, Staphylococcus epidermidis
GGDKELPYLDLPKEINPFLGYRAIRLCLAQPEIFRPQLRALLRASVYGKLNIMFPMVATIKEFRDAKSM

SEQ ID NO: 1827523 - protein, 69 aa, Staphylococcus epidermidis
GGDKELPYLDLPKEMNPFLGYRAIRLCLAQPEIFRPQLRALLRASVYGKLNIMFPMVATIKEFRDAKSI

SEQ ID NO: 1827524 - protein, 18 aa, Staphylococcus epidermidis
GGGWNAIFWCNHDQPRVV

SEQ ID NO: 1827525 - protein, 24 aa, Staphylococcus epidermidis
GGHQWKSWKPLLGDILLQFLSNQI

SEQ ID NO: 1827526 - protein, 29 aa, Staphylococcus epidermidis
GGIVLAIRNELHIPVKYVGLGEKLDDLQP

SEQ ID NO: 1827527 - protein, 26 aa, Staphylococcus epidermidis
GGMGTALLAFLDAKLQPGIELVLEET

SEQ ID NO: 1827528 - protein, 24 aa, Staphylococcus epidermidis
GGPHGDLYVVFRVQPSDTFERDGD

SEQ ID NO: 1827529 - protein, 23 aa, Staphylococcus epidermidis
GGQFQRVWIAKALIVEPQVLILD

SEQ ID NO: 1827530 - protein, 17 aa, Staphylococcus epidermidis
GGQIIFGANLQIGYYDQ

SEQ ID NO: 1827531 - protein, 34 aa, Staphylococcus epidermidis
GGQQAGLFGGPLYTFHKIFSIIILSRQLSEKYDT

SEQ ID NO: 1827532 - protein, 28 aa, Staphylococcus epidermidis
GGQQAGLFGGPLYTFHKIFSIVTLCNEL

SEQ ID NO: 1827533 - protein, 32 aa, Staphylococcus epidermidis
GGRHTPFFSNYRPQFYFRTTDVTGVVNLPEGT

SEQ ID NO: 1827534 - protein, 20 aa, Staphylococcus epidermidis
GGRYNGLLQLLDGPSETGIG

SEQ ID NO: 1827535 - protein, 24 aa, Staphylococcus epidermidis
GGTINILTYNFTDKSYFLSGEEAE

SEQ ID NO: 1827536 - protein, 24 aa, Staphylococcus epidermidis
GGTQMLFYYRSLVEKERRLTTLEY

SEQ ID NO: 1827537 - protein, 22 aa, Staphylococcus epidermidis
GGTYHYQRMQVLLDDLSKTDGL

SEQ ID NO: 1827538 - protein, 25 aa, Staphylococcus epidermidis
GGVDDLISLFLLLQMEDVDLIGVST

SEQ ID NO: 1827539 - protein, 25 aa, Staphylococcus epidermidis
GGVGPLTITMVLNNTLLAEKMRRGI

SEQ ID NO: 1827540 - protein, 24 aa, Staphylococcus epidermidis
GGVTKFPHFILMAKNRKGFEALSK

SEQ ID NO: 1827541 - protein, 23 aa, Staphylococcus epidermidis
GGYGAIKFALTQSYRFSKAAMLS

SEQ ID NO: 1827542 - protein, 28 aa, Staphylococcus epidermidis
GGYTKIATVTLLDLKKLAQLKPGETIHF

SEQ ID NO: 1827543 - protein, 27 aa, Staphylococcus epidermidis
GHDAHTAYMLILGETLIEMKDQFKGKI

SEQ ID NO: 1827544 - protein, 19 aa, Staphylococcus epidermidis
GHFGIFSFNGNKIITTSGG

SEQ ID NO: 1827545 - protein, 19 aa, Staphylococcus epidermidis
GHGTLAWVPAKEGLTPQEV

SEQ ID NO: 1827546 - protein, 26 aa, Staphylococcus epidermidis
GHKGAKLMGYYQDELYEYAKNLDAKM

SEQ ID NO: 1827547 - protein, 20 aa, Staphylococcus epidermidis
GHLYYMYTGNHRDHHWDRVS

SEQ ID NO: 1827548 - protein, 32 aa, Staphylococcus epidermidis; identical to SEQ ID NO: 1680328

SEQ ID NO: 1827549 - protein, 17 aa, Staphylococcus epidermidis
GHPLDNNLLIKLIEYFE

SEQ ID NO: 1827550 - protein, 24 aa, Staphylococcus epidermidis
GHQLKRHGFFYAPTVLDNVRKDDN

SEQ ID NO: 1827551 - protein, 25 aa, Staphylococcus epidermidis
GHQLKRHGFFYAPTVLDNVRKDDNV

SEQ ID NO: 1827552 - protein, 24 aa, Staphylococcus epidermidis
GHQLKRHGFFYAPTVLDNVRKDDS

SEQ ID NO: 1827553 - protein, 20 aa, Staphylococcus epidermidis
GHQVNKLVRIQFGPIDLKGL

SEQ ID NO: 1827554 - protein, 24 aa, Staphylococcus epidermidis
GHSKTIWIWTGFLFEYLKHQTDER

SEQ ID NO: 1827555 - protein, 26 aa, Staphylococcus epidermidis
GHTKTIWVWTGFLFEYLKQQNDARKS

SEQ ID NO: 1827556 - protein, 23 aa, Staphylococcus epidermidis
GHTTALMLFVTRCKAMADKGELP

SEQ ID NO: 1827557 - protein, 22 aa, Staphylococcus epidermidis
GHTYPYQHILLATGFVNQLGAQ

SEQ ID NO: 1827558 - protein, 26 aa, Staphylococcus epidermidis
GHWGEFVPFFLERMDDILFADHLEHP

SEQ ID NO: 1827559 - protein, 22 aa, Staphylococcus epidermidis
GHYRGIATWEYDKDRGKLIGTI

SEQ ID NO: 1827560 - protein, 20 aa, Staphylococcus epidermidis
GIAIVKLLHSYGVRDMIMCD

SEQ ID NO: 1827561 - protein, 23 aa, Staphylococcus epidermidis
GIAMGHIGMRYSLPSREIIADAA

SEQ ID NO: 1827562 - protein, 20 aa, Staphylococcus epidermidis
GIARAIALRPKLIVADEPVS

SEQ ID NO: 1827563 - protein, 17 aa, Staphylococcus epidermidis
GIDLKKANALLLEEAGV

SEQ ID NO: 1827564 - protein, 20 aa, Staphylococcus epidermidis
GIDPSLRKEIWKQLRELTNK

SEQ ID NO: 1827565 - protein, 19 aa, Staphylococcus epidermidis
GIDTNFNFLTLAPGYNEIE

SEQ ID NO: 1827566 - protein, 18 aa, Staphylococcus epidermidis
GIEAAFKSYFKQFEENYG

SEQ ID NO: 1827567 - protein, 20 aa, Staphylococcus epidermidis
GIECIYALYKKNRRSLQIYG

SEQ ID NO: 1827568 - protein, 25 aa, Staphylococcus epidermidis
GIENYSVHLTLRPLGSTPYTLLDYF

SEQ ID NO: 1827569 - protein, 24 aa, Staphylococcus epidermidis
GIFAFDNQVLFDKLAQVKNDNAQG

SEQ ID NO: 1827570 - protein, 18 aa, Staphylococcus epidermidis
GIGFKGFWDNDAGFNYEF

SEQ ID NO: 1827571 - protein, 26 aa, Staphylococcus epidermidis
GIGGLNNAFGFKLDTYHNTSPPKSDA

SEQ ID NO: 1827572 - protein, 22 aa, Staphylococcus epidermidis
GIGKDYPLSREKLSPLLAMVTA

SEQ ID NO: 1827573 - protein, 19 aa, Staphylococcus epidermidis
GIGKRTIELLPSYVKDCYP

SEQ ID NO: 1827574 - protein, 17 aa, Staphylococcus epidermidis
GIGLYKAITLKAAFELG

SEQ ID NO: 1827575 - protein, 19 aa, Staphylococcus epidermidis
GIGLYRTEFLYMGRDQMPT

SEQ ID NO: 1827576 - protein, 20 aa, Staphylococcus epidermidis
GIHEGEIVKWFIKAGDTIEE

SEQ ID NO: 1827577 - protein, 18 aa, Staphylococcus epidermidis
GIHNKDDIKRSSAYVNAD

SEQ ID NO: 1827578 - protein, 19 aa, Staphylococcus epidermidis
GIHPEWLYCAKANLVLEPA

SEQ ID NO: 1827579 - protein, 35 aa, Staphylococcus epidermidis
GIIEKLDYLKYLGVDYLWLTPIYESPMNDNGYDIS

SEQ ID NO: 1827580 - protein, 17 aa, Staphylococcus epidermidis
GIILNKIEINQPSWMQI

SEQ ID NO: 1827581 - protein, 28 aa, Staphylococcus epidermidis
GIKCVMIAKLPFMNKHNTKYWLMDTEFT

SEQ ID NO: 1827582 - protein, 26 aa, Staphylococcus epidermidis
GIKDVVEQQFEFAKKIIAKGLVPIIE

SEQ ID NO: 1827583 - protein, 18 aa, Staphylococcus epidermidis
GIKKQMDAILLPDELDDL

SEQ ID NO: 1827584 - protein, 32 aa, Staphylococcus epidermidis
GIKSLKISFNKVFGYFIEITRANLQGFEPSEF

SEQ ID NO: 1827585 - protein, 17 aa, Staphylococcus epidermidis
GINLRYPEGFEFEEAIE

SEQ ID NO: 1827586 - protein, 24 aa, Staphylococcus epidermidis
GINRFHPDYYITVSWQRLREGKNI

SEQ ID NO: 1827587 - protein, 18 aa, Staphylococcus epidermidis
GIPVSKLNKILKGKGTLS

SEQ ID NO: 1827588 - protein, 17 aa, Staphylococcus epidermidis
GIQIGTDIPFCIYNKTA

SEQ ID NO: 1827589 - protein, 17 aa, Staphylococcus epidermidis
GISNKNMLYRLGALGLN

SEQ ID NO: 1827590 - protein, 24 aa, Staphylococcus epidermidis
GITKDNLLMRMKEQEWDDVIDTNL

SEQ ID NO: 1827591 - protein, 18 aa, Staphylococcus epidermidis
GITQINPLKYNNLPHWRH

SEQ ID NO: 1827592 - protein, 18 aa, Staphylococcus epidermidis
GIVLLNKDNIVYLGIYDG

SEQ ID NO: 1827593 - protein, 25 aa, Staphylococcus epidermidis
GIYNKPSYRLVSINNVNVIFIKGAI

SEQ ID NO: 1827594 - protein, 19 aa, Staphylococcus epidermidis
GIYYYIHVDAAYGGYGRSI

SEQ ID NO: 1827595 - protein, 17 aa, Staphylococcus epidermidis
GKALHVAGFLKNNIRRI

SEQ ID NO: 1827596 - protein, 24 aa, Staphylococcus epidermidis
GKANNLYIKLPKPFHIKELKNCRV

SEQ ID NO: 1827597 - protein, 27 aa, Staphylococcus epidermidis
GKAQHVVNFMYFIAEELREILASLGLE

SEQ ID NO: 1827598 - protein, 22 aa, Staphylococcus epidermidis
GKDGEHLDLLSKIAITFSEEEN

SEQ ID NO: 1827599 - protein, 23 aa, Staphylococcus epidermidis
GKEAAFHMNQIQDKVRQISAEAE

SEQ ID NO: 1827600 - protein, 18 aa, Staphylococcus epidermidis
GKERLNYGASWFESNHLY

SEQ ID NO: 1827601 - protein, 23 aa, Staphylococcus epidermidis
GKGLLCVYEGFLKGLKGEKVEAK

SEQ ID NO: 1827602 - protein, 40 aa, Staphylococcus epidermidis
GKGLWMSLVLRPNVPFALIPKFNLFIALGIRDAIQQFSND

SEQ ID NO: 1827603 - protein, 23 aa, Staphylococcus epidermidis
GKGQLFYVYEIIDGWCRVHGPSD

SEQ ID NO: 1827604 - protein, 24 aa, Staphylococcus epidermidis
GKGTKKYFRFAFPIIDENGEKIII

SEQ ID NO: 1827605 - protein, 19 aa, Staphylococcus epidermidis
GKIVFYRLVSNHVHHLMQE

SEQ ID NO: 1827606 - protein, 17 aa, Staphylococcus epidermidis
GKKLAVVPILRAGLGMT

SEQ ID NO: 1827607 - protein, 24 aa, Staphylococcus epidermidis
GKKVKLNMILNAKSGICSEDCGYC

SEQ ID NO: 1827608 - protein, 20 aa, Staphylococcus epidermidis
GKMAFRVYPTWEKDLNRVAQ

SEQ ID NO: 1827609 - protein, 20 aa, Staphylococcus epidermidis
GKNELDKLDWAPADVPAVRR

SEQ ID NO: 1827610 - protein, 32 aa, Staphylococcus epidermidis
GKPFSISSITYILANPFYIGKIQFAKYKDWSE

SEQ ID NO: 1827611 - protein, 26 aa, Staphylococcus epidermidis
GKQKYSFQDLPQFTPEIFMKVSAKNV

SEQ ID NO: 1827612 - protein, 18 aa, Staphylococcus epidermidis
GKQVLVYFGLFKDARKKL

SEQ ID NO: 1827613 - protein, 18 aa, Staphylococcus epidermidis
GKQYLQTLTHLNDAQRNA

SEQ ID NO: 1827614 - protein, 24 aa, Staphylococcus epidermidis
GKRSVARYIFFEKALKVIRPVYLN

SEQ ID NO: 1827615 - protein, 17 aa, Staphylococcus epidermidis
GKSLLTRTILGMKPSQL

SEQ ID NO: 1827616 - protein, 21 aa, Staphylococcus epidermidis
GKSQRVLVFAKGDKITEAEEA

SEQ ID NO: 1827617 - protein, 27 aa, Staphylococcus epidermidis
GKSTLLKIILGLLPLQKGEIFVEGHLY

SEQ ID NO: 1827618 - protein, 22 aa, Staphylococcus epidermidis
GKTECWYILDAEPGAEIIYGVD

SEQ ID NO: 1827619 - protein, 27 aa, Staphylococcus epidermidis
GKTLLISGMALYDLLMGKDPLNERLIG

SEQ ID NO: 1827620 - protein, 17 aa, Staphylococcus epidermidis
GKTLLMLSGGIDSPVAG

SEQ ID NO: 1827621 - protein, 17 aa, Staphylococcus epidermidis
GKTLYKLSRFSFVDEII

SEQ ID NO: 1827622 - protein, 25 aa, Staphylococcus epidermidis
GKTQVEVILDLKLIFSTNAILNFPP

SEQ ID NO: 1827623 - protein, 22 aa, Staphylococcus epidermidis
GKTSLMKVILGYSSYQDGTFRI

SEQ ID NO: 1827624 - protein, 27 aa, Staphylococcus epidermidis
GKTTLMNHAISFLKERGYSVATIKHNG

SEQ ID NO: 1827625 - protein, 22 aa, Staphylococcus epidermidis
GKVDTIFLHCLPAFHDTQTEYG

SEQ ID NO: 1827626 - protein, 22 aa, Staphylococcus epidermidis
GKVNTIFLHCLPAFHDTQTEYG

SEQ ID NO: 1827627 - protein, 17 aa, Staphylococcus epidermidis
GKWSYLYRAIDTEGHTL

SEQ ID NO: 1827628 - protein, 23 aa, Staphylococcus epidermidis
GKYEPMIGTMSLVPQVVDAVSLP

SEQ ID NO: 1827629 - protein, 20 aa, Staphylococcus epidermidis
GKYFGPYPNAYSAQETKKLL

SEQ ID NO: 1827630 - protein, 17 aa, Staphylococcus epidermidis
GKYTGDYLADKGVVPFL

SEQ ID NO: 1827631 - protein, 19 aa, Staphylococcus epidermidis
GLAITGVSFVLEKVVGSFN

SEQ ID NO: 1827632 - protein, 20 aa, Staphylococcus epidermidis
GLDFEHAALLYDFTFERFES

SEQ ID NO: 1827633 - protein, 17 aa, Staphylococcus epidermidis
GLDMILEKIIGIDINNI

SEQ ID NO: 1827634 - protein, 33 aa, Staphylococcus epidermidis
GLDQNAIQYPAIPSVLYSLPRLSQIGVTVSEAQ

SEQ ID NO: 1827635 - protein, 26 aa, Staphylococcus epidermidis
GLDYIDLFLIHWPCEKDGLFIESYKA

SEQ ID NO: 1827636 - protein, 19 aa, Staphylococcus epidermidis
GLEEYLITKHILTNTNPEP

SEQ ID NO: 1827637 - protein, 24 aa, Staphylococcus epidermidis
GLEFPIVFIMGMEESLFPHIRAIK

SEQ ID NO: 1827638 - protein, 17 aa, Staphylococcus epidermidis
GLELLDKGIARTGYEVL

SEQ ID NO: 1827639 - protein, 20 aa, Staphylococcus epidermidis
GLEPWHFVVVQSETLRDKLK

SEQ ID NO: 1827640 - protein, 22 aa, Staphylococcus epidermidis
GLFDAIHTIKGSLRIFEGMVAS

SEQ ID NO: 1827641 - protein, 17 aa, Staphylococcus epidermidis
GLFGSPIKWNFTKFIID

SEQ ID NO: 1827642 - protein, 22 aa, Staphylococcus epidermidis
GLFHIGILLPELSSLADLLVQL

SEQ ID NO: 1827643 - protein, 24 aa, Staphylococcus epidermidis
GLGAIPYHHPLFLGMGGMHGSYAS

SEQ ID NO: 1827644 - protein, 24 aa, Staphylococcus epidermidis
GLGFKSFWEENEGFHYDLFDKVDD

SEQ ID NO: 1827645 - protein, 18 aa, Staphylococcus epidermidis
GLGLGFLSIYYELKENIY

SEQ ID NO: 1827646 - protein, 31 aa, Staphylococcus epidermidis
GLGNLKNLSYQQLLKVWGHTFQYIKAEHINE

SEQ ID NO: 1827647 - protein, 18 aa, Staphylococcus epidermidis
GLGYLLSNLTDYTELTNL

SEQ ID NO: 1827648 - protein, 20 aa, Staphylococcus epidermidis
GLHAVWSHLVAHKLYNKKRY

SEQ ID NO: 1827649 - protein, 37 aa, Staphylococcus epidermidis
GLHPYGATFFVFSDYLKPALRLSAIMGLNSTFIFTHD

SEQ ID NO: 1827650 - protein, 23 aa, Staphylococcus epidermidis
GLIEAILAVRDIENIHIASRTFE

SEQ ID NO: 1827651 - protein, 20 aa, Staphylococcus epidermidis
GLIKLDGLPLNQLKNKDIAR

SEQ ID NO: 1827652 - protein, 17 aa, Staphylococcus epidermidis
GLKKLYEELFGAKTLYI

SEQ ID NO: 1827653 - protein, 18 aa, Staphylococcus epidermidis
GLKNLFKIVSASLVQYYY

SEQ ID NO: 1827654 - protein, 24 aa, Staphylococcus epidermidis
GLKPVQRRILFAMYSSGNTFDKNF

SEQ ID NO: 1827655 - protein, 23 aa, Staphylococcus epidermidis
GLKRIGLNVIWIIKDVPLKDKYV

SEQ ID NO: 1827656 - protein, 27 aa, Staphylococcus epidermidis
GLKVEGLYPYHIYTYIINELMGKPIEK

SEQ ID NO: 1827657 - protein, 18 aa, Staphylococcus epidermidis
GLLGVCIPHQDKTMDYAI

SEQ ID NO: 1827658 - protein, 21 aa, Staphylococcus epidermidis
GLLLKKHGQKLYDAGLRRINV

SEQ ID NO: 1827659 - protein, 18 aa, Staphylococcus epidermidis
GLNFNREGQLFLLDVFEG

SEQ ID NO: 1827660 - protein, 24 aa, Staphylococcus epidermidis
GLNKPNRLYLLKPNYDIEASHIKE

SEQ ID NO: 1827661 - protein, 25 aa, Staphylococcus epidermidis
GLNKPNRLYLLKPNYDIKASHSKEL

SEQ ID NO: 1827662 - protein, 25 aa, Staphylococcus epidermidis
GLNKPNRLYLLKPNYNIKASHTKEL

SEQ ID NO: 1827663 - protein, 17 aa, Staphylococcus epidermidis
GLNRAKATYKFAGGKGI

SEQ ID NO: 1827664 - protein, 26 aa, Staphylococcus epidermidis
GLNREDLFITSKLWLEDYGRANVDQA

SEQ ID NO: 1827665 - protein, 23 aa, Staphylococcus epidermidis
GLNRRLMIVPFKAKFTNTDIDYD

SEQ ID NO: 1827666 - protein, 28 aa, Staphylococcus epidermidis
GLNSNWDMLFIVFSIHLIDIAKQLKKPL

SEQ ID NO: 1827667 - protein, 32 aa, Staphylococcus epidermidis
GLNTEAIQYPPIPSVLYSLPRLSQIGVTVSEA

SEQ ID NO: 1827668 - protein, 27 aa, Staphylococcus epidermidis
GLNTKVIIVTTFKRPGYFEKAVANGVD

SEQ ID NO: 1827669 - protein, 27 aa, Staphylococcus epidermidis
GLPSFTYTFLGFLPRKEKEKIDVLQLR

SEQ ID NO: 1827670 - protein, 18 aa, Staphylococcus epidermidis
GLQSFLEKLLYPKKVYQR

SEQ ID NO: 1827671 - protein, 18 aa, Staphylococcus epidermidis
GLRLSQFYKELMVSTGSL

SEQ ID NO: 1827672 - protein, 23 aa, Staphylococcus epidermidis
GLRVGIIRDWEAKWYAEKDFASL

SEQ ID NO: 1827673 - protein, 24 aa, Staphylococcus epidermidis
GLSNSQLLTLYRTKPKRIKLKWSS

SEQ ID NO: 1827674 - protein, 21 aa, Staphylococcus epidermidis
GLSQMHVSRLQRTAIKKLQEA

SEQ ID NO: 1827675 - protein, 19 aa, Staphylococcus epidermidis
GLTALFWNHGHLASELEAG

SEQ ID NO: 1827676 - protein, 18 aa, Staphylococcus epidermidis
GLTALMASGLPSFTYTFL

SEQ ID NO: 1827677 - protein, 27 aa, Staphylococcus epidermidis
GLTYSQYLVLLVLWENDEQPLNVIGQQ

SEQ ID NO: 1827678 - protein, 22 aa, Staphylococcus epidermidis
GMALTPPMVPTTGRYGFDIEDN

SEQ ID NO: 1827679 - protein, 26 aa, Staphylococcus epidermidis
GMELGQLFHHLGSEITLMQRSERLLK

SEQ ID NO: 1827680 - protein, 18 aa, Staphylococcus epidermidis
GMERQLVVDFYADQGLTE

SEQ ID NO: 1827681 - protein, 18 aa, Staphylococcus epidermidis
GMEYLTEGAELFGYIYYA

SEQ ID NO: 1827682 - protein, 21 aa, Staphylococcus epidermidis
GMGGPLIAKILNDGKDKLVNH

SEQ ID NO: 1827683 - protein, 19 aa, Staphylococcus epidermidis
GMIIYLPQEGRGIGLMNKL

SEQ ID NO: 1827684 - protein, 18 aa, Staphylococcus epidermidis
GMINVLNYLFDHLSLEHI

SEQ ID NO: 1827685 - protein, 26 aa, Staphylococcus epidermidis
GMKQKLGIAIAFLNSPKLIILDEPMN

SEQ ID NO: 1827686 - protein, 27 aa, Staphylococcus epidermidis
GMKQKVMIICAFIVDPELYIIDEPFLG

SEQ ID NO: 1827687 - protein, 21 aa, Staphylococcus epidermidis
GMKQRLGIALALLCGPDILVL

SEQ ID NO: 1827688 - protein, 26 aa, Staphylococcus epidermidis
GMKRRLSLAISFLQNPNILILDEPTV

SEQ ID NO: 1827689 - protein, 24 aa, Staphylococcus epidermidis
GMRSKRAMKILLKQGHDVINVRDG

SEQ ID NO: 1827690 - protein, 28 aa, Staphylococcus epidermidis
GMSRQHHRFLFFINKLPGITIKELLITL

SEQ ID NO: 1827691 - protein, 28 aa, Staphylococcus epidermidis
GMTCMFQSKRMLLGNYYTFQDRQMKIQR

SEQ ID NO: 1827692 - protein, 22 aa, Staphylococcus epidermidis
GMTLMDGVIFPDKFKRYEASIS

SEQ ID NO: 1827693 - protein, 19 aa, Staphylococcus epidermidis
GMVCPFPLIEAQKKMNDLN

SEQ ID NO: 1827694 - protein, 19 aa, Staphylococcus epidermidis
GMVCPFPLIEAQKKMQELN

SEQ ID NO: 1827695 - protein, 17 aa, Staphylococcus epidermidis
GMVFQDFALWPHMSVFQ

SEQ ID NO: 1827696 - protein, 25 aa, Staphylococcus epidermidis
GMVKQWQDKFFNKRFSHSVFNDQPN

SEQ ID NO: 1827697 - protein, 25 aa, Staphylococcus epidermidis
GMVKQWQDKFFNQRFSHSVFNDQPD

SEQ ID NO: 1827698 - protein, 32 aa, Staphylococcus epidermidis
GMVMADGPERFWPADLVLLSIGFVGTETTIPH

SEQ ID NO: 1827699 - protein, 21 aa, Staphylococcus epidermidis
GMYTYAFNLSYFDGNLDLLKT

SEQ ID NO: 1827700 - protein, 19 aa, Staphylococcus epidermidis
GNDTFLNFVQKDKKSFVLF

SEQ ID NO: 1827701 - protein, 24 aa, Staphylococcus epidermidis
GNDYPKWIFKKFEEIFKVVPSKKY

SEQ ID NO: 1827702 - protein, 29 aa, Staphylococcus epidermidis
GNELPISAGFFIINPFEVVYYAGGTSNRY

SEQ ID NO: 1827703 - protein, 34 aa, Staphylococcus epidermidis
GNFELNVFKPVILHNTLQSIYLLADGMQTFNDNC

SEQ ID NO: 1827704 - protein, 32 aa, Staphylococcus epidermidis
GNFELNVFKPVIMHNTLQSIYLLADGMNTFNK

SEQ ID NO: 1827705 - protein, 19 aa, Staphylococcus epidermidis
GNHKKQFYVTLKLNNEIIK

SEQ ID NO: 1827706 - protein, 25 aa, Staphylococcus epidermidis
GNIAVPLDLPALFKGYYKDEERTKA

SEQ ID NO: 1827707 - protein, 24 aa, Staphylococcus epidermidis
GNISREILPIKVKGAWFDRDESIK

SEQ ID NO: 1827708 - protein, 23 aa, Staphylococcus epidermidis
GNKIDWKSLYEKSLNHDFAEVFT

SEQ ID NO: 1827709 - protein, 19 aa, Staphylococcus epidermidis
GNKLIFSGFRRGGQFVSKK

SEQ ID NO: 1827710 - protein, 33 aa, Staphylococcus epidermidis
GNKLVKFLKRKNLLYTYQNFLRYPPKNPRENGL

SEQ ID NO: 1827711 - protein, 17 aa, Staphylococcus epidermidis
GNKNGMEYLTEGAELFG

SEQ ID NO: 1827712 - protein, 24 aa, Staphylococcus epidermidis
GNLDPSILLAPWDVIESRLKDILN

SEQ ID NO: 1827713 - protein, 23 aa, Staphylococcus epidermidis
GNMRIMSRILPHSIPERYHLTLI

SEQ ID NO: 1827714 - protein, 18 aa, Staphylococcus epidermidis
GNMRIMSRILPNSIPEGY

SEQ ID NO: 1827715 - protein, 25 aa, Staphylococcus epidermidis
GNPLLDKFMKDLIIQILAMVSEQER

SEQ ID NO: 1827716 - protein, 22 aa, Staphylococcus epidermidis
GNQTVYVKTPWGSLIELQTVPN

SEQ ID NO: 1827717 - protein, 23 aa, Staphylococcus epidermidis
GNSGVILSQLFRGFCKNIENEKE

SEQ ID NO: 1827718 - protein, 26 aa, Staphylococcus epidermidis
GNSLSFRAFYALPLLSNHAGIHTNAV

SEQ ID NO: 1827719 - protein, 30 aa, Staphylococcus epidermidis; identical to SEQ ID NO: 1681042

SEQ ID NO: 1827720 - protein, 27 aa, Staphylococcus epidermidis
GNTNTYPQLGRLIGFIPKESAVEVCEK

SEQ ID NO: 1827721 - protein, 24 aa, Staphylococcus epidermidis
GNTYDYYKFSNGHEFRHGCDCELI

SEQ ID NO: 1827722 - protein, 24 aa, Staphylococcus epidermidis
GNTYDYYKFSNGHEFRHGCDCTMI

SEQ ID NO: 1827723 - protein, 26 aa, Staphylococcus epidermidis
GNVDVQYIIRLIPFGSLEHTKDVITL

SEQ ID NO: 1827724 - protein, 22 aa, Staphylococcus epidermidis
GNVHGMPLRILAGDGPDELVHL

SEQ ID NO: 1827725 - protein, 20 aa, Staphylococcus epidermidis
GNVVFIFQYGEEIMPGGSQE

SEQ ID NO: 1827726 - protein, 19 aa, Staphylococcus epidermidis
GNYRTIWRNVSSKLSDIKA

SEQ ID NO: 1827727 - protein, 21 aa, Staphylococcus epidermidis
GPEALYQMIDHFYYLVERDER

SEQ ID NO: 1827728 - protein, 29 aa, Staphylococcus epidermidis
GPEREIRLRPSYFPFTEPSVEVDISCFKC

SEQ ID NO: 1827729 - protein, 20 aa, Staphylococcus epidermidis
GPFNFKIIKDINWEELFISQ

SEQ ID NO: 1827730 - protein, 26 aa, Staphylococcus epidermidis
GPGGLMLGLLLQQQGFEVSIFEKAGL

SEQ ID NO: 1827731 - protein, 25 aa, Staphylococcus epidermidis
GPKDRIIKPLTYLYEKGLERDGLVN

SEQ ID NO: 1827732 - protein, 21 aa, Staphylococcus epidermidis
GPKGVGLLLVKEYTPIAYNQL

SEQ ID NO: 1827733 - protein, 26 aa, Staphylococcus epidermidis
GPKLSMAIYQFYMSDTLKILDENPYQ

SEQ ID NO: 1827734 - protein, 18 aa, Staphylococcus epidermidis
GPKYIADYMEKLLGEVMA

SEQ ID NO: 1827735 - protein, 17 aa, Staphylococcus epidermidis
GPLIAKILNDGKDKLVN

SEQ ID NO: 1827736 - protein, 23 aa, Staphylococcus epidermidis
GPMYEEYLYIDKILDGIAKNENY

SEQ ID NO: 1827737 - protein, 23 aa, Staphylococcus epidermidis
GPRGLSILERLACRFENLSLNHH

SEQ ID NO: 1827738 - protein, 28 aa, Staphylococcus epidermidis
GPSMISQLRLYIHDVPIVAIGGINETNV

SEQ ID NO: 1827739 - protein, 25 aa, Staphylococcus epidermidis
GPVNNGGVILRWLRDEILASEVETA

SEQ ID NO: 1827740 - protein, 19 aa, Staphylococcus epidermidis
GPYYAGVTACYLLVNRSIR

SEQ ID NO: 1827741 - protein, 26 aa, Staphylococcus epidermidis
GQALINAIEAWSLNHKIRRIEATVVT

SEQ ID NO: 1827742 - protein, 19 aa, Staphylococcus epidermidis
GQFFVGRYSINANKEIKQS

SEQ ID NO: 1827743 - protein, 23 aa, Staphylococcus epidermidis
GQGALPVGLLPKIVVDDKEYVVP

SEQ ID NO: 1827744 - protein, 17 aa, Staphylococcus epidermidis
GQGIHYFKVNDLTIGTI

SEQ ID NO: 1827745 - protein, 21 aa, Staphylococcus epidermidis
GQGLLLIKNIQNIEPVIHGGG

SEQ ID NO: 1827746 - protein, 35 aa, Staphylococcus epidermidis
GQIKGVGQLLFKKIPKLPYTLCYVSRGFVADYNNK

SEQ ID NO: 1827747 - protein, 19 aa, Staphylococcus epidermidis
GQILRPDIVLYGEMLNQNT

SEQ ID NO: 1827748 - protein, 17 aa, Staphylococcus epidermidis
GQKPRHLYQWFGQTMRT

SEQ ID NO: 1827749 - protein, 33 aa, Staphylococcus epidermidis
GQKYNINKLLDLPFGKCHFALAAKPETSRYKKV

SEQ ID NO: 1827750 - protein, 20 aa, Staphylococcus epidermidis
GQLLFKKYQNFLIRYVTYQE

SEQ ID NO: 1827751 - protein, 19 aa, Staphylococcus epidermidis
GQPSYFPIPEVIGVRLTNS

SEQ ID NO: 1827752 - protein, 19 aa, Staphylococcus epidermidis
GQRGFVPASLISTDFIEDF

SEQ ID NO: 1827753 - protein, 25 aa, Staphylococcus epidermidis
GQSLQCCAVKFLHPIYKNEISINID

SEQ ID NO: 1827754 - protein, 25 aa, Staphylococcus epidermidis
GQTESTLLIGFLKDTEPRPGSMGKG

SEQ ID NO: 1827755 - protein, 22 aa, Staphylococcus epidermidis
GQTIKFKGFMTLYVEAKDDKDN

SEQ ID NO: 1827756 - protein, 19 aa, Staphylococcus epidermidis
GQTPFVTLGFGLGTDELSR

SEQ ID NO: 1827757 - protein, 20 aa, Staphylococcus epidermidis
GQVILLLDEIHRLDKAKQDF

SEQ ID NO: 1827758 - protein, 19 aa, Staphylococcus epidermidis
GQVNIKIQPYANVNNLIKF

SEQ ID NO: 1827759 - protein, 29 aa, Staphylococcus epidermidis
GQYELTYLVEYFIQTNYPDQPFYNKAMCV

SEQ ID NO: 1827760 - protein, 23 aa, Staphylococcus epidermidis
GRAYNSLYHAALARSEADWIVGI

SEQ ID NO: 1827761 - protein, 20 aa, Staphylococcus epidermidis
GRGLICAPIDRSIARRLELN

SEQ ID NO: 1827762 - protein, 26 aa, Staphylococcus epidermidis
GRGMTINRMYWRARRRESIFMTYILK

SEQ ID NO: 1827763 - protein, 18 aa, Staphylococcus epidermidis
GRGPVNHFAYLKKVGLDD

SEQ ID NO: 1827764 - protein, 24 aa, Staphylococcus epidermidis
GRGQLFINLAIDQAIKFGKSKIWL

SEQ ID NO: 1827765 - protein, 18 aa, Staphylococcus epidermidis
GRIAKYPIFTILYEKVEY

SEQ ID NO: 1827766 - protein, 18 aa, Staphylococcus epidermidis
GRKIEWLEFIFDAEKCIH

SEQ ID NO: 1827767 - protein, 18 aa, Staphylococcus epidermidis
GRKNIILADYLIDDNPKQ

SEQ ID NO: 1827768 - protein, 27 aa, Staphylococcus epidermidis
GRKVDERLWLLNRAGKIPFVVSGQGQE

SEQ ID NO: 1827769 - protein, 26 aa, Staphylococcus epidermidis
GRNQTLFNYILKLQQIAFSKDEIRNT

SEQ ID NO: 1827770 - protein, 24 aa, Staphylococcus epidermidis
GRRFAYWIKYTPGLPFKIVGTKNG

SEQ ID NO: 1827771 - protein, 19 aa, Staphylococcus epidermidis
GRRFRFTALVVVGDKKGRV

SEQ ID NO: 1827772 - protein, 26 aa, Staphylococcus epidermidis
GRSMTVGVTTPLTLGLGAAVKKSADF

SEQ ID NO: 1827773 - protein, 20 aa, Staphylococcus epidermidis
GRSYLKYLKANYPNRHYITN

SEQ ID NO: 1827774 - protein, 19 aa, Staphylococcus epidermidis
GRTILGRIAKHTLINVLPQ

SEQ ID NO: 1827775 - protein, 25 aa, Staphylococcus epidermidis
GRTPSELGFRYYVNRLLEQTSHQNQ

SEQ ID NO: 1827776 - protein, 30 aa, Staphylococcus epidermidis
GRVGYHPTWKMILGLFPKEDKVKAMNALER

SEQ ID NO: 1827777 - protein, 17 aa, Staphylococcus epidermidis
GRWNAMINRCENPNTLA

SEQ ID NO: 1827778 - protein, 28 aa, Staphylococcus epidermidis
GRYIYKLKNIYYLRISTLPLSLGNESCV

SEQ ID NO: 1827779 - protein, 24 aa, Staphylococcus epidermidis
GSDDYRYFPEPDIVPLYVDEEWKE

SEQ ID NO: 1827780 - protein, 26 aa, Staphylococcus epidermidis
GSDFTTGWIFFINQEGEHELVSAVDL

SEQ ID NO: 1827781 - protein, 24 aa, Staphylococcus epidermidis
GSDQQWIPVHKSWRLNERHYGALQ

SEQ ID NO: 1827782 - protein, 24 aa, Staphylococcus epidermidis
GSDQQWIPVHKSWRLNERHYGGLQ

SEQ ID NO: 1827783 - protein, 17 aa, Staphylococcus epidermidis
GSEQKYIQDAFEKNWIA

SEQ ID NO: 1827784 - protein, 23 aa, Staphylococcus epidermidis
GSEYAVYVNYGTGIYAVGPGGSR

SEQ ID NO: 1827785 - protein, 21 aa, Staphylococcus epidermidis
GSFINAIKRIVGNKKIILAAN

SEQ ID NO: 1827786 - protein, 23 aa, Staphylococcus epidermidis
GSGKSLAYLLAALMYNIETGRHV

SEQ ID NO: 1827787 - protein, 25 aa, Staphylococcus epidermidis
GSGKTMIFDAIVYALFGKASTENRK

SEQ ID NO: 1827788 - protein, 27 aa, Staphylococcus epidermidis
GSGQQWYSWIHIDDLIRGILFTIGNKD

SEQ ID NO: 1827789 - protein, 17 aa, Staphylococcus epidermidis
GSLIKAFRQCGFEIDKV

SEQ ID NO: 1827790 - protein, 19 aa, Staphylococcus epidermidis
GSLTANYDRFMTWRSKDGK

SEQ ID NO: 1827791 - protein, 17 aa, Staphylococcus epidermidis
GSMLLLAHDLQTAKNIV

SEQ ID NO: 1827792 - protein, 32 aa, Staphylococcus epidermidis
GSNIVAFPHINKGLFIPFLDQHSIANYDDFVK

SEQ ID NO: 1827793 - protein, 21 aa, Staphylococcus epidermidis
GSPVNFSGKFYNFVEYGVDKE

SEQ ID NO: 1827794 - protein, 21 aa, Staphylococcus epidermidis
GSRVIYLYPQVLEAYQQVITR

SEQ ID NO: 1827795 - protein, 25 aa, Staphylococcus epidermidis
GSSGTIPGVLFKLEKTHDLTEDQMV

SEQ ID NO: 1827796 - protein, 23 aa, Staphylococcus epidermidis
GSTYKIYFGFANRTAYEDFKASN

SEQ ID NO: 1827797 - protein, 22 aa, Staphylococcus epidermidis
GSTYLLKKYKGKVLIIVNTATN

SEQ ID NO: 1827798 - protein, 17 aa, Staphylococcus epidermidis
GSTYLLKRYKGKVLIIV

SEQ ID NO: 1827799 - protein, 20 aa, Staphylococcus epidermidis
GSTYLLKRYKGKVLIIVNTA

SEQ ID NO: 1827800 - protein, 19 aa, Staphylococcus epidermidis
GSVYPILQMLEDREFVSIS

SEQ ID NO: 1827801 - protein, 25 aa, Staphylococcus epidermidis
GSYGDFHDPKLAFLMGLIAGDGTFG

SEQ ID NO: 1827802 - protein, 19 aa, Staphylococcus epidermidis
GSYVALYVTYEAAPFFNKE

SEQ ID NO: 1827803 - protein, 25 aa, Staphylococcus epidermidis
GSYVMRYLLDGRVPSLPLAITYPEY

SEQ ID NO: 1827804 - protein, 17 aa, Staphylococcus epidermidis
GTAGIRGIFGIGPGRMN

SEQ ID NO: 1827805 - protein, 20 aa, Staphylococcus epidermidis
GTAKDKLIFALPGSTGAVKL

SEQ ID NO: 1827806 - protein, 18 aa, Staphylococcus epidermidis
GTAKGGIVLAIRNELHIP

SEQ ID NO: 1827807 - protein, 32 aa, Staphylococcus epidermidis
GTAKGGIVLAIRNELHIPVKYVGLGEKMDDLQ

SEQ ID NO: 1827808 - protein, 24 aa, Staphylococcus epidermidis
GTDARMMYWFTQKEYDVIRKPQGA

SEQ ID NO: 1827809 - protein, 17 aa, Staphylococcus epidermidis
GTEHILLGLIRENEGVA

SEQ ID NO: 1827810 - protein, 24 aa, Staphylococcus epidermidis
GTENLPQIVGLTKALELAITNQDA

SEQ ID NO: 1827811 - protein, 25 aa, Staphylococcus epidermidis
GTFKKMHVRMMPGQEPPYTRLIDSA

SEQ ID NO: 1827812 - protein, 21 aa, Staphylococcus epidermidis
GTFSYMVFKSWYRKLGITSEE

SEQ ID NO: 1827813 - protein, 18 aa, Staphylococcus epidermidis
GTFTKYFTQNDVPTFAIC

SEQ ID NO: 1827814 - protein, 23 aa, Staphylococcus epidermidis
GTFVEYSYFALGNKLDIFCAKEI

SEQ ID NO: 1827815 - protein, 24 aa, Staphylococcus epidermidis
GTGKSLLLYDIAKKLKKEFNILII

SEQ ID NO: 1827816 - protein, 24 aa, Staphylococcus epidermidis
GTGKTFLAVVYAAKQLRKGTVKRI

SEQ ID NO: 1827817 - protein, 26 aa, Staphylococcus epidermidis
GTGQSFDWKLLKKVKDVDFLIAGGLD

SEQ ID NO: 1827818 - protein, 33 aa, Staphylococcus epidermidis
GTKVKNFKITVPKSSYYLIMIRNDGSFTRIKFN

SEQ ID NO: 1827819 - protein, 19 aa, Staphylococcus epidermidis
GTLKLIKQLVKNGAIALVG

SEQ ID NO: 1827820 - protein, 24 aa, Staphylococcus epidermidis
GTLNKPMYKLISINDTEMLFIKGA

SEQ ID NO: 1827821 - protein, 25 aa, Staphylococcus epidermidis
GTLNKPMYKLISINDTEMLFIKGAV

SEQ ID NO: 1827822 - protein, 23 aa, Staphylococcus epidermidis
GTNFDILPLIYQISNGSIKWHEF

SEQ ID NO: 1827823 - protein, 24 aa, Staphylococcus epidermidis
GTNLLTGIIHCPQCGAPMAASNTT

SEQ ID NO: 1827824 - protein, 22 aa, Staphylococcus epidermidis
GTNMEKYLRPETLFGTKFEGYL

SEQ ID NO: 1827825 - protein, 22 aa, Staphylococcus epidermidis
GTNVLTFAVRRMNLYDRNLPNP

SEQ ID NO: 1827826 - protein, 22 aa, Staphylococcus epidermidis
GTSGLQLFDYKFGQTGVHGTEA

SEQ ID NO: 1827827 - protein, 18 aa, Staphylococcus epidermidis
GTSHASLIRFPESALRPL

SEQ ID NO: 1827828 - protein, 28 aa, Staphylococcus epidermidis
GTSVKAQPPFFYPLDKLISISTMIEEAG

SEQ ID NO: 1827829 - protein, 28 aa, Staphylococcus epidermidis
GTSVKIKPPFYYPLNKIISIGTMIKEAG

SEQ ID NO: 1827830 - protein, 21 aa, Staphylococcus epidermidis
GTTYHLVFNPPKVEGICDIDG

SEQ ID NO: 1827831 - protein, 21 aa, Staphylococcus epidermidis
GTWTYLGEMLVSIPFEPDDPI

SEQ ID NO: 1827832 - protein, 23 aa, Staphylococcus epidermidis
GTYRALTKVFTRFGVEVDFVDTT

SEQ ID NO: 1827833 - protein, 24 aa, Staphylococcus epidermidis
GVAFDKLGYRIGYGGGYYDRFLSQ

SEQ ID NO: 1827834 - protein, 27 aa, Staphylococcus epidermidis
GVASKAFMTLINSKIPFYQTTTSEISI

SEQ ID NO: 1827835 - protein, 26 aa, Staphylococcus epidermidis
GVCLNVGCIPSKALLHASHRFVEAQH

SEQ ID NO: 1827836 - protein, 28 aa, Staphylococcus epidermidis
GVCNGFQILTEIGLLPGALLHNDSHLFI

SEQ ID NO: 1827837 - protein, 23 aa, Staphylococcus epidermidis
GVDFRLIEPEAFYHTLQHFTGSK

SEQ ID NO: 1827838 - protein, 27 aa, Staphylococcus epidermidis
GVDVSGKWFFDRFSPVTHIKAIGNADV

SEQ ID NO: 1827839 - protein, 21 aa, Staphylococcus epidermidis
GVEHAIIPDRIEAGTLLIAGA

SEQ ID NO: 1827840 - protein, 17 aa, Staphylococcus epidermidis
GVEIFIRTKKQLITTTE

SEQ ID NO: 1827841 - protein, 25 aa, Staphylococcus epidermidis
GVEITVLIKSVYRLTGLKTGSNLAI

SEQ ID NO: 1827842 - protein, 37 aa, Staphylococcus epidermidis
GVENAFDFPGFVPAYIRPLFCEGKGPFRFAALSGDPK

SEQ ID NO: 1827843 - protein, 19 aa, Staphylococcus epidermidis
GVEPIVALNAFIHDTASET

SEQ ID NO: 1827844 - protein, 22 aa, Staphylococcus epidermidis
GVGPVIEGGFYYDFDMDEKVSS

SEQ ID NO: 1827845 - protein, 28 aa, Staphylococcus epidermidis
GVHGLPVQFDIDKLWIKNINVTTGLVSG

SEQ ID NO: 1827846 - protein, 18 aa, Staphylococcus epidermidis
GVHHPLIRILKENTLNQL

SEQ ID NO: 1827847 - protein, 24 aa, Staphylococcus epidermidis
GVIGKTVILPIVGRELPILADEYV

SEQ ID NO: 1827848 - protein, 24 aa, Staphylococcus epidermidis
GVIHHTVLSVLYNLNIQIPADVCT

SEQ ID NO: 1827849 - protein, 18 aa, Staphylococcus epidermidis
GVIIAVGQGRLLDNGSRV

SEQ ID NO: 1827850 - protein, 24 aa, Staphylococcus epidermidis
GVKGSLQRLGLDHIDLYQLHGGTI

SEQ ID NO: 1827851 - protein, 17 aa, Staphylococcus epidermidis
GVLKEEILKFVDLMKSL

SEQ ID NO: 1827852 - protein, 29 aa, Staphylococcus epidermidis
GVLQGPMNFGPFNLILRFSYKGMDYKEYR

SEQ ID NO: 1827853 - protein, 20 aa, Staphylococcus epidermidis
GVLTNMAQLVFLLGELDVKD

SEQ ID NO: 1827854 - protein, 19 aa, Staphylococcus epidermidis
GVMADLHFAPTLNAATNLI

SEQ ID NO: 1827855 - protein, 24 aa, Staphylococcus epidermidis
GVNMIALVNGRPKLINLKEALIHY

SEQ ID NO: 1827856 - protein, 25 aa, Staphylococcus epidermidis
GVNPKPIFEIIQKANMSKLGEAGKP

SEQ ID NO: 1827857 - protein, 34 aa, Staphylococcus epidermidis
GVNVIAILEIYFPTSNIYLYAPITGMHAFDRLDV

SEQ ID NO: 1827858 - protein, 23 aa, Staphylococcus epidermidis
GVPSTPLFYFVDGNIVGAVDIRH

SEQ ID NO: 1827859 - protein, 25 aa, Staphylococcus epidermidis
GVQEVRAWTFRQGMTAPQCAGIIHT

SEQ ID NO: 1827860 - protein, 17 aa, Staphylococcus epidermidis
GVRHWKQRYLKDKTPNG

SEQ ID NO: 1827861 - protein, 36 aa, Staphylococcus epidermidis
GVRILFVAATAPFTPFYRALDWIVTDPLAAIKDGID

SEQ ID NO: 1827862 - protein, 21 aa, Staphylococcus epidermidis
GVRVVSMPNWFAFEQQSDEYK

SEQ ID NO: 1827863 - protein, 24 aa, Staphylococcus epidermidis
GVSGPAALRCSQFVYKEQKNQKKQ

SEQ ID NO: 1827864 - protein, 21 aa, Staphylococcus epidermidis
GVTCEFEFKKDYPALYNDPDF

SEQ ID NO: 1827865 - protein, 23 aa, Staphylococcus epidermidis
GVTLAAGYSLNWLKKTFFENDSF

SEQ ID NO: 1827866 - protein, 37 aa, Staphylococcus epidermidis
GVTLELVDQLKFFINERIIPVIPQQGSLGASGDLAPL

SEQ ID NO: 1827867 - protein, 30 aa, Staphylococcus epidermidis
GVVGGDGIGFAFSPGPLGQIGKEGAAVGIG

SEQ ID NO: 1827868 - protein, 18 aa, Staphylococcus epidermidis
GVVGKFVEFFGPGVQHLP

SEQ ID NO: 1827869 - protein, 19 aa, Staphylococcus epidermidis
GVVKVDRYPIFIPNALIDE

SEQ ID NO: 1827870 - protein, 30 aa, Staphylococcus epidermidis
GVYEELVRFLAGRTDWARLTARLAESFVND

SEQ ID NO: 1827871 - protein, 17 aa, Staphylococcus epidermidis
GWDYNEAIEAPAGMRRK

SEQ ID NO: 1827872 - protein, 28 aa, Staphylococcus epidermidis
GWSNRPNFHLFFHEFGFHATGRKKGKRH

SEQ ID NO: 1827873 - protein, 18 aa, Staphylococcus epidermidis
GYAKFAFEKAIIYAFNIL

SEQ ID NO: 1827874 - protein, 23 aa, Staphylococcus epidermidis
GYAKFAFEKAIIYAFNILNMHKI

SEQ ID NO: 1827875 - protein, 20 aa, Staphylococcus epidermidis
GYAKFAFEKAINYAFDILNM

SEQ ID NO: 1827876 - protein, 17 aa, Staphylococcus epidermidis
GYAKKAFKMAIDYAFLV

SEQ ID NO: 1827877 - protein, 18 aa, Staphylococcus epidermidis
GYANKFNRKLHPYEGKQY

SEQ ID NO: 1827878 - protein, 26 aa, Staphylococcus epidermidis
GYDRQIICTQSFYQKLDTLKDGNGRY

SEQ ID NO: 1827879 - protein, 25 aa, Staphylococcus epidermidis
GYDSDRYLPVLAIAIGKKAQDAHDS

SEQ ID NO: 1827880 - protein, 22 aa, Staphylococcus epidermidis
GYEAPCYIAWSGKNRSPLVRVP

SEQ ID NO: 1827881 - protein, 18 aa, Staphylococcus epidermidis
GYEESYGFLARPFVRDKD

SEQ ID NO: 1827882 - protein, 25 aa, Staphylococcus epidermidis
GYEYKLLVLNYSPNLRLFLHRHDLF

SEQ ID NO: 1827883 - protein, 17 aa, Staphylococcus epidermidis
GYFIEPTIFSGLQSADR

SEQ ID NO: 1827884 - protein, 18 aa, Staphylococcus epidermidis
GYFIYPYQEVMKDSNVKL

SEQ ID NO: 1827885 - protein, 27 aa, Staphylococcus epidermidis
GYFNLAPEEFIVWVLGFNKSISELKQK

SEQ ID NO: 1827886 - protein, 22 aa, Staphylococcus epidermidis
GYGDYFPHRLGHGLGLEEHEYQ

SEQ ID NO: 1827887 - protein, 24 aa, Staphylococcus epidermidis
GYGEYFPHRLGHGLGLEEHEYQDV

SEQ ID NO: 1827888 - protein, 19 aa, Staphylococcus epidermidis
GYGPIGLTIAKISPHHQLS

SEQ ID NO: 1827889 - protein, 27 aa, Staphylococcus epidermidis
GYHPTWKMVLGLFPKEDKIKAMNALER

SEQ ID NO: 1827890 - protein, 20 aa, Staphylococcus epidermidis
GYIKSYGVHAIHGRALPLAQ

SEQ ID NO: 1827891 - protein, 24 aa, Staphylococcus epidermidis
GYIKYLDNITTPYSPNGPPPGYAF

SEQ ID NO: 1827892 - protein, 25 aa, Staphylococcus epidermidis
GYINCNHHLDFALAIRTMIIDEETV

SEQ ID NO: 1827893 - protein, 19 aa, Staphylococcus epidermidis
GYINFIELIVHRIDSINYE

SEQ ID NO: 1827894 - protein, 25 aa, Staphylococcus epidermidis
GYKEYIDFRYLINLSYHLEKMRGLK

SEQ ID NO: 1827895 - protein, 26 aa, Staphylococcus epidermidis
GYPPNNLPDFFELQAGIAYGENNSID

SEQ ID NO: 1827896 - protein, 30 aa, Staphylococcus epidermidis
GYPSLTYDLEWLPQLFVMGGLADLELGPFA

SEQ ID NO: 1827897 - protein, 18 aa, Staphylococcus epidermidis
GYQDLGFSGAGALDQYSL

SEQ ID NO: 1827898 - protein, 22 aa, Staphylococcus epidermidis
GYQLIKYVNLNETAIIVVTAKN

SEQ ID NO: 1827899 - protein, 24 aa, Staphylococcus epidermidis
GYSKFKSLLQHFNLQHQKPLNKVQ

SEQ ID NO: 1827900 - protein, 25 aa, Staphylococcus epidermidis
GYSKFKSLLQYFNLQHQKPLNKVQR

SEQ ID NO: 1827901 - protein, 20 aa, Staphylococcus epidermidis
GYSLKPRQFLFKNETIKEVK

SEQ ID NO: 1827902 - protein, 17 aa, Staphylococcus epidermidis
GYSPFYVYEVREGWARV

SEQ ID NO: 1827903 - protein, 21 aa, Staphylococcus epidermidis
GYSYRDYQRLVNKMQVHDKEI

SEQ ID NO: 1827904 - protein, 31 aa, Staphylococcus epidermidis
GYTKRSFIMTAYIMEFQALNGMRIGELLAIQ

SEQ ID NO: 1827905 - protein, 17 aa, Staphylococcus epidermidis
GYVETKEKHPNADKLSV

SEQ ID NO: 1827906 - protein, 22 aa, Staphylococcus epidermidis
GYVYIKGYGDLKFYEAFVLDSE

SEQ ID NO: 1827907 - protein, 18 aa, Staphylococcus epidermidis
HAAQHMYLVYQNPELQFI

SEQ ID NO: 1827908 - protein, 17 aa, Staphylococcus epidermidis
HAFNPRTIFLLQHACRD

SEQ ID NO: 1827909 - protein, 26 aa, Staphylococcus epidermidis
HAGTGRLLDYNYLLPYLYESCNEQDA

SEQ ID NO: 1827910 - protein, 29 aa, Staphylococcus epidermidis
HAKDFGKKYIIFPNPMYGSWESTLYHNQY

SEQ ID NO: 1827911 - protein, 22 aa, Staphylococcus epidermidis
HALLVLNQLNEMLKPRGYLIMI

SEQ ID NO: 1827912 - protein, 19 aa, Staphylococcus epidermidis
HANDDFIIGYRLSPEEAES

SEQ ID NO: 1827913 - protein, 17 aa, Staphylococcus epidermidis
HAPDLIKSASYPNILPS

SEQ ID NO: 1827914 - protein, 23 aa, Staphylococcus epidermidis
HAPVYHILPEAFKNYMHHHPNIQ

SEQ ID NO: 1827915 - protein, 26 aa, Staphylococcus epidermidis
HAQLKGYHFVLKEKIPKQLGYKALKD

SEQ ID NO: 1827916 - protein, 21 aa, Staphylococcus epidermidis
HAQMKMFLTRLGFGSKMVVTG

SEQ ID NO: 1827917 - protein, 17 aa, Staphylococcus epidermidis
HASLLPKYRGGAPIHQA

SEQ ID NO: 1827918 - protein, 17 aa, Staphylococcus epidermidis
HASTQKVILAKGLSKGK

SEQ ID NO: 1827919 - protein, 19 aa, Staphylococcus epidermidis
HATAPYSIFIRGAKYRFEP

SEQ ID NO: 1827920 - protein, 20 aa, Staphylococcus epidermidis
HATIFLMNAVYDFDTVREYQ

SEQ ID NO: 1827921 - protein, 20 aa, Staphylococcus epidermidis
HAVTYFLQQGTPFIYQGQEI

SEQ ID NO: 1827922 - protein, 28 aa, Staphylococcus epidermidis
HCMYTRSPRIYNFWYRPRKARCMFNIDI

SEQ ID NO: 1827923 - protein, 24 aa, Staphylococcus epidermidis
HDDIQFIILGHYQLIDALLEKNHQ

SEQ ID NO: 1827924 - protein, 17 aa, Staphylococcus epidermidis
HDFIIEQILTRSCEIES

SEQ ID NO: 1827925 - protein, 17 aa, Staphylococcus epidermidis
HDFTPKSKIRKVKTIGT

SEQ ID NO: 1827926 - protein, 29 aa, Staphylococcus epidermidis
HDGTKLGFMSFFTKAAVAALKKYPEVNAE

SEQ ID NO: 1827927 - protein, 22 aa, Staphylococcus epidermidis
HDHWTYDPFTLTEDQGYLYGRG

SEQ ID NO: 1827928 - protein, 25 aa, Staphylococcus epidermidis
HDIAYAQYLATRKVFPESSIGVINI

SEQ ID NO: 1827929 - protein, 31 aa, Staphylococcus epidermidis
HDIKIDKRKMDLPQGIHALGYTNVPVKLDKE

SEQ ID NO: 1827930 - protein, 18 aa, Staphylococcus epidermidis
HDINLIKQLIKQYGLLYI

SEQ ID NO: 1827931 - protein, 23 aa, Staphylococcus epidermidis
HDKHLFVEGAYMYYLGSFIDSDS

SEQ ID NO: 1827932 - protein, 24 aa, Staphylococcus epidermidis
HDKKKTQLPQLFGFQAEGASPIVQ

SEQ ID NO: 1827933 - protein, 23 aa, Staphylococcus epidermidis
HDLIEINHFVDDGTNLNDIMHDL

SEQ ID NO: 1827934 - protein, 19 aa, Staphylococcus epidermidis
HDQIFIFDEPTTGLHEDDL

SEQ ID NO: 1827935 - protein, 25 aa, Staphylococcus epidermidis
HDRPIGRCWLVQASKLKWIFKFEIS

SEQ ID NO: 1827936 - protein, 23 aa, Staphylococcus epidermidis
HDRPSEDWVWRDGFVKMDTLEVN

SEQ ID NO: 1827937 - protein, 23 aa, Staphylococcus epidermidis
HDRYFLDKIVTQIYDVALGDVKR

SEQ ID NO: 1827938 - protein, 20 aa, Staphylococcus epidermidis
HDRYFLDKIVTQVYDVALGN

SEQ ID NO: 1827939 - protein, 27 aa, Staphylococcus epidermidis
HDSREFLSMQSLPNSITFIGAGIISIE

SEQ ID NO: 1827940 - protein, 28 aa, Staphylococcus epidermidis
HDVCVVVTRYFGGIKLGGGGLIRAYSGA

SEQ ID NO: 1827941 - protein, 27 aa, Staphylococcus epidermidis
HDWRTKKPVIFRATPQWFASISKVRQD

SEQ ID NO: 1827942 - protein, 20 aa, Staphylococcus epidermidis
HEAIRKVIGIIYKKDKQHVS

SEQ ID NO: 1827943 - protein, 18 aa, Staphylococcus epidermidis
HEAPNHVMNYFDPKDKTL

SEQ ID NO: 1827944 - protein, 25 aa, Staphylococcus epidermidis
HEDAEILDWFDAIGRRRGLLQKGNE

SEQ ID NO: 1827945 - protein, 19 aa, Staphylococcus epidermidis
HEDGIPVYLGMPMGIVVEA

SEQ ID NO: 1827946 - protein, 22 aa, Staphylococcus epidermidis
HEDIDIRWLDAYIAIRDDDQLN

SEQ ID NO: 1827947 - protein, 25 aa, Staphylococcus epidermidis
HEEYGYRYKAIALTLDYFFNIQNHS

SEQ ID NO: 1827948 - protein, 34 aa, Staphylococcus epidermidis
HEFDYLFKHVPVKPGDFFYVPAGTVHAIGSGILI

SEQ ID NO: 1827949 - protein, 26 aa, Staphylococcus epidermidis
HEGKPFYEKLISFITSAPVFAMVVEG

SEQ ID NO: 1827950 - protein, 25 aa, Staphylococcus epidermidis
HEGVKKLIVITLGKYGYVYNEVNYK

SEQ ID NO: 1827951 - protein, 24 aa, Staphylococcus epidermidis
HEKQKLIKYMPSKIAFIFQTMDIE

SEQ ID NO: 1827952 - protein, 24 aa, Staphylococcus epidermidis
HEKRKIEFLAGRFAVKEAFSKALG

SEQ ID NO: 1827953 - protein, 29 aa, Staphylococcus epidermidis
HELDNGLKLFIIPKPGFQKTFVTYTTQFG

SEQ ID NO: 1827954 - protein, 26 aa, Staphylococcus epidermidis
HELESKLPYYMIPTNIFQLDNLPITF

SEQ ID NO: 1827955 - protein, 34 aa, Staphylococcus epidermidis
HELRNLFEEILGYTLFRRNEYGKFFILTGGGSNG

SEQ ID NO: 1827956 - protein, 22 aa, Staphylococcus epidermidis
HERHFFNMAYINEKWEYRGDNN

SEQ ID NO: 1827957 - protein, 25 aa, Staphylococcus epidermidis
HESLNIEMPLAEQFWGGTMGAFTDK

SEQ ID NO: 1827958 - protein, 23 aa, Staphylococcus epidermidis
HESPKHVMNYYDPKDKTLLKEGL

SEQ ID NO: 1827959 - protein, 25 aa, Staphylococcus epidermidis
HETTTLYDVPAGKIPLTVKTLSLKH

SEQ ID NO: 1827960 - protein, 25 aa, Staphylococcus epidermidis
HETTTLYDVPAGKIPLTVKTLSLMH

SEQ ID NO: 1827961 - protein, 26 aa, Staphylococcus epidermidis
HEVEEPDFLIVIYHGGLNKISSTNKR

SEQ ID NO: 1827962 - protein, 18 aa, Staphylococcus epidermidis
HEVFKDYGILFIDAQYPE

SEQ ID NO: 1827963 - protein, 34 aa, Staphylococcus epidermidis
HFDPAKTSILMLMDYLFEMINPYSLNQQGQDKGQ

SEQ ID NO: 1827964 - protein, 18 aa, Staphylococcus epidermidis
HFECEYVQTVRIPTGDPV

SEQ ID NO: 1827965 - protein, 19 aa, Staphylococcus epidermidis
HFEKRYAKRSQLREFNVEE

SEQ ID NO: 1827966 - protein, 19 aa, Staphylococcus epidermidis
HFHKFIKSDLHDRIQFVIL

SEQ ID NO: 1827967 - protein, 28 aa, Staphylococcus epidermidis
HFIAEKDFFNFFRNFFTRKWEREIDTNM

SEQ ID NO: 1827968 - protein, 23 aa, Staphylococcus epidermidis
HFIFSPFIRYKYHFYKFEGNSII

SEQ ID NO: 1827969 - protein, 19 aa, Staphylococcus epidermidis
HFLSFIKGLIRHFTANENE

SEQ ID NO: 1827970 - protein, 23 aa, Staphylococcus epidermidis
HFNKLEVPFIYRVHEQPKSDRLR

SEQ ID NO: 1827971 - protein, 18 aa, Staphylococcus epidermidis
HFNKMEVPFIYRVHEQPK

SEQ ID NO: 1827972 - protein, 18 aa, Staphylococcus epidermidis
HFVLDHISIEYLRFSYYL

SEQ ID NO: 1827973 - protein, 24 aa, Staphylococcus epidermidis
HFYDVNRTRMKLAEKAKSLACQFA

SEQ ID NO: 1827974 - protein, 22 aa, Staphylococcus epidermidis
HGAPVNFSGKFYHFVEYGVDQE

SEQ ID NO: 1827975 - protein, 21 aa, Staphylococcus epidermidis
HGARKNYFAKGYFLNVDVASY

SEQ ID NO: 1827976 - protein, 28 aa, Staphylococcus epidermidis
HGASGSEEIIYLGGPRSDLRNAIEKQLV

SEQ ID NO: 1827977 - protein, 21 aa, Staphylococcus epidermidis
HGDLFVNIKVVTPTKLNDRQK

SEQ ID NO: 1827978 - protein, 20 aa, Staphylococcus epidermidis
HGDLFVNIKVVTPTKMNDRQ

SEQ ID NO: 1827979 - protein, 28 aa, Staphylococcus epidermidis
HGDQALIRGAKILALMGLELIENEQLFN

SEQ ID NO: 1827980 - protein, 42 aa, Staphylococcus epidermidis
HGEKVAYGILVQLVLENAPTEKFMKYKTFFDNINMPTTLEGL

SEQ ID NO: 1827981 - protein, 23 aa, Staphylococcus epidermidis
HGILQPIVLRQTVQGYYIVVGER

SEQ ID NO: 1827982 - protein, 19 aa, Staphylococcus epidermidis
HGKAFIYKMLALLRNNEAI

SEQ ID NO: 1827983 - protein, 29 aa, Staphylococcus epidermidis
HGKALFAAAFITHFSGQTPHIHFDIAGPA

SEQ ID NO: 1827984 - protein, 27 aa, Staphylococcus epidermidis
HGKLAMVLVQFPPWFDCNVQNINYILY

SEQ ID NO: 1827985 - protein, 19 aa, Staphylococcus epidermidis
HGLKMIYGMEGMLVDDGVP

SEQ ID NO: 1827986 - protein, 26 aa, Staphylococcus epidermidis
HGQDHLMTTILLKDLMKHLIELYKRK

SEQ ID NO: 1827987 - protein, 18 aa, Staphylococcus epidermidis
HGQKLYDAGLRRINVSLD

SEQ ID NO: 1827988 - protein, 20 aa, Staphylococcus epidermidis
HGRIFISLAVKFSKARLIDN

SEQ ID NO: 1827989 - protein, 17 aa, Staphylococcus epidermidis
HGVGSAGFHIHFASDER

SEQ ID NO: 1827990 - protein, 21 aa, Staphylococcus epidermidis
HGVVKIDRYPVFVPNALIDEE

SEQ ID NO: 1827991 - protein, 26 aa, Staphylococcus epidermidis
HGYGTKMMMFLPEYVQALFPDFTHLY

SEQ ID NO: 1827992 - protein, 26 aa, Staphylococcus epidermidis
HGYGTKMMMFLPQYVQELFPDFNHLY

SEQ ID NO: 1827993 - protein, 18 aa, Staphylococcus epidermidis
HGYIPGNMKVMLSQNLQS

SEQ ID NO: 1827994 - protein, 17 aa, Staphylococcus epidermidis
HGYLYFCGQLDIPLTER

SEQ ID NO: 1827995 - protein, 17 aa, Staphylococcus epidermidis
HGYYFHEILNRHHLDGA

SEQ ID NO: 1827996 - protein, 23 aa, Staphylococcus epidermidis
HHDDAFPFELLKARIHAIPLPEK

SEQ ID NO: 1827997 - protein, 19 aa, Staphylococcus epidermidis
HHGHPGHLALPRKQEFIAT

SEQ ID NO: 1827998 - protein, 20 aa, Staphylococcus epidermidis
HHHLQQLTFQLYQKLKRQNP

SEQ ID NO: 1827999 - protein, 26 aa, Staphylococcus epidermidis
HHIADSQLQLFSRLKLALTEENPSAP

SEQ ID NO: 1828000 - protein, 17 aa, Staphylococcus epidermidis
HHKKQFYVTLKLNNDII

SEQ ID NO: 1828001 - protein, 17 aa, Staphylococcus epidermidis
HHLFSKVKFEKEYVCLA

SEQ ID NO: 1828002 - protein, 18 aa, Staphylococcus epidermidis
HHTFFEMLGNFSIGDYFK

SEQ ID NO: 1828003 - protein, 26 aa, Staphylococcus epidermidis
HIADNERTLYDWASKQTYIALANMMT

SEQ ID NO: 1828004 - protein, 23 aa, Staphylococcus epidermidis
HIDANYFVYWMNASAQAKSQLNQ

SEQ ID NO: 1828005 - protein, 23 aa, Staphylococcus epidermidis
HIEIFDRSWYGRVLVERVEGFAS

SEQ ID NO: 1828006 - protein, 34 aa, Staphylococcus epidermidis; identical to SEQ ID NO: 1684967

SEQ ID NO: 1828007 - protein, 31 aa, Staphylococcus epidermidis
HIFITHMHGDHIFGLPGLLTSRSFQGGENKP

SEQ ID NO: 1828008 - protein, 17 aa, Staphylococcus epidermidis
HIFKLDPAKSISDDDLE

SEQ ID NO: 1828009 - protein, 17 aa, Staphylococcus epidermidis
HIHRMLEAAEELPINVG

SEQ ID NO: 1828010 - protein, 18 aa, Staphylococcus epidermidis
HIIKFLEMLPDPKTGKQL

SEQ ID NO: 1828011 - protein, 30 aa, Staphylococcus epidermidis
HIIKLARSNAIPIIYHVYAPRSITMKQVID

SEQ ID NO: 1828012 - protein, 17 aa, Staphylococcus epidermidis
HIKTYLPESFVIAGNVG

SEQ ID NO: 1828013 - protein, 17 aa, Staphylococcus epidermidis
HILGRRVNPHIFKASCV

SEQ ID NO: 1828014 - protein, 20 aa, Staphylococcus epidermidis
HILMLVATGSDLHLEKKRKM

SEQ ID NO: 1828015 - protein, 18 aa, Staphylococcus epidermidis
HILQYQFINQKNNAPFIC

SEQ ID NO: 1828016 - protein, 19 aa, Staphylococcus epidermidis
HILQYQFINQKNNAPFICA

SEQ ID NO: 1828017 - protein, 18 aa, Staphylococcus epidermidis
HILQYQFINQKNNAPFIY

SEQ ID NO: 1828018 - protein, 19 aa, Staphylococcus epidermidis
HIPFCYRICTYCDFNKYFI

SEQ ID NO: 1828019 - protein, 32 aa, Staphylococcus epidermidis
HIQNTLRLLYRNRDQLWLGCRDFTLIDVYLNG

SEQ ID NO: 1828020 - protein, 23 aa, Staphylococcus epidermidis
HIRAYYENDIPQRLIAYINQQPV

SEQ ID NO: 1828021 - protein, 23 aa, Staphylococcus epidermidis
HIRDLDNRFLIELTALEDQYDHE

SEQ ID NO: 1828022 - protein, 20 aa, Staphylococcus epidermidis
HIRGLSPWPVAYTTMDDKNL

SEQ ID NO: 1828023 - protein, 17 aa, Staphylococcus epidermidis
HISLLSQLGISLRAIMD

SEQ ID NO: 1828024 - protein, 21 aa, Staphylococcus epidermidis
HISNHLLPRTGAYHEIWLDGE

SEQ ID NO: 1828025 - protein, 33 aa, Staphylococcus epidermidis
HISSYGLILEPKTQFYNLYRKGHLKLPNEDLGA

SEQ ID NO: 1828026 - protein, 32 aa, Staphylococcus epidermidis
HISSYGLILEPKTQFYNMYRKGHLKLPNEDLG

SEQ ID NO: 1828027 - protein, 19 aa, Staphylococcus epidermidis
HIVGQPISKLLLQANATVT

SEQ ID NO: 1828028 - protein, 18 aa, Staphylococcus epidermidis
HIYKLRDYKEKLIIPGFF

SEQ ID NO: 1828029 - protein, 27 aa, Staphylococcus epidermidis
HKALHMVWPDLIFPESEIAFIVLHFGG

SEQ ID NO: 1828030 - protein, 24 aa, Staphylococcus epidermidis
HKDGRLFVCYLGDFKTTGGIFATN

SEQ ID NO: 1828031 - protein, 26 aa, Staphylococcus epidermidis
HKDIKIKVLVDYRFKPKNLKAIVANR

SEQ ID NO: 1828032 - protein, 22 aa, Staphylococcus epidermidis
HKDKCIAVNFLSEPWLRNIVEV

SEQ ID NO: 1828033 - protein, 21 aa, Staphylococcus epidermidis
HKDMYFIEPLYGKETIVSKTK

SEQ ID NO: 1828034 - protein, 26 aa, Staphylococcus epidermidis
HKDNELLTETLKFLFDDLIVTGISSK

SEQ ID NO: 1828035 - protein, 24 aa, Staphylococcus epidermidis
HKGILGTGIVRIFDMTIAQTGLTE

SEQ ID NO: 1828036 - protein, 25 aa, Staphylococcus epidermidis
HKGKPFYDKLISFITSAPVFAMVVE

SEQ ID NO: 1828037 - protein, 25 aa, Staphylococcus epidermidis
HKGRIKEVYAYDLSLLDGGRNSYAQ

SEQ ID NO: 1828038 - protein, 17 aa, Staphylococcus epidermidis
HKNCVFLVDTFHTLKSG

SEQ ID NO: 1828039 - protein, 21 aa, Staphylococcus epidermidis
HKRTKFLPELQFAILDEVDSI

SEQ ID NO: 1828040 - protein, 17 aa, Staphylococcus epidermidis
HKVMLLSGTLTTDTPRN

SEQ ID NO: 1828041 - protein, 25 aa, Staphylococcus epidermidis
HKYPDESELLIYFIEGLMSENQTDE

SEQ ID NO: 1828042 - protein, 17 aa, Staphylococcus epidermidis
HLDDLHNSQISLMSTSG

SEQ ID NO: 1828043 - protein, 19 aa, Staphylococcus epidermidis
HLDIPLERALENLSTFKPF

SEQ ID NO: 1828044 - protein, 28 aa, Staphylococcus epidermidis
HLDLETTKWLEDYLKYFKGAIVIISHDR

SEQ ID NO: 1828045 - protein, 26 aa, Staphylococcus epidermidis
HLENGLVWSILITLPVTEEEADQLEI

SEQ ID NO: 1828046 - protein, 18 aa, Staphylococcus epidermidis
HLFLVGRESDRIIVGGIN

SEQ ID NO: 1828047 - protein, 31 aa, Staphylococcus epidermidis
HLGDLYLDTATGVAYRFLKKGTTSPTYYWSP

SEQ ID NO: 1828048 - protein, 28 aa, Staphylococcus epidermidis
HLGFQFDHLFWKQFIHNIKTLHSKGVYR

SEQ ID NO: 1828049 - protein, 28 aa, Staphylococcus epidermidis
HLGFQFDHLLWKQFIHNIKTLHSKGVYR

SEQ ID NO: 1828050 - protein, 32 aa, Staphylococcus epidermidis
HLHIDEPITFELWIAILIVQQPKDVQLSSLKI

SEQ ID NO: 1828051 - protein, 17 aa, Staphylococcus epidermidis
HLIIKSPHPSPLSAFRG

SEQ ID NO: 1828052 - protein, 17 aa, Staphylococcus epidermidis
HLILLMIETGGRFSDCI

SEQ ID NO: 1828053 - protein, 26 aa, Staphylococcus epidermidis
HLKMMLKVVLYAYTQFVFSGRKIENL

SEQ ID NO: 1828054 - protein, 29 aa, Staphylococcus epidermidis
HLKSTYAKNMFRLLKQYKHTGYVKINITD

SEQ ID NO: 1828055 - protein, 29 aa, Staphylococcus epidermidis
HLKTIRISEIKSYYLNYFGLEESAYMDDY

SEQ ID NO: 1828056 - protein, 17 aa, Staphylococcus epidermidis
HLKYLQAKRTYLMDQFL

SEQ ID NO: 1828057 - protein, 20 aa, Staphylococcus epidermidis
HLLQHFDSTAFLNFNTYRDD

SEQ ID NO: 1828058 - protein, 28 aa, Staphylococcus epidermidis
HLLQHIHTPHKWLARFDWCRPNSTHFKT

SEQ ID NO: 1828059 - protein, 23 aa, Staphylococcus epidermidis
HLMNLKELFLVSLQERAIPFELN

SEQ ID NO: 1828060 - protein, 18 aa, Staphylococcus epidermidis
HLNDIDCLIYTSGTALYG

SEQ ID NO: 1828061 - protein, 18 aa, Staphylococcus epidermidis
HLPILLISGKEDPFGDYG

SEQ ID NO: 1828062 - protein, 17 aa, Staphylococcus epidermidis
HLPRYIETTIKGKKVLF

SEQ ID NO: 1828063 - protein, 42 aa, Staphylococcus epidermidis
HLQDVPGFKALRFLRPKTYGRHYIIVTLWESRQAFYDWQNSR

SEQ ID NO: 1828064 - protein, 34 aa, Staphylococcus epidermidis
HLQEKERLLPGGYLFLSDLVGNPTLLNKVGKLIA

SEQ ID NO: 1828065 - protein, 23 aa, Staphylococcus epidermidis
HLQKLLPIPVIGVIEPGARTAIM

SEQ ID NO: 1828066 - protein, 17 aa, Staphylococcus epidermidis
HLRTIQVQPGDFYFIPA

SEQ ID NO: 1828067 - protein, 17 aa, Staphylococcus epidermidis
HLSLEFQILLWHMVEER

SEQ ID NO: 1828068 - protein, 19 aa, Staphylococcus epidermidis
HLSYLCLVENDLTYFNPQK

SEQ ID NO: 1828069 - protein, 30 aa, Staphylococcus epidermidis
HLVENIRFATILLQPFLTHAPREIFKQLNI

SEQ ID NO: 1828070 - protein, 23 aa, Staphylococcus epidermidis
HLVRRTFVEGSAVPSLFGVQQDA

SEQ ID NO: 1828071 - protein, 17 aa, Staphylococcus epidermidis
HLWIMDPIDGTSNLVKQ

SEQ ID NO: 1828072 - protein, 21 aa, Staphylococcus epidermidis
HLYTLIKHCNEFLYRRDDYRI

SEQ ID NO: 1828073 - protein, 24 aa, Staphylococcus epidermidis
HLYTLIKHCNEFLYRRDDYRIPSY

SEQ ID NO: 1828074 - protein, 17 aa, Staphylococcus epidermidis
HLYYMYTGNHRDQHWNR

SEQ ID NO: 1828075 - protein, 19 aa, Staphylococcus epidermidis
HMAMFEFKQNVQIFGKSII

SEQ ID NO: 1828076 - protein, 18 aa, Staphylococcus epidermidis
HMEKFEGFDFGRGATGFG

SEQ ID NO: 1828077 - protein, 23 aa, Staphylococcus epidermidis
HMEKSRLKALYLSVIDRINIRKD

SEQ ID NO: 1828078 - protein, 18 aa, Staphylococcus epidermidis
HMFKLDPAKSISDEDLEA

SEQ ID NO: 1828079 - protein, 18 aa, Staphylococcus epidermidis
HMGVLYQKTNFPKLFKVK

SEQ ID NO: 1828080 - protein, 17 aa, Staphylococcus epidermidis
HMIIFKPSQPITWKQHK

SEQ ID NO: 1828081 - protein, 17 aa, Staphylococcus epidermidis
HMPLILGIEKGWFKEES

SEQ ID NO: 1828082 - protein, 21 aa, Staphylococcus epidermidis
HMRADFDQRFKCNCGKSGCIE

SEQ ID NO: 1828083 - protein, 29 aa, Staphylococcus epidermidis
HMTIRENIVLVPKLLKWSKEKKDAKAKEL

SEQ ID NO: 1828084 - protein, 19 aa, Staphylococcus epidermidis
HMYIIMKHCNEFLERQDDY

SEQ ID NO: 1828085 - protein, 21 aa, Staphylococcus epidermidis
HNARLEMLEQAIAGLTNQLLQ

SEQ ID NO: 1828086 - protein, 17 aa, Staphylococcus epidermidis
HNATIRPEVQDAVNLAN

SEQ ID NO: 1828087 - protein, 24 aa, Staphylococcus epidermidis
HNEPSWMTELRKKALELTETLEMP

SEQ ID NO: 1828088 - protein, 18 aa, Staphylococcus epidermidis
HNHIVINSIDLETGKKYQ

SEQ ID NO: 1828089 - protein, 17 aa, Staphylococcus epidermidis
HNHVILVTRIDETKAKF

SEQ ID NO: 1828090 - protein, 22 aa, Staphylococcus epidermidis
HNKVYWLNEEYYGFGAGASGYV

SEQ ID NO: 1828091 - protein, 23 aa, Staphylococcus epidermidis
HNNPGILDHNTLQNIINKIEEAQ

SEQ ID NO: 1828092 - protein, 25 aa, Staphylococcus epidermidis
HNNQMFDLFHLYIEQFDKIIQKFHE

SEQ ID NO: 1828093 - protein, 33 aa, Staphylococcus epidermidis
HNPANLIGIRAFKKLLPNIPHVAVFDTSFHQTM

SEQ ID NO: 1828094 - protein, 25 aa, Staphylococcus epidermidis
HNPRYVERYLLDGKVPPLPLSITND

SEQ ID NO: 1828095 - protein, 23 aa, Staphylococcus epidermidis
HNQRFYKVNIPSIKVLNPVGSGD

SEQ ID NO: 1828096 - protein, 27 aa, Staphylococcus epidermidis
HNVNPLWKIYQIVKFPKVFKQTVIIEV

SEQ ID NO: 1828097 - protein, 18 aa, Staphylococcus epidermidis
HNWTEDMYYYANAICAAL

SEQ ID NO: 1828098 - protein, 18 aa, Staphylococcus epidermidis
HPAVCFTMLGHDLGVNVE

SEQ ID NO: 1828099 - protein, 17 aa, Staphylococcus epidermidis
HPDAVINKVAMIGGSGI

SEQ ID NO: 1828100 - protein, 28 aa, Staphylococcus epidermidis
HPDGIYLSGALLMFAGNKSYYLYGASSN

SEQ ID NO: 1828101 - protein, 22 aa, Staphylococcus epidermidis
HPDIILLDLGLPDIDGLSLIQQ

SEQ ID NO: 1828102 - protein, 26 aa, Staphylococcus epidermidis
HPDNPFDLTKVWYKGDYPLIEVGEFE

SEQ ID NO: 1828103 - protein, 23 aa, Staphylococcus epidermidis
HPEGVNRMLAHQLGLENISMINT

SEQ ID NO: 1828104 - protein, 25 aa, Staphylococcus epidermidis
HPELDFDFIHWLVTGVKDHESVLDE

SEQ ID NO: 1828105 - protein, 18 aa, Staphylococcus epidermidis
HPFAFDNDLLIQNLKDLR

SEQ ID NO: 1828106 - protein, 22 aa, Staphylococcus epidermidis
HPIEWQLKYLLLRRTLNENELC

SEQ ID NO: 1828107 - protein, 22 aa, Staphylococcus epidermidis
HPLIFKGIKNIVQTGYGKIIRK

SEQ ID NO: 1828108 - protein, 18 aa, Staphylococcus epidermidis
HPLKLNMVTYDGRPELPK

SEQ ID NO: 1828109 - protein, 24 aa, Staphylococcus epidermidis
HPNVITTYDLLYRAGLDLDVDFVI

SEQ ID NO: 1828110 - protein, 19 aa, Staphylococcus epidermidis
HPPTIYFPLNVEEGMMIEP

SEQ ID NO: 1828111 - protein, 17 aa, Staphylococcus epidermidis
HPQFVVPTSHRIFDFFN

SEQ ID NO: 1828112 - protein, 18 aa, Staphylococcus epidermidis
HPRREWCKYLMENDIFPI

SEQ ID NO: 1828113 - protein, 19 aa, Staphylococcus epidermidis
HQACDEWLDRYVKTSGSKQ

SEQ ID NO: 1828114 - protein, 25 aa, Staphylococcus epidermidis
HQCREAGLPCYFTMDAGPNVKVLVE

SEQ ID NO: 1828115 - protein, 30 aa, Staphylococcus epidermidis
HQDLQAAAQTLYFLYSMKLLDQSNSYEVIT

SEQ ID NO: 1828116 - protein, 18 aa, Staphylococcus epidermidis
HQHYFLCHDILEDAWKSQ

SEQ ID NO: 1828117 - protein, 18 aa, Staphylococcus epidermidis
HQLKLDIQQLNEDISNQK

SEQ ID NO: 1828118 - protein, 23 aa, Staphylococcus epidermidis
HQLKRHGFFYAPTVLDNVRKDYN

SEQ ID NO: 1828119 - protein, 25 aa, Staphylococcus epidermidis
HQMMRVILIEQIYRAFKIMRGEAYN

SEQ ID NO: 1828120 - protein, 20 aa, Staphylococcus epidermidis
HQQRFYNCSIYGFGGDPMTQ

SEQ ID NO: 1828121 - protein, 20 aa, Staphylococcus epidermidis
HQSYYALMKLTKQELDVFLM

SEQ ID NO: 1828122 - protein, 28 aa, Staphylococcus epidermidis
HQVNPLWHIYRKIKFIKVLKQTLIIEIA

SEQ ID NO: 1828123 - protein, 17 aa, Staphylococcus epidermidis
HQVQGLGPVILKVNELA

SEQ ID NO: 1828124 - protein, 19 aa, Staphylococcus epidermidis
HQVVIRCIFVYLGQLTKEE

SEQ ID NO: 1828125 - protein, 19 aa, Staphylococcus epidermidis
HQYYQVPFYGKVSAGNFEM

SEQ ID NO: 1828126 - protein, 22 aa, Staphylococcus epidermidis
HRETLTLDYVPSLKLSNYEANQ

SEQ ID NO: 1828127 - protein, 21 aa, Staphylococcus epidermidis
HRKRPATAKPVLLGITKASLE

SEQ ID NO: 1828128 - protein, 21 aa, Staphylococcus epidermidis
HRKRPATSKPVLLGITKASLE

SEQ ID NO: 1828129 - protein, 21 aa, Staphylococcus epidermidis
HRKYPIYGLQYHPESILSEYG

SEQ ID NO: 1828130 - protein, 18 aa, Staphylococcus epidermidis
HRLHSYPHMLSGGEKQRV

SEQ ID NO: 1828131 - protein, 23 aa, Staphylococcus epidermidis
HRNKKFILLTAHRRENIGQPMKN

SEQ ID NO: 1828132 - protein, 25 aa, Staphylococcus epidermidis
HRSNLVMMGVLPLQFQQGDSAESLG

SEQ ID NO: 1828133 - protein, 25 aa, Staphylococcus epidermidis
HRSNLVMMGVLPLQFQQGESAETLG

SEQ ID NO: 1828134 - protein, 17 aa, Staphylococcus epidermidis
HRTCEVLIIIDPQYANR

SEQ ID NO: 1828135 - protein, 31 aa, Staphylococcus epidermidis
HSAPPEEILKSSPYVWFKDVLDGYDYLVDQG

SEQ ID NO: 1828136 - protein, 24 aa, Staphylococcus epidermidis
HSDIQFQIKHLMVSKVKGTFTQFD

SEQ ID NO: 1828137 - protein, 26 aa, Staphylococcus epidermidis
HSDLDFDFIYWLVTGVKDHQIVLDDT

SEQ ID NO: 1828138 - protein, 17 aa, Staphylococcus epidermidis
HSDYYPKFGFKKASNWN

SEQ ID NO: 1828139 - protein, 24 aa, Staphylococcus epidermidis
HSHISLLSQLGISLKAIMERVGHT

SEQ ID NO: 1828140 - protein, 24 aa, Staphylococcus epidermidis
HSHYKHLFAILELAKKQGVDKVYV

SEQ ID NO: 1828141 - protein, 31 aa, Staphylococcus epidermidis
HSIEVPMDLLPYLFFQFAKDGKRLYSDNAVD

SEQ ID NO: 1828142 - protein, 17 aa, Staphylococcus epidermidis
HSKLKNLYFLQENAKQS

SEQ ID NO: 1828143 - protein, 26 aa, Staphylococcus epidermidis
HSKVIFCEANEWKQFYQQNHSLITEL

SEQ ID NO: 1828144 - protein, 26 aa, Staphylococcus epidermidis
HSLSLYACIYALFTGRTFIGQKVFNA

SEQ ID NO: 1828145 - protein, 17 aa, Staphylococcus epidermidis
HSMLGYLGKREQREIKA

SEQ ID NO: 1828146 - protein, 29 aa, Staphylococcus epidermidis
HSMNIPHDLFTPIFAVSRASGWIAHILEQ

SEQ ID NO: 1828147 - protein, 29 aa, Staphylococcus epidermidis
HSMNIPHDLFTPIFAVSRTSGWIAHILEQ

SEQ ID NO: 1828148 - protein, 30 aa, Staphylococcus epidermidis
HSNGKQLLKKLNAFGYTEDDVRKALFEEEE

SEQ ID NO: 1828149 - protein, 19 aa, Staphylococcus epidermidis
HSSLPFLGQNAIKPLLEFI

SEQ ID NO: 1828150 - protein, 17 aa, Staphylococcus epidermidis
HSYPHDWRTKKPVIFRA

SEQ ID NO: 1828151 - protein, 22 aa, Staphylococcus epidermidis
HTFWCANIHYDTDNIHIHIATS

SEQ ID NO: 1828152 - protein, 23 aa, Staphylococcus epidermidis
HTFWCANIHYDTDNIHIHIATSE

SEQ ID NO: 1828153 - protein, 17 aa, Staphylococcus epidermidis
HTKDKDVLAVDHVDLNI

SEQ ID NO: 1828154 - protein, 17 aa, Staphylococcus epidermidis
HTKNKDVLAVDHVDLNI

SEQ ID NO: 1828155 - protein, 20 aa, Staphylococcus epidermidis
HTLEQFLGLIKQIPPMYSSV

SEQ ID NO: 1828156 - protein, 18 aa, Staphylococcus epidermidis
HTLLMETSVLIPANDISR

SEQ ID NO: 1828157 - protein, 24 aa, Staphylococcus epidermidis
HTPGTTLYLWDNGEHRYLFTGDFL

SEQ ID NO: 1828158 - protein, 19 aa, Staphylococcus epidermidis
HTRFPIVNKDFKLVGIVTS

SEQ ID NO: 1828159 - protein, 23 aa, Staphylococcus epidermidis
HTSHFDMQFPVYINAMTGGSEWT

SEQ ID NO: 1828160 - protein, 26 aa, Staphylococcus epidermidis
HTSKELLDLFRLHLTLFEKHSTEETQ

SEQ ID NO: 1828161 - protein, 31 aa, Staphylococcus epidermidis; identical to SEQ ID NO: 1748050

SEQ ID NO: 1828162 - protein, 25 aa, Staphylococcus epidermidis
HVELAQLDYLLPRLQGHGKSLSRLG

SEQ ID NO: 1828163 - protein, 19 aa, Staphylococcus epidermidis
HVELVEVPIKASDRLKARD

SEQ ID NO: 1828164 - protein, 21 aa, Staphylococcus epidermidis
HVFYAALSVNTELGLPAIILV

SEQ ID NO: 1828165 - protein, 26 aa, Staphylococcus epidermidis
HVGKVLTYQVLLKSLYGYVNHTEMAA

SEQ ID NO: 1828166 - protein, 18 aa, Staphylococcus epidermidis
HVGNWRDKFYKENTYKYQ

SEQ ID NO: 1828167 - protein, 17 aa, Staphylococcus epidermidis
HVHPGTVLGISGSTGSS

SEQ ID NO: 1828168 - protein, 18 aa, Staphylococcus epidermidis
HVHPLMFPSEQEGFRVIN

SEQ ID NO: 1828169 - protein, 18 aa, Staphylococcus epidermidis
HVLLTGATGFLGAYLINE

SEQ ID NO: 1828170 - protein, 18 aa, Staphylococcus epidermidis
HVLTTQTLRLPKFKTMKV

SEQ ID NO: 1828171 - protein, 18 aa, Staphylococcus epidermidis
HVMYQDVISFDNQFLKDN

SEQ ID NO: 1828172 - protein, 18 aa, Staphylococcus epidermidis
HVQSFIAQRLYHRQLDFL

SEQ ID NO: 1828173 - protein, 26 aa, Staphylococcus epidermidis
HVQTVGKGGLLLTLAKISAYYNMGLE

SEQ ID NO: 1828174 - protein, 17 aa, Staphylococcus epidermidis
HVTGSRLLKKKHINEYI

SEQ ID NO: 1828175 - protein, 27 aa, Staphylococcus epidermidis
HVTTPEWMLLPMHKGGTFGKFSTAIGL

SEQ ID NO: 1828176 - protein, 17 aa, Staphylococcus epidermidis
HWEIMGLNIMQPFKVYP

SEQ ID NO: 1828177 - protein, 22 aa, Staphylococcus epidermidis
HWYDKETILTVANRLRKWIPQV

SEQ ID NO: 1828178 - protein, 22 aa, Staphylococcus epidermidis
HYAPVLTAFLDPRGQYILEVIV

SEQ ID NO: 1828179 - protein, 19 aa, Staphylococcus epidermidis
HYDLGVKTALWLQTTPLLK

SEQ ID NO: 1828180 - protein, 20 aa, Staphylococcus epidermidis
HYDMNREISPLKKADDAITL

SEQ ID NO: 1828181 - protein, 19 aa, Staphylococcus epidermidis
HYETEAIWQLFKEADYDRV

SEQ ID NO: 1828182 - protein, 23 aa, Staphylococcus epidermidis
HYGPLLNGFYHIPFPDKYRGMFE

SEQ ID NO: 1828183 - protein, 22 aa, Staphylococcus epidermidis
HYLYEHDAIARKILIASQPGNP

SEQ ID NO: 1828184 - protein, 24 aa, Staphylococcus epidermidis
HYNLDKVVLYFTRTIWEGNENRKG

SEQ ID NO: 1828185 - protein, 17 aa, Staphylococcus epidermidis
HYQPYILLIKIFKKENL

SEQ ID NO: 1828186 - protein, 24 aa, Staphylococcus epidermidis
HYSDDYLRNSGLNYTIVHPGLLKD

SEQ ID NO: 1828187 - protein, 27 aa, Staphylococcus epidermidis
HYTGTLVNGLMYQIKDLSGINGEIRPG

SEQ ID NO: 1828188 - protein, 19 aa, Staphylococcus epidermidis
HYTIEYQSFYNLIQSVYED

SEQ ID NO: 1828189 - protein, 24 aa, Staphylococcus epidermidis
IAADMSVRNPGYVSSIILVNPTSI

SEQ ID NO: 1828190 - protein, 24 aa, Staphylococcus epidermidis
IAAQILKYFNIEKIKLLSNNPKKF

SEQ ID NO: 1828191 - protein, 18 aa, Staphylococcus epidermidis
IAAYTVLRELGLSDESIE

SEQ ID NO: 1828192 - protein, 22 aa, Staphylococcus epidermidis
IADNFNVELPKYGKSYLKEMGV

SEQ ID NO: 1828193 - protein, 29 aa, Staphylococcus epidermidis
IADQILKEIISRLSFLNNVGLEYLTLERS

SEQ ID NO: 1828194 - protein, 18 aa, Staphylococcus epidermidis
IAEALYLLQNGTGTALSA

SEQ ID NO: 1828195 - protein, 22 aa, Staphylococcus epidermidis
IAEELVIIEKPMRAFSENSNHM

SEQ ID NO: 1828196 - protein, 25 aa, Staphylococcus epidermidis
IAELNSFWVYQDLNKKNRFKVNGKK

SEQ ID NO: 1828197 - protein, 23 aa, Staphylococcus epidermidis
IAEVKDYVFINNHDPRLFEGFSM

SEQ ID NO: 1828198 - protein, 19 aa, Staphylococcus epidermidis
IAEYSVSIALQLVRKFPAI

SEQ ID NO: 1828199 - protein, 25 aa, Staphylococcus epidermidis
IAFHEPPINTFLPNAKYWQDKNEEI

SEQ ID NO: 1828200 - protein, 22 aa, Staphylococcus epidermidis
IAFNINIPKESIGKATKFLLAL

SEQ ID NO: 1828201 - protein, 18 aa, Staphylococcus epidermidis
IAGLRMMCQFVDDIDVVV

SEQ ID NO: 1828202 - protein, 19 aa, Staphylococcus epidermidis
IAHANAMIMLPGGTRGFKA

SEQ ID NO: 1828203 - protein, 17 aa, Staphylococcus epidermidis
IAHKLEQLLDEGLEWVL

SEQ ID NO: 1828204 - protein, 19 aa, Staphylococcus epidermidis
IAHVKFYVGTLNHKEVVLT

SEQ ID NO: 1828205 - protein, 17 aa, Staphylococcus epidermidis
IAKALRDDLGMAKAQSV

SEQ ID NO: 1828206 - protein, 25 aa, Staphylococcus epidermidis
IAKDFKNIMIIAPLADGYGNLPSVK

SEQ ID NO: 1828207 - protein, 19 aa, Staphylococcus epidermidis
IAKKLLPNDDIQSRGLFAM

SEQ ID NO: 1828208 - protein, 19 aa, Staphylococcus epidermidis
IAKLRLPVNVVGIIASAEN

SEQ ID NO: 1828209 - protein, 24 aa, Staphylococcus epidermidis
IAKYYDFIEVQPPALYQDLMDREL

SEQ ID NO: 1828210 - protein, 19 aa, Staphylococcus epidermidis
IALEQLGINTLYCSAIPTG

SEQ ID NO: 1828211 - protein, 18 aa, Staphylococcus epidermidis
IALLFEKDSTRTRCAFEV

SEQ ID NO: 1828212 - protein, 18 aa, Staphylococcus epidermidis
IALLFEKTSTRTRAAFTV

SEQ ID NO: 1828213 - protein, 17 aa, Staphylococcus epidermidis
IAMAISCSPKLLIADEP

SEQ ID NO: 1828214 - protein, 17 aa, Staphylococcus epidermidis
IAMKLAREYGRPVLMVK

SEQ ID NO: 1828215 - protein, 23 aa, Staphylococcus epidermidis
IANELYKIVRPTITIANRTMSRF

SEQ ID NO: 1828216 - protein, 18 aa, Staphylococcus epidermidis
IAQLDEQPTHLLIDAMKL

SEQ ID NO: 1828217 - protein, 21 aa, Staphylococcus epidermidis
IAQTCYQFKVPFIVTRAVSDL

SEQ ID NO: 1828218 - protein, 25 aa, Staphylococcus epidermidis
IARKHNLHATFMPKPLFGVNGSGMH

SEQ ID NO: 1828219 - protein, 17 aa, Staphylococcus epidermidis
IARKIHDKPLFEKPRLG

SEQ ID NO: 1828220 - protein, 18 aa, Staphylococcus epidermidis
IASDLEFVTDMYGSPGFS

SEQ ID NO: 1828221 - protein, 19 aa, Staphylococcus epidermidis
IASDLQFVTNMYGSPGFSS

SEQ ID NO: 1828222 - protein, 23 aa, Staphylococcus epidermidis
IASRFYIADFDFPKALTKEEIAE

SEQ ID NO: 1828223 - protein, 26 aa, Staphylococcus epidermidis
IATDSYLKLRFIQKSILKAIDSEWIE

SEQ ID NO: 1828224 - protein, 18 aa, Staphylococcus epidermidis
IAYAQYLATRKVYPNESI

SEQ ID NO: 1828225 - protein, 18 aa, Staphylococcus epidermidis
IAYSLYNELKDPDVPIRL

SEQ ID NO: 1828226 - protein, 29 aa, Staphylococcus epidermidis
ICDDYDIYRLLKYLYYFDNVKDYQEFINE

SEQ ID NO: 1828227 - protein, 24 aa, Staphylococcus epidermidis
ICDHYNLWLHVDGAYGLSHILSDK

SEQ ID NO: 1828228 - protein, 24 aa, Staphylococcus epidermidis
ICGGTKFLHSIINSLKELNYDMNH

SEQ ID NO: 1828229 - protein, 17 aa, Staphylococcus epidermidis
ICHSLNGKVFKVKDMMP

SEQ ID NO: 1828230 - protein, 25 aa, Staphylococcus epidermidis
ICKDYNIFRQCYCGCVFAAMKQGID

SEQ ID NO: 1828231 - protein, 21 aa, Staphylococcus epidermidis
ICKKIYLNLETPPIITEEKMK

SEQ ID NO: 1828232 - protein, 24 aa, Staphylococcus epidermidis
ICSSLYYNFTLSNISFYGDMKGNE

SEQ ID NO: 1828233 - protein, 18 aa, Staphylococcus epidermidis
IDAAIFNLGYLPKGNKEI

SEQ ID NO: 1828234 - protein, 23 aa, Staphylococcus epidermidis
IDAARYFLTMRSPDSHFDFDLEL

SEQ ID NO: 1828235 - protein, 28 aa, Staphylococcus epidermidis
IDDIIGVFHSKYLLAWSKHKEDAITNYA

SEQ ID NO: 1828236 - protein, 32 aa, Staphylococcus epidermidis
IDDITLKLAPITHLIPALNTIALKQVINVIAL

SEQ ID NO: 1828237 - protein, 23 aa, Staphylococcus epidermidis
IDDLKNIFTDYDKVIFSVGSGGS

SEQ ID NO: 1828238 - protein, 25 aa, Staphylococcus epidermidis
IDDNGDIYFIFTNESLQNILDKSKN

SEQ ID NO: 1828239 - protein, 17 aa, Staphylococcus epidermidis
IDDYFEMILNYFKQINE

SEQ ID NO: 1828240 - protein, 23 aa, Staphylococcus epidermidis
IDEIKNAKFPVLLAGMRSSSQAE

SEQ ID NO: 1828241 - protein, 22 aa, Staphylococcus epidermidis
IDELPLGIYRFLEKETKVYART

SEQ ID NO: 1828242 - protein, 31 aa, Staphylococcus epidermidis
IDEMSMVDTWLFHQFLSAVPLDAQIIFVGDE

SEQ ID NO: 1828243 - protein, 17 aa, Staphylococcus epidermidis
IDFFITATDLQNKILTQ

SEQ ID NO: 1828244 - protein, 19 aa, Staphylococcus epidermidis
IDFLNLKIEKVKAPIQTIP

SEQ ID NO: 1828245 - protein, 18 aa, Staphylococcus epidermidis
IDFNDFDIPRVLGDIIIC

SEQ ID NO: 1828246 - protein, 32 aa, Staphylococcus epidermidis
IDFSNPELLFPLLNDTFHLPLVIATTGEKDTL

SEQ ID NO: 1828247 - protein, 27 aa, Staphylococcus epidermidis
IDGNEYIDYVLSWGPLILGHKNKQVIE

SEQ ID NO: 1828248 - protein, 24 aa, Staphylococcus epidermidis
IDHIKYFIATYTQTLVKPLIAYIQ

SEQ ID NO: 1828249 - protein, 24 aa, Staphylococcus epidermidis
IDHSYFNVTYLSTLYTDDLESSLT

SEQ ID NO: 1828250 - protein, 26 aa, Staphylococcus epidermidis
IDIDMKYVLLSGDWIDVGLPKRMKKV

SEQ ID NO: 1828251 - protein, 22 aa, Staphylococcus epidermidis
IDIEPSYFYTLLGPSGCGKTTI

SEQ ID NO: 1828252 - protein, 19 aa, Staphylococcus epidermidis
IDIGYFYLGAKNSALKFQK

SEQ ID NO: 1828253 - protein, 24 aa, Staphylococcus epidermidis
IDITRINPRLKDVNIKVACDVTNP

SEQ ID NO: 1828254 - protein, 23 aa, Staphylococcus epidermidis
IDKDKLLNLIRKNKHMHPQDIVQ

SEQ ID NO: 1828255 - protein, 24 aa, Staphylococcus epidermidis
IDKIKISMGYLDNLSLDLSSNLNT

SEQ ID NO: 1828256 - protein, 20 aa, Staphylococcus epidermidis
IDKLCSYLHISPSEFFEHNP

SEQ ID NO: 1828257 - protein, 17 aa, Staphylococcus epidermidis
IDKQADLNWFIPDFTKS

SEQ ID NO: 1828258 - protein, 18 aa, Staphylococcus epidermidis
IDLDYADVLGLQSQGRDN

SEQ ID NO: 1828259 - protein, 28 aa, Staphylococcus epidermidis
IDLEENRTLPIFGKYVFSTAAGIHQQGI

SEQ ID NO: 1828260 - protein, 27 aa, Staphylococcus epidermidis
IDLIPEYAHLNIFPVGRLDKDTEGLLL

SEQ ID NO: 1828261 - protein, 25 aa, Staphylococcus epidermidis
IDLNEMVGALPKQLTKRKLLNPNSQ

SEQ ID NO: 1828262 - protein, 20 aa, Staphylococcus epidermidis
IDLWEYFAAIAEDDYEIALS

SEQ ID NO: 1828263 - protein, 30 aa, Staphylococcus epidermidis
IDLYFTSLSHRTIVYKGWLRSDQIKGLYLD

SEQ ID NO: 1828264 - protein, 17 aa, Staphylococcus epidermidis
IDMRSSHRLILVDENSL

SEQ ID NO: 1828265 - protein, 24 aa, Staphylococcus epidermidis
IDNNYTPLIIKPSTIKGINYQMEV

SEQ ID NO: 1828266 - protein, 26 aa, Staphylococcus epidermidis
IDNQQWQYAMNRFLPNDIYVKSVQTV

SEQ ID NO: 1828267 - protein, 27 aa, Staphylococcus epidermidis
IDNYDGHLLIQWYSKGIYKFRYNVIEA

SEQ ID NO: 1828268 - protein, 32 aa, Staphylococcus epidermidis
IDNYNGHLLIQWYSKGIYKFRFPILEAIKEVY

SEQ ID NO: 1828269 - protein, 18 aa, Staphylococcus epidermidis
IDPIRDLSSYIRVADEEG

SEQ ID NO: 1828270 - protein, 19 aa, Staphylococcus epidermidis
IDPVSLNPLMFDNTTKAYY

SEQ ID NO: 1828271 - protein, 20 aa, Staphylococcus epidermidis
IDQMRGLNNEIIEFIKQLDD

SEQ ID NO: 1828272 - protein, 18 aa, Staphylococcus epidermidis
IDQRLKIVSLSEKGKEYI

SEQ ID NO: 1828273 - protein, 26 aa, Staphylococcus epidermidis
IDRFSFKNYLYVFLANHFISSELSNH

SEQ ID NO: 1828274 - protein, 23 aa, Staphylococcus epidermidis
IDRGLDYVFFGHIFPTTSHPNEL

SEQ ID NO: 1828275 - protein, 25 aa, Staphylococcus epidermidis
IDRVDHRYVYVNFGRIEAVLSEAER

SEQ ID NO: 1828276 - protein, 21 aa, Staphylococcus epidermidis
IDSLMLKMIINKSSNLEQGVD

SEQ ID NO: 1828277 - protein, 24 aa, Staphylococcus epidermidis
IDVLDGFHRLLAVQRALRENPMIE

SEQ ID NO: 1828278 - protein, 22 aa, Staphylococcus epidermidis
IDWVIIGPEQPLIDGLADLLRN

SEQ ID NO: 1828279 - protein, 24 aa, Staphylococcus epidermidis
IDYDPFIIDKLLSPDSLQYCLVMA

SEQ ID NO: 1828280 - protein, 17 aa, Staphylococcus epidermidis
IDYINDNIIYGSEIKRE

SEQ ID NO: 1828281 - protein, 25 aa, Staphylococcus epidermidis
IDYRLKGIAFDLLEYALKFAFEHYS

SEQ ID NO: 1828282 - protein, 17 aa, Staphylococcus epidermidis
IEAAFGVEIFIRTKKQL

SEQ ID NO: 1828283 - protein, 18 aa, Staphylococcus epidermidis
IEALTGKSAFLYLEDIQS

SEQ ID NO: 1828284 - protein, 19 aa, Staphylococcus epidermidis
IECIYALYKKNRRSLQIYG

SEQ ID NO: 1828285 - protein, 26 aa, Staphylococcus epidermidis
IEDEDILPYIYRGLHDKSPAVRRTAG

SEQ ID NO: 1828286 - protein, 19 aa, Staphylococcus epidermidis
IEDIRHFYTNDVRFLDQFK

SEQ ID NO: 1828287 - protein, 22 aa, Staphylococcus epidermidis
IEDLLEMIGLVAEVQELKANPE

SEQ ID NO: 1828288 - protein, 22 aa, Staphylococcus epidermidis
IEDLLITDKYKNIYQLFHSDKK

SEQ ID NO: 1828289 - protein, 21 aa, Staphylococcus epidermidis
IEDLRIISCHIGNGASIAAID

SEQ ID NO: 1828290 - protein, 28 aa, Staphylococcus epidermidis
IEDLTDSFAPYLTMAEGLKLAALTFDKD

SEQ ID NO: 1828291 - protein, 23 aa, Staphylococcus epidermidis
IEDTKFLMHFWDSWDHISYKQAF

SEQ ID NO: 1828292 - protein, 22 aa, Staphylococcus epidermidis
IEDYLKIYQYFAQPFGESYAIA

SEQ ID NO: 1828293 - protein, 22 aa, Staphylococcus epidermidis
IEEAFVVKQILQHLATKHGINF

SEQ ID NO: 1828294 - protein, 28 aa, Staphylococcus epidermidis
IEEALKFKPITLNPWGISDLELIGIGGF

SEQ ID NO: 1828295 - protein, 27 aa, Staphylococcus epidermidis
IEEIAPLFDKALPYYKQFIQEVAQFLE

SEQ ID NO: 1828296 - protein, 28 aa, Staphylococcus epidermidis
IEEIPGELIMKILAFDSDLGKIDLVGQE

SEQ ID NO: 1828297 - protein, 23 aa, Staphylococcus epidermidis
IEERYLLFMLEQSQIDDETTSHH

SEQ ID NO: 1828298 - protein, 21 aa, Staphylococcus epidermidis
IEETLTMPFFSDKKAIVVKNA

SEQ ID NO: 1828299 - protein, 22 aa, Staphylococcus epidermidis
IEFGIKKVIYAIKDTTLVSKGD

SEQ ID NO: 1828300 - protein, 18 aa, Staphylococcus epidermidis
IEFLGRMDYQISLRGHRI

SEQ ID NO: 1828301 - protein, 23 aa, Staphylococcus epidermidis
IEGALRFYDFLNQQSFKVGDKEI

SEQ ID NO: 1828302 - protein, 25 aa, Staphylococcus epidermidis
IEGAQKIYELFKPTLEKKDKKLSAD

SEQ ID NO: 1828303 - protein, 17 aa, Staphylococcus epidermidis
IEGLDEFLTGPTAIATS

SEQ ID NO: 1828304 - protein, 17 aa, Staphylococcus epidermidis
IEGNDWEVLLKPAKRIK

SEQ ID NO: 1828305 - protein, 20 aa, Staphylococcus epidermidis
IEGNGNWNFTLFIQNGRVKD

SEQ ID NO: 1828306 - protein, 25 aa, Staphylococcus epidermidis
IEGNLFDKYLDYMSIDKLKKKQGYN

SEQ ID NO: 1828307 - protein, 17 aa, Staphylococcus epidermidis
IEGTLNILSPGGTLLLC

SEQ ID NO: 1828308 - protein, 27 aa, Staphylococcus epidermidis
IEGYHTLLTIGRYPICYINIQMDPILV

SEQ ID NO: 1828309 - protein, 38 aa, Staphylococcus epidermidis
IEHELRYPILSQTLILPPLLNQTYLSYQKLRSGMTMKE

SEQ ID NO: 1828310 - protein, 24 aa, Staphylococcus epidermidis
IEHPYPLNSFTLKVATSLFISEND

SEQ ID NO: 1828311 - protein, 23 aa, Staphylococcus epidermidis
IEHRLVYKIKNDSIFIVSCRFHY

SEQ ID NO: 1828312 - protein, 18 aa, Staphylococcus epidermidis
IEIAIKMAYQYWKNIDAK

SEQ ID NO: 1828313 - protein, 17 aa, Staphylococcus epidermidis
IEIIMWDERLSTMAAER

SEQ ID NO: 1828314 - protein, 21 aa, Staphylococcus epidermidis
IEILLSLHHLLKQNGLTTANQ

SEQ ID NO: 1828315 - protein, 17 aa, Staphylococcus epidermidis
IEKIVVYQPKEVLKKYL

SEQ ID NO: 1828316 - protein, 21 aa, Staphylococcus epidermidis
IEKKPLIVMVNGMGGTPLSEL

SEQ ID NO: 1828317 - protein, 19 aa, Staphylococcus epidermidis
IEKKYKFYVQGATLQEMAP

SEQ ID NO: 1828318 - protein, 17 aa, Staphylococcus epidermidis
IEKKYNILFPQLALNEE

SEQ ID NO: 1828319 - protein, 17 aa, Staphylococcus epidermidis
IEKSNWEFLYYSSELEG

SEQ ID NO: 1828320 - protein, 18 aa, Staphylococcus epidermidis
IELICDRAVFLRDGKFVE

SEQ ID NO: 1828321 - protein, 23 aa, Staphylococcus epidermidis
IELLRAIKQPKYLYGDAVVPFEG

SEQ ID NO: 1828322 - protein, 25 aa, Staphylococcus epidermidis
IELMNAGFQHLQFYRIIIEDQHIEK

SEQ ID NO: 1828323 - protein, 19 aa, Staphylococcus epidermidis
IELQTVPNGFYYPPDSEAE

SEQ ID NO: 1828324 - protein, 21 aa, Staphylococcus epidermidis
IELRMHGIKAKILILGVIRTE

SEQ ID NO: 1828325 - protein, 23 aa, Staphylococcus epidermidis
IELSGVQFFTLPFATVSEVQNYF

SEQ ID NO: 1828326 - protein, 33 aa, Staphylococcus epidermidis
IELSIVNVKYRTYYDHIWVYEKDGSVAGCIIAY

SEQ ID NO: 1828327 - protein, 18 aa, Staphylococcus epidermidis
IELVRRLLKENNVVNGGV

SEQ ID NO: 1828328 - protein, 18 aa, Staphylococcus epidermidis
IEMAAASGLALLSKDERN

SEQ ID NO: 1828329 - protein, 17 aa, Staphylococcus epidermidis
IEMCLLLPNLNEEQYGS

SEQ ID NO: 1828330 - protein, 24 aa, Staphylococcus epidermidis
IEMKKTVIFVFYGKSRPKYNNHTL

SEQ ID NO: 1828331 - protein, 25 aa, Staphylococcus epidermidis
IENEKYIVTWALGHLVTNAAPEQYD

SEQ ID NO: 1828332 - protein, 27 aa, Staphylococcus epidermidis
IENIFAIGDIVPGLPLAHKASYEAKVA

SEQ ID NO: 1828333 - protein, 25 aa, Staphylococcus epidermidis
IENIQPFLYHFYDMSVGICHNGNLI

SEQ ID NO: 1828334 - protein, 17 aa, Staphylococcus epidermidis
IEPFLMSYDKLIDFCKK

SEQ ID NO: 1828335 - protein, 19 aa, Staphylococcus epidermidis
IEQDLVECIVTLPGQLFYS

SEQ ID NO: 1828336 - protein, 20 aa, Staphylococcus epidermidis
IEQLATQLVFMRDGQIILKE

SEQ ID NO: 1828337 - protein, 29 aa, Staphylococcus epidermidis
IERDLNGIYKLIFKLPVNKSDQHKLVEKD

SEQ ID NO: 1828338 - protein, 17 aa, Staphylococcus epidermidis
IERLVPFRTLTGRQSYY

SEQ ID NO: 1828339 - protein, 17 aa, Staphylococcus epidermidis
IESHLPGVTLKIKQMPF

SEQ ID NO: 1828340 - protein, 25 aa, Staphylococcus epidermidis
IESNLSALSFKYLTSHDALGSIIVG

SEQ ID NO: 1828341 - protein, 18 aa, Staphylococcus epidermidis
IESSFGVEIFIRTKKQLI

SEQ ID NO: 1828342 - protein, 18 aa, Staphylococcus epidermidis
IETLFAKRLKEIKQIIAN

SEQ ID NO: 1828343 - protein, 21 aa, Staphylococcus epidermidis
IETNYIDRFPLPIKEIIENDS

SEQ ID NO: 1828344 - protein, 19 aa, Staphylococcus epidermidis
IEVLYVKPEYRKQSIATHL

SEQ ID NO: 1828345 - protein, 23 aa, Staphylococcus epidermidis
IEVVYGFAQLKRGAALANHELGK

SEQ ID NO: 1828346 - protein, 17 aa, Staphylococcus epidermidis
IEWLIQEGYTKLTLPKA

SEQ ID NO: 1828347 - protein, 28 aa, Staphylococcus epidermidis
IEYDVALFSYHKLLEIFFSVINPLDEGG

SEQ ID NO: 1828348 - protein, 20 aa, Staphylococcus epidermidis
IFASRTLIDILRAYEFEIET

SEQ ID NO: 1828349 - protein, 19 aa, Staphylococcus epidermidis
IFCDVGEFLMIRDIFKKLE

SEQ ID NO: 1828350 - protein, 29 aa, Staphylococcus epidermidis
IFCHQDISNIKLIDKYWKYLKNESEKILA

SEQ ID NO: 1828351 - protein, 17 aa, Staphylococcus epidermidis
IFDIALYRKVASKVGVE

SEQ ID NO: 1828352 - protein, 25 aa, Staphylococcus epidermidis
IFFDKLTDLLKYMIPGYKKEGKSQL

SEQ ID NO: 1828353 - protein, 18 aa, Staphylococcus epidermidis
IFGSGAYRISSREMWRDL

SEQ ID NO: 1828354 - protein, 20 aa, Staphylococcus epidermidis
IFKGIYIPTKEDWQRLAREV

SEQ ID NO: 1828355 - protein, 20 aa, Staphylococcus epidermidis
IFKGLLHEVFKEYGVLFIDA

SEQ ID NO: 1828356 - protein, 19 aa, Staphylococcus epidermidis
IFKQYVNCPVYVDNDANVA

SEQ ID NO: 1828357 - protein, 17 aa, Staphylococcus epidermidis
IFLEGPYEVLEEAKQYP

SEQ ID NO: 1828358 - protein, 21 aa, Staphylococcus epidermidis
IFNESPIIQKVTFTGSTQVGK

SEQ ID NO: 1828359 - protein, 28 aa, Staphylococcus epidermidis
IFNSLSTPFLALYDLPTKGKGILFWQEH

SEQ ID NO: 1828360 - protein, 18 aa, Staphylococcus epidermidis
IFNSLYDVSGLGLDLFAG

SEQ ID NO: 1828361 - protein, 19 aa, Staphylococcus epidermidis
IFPDAFVPFLQQYDQRVVN

SEQ ID NO: 1828362 - protein, 21 aa, Staphylococcus epidermidis
IFSDLWDDLFGLFDKLRESFK

SEQ ID NO: 1828363 - protein, 19 aa, Staphylococcus epidermidis
IFTNEPLDILVPEGGVIQY

SEQ ID NO: 1828364 - protein, 26 aa, Staphylococcus epidermidis
IFTNEPLEIILPEYGVIQYKVSDNVI

SEQ ID NO: 1828365 - protein, 22 aa, Staphylococcus epidermidis
IFTVAMGKLQIFLEQDIAKMTS

SEQ ID NO: 1828366 - protein, 19 aa, Staphylococcus epidermidis
IFTVIYKNKKYRAADIVYE

SEQ ID NO: 1828367 - protein, 18 aa, Staphylococcus epidermidis
IFYILNTKNKVSFKGSFT

SEQ ID NO: 1828368 - protein, 24 aa, Staphylococcus epidermidis
IGAMKLQDILKYIEKHTLLIVGNR

SEQ ID NO: 1828369 - protein, 20 aa, Staphylococcus epidermidis
IGELLMCDIIDAFINAEYKP

SEQ ID NO: 1828370 - protein, 24 aa, Staphylococcus epidermidis
IGEQKFGLRLPGEFNREMMKEAVQ

SEQ ID NO: 1828371 - protein, 17 aa, Staphylococcus epidermidis
IGFGKAGKTLAAHAAGH

SEQ ID NO: 1828372 - protein, 17 aa, Staphylococcus epidermidis
IGFTLDEQIQFSKKALQ

SEQ ID NO: 1828373 - protein, 19 aa, Staphylococcus epidermidis
IGGLALGLAVTGYRPVMEI

SEQ ID NO: 1828374 - protein, 36 aa, Staphylococcus epidermidis
IGGVEHAVLHLLYARFWHKVLYDLGVVPTKEPFQKL

SEQ ID NO: 1828375 - protein, 20 aa, Staphylococcus epidermidis
IGIFLTDNGDLYAIGNICPH

SEQ ID NO: 1828376 - protein, 17 aa, Staphylococcus epidermidis
IGIIYKKDKQHVSAMCS

SEQ ID NO: 1828377 - protein, 26 aa, Staphylococcus epidermidis
IGINPNWLTKPIMGKIFMPIVNDARS

SEQ ID NO: 1828378 - protein, 21 aa, Staphylococcus epidermidis
IGKRPMDRVLKPLLKMNARIS

SEQ ID NO: 1828379 - protein, 21 aa, Staphylococcus epidermidis
IGKRPMDRVMKPLLKMNANIS

SEQ ID NO: 1828380 - protein, 27 aa, Staphylococcus epidermidis
IGLLLPNQRMIFNIPIRTIEYNHEEAV

SEQ ID NO: 1828381 - protein, 21 aa, Staphylococcus epidermidis
IGLQLIGKPFDEKTLYRVAYQ

SEQ ID NO: 1828382 - protein, 25 aa, Staphylococcus epidermidis
IGLTTQFIPHWEQPEYIKSLTFESA

SEQ ID NO: 1828383 - protein, 19 aa, Staphylococcus epidermidis
IGMALDKYLHMSIRKIERS

SEQ ID NO: 1828384 - protein, 18 aa, Staphylococcus epidermidis
IGMLLKSIKLMRKELKNW

SEQ ID NO: 1828385 - protein, 19 aa, Staphylococcus epidermidis
IGMPLEELIEILTLIYEEE

SEQ ID NO: 1828386 - protein, 20 aa, Staphylococcus epidermidis
IGPVEAVRQALKRSGKTASD

SEQ ID NO: 1828387 - protein, 20 aa, Staphylococcus epidermidis
IGQTLLPEVLSLYNTQFPNV

SEQ ID NO: 1828388 - protein, 27 aa, Staphylococcus epidermidis
IGRGMTINRMYWRARRRESIFMTYILK

SEQ ID NO: 1828389 - protein, 31 aa, Staphylococcus epidermidis
IGRVKPFYGNFGIYLRAYTYIRTMGAEGLKE

SEQ ID NO: 1828390 - protein, 19 aa, Staphylococcus epidermidis
IGSKDIEFTFIEKPKKNIY

SEQ ID NO: 1828391 - protein, 21 aa, Staphylococcus epidermidis
IGTAIPVPVLGTLVGAGVGAI

SEQ ID NO: 1828392 - protein, 17 aa, Staphylococcus epidermidis
IGTFYPFINDNVELFGV

SEQ ID NO: 1828393 - protein, 21 aa, Staphylococcus epidermidis
IGTRYVVLTLNNPAGTNNNGW

SEQ ID NO: 1828394 - protein, 19 aa, Staphylococcus epidermidis
IGVLLPDGRMIFNIPIRTI

SEQ ID NO: 1828395 - protein, 17 aa, Staphylococcus epidermidis
IGYLIEHPKLYQDLSGL

SEQ ID NO: 1828396 - protein, 18 aa, Staphylococcus epidermidis
IHDKPLFEKPRLGKVPDY

SEQ ID NO: 1828397 - protein, 24 aa, Staphylococcus epidermidis
IHDQFDHYLLNDLTPFKGKSPSTE

SEQ ID NO: 1828398 - protein, 19 aa, Staphylococcus epidermidis
IHELSQIIQPHPALLEAIG

SEQ ID NO: 1828399 - protein, 20 aa, Staphylococcus epidermidis
IHGANTYLLQQFFSPHSNRR

SEQ ID NO: 1828400 - protein, 17 aa, Staphylococcus epidermidis
IHIAHGIYPIPAPATAE

SEQ ID NO: 1828401 - protein, 18 aa, Staphylococcus epidermidis
IHIAHGIYPIPAPATAEI

SEQ ID NO: 1828402 - protein, 24 aa, Staphylococcus epidermidis
IHLNQYDYLIKRYLLNIERENDIS

SEQ ID NO: 1828403 - protein, 26 aa, Staphylococcus epidermidis
IHLRKSLSRPYIFGMRKLEEDNSFSS

SEQ ID NO: 1828404 - protein, 26 aa, Staphylococcus epidermidis
IHMSMKALLPLVLESLDIHLSDISNQ

SEQ ID NO: 1828405 - protein, 18 aa, Staphylococcus epidermidis
IHNHIRGLSPWPVAYTTM

SEQ ID NO: 1828406 - protein, 23 aa, Staphylococcus epidermidis
IHQVAPISLEFYKQFIGGEATEL

SEQ ID NO: 1828407 - protein, 18 aa, Staphylococcus epidermidis
IHRTCEVLIIIDPQYANN

SEQ ID NO: 1828408 - protein, 20 aa, Staphylococcus epidermidis
IHVINLLKDKEKVGFIAVEQ

SEQ ID NO: 1828409 - protein, 26 aa, Staphylococcus epidermidis
IHVTDEWIIQIAYDKLIIMAKSEMDQ

SEQ ID NO: 1828410 - protein, 20 aa, Staphylococcus epidermidis
IIAEKYLKDHKQLLLVTNNL

SEQ ID NO: 1828411 - protein, 18 aa, Staphylococcus epidermidis
IIALRQRAKKRNIKLNVK

SEQ ID NO: 1828412 - protein, 18 aa, Staphylococcus epidermidis
IIDNSGLVGGYFKDYFKE

SEQ ID NO: 1828413 - protein, 32 aa, Staphylococcus epidermidis
IIDPSGILSGSPYWYTLPNYADKDKFNRTSDV

SEQ ID NO: 1828414 - protein, 20 aa, Staphylococcus epidermidis
IIEGHLFLNGKKPIQHRSSY

SEQ ID NO: 1828415 - protein, 27 aa, Staphylococcus epidermidis
IIEINCHGGILTINRILELTMTYGARM

SEQ ID NO: 1828416 - protein, 17 aa, Staphylococcus epidermidis
IIEMAVASGLDLLKEDE

SEQ ID NO: 1828417 - protein, 20 aa, Staphylococcus epidermidis
IIEQWNIVKLPFNVGCLSEY

SEQ ID NO: 1828418 - protein, 18 aa, Staphylococcus epidermidis
IIFDHYKSYFSHKLVIKC

SEQ ID NO: 1828419 - protein, 18 aa, Staphylococcus epidermidis
IIFDLLVEYDGELPFWDK

SEQ ID NO: 1828420 - protein, 17 aa, Staphylococcus epidermidis
IIFLDEPTTYLDICHQL

SEQ ID NO: 1828421 - protein, 18 aa, Staphylococcus epidermidis
IIFVINQIDKHNEEEITF

SEQ ID NO: 1828422 - protein, 21 aa, Staphylococcus epidermidis
IIGICLGMQLLFEHSAEGDVD

SEQ ID NO: 1828423 - protein, 25 aa, Staphylococcus epidermidis
IIGINPNWLTKPILSDIFSSIVNEA

SEQ ID NO: 1828424 - protein, 17 aa, Staphylococcus epidermidis
IIGYKVNGEPFATARIR

SEQ ID NO: 1828425 - protein, 21 aa, Staphylococcus epidermidis
IIIDAIGQLIGMRASSDYVRH

SEQ ID NO: 1828426 - protein, 22 aa, Staphylococcus epidermidis
IIKKNRIDPFYNTNLEVILKSL

SEQ ID NO: 1828427 - protein, 17 aa, Staphylococcus epidermidis
IIKPHIPIVYAVKNDDA

SEQ ID NO: 1828428 - protein, 18 aa, Staphylococcus epidermidis
IILDFYKNKNITDVLADI

SEQ ID NO: 1828429 - protein, 17 aa, Staphylococcus epidermidis
IILLPGPPKEMQPMAKN

SEQ ID NO: 1828430 - protein, 18 aa, Staphylococcus epidermidis
IILYALIQSKHAIKQFSL

SEQ ID NO: 1828431 - protein, 18 aa, Staphylococcus epidermidis
IIMLYREYAGMFFKSQKL

SEQ ID NO: 1828432 - protein, 18 aa, Staphylococcus epidermidis
IIMWDERLSTMAAERSLL

SEQ ID NO: 1828433 - protein, 24 aa, Staphylococcus epidermidis
IINAYDHMWGYFKKVATDEEQHKA

SEQ ID NO: 1828434 - protein, 26 aa, Staphylococcus epidermidis
IINDQPLYKFAPLTLGDTGLLTQWTM

SEQ ID NO: 1828435 - protein, 21 aa, Staphylococcus epidermidis
IINEPTAAALAYGLDKTDKDQ

SEQ ID NO: 1828436 - protein, 30 aa, Staphylococcus epidermidis
IINYHSNYDMLSWLQDPFTKNKTGKRVNLE

SEQ ID NO: 1828437 - protein, 26 aa, Staphylococcus epidermidis
IINYHSTYDILSWVQDPVFKNNPGKR

SEQ ID NO: 1828438 - protein, 18 aa, Staphylococcus epidermidis
IINYQYPVGYSYKKDSRG

SEQ ID NO: 1828439 - protein, 20 aa, Staphylococcus epidermidis
IIPMIDYFKDKDIEIRFIEF

SEQ ID NO: 1828440 - protein, 25 aa, Staphylococcus epidermidis
IIPSYRAILIYFDNTKIKGNELLEN

SEQ ID NO: 1828441 - protein, 18 aa, Staphylococcus epidermidis
IIPVHHIAGHIYANHLEQ

SEQ ID NO: 1828442 - protein, 28 aa, Staphylococcus epidermidis
IIQKRFTLNMLYPYIDEILITKSKTLMG

SEQ ID NO: 1828443 - protein, 25 aa, Staphylococcus epidermidis
IIQQYPIQVVVLKPFRLGGIDRILD

SEQ ID NO: 1828444 - protein, 18 aa, Staphylococcus epidermidis
IISGLWTHFGYADEFDVP

SEQ ID NO: 1828445 - protein, 18 aa, Staphylococcus epidermidis
IISIMIFTKPSGIRKKFI

SEQ ID NO: 1828446 - protein, 20 aa, Staphylococcus epidermidis
IISVLKRFKAMLLQKNETVE

SEQ ID NO: 1828447 - protein, 33 aa, Staphylococcus epidermidis
IITVSEYLKQFVKVFLDLGIKVKFYNVVGNHSR

SEQ ID NO: 1828448 - protein, 17 aa, Staphylococcus epidermidis
IIVTLAEKTPYLESKRL

SEQ ID NO: 1828449 - protein, 17 aa, Staphylococcus epidermidis
IIWPKSVTPFDIHLITI

SEQ ID NO: 1828450 - protein, 19 aa, Staphylococcus epidermidis
IKAAKIGVGIILSKSAPTS

SEQ ID NO: 1828451 - protein, 17 aa, Staphylococcus epidermidis
IKAFRQCGFEIDKVVFE

SEQ ID NO: 1828452 - protein, 25 aa, Staphylococcus epidermidis
IKALNPKLKAFAPVREWAWSREEEI

SEQ ID NO: 1828453 - protein, 21 aa, Staphylococcus epidermidis
IKDFAAVGLLFRDGDDYIWKS

SEQ ID NO: 1828454 - protein, 24 aa, Staphylococcus epidermidis
IKDIYRVYKYKFGITFPIHAKINV

SEQ ID NO: 1828455 - protein, 25 aa, Staphylococcus epidermidis
IKDKDKFIIFTSYPNLNEIKNKLNN

SEQ ID NO: 1828456 - protein, 25 aa, Staphylococcus epidermidis
IKDKLFELEGDLPLFPGHGPYTTVD

SEQ ID NO: 1828457 - protein, 27 aa, Staphylococcus epidermidis
IKDLRRLGLRVYFNIKNALVSLSEEKR

SEQ ID NO: 1828458 - protein, 25 aa, Staphylococcus epidermidis
IKDNNMIRFIHKPLGFNTDLKVVKL

SEQ ID NO: 1828459 - protein, 18 aa, Staphylococcus epidermidis
IKEAAMLAGYFSKAGSSA

SEQ ID NO: 1828460 - protein, 19 aa, Staphylococcus epidermidis
IKEAAMLAGYFSKAGSSAQ

SEQ ID NO: 1828461 - protein, 33 aa, Staphylococcus epidermidis
IKEFKPDLFISHYPLLMTYSHKLHLHDGSNGSF

SEQ ID NO: 1828462 - protein, 18 aa, Staphylococcus epidermidis
IKEHDLFIIISGSGSTEH

SEQ ID NO: 1828463 - protein, 22 aa, Staphylococcus epidermidis
IKEIQLLRVMGLPFNGQKITDK

SEQ ID NO: 1828464 - protein, 25 aa, Staphylococcus epidermidis
IKEISPIDLTYLMKSTLKANEKQLQ

SEQ ID NO: 1828465 - protein, 27 aa, Staphylococcus epidermidis
IKEKPKARWLFLTLSTKNAIDGEHLEQ

SEQ ID NO: 1828466 - protein, 19 aa, Staphylococcus epidermidis
IKELGFIFNNLNINKIKAK

SEQ ID NO: 1828467 - protein, 23 aa, Staphylococcus epidermidis
IKEQAMIYLLINAESKWGQLTRP

SEQ ID NO: 1828468 - protein, 29 aa, Staphylococcus epidermidis
IKEQFRGYGLGQLLLKYVKNYASHTCEVM

SEQ ID NO: 1828469 - protein, 24 aa, Staphylococcus epidermidis
IKETPLYFLQHGILFMKPHDNPKT

SEQ ID NO: 1828470 - protein, 19 aa, Staphylococcus epidermidis
IKFGKSKIWLGVWEHNPKA

SEQ ID NO: 1828471 - protein, 18 aa, Staphylococcus epidermidis
IKFKAFLEHALKLGADYV

SEQ ID NO: 1828472 - protein, 19 aa, Staphylococcus epidermidis
IKFKAFLEHALKLGADYVA

SEQ ID NO: 1828473 - protein, 27 aa, Staphylococcus epidermidis
IKGETKFYQVIFAAIYNLYQDGLTTIT

SEQ ID NO: 1828474 - protein, 24 aa, Staphylococcus epidermidis
IKGTTIVCIIKRDNTKYKGNENKA

SEQ ID NO: 1828475 - protein, 24 aa, Staphylococcus epidermidis
IKGWMRHWDEYQFGYFILMMRDNQ

SEQ ID NO: 1828476 - protein, 17 aa, Staphylococcus epidermidis
IKHFMTIQLLSDMAGIS

SEQ ID NO: 1828477 - protein, 20 aa, Staphylococcus epidermidis
IKHHKEISRIKRLGAKTFEQ

SEQ ID NO: 1828478 - protein, 22 aa, Staphylococcus epidermidis
IKHIGITNKKMLYRLGAMGVTK

SEQ ID NO: 1828479 - protein, 21 aa, Staphylococcus epidermidis
IKHLYNQLDIYKEQSKRDKEQ

SEQ ID NO: 1828480 - protein, 26 aa, Staphylococcus epidermidis
IKIAISHYYFGYIHPFYDGNGRTSRF

SEQ ID NO: 1828481 - protein, 29 aa, Staphylococcus epidermidis
IKIIDRTQLILEIFALRARSREGKLHVEL

SEQ ID NO: 1828482 - protein, 25 aa, Staphylococcus epidermidis
IKKDLPHIKVVMLTSFIEDKEVYRA

SEQ ID NO: 1828483 - protein, 26 aa, Staphylococcus epidermidis
IKKHQLNFDLLVDKDYLLANKVGVYQ

SEQ ID NO: 1828484 - protein, 25 aa, Staphylococcus epidermidis
IKKNGNILIIPKLDNYQNLLKDLAN

SEQ ID NO: 1828485 - protein, 19 aa, Staphylococcus epidermidis
IKKSETIFIYGYGASFVVA

SEQ ID NO: 1828486 - protein, 22 aa, Staphylococcus epidermidis
IKKYQLSYIIDDKFNYASNLDS

SEQ ID NO: 1828487 - protein, 18 aa, Staphylococcus epidermidis
IKLLLNYTDTYISGHDIA

SEQ ID NO: 1828488 - protein, 24 aa, Staphylococcus epidermidis
IKMSKLNFESFKLAFRDPDARVKL

SEQ ID NO: 1828489 - protein, 27 aa, Staphylococcus epidermidis
IKNHQSFNFPKFIKLIKDRDSEAIYEE

SEQ ID NO: 1828490 - protein, 21 aa, Staphylococcus epidermidis
IKNIILNYLIEFNLSTDLITK

SEQ ID NO: 1828491 - protein, 22 aa, Staphylococcus epidermidis
IKNIILNYLIEFNLSTDLITKF

SEQ ID NO: 1828492 - protein, 26 aa, Staphylococcus epidermidis
IKNKQSLILLHITKIMKIETRLQIMF

SEQ ID NO: 1828493 - protein, 29 aa, Staphylococcus epidermidis
IKNRTQVETWWRWYRNGESYRFSQHVGKQ

SEQ ID NO: 1828494 - protein, 25 aa, Staphylococcus epidermidis
IKNYKHFAYVIKMLPQIIEKLRDNG

SEQ ID NO: 1828495 - protein, 23 aa, Staphylococcus epidermidis
IKPEQVIKLIDKGNLEVDDNGNV

SEQ ID NO: 1828496 - protein, 29 aa, Staphylococcus epidermidis
IKQGITKFRIVPLLIFSAMHYVSDIPQIL

SEQ ID NO: 1828497 - protein, 20 aa, Staphylococcus epidermidis
IKQLYNQVAIYKEQSNRDKE

SEQ ID NO: 1828498 - protein, 24 aa, Staphylococcus epidermidis
IKRIQELGFSLSEIYKLLGVVDKD

SEQ ID NO: 1828499 - protein, 18 aa, Staphylococcus epidermidis
IKRVIAHLPNFESDTDTF

SEQ ID NO: 1828500 - protein, 19 aa, Staphylococcus epidermidis
IKVCEYLKDLLSQYDIDSK

SEQ ID NO: 1828501 - protein, 25 aa, Staphylococcus epidermidis
IKVTAWMPLMRNRGLLDHPTIVDIA

SEQ ID NO: 1828502 - protein, 18 aa, Staphylococcus epidermidis
IKVTHIFKALSDFNRVRI

SEQ ID NO: 1828503 - protein, 17 aa, Staphylococcus epidermidis
IKWVLGEQSAKSLRGAK

SEQ ID NO: 1828504 - protein, 17 aa, Staphylococcus epidermidis
ILAFINKDELELQDDGK

SEQ ID NO: 1828505 - protein, 26 aa, Staphylococcus epidermidis
ILDDGESYSYLIFVQETWSMLHENRD

SEQ ID NO: 1828506 - protein, 23 aa, Staphylococcus epidermidis
ILDENPYQLVYDIKGIGFNKADQ

SEQ ID NO: 1828507 - protein, 19 aa, Staphylococcus epidermidis
ILDFALALVGKPELLILDE

SEQ ID NO: 1828508 - protein, 17 aa, Staphylococcus epidermidis
ILDIEIPGITGLEILSY

SEQ ID NO: 1828509 - protein, 18 aa, Staphylococcus epidermidis
ILDIEIPGITGLEILSYV

SEQ ID NO: 1828510 - protein, 19 aa, Staphylococcus epidermidis
ILDIEIPGMTGLEILAQIR

SEQ ID NO: 1828511 - protein, 33 aa, Staphylococcus epidermidis; identical to SEQ ID NO: 1681094

SEQ ID NO: 1828512 - protein, 29 aa, Staphylococcus epidermidis
ILENNIEHKIWYKLLVNLGINSITAIGHQ

SEQ ID NO: 1828513 - protein, 18 aa, Staphylococcus epidermidis
ILENVSIPLIYNGMGSKE

SEQ ID NO: 1828514 - protein, 18 aa, Staphylococcus epidermidis
ILEQNWVGGAYWTPPEVT

SEQ ID NO: 1828515 - protein, 25 aa, Staphylococcus epidermidis
ILEQSFDLMFVKWIPRKQNKEANQL

SEQ ID NO: 1828516 - protein, 24 aa, Staphylococcus epidermidis
ILEQSFELMFVKWVPREQNKEANQ

SEQ ID NO: 1828517 - protein, 19 aa, Staphylococcus epidermidis
ILERTVYPVVPPKVDYRLT

SEQ ID NO: 1828518 - protein, 17 aa, Staphylococcus epidermidis
ILGLLIINNKQTTFKNI

SEQ ID NO: 1828519 - protein, 22 aa, Staphylococcus epidermidis
ILGQMRDAFFLAQETGTTGTIF

SEQ ID NO: 1828520 - protein, 19 aa, Staphylococcus epidermidis
ILGVSDRINRLFDITGLKD

SEQ ID NO: 1828521 - protein, 18 aa, Staphylococcus epidermidis
ILHFAQHNAIDWVIIGPE

SEQ ID NO: 1828522 - protein, 20 aa, Staphylococcus epidermidis
ILHVLKRFKAMLIQKNETVE

SEQ ID NO: 1828523 - protein, 18 aa, Staphylococcus epidermidis
ILIDMHIGDSISVNGACL

SEQ ID NO: 1828524 - protein, 27 aa, Staphylococcus epidermidis
ILISIELPKNLVSLMLEYLRFAEYSHT

SEQ ID NO: 1828525 - protein, 21 aa, Staphylococcus epidermidis
ILIVVDMFLTGFDSKKLNTLY

SEQ ID NO: 1828526 - protein, 18 aa, Staphylococcus epidermidis
ILKAIRLINTLDEAKILD

SEQ ID NO: 1828527 - protein, 22 aa, Staphylococcus epidermidis
ILKDKGYKVKLLIVGALEKDDS

SEQ ID NO: 1828528 - protein, 18 aa, Staphylococcus epidermidis
ILKNIEKLVWMGGTFLDK

SEQ ID NO: 1828529 - protein, 20 aa, Staphylococcus epidermidis
ILLIIKLHYLVKNDVNFTTA

SEQ ID NO: 1828530 - protein, 17 aa, Staphylococcus epidermidis
ILLLDESLSALDLKLRT

SEQ ID NO: 1828531 - protein, 18 aa, Staphylococcus epidermidis
ILLMIETGGRFSDCINLT

SEQ ID NO: 1828532 - protein, 23 aa, Staphylococcus epidermidis
ILLPTHNWGNYKLVFSTRHGAHI

SEQ ID NO: 1828533 - protein, 17 aa, Staphylococcus epidermidis
ILLQVLLHTSIGKKEGY

SEQ ID NO: 1828534 - protein, 29 aa, Staphylococcus epidermidis
ILMPKTEMPPFREFAWVQDKFGVSFQLAL

SEQ ID NO: 1828535 - protein, 19 aa, Staphylococcus epidermidis
ILNIQKLSVDCHFPRTSRK

SEQ ID NO: 1828536 - protein, 17 aa, Staphylococcus epidermidis
ILNLLTLSNNDPLLVDQ

SEQ ID NO: 1828537 - protein, 21 aa, Staphylococcus epidermidis
ILNQTILNHFKLLMTHYDKLG

SEQ ID NO: 1828538 - protein, 18 aa, Staphylococcus epidermidis
ILNSGIDGLLIGEALMKC

SEQ ID NO: 1828539 - protein, 26 aa, Staphylococcus epidermidis
ILPLTEGRVIIYMKYSKEYLEKIKLN

SEQ ID NO: 1828540 - protein, 17 aa, Staphylococcus epidermidis
ILQEALNFVRMGDRFIV

SEQ ID NO: 1828541 - protein, 17 aa, Staphylococcus epidermidis
ILQEALNFVRMGDRFVV

SEQ ID NO: 1828542 - protein, 20 aa, Staphylococcus epidermidis
ILQGLDIKPVNLPKDVKPSK

SEQ ID NO: 1828543 - protein, 17 aa, Staphylococcus epidermidis
ILQVLSIDESGKLDVSV

SEQ ID NO: 1828544 - protein, 22 aa, Staphylococcus epidermidis
ILQYTLGDDFVAAKPAGICSCT

SEQ ID NO: 1828545 - protein, 18 aa, Staphylococcus epidermidis
ILRNFPEKLSKYISNWFS

SEQ ID NO: 1828546 - protein, 19 aa, Staphylococcus epidermidis
ILSAKELLYLLTQAAVGDE

SEQ ID NO: 1828547 - protein, 30 aa, Staphylococcus epidermidis
ILSKLPKTYVSLFMKLARPFIITKKSRARL

SEQ ID NO: 1828548 - protein, 28 aa, Staphylococcus epidermidis
ILSLNHSKYLLIELPSNGVPHYTERLFY

SEQ ID NO: 1828549 - protein, 29 aa, Staphylococcus epidermidis
ILTGTGMFPKWKGIPATFALKLITVILGK

SEQ ID NO: 1828550 - protein, 26 aa, Staphylococcus epidermidis
ILTGTGMFPKWKGVPIRLAMKIVTFI

SEQ ID NO: 1828551 - protein, 43 aa, Staphylococcus epidermidis
ILTGTGMFPKWKGVPIRLAMKLVTFIFGKRRRLKWVNQLLNKT

SEQ ID NO: 1828552 - protein, 18 aa, Staphylococcus epidermidis
ILTQLFQYRFGENQVDGH

SEQ ID NO: 1828553 - protein, 17 aa, Staphylococcus epidermidis
ILTRILSEEFNKLSDNE

SEQ ID NO: 1828554 - protein, 20 aa, Staphylococcus epidermidis
ILVDDYHPMIYKLQFRENQE

SEQ ID NO: 1828555 - protein, 20 aa, Staphylococcus epidermidis
ILVQVPLPKQVSEQKVLESI

SEQ ID NO: 1828556 - protein, 19 aa, Staphylococcus epidermidis
ILVTLLHQLNETTQNGLAS

SEQ ID NO: 1828557 - protein, 26 aa, Staphylococcus epidermidis
IMAIYVQTVASYIFKHILLEVYKAQC

SEQ ID NO: 1828558 - protein, 18 aa, Staphylococcus epidermidis
IMGCYGIGVSRTLSAIVE

SEQ ID NO: 1828559 - protein, 17 aa, Staphylococcus epidermidis
IMGDLNFIKNLKILSEA

SEQ ID NO: 1828560 - protein, 29 aa, Staphylococcus epidermidis
IMKEENYNIIFKLIIKNNFLDDSTSDLID

SEQ ID NO: 1828561 - protein, 19 aa, Staphylococcus epidermidis
IMKELIKIFHYFVRLFNKN

SEQ ID NO: 1828562 - protein, 17 aa, Staphylococcus epidermidis
IMKSSARGMFDKGWLFV

SEQ ID NO: 1828563 - protein, 19 aa, Staphylococcus epidermidis
IMLAIPELFWSIELSKELD

SEQ ID NO: 1828564 - protein, 18 aa, Staphylococcus epidermidis
IMLMIDWKDGREGVLTYD

SEQ ID NO: 1828565 - protein, 17 aa, Staphylococcus epidermidis
IMLTKEYLRLLEKRKEV

SEQ ID NO: 1828566 - protein, 26 aa, Staphylococcus epidermidis
IMNNHSILLYPLEIKSLYHIDEWINA

SEQ ID NO: 1828567 - protein, 22 aa, Staphylococcus epidermidis
IMQIAFTPLRELGIDWPSVHAD

SEQ ID NO: 1828568 - protein, 25 aa, Staphylococcus epidermidis
INAEFGRWQIGKNDKLLLIGSGAYP

SEQ ID NO: 1828569 - protein, 24 aa, Staphylococcus epidermidis
INDDYVFTRLKTMGKLAMLMLEDL

SEQ ID NO: 1828570 - protein, 26 aa, Staphylococcus epidermidis
INDIPYKIDIYPYYSSDASAALKAGV

SEQ ID NO: 1828571 - protein, 20 aa, Staphylococcus epidermidis
INDLMKIKGFGKKTFEKLKE

SEQ ID NO: 1828572 - protein, 19 aa, Staphylococcus epidermidis
INDWWEQVTAAYQFLRNEG

SEQ ID NO: 1828573 - protein, 18 aa, Staphylococcus epidermidis
INDYLKLNANFYNNADTF

SEQ ID NO: 1828574 - protein, 24 aa, Staphylococcus epidermidis
INEDVAMAFGFFDGMHRGHDKVFQ

SEQ ID NO: 1828575 - protein, 29 aa, Staphylococcus epidermidis
INEIITVNLYDWKYPFKNCEFDNIDQYNM

SEQ ID NO: 1828576 - protein, 29 aa, Staphylococcus epidermidis
INEQFQISKQFWAYLIREGHIESPDKFIQ

SEQ ID NO: 1828577 - protein, 21 aa, Staphylococcus epidermidis
INEQIFISLAVKFSKARLIDN

SEQ ID NO: 1828578 - protein, 18 aa, Staphylococcus epidermidis
INESHWFYKATSQGIYLS

SEQ ID NO: 1828579 - protein, 28 aa, Staphylococcus epidermidis
INESNLEMLFLDPQYFRKGYGTEILQTL

SEQ ID NO: 1828580 - protein, 25 aa, Staphylococcus epidermidis
INFISLFENLFSYVPRNKPIELKEI

SEQ ID NO: 1828581 - protein, 18 aa, Staphylococcus epidermidis
INFQLYNYAQEHPAYNGM

SEQ ID NO: 1828582 - protein, 32 aa, Staphylococcus epidermidis
INGADNLTIDSGFYKTPKYSVGDYVWEDTNKD

SEQ ID NO: 1828583 - protein, 17 aa, Staphylococcus epidermidis
INGFWAYQNTRNKEFTV

SEQ ID NO: 1828584 - protein, 26 aa, Staphylococcus epidermidis
INGGELTAKGYYRRVWRDGKARNRVQ

SEQ ID NO: 1828585 - protein, 20 aa, Staphylococcus epidermidis
INHAYFIPAGNKYIMRHMKV

SEQ ID NO: 1828586 - protein, 23 aa, Staphylococcus epidermidis
INHEHRLVYTIKDPSIIIIACRY

SEQ ID NO: 1828587 - protein, 26 aa, Staphylococcus epidermidis
INIERNLINYLVGKIGYEIKPAGGVF

SEQ ID NO: 1828588 - protein, 31 aa, Staphylococcus epidermidis
INIPYNKNFINQIGWYLNFEKDIDLIGDKST

SEQ ID NO: 1828589 - protein, 19 aa, Staphylococcus epidermidis
INIPYVLNRALENEKNSYI

SEQ ID NO: 1828590 - protein, 19 aa, Staphylococcus epidermidis
INMIKHIKTYLPESFVIAG

SEQ ID NO: 1828591 - protein, 18 aa, Staphylococcus epidermidis
INNEYRFQILVKYKREPQ

SEQ ID NO: 1828592 - protein, 23 aa, Staphylococcus epidermidis
INPNLHGQLFKLLEFSNMEESDV

SEQ ID NO: 1828593 - protein, 18 aa, Staphylococcus epidermidis
INQFVLKPIINELSPIFK

SEQ ID NO: 1828594 - protein, 28 aa, Staphylococcus epidermidis
INQKVLTPIINELNFIFKNLHINKIKAK

SEQ ID NO: 1828595 - protein, 21 aa, Staphylococcus epidermidis
INQLGISILPATIAQLLNDDV

SEQ ID NO: 1828596 - protein, 18 aa, Staphylococcus epidermidis
INQLHLKTVFLSLKKAFN

SEQ ID NO: 1828597 - protein, 24 aa, Staphylococcus epidermidis
INQNTFLSMPLYAPTINEQKKIGD

SEQ ID NO: 1828598 - protein, 28 aa, Staphylococcus epidermidis
INQPSWMHQLLKFYQLAPRTLERLLPKF

SEQ ID NO: 1828599 - protein, 24 aa, Staphylococcus epidermidis
INRDEVIHRFITSLPQRHVVPDEG

SEQ ID NO: 1828600 - protein, 19 aa, Staphylococcus epidermidis
INRGKLPIIAGGTGLYIQS

SEQ ID NO: 1828601 - protein, 19 aa, Staphylococcus epidermidis
INRLIPLSEGYIYFKEKPI

SEQ ID NO: 1828602 - protein, 18 aa, Staphylococcus epidermidis
INSKYLIATTAAKRAREL

SEQ ID NO: 1828603 - protein, 20 aa, Staphylococcus epidermidis
INSLRYTGHPDAVINKVAMI

SEQ ID NO: 1828604 - protein, 19 aa, Staphylococcus epidermidis
INVDALRDIGLEPGPKYQE

SEQ ID NO: 1828605 - protein, 26 aa, Staphylococcus epidermidis
INVSFDDTFRFLKGHYFFTIKDKNAN

SEQ ID NO: 1828606 - protein, 21 aa, Staphylococcus epidermidis
INYILYVRKQLSDIPMSIEFR

SEQ ID NO: 1828607 - protein, 19 aa, Staphylococcus epidermidis
INYLNDFHPKAGETLYLVG

SEQ ID NO: 1828608 - protein, 24 aa, Staphylococcus epidermidis
IPAEFCLSIQRESFSKALFGRWRK

SEQ ID NO: 1828609 - protein, 31 aa, Staphylococcus epidermidis
IPERYHLTLIDRMPFHGLKPEFYALAAGTKS

SEQ ID NO: 1828610 - protein, 26 aa, Staphylococcus epidermidis
IPFDKKREFDPNLAPGTEKVVQKGEP

SEQ ID NO: 1828611 - protein, 20 aa, Staphylococcus epidermidis
IPFIKKMHHEGLFASISVGV

SEQ ID NO: 1828612 - protein, 21 aa, Staphylococcus epidermidis
IPGHFAPIADFDLVTKAKKAA

SEQ ID NO: 1828613 - protein, 17 aa, Staphylococcus epidermidis
IPHNFNMQIQLSDSKIN

SEQ ID NO: 1828614 - protein, 19 aa, Staphylococcus epidermidis
IPIKALTAHLGFGNYELRL

SEQ ID NO: 1828615 - protein, 18 aa, Staphylococcus epidermidis
IPKQLGFKALKEDTLQPS

SEQ ID NO: 1828616 - protein, 24 aa, Staphylococcus epidermidis
IPMDQKFIFNPYETKSIAGFDIES

SEQ ID NO: 1828617 - protein, 31 aa, Staphylococcus epidermidis
IPNFDKLKGRLILMITRFSVYLRKATPEAKN

SEQ ID NO: 1828618 - protein, 24 aa, Staphylococcus epidermidis
IPNQKACINLLRKLTAIKPGSRIK

SEQ ID NO: 1828619 - protein, 17 aa, Staphylococcus epidermidis
IPPEIRPMVQLDGGRFA

SEQ ID NO: 1828620 - protein, 30 aa, Staphylococcus epidermidis
IPQSLKKDWGFFFMPKFNFVINVANENRIE

SEQ ID NO: 1828621 - protein, 24 aa, Staphylococcus epidermidis
IPSVSLTAWQALFDHYHLQSNDRI

SEQ ID NO: 1828622 - protein, 18 aa, Staphylococcus epidermidis
IPSYRAILIYFDKSGING

SEQ ID NO: 1828623 - protein, 24 aa, Staphylococcus epidermidis
IPTKQAPKLLLKGTGDLKGSSIGT

SEQ ID NO: 1828624 - protein, 17 aa, Staphylococcus epidermidis
IPYVSWSIKKAIKENIK

SEQ ID NO: 1828625 - protein, 34 aa, Staphylococcus epidermidis
IQATNHQYLKVFWNHLKPVMESLILISMRQRMAN

SEQ ID NO: 1828626 - protein, 34 aa, Staphylococcus epidermidis
IQATNHQYLKVFWNHLKPVMESLILISMRQRMTN

SEQ ID NO: 1828627 - protein, 24 aa, Staphylococcus epidermidis
IQEIKEFICIYSLSKSESSVLNLR

SEQ ID NO: 1828628 - protein, 25 aa, Staphylococcus epidermidis
IQEIKQFIKAYVKSHSFIQTLVLGI

SEQ ID NO: 1828629 - protein, 19 aa, Staphylococcus epidermidis
IQFQSLRDIGNPVDLALFY

SEQ ID NO: 1828630 - protein, 24 aa, Staphylococcus epidermidis
IQGDANVFIFPSLEAGNIGYKIAQ

SEQ ID NO: 1828631 - protein, 24 aa, Staphylococcus epidermidis
IQGMIDLIFQKDGAYYFVDYKTDA

SEQ ID NO: 1828632 - protein, 30 aa, Staphylococcus epidermidis
IQGPIIWVEDTLIALQQLAKAYLNHVNPKV

SEQ ID NO: 1828633 - protein, 18 aa, Staphylococcus epidermidis
IQILLFSINTAQRNTLVT

SEQ ID NO: 1828634 - protein, 17 aa, Staphylococcus epidermidis
IQKAVAEMKLAVGLLVD

SEQ ID NO: 1828635 - protein, 18 aa, Staphylococcus epidermidis
IQKAVAEMKLAVGLLVDK

SEQ ID NO: 1828636 - protein, 22 aa, Staphylococcus epidermidis
IQKAVAEMKLAVGLLVDKKLSH

SEQ ID NO: 1828637 - protein, 27 aa, Staphylococcus epidermidis
IQKEKFYQLPKVFFTNPKYTKLSNDAK

SEQ ID NO: 1828638 - protein, 20 aa, Staphylococcus epidermidis
IQLKHSISEIPNIKALLNEL

SEQ ID NO: 1828639 - protein, 20 aa, Staphylococcus epidermidis
IQLKNDVPLYLIVIGKHLKQ

SEQ ID NO: 1828640 - protein, 19 aa, Staphylococcus epidermidis
IQLLAPVVSHRKGTHEKLI

SEQ ID NO: 1828641 - protein, 19 aa, Staphylococcus epidermidis
IQLYNALSFNFYYLGNKDE

SEQ ID NO: 1828642 - protein, 17 aa, Staphylococcus epidermidis
IQLYPLLYSIDENEREV

SEQ ID NO: 1828643 - protein, 25 aa, Staphylococcus epidermidis
IQNKLTAFVVLPKDLEDFGPAWIER

SEQ ID NO: 1828644 - protein, 24 aa, Staphylococcus epidermidis
IQPYEGHLWIMDPIDGTANLVKQQ

SEQ ID NO: 1828645 - protein, 25 aa, Staphylococcus epidermidis
IQQHFTLSMLYRYIDEIHISKNKSL

SEQ ID NO: 1828646 - protein, 20 aa, Staphylococcus epidermidis
IQQLFQNIYRYLRDDLKLGL

SEQ ID NO: 1828647 - protein, 25 aa, Staphylococcus epidermidis
IQQRRPVHIHLPIDVALTEIEVSKP

SEQ ID NO: 1828648 - protein, 25 aa, Staphylococcus epidermidis
IQQSLEEPLIFYNKMKSSDIKPKLL

SEQ ID NO: 1828649 - protein, 25 aa, Staphylococcus epidermidis
IQRSTFMPHLDYDISFMIQEYIEDK

SEQ ID NO: 1828650 - protein, 17 aa, Staphylococcus epidermidis
IQSVLEIVLLRAQDAME

SEQ ID NO: 1828651 - protein, 17 aa, Staphylococcus epidermidis
IQTALEVFITKFLERYY

SEQ ID NO: 1828652 - protein, 19 aa, Staphylococcus epidermidis
IQVFMKRFEEFQSHIALIQ

SEQ ID NO: 1828653 - protein, 23 aa, Staphylococcus epidermidis
IQVGSHFHFFEANQALKFDREKA

SEQ ID NO: 1828654 - protein, 20 aa, Staphylococcus epidermidis
IQYPDVLWQHVILHTKLNQT

SEQ ID NO: 1828655 - protein, 28 aa, Staphylococcus epidermidis
IRDVATKAWYNTYLNIYAASTVNELLAA

SEQ ID NO: 1828656 - protein, 26 aa, Staphylococcus epidermidis
IREGGIRGIVLSLLSLDHIDVSDDAI

SEQ ID NO: 1828657 - protein, 24 aa, Staphylococcus epidermidis
IRELIFREFYYVLMTNYPETAHVA

SEQ ID NO: 1828658 - protein, 18 aa, Staphylococcus epidermidis
IRFENFNELFQFVFNEYY

SEQ ID NO: 1828659 - protein, 17 aa, Staphylococcus epidermidis
IRGIFGIGPGRMNAFTV

SEQ ID NO: 1828660 - protein, 20 aa, Staphylococcus epidermidis
IRKQIPLKRTKIKKYKKQIN

SEQ ID NO: 1828661 - protein, 24 aa, Staphylococcus epidermidis
IRLIAADLVDFDWIDGFDIECRNE

SEQ ID NO: 1828662 - protein, 21 aa, Staphylococcus epidermidis
IRNRFNIKVSVFKSADEAIDS

SEQ ID NO: 1828663 - protein, 23 aa, Staphylococcus epidermidis
IRQKYLNFFVEKGHMIEPSAPLV

SEQ ID NO: 1828664 - protein, 26 aa, Staphylococcus epidermidis
IRQNYNFDFIFIDVPPTINSDFTNNA

SEQ ID NO: 1828665 - protein, 23 aa, Staphylococcus epidermidis
IRSSIAIGILEHKGYHNIINVNE

SEQ ID NO: 1828666 - protein, 17 aa, Staphylococcus epidermidis
IRSTRVPNLDLLTSGPI

SEQ ID NO: 1828667 - protein, 27 aa, Staphylococcus epidermidis
IRVNCVAPGPFWSPLQITGGQPQSAIP

SEQ ID NO: 1828668 - protein, 19 aa, Staphylococcus epidermidis
IRYAQYLNELSEQTQFIVI

SEQ ID NO: 1828669 - protein, 32 aa, Staphylococcus epidermidis
IRYYDSVLLSTKFKAPRWLVTPIKNYSVRKHK

SEQ ID NO: 1828670 - protein, 43 aa, Staphylococcus epidermidis
ISAGFTLEQFAVQDFFFQPDYDRPWNYLNVLAQQALGDTFGSD

SEQ ID NO: 1828671 - protein, 26 aa, Staphylococcus epidermidis
ISARMRTYSIPWHTAGRYWGHMNTET

SEQ ID NO: 1828672 - protein, 20 aa, Staphylococcus epidermidis
ISDEPVQFDKVLIAIGRKPN

SEQ ID NO: 1828673 - protein, 30 aa, Staphylococcus epidermidis
ISDITRPTPNHILVPLLIEELNHVPRENFV

SEQ ID NO: 1828674 - protein, 25 aa, Staphylococcus epidermidis
ISDMYLPKEVILEMLYQVDPRLTEL

SEQ ID NO: 1828675 - protein, 23 aa, Staphylococcus epidermidis
ISEDKLVFHLKDGSLEMYIDHDE

SEQ ID NO: 1828676 - protein, 17 aa, Staphylococcus epidermidis
ISEEYNVPLLMKFEVQG

SEQ ID NO: 1828677 - protein, 23 aa, Staphylococcus epidermidis
ISEIYEFVMSKDSFSPSEVTAIA

SEQ ID NO: 1828678 - protein, 22 aa, Staphylococcus epidermidis
ISEMLQLLHNKKKKLFVVSSKK

SEQ ID NO: 1828679 - protein, 30 aa, Staphylococcus epidermidis
ISFAHHIMTYFWMLERDKGRFMDSLKRIDV

SEQ ID NO: 1828680 - protein, 26 aa, Staphylococcus epidermidis
ISGHYRNGILLSPIIGRDIANWLLSG

SEQ ID NO: 1828681 - protein, 20 aa, Staphylococcus epidermidis
ISGIPFNYITKWSDFKKLNK

SEQ ID NO: 1828682 - protein, 28 aa, Staphylococcus epidermidis
ISGNELGLILMKLRYQDLIDASYENLYI

SEQ ID NO: 1828683 - protein, 26 aa, Staphylococcus epidermidis
ISHQMDMIFTHFGVSGPAALRCSQFV

SEQ ID NO: 1828684 - protein, 31 aa, Staphylococcus epidermidis
ISIKQDLISLFKMTKLFLKEKPLIVNSGTPK

SEQ ID NO: 1828685 - protein, 27 aa, Staphylococcus epidermidis
ISIPFDTDYGWNVKFGKNVFINTNCYL

SEQ ID NO: 1828686 - protein, 30 aa, Staphylococcus epidermidis
ISIVYRDDLYLTPVIQNFISLIYNVNFEET

SEQ ID NO: 1828687 - protein, 18 aa, Staphylococcus epidermidis
ISIYPFLCYLDKELVAIG

SEQ ID NO: 1828688 - protein, 24 aa, Staphylococcus epidermidis
ISKAFRGYGLGQLLLKYAMNYARF

SEQ ID NO: 1828689 - protein, 19 aa, Staphylococcus epidermidis
ISLEFYKQFIGGETTGLHT

SEQ ID NO: 1828690 - protein, 28 aa, Staphylococcus epidermidis
ISLNTRLDSNRSFRFTGKVNLGNRYEGY

SEQ ID NO: 1828691 - protein, 20 aa, Staphylococcus epidermidis
ISMPYLRSPFVHHIHPKPFH

SEQ ID NO: 1828692 - protein, 30 aa, Staphylococcus epidermidis
ISNDKFFNIYKDFYLSLSKFSNLFHINRQS

SEQ ID NO: 1828693 - protein, 17 aa, Staphylococcus epidermidis
ISNLLKKRGIRHDVLNA

SEQ ID NO: 1828694 - protein, 19 aa, Staphylococcus epidermidis
ISPELFFQKGDYKGKSNMI

SEQ ID NO: 1828695 - protein, 19 aa, Staphylococcus epidermidis
ISPNYTGYFDGENMIFETF

SEQ ID NO: 1828696 - protein, 19 aa, Staphylococcus epidermidis
ISQGLLEGFKNLGFETYFA

SEQ ID NO: 1828697 - protein, 22 aa, Staphylococcus epidermidis
ISQLFIENVLTKILQHIDDNLE

SEQ ID NO: 1828698 - protein, 21 aa, Staphylococcus epidermidis
ISQYYNNLGVIWYDAHGDLNV

SEQ ID NO: 1828699 - protein, 20 aa, Staphylococcus epidermidis
ISRYMIVNETDKILMALRPY

SEQ ID NO: 1828700 - protein, 20 aa, Staphylococcus epidermidis
ISRYMVVNETDKFLMALRPY

SEQ ID NO: 1828701 - protein, 24 aa, Staphylococcus epidermidis
ISSDYLLCKAFGKTATNIEKYTSQ

SEQ ID NO: 1828702 - protein, 22 aa, Staphylococcus epidermidis
ISSHIWIIETILPNGSIEDNYD

SEQ ID NO: 1828703 - protein, 25 aa, Staphylococcus epidermidis
ISTDKPDPLLGQKAPVTLGHEFSGV

SEQ ID NO: 1828704 - protein, 18 aa, Staphylococcus epidermidis
ISTHSFRHTHCALLIEAG

SEQ ID NO: 1828705 - protein, 23 aa, Staphylococcus epidermidis
ISTNSHPWISMTVKRRIGYLKEQ

SEQ ID NO: 1828706 - protein, 20 aa, Staphylococcus epidermidis
ISVDNGIWKVIDFQHVKPGK

SEQ ID NO: 1828707 - protein, 25 aa, Staphylococcus epidermidis
ISVRDKILIFSGRISSEILIKAAKI

SEQ ID NO: 1828708 - protein, 18 aa, Staphylococcus epidermidis
ISVSKLNKILKGKGTLSG

SEQ ID NO: 1828709 - protein, 20 aa, Staphylococcus epidermidis
ISYEWYKMVVSIIGDGLTVS

SEQ ID NO: 1828710 - protein, 28 aa, Staphylococcus epidermidis
ITADTLFSALFIETLQLGKDTDWLLNDL

SEQ ID NO: 1828711 - protein, 29 aa, Staphylococcus epidermidis
ITDDISTDLVWYLWTGKYSSLFGKRAMTT

SEQ ID NO: 1828712 - protein, 25 aa, Staphylococcus epidermidis
ITDKNLIKPIPTLSTGTYSGASVAT

SEQ ID NO: 1828713 - protein, 17 aa, Staphylococcus epidermidis
ITEDGEIKLINSTVPFG

SEQ ID NO: 1828714 - protein, 31 aa, Staphylococcus epidermidis
ITEVGKKKLKRWLMKYDFKDLVYATDKAFAA

SEQ ID NO: 1828715 - protein, 25 aa, Staphylococcus epidermidis
ITGGEPLLRRNLYQLIEQLNEIEGI

SEQ ID NO: 1828716 - protein, 27 aa, Staphylococcus epidermidis
ITGNPYAIFLYLVNHKEYRRFLHKWVV

SEQ ID NO: 1828717 - protein, 27 aa, Staphylococcus epidermidis
ITGQKADLLLWFLRPEMKDLNTIENEF

SEQ ID NO: 1828718 - protein, 19 aa, Staphylococcus epidermidis
ITIGVPLRYMHSNVSVLNI

SEQ ID NO: 1828719 - protein, 22 aa, Staphylococcus epidermidis
ITKNALLELLQDKFKNSSQIFS

SEQ ID NO: 1828720 - protein, 24 aa, Staphylococcus epidermidis
ITLDHIKHFIAVYTQTLVTPLIAY

SEQ ID NO: 1828721 - protein, 18 aa, Staphylococcus epidermidis
ITLLKIMEMPAYLELQKQ

SEQ ID NO: 1828722 - protein, 17 aa, Staphylococcus epidermidis
ITLVYDYNLKDIEILLS

SEQ ID NO: 1828723 - protein, 25 aa, Staphylococcus epidermidis
ITNRSSIWKYYKNDWKLLFHQGTET

SEQ ID NO: 1828724 - protein, 21 aa, Staphylococcus epidermidis
ITNTLKGVAWFWHTTFNHQTE

SEQ ID NO: 1828725 - protein, 19 aa, Staphylococcus epidermidis
ITPPCMYYYKCGGCQLQHM

SEQ ID NO: 1828726 - protein, 23 aa, Staphylococcus epidermidis
ITRDNLLMRMKEQEWDDVIDTNL

SEQ ID NO: 1828727 - protein, 27 aa, Staphylococcus epidermidis
ITSKPPILLTPLFPTYFFPTHSDRQEE

SEQ ID NO: 1828728 - protein, 27 aa, Staphylococcus epidermidis
ITSNIPFRIRKPLPNITFHQVEVNQYA

SEQ ID NO: 1828729 - protein, 25 aa, Staphylococcus epidermidis
ITTHHSRYLLLTNNYSHDPTPDSGN

SEQ ID NO: 1828730 - protein, 26 aa, Staphylococcus epidermidis
ITTIDPIKFNLLFERFLNPERVTMPD

SEQ ID NO: 1828731 - protein, 27 aa, Staphylococcus epidermidis
ITVIEWSQFIKDLLPPQHLIINIKVKN

SEQ ID NO: 1828732 - protein, 24 aa, Staphylococcus epidermidis
ITYKEVFNLIKENKIWLGVHLGRG

SEQ ID NO: 1828733 - protein, 17 aa, Staphylococcus epidermidis
ITYYPLEHETKFFAFRD

SEQ ID NO: 1828734 - protein, 23 aa, Staphylococcus epidermidis
IVAAICMYALKTAGYQSALMVPT

SEQ ID NO: 1828735 - protein, 25 aa, Staphylococcus epidermidis
IVAEHRLYYLMQNADRFVYMDNGRV

SEQ ID NO: 1828736 - protein, 18 aa, Staphylococcus epidermidis
IVAIIATLKIGAIFVPLS

SEQ ID NO: 1828737 - protein, 20 aa, Staphylococcus epidermidis
IVALTIVNPVAGAVAAGAYT

SEQ ID NO: 1828738 - protein, 38 aa, Staphylococcus epidermidis
IVAPFYKDWDHELFINYLQFFQLPYNKKIKTFSTGMKM

SEQ ID NO: 1828739 - protein, 20 aa, Staphylococcus epidermidis
IVATYDIPRFNKSPYDGFAI

SEQ ID NO: 1828740 - protein, 25 aa, Staphylococcus epidermidis
IVDKILTQLNIRLLEQRISIEVSDK

SEQ ID NO: 1828741 - protein, 17 aa, Staphylococcus epidermidis
IVDKLTLDMIKQLIRMN

SEQ ID NO: 1828742 - protein, 24 aa, Staphylococcus epidermidis
IVDYEPSIKIMLPTELQLEIKSYI

SEQ ID NO: 1828743 - protein, 27 aa, Staphylococcus epidermidis
IVEIAEQLITFIPHSLLTLDNVKYNER

SEQ ID NO: 1828744 - protein, 18 aa, Staphylococcus epidermidis
IVFGAIEEKLKSFESFAT

SEQ ID NO: 1828745 - protein, 24 aa, Staphylococcus epidermidis
IVGEVVKMREKINWFVEQATVQNE

SEQ ID NO: 1828746 - protein, 17 aa, Staphylococcus epidermidis
IVGFNYEGQLAATIEIS

SEQ ID NO: 1828747 - protein, 24 aa, Staphylococcus epidermidis
IVGPGNQFVAYAKKYVFGQVGIDQ

SEQ ID NO: 1828748 - protein, 29 aa, Staphylococcus epidermidis
IVGSETAFPLLYTHFVRRGNWSLQQLVDY

SEQ ID NO: 1828749 - protein, 23 aa, Staphylococcus epidermidis
IVIKDIRMREVISYFATYVFEKG

SEQ ID NO: 1828750 - protein, 17 aa, Staphylococcus epidermidis
IVIKFYRALQKFDYQQG

SEQ ID NO: 1828751 - protein, 17 aa, Staphylococcus epidermidis
IVIRDPLQTYIPRATHK

SEQ ID NO: 1828752 - protein, 26 aa, Staphylococcus epidermidis
IVKINAPLVEGSFTAAVKLSTGGNMK

SEQ ID NO: 1828753 - protein, 21 aa, Staphylococcus epidermidis
IVKNNVDILPYLDASFRTEPS

SEQ ID NO: 1828754 - protein, 28 aa, Staphylococcus epidermidis
IVKNTPDSWYFSKRLLYGKLDEIKEGLG

SEQ ID NO: 1828755 - protein, 17 aa, Staphylococcus epidermidis
IVLIAPIEHKALENLLI

SEQ ID NO: 1828756 - protein, 25 aa, Staphylococcus epidermidis
IVMPRLRITYLYARTKKLLKQYNLS

SEQ ID NO: 1828757 - protein, 35 aa, Staphylococcus epidermidis
IVNDELYVINFERLRNYFFIKKPKRMKYINKFNEE

SEQ ID NO: 1828758 - protein, 26 aa, Staphylococcus epidermidis
IVNSLDFFKPRIGSNIITAPKYDGFL

SEQ ID NO: 1828759 - protein, 24 aa, Staphylococcus epidermidis
IVNVRYRSFYEHIWVYEKDGVVAG

SEQ ID NO: 1828760 - protein, 17 aa, Staphylococcus epidermidis
IVPILRAGLGMTDGVLS

SEQ ID NO: 1828761 - protein, 19 aa, Staphylococcus epidermidis
IVPWQQLAQRKNASLKFIP

SEQ ID NO: 1828762 - protein, 38 aa, Staphylococcus epidermidis
IVQKFPVGVVGAITPWNFPAAMITRKMAPALAAGCTIV

SEQ ID NO: 1828763 - protein, 23 aa, Staphylococcus epidermidis
IVQPHPMAFNYVYYEIYTQMIEM

SEQ ID NO: 1828764 - protein, 18 aa, Staphylococcus epidermidis
IVSWKYHDNNIILGNVVE

SEQ ID NO: 1828765 - protein, 25 aa, Staphylococcus epidermidis
IVTTYLDKDILLPAIGQGALGIECR

SEQ ID NO: 1828766 - protein, 26 aa, Staphylococcus epidermidis
IVVGIAFIIELKYLHGIEKIKDYDVM

SEQ ID NO: 1828767 - protein, 19 aa, Staphylococcus epidermidis
IVVGNTYGRIRAMVNDLGK

SEQ ID NO: 1828768 - protein, 18 aa, Staphylococcus epidermidis
IVYSTQNLDLWYGENHAL

SEQ ID NO: 1828769 - protein, 18 aa, Staphylococcus epidermidis
IWEPIYNKTTIVTKDYFK

SEQ ID NO: 1828770 - protein, 23 aa, Staphylococcus epidermidis
IWNSVPTLFQMLLENMEYYKVID

SEQ ID NO: 1828771 - protein, 21 aa, Staphylococcus epidermidis
IWRKDAYLNFVTRQWIDFISQ

SEQ ID NO: 1828772 - protein, 21 aa, Staphylococcus epidermidis
IYAHVMHTHLLINFVTRTQGV

SEQ ID NO: 1828773 - protein, 20 aa, Staphylococcus epidermidis
IYCGTIGVLLPDGRMIFNIP

SEQ ID NO: 1828774 - protein, 18 aa, Staphylococcus epidermidis
IYDALINIVGHQLLVRLK

SEQ ID NO: 1828775 - protein, 18 aa, Staphylococcus epidermidis
IYDRAILIEWVGPMNRKN

SEQ ID NO: 1828776 - protein, 17 aa, Staphylococcus epidermidis
IYDSYRRAKMQLDADDE

SEQ ID NO: 1828777 - protein, 17 aa, Staphylococcus epidermidis
IYDYIKKIVQTKGYPPS

SEQ ID NO: 1828778 - protein, 18 aa, Staphylococcus epidermidis
IYELYFKNQSPFKQTNFY

SEQ ID NO: 1828779 - protein, 19 aa, Staphylococcus epidermidis
IYHQAYKKGVPQFDLKEIG

SEQ ID NO: 1828780 - protein, 17 aa, Staphylococcus epidermidis
IYIEYHDYYWGQPIYDS

SEQ ID NO: 1828781 - protein, 19 aa, Staphylococcus epidermidis
IYKAINADVLFNKAAQRPG

SEQ ID NO: 1828782 - protein, 23 aa, Staphylococcus epidermidis
IYKPYIEGFVKMLAPIAPHIGEE

SEQ ID NO: 1828783 - protein, 18 aa, Staphylococcus epidermidis
IYKTMPTMNQWLKDIEVQ

SEQ ID NO: 1828784 - protein, 18 aa, Staphylococcus epidermidis
IYLPGGHGTVFDFANNEK

SEQ ID NO: 1828785 - protein, 22 aa, Staphylococcus epidermidis
IYNLPGQVFIFGGQTLFEEMID

SEQ ID NO: 1828786 - protein, 18 aa, Staphylococcus epidermidis
IYNYPTHQTFFSSSDKLS

SEQ ID NO: 1828787 - protein, 26 aa, Staphylococcus epidermidis
IYTGSLYLSLISLLETRDLKGDQTIG

SEQ ID NO: 1828788 - protein, 18 aa, Staphylococcus epidermidis
IYVYVPAVGDSSLAPKGK

SEQ ID NO: 1828789 - protein, 20 aa, Staphylococcus epidermidis
IYYALDLGKSYRLIDKSMLE

SEQ ID NO: 1828790 - protein, 22 aa, Staphylococcus epidermidis
IYYESRVIPLNLPQSLDLDEAY

SEQ ID NO: 1828791 - protein, 30 aa, Staphylococcus epidermidis; identical to SEQ ID NO: 1685793

SEQ ID NO: 1828792 - protein, 20 aa, Staphylococcus epidermidis
KAARRWAYDVKGIEPNKAEI

SEQ ID NO: 1828793 - protein, 26 aa, Staphylococcus epidermidis
KAARSGIVTFKGWTGGGNTLSIFDGK

SEQ ID NO: 1828794 - protein, 18 aa, Staphylococcus epidermidis
KACVLLDMHIGHLKSIME

SEQ ID NO: 1828795 - protein, 19 aa, Staphylococcus epidermidis
KADSVAICWAMGITQQDIG

SEQ ID NO: 1828796 - protein, 21 aa, Staphylococcus epidermidis
KADWEIFQLIANQLGANWDYS

SEQ ID NO: 1828797 - protein, 25 aa, Staphylococcus epidermidis
KAEQYFDRILLLNQTIRYLGAPKEA

SEQ ID NO: 1828798 - protein, 19 aa, Staphylococcus epidermidis
KAESVAICWAMGITQQDIG

SEQ ID NO: 1828799 - protein, 22 aa, Staphylococcus epidermidis
KAFEMMKNDAIFINIGRGAIVD

SEQ ID NO: 1828800 - protein, 29 aa, Staphylococcus epidermidis
KAFIEECKNLKWIAWYATGVNNLPLDYIN

SEQ ID NO: 1828801 - protein, 19 aa, Staphylococcus epidermidis
KAFQKRINDFHMRNGVTIL

SEQ ID NO: 1828802 - protein, 39 aa, Staphylococcus epidermidis
KAGANVTVIYRGERYPKAIKPWILPNFESLVTHEKITME

SEQ ID NO: 1828803 - protein, 38 aa, Staphylococcus epidermidis
KAGANVTVLYRGEQYPKAIKPWILPNFESLVNHEKITM

SEQ ID NO: 1828804 - protein, 25 aa, Staphylococcus epidermidis
KAHADILRKVLFGPTITVKALLSMR

SEQ ID NO: 1828805 - protein, 32 aa, Staphylococcus epidermidis
KAHGTALTYAERYFLMKFFNIPTDEDDADAKQ

SEQ ID NO: 1828806 - protein, 20 aa, Staphylococcus epidermidis
KAHLEDMFNLLLDSTSPKKD

SEQ ID NO: 1828807 - protein, 21 aa, Staphylococcus epidermidis
KAIDYIILNQLFEIGDKAYIF

SEQ ID NO: 1828808 - protein, 23 aa, Staphylococcus epidermidis
KAIDYLREKGIAKAAKKADRIAA

SEQ ID NO: 1828809 - protein, 20 aa, Staphylococcus epidermidis
KAIEVSLAKEKAIKPEQVIK

SEQ ID NO: 1828810 - protein, 23 aa, Staphylococcus epidermidis
KAIKPEGMFWNTTQSLIINVTAS

SEQ ID NO: 1828811 - protein, 17 aa, Staphylococcus epidermidis
KAIMLYHSKVVNKCHYY

SEQ ID NO: 1828812 - protein, 24 aa, Staphylococcus epidermidis
KAIYKRDYLCIIGQTVHEKLGHEM

SEQ ID NO: 1828813 - protein, 19 aa, Staphylococcus epidermidis
KAKASLLTVLPLDKERLAD

SEQ ID NO: 1828814 - protein, 22 aa, Staphylococcus epidermidis
KAKDIINAVPDGTLDKARIEQA

SEQ ID NO: 1828815 - protein, 30 aa, Staphylococcus epidermidis
KAKDNSFEHLLFGLGIRHLGVKASQVLAEK

SEQ ID NO: 1828816 - protein, 17 aa, Staphylococcus epidermidis
KAKEFVENAKDKANDFI

SEQ ID NO: 1828817 - protein, 22 aa, Staphylococcus epidermidis
KAKFVLKQHPYLQYHATANIVC

SEQ ID NO: 1828818 - protein, 22 aa, Staphylococcus epidermidis
KAKIEDGLWFIQGRIDFQIKLN

SEQ ID NO: 1828819 - protein, 24 aa, Staphylococcus epidermidis
KAKLKPPIHEWADKGLLTIVDEPT

SEQ ID NO: 1828820 - protein, 20 aa, Staphylococcus epidermidis
KAKVIILDTYYLMMGGYQKK

SEQ ID NO: 1828821 - protein, 26 aa, Staphylococcus epidermidis
KALDKYYYCLLALDTGVRAEALNKLT

SEQ ID NO: 1828822 - protein, 21 aa, Staphylococcus epidermidis
KALSMWMTLKCGIVDLPYGGG

SEQ ID NO: 1828823 - protein, 17 aa, Staphylococcus epidermidis
KAMGFLVGQIMKASKGQ

SEQ ID NO: 1828824 - protein, 20 aa, Staphylococcus epidermidis
KAMIRPLKEHGKLAMVLVQF

SEQ ID NO: 1828825 - protein, 24 aa, Staphylococcus epidermidis
KAMNADFFILGTPNYHGSYSGILK

SEQ ID NO: 1828826 - protein, 32 aa, Staphylococcus epidermidis
KANIVIWDAPNHEYIPYHFGINHAQKVIKDGK

SEQ ID NO: 1828827 - protein, 21 aa, Staphylococcus epidermidis
KAPEIGLATVYRTLELLAELK

SEQ ID NO: 1828828 - protein, 31 aa, Staphylococcus epidermidis
KAPKTYVEKIKYVGALFLGHYSPEVIGDYVA

SEQ ID NO: 1828829 - protein, 25 aa, Staphylococcus epidermidis
KAQHVVNFMYFIAEELREILASLGL

SEQ ID NO: 1828830 - protein, 24 aa, Staphylococcus epidermidis
KAQKLIVQTVPKSKLDFLSNAPHQ

SEQ ID NO: 1828831 - protein, 24 aa, Staphylococcus epidermidis
KAQNIKARAYKIPFKAIGKAMIDD

SEQ ID NO: 1828832 - protein, 24 aa, Staphylococcus epidermidis
KAQPLIMGCYGIGISRTLSAIVEQ

SEQ ID NO: 1828833 - protein, 28 aa, Staphylococcus epidermidis
KAQSKKFFELYTPLLRKGGLVVTDNVLY

SEQ ID NO: 1828834 - protein, 27 aa, Staphylococcus epidermidis
KARDLLGRFHSIFTDKVDVSMVAPTFI

SEQ ID NO: 1828835 - protein, 43 aa, Staphylococcus epidermidis
KARNIFFEKALKVLRPIYLEQSPVPTFYIVNVGGGYLDGDRYR

SEQ ID NO: 1828836 - protein, 24 aa, Staphylococcus epidermidis
KASAKRNWYIWADPKPDGSEPNNW

SEQ ID NO: 1828837 - protein, 23 aa, Staphylococcus epidermidis
KASILFVPTFKFELNINNLKELI

SEQ ID NO: 1828838 - protein, 30 aa, Staphylococcus epidermidis; identical to SEQ ID NO: 1754920

SEQ ID NO: 1828839 - protein, 17 aa, Staphylococcus epidermidis
KASKFPYAANGRALSLD

SEQ ID NO: 1828840 - protein, 18 aa, Staphylococcus epidermidis
KASPFDGKIIGYLDTENP

SEQ ID NO: 1828841 - protein, 17 aa, Staphylococcus epidermidis
KASPFSPSIVISALERL

SEQ ID NO: 1828842 - protein, 23 aa, Staphylococcus epidermidis
KASYPSTVLMTATLAQVAGVKHI

SEQ ID NO: 1828843 - protein, 25 aa, Staphylococcus epidermidis
KATIKKWITLIQTLPKIQSKQSLIT

SEQ ID NO: 1828844 - protein, 18 aa, Staphylococcus epidermidis
KATRMGIPIVSHLGLTPQ

SEQ ID NO: 1828845 - protein, 27 aa, Staphylococcus epidermidis
KAVELMLLKYDVIQDMLYNLDYSKFNS

SEQ ID NO: 1828846 - protein, 22 aa, Staphylococcus epidermidis
KAVITVPAYFNDAERQATKDAG

SEQ ID NO: 1828847 - protein, 17 aa, Staphylococcus epidermidis
KAVITVPAYFNDGERQA

SEQ ID NO: 1828848 - protein, 17 aa, Staphylococcus epidermidis
KAVLKLLKENNTVPFIA

SEQ ID NO: 1828849 - protein, 25 aa, Staphylococcus epidermidis
KAVTQVMDMLLKKYLKSLLNDIEKS

SEQ ID NO: 1828850 - protein, 17 aa, Staphylococcus epidermidis
KAWMIATQSKKGPFAIL

SEQ ID NO: 1828851 - protein, 23 aa, Staphylococcus epidermidis
KAYDKLFDKYRKLHDILGHENPE

SEQ ID NO: 1828852 - protein, 23 aa, Staphylococcus epidermidis
KAYQFHIKYLKNRKSKIIRPFLN

SEQ ID NO: 1828853 - protein, 24 aa, Staphylococcus epidermidis
KDADVPVWLDRDCPFNIEGGDELV

SEQ ID NO: 1828854 - protein, 32 aa, Staphylococcus epidermidis
KDAIKEWHRILPLIQELPIAALDMGLLATYCQ

SEQ ID NO: 1828855 - protein, 18 aa, Staphylococcus epidermidis
KDAIPNNAPILYKSGAFK

SEQ ID NO: 1828856 - protein, 24 aa, Staphylococcus epidermidis
KDAMGKMFFTMISAFAELEANLLS

SEQ ID NO: 1828857 - protein, 24 aa, Staphylococcus epidermidis
KDAMGKMFFTMMSAFAELEANLLS

SEQ ID NO: 1828858 - protein, 25 aa, Staphylococcus epidermidis
KDDDNLVLVGFGGGLTWGAIVIKWG

SEQ ID NO: 1828859 - protein, 17 aa, Staphylococcus epidermidis
KDDDRLLVPIFDARREA

SEQ ID NO: 1828860 - protein, 25 aa, Staphylococcus epidermidis
KDDTSFFDIVAFGKTAQLLNDYCGK

SEQ ID NO: 1828861 - protein, 23 aa, Staphylococcus epidermidis
KDDTYIIKDIPFGRQMVFEYQNE

SEQ ID NO: 1828862 - protein, 22 aa, Staphylococcus epidermidis
KDEDGYFWFEGRRDDIIISSGY

SEQ ID NO: 1828863 - protein, 33 aa, Staphylococcus epidermidis
KDEEQDLFIDLIFSPIYFNILIKPDSLDENYIE

SEQ ID NO: 1828864 - protein, 23 aa, Staphylococcus epidermidis
KDENVPLWLDRDCPFNIEGGDEL

SEQ ID NO: 1828865 - protein, 27 aa, Staphylococcus epidermidis
KDEPTFINILELLALEYAKDKGYQLYN

SEQ ID NO: 1828866 - protein, 24 aa, Staphylococcus epidermidis
KDFANIFFMMMNYYSIERSMEIAK

SEQ ID NO: 1828867 - protein, 38 aa, Staphylococcus epidermidis
KDFEGTIIFVSHDRYFINQLANKVFDLNLNGGQMYLGD

SEQ ID NO: 1828868 - protein, 18 aa, Staphylococcus epidermidis
KDFNLPVHVIGIDIVREK

SEQ ID NO: 1828869 - protein, 17 aa, Staphylococcus epidermidis
KDFQQLITEAGFDYQLD

SEQ ID NO: 1828870 - protein, 24 aa, Staphylococcus epidermidis
KDFVIHTPLMWLDKAQTWELSDEL

SEQ ID NO: 1828871 - protein, 36 aa, Staphylococcus epidermidis
KDGAKVMSLLEPAYQRGKRDLPYGRALIIYSDDDIV

SEQ ID NO: 1828872 - protein, 26 aa, Staphylococcus epidermidis
KDIHKAMIFNLTLRPNSRKPKHDFTA

SEQ ID NO: 1828873 - protein, 21 aa, Staphylococcus epidermidis
KDIIKVDEPLKRYTYTETGGK

SEQ ID NO: 1828874 - protein, 17 aa, Staphylococcus epidermidis
KDILDFQKPHTYCLVSM

SEQ ID NO: 1828875 - protein, 20 aa, Staphylococcus epidermidis
KDIMFEFNIGKVPMKQIKTE

SEQ ID NO: 1828876 - protein, 24 aa, Staphylococcus epidermidis
KDINWEELFISQTPFMYVVNEKNI

SEQ ID NO: 1828877 - protein, 24 aa, Staphylococcus epidermidis
KDKAFQLLLELGFSRNVMSSSPFQ

SEQ ID NO: 1828878 - protein, 19 aa, Staphylococcus epidermidis
KDKIYKYWGNHTLLSIINY

SEQ ID NO: 1828879 - protein, 24 aa, Staphylococcus epidermidis
KDKKIKLGVIPNFSLYKLHEKNYI

SEQ ID NO: 1828880 - protein, 17 aa, Staphylococcus epidermidis
KDKLYVPVIKHADEKSI

SEQ ID NO: 1828881 - protein, 24 aa, Staphylococcus epidermidis
KDKTLLKEGLVIAVEPFISSRATY

SEQ ID NO: 1828882 - protein, 18 aa, Staphylococcus epidermidis
KDKYKLKKSFIGESFLAV

SEQ ID NO: 1828883 - protein, 17 aa, Staphylococcus epidermidis
KDLDFIISTSEPKKVQQ

SEQ ID NO: 1828884 - protein, 23 aa, Staphylococcus epidermidis
KDLDVTFTLLRPTTESEFEAMVS

SEQ ID NO: 1828885 - protein, 19 aa, Staphylococcus epidermidis
KDLELFTNSQLVGAGLPLW

SEQ ID NO: 1828886 - protein, 19 aa, Staphylococcus epidermidis
KDLFAVVMDAKTGEILAYS

SEQ ID NO: 1828887 - protein, 20 aa, Staphylococcus epidermidis
KDLGILINKHGRIAEIFFKE

SEQ ID NO: 1828888 - protein, 19 aa, Staphylococcus epidermidis
KDLYILGVSDRINRLFDIT

SEQ ID NO: 1828889 - protein, 18 aa, Staphylococcus epidermidis
KDMEARGMVLHINRNTRT

SEQ ID NO: 1828890 - protein, 19 aa, Staphylococcus epidermidis
KDMNLWLKFLNEVMNSNLF

SEQ ID NO: 1828891 - protein, 25 aa, Staphylococcus epidermidis
KDMTSFNSWLPYLNQMNDAPAARSM

SEQ ID NO: 1828892 - protein, 23 aa, Staphylococcus epidermidis
KDNYLSMFLSYEQQKKKLKHFRV

SEQ ID NO: 1828893 - protein, 21 aa, Staphylococcus epidermidis
KDPETKGLYWDGKMYVFDERI

SEQ ID NO: 1828894 - protein, 21 aa, Staphylococcus epidermidis
KDPHNLPWKSLEIDLVLECTG

SEQ ID NO: 1828895 - protein, 25 aa, Staphylococcus epidermidis
KDQIKIGATVLAGFGPRIVRINNFS

SEQ ID NO: 1828896 - protein, 23 aa, Staphylococcus epidermidis
KDQKVIDWLWETQDKTFFNSKED

SEQ ID NO: 1828897 - protein, 28 aa, Staphylococcus epidermidis
KDRAELLLRVAAIIRRRKEEISAVMVYE

SEQ ID NO: 1828898 - protein, 19 aa, Staphylococcus epidermidis
KDRILIPQNDFDRSPKKNK

SEQ ID NO: 1828899 - protein, 36 aa, Staphylococcus epidermidis
KDRVKLALLASFKNKSLLKFYCKETQWFSGKEVDTI

SEQ ID NO: 1828900 - protein, 21 aa, Staphylococcus epidermidis
KDSDIFWTDAMLSMLENMKKE

SEQ ID NO: 1828901 - protein, 19 aa, Staphylococcus epidermidis
KDTEGITWTFVSPSAEFDP

SEQ ID NO: 1828902 - protein, 25 aa, Staphylococcus epidermidis
KDTFEWLQPLLKRKFPEHHFEFTYI

SEQ ID NO: 1828903 - protein, 26 aa, Staphylococcus epidermidis
KDTKKKLWWGKFKYPTNPNAGYFYCA

SEQ ID NO: 1828904 - protein, 22 aa, Staphylococcus epidermidis
KDTYTIVIPPPNVTGKLHLGHA

SEQ ID NO: 1828905 - protein, 23 aa, Staphylococcus epidermidis
KDVELVSFLNKELGLPGINPEIV

SEQ ID NO: 1828906 - protein, 25 aa, Staphylococcus epidermidis
KDVIGKKVILPIVGRELPILADEYV

SEQ ID NO: 1828907 - protein, 19 aa, Staphylococcus epidermidis
KDVIRRRVSLMKDAGVLFK

SEQ ID NO: 1828908 - protein, 24 aa, Staphylococcus epidermidis
KDVPLLSLIQPGDTFKFVYTKENN

SEQ ID NO: 1828909 - protein, 19 aa, Staphylococcus epidermidis
KDYFNRDRFILSAGHGSAL

SEQ ID NO: 1828910 - protein, 20 aa, Staphylococcus epidermidis
KDYKPLLKSLSQKEVYPKYI

SEQ ID NO: 1828911 - protein, 17 aa, Staphylococcus epidermidis
KDYNVFKDEIFGPVLAI

SEQ ID NO: 1828912 - protein, 18 aa, Staphylococcus epidermidis
KEAAMIAGYFSKAGNSGQ

SEQ ID NO: 1828913 - protein, 34 aa, Staphylococcus epidermidis
KEADVILYDRLVNKKILEFASPSTKFFYCGKDPN

SEQ ID NO: 1828914 - protein, 17 aa, Staphylococcus epidermidis
KEAFYQLTPGRQHQYLY

SEQ ID NO: 1828915 - protein, 28 aa, Staphylococcus epidermidis
KEALENQLMKILGSKWKKYIGSVAKDMK

SEQ ID NO: 1828916 - protein, 20 aa, Staphylococcus epidermidis
KEALPFLMTAAELDDDRDLE

SEQ ID NO: 1828917 - protein, 18 aa, Staphylococcus epidermidis
KEAMFLKGFNLSDLSRET

SEQ ID NO: 1828918 - protein, 19 aa, Staphylococcus epidermidis
KEAMMLVPEIALTPQMVLR

SEQ ID NO: 1828919 - protein, 24 aa, Staphylococcus epidermidis
KEAPDFITVFLGTNDYGLVGGKTR

SEQ ID NO: 1828920 - protein, 19 aa, Staphylococcus epidermidis
KECLDIFDIISTGGGIIEN

SEQ ID NO: 1828921 - protein, 22 aa, Staphylococcus epidermidis
KEDAYFYYHQLEEIDSLQDLPQ

SEQ ID NO: 1828922 - protein, 21 aa, Staphylococcus epidermidis
KEDDIELFTDIANKVKQTNSY

SEQ ID NO: 1828923 - protein, 34 aa, Staphylococcus epidermidis
KEEEQDLFIDLIFSPIYFNILIKPETLDENYIKK

SEQ ID NO: 1828924 - protein, 29 aa, Staphylococcus epidermidis
KEEFLEKIRKALYMSKICSYAQGFAQMRK

SEQ ID NO: 1828925 - protein, 19 aa, Staphylococcus epidermidis
KEEGIYVKSIVFPTVPRGT

SEQ ID NO: 1828926 - protein, 18 aa, Staphylococcus epidermidis
KEEKVLPVTFIDKVFENL

SEQ ID NO: 1828927 - protein, 19 aa, Staphylococcus epidermidis
KEETTYSRLSLNNLNRLKE

SEQ ID NO: 1828928 - protein, 17 aa, Staphylococcus epidermidis
KEFDYIRSLRKLTTKPI

SEQ ID NO: 1828929 - protein, 17 aa, Staphylococcus epidermidis
KEFNNLFSVNQFCFDEQ

SEQ ID NO: 1828930 - protein, 39 aa, Staphylococcus epidermidis
KEFVDKYYFEIKDKYLKDLPFISGFIGTCSFDLVRHEFK

SEQ ID NO: 1828931 - protein, 35 aa, Staphylococcus epidermidis
KEFYFELDDFQKFLSAFLFLYYKEDNDIFYDQFFI

SEQ ID NO: 1828932 - protein, 24 aa, Staphylococcus epidermidis
KEGAYKFMNFLLDAKNNKQNTEWV

SEQ ID NO: 1828933 - protein, 23 aa, Staphylococcus epidermidis
KEHDLYVKFLNSNGERFSGMTVE

SEQ ID NO: 1828934 - protein, 23 aa, Staphylococcus epidermidis
KEHIKYFCNILKYDVSQSEIEDL

SEQ ID NO: 1828935 - protein, 28 aa, Staphylococcus epidermidis
KEHMPIEVIYGFAQLKRGAALANHELGK

SEQ ID NO: 1828936 - protein, 23 aa, Staphylococcus epidermidis
KEHYIVYRKNAYALTYYGSNLVS

SEQ ID NO: 1828937 - protein, 23 aa, Staphylococcus epidermidis
KEIAKKIAILPQSPEVADGLTVG

SEQ ID NO: 1828938 - protein, 22 aa, Staphylococcus epidermidis
KEIDKNIKIYAPLTGEYVKIED

SEQ ID NO: 1828939 - protein, 17 aa, Staphylococcus epidermidis
KEIENFKFFSQYANFKN

SEQ ID NO: 1828940 - protein, 23 aa, Staphylococcus epidermidis
KEIENFKFFVQYGNFKNLENYKD

SEQ ID NO: 1828941 - protein, 20 aa, Staphylococcus epidermidis
KEIENFKFFVQYGNFKNLKH

SEQ ID NO: 1828942 - protein, 23 aa, Staphylococcus epidermidis
KEIENFKFFVQYGNFKNLKHYKD

SEQ ID NO: 1828943 - protein, 27 aa, Staphylococcus epidermidis
KEIKSTMVGTFFLQDSKELTDPQIKVG

SEQ ID NO: 1828944 - protein, 17 aa, Staphylococcus epidermidis
KEILLSLPNDFDREVQT

SEQ ID NO: 1828945 - protein, 24 aa, Staphylococcus epidermidis
KEIMEKFQHWLQEPSLHDTIQDAI

SEQ ID NO: 1828946 - protein, 19 aa, Staphylococcus epidermidis
KEISKFDKDLSSAMDKIRN

SEQ ID NO: 1828947 - protein, 18 aa, Staphylococcus epidermidis
KEIVPIYNFVRENEFPTC

SEQ ID NO: 1828948 - protein, 26 aa, Staphylococcus epidermidis
KEKAYQLLLDLGFSRDIMSLSPFQMS

SEQ ID NO: 1828949 - protein, 21 aa, Staphylococcus epidermidis
KEKELRFLKFFHQQKYNVVDF

SEQ ID NO: 1828950 - protein, 26 aa, Staphylococcus epidermidis
KEKNTIPSIVKLYVTLDIDIFKVDLE

SEQ ID NO: 1828951 - protein, 18 aa, Staphylococcus epidermidis
KEKYSLFEITHQPELCAY

SEQ ID NO: 1828952 - protein, 23 aa, Staphylococcus epidermidis
KELEEFEKETIRWAKKGIAKTTT

SEQ ID NO: 1828953 - protein, 24 aa, Staphylococcus epidermidis
KELEEFEKETIRWAKKGIAKTTTI

SEQ ID NO: 1828954 - protein, 30 aa, Staphylococcus epidermidis
KELEITMEDALFNFQWLAATQGVKVVNDKL

SEQ ID NO: 1828955 - protein, 26 aa, Staphylococcus epidermidis
KELETSLFINKQWYPTVDKVSFKLEK

SEQ ID NO: 1828956 - protein, 26 aa, Staphylococcus epidermidis
KELGAPFEILKQIKDKGRLPVVNFAA

SEQ ID NO: 1828957 - protein, 21 aa, Staphylococcus epidermidis
KELLFRIKAVLRRYQINADNE

SEQ ID NO: 1828958 - protein, 23 aa, Staphylococcus epidermidis
KELLFRIKAVLRRYQINAESELK

SEQ ID NO: 1828959 - protein, 30 aa, Staphylococcus epidermidis
KELLSSMSKLLLLIFQLPETLTRLEYSLSQ

SEQ ID NO: 1828960 - protein, 18 aa, Staphylococcus epidermidis
KELNSAMQALRDAVGQQN

SEQ ID NO: 1828961 - protein, 39 aa, Staphylococcus epidermidis
KELVDKYYFEIKDKYLKDLPFISGFIGTCSFDLVRHEFK

SEQ ID NO: 1828962 - protein, 19 aa, Staphylococcus epidermidis
KEMFLEDLGIEEPGLDRLI

SEQ ID NO: 1828963 - protein, 33 aa, Staphylococcus epidermidis
KEMNYRKLGKYPPYYFLINFTISHKEMKKVMEA

SEQ ID NO: 1828964 - protein, 25 aa, Staphylococcus epidermidis
KEMSKDLDFIISTRAPEKVQQQLLE

SEQ ID NO: 1828965 - protein, 21 aa, Staphylococcus epidermidis
KEMSKDLDFIISTSEPKKVQQ

SEQ ID NO: 1828966 - protein, 23 aa, Staphylococcus epidermidis
KENDYLLEIIKSKLKKKDFETEE

SEQ ID NO: 1828967 - protein, 28 aa, Staphylococcus epidermidis
KENKGYKILRLNQLVLSPQNLWLGNINL

SEQ ID NO: 1828968 - protein, 18 aa, Staphylococcus epidermidis
KENLIVFGAIEEKLKSFE

SEQ ID NO: 1828969 - protein, 20 aa, Staphylococcus epidermidis
KENQDFIIHHIYSVTLDKEK

SEQ ID NO: 1828970 - protein, 25 aa, Staphylococcus epidermidis
KENQKSYYMITLTPFKNLKIENFNL

SEQ ID NO: 1828971 - protein, 29 aa, Staphylococcus epidermidis
KEPEAYPHPIYNNVLPHIDVFLENGYTKE

SEQ ID NO: 1828972 - protein, 22 aa, Staphylococcus epidermidis
KEPLDVYYLGKDFFAVLTVAFN

SEQ ID NO: 1828973 - protein, 28 aa, Staphylococcus epidermidis
KEPSIPHNFTFHLLFSNNKLKINDPNIS

SEQ ID NO: 1828974 - protein, 24 aa, Staphylococcus epidermidis
KEPYNDIKMWDYKALPAVFGGDNV

SEQ ID NO: 1828975 - protein, 25 aa, Staphylococcus epidermidis
KEQIKTLNRLLENQQILTLESNKKI

SEQ ID NO: 1828976 - protein, 26 aa, Staphylococcus epidermidis
KEQINTLNRLLENQQILALESNKKIQ

SEQ ID NO: 1828977 - protein, 25 aa, Staphylococcus epidermidis
KEQQERITLYLKYNTKKPNTIKSVH

SEQ ID NO: 1828978 - protein, 25 aa, Staphylococcus epidermidis
KEQYKGIGIMYKNHQWYFVVANIES

SEQ ID NO: 1828979 - protein, 26 aa, Staphylococcus epidermidis
KERAHRLIRKGAMLEKYFECEHLSPD

SEQ ID NO: 1828980 - protein, 26 aa, Staphylococcus epidermidis
KESEGRIILFIDEIHMLVGAGKTEGA

SEQ ID NO: 1828981 - protein, 23 aa, Staphylococcus epidermidis
KESEYRRIPFLKRGQALLNISGY

SEQ ID NO: 1828982 - protein, 28 aa, Staphylococcus epidermidis
KESFMTNIFGMMFLSQAAVPYLSEGDTI

SEQ ID NO: 1828983 - protein, 24 aa, Staphylococcus epidermidis
KESRKSIVLMLYGPSGVGKTEMSK

SEQ ID NO: 1828984 - protein, 32 aa, Staphylococcus epidermidis
KESVAHLLSILKLPHNIMSLMLEYLRFAEYDN

SEQ ID NO: 1828985 - protein, 21 aa, Staphylococcus epidermidis
KETDTLRIKWVEKGSIESYDD

SEQ ID NO: 1828986 - protein, 28 aa, Staphylococcus epidermidis
KETFMTNIFGMMFLSQSAVPYLSEGDTI

SEQ ID NO: 1828987 - protein, 25 aa, Staphylococcus epidermidis
KETHDTVIRFAPPLVITKEELDLAI

SEQ ID NO: 1828988 - protein, 20 aa, Staphylococcus epidermidis
KEVFFYYTLPGSDELHYYTA

SEQ ID NO: 1828989 - protein, 25 aa, Staphylococcus epidermidis
KEVFRKQIALAKRVQLPIIIHNREA

SEQ ID NO: 1828990 - protein, 27 aa, Staphylococcus epidermidis
KEVIKQLKIFHLKILVTYRTSIQGGKG

SEQ ID NO: 1828991 - protein, 19 aa, Staphylococcus epidermidis
KEVKYPRIKRIQTLADYFN

SEQ ID NO: 1828992 - protein, 24 aa, Staphylococcus epidermidis
KEVNYDICIFATGSKAFVLPIEGS

SEQ ID NO: 1828993 - protein, 27 aa, Staphylococcus epidermidis
KEVPEGLVPLLKIQGLGSKKIAKLYKE

SEQ ID NO: 1828994 - protein, 26 aa, Staphylococcus epidermidis
KEYKKDKVIIILNYPNNPTGYTPNKE

SEQ ID NO: 1828995 - protein, 19 aa, Staphylococcus epidermidis
KEYQVCGYQSIWVEGYEQH

SEQ ID NO: 1828996 - protein, 28 aa, Staphylococcus epidermidis
KFADIKTYIFYQLFEKYIIDYSMASATG

SEQ ID NO: 1828997 - protein, 28 aa, Staphylococcus epidermidis
KFARLPESLNFISWLQHLQENGIADDLS

SEQ ID NO: 1828998 - protein, 17 aa, Staphylococcus epidermidis
KFDSSNRYKIIKIIIEK

SEQ ID NO: 1828999 - protein, 24 aa, Staphylococcus epidermidis
KFEEPLVEFFYKKDELNDPLITDD

SEQ ID NO: 1829000 - protein, 18 aa, Staphylococcus epidermidis
KFEMPYEEAKSWMLKALE

SEQ ID NO: 1829001 - protein, 19 aa, Staphylococcus epidermidis
KFFLDYCKYFEALVAYAKY

SEQ ID NO: 1829002 - protein, 18 aa, Staphylococcus epidermidis
KFGGPKGVGLLLVKEYTP

SEQ ID NO: 1829003 - protein, 22 aa, Staphylococcus epidermidis
KFGPYLLKEKNDYFYKKWNREL

SEQ ID NO: 1829004 - protein, 22 aa, Staphylococcus epidermidis
KFGVYVIFDQKKPVFVGQTGGY

SEQ ID NO: 1829005 - protein, 17 aa, Staphylococcus epidermidis
KFKAFLEHALKLGADYV

SEQ ID NO: 1829006 - protein, 25 aa, Staphylococcus epidermidis
KFKKMHVRMMPAQEPPYTRLIDSAR

SEQ ID NO: 1829007 - protein, 18 aa, Staphylococcus epidermidis
KFKYKDFENEIELDFTEG

SEQ ID NO: 1829008 - protein, 19 aa, Staphylococcus epidermidis
KFLMNKYGVPKELIIGFGD

SEQ ID NO: 1829009 - protein, 20 aa, Staphylococcus epidermidis
KFNAKFLHYKNKPYKLNKKE

SEQ ID NO: 1829010 - protein, 27 aa, Staphylococcus epidermidis
KFNEDQGRYFVRLSFVKTWNKGDEIVN

SEQ ID NO: 1829011 - protein, 27 aa, Staphylococcus epidermidis
KFNEEQGRYFVRLSFVKTWNKGDEIVN

SEQ ID NO: 1829012 - protein, 25 aa, Staphylococcus epidermidis
KFNQIYFARVSILDGLSIITSQKAM

SEQ ID NO: 1829013 - protein, 21 aa, Staphylococcus epidermidis
KFPNISVATIYNNLRVFKDIG

SEQ ID NO: 1829014 - protein, 20 aa, Staphylococcus epidermidis
KFQGDTFFPPYTFENWEVES

SEQ ID NO: 1829015 - protein, 18 aa, Staphylococcus epidermidis
KFRNIYQSGFMIGDLNFN

SEQ ID NO: 1829016 - protein, 26 aa, Staphylococcus epidermidis
KGAIVGFFTPELFHGVGSAGFHIHFA

SEQ ID NO: 1829017 - protein, 18 aa, Staphylococcus epidermidis
KGASGWFGRLGGSLLTTI

SEQ ID NO: 1829018 - protein, 26 aa, Staphylococcus epidermidis
KGCDETFIKTLLKLNPKRIVYISCNP

SEQ ID NO: 1829019 - protein, 26 aa, Staphylococcus epidermidis
KGCDETFLTTLLKLNPKRIIYISCNP

SEQ ID NO: 1829020 - protein, 17 aa, Staphylococcus epidermidis
KGDDLPPSDLVGSFIMT

SEQ ID NO: 1829021 - protein, 26 aa, Staphylococcus epidermidis
KGDEVLPITFIEGGIAKTGAYITQEE

SEQ ID NO: 1829022 - protein, 25 aa, Staphylococcus epidermidis
KGDKKFLLERIKMKSFYKKYGDLAN

SEQ ID NO: 1829023 - protein, 23 aa, Staphylococcus epidermidis
KGDKLAQLVIVPIWTPELKEVEE

SEQ ID NO: 1829024 - protein, 23 aa, Staphylococcus epidermidis
KGDVALFFGLSGTGKTTLSADAE

SEQ ID NO: 1829025 - protein, 23 aa, Staphylococcus epidermidis
KGELNYFINNFLSFIKEGQESLI

SEQ ID NO: 1829026 - protein, 17 aa, Staphylococcus epidermidis
KGFGINPIIIKSVAKQV

SEQ ID NO: 1829027 - protein, 19 aa, Staphylococcus epidermidis
KGGLFYHFKSKDELIKELV

SEQ ID NO: 1829028 - protein, 23 aa, Staphylococcus epidermidis
KGGLQFTYISLDDFRILQSQFFG

SEQ ID NO: 1829029 - protein, 37 aa, Staphylococcus epidermidis; identical to SEQ ID NO: 1681723

SEQ ID NO: 1829030 - protein, 23 aa, Staphylococcus epidermidis
KGIGAGLIINNQLYRGANGEAGE

SEQ ID NO: 1829031 - protein, 20 aa, Staphylococcus epidermidis
KGIGLYKAVIIQAAFELGER

SEQ ID NO: 1829032 - protein, 20 aa, Staphylococcus epidermidis
KGIGLYKAVILQAAFELGER

SEQ ID NO: 1829033 - protein, 17 aa, Staphylococcus epidermidis
KGILFWQEQSHGYIPGN

SEQ ID NO: 1829034 - protein, 35 aa, Staphylococcus epidermidis; identical to SEQ ID NO: 1692646

SEQ ID NO: 1829035 - protein, 25 aa, Staphylococcus epidermidis
KGIVFDREEYSWKDELRELIENAKT

SEQ ID NO: 1829036 - protein, 25 aa, Staphylococcus epidermidis
KGKKTTFRLLLIDTPETKDPRKPVE

SEQ ID NO: 1829037 - protein, 20 aa, Staphylococcus epidermidis
KGKQILVYSGLFKEARKKLK

SEQ ID NO: 1829038 - protein, 17 aa, Staphylococcus epidermidis
KGLDKAIESLKESKPYL

SEQ ID NO: 1829039 - protein, 17 aa, Staphylococcus epidermidis
KGLGVLARKYNLPIYAN

SEQ ID NO: 1829040 - protein, 20 aa, Staphylococcus epidermidis
KGLITTKFLQAQEKEIPISI

SEQ ID NO: 1829041 - protein, 19 aa, Staphylococcus epidermidis
KGLKIAFPKEYVSEGISEE

SEQ ID NO: 1829042 - protein, 17 aa, Staphylococcus epidermidis
KGLKSLYYTRNKLLSVE

SEQ ID NO: 1829043 - protein, 24 aa, Staphylococcus epidermidis
KGLLGGKLFIYYNDHEWYKFRHFS

SEQ ID NO: 1829044 - protein, 17 aa, Staphylococcus epidermidis
KGMHFYFKGYNMTTNKT

SEQ ID NO: 1829045 - protein, 25 aa, Staphylococcus epidermidis
KGMRDRVIIELLYATGIRVSELVNI

SEQ ID NO: 1829046 - protein, 23 aa, Staphylococcus epidermidis
KGPEIYRQKLYQLGIEATIIEKY

SEQ ID NO: 1829047 - protein, 24 aa, Staphylococcus epidermidis
KGQLAAYLTPRLQPWDYAGGLMIL

SEQ ID NO: 1829048 - protein, 24 aa, Staphylococcus epidermidis
KGQSEPIVLVIFTNKDNKSDKPND

SEQ ID NO: 1829049 - protein, 21 aa, Staphylococcus epidermidis
KGRSYLKYLKANYPNRHYITN

SEQ ID NO: 1829050 - protein, 18 aa, Staphylococcus epidermidis
KGRYSIVIFDHYGKITLD

SEQ ID NO: 1829051 - protein, 20 aa, Staphylococcus epidermidis
KGRYVALYMTYEAAPYFNDK

SEQ ID NO: 1829052 - protein, 24 aa, Staphylococcus epidermidis
KGTDDDLYLFPKKNKHGDSSIYKG

SEQ ID NO: 1829053 - protein, 27 aa, Staphylococcus epidermidis
KGTDNLVLLGIKTRGAFLANRIQDKIH

SEQ ID NO: 1829054 - protein, 23 aa, Staphylococcus epidermidis
KGTGIFVTILRSFSHFSQQIQPE

SEQ ID NO: 1829055 - protein, 34 aa, Staphylococcus epidermidis
KGTKIEDIIYTPYKKYLAFLNKYKANFTRMKVEL

SEQ ID NO: 1829056 - protein, 23 aa, Staphylococcus epidermidis
KGTSKWFGNAYSSLKSWTGSMYD

SEQ ID NO: 1829057 - protein, 20 aa, Staphylococcus epidermidis
KGWMCVQVFFIRQGNMIKRD

SEQ ID NO: 1829058 - protein, 30 aa, Staphylococcus epidermidis
KGYEQSRAKWLFLDVFQWSRTDYLIHSQEL

SEQ ID NO: 1829059 - protein, 18 aa, Staphylococcus epidermidis
KGYLIDYTLFINKKDILE

SEQ ID NO: 1829060 - protein, 20 aa, Staphylococcus epidermidis
KHCDFFSFGTNDLTQLTYGF

SEQ ID NO: 1829061 - protein, 18 aa, Staphylococcus epidermidis
KHCNEFLYRRDDYRIPSY

SEQ ID NO: 1829062 - protein, 34 aa, Staphylococcus epidermidis
KHFEGTIIFVSHDRYFINQLANKVFDLNYQGGQM

SEQ ID NO: 1829063 - protein, 35 aa, Staphylococcus epidermidis
KHGQTIALLPKEFVKNLMFFSISAPRNKNSGRISL

SEQ ID NO: 1829064 - protein, 21 aa, Staphylococcus epidermidis
KHHALSELYQFFKKIKLDDSV

SEQ ID NO: 1829065 - protein, 27 aa, Staphylococcus epidermidis
KHIHQILLQHLTDKALVLGPSPAALAR

SEQ ID NO: 1829066 - protein, 25 aa, Staphylococcus epidermidis
KHKGRMSLFYYAELTYQPTHCENCS

SEQ ID NO: 1829067 - protein, 17 aa, Staphylococcus epidermidis
KHKLKYFSKDNFDISLK

SEQ ID NO: 1829068 - protein, 26 aa, Staphylococcus epidermidis
KHKVSHKFNIGYMYIETLEGTMTASL

SEQ ID NO: 1829069 - protein, 26 aa, Staphylococcus epidermidis
KHLSDMDIVISAPFYPAYMTKERIEK

SEQ ID NO: 1829070 - protein, 24 aa, Staphylococcus epidermidis
KHPKLKNLYFLQENAKQAIASMSQ

SEQ ID NO: 1829071 - protein, 24 aa, Staphylococcus epidermidis
KHQFSELHVFPYSPRIGTPAARMD

SEQ ID NO: 1829072 - protein, 24 aa, Staphylococcus epidermidis
KHQIPTVTTLLGLGAIPYHHPLFL

SEQ ID NO: 1829073 - protein, 20 aa, Staphylococcus epidermidis
KHSPTALRFLKAAMNADTDG

SEQ ID NO: 1829074 - protein, 18 aa, Staphylococcus epidermidis
KHSRLLEASMLQDLQKQR

SEQ ID NO: 1829075 - protein, 18 aa, Staphylococcus epidermidis
KHVWILNNKDILEDYPIL

SEQ ID NO: 1829076 - protein, 19 aa, Staphylococcus epidermidis
KHWRLVAILEVIEIKSCHY

SEQ ID NO: 1829077 - protein, 25 aa, Staphylococcus epidermidis
KHYGPLLNGFYHIPFPDKYRGMFDQ

SEQ ID NO: 1829078 - protein, 25 aa, Staphylococcus epidermidis
KHYGPLLNGFYHIPFPDKYRGMFEQ

SEQ ID NO: 1829079 - protein, 27 aa, Staphylococcus epidermidis
KHYVQDRLLLNINRLKIYQNDRIGLVG

SEQ ID NO: 1829080 - protein, 17 aa, Staphylococcus epidermidis
KIAFPTDKSYQLSELAQ

SEQ ID NO: 1829081 - protein, 17 aa, Staphylococcus epidermidis
KIDDQSMQALFKSTGMT

SEQ ID NO: 1829082 - protein, 25 aa, Staphylococcus epidermidis
KIDIKQHQTLLQTLRQITNEKSKAN

SEQ ID NO: 1829083 - protein, 24 aa, Staphylococcus epidermidis
KIDVLQLRMYQDSTLILYESPHRV

SEQ ID NO: 1829084 - protein, 27 aa, Staphylococcus epidermidis
KIEQEDKMYILFYKPTQVITSVSDDRG

SEQ ID NO: 1829085 - protein, 23 aa, Staphylococcus epidermidis
KIERSNWEFLYYSSELEGLPKDE

SEQ ID NO: 1829086 - protein, 18 aa, Staphylococcus epidermidis
KIEYIRMFDKLKDEIKQR

SEQ ID NO: 1829087 - protein, 19 aa, Staphylococcus epidermidis
KIFNKNDIPIERFPVFIHP

SEQ ID NO: 1829088 - protein, 29 aa, Staphylococcus epidermidis
KIFSELSFTLYKLFKRLRKLFIENTQEPW

SEQ ID NO: 1829089 - protein, 26 aa, Staphylococcus epidermidis
KIGDIPFPYFMSYVSGAGLSLIRHWV

SEQ ID NO: 1829090 - protein, 40 aa, Staphylococcus epidermidis
KIIDRFSWEYFYYVTVAKYFILNMRQPKWLVKKKDQTILS

SEQ ID NO: 1829091 - protein, 19 aa, Staphylococcus epidermidis
KIIGQILLSKISIVSGKNS

SEQ ID NO: 1829092 - protein, 17 aa, Staphylococcus epidermidis
KIIGYVGLWLVVDQAQI

SEQ ID NO: 1829093 - protein, 17 aa, Staphylococcus epidermidis
KIIIIDGQIGYIGGFNV

SEQ ID NO: 1829094 - protein, 34 aa, Staphylococcus epidermidis
KIIKDFIVRYKTMKGFYAPYVPGWDTHGLPIEQA

SEQ ID NO: 1829095 - protein, 20 aa, Staphylococcus epidermidis
KIILGNTYHLWLQPGNDIIK

SEQ ID NO: 1829096 - protein, 24 aa, Staphylococcus epidermidis
KIIRDFYNVPTKKAPTLKMKSIGK

SEQ ID NO: 1829097 - protein, 36 aa, Staphylococcus epidermidis
KIKASRLNFTIIKPSFFMDNFLRITKVENGEIKIPE

SEQ ID NO: 1829098 - protein, 21 aa, Staphylococcus epidermidis
KIKFPIILNEALTAVVAVPLW

SEQ ID NO: 1829099 - protein, 28 aa, Staphylococcus epidermidis
KIKPLEEVLTGAVAWVSGLRRAQSPTRA

SEQ ID NO: 1829100 - protein, 24 aa, Staphylococcus epidermidis
KIKPLHHIIDIPKRVFAKLDITPN

SEQ ID NO: 1829101 - protein, 24 aa, Staphylococcus epidermidis
KIKPLKHIIDIPKRVFDALDIVPN

SEQ ID NO: 1829102 - protein, 30 aa, Staphylococcus epidermidis
KIKSEYDDCLLFFRLGDFYEMFFEDAKEAS

SEQ ID NO: 1829103 - protein, 19 aa, Staphylococcus epidermidis
KIMEMPAYLELQKQRFYCK

SEQ ID NO: 1829104 - protein, 19 aa, Staphylococcus epidermidis
KIMMDVVKYITDLKTNLTL

SEQ ID NO: 1829105 - protein, 20 aa, Staphylococcus epidermidis
KINFIGIRLDSGDIAYLSKE

SEQ ID NO: 1829106 - protein, 17 aa, Staphylococcus epidermidis
KINQFGMNLYQPYTVYP

SEQ ID NO: 1829107 - protein, 21 aa, Staphylococcus epidermidis
KINQLPKLKEKLKHFNELGIG

SEQ ID NO: 1829108 - protein, 17 aa, Staphylococcus epidermidis
KIPKKYYQVKSLPYTST

SEQ ID NO: 1829109 - protein, 19 aa, Staphylococcus epidermidis
KIQALLRRTYDLSVSNDEL

SEQ ID NO: 1829110 - protein, 20 aa, Staphylococcus epidermidis
KIQQGWFDFDVVVATPDMMG

SEQ ID NO: 1829111 - protein, 24 aa, Staphylococcus epidermidis
KISKLPYSIRVLLESVLRQEDDFV

SEQ ID NO: 1829112 - protein, 25 aa, Staphylococcus epidermidis
KISKLPYSIRVLLESVLRQEDDFVI

SEQ ID NO: 1829113 - protein, 23 aa, Staphylococcus epidermidis
KITDSAFKLLKTNKNIILKKFNH

SEQ ID NO: 1829114 - protein, 17 aa, Staphylococcus epidermidis
KITFYYESGRLTLNDTN

SEQ ID NO: 1829115 - protein, 23 aa, Staphylococcus epidermidis
KIVDYLFKSLYTDILKAYFVYTE

SEQ ID NO: 1829116 - protein, 21 aa, Staphylococcus epidermidis
KIVQDNFIQGFKTISLRTNDI

SEQ ID NO: 1829117 - protein, 17 aa, Staphylococcus epidermidis
KIVVYNPAPLAIKETRL

SEQ ID NO: 1829118 - protein, 17 aa, Staphylococcus epidermidis
KIYEYIGDFIKPIKPLF

SEQ ID NO: 1829119 - protein, 26 aa, Staphylococcus epidermidis
KKAADPYFILRFIQKSIIKAIDIAWI

SEQ ID NO: 1829120 - protein, 24 aa, Staphylococcus epidermidis
KKASKDIFFSERHLKRLEKDSFEY

SEQ ID NO: 1829121 - protein, 26 aa, Staphylococcus epidermidis
KKDDTSFFDIVAFGKTAQLLNDYCGK

SEQ ID NO: 1829122 - protein, 24 aa, Staphylococcus epidermidis
KKDIDKTIFPGIQGGPLEHVIAAK

SEQ ID NO: 1829123 - protein, 18 aa, Staphylococcus epidermidis
KKDKYLEISTSPNLKHIL

SEQ ID NO: 1829124 - protein, 23 aa, Staphylococcus epidermidis
KKEDIYYQVYTNRGIYTEDPQRD

SEQ ID NO: 1829125 - protein, 17 aa, Staphylococcus epidermidis
KKEDVDYILSLIDRFKN

SEQ ID NO: 1829126 - protein, 28 aa, Staphylococcus epidermidis
KKEGIKLILKIFEAWKIPIIFVTHSNYE

SEQ ID NO: 1829127 - protein, 25 aa, Staphylococcus epidermidis
KKEIENFKFFVQYGNFKDFKDYKNG

SEQ ID NO: 1829128 - protein, 24 aa, Staphylococcus epidermidis
KKEIKNFQFFSQYGNFKNLKDYKN

SEQ ID NO: 1829129 - protein, 17 aa, Staphylococcus epidermidis
KKELLNKGYYKHKLDEL

SEQ ID NO: 1829130 - protein, 42 aa, Staphylococcus epidermidis
KKEQPGYILNTLLVPLLTAAQRLLALGITDFKMIDKAWMIAT

SEQ ID NO: 1829131 - protein, 20 aa, Staphylococcus epidermidis
KKFMHYLIKAQEHYQMTIVF

SEQ ID NO: 1829132 - protein, 26 aa, Staphylococcus epidermidis
KKGHQIRWRLLYIANPDYTVKPPFFI

SEQ ID NO: 1829133 - protein, 28 aa, Staphylococcus epidermidis
KKGHQLRWRLLYIANPDYRVKPPFFIEW

SEQ ID NO: 1829134 - protein, 32 aa, Staphylococcus epidermidis
KKGIAKLFDFMLPNSPIKMPISKMNMFGVGNL

SEQ ID NO: 1829135 - protein, 35 aa, Staphylococcus epidermidis
KKGIAKLFDFMLPNSPIKMTISKMNMFGVGNLMMR

SEQ ID NO: 1829136 - protein, 36 aa, Staphylococcus epidermidis
KKGIAKMFDFMLPKTSLKMPLSKMNMFGLGNIMMRY

SEQ ID NO: 1829137 - protein, 24 aa, Staphylococcus epidermidis
KKGIFSVMNYLLPMQDIMSMHCSA

SEQ ID NO: 1829138 - protein, 25 aa, Staphylococcus epidermidis
KKGIFSVMNYLLPMQDIMSMHCSAN

SEQ ID NO: 1829139 - protein, 19 aa, Staphylococcus epidermidis
KKGIYKMPSFLLKDAFDDL

SEQ ID NO: 1829140 - protein, 36 aa, Staphylococcus epidermidis; identical to SEQ ID NO: 1697078

SEQ ID NO: 1829141 - protein, 28 aa, Staphylococcus epidermidis
KKGTTSPTYYWSPISDQIITDALNRAKT

SEQ ID NO: 1829142 - protein, 22 aa, Staphylococcus epidermidis
KKGYDIELAFEAGLLSRNEENF

SEQ ID NO: 1829143 - protein, 22 aa, Staphylococcus epidermidis
KKGYDIELAYEAGLLSRNEENF

SEQ ID NO: 1829144 - protein, 24 aa, Staphylococcus epidermidis
KKHNCLYLRVDPYLPYQYLNHDGE

SEQ ID NO: 1829145 - protein, 18 aa, Staphylococcus epidermidis
KKHRLEFLGHTLLEGFDY

SEQ ID NO: 1829146 - protein, 23 aa, Staphylococcus epidermidis
KKIGKILRYVFHNIEKMKKSQLK

SEQ ID NO: 1829147 - protein, 22 aa, Staphylococcus epidermidis
KKKFFNNLLSKQVDGIIFLGGT

SEQ ID NO: 1829148 - protein, 17 aa, Staphylococcus epidermidis
KKKFVLGSVSHKVAKRA

SEQ ID NO: 1829149 - protein, 31 aa, Staphylococcus epidermidis
KKKQEAQLSHKIGGYLLNKLDLNMINSSDEL

SEQ ID NO: 1829150 - protein, 23 aa, Staphylococcus epidermidis
KKLKLNELWLSYPNNPNYLVSNL

SEQ ID NO: 1829151 - protein, 19 aa, Staphylococcus epidermidis
KKLKNMMVRLLKIKDIKLG

SEQ ID NO: 1829152 - protein, 17 aa, Staphylococcus epidermidis
KKMIEHNLLLVPSTSNE

SEQ ID NO: 1829153 - protein, 19 aa, Staphylococcus epidermidis
KKMTLFGKGKEAVYRCVCG

SEQ ID NO: 1829154 - protein, 27 aa, Staphylococcus epidermidis
KKNEMIKFKIMLLEKGLKDITLDDIFF

SEQ ID NO: 1829155 - protein, 24 aa, Staphylococcus epidermidis
KKNIEFYLIPTKGTAKIDKTLSLI

SEQ ID NO: 1829156 - protein, 24 aa, Staphylococcus epidermidis
KKNKERFNLYLDGVFEMGIDIDTL

SEQ ID NO: 1829157 - protein, 24 aa, Staphylococcus epidermidis
KKPEPQQIEWKWSGTFYPNTSIKV

SEQ ID NO: 1829158 - protein, 19 aa, Staphylococcus epidermidis
KKPNMIWHVYKNRHSKFKG

SEQ ID NO: 1829159 - protein, 26 aa, Staphylococcus epidermidis
KKQELNDALYYFNVPAEVKNVTEGPS

SEQ ID NO: 1829160 - protein, 26 aa, Staphylococcus epidermidis
KKQRDGAVITYYYSGVPTLSNDPAKS

SEQ ID NO: 1829161 - protein, 24 aa, Staphylococcus epidermidis
KKQTLHFRVYLLGGEMRDLTEAFV

SEQ ID NO: 1829162 - protein, 19 aa, Staphylococcus epidermidis
KKRMLHVMMLSMTHLKIIV

SEQ ID NO: 1829163 - protein, 24 aa, Staphylococcus epidermidis
KKRNCLYVLVDPYLLENLRNAEGE

SEQ ID NO: 1829164 - protein, 18 aa, Staphylococcus epidermidis
KKSKFNAKFLHYKNKPYK

SEQ ID NO: 1829165 - protein, 24 aa, Staphylococcus epidermidis
KKSSYIRGIFKNRNIFYRDFELKE

SEQ ID NO: 1829166 - protein, 20 aa, Staphylococcus epidermidis
KKTDIDLMWQFIHTMMNQTA

SEQ ID NO: 1829167 - protein, 23 aa, Staphylococcus epidermidis
KKTDVLIRNLEILKIDHLFTEVI

SEQ ID NO: 1829168 - protein, 22 aa, Staphylococcus epidermidis
KKTWDWKGRFYPNTTIKVRKKP

SEQ ID NO: 1829169 - protein, 20 aa, Staphylococcus epidermidis
KKVIHMFNKVYIELVDRIQV

SEQ ID NO: 1829170 - protein, 21 aa, Staphylococcus epidermidis
KKVLFIHYEIPNDKLDVGIEG

SEQ ID NO: 1829171 - protein, 25 aa, Staphylococcus epidermidis
KKVMDTLELFKIAFPTDKSYQLSEL

SEQ ID NO: 1829172 - protein, 25 aa, Staphylococcus epidermidis
KKYDEKFYHSLGFANTYAFMVTKET

SEQ ID NO: 1829173 - protein, 26 aa, Staphylococcus epidermidis
KKYDEKFYHSLGFANTYAFMVTKETA

SEQ ID NO: 1829174 - protein, 27 aa, Staphylococcus epidermidis
KKYDIKQYLVYLLKFPELHPEDDFLRD

SEQ ID NO: 1829175 - protein, 23 aa, Staphylococcus epidermidis
KKYFNLDIISVLLFLEINKTYKL

SEQ ID NO: 1829176 - protein, 19 aa, Staphylococcus epidermidis
KKYNILFPQLALNEEEFVK

SEQ ID NO: 1829177 - protein, 21 aa, Staphylococcus epidermidis
KKYQLSYIIDDKFNYASNLDS

SEQ ID NO: 1829178 - protein, 30 aa, Staphylococcus epidermidis
KKYSNIFQRIISFFTMGFKFNQFTIYDNHQ

SEQ ID NO: 1829179 - protein, 17 aa, Staphylococcus epidermidis
KLAHLLQDSKKPMILYG

SEQ ID NO: 1829180 - protein, 20 aa, Staphylococcus epidermidis
KLAIKVIPKDYKLMMQKIDL

SEQ ID NO: 1829181 - protein, 22 aa, Staphylococcus epidermidis
KLALELYDATWIHWYHDQMKLK

SEQ ID NO: 1829182 - protein, 24 aa, Staphylococcus epidermidis
KLANILVHFRDKDKIISSVCHGPS

SEQ ID NO: 1829183 - protein, 31 aa, Staphylococcus epidermidis
KLDAFNGPLDLLLHLIQKFEIDIYDIPMKAL

SEQ ID NO: 1829184 - protein, 27 aa, Staphylococcus epidermidis
KLDAFNGPLDLLLHLIQKYEIDIYDIP

SEQ ID NO: 1829185 - protein, 20 aa, Staphylococcus epidermidis
KLDGLPLNQLKHKDIARFRR

SEQ ID NO: 1829186 - protein, 17 aa, Staphylococcus epidermidis
KLDIQQLNEDISNQKSK

SEQ ID NO: 1829187 - protein, 23 aa, Staphylococcus epidermidis
KLDNKDITYLKGKKLREARQDFQ

SEQ ID NO: 1829188 - protein, 20 aa, Staphylococcus epidermidis
KLDQLICNWLNIVDDILPQL

SEQ ID NO: 1829189 - protein, 20 aa, Staphylococcus epidermidis
KLDRLTLIIDKDQEYYLMNY

SEQ ID NO: 1829190 - protein, 25 aa, Staphylococcus epidermidis
KLEIDVAYTSLLTRALETTQYILAG

SEQ ID NO: 1829191 - protein, 22 aa, Staphylococcus epidermidis
KLEKSIFKQGLLKAASLKYQRL

SEQ ID NO: 1829192 - protein, 41 aa, Staphylococcus epidermidis
KLENIIAPFYDRWDHEIFIKYLKIFQLPYKNKIKTFSTGMK

SEQ ID NO: 1829193 - protein, 42 aa, Staphylococcus epidermidis
KLENIIAPFYDRWDHEIFIKYLNFFQLPYKNKIKTFSTGMKM

SEQ ID NO: 1829194 - protein, 28 aa, Staphylococcus epidermidis
KLEQEIYNHMLWKGFKPFKITNITQETS

SEQ ID NO: 1829195 - protein, 24 aa, Staphylococcus epidermidis
KLERDYIEVLYLDIYEKFNEDINN

SEQ ID NO: 1829196 - protein, 26 aa, Staphylococcus epidermidis
KLGADPMTFLGLGGIGDLIVTCTSTH

SEQ ID NO: 1829197 - protein, 17 aa, Staphylococcus epidermidis
KLHLPQGFNIRVDSLLY

SEQ ID NO: 1829198 - protein, 27 aa, Staphylococcus epidermidis
KLHLPQGFNIRVDSLLYSGYQVSPYYD

SEQ ID NO: 1829199 - protein, 19 aa, Staphylococcus epidermidis
KLIHLCKEITFCESFQYSI

SEQ ID NO: 1829200 - protein, 17 aa, Staphylococcus epidermidis
KLILQVLSIDESGKLDV

SEQ ID NO: 1829201 - protein, 18 aa, Staphylococcus epidermidis
KLINLKEALIHYLEHQKV

SEQ ID NO: 1829202 - protein, 31 aa, Staphylococcus epidermidis; identical to SEQ ID NO: 1681494

SEQ ID NO: 1829203 - protein, 19 aa, Staphylococcus epidermidis
KLIQYENYEFTLFKDGRMN

SEQ ID NO: 1829204 - protein, 21 aa, Staphylococcus epidermidis
KLIQYILVELSTCKVEYLKFN

SEQ ID NO: 1829205 - protein, 24 aa, Staphylococcus epidermidis
KLKAKLFRYKYPDVKLTWICKAPK

SEQ ID NO: 1829206 - protein, 17 aa, Staphylococcus epidermidis
KLKILNRFLNKNDNNDE

SEQ ID NO: 1829207 - protein, 18 aa, Staphylococcus epidermidis
KLKLYVYQERQNKNIKQD

SEQ ID NO: 1829208 - protein, 17 aa, Staphylococcus epidermidis
KLKQMINYWKTIGTTVI

SEQ ID NO: 1829209 - protein, 19 aa, Staphylococcus epidermidis
KLKSILDKLLVIADKNCMI

SEQ ID NO: 1829210 - protein, 20 aa, Staphylococcus epidermidis
KLKYLTYDKYTPQPPKSLGN

SEQ ID NO: 1829211 - protein, 26 aa, Staphylococcus epidermidis
KLLDFDYDIPYYKQNYLFIIEDIKNN

SEQ ID NO: 1829212 - protein, 20 aa, Staphylococcus epidermidis
KLLHLGDILHKRVVGQDKAV

SEQ ID NO: 1829213 - protein, 21 aa, Staphylococcus epidermidis
KLLLHKREILKLGERTREIGY

SEQ ID NO: 1829214 - protein, 20 aa, Staphylococcus epidermidis
KLLMKQLLHGSSVNIPKFEK

SEQ ID NO: 1829215 - protein, 20 aa, Staphylococcus epidermidis
KLLQHIFQDIKHMEKSRLKA

SEQ ID NO: 1829216 - protein, 24 aa, Staphylococcus epidermidis
KLLSGSIIPRPIAFVTTQNLKGDV

SEQ ID NO: 1829217 - protein, 30 aa, Staphylococcus epidermidis
KLLSSEEVQWIVLAGYMRLIGQDLLQAYEG

SEQ ID NO: 1829218 - protein, 18 aa, Staphylococcus epidermidis
KLLVPIFDARREAVYAGV

SEQ ID NO: 1829219 - protein, 24 aa, Staphylococcus epidermidis
KLMMKTIEALMRKGYKYDKIKTKL

SEQ ID NO: 1829220 - protein, 21 aa, Staphylococcus epidermidis
KLNDYFLLPKIVKEKKGNNQK

SEQ ID NO: 1829221 - protein, 22 aa, Staphylococcus epidermidis
KLNVAFAYIDWKNSEFGPLARE

SEQ ID NO: 1829222 - protein, 18 aa, Staphylococcus epidermidis
KLPYRLYVGGKLGSGRQW

SEQ ID NO: 1829223 - protein, 18 aa, Staphylococcus epidermidis
KLQELIDLGIDPFGHRFD

SEQ ID NO: 1829224 - protein, 17 aa, Staphylococcus epidermidis
KLQGLTQAQNALQGSHL

SEQ ID NO: 1829225 - protein, 26 aa, Staphylococcus epidermidis
KLQVDLERPVPYINELLALNTFNPQN

SEQ ID NO: 1829226 - protein, 25 aa, Staphylococcus epidermidis
KLREEPLDHVLLFGPPGLGKTTLSN

SEQ ID NO: 1829227 - protein, 20 aa, Staphylococcus epidermidis
KLRFPNLLKNATKNTITAYL

SEQ ID NO: 1829228 - protein, 32 aa, Staphylococcus epidermidis
KLRRHMSFLMREGKLYLPYNGNLLIHGCIPVD

SEQ ID NO: 1829229 - protein, 20 aa, Staphylococcus epidermidis
KLSEAKYLNGKMEELKAIVA

SEQ ID NO: 1829230 - protein, 32 aa, Staphylococcus epidermidis
KLSEFMSIEPQIRLWDILQTKFKAKALQEKVY

SEQ ID NO: 1829231 - protein, 21 aa, Staphylococcus epidermidis
KLSFKYIDRILLNWKKNNVKT

SEQ ID NO: 1829232 - protein, 19 aa, Staphylococcus epidermidis
KLSIKAKLLYALITERQNL

SEQ ID NO: 1829233 - protein, 22 aa, Staphylococcus epidermidis
KLSINDLLKIKGIGLYKAVIIQ

SEQ ID NO: 1829234 - protein, 21 aa, Staphylococcus epidermidis
KLSNAHILVFGAGALGTHIID

SEQ ID NO: 1829235 - protein, 23 aa, Staphylococcus epidermidis
KLSTSQILIFGAGALGSHIVDQL

SEQ ID NO: 1829236 - protein, 25 aa, Staphylococcus epidermidis
KLSYIYDYPHQRLYRAIAGVGAYEN

SEQ ID NO: 1829237 - protein, 25 aa, Staphylococcus epidermidis
KLTHIKHYYHQPKFIKYWTDQINET

SEQ ID NO: 1829238 - protein, 18 aa, Staphylococcus epidermidis
KLTKMSIDELGPVNLNAI

SEQ ID NO: 1829239 - protein, 20 aa, Staphylococcus epidermidis
KLTKMSIDELGPVNLNAIEQ

SEQ ID NO: 1829240 - protein, 26 aa, Staphylococcus epidermidis
KLTNSSQTVIYKFKDVQGPQISVDSQ

SEQ ID NO: 1829241 - protein, 22 aa, Staphylococcus epidermidis
KLTRDEMIWLKQNIISYMEDDG

SEQ ID NO: 1829242 - protein, 20 aa, Staphylococcus epidermidis
KLTRIQFGPLDLKGLNAGEG

SEQ ID NO: 1829243 - protein, 21 aa, Staphylococcus epidermidis
KLTTQFYPTQFIKFEEATIET

SEQ ID NO: 1829244 - protein, 21 aa, Staphylococcus epidermidis
KLTYHPRLILQSNIQTQVLRN

SEQ ID NO: 1829245 - protein, 25 aa, Staphylococcus epidermidis
KLVHEQFDHYLLNDLPAFKDKSPST

SEQ ID NO: 1829246 - protein, 32 aa, Staphylococcus epidermidis
KLVIQTYFERVHLKFLSTLPVGGLGLDFVHDN

SEQ ID NO: 1829247 - protein, 25 aa, Staphylococcus epidermidis
KLVKKTFPGYVLVELVMTDESWYVV

SEQ ID NO: 1829248 - protein, 20 aa, Staphylococcus epidermidis
KLVRIQFGPIDLKGLNAGEG

SEQ ID NO: 1829249 - protein, 26 aa, Staphylococcus epidermidis
KLYGNKTGLFNLKLFAQVLGDGFDKE

SEQ ID NO: 1829250 - protein, 23 aa, Staphylococcus epidermidis
KLYKFLFEDPAFNDLPSKAKLLY

SEQ ID NO: 1829251 - protein, 25 aa, Staphylococcus epidermidis
KMDMPGISLYPETERFYPNGNFASH

SEQ ID NO: 1829252 - protein, 19 aa, Staphylococcus epidermidis
KMDQYELQLLLDGPHDANN

SEQ ID NO: 1829253 - protein, 27 aa, Staphylococcus epidermidis
KMESLLLSARHFLWSTAHGYQLYEEDA

SEQ ID NO: 1829254 - protein, 24 aa, Staphylococcus epidermidis
KMGGKILKPLAIGSAIMDNYKKDD

SEQ ID NO: 1829255 - protein, 19 aa, Staphylococcus epidermidis
KMIDKAWMIATQSKKGPFA

SEQ ID NO: 1829256 - protein, 17 aa, Staphylococcus epidermidis
KMIEKFPQFNDYGYKIL

SEQ ID NO: 1829257 - protein, 18 aa, Staphylococcus epidermidis
KMLTDTGLFTCKGHANAF

SEQ ID NO: 1829258 - protein, 18 aa, Staphylococcus epidermidis
KMPISKMNMFGVGNLMMR

SEQ ID NO: 1829259 - protein, 25 aa, Staphylococcus epidermidis
KMRQESNVPILFLSSRDNPMDQVMS

SEQ ID NO: 1829260 - protein, 31 aa, Staphylococcus epidermidis
KMSFNHALDVLFLVLRQFNHLHLGFLIERVT

SEQ ID NO: 1829261 - protein, 23 aa, Staphylococcus epidermidis
KMSINDLLKIKGIGLYKAVILQA

SEQ ID NO: 1829262 - protein, 18 aa, Staphylococcus epidermidis
KMYENHPNILFWDNKKDI

SEQ ID NO: 1829263 - protein, 37 aa, Staphylococcus epidermidis
KMYKERGFEIKPHIAGLMISAIISDSLLFKSPTCTQE

SEQ ID NO: 1829264 - protein, 21 aa, Staphylococcus epidermidis
KNAGLRLKFLKSETSGTAVWG

SEQ ID NO: 1829265 - protein, 25 aa, Staphylococcus epidermidis
KNANTTMFLITPQYDKPGLLASVLN

SEQ ID NO: 1829266 - protein, 27 aa, Staphylococcus epidermidis
KNARVNRYTYLYNKRYLKIQMSASSRG

SEQ ID NO: 1829267 - protein, 25 aa, Staphylococcus epidermidis
KNAVKYFYAYLKSVKVKKVAVIGAK

SEQ ID NO: 1829268 - protein, 37 aa, Staphylococcus epidermidis
KNDLNLVPLRKFTSTEINLFFAMCNKLKEKETNTLHL

SEQ ID NO: 1829269 - protein, 27 aa, Staphylococcus epidermidis
KNDNAQGEYYLPDVLSLILEDGGKAEI

SEQ ID NO: 1829270 - protein, 29 aa, Staphylococcus epidermidis
KNDRPVTGKWSWLAPPLSPTLTSNYHHGY

SEQ ID NO: 1829271 - protein, 21 aa, Staphylococcus epidermidis
KNDVIFVLPSSDEKLVKVVQD

SEQ ID NO: 1829272 - protein, 17 aa, Staphylococcus epidermidis
KNELDKLEWAPADVPAV

SEQ ID NO: 1829273 - protein, 26 aa, Staphylococcus epidermidis
KNELSYLAIFILIVAGGRFVEVQNYN

SEQ ID NO: 1829274 - protein, 31 aa, Staphylococcus epidermidis
KNEMKHDPLGDPIILIAPTQSTFQLEQAFVN

SEQ ID NO: 1829275 - protein, 23 aa, Staphylococcus epidermidis
KNEMNLVPLRRFTATEINLFFAM

SEQ ID NO: 1829276 - protein, 24 aa, Staphylococcus epidermidis
KNEMNLVPLRRFTATEINLFFAMC

SEQ ID NO: 1829277 - protein, 17 aa, Staphylococcus epidermidis
KNEQSYSILFDRYQRDV

SEQ ID NO: 1829278 - protein, 20 aa, Staphylococcus epidermidis
KNFIQKCIGYLTLGLKLNQY

SEQ ID NO: 1829279 - protein, 25 aa, Staphylococcus epidermidis
KNFRDIFNKIAWLNKGKMEEALKGN

SEQ ID NO: 1829280 - protein, 32 aa, Staphylococcus epidermidis
KNGDKWLQIDSDKWGFLLKISPLLDSDVKVSD

SEQ ID NO: 1829281 - protein, 24 aa, Staphylococcus epidermidis
KNGDPMLTITFVILEGEFADNKIW

SEQ ID NO: 1829282 - protein, 33 aa, Staphylococcus epidermidis
KNHSITSKLIFASWSPRLHFNASLFQIEDDDIL

SEQ ID NO: 1829283 - protein, 20 aa, Staphylococcus epidermidis
KNIILNYLIEFNLSTDLITK

SEQ ID NO: 1829284 - protein, 24 aa, Staphylococcus epidermidis
KNILTYRNKSFLAILDFIEEDKFP

SEQ ID NO: 1829285 - protein, 27 aa, Staphylococcus epidermidis
KNKAKAIQALLLWLNQHHFDYSSIAKL

SEQ ID NO: 1829286 - protein, 17 aa, Staphylococcus epidermidis
KNKHLSWSLWNYDTQLD

SEQ ID NO: 1829287 - protein, 19 aa, Staphylococcus epidermidis
KNKNIALLFEKDSTRTRCA

SEQ ID NO: 1829288 - protein, 18 aa, Staphylococcus epidermidis
KNLANQSPEFGRPEKFCD

SEQ ID NO: 1829289 - protein, 26 aa, Staphylococcus epidermidis
KNLENKIKTFKFFSQYGNFKEMDSYK

SEQ ID NO: 1829290 - protein, 25 aa, Staphylococcus epidermidis
KNLIGAFYRPKAVIYDLDFLETLPY

SEQ ID NO: 1829291 - protein, 17 aa, Staphylococcus epidermidis
KNLIKEISPVDLTDLMK

SEQ ID NO: 1829292 - protein, 23 aa, Staphylococcus epidermidis
KNLKIAIVVSRFNDFITGRLLEG

SEQ ID NO: 1829293 - protein, 27 aa, Staphylococcus epidermidis
KNLNKNYGIPLYYKKGKHFKLTEAGEL

SEQ ID NO: 1829294 - protein, 17 aa, Staphylococcus epidermidis
KNMIKEISPIDLTYLMK

SEQ ID NO: 1829295 - protein, 19 aa, Staphylococcus epidermidis
KNMLYRLGALGLNIGSEIS

SEQ ID NO: 1829296 - protein, 20 aa, Staphylococcus epidermidis
KNNLNPVPNSKLKPTKVDEA

SEQ ID NO: 1829297 - protein, 21 aa, Staphylococcus epidermidis
KNNLSFILHDGPPYANGNLHM

SEQ ID NO: 1829298 - protein, 25 aa, Staphylococcus epidermidis
KNPDITSKRWLLKTYSFESNDVAEK

SEQ ID NO: 1829299 - protein, 24 aa, Staphylococcus epidermidis
KNRGQKWYQLGQTPELKLQEQARP

SEQ ID NO: 1829300 - protein, 17 aa, Staphylococcus epidermidis
KNRNIFYRDFELKEIMR

SEQ ID NO: 1829301 - protein, 28 aa, Staphylococcus epidermidis
KNRTWEFQISLPRFLSHEDYLLFTHAIE

SEQ ID NO: 1829302 - protein, 25 aa, Staphylococcus epidermidis
KNSDHEFSYLIYTGSRLKNDKSLIT

SEQ ID NO: 1829303 - protein, 23 aa, Staphylococcus epidermidis
KNSFRPEFLNRVDDIIVFHKLSK

SEQ ID NO: 1829304 - protein, 19 aa, Staphylococcus epidermidis
KNSLSDWKDYLKDEFRPDN

SEQ ID NO: 1829305 - protein, 28 aa, Staphylococcus epidermidis
KNSSYLIDLLENFALERGVYGKRWLDED

SEQ ID NO: 1829306 - protein, 29 aa, Staphylococcus epidermidis
KNTSTIIPMCHPLPLTGIDVQFEWDSTQA

SEQ ID NO: 1829307 - protein, 19 aa, Staphylococcus epidermidis
KNVESFTNLLNQMVKSNVE

SEQ ID NO: 1829308 - protein, 17 aa, Staphylococcus epidermidis
KNVIVTLKNNEKFKGFV

SEQ ID NO: 1829309 - protein, 20 aa, Staphylococcus epidermidis
KNVLPSPKPMKVLLVAGHGK

SEQ ID NO: 1829310 - protein, 20 aa, Staphylococcus epidermidis
KNVWFGVREFAMGAAVNGMA

SEQ ID NO: 1829311 - protein, 21 aa, Staphylococcus epidermidis
KNWHGAFIIVSHDRAFLDNLC

SEQ ID NO: 1829312 - protein, 23 aa, Staphylococcus epidermidis
KPEDYDALLIPGGFSPDHLRGDE

SEQ ID NO: 1829313 - protein, 25 aa, Staphylococcus epidermidis
KPEFTTIKINKDYKILFNEVAYQRR

SEQ ID NO: 1829314 - protein, 22 aa, Staphylococcus epidermidis
KPENFDYLINNTKLELTYDEAK

SEQ ID NO: 1829315 - protein, 35 aa, Staphylococcus epidermidis
KPFSISSITYIISNPFYIGKIQFAKYRHWSDKRRK

SEQ ID NO: 1829316 - protein, 26 aa, Staphylococcus epidermidis
KPFVKQKLIFLVGMAGERDLTKTPEM

SEQ ID NO: 1829317 - protein, 20 aa, Staphylococcus epidermidis
KPGPLLPNYNDYIVFEGISV

SEQ ID NO: 1829318 - protein, 19 aa, Staphylococcus epidermidis
KPGPTIGFLAEYDALPGLG

SEQ ID NO: 1829319 - protein, 22 aa, Staphylococcus epidermidis
KPHETWAPKLILRTVLGQMSTV

SEQ ID NO: 1829320 - protein, 27 aa, Staphylococcus epidermidis
KPIEINGIQFFTLPFATVSEVQDFFKD

SEQ ID NO: 1829321 - protein, 18 aa, Staphylococcus epidermidis
KPINKPMYAIYNALKKLK

SEQ ID NO: 1829322 - protein, 20 aa, Staphylococcus epidermidis
KPKDTLLKLHPGRGKKVVNN

SEQ ID NO: 1829323 - protein, 22 aa, Staphylococcus epidermidis
KPKIGAYHFTTIKPNLGVVSTP

SEQ ID NO: 1829324 - protein, 19 aa, Staphylococcus epidermidis
KPKLLNYLESFGLTEHLLQ

SEQ ID NO: 1829325 - protein, 26 aa, Staphylococcus epidermidis
KPLRLRKETILTRWTKELFSYKEILN

SEQ ID NO: 1829326 - protein, 20 aa, Staphylococcus epidermidis
KPMINVFKAIRKLIDEYHDL

SEQ ID NO: 1829327 - protein, 21 aa, Staphylococcus epidermidis
KPMPEFFDYIFEKIGENEREQ

SEQ ID NO: 1829328 - protein, 25 aa, Staphylococcus epidermidis
KPNPKVLAPLFDAYDVSPNQVAIIG

SEQ ID NO: 1829329 - protein, 21 aa, Staphylococcus epidermidis
KPRHLYQWFGQTMRTQDEDIW

SEQ ID NO: 1829330 - protein, 32 aa, Staphylococcus epidermidis
KPSEETTLLTLRLAELFRASTIPAGLIQIIPG

SEQ ID NO: 1829331 - protein, 29 aa, Staphylococcus epidermidis
KPTFKKERTVYLPNAFHPLLNKETVVANT

SEQ ID NO: 1829332 - protein, 23 aa, Staphylococcus epidermidis
KPTIEELLINNGMKYYMVGSTYR

SEQ ID NO: 1829333 - protein, 17 aa, Staphylococcus epidermidis
KPVMESLILLSMRHRMD

SEQ ID NO: 1829334 - protein, 19 aa, Staphylococcus epidermidis
KPYHILSYVIRMFNQLRGT

SEQ ID NO: 1829335 - protein, 20 aa, Staphylococcus epidermidis
KQALNDLINSAPNKQKVAEI

SEQ ID NO: 1829336 - protein, 27 aa, Staphylococcus epidermidis
KQDAVRYQIAFYMKRYETDPESVHLCV

SEQ ID NO: 1829337 - protein, 28 aa, Staphylococcus epidermidis
KQDQKKLYKFFLLVARYIKRKEAFYKAT

SEQ ID NO: 1829338 - protein, 18 aa, Staphylococcus epidermidis
KQEKNNLNPVPNSKLKPT

SEQ ID NO: 1829339 - protein, 22 aa, Staphylococcus epidermidis
KQELDVFLMHKCEQLSLNDVAG

SEQ ID NO: 1829340 - protein, 25 aa, Staphylococcus epidermidis
KQEQIVLFLNRRGYASFMLCRDCGY

SEQ ID NO: 1829341 - protein, 23 aa, Staphylococcus epidermidis
KQEVRLHIIQMKTPLFKQYQTVN

SEQ ID NO: 1829342 - protein, 27 aa, Staphylococcus epidermidis
KQFDQIFDLLAIRVIVNSINDCYAILG

SEQ ID NO: 1829343 - protein, 30 aa, Staphylococcus epidermidis
KQFECKWGNETLVWTLKKMAKGGLVDVYLD

SEQ ID NO: 1829344 - protein, 23 aa, Staphylococcus epidermidis
KQFFVGDGLLKYYISNNITPPFV

SEQ ID NO: 1829345 - protein, 20 aa, Staphylococcus epidermidis
KQFKIIKRYNEDPIIKDINN

SEQ ID NO: 1829346 - protein, 20 aa, Staphylococcus epidermidis
KQFTITIQDTISPVVNVTPS

SEQ ID NO: 1829347 - protein, 24 aa, Staphylococcus epidermidis
KQHKFILDYLYYKKSSKVPPILKY

SEQ ID NO: 1829348 - protein, 24 aa, Staphylococcus epidermidis
KQHKVKLVFFLAMSKKDLNINRKI

SEQ ID NO: 1829349 - protein, 19 aa, Staphylococcus epidermidis
KQILGVDPAFRTGCKLAVI

SEQ ID NO: 1829350 - protein, 18 aa, Staphylococcus epidermidis
KQILQHLAAKHGINFHEM

SEQ ID NO: 1829351 - protein, 25 aa, Staphylococcus epidermidis
KQKDSKFIPVFLDILDNGKPSLPTF

SEQ ID NO: 1829352 - protein, 22 aa, Staphylococcus epidermidis
KQKLAIAVSLMNKPRYLILDEP

SEQ ID NO: 1829353 - protein, 18 aa, Staphylococcus epidermidis
KQKLLTEKYATWSSSYRN

SEQ ID NO: 1829354 - protein, 17 aa, Staphylococcus epidermidis
KQKLYAHDIIYTTNGRL

SEQ ID NO: 1829355 - protein, 26 aa, Staphylococcus epidermidis
KQLASYIHIPVGVLLPFKSQCFVRHY

SEQ ID NO: 1829356 - protein, 25 aa, Staphylococcus epidermidis
KQLDTASHFVLIFARKNVTAHTEYV

SEQ ID NO: 1829357 - protein, 25 aa, Staphylococcus epidermidis
KQLDTASHFVLIFARKNVTSHSDYV

SEQ ID NO: 1829358 - protein, 27 aa, Staphylococcus epidermidis
KQLRKRYDIPTQQPPKLLLKGTGDLKD

SEQ ID NO: 1829359 - protein, 22 aa, Staphylococcus epidermidis
KQLSEYIIAFILDDYKKMRTSY

SEQ ID NO: 1829360 - protein, 24 aa, Staphylococcus epidermidis
KQLSHLSSYYKFKQPSLLYDQQIQ

SEQ ID NO: 1829361 - protein, 17 aa, Staphylococcus epidermidis
KQLYSPVQFIKSTEWLI

SEQ ID NO: 1829362 - protein, 26 aa, Staphylococcus epidermidis
KQNANKFYKFAIYGKFGTGKTTFLTK

SEQ ID NO: 1829363 - protein, 28 aa, Staphylococcus epidermidis
KQNFIEYILFNYRFKSRITVWVLNYLKA

SEQ ID NO: 1829364 - protein, 19 aa, Staphylococcus epidermidis
KQNTNKFYKFAIYGKFGTG

SEQ ID NO: 1829365 - protein, 25 aa, Staphylococcus epidermidis
KQQEDYCIILGYFIDGEPKLSYIYD

SEQ ID NO: 1829366 - protein, 27 aa, Staphylococcus epidermidis
KQQFEVNVFGLARLTQLVLPHMREQRS

SEQ ID NO: 1829367 - protein, 24 aa, Staphylococcus epidermidis
KQRELARLEQLKQAMRSETESMVE

SEQ ID NO: 1829368 - protein, 17 aa, Staphylococcus epidermidis
KQRFGGSRPFNVLMTPS

SEQ ID NO: 1829369 - protein, 28 aa, Staphylococcus epidermidis
KQRFGGSRPFNVLMTPSDKKRMMDQKHK

SEQ ID NO: 1829370 - protein, 25 aa, Staphylococcus epidermidis
KQRREKALTLVKKKSLLSSGASVVP

SEQ ID NO: 1829371 - protein, 20 aa, Staphylococcus epidermidis
KQRRYWLQQFEDDVPVLNMP

SEQ ID NO: 1829372 - protein, 18 aa, Staphylococcus epidermidis
KQRTLTQYIDRLKRENNI

SEQ ID NO: 1829373 - protein, 25 aa, Staphylococcus epidermidis
KQRVIGYKNQLPWHLPSDLKHVKKL

SEQ ID NO: 1829374 - protein, 18 aa, Staphylococcus epidermidis
KQSACNIIFRTAIVKAHH

SEQ ID NO: 1829375 - protein, 34 aa, Staphylococcus epidermidis
KQSFLEYLLFHYRFKSRITVWVLNYLKANHDKLN

SEQ ID NO: 1829376 - protein, 23 aa, Staphylococcus epidermidis
KQSLHFRVYLLGGEMRDLTEAFV

SEQ ID NO: 1829377 - protein, 18 aa, Staphylococcus epidermidis
KQVAFLVPTTILAQQHYE

SEQ ID NO: 1829378 - protein, 25 aa, Staphylococcus epidermidis
KQVDGAIETFYYSGVPTLTNIPASY

SEQ ID NO: 1829379 - protein, 28 aa, Staphylococcus epidermidis
KQVFNDIPLDEVLLSTSSLFLPQPFYLT

SEQ ID NO: 1829380 - protein, 20 aa, Staphylococcus epidermidis
KQVIEVILDWVFHNDIPLNY

SEQ ID NO: 1829381 - protein, 21 aa, Staphylococcus epidermidis
KQVIEVILDWVFHNDIPLNYK

SEQ ID NO: 1829382 - protein, 18 aa, Staphylococcus epidermidis
KQVIHATQYFTLAESLGA

SEQ ID NO: 1829383 - protein, 17 aa, Staphylococcus epidermidis
KQVLVYSGLFKDARKKL

SEQ ID NO: 1829384 - protein, 28 aa, Staphylococcus epidermidis
KQWSKDTLPFIPEDFIFKVSDYGSKQFK

SEQ ID NO: 1829385 - protein, 29 aa, Staphylococcus epidermidis
KQYDIPSGEWLYIKLKTGKFNDATKFEKQ

SEQ ID NO: 1829386 - protein, 30 aa, Staphylococcus epidermidis; identical to SEQ ID NO: 1689730

SEQ ID NO: 1829387 - protein, 25 aa, Staphylococcus epidermidis
KQYTDMPFIIMLDKDEKGYKAGRFL

SEQ ID NO: 1829388 - protein, 20 aa, Staphylococcus epidermidis
KRAFLDKTLERKAVWDKWME

SEQ ID NO: 1829389 - protein, 33 aa, Staphylococcus epidermidis
KRAPQIFRKLNIEWVYRVLIDWKRIGRMISIPK

SEQ ID NO: 1829390 - protein, 22 aa, Staphylococcus epidermidis
KRAQKLFGQKSYVFDIRKHEMA

SEQ ID NO: 1829391 - protein, 26 aa, Staphylococcus epidermidis
KRDDEGKYFYYLGKAKYINGTEKQDY

SEQ ID NO: 1829392 - protein, 21 aa, Staphylococcus epidermidis
KRELFEQWFHPQDASVTVYNF

SEQ ID NO: 1829393 - protein, 20 aa, Staphylococcus epidermidis
KRELGLVLMILNIRKVPAQR

SEQ ID NO: 1829394 - protein, 24 aa, Staphylococcus epidermidis
KRGFDKFLKYRDVNKIFNSMNKRQ

SEQ ID NO: 1829395 - protein, 25 aa, Staphylococcus epidermidis
KRGIFTIGDLAKYPYRYLKRDFGVL

SEQ ID NO: 1829396 - protein, 20 aa, Staphylococcus epidermidis
KRGQLMAQAFPNGVGGMAAV

SEQ ID NO: 1829397 - protein, 30 aa, Staphylococcus epidermidis
KRHAKRRLTYHTYLALYKQILKEDGEIHFK

SEQ ID NO: 1829398 - protein, 19 aa, Staphylococcus epidermidis
KRHVSLNQLKYLAKIVPDH

SEQ ID NO: 1829399 - protein, 18 aa, Staphylococcus epidermidis
KRIAIKYSIPKWIVDHWV

SEQ ID NO: 1829400 - protein, 20 aa, Staphylococcus epidermidis
KRIDVAVTKGLPRFIDVLEN

SEQ ID NO: 1829401 - protein, 20 aa, Staphylococcus epidermidis
KRIGFYPKTVANISQISFIA

SEQ ID NO: 1829402 - protein, 20 aa, Staphylococcus epidermidis
KRILKQLNYKKMILIAGNHD

SEQ ID NO: 1829403 - protein, 27 aa, Staphylococcus epidermidis
KRINEAGIPIIFVINQIDKHNEEEITF

SEQ ID NO: 1829404 - protein, 20 aa, Staphylococcus epidermidis
KRINEGVIVTIFPDGSDRYM

SEQ ID NO: 1829405 - protein, 24 aa, Staphylococcus epidermidis
KRINEVGIPVVFVINQIDKHNEEE

SEQ ID NO: 1829406 - protein, 27 aa, Staphylococcus epidermidis
KRKMIRMPVVLIISPRYNWLSSDAKII

SEQ ID NO: 1829407 - protein, 20 aa, Staphylococcus epidermidis
KRLFVVSSKKTDVLIRNLEI

SEQ ID NO: 1829408 - protein, 19 aa, Staphylococcus epidermidis
KRLNFDYYFIDIENLETKN

SEQ ID NO: 1829409 - protein, 18 aa, Staphylococcus epidermidis
KRLRNNPIRTFMCDDCKS

SEQ ID NO: 1829410 - protein, 22 aa, Staphylococcus epidermidis
KRMQFSLDKFPLHHFELSMFEN

SEQ ID NO: 1829411 - protein, 24 aa, Staphylococcus epidermidis
KRMQLLHDALVYRIERLQDAIPDN

SEQ ID NO: 1829412 - protein, 17 aa, Staphylococcus epidermidis
KRMVRPVKNIRNLTKAD

SEQ ID NO: 1829413 - protein, 22 aa, Staphylococcus epidermidis
KRPQDLIFLSDMKKEFEKSVTA

SEQ ID NO: 1829414 - protein, 30 aa, Staphylococcus epidermidis
KRQKVSMIFQHFNLLWSRNVLKNVTFPLEI

SEQ ID NO: 1829415 - protein, 34 aa, Staphylococcus epidermidis
KRQKVSMIFQHFNLLWSRTVLKNITFPLEIAGVP

SEQ ID NO: 1829416 - protein, 26 aa, Staphylococcus epidermidis
KRQNPSPYMYYINKDMPIVIGSSPES

SEQ ID NO: 1829417 - protein, 23 aa, Staphylococcus epidermidis
KRRSVKRLLKKYGYPSDLETIAI

SEQ ID NO: 1829418 - protein, 20 aa, Staphylococcus epidermidis
KRRVFVNTPVPPYDTGDMWT

SEQ ID NO: 1829419 - protein, 26 aa, Staphylococcus epidermidis
KRTAFTSMVIFLKLNSINFECTQDEA

SEQ ID NO: 1829420 - protein, 25 aa, Staphylococcus epidermidis
KRTALDEWLFLRFDSVNTHIHKEYP

SEQ ID NO: 1829421 - protein, 19 aa, Staphylococcus epidermidis
KRVHISEFKYPLYMDFLGT

SEQ ID NO: 1829422 - protein, 17 aa, Staphylococcus epidermidis
KRVINRAIPDAPHEALL

SEQ ID NO: 1829423 - protein, 22 aa, Staphylococcus epidermidis
KRVKHYNYVLAGDELILKNGKG

SEQ ID NO: 1829424 - protein, 20 aa, Staphylococcus epidermidis
KRVLAHILGVDLPNPSMIDE

SEQ ID NO: 1829425 - protein, 20 aa, Staphylococcus epidermidis
KRVLDMNDRALRHVNVGLGG

SEQ ID NO: 1829426 - protein, 28 aa, Staphylococcus epidermidis
KRYDIPTNQALKLLLKGTGDLKGSSVGY

SEQ ID NO: 1829427 - protein, 18 aa, Staphylococcus epidermidis
KRYIAKYTINPAITHGIS

SEQ ID NO: 1829428 - protein, 18 aa, Staphylococcus epidermidis
KSALLHHPRRRDNIIFNL

SEQ ID NO: 1829429 - protein, 26 aa, Staphylococcus epidermidis
KSAVTMLTLQYSKGLPHMQINAADPG

SEQ ID NO: 1829430 - protein, 27 aa, Staphylococcus epidermidis
KSDKSSIMLFILLITGGRFSEVNRMTY

SEQ ID NO: 1829431 - protein, 22 aa, Staphylococcus epidermidis
KSDVKVFPIALGTNAVGGHNLY

SEQ ID NO: 1829432 - protein, 27 aa, Staphylococcus epidermidis
KSELGSRMRLRIIPDLTFEYDESIEYG

SEQ ID NO: 1829433 - protein, 21 aa, Staphylococcus epidermidis
KSFDEPDASKLPWGDLDIDVV

SEQ ID NO: 1829434 - protein, 27 aa, Staphylococcus epidermidis
KSFIGESFLAVFNKLLETPLFSYASRN

SEQ ID NO: 1829435 - protein, 20 aa, Staphylococcus epidermidis
KSFILNIPVFDRDPNIDIKN

SEQ ID NO: 1829436 - protein, 23 aa, Staphylococcus epidermidis
KSFYSDILGFKLISNQKQPPGKR

SEQ ID NO: 1829437 - protein, 25 aa, Staphylococcus epidermidis
KSGKQSELSGLREDLKRLKEALKGV

SEQ ID NO: 1829438 - protein, 19 aa, Staphylococcus epidermidis
KSGLKYNISYASKAFTCIQ

SEQ ID NO: 1829439 - protein, 22 aa, Staphylococcus epidermidis
KSGMLDGIRMVTQLLTGLTHGI

SEQ ID NO: 1829440 - protein, 25 aa, Staphylococcus epidermidis
KSGRIKYYPLAIDRGFGATLVDVDG

SEQ ID NO: 1829441 - protein, 31 aa, Staphylococcus epidermidis
KSIHTPTIFNLVGPLINPFKLTYQVMGVYDV

SEQ ID NO: 1829442 - protein, 18 aa, Staphylococcus epidermidis
KSIKEVYPNIIIFVDNCY

SEQ ID NO: 1829443 - protein, 27 aa, Staphylococcus epidermidis
KSIKKRGHDIFLDLKLHDIPNTVSKAM

SEQ ID NO: 1829444 - protein, 26 aa, Staphylococcus epidermidis
KSIKNVVKPLLKYAYDRGIYVQMNSN

SEQ ID NO: 1829445 - protein, 26 aa, Staphylococcus epidermidis
KSILNKSIIKLLPDKISKITHGEVIF

SEQ ID NO: 1829446 - protein, 23 aa, Staphylococcus epidermidis
KSITLNPWSISDLELIGIGGFSP

SEQ ID NO: 1829447 - protein, 22 aa, Staphylococcus epidermidis
KSKDNGKIIKNHKWMTGNELKA

SEQ ID NO: 1829448 - protein, 22 aa, Staphylococcus epidermidis
KSKEIIELISITILVSRLIKEI

SEQ ID NO: 1829449 - protein, 30 aa, Staphylococcus epidermidis
KSKERSLEHLLFGLGIRHLGVKASQVLAER

SEQ ID NO: 1829450 - protein, 21 aa, Staphylococcus epidermidis
KSKLKQWLYSMLHTGNLNNQV

SEQ ID NO: 1829451 - protein, 21 aa, Staphylococcus epidermidis
KSLFPSCRIAYIVLPEKVMNT

SEQ ID NO: 1829452 - protein, 26 aa, Staphylococcus epidermidis
KSLINLLKLNYKSCEGFFLSYEVPHI

SEQ ID NO: 1829453 - protein, 24 aa, Staphylococcus epidermidis
KSLLEDWLFEYKDELPIEASDINT

SEQ ID NO: 1829454 - protein, 20 aa, Staphylococcus epidermidis
KSLLQYVSGLTSTIAQNIID

SEQ ID NO: 1829455 - protein, 27 aa, Staphylococcus epidermidis
KSLQLLDTPGILWPKFEDEKVGKKLSL

SEQ ID NO: 1829456 - protein, 19 aa, Staphylococcus epidermidis
KSLQPFLNKYLSQPEFVEV

SEQ ID NO: 1829457 - protein, 19 aa, Staphylococcus epidermidis
KSLQPFLNKYLSQPEFVVV

SEQ ID NO: 1829458 - protein, 17 aa, Staphylococcus epidermidis
KSLQYMQLKPGQKLKDI

SEQ ID NO: 1829459 - protein, 26 aa, Staphylococcus epidermidis
KSLRSRSFYLELMLEVIVDQLLERLE

SEQ ID NO: 1829460 - protein, 25 aa, Staphylococcus epidermidis
KSNKHSMLLLALISNDINQVIHTVE

SEQ ID NO: 1829461 - protein, 17 aa, Staphylococcus epidermidis
KSNWEFLYYSSELEGLP

SEQ ID NO: 1829462 - protein, 21 aa, Staphylococcus epidermidis
KSNWLSMGPKVKEFESMWAKE

SEQ ID NO: 1829463 - protein, 19 aa, Staphylococcus epidermidis
KSPDYSYIPAIFTKEKAMK

SEQ ID NO: 1829464 - protein, 23 aa, Staphylococcus epidermidis
KSSHIHVVIACYYGLGISTLLAE

SEQ ID NO: 1829465 - protein, 23 aa, Staphylococcus epidermidis
KSSKRDVVLLNAALALYVAEKVN

SEQ ID NO: 1829466 - protein, 23 aa, Staphylococcus epidermidis
KSSLAFDTIYAEGQRRYVESLSA

SEQ ID NO: 1829467 - protein, 25 aa, Staphylococcus epidermidis
KSSLVNEILYKALAQKINKSKMKPG

SEQ ID NO: 1829468 - protein, 24 aa, Staphylococcus epidermidis
KSSLVNEILYKSLAQKINKSKVKP

SEQ ID NO: 1829469 - protein, 21 aa, Staphylococcus epidermidis
KSSVNVFPIALGTNAVGGHNL

SEQ ID NO: 1829470 - protein, 24 aa, Staphylococcus epidermidis
KSTLINILGFIDRGYEGEYLFNNE

SEQ ID NO: 1829471 - protein, 22 aa, Staphylococcus epidermidis
KSTLLKALSRLLSIKDGAINLD

SEQ ID NO: 1829472 - protein, 22 aa, Staphylococcus epidermidis
KSTLLKALSRLLSIKEGRINLD

SEQ ID NO: 1829473 - protein, 25 aa, Staphylococcus epidermidis
KSTLLKVILGLLPIQKGEIIVEGKP

SEQ ID NO: 1829474 - protein, 17 aa, Staphylococcus epidermidis
KSTLLNILGLLEAPTEG

SEQ ID NO: 1829475 - protein, 22 aa, Staphylococcus epidermidis
KSTLLRCMNLLETPTKGQVIFE

SEQ ID NO: 1829476 - protein, 23 aa, Staphylococcus epidermidis
KSTSLVFYQIKIDLDYADVLGLQ

SEQ ID NO: 1829477 - protein, 22 aa, Staphylococcus epidermidis
KSTWIKHLIGLVNLKKAQFTID

SEQ ID NO: 1829478 - protein, 24 aa, Staphylococcus epidermidis
KSVDEFLKKTLMFPIIDRVIKKES

SEQ ID NO: 1829479 - protein, 22 aa, Staphylococcus epidermidis
KSVKFTHEFMFARPVNRTPDMI

SEQ ID NO: 1829480 - protein, 17 aa, Staphylococcus epidermidis
KSVKVCPLIYWTEDEVW

SEQ ID NO: 1829481 - protein, 21 aa, Staphylococcus epidermidis
KSVLIDLGLIIGKDARRRREI

SEQ ID NO: 1829482 - protein, 27 aa, Staphylococcus epidermidis
KSWEKIGVRLVDKLLETFPVHDKEVAH

SEQ ID NO: 1829483 - protein, 18 aa, Staphylococcus epidermidis
KSYDAVFPLLHGPNGEDG

SEQ ID NO: 1829484 - protein, 23 aa, Staphylococcus epidermidis
KSYDIDTYHWLPITFSVNKGVSY

SEQ ID NO: 1829485 - protein, 18 aa, Staphylococcus epidermidis
KSYILYYGYSGNSHIYIK

SEQ ID NO: 1829486 - protein, 24 aa, Staphylococcus epidermidis
KTARRPMILPVIMKVNEDKGNHKQ

SEQ ID NO: 1829487 - protein, 29 aa, Staphylococcus epidermidis
KTDQKKLYKFFLLIAKYIKRKEAFYRATL

SEQ ID NO: 1829488 - protein, 22 aa, Staphylococcus epidermidis
KTERFYQLPKYLFEDAYFKKMS

SEQ ID NO: 1829489 - protein, 18 aa, Staphylococcus epidermidis
KTESNFFAEKLTVTYDTS

SEQ ID NO: 1829490 - protein, 21 aa, Staphylococcus epidermidis
KTFWNHLKPVMESLILLSMRH

SEQ ID NO: 1829491 - protein, 24 aa, Staphylococcus epidermidis
KTHELGIPVMILFEGVPASGKTRL

SEQ ID NO: 1829492 - protein, 19 aa, Staphylococcus epidermidis
KTHGPLKIVFKTTNPIVLM

SEQ ID NO: 1829493 - protein, 22 aa, Staphylococcus epidermidis
KTHTSNFERFSEHLAQSGIEFS

SEQ ID NO: 1829494 - protein, 20 aa, Staphylococcus epidermidis
KTIDYWLLQYTEGVVEPIQV

SEQ ID NO: 1829495 - protein, 21 aa, Staphylococcus epidermidis
KTIGVMPTFLQQRELAHDKLD

SEQ ID NO: 1829496 - protein, 24 aa, Staphylococcus epidermidis
KTIKHARKLGFHIIYVVIGFSEDY

SEQ ID NO: 1829497 - protein, 23 aa, Staphylococcus epidermidis
KTIQGFYIVVGERRFRASQIAGL

SEQ ID NO: 1829498 - protein, 24 aa, Staphylococcus epidermidis
KTIRTLITRLYKKEIIKRYKYNNI

SEQ ID NO: 1829499 - protein, 20 aa, Staphylococcus epidermidis
KTISSQRLMIGQIVFDGVED

SEQ ID NO: 1829500 - protein, 28 aa, Staphylococcus epidermidis
KTIYEISKRTVLFLIGKDITVYGTTIAC

SEQ ID NO: 1829501 - protein, 24 aa, Staphylococcus epidermidis
KTKDHVIFLGFDYNYRGNSKYLFN

SEQ ID NO: 1829502 - protein, 24 aa, Staphylococcus epidermidis
KTKDKYLRPIRKKVGIVFQFSESQ

SEQ ID NO: 1829503 - protein, 24 aa, Staphylococcus epidermidis
KTKHSFFFHSKLNERLYKTGDTAM

SEQ ID NO: 1829504 - protein, 28 aa, Staphylococcus epidermidis
KTKQVDTPLYLFPTKSYIKNEPYGTVLI

SEQ ID NO: 1829505 - protein, 21 aa, Staphylococcus epidermidis
KTKTFHLFDVVQRKADYYIKA

SEQ ID NO: 1829506 - protein, 22 aa, Staphylococcus epidermidis
KTKTFHLYDIVQRKANYYIKAG

SEQ ID NO: 1829507 - protein, 24 aa, Staphylococcus epidermidis
KTLDTAMHGLRESIKDKSDIKNSS

SEQ ID NO: 1829508 - protein, 30 aa, Staphylococcus epidermidis
KTLNATKLSKPFYLGFEKGLNAISGIPFNY

SEQ ID NO: 1829509 - protein, 26 aa, Staphylococcus epidermidis
KTLNIQYLTTILLNDFRINKSLDLLL

SEQ ID NO: 1829510 - protein, 18 aa, Staphylococcus epidermidis
KTLRDGIHNKDDIKRSSA

SEQ ID NO: 1829511 - protein, 30 aa, Staphylococcus epidermidis
KTLSLIDMLNPYLCIIFCNSRENANELANS

SEQ ID NO: 1829512 - protein, 30 aa, Staphylococcus epidermidis
KTLTALQELLQYIIDFYRLDVKVQDIEITF

SEQ ID NO: 1829513 - protein, 22 aa, Staphylococcus epidermidis
KTNDELLYITGSPYDTLLEVIG

SEQ ID NO: 1829514 - protein, 27 aa, Staphylococcus epidermidis
KTNLHGLTKHPVYGRWNAMINRCENPN

SEQ ID NO: 1829515 - protein, 20 aa, Staphylococcus epidermidis
KTPYDAWFPNAEENIILFCP

SEQ ID NO: 1829516 - protein, 24 aa, Staphylococcus epidermidis
KTQFSKIKIIRPINDLLKKFHKCV

SEQ ID NO: 1829517 - protein, 18 aa, Staphylococcus epidermidis
KTQLGMYRFFVQADTPVT

SEQ ID NO: 1829518 - protein, 24 aa, Staphylococcus epidermidis
KTQLLKWHIELPKVVKLQKDIEKK

SEQ ID NO: 1829519 - protein, 22 aa, Staphylococcus epidermidis
KTQTVILRRIYVNTTKSLIVLE

SEQ ID NO: 1829520 - protein, 24 aa, Staphylococcus epidermidis
KTRENYNFISSNKPPYHFKDEVEE

SEQ ID NO: 1829521 - protein, 26 aa, Staphylococcus epidermidis
KTSDNNCLVVLPLNKAISESTLNKIR

SEQ ID NO: 1829522 - protein, 26 aa, Staphylococcus epidermidis
KTSIATMIHLIYRKLNKSSAYLGTNG

SEQ ID NO: 1829523 - protein, 26 aa, Staphylococcus epidermidis
KTSLLESMLQLIKYKGLMTYDNKELK

SEQ ID NO: 1829524 - protein, 28 aa, Staphylococcus epidermidis
KTTALVGGAFTFNMLNNHQALAASETPI

SEQ ID NO: 1829525 - protein, 17 aa, Staphylococcus epidermidis
KTTIIFDPSPRINKMNC

SEQ ID NO: 1829526 - protein, 24 aa, Staphylococcus epidermidis
KTTLLRMMNALEIPTQGSVFVNGK

SEQ ID NO: 1829527 - protein, 27 aa, Staphylococcus epidermidis
KTTTAGKLALLMRKKYNKKPMLVAGDI

SEQ ID NO: 1829528 - protein, 25 aa, Staphylococcus epidermidis
KTVPKDLFFIISLSGETYQLTEVTQ

SEQ ID NO: 1829529 - protein, 24 aa, Staphylococcus epidermidis
KTVQKFPIMYSVMDKLFNYSNPIL

SEQ ID NO: 1829530 - protein, 21 aa, Staphylococcus epidermidis
KTVYKNVAMPLILSKKSKSEI

SEQ ID NO: 1829531 - protein, 21 aa, Staphylococcus epidermidis
KTYDLEVWLPSYNDYKEISSC

SEQ ID NO: 1829532 - protein, 21 aa, Staphylococcus epidermidis
KTYEFVLPEDWGRTREFYIDK

SEQ ID NO: 1829533 - protein, 20 aa, Staphylococcus epidermidis
KVANYIGYLCSIISVTSNPK

SEQ ID NO: 1829534 - protein, 17 aa, Staphylococcus epidermidis
KVAQLVGAKPSEVIFTS

SEQ ID NO: 1829535 - protein, 25 aa, Staphylococcus epidermidis
KVDKDTLIMSFKLTLGKLAIVKEPI

SEQ ID NO: 1829536 - protein, 25 aa, Staphylococcus epidermidis
KVEEYVDIVEIGTPIVINEGLPSVQ

SEQ ID NO: 1829537 - protein, 24 aa, Staphylococcus epidermidis
KVEILLNEHLLSLKVARKSALKRY

SEQ ID NO: 1829538 - protein, 23 aa, Staphylococcus epidermidis
KVEKFAQLLEEIKQQLNSTADAV

SEQ ID NO: 1829539 - protein, 32 aa, Staphylococcus epidermidis
KVERLLSALQLWLLRIHYLDQPHFYPSIETAE

SEQ ID NO: 1829540 - protein, 25 aa, Staphylococcus epidermidis
KVESVWNFINKIWNAARFSLMNIGE

SEQ ID NO: 1829541 - protein, 17 aa, Staphylococcus epidermidis
KVFRKVGIFCDVGEFLM

SEQ ID NO: 1829542 - protein, 24 aa, Staphylococcus epidermidis
KVFTSFDAWLPYLSELDSMPATRA

SEQ ID NO: 1829543 - protein, 18 aa, Staphylococcus epidermidis
KVIEMLKFVGLANKKNQF

SEQ ID NO: 1829544 - protein, 19 aa, Staphylococcus epidermidis
KVIFASARPIRDLLPVIPE

SEQ ID NO: 1829545 - protein, 30 aa, Staphylococcus epidermidis
KVINLNDYIKYANKMRFILESHARSHYKIE

SEQ ID NO: 1829546 - protein, 21 aa, Staphylococcus epidermidis
KVIQLVPNPAFEVMYNHIQEN

SEQ ID NO: 1829547 - protein, 33 aa, Staphylococcus epidermidis
KVIRPVYLNQSTIPTFYIVNVGGGYLDGDRYRL

SEQ ID NO: 1829548 - protein, 20 aa, Staphylococcus epidermidis
KVKDVLQIIAEFQNKLNKPL

SEQ ID NO: 1829549 - protein, 17 aa, Staphylococcus epidermidis
KVKEYLDFAFKNNKLNF

SEQ ID NO: 1829550 - protein, 17 aa, Staphylococcus epidermidis
KVKFYNVVGNHSRVVAN

SEQ ID NO: 1829551 - protein, 24 aa, Staphylococcus epidermidis
KVKGLYLHGPFGTGKSFILGAIAN

SEQ ID NO: 1829552 - protein, 17 aa, Staphylococcus epidermidis
KVKPGCTVAIVSAGPVG

SEQ ID NO: 1829553 - protein, 27 aa, Staphylococcus epidermidis
KVKQTNSYDLAFDELEKEKDFLQVIVK

SEQ ID NO: 1829554 - protein, 25 aa, Staphylococcus epidermidis
KVKRELGFVLMALNIRKVVAQRAEN

SEQ ID NO: 1829555 - protein, 17 aa, Staphylococcus epidermidis
KVLELSGNDIKRAIERS

SEQ ID NO: 1829556 - protein, 31 aa, Staphylococcus epidermidis
KVLIIMPRAIATYELYIAALKLGIAIIPSSE

SEQ ID NO: 1829557 - protein, 26 aa, Staphylococcus epidermidis
KVLNIDGDYSCFLSTNLYGIYDPNGT

SEQ ID NO: 1829558 - protein, 20 aa, Staphylococcus epidermidis
KVLQKRRFKKALQAKRQQNQ

SEQ ID NO: 1829559 - protein, 25 aa, Staphylococcus epidermidis
KVLSKAKIIILDTYYLMMGGYQKKK

SEQ ID NO: 1829560 - protein, 25 aa, Staphylococcus epidermidis
KVMQEEIFGPILPILTYDSFDEAIE

SEQ ID NO: 1829561 - protein, 17 aa, Staphylococcus epidermidis
KVMYITDGVFSMDGDVA

SEQ ID NO: 1829562 - protein, 24 aa, Staphylococcus epidermidis
KVNDTYVLNFVGLGLIVQNAENVQ

SEQ ID NO: 1829563 - protein, 27 aa, Staphylococcus epidermidis
KVNGEPFATARIRPIDNYSGKIERVAI

SEQ ID NO: 1829564 - protein, 23 aa, Staphylococcus epidermidis
KVNKLNVKVYLPPVIKAYLNDDN

SEQ ID NO: 1829565 - protein, 21 aa, Staphylococcus epidermidis
KVNSKYLIATTAAKRARELDE

SEQ ID NO: 1829566 - protein, 30 aa, Staphylococcus epidermidis
KVNWKKFFKEKAIVTYWKQGYYYQHEAYIK

SEQ ID NO: 1829567 - protein, 27 aa, Staphylococcus epidermidis
KVNYLIGTMIETPRACLIAQHLAKHCD

SEQ ID NO: 1829568 - protein, 23 aa, Staphylococcus epidermidis
KVPIMNARPFKPSNEKKKPYAPY

SEQ ID NO: 1829569 - protein, 23 aa, Staphylococcus epidermidis
KVPYNPHRVAVLDYGALDVMKQL

SEQ ID NO: 1829570 - protein, 26 aa, Staphylococcus epidermidis
KVQEELAKATALNNAMKALRDSIQNV

SEQ ID NO: 1829571 - protein, 25 aa, Staphylococcus epidermidis
KVQKEIFLLSEILAGKNDYKLTLEN

SEQ ID NO: 1829572 - protein, 23 aa, Staphylococcus epidermidis
KVQQYNEWLMEQSQFTTNFINMD

SEQ ID NO: 1829573 - protein, 17 aa, Staphylococcus epidermidis
KVRLLFDEHKFTLNNIM

SEQ ID NO: 1829574 - protein, 25 aa, Staphylococcus epidermidis
KVRTRNWTFVIYPESVFQNWRDVLD

SEQ ID NO: 1829575 - protein, 26 aa, Staphylococcus epidermidis
KVSAKRIIDFLSGTVYAIGGDIQRVG

SEQ ID NO: 1829576 - protein, 30 aa, Staphylococcus epidermidis
KVSFKLIATELLWFIKGDTNIQYLLKYNNN

SEQ ID NO: 1829577 - protein, 19 aa, Staphylococcus epidermidis
KVSLELGGKSPYIVLDDVD

SEQ ID NO: 1829578 - protein, 30 aa, Staphylococcus epidermidis
KVTFLDKPPSAWVVLAKPDLGISSPDVFKA

SEQ ID NO: 1829579 - protein, 29 aa, Staphylococcus epidermidis
KVTIWNSVPALFKLFLDYIEKLDQRTLSI

SEQ ID NO: 1829580 - protein, 19 aa, Staphylococcus epidermidis
KVTLLFTGPLTDLAKAINY

SEQ ID NO: 1829581 - protein, 23 aa, Staphylococcus epidermidis
KVTLLIGDLSFYHDMNGLLMAKL

SEQ ID NO: 1829582 - protein, 18 aa, Staphylococcus epidermidis
KVVKLLHGSYALGLLDEE

SEQ ID NO: 1829583 - protein, 19 aa, Staphylococcus epidermidis
KVYEQYIQTKAQYGNLSLL

SEQ ID NO: 1829584 - protein, 33 aa, Staphylococcus epidermidis
KVYNTNVFGIVRMMNTFIPLLEQSQQPVVVNVS

SEQ ID NO: 1829585 - protein, 18 aa, Staphylococcus epidermidis
KWFLQDFEVLINGQRETR

SEQ ID NO: 1829586 - protein, 22 aa, Staphylococcus epidermidis
KWKDTAFIFPESMKSLLPESAQ

SEQ ID NO: 1829587 - protein, 24 aa, Staphylococcus epidermidis
KWNCKYHIVFAPKYRRQVIYGKIK

SEQ ID NO: 1829588 - protein, 25 aa, Staphylococcus epidermidis
KWNCKYHIVFAPKYRRQVIYGKIKR

SEQ ID NO: 1829589 - protein, 23 aa, Staphylococcus epidermidis
KYCLLFNIEFNGHVPTLMCAKLW

SEQ ID NO: 1829590 - protein, 25 aa, Staphylococcus epidermidis
KYCPNCGRLLQYDYIHYNQIGHYHC

SEQ ID NO: 1829591 - protein, 26 aa, Staphylococcus epidermidis
KYCPNCGRLLQYDYIHYNQIGHYHCQ

SEQ ID NO: 1829592 - protein, 28 aa, Staphylococcus epidermidis
KYDCKVYLKREDLQWVRSFKLRGAYNAI

SEQ ID NO: 1829593 - protein, 21 aa, Staphylococcus epidermidis
KYDGRIILYLKEERLSTFLSE

SEQ ID NO: 1829594 - protein, 20 aa, Staphylococcus epidermidis
KYDGYYPSYLKQYTKDAIDQ

SEQ ID NO: 1829595 - protein, 17 aa, Staphylococcus epidermidis
KYDHLYRFFDDNKEKYQ

SEQ ID NO: 1829596 - protein, 18 aa, Staphylococcus epidermidis
KYDVTPISHLKLLEGQKK

SEQ ID NO: 1829597 - protein, 21 aa, Staphylococcus epidermidis
KYEVMSIPTLIVFKDGQPVDK

SEQ ID NO: 1829598 - protein, 18 aa, Staphylococcus epidermidis
KYFLKKYFNLNVSIIPFE

SEQ ID NO: 1829599 - protein, 18 aa, Staphylococcus epidermidis
KYFRNTYKRFYYSRPNEL

SEQ ID NO: 1829600 - protein, 19 aa, Staphylococcus epidermidis
KYFRNTYKRFYYSRPNELD

SEQ ID NO: 1829601 - protein, 20 aa, Staphylococcus epidermidis
KYHFMGYRQMKTLKSELIKM

SEQ ID NO: 1829602 - protein, 22 aa, Staphylococcus epidermidis
KYHMIVRRWLNALEKEHYIVYR

SEQ ID NO: 1829603 - protein, 23 aa, Staphylococcus epidermidis
KYKSIYERLLSIGSSRYDEFILY

SEQ ID NO: 1829604 - protein, 23 aa, Staphylococcus epidermidis
KYLKDAHDFCPYSKATRGNIDVN

SEQ ID NO: 1829605 - protein, 30 aa, Staphylococcus epidermidis
KYLNLNPSTQALLKYPYRQTELFISEVMNL

SEQ ID NO: 1829606 - protein, 22 aa, Staphylococcus epidermidis
KYLQDAHDFCPYSKATRANIDV

SEQ ID NO: 1829607 - protein, 23 aa, Staphylococcus epidermidis
KYNKDIMNIKYDTPIYFNIEEVF

SEQ ID NO: 1829608 - protein, 22 aa, Staphylococcus epidermidis
KYNVKIFEFKSPYLKLTRDGEK

SEQ ID NO: 1829609 - protein, 25 aa, Staphylococcus epidermidis
KYNVNEIYLIAHAFLESGYGRSNYA

SEQ ID NO: 1829610 - protein, 17 aa, Staphylococcus epidermidis
KYPITIWNSVPTLFQML

SEQ ID NO: 1829611 - protein, 17 aa, Staphylococcus epidermidis
KYPIYGLQYHPESILSE

SEQ ID NO: 1829612 - protein, 19 aa, Staphylococcus epidermidis
KYPIYGLQYHPESILSEYG

SEQ ID NO: 1829613 - protein, 25 aa, Staphylococcus epidermidis
KYQASSYFYLVKENPKIIYKKRHLQ

SEQ ID NO: 1829614 - protein, 27 aa, Staphylococcus epidermidis
KYQFKSYKLFNEIIRLIIENKSFETCY

SEQ ID NO: 1829615 - protein, 20 aa, Staphylococcus epidermidis
KYRVYRRNKGVSKPVYLVDS

SEQ ID NO: 1829616 - protein, 20 aa, Staphylococcus epidermidis
KYTIAKFYKLYMERSNEGIS

SEQ ID NO: 1829617 - protein, 19 aa, Staphylococcus epidermidis
KYTKIRRPVELVYQETYTT

SEQ ID NO: 1829618 - protein, 20 aa, Staphylococcus epidermidis
KYTRSKLRKALPEQYVYIIE

SEQ ID NO: 1829619 - protein, 18 aa, Staphylococcus epidermidis
KYWQAYDFNSGYFMSLKL

SEQ ID NO: 1829620 - protein, 24 aa, Staphylococcus epidermidis
KYYEEKLELFKKYLPQYDEYKTQL

SEQ ID NO: 1829621 - protein, 25 aa, Staphylococcus epidermidis
LAAKPQVHVFIATSPIHLEHKLKMT

SEQ ID NO: 1829622 - protein, 25 aa, Staphylococcus epidermidis
LAAKRKLSVFLYSVNDFTDFNATTQ

SEQ ID NO: 1829623 - protein, 21 aa, Staphylococcus epidermidis
LAARKGLPYVFAGHFAPQQMK

SEQ ID NO: 1829624 - protein, 21 aa, Staphylococcus epidermidis
LADMEVWMAFRNDIHEYGQST

SEQ ID NO: 1829625 - protein, 25 aa, Staphylococcus epidermidis
LADSDNFLLVLADSLSLVDVDALSD

SEQ ID NO: 1829626 - protein, 17 aa, Staphylococcus epidermidis
LAEDIGYPVVLKAASGG

SEQ ID NO: 1829627 - protein, 23 aa, Staphylococcus epidermidis
LAEIRVISPNDIYFYQSIEHYIN

SEQ ID NO: 1829628 - protein, 33 aa, Staphylococcus epidermidis
LAENKLRSIFNKRKPYYVITSDNPNIKYAVKNP

SEQ ID NO: 1829629 - protein, 26 aa, Staphylococcus epidermidis
LAERSLDMIVGMLGILKSGAGYLPID

SEQ ID NO: 1829630 - protein, 17 aa, Staphylococcus epidermidis
LAFIKSAVDRELPYHLA

SEQ ID NO: 1829631 - protein, 23 aa, Staphylococcus epidermidis
LAGDRFVVFSDEKQARRIGEARH

SEQ ID NO: 1829632 - protein, 19 aa, Staphylococcus epidermidis
LAHAGGTLPYLKWRINETL

SEQ ID NO: 1829633 - protein, 21 aa, Staphylococcus epidermidis
LAHDLGEFIFKNGFKPRIYEE

SEQ ID NO: 1829634 - protein, 20 aa, Staphylococcus epidermidis
LAIESRAMFPQLSKSLLDET

SEQ ID NO: 1829635 - protein, 20 aa, Staphylococcus epidermidis
LAIGCLYVHERFKDLIMITD

SEQ ID NO: 1829636 - protein, 27 aa, Staphylococcus epidermidis
LAKGLNIIGLINIQFVIAHDGVYVLEV

SEQ ID NO: 1829637 - protein, 29 aa, Staphylococcus epidermidis
LAKREIQFDIIFLDPPYKKGLIDEAIERI

SEQ ID NO: 1829638 - protein, 20 aa, Staphylococcus epidermidis
LAKVITEKLTIPVIGIGAGK

SEQ ID NO: 1829639 - protein, 24 aa, Staphylococcus epidermidis
LAKVSPLIHRANIGGVLNVTELNV

SEQ ID NO: 1829640 - protein, 17 aa, Staphylococcus epidermidis
LAKYQDMMLISGKQFEV

SEQ ID NO: 1829641 - protein, 18 aa, Staphylococcus epidermidis
LALKMDIDHISSYGLILE

SEQ ID NO: 1829642 - protein, 30 aa, Staphylococcus epidermidis
LANFRKKQLGFIFQDYSVLPTLTVKENIML

SEQ ID NO: 1829643 - protein, 18 aa, Staphylococcus epidermidis
LANKVGVYQLKKSFGKEN

SEQ ID NO: 1829644 - protein, 24 aa, Staphylococcus epidermidis
LANLEGLWYARNIKSLPLAMKEVA

SEQ ID NO: 1829645 - protein, 17 aa, Staphylococcus epidermidis
LAPLSHLVLALIGEGDV

SEQ ID NO: 1829646 - protein, 39 aa, Staphylococcus epidermidis
LAQGEKGLFIVPLNGFKKWLTPVDLWKDHQMTIKVGQDI

SEQ ID NO: 1829647 - protein, 18 aa, Staphylococcus epidermidis
LAQTLIDEGFRVVSGGTD

SEQ ID NO: 1829648 - protein, 24 aa, Staphylococcus epidermidis
LAQYQRILKQKNNYLKQLQIGQKT

SEQ ID NO: 1829649 - protein, 22 aa, Staphylococcus epidermidis
LASCYLFTMDDTLNSINFIRSQ

SEQ ID NO: 1829650 - protein, 27 aa, Staphylococcus epidermidis
LASGSIMYKFLTKQLQFDKERIIVIPP

SEQ ID NO: 1829651 - protein, 29 aa, Staphylococcus epidermidis
LASILKAKRIILLAFGPKKKEAISKLLNE

SEQ ID NO: 1829652 - protein, 23 aa, Staphylococcus epidermidis
LATLLTAQFFSPSKIIMIDLDDN

SEQ ID NO: 1829653 - protein, 18 aa, Staphylococcus epidermidis
LATQIGSRLTGVLYVLDE

SEQ ID NO: 1829654 - protein, 18 aa, Staphylococcus epidermidis
LATVYRTLELLAELKVVD

SEQ ID NO: 1829655 - protein, 39 aa, Staphylococcus epidermidis
LAVEYKMAFPLHPEFRTMPMVWYCPPLSPIMSYFEGQNA

SEQ ID NO: 1829656 - protein, 19 aa, Staphylococcus epidermidis
LAVPIHMSMKALLPLVLES

SEQ ID NO: 1829657 - protein, 27 aa, Staphylococcus epidermidis
LAYFEVLHEMKLIVDLMYEGGMENVRY

SEQ ID NO: 1829658 - protein, 18 aa, Staphylococcus epidermidis
LCCSTFLGDFEPVSIKMA

SEQ ID NO: 1829659 - protein, 17 aa, Staphylococcus epidermidis
LCGVHISIFSVGPDREQ

SEQ ID NO: 1829660 - protein, 32 aa, Staphylococcus epidermidis
LCLAQQDIFRPQLRALLRASAYGKLNIMFPMV

SEQ ID NO: 1829661 - protein, 18 aa, Staphylococcus epidermidis
LCSLASRIPYGEALSFAK

SEQ ID NO: 1829662 - protein, 25 aa, Staphylococcus epidermidis
LCVKGISEALLRTSAPKLYVSNVMT

SEQ ID NO: 1829663 - protein, 25 aa, Staphylococcus epidermidis
LCYQFPTYLIEKPTLVISPLISLMD

SEQ ID NO: 1829664 - protein, 18 aa, Staphylococcus epidermidis
LCYQLPTYILEKPTLIIS

SEQ ID NO: 1829665 - protein, 26 aa, Staphylococcus epidermidis
LDAAYRGAYPIFYWKEFDYIIEKHGG

SEQ ID NO: 1829666 - protein, 25 aa, Staphylococcus epidermidis
LDADELIALLYILLHGTLCLQIERL

SEQ ID NO: 1829667 - protein, 24 aa, Staphylococcus epidermidis
LDAYYTPIFMKKSRPSTQLTLICK

SEQ ID NO: 1829668 - protein, 24 aa, Staphylococcus epidermidis
LDEETKFYINPTGRFVIGGPQGDA

SEQ ID NO: 1829669 - protein, 24 aa, Staphylococcus epidermidis
LDEIVKTMIFKIDGEFIMLLVRGH

SEQ ID NO: 1829670 - protein, 23 aa, Staphylococcus epidermidis
LDEIVKTMIFKVDGEFIMVLIRG

SEQ ID NO: 1829671 - protein, 25 aa, Staphylococcus epidermidis
LDELKFIYFKMQKLNPDYLKLAVMP

SEQ ID NO: 1829672 - protein, 18 aa, Staphylococcus epidermidis
LDEQMYGVLLLGQRNHQP

SEQ ID NO: 1829673 - protein, 23 aa, Staphylococcus epidermidis
LDEWQKVIDINLTGAFIGSREAI

SEQ ID NO: 1829674 - protein, 24 aa, Staphylococcus epidermidis
LDEYICQWIRGLDDIIPRLVEKME

SEQ ID NO: 1829675 - protein, 18 aa, Staphylococcus epidermidis
LDFALTLVGQPEFLILDE

SEQ ID NO: 1829676 - protein, 20 aa, Staphylococcus epidermidis
LDHRNTLGVLPTGGGKSICY

SEQ ID NO: 1829677 - protein, 23 aa, Staphylococcus epidermidis
LDHSYDWLIFSSKNAVKYFYPYL

SEQ ID NO: 1829678 - protein, 25 aa, Staphylococcus epidermidis
LDHSYDWLIFSSKNAVKYFYPYLKN

SEQ ID NO: 1829679 - protein, 17 aa, Staphylococcus epidermidis
LDIDVPFLVVNPLLPEH

SEQ ID NO: 1829680 - protein, 26 aa, Staphylococcus epidermidis
LDIFKDTKAWLREYFKGNYPEIKVPL

SEQ ID NO: 1829681 - protein, 18 aa, Staphylococcus epidermidis
LDIGFDLNYLYPDAKHSI

SEQ ID NO: 1829682 - protein, 20 aa, Staphylococcus epidermidis
LDIHYQYQVLDTIRLLKERY

SEQ ID NO: 1829683 - protein, 18 aa, Staphylococcus epidermidis
LDILESGPIWGFDTPIHG

SEQ ID NO: 1829684 - protein, 21 aa, Staphylococcus epidermidis
LDKCGFLVNFRDLKKLVHEQF

SEQ ID NO: 1829685 - protein, 34 aa, Staphylococcus epidermidis
LDKEDFINLILLFLETWYFRASFSQKFGIIEDSK

SEQ ID NO: 1829686 - protein, 17 aa, Staphylococcus epidermidis
LDKGFTGHIIRRGSADA

SEQ ID NO: 1829687 - protein, 17 aa, Staphylococcus epidermidis
LDKKELLKAIKGGLELK

SEQ ID NO: 1829688 - protein, 18 aa, Staphylococcus epidermidis
LDKPLLKQTHRTKNILVL

SEQ ID NO: 1829689 - protein, 17 aa, Staphylococcus epidermidis
LDKWYKINELKKLVTFI

SEQ ID NO: 1829690 - protein, 17 aa, Staphylococcus epidermidis
LDKYLHMSIRKIERSNW

SEQ ID NO: 1829691 - protein, 23 aa, Staphylococcus epidermidis
LDKYLLTHNMTLLDLANAIYIDR

SEQ ID NO: 1829692 - protein, 25 aa, Staphylococcus epidermidis
LDLDKLDKAWKRLFELHPMLKARFT

SEQ ID NO: 1829693 - protein, 21 aa, Staphylococcus epidermidis
LDLLVSLDFRMTATPLYSDIV

SEQ ID NO: 1829694 - protein, 18 aa, Staphylococcus epidermidis
LDLQTYYQISGQNEEQLR

SEQ ID NO: 1829695 - protein, 23 aa, Staphylococcus epidermidis
LDLYLSVLGMPGQTAYHGLLDIG

SEQ ID NO: 1829696 - protein, 24 aa, Staphylococcus epidermidis
LDNFKDILQDVFQLAPTPLDVDKL

SEQ ID NO: 1829697 - protein, 25 aa, Staphylococcus epidermidis
LDNSRKYLNLIYYDHLKTLINTLDS

SEQ ID NO: 1829698 - protein, 17 aa, Staphylococcus epidermidis
LDQGYFARPTIFINVDN

SEQ ID NO: 1829699 - protein, 22 aa, Staphylococcus epidermidis
LDRVYRSLGILQNSRIISMEEA

SEQ ID NO: 1829700 - protein, 18 aa, Staphylococcus epidermidis
LDSARFRYLISKELGVTA

SEQ ID NO: 1829701 - protein, 21 aa, Staphylococcus epidermidis
LDTARYQCFIAEELQVSVKDI

SEQ ID NO: 1829702 - protein, 22 aa, Staphylococcus epidermidis
LDTGTVSPLLKRMEQVDLIKRE

SEQ ID NO: 1829703 - protein, 25 aa, Staphylococcus epidermidis
LDTHTFIDSFYWIDNYSNVLTYLKD

SEQ ID NO: 1829704 - protein, 24 aa, Staphylococcus epidermidis
LDTQKQLYYLSKDLKYDLYNILFE

SEQ ID NO: 1829705 - protein, 26 aa, Staphylococcus epidermidis
LDVILRDEAFLKESFFINGKFQHDLF

SEQ ID NO: 1829706 - protein, 19 aa, Staphylococcus epidermidis
LDVLINHAIDHLNDVYQLT

SEQ ID NO: 1829707 - protein, 30 aa, Staphylococcus epidermidis; identical to SEQ ID NO: 1697553

SEQ ID NO: 1829708 - protein, 22 aa, Staphylococcus epidermidis
LDVTLELKLLADVGLVGFPSVG

SEQ ID NO: 1829709 - protein, 26 aa, Staphylococcus epidermidis
LDVTPTHLLIDAMTLDIDIPQTSIIK

SEQ ID NO: 1829710 - protein, 25 aa, Staphylococcus epidermidis
LDWYAKILYTIYRNRYLFAIKENMG

SEQ ID NO: 1829711 - protein, 27 aa, Staphylococcus epidermidis
LDYLREGDILVIYKLDRLGRTTKQLIE

SEQ ID NO: 1829712 - protein, 18 aa, Staphylococcus epidermidis
LDYMYNLGKRDGFSTHDV

SEQ ID NO: 1829713 - protein, 26 aa, Staphylococcus epidermidis
LDYNGVMGVPITFLHKFNPEQFELIK

SEQ ID NO: 1829714 - protein, 21 aa, Staphylococcus epidermidis
LEAFKEALPFLMTAAEKDENN

SEQ ID NO: 1829715 - protein, 29 aa, Staphylococcus epidermidis
LEAGRSDYFWDLFIQMPAALMFPSGNPFY

SEQ ID NO: 1829716 - protein, 25 aa, Staphylococcus epidermidis
LEAKTGAGFIVALTGAIMTMPGLPK

SEQ ID NO: 1829717 - protein, 20 aa, Staphylococcus epidermidis
LEALNYYVRRFMITVPFENI

SEQ ID NO: 1829718 - protein, 32 aa, Staphylococcus epidermidis
LEARAHQLVIKYSSAWSFLVPEILQIDESTIE

SEQ ID NO: 1829719 - protein, 25 aa, Staphylococcus epidermidis
LEDLNSRLYHYWALGHIHEREQLSD

SEQ ID NO: 1829720 - protein, 17 aa, Staphylococcus epidermidis
LEDMFYLTKLVITDTET

SEQ ID NO: 1829721 - protein, 23 aa, Staphylococcus epidermidis
LEEAYALINWIKDNENRKALDKY

SEQ ID NO: 1829722 - protein, 23 aa, Staphylococcus epidermidis
LEEHKQDILDNKLLLVANRDNSS

SEQ ID NO: 1829723 - protein, 27 aa, Staphylococcus epidermidis
LEELDLKELVLPLIVLDYSKEAAKNSD

SEQ ID NO: 1829724 - protein, 24 aa, Staphylococcus epidermidis
LEELDLKELVLPLIVLDYSTEASE

SEQ ID NO: 1829725 - protein, 17 aa, Staphylococcus epidermidis
LEELPQSIQRYLSNFSV

SEQ ID NO: 1829726 - protein, 24 aa, Staphylococcus epidermidis
LEELSHYWATVRPYYTDFESDIKS

SEQ ID NO: 1829727 - protein, 19 aa, Staphylococcus epidermidis
LEELYILGLLIINNKQTTF

SEQ ID NO: 1829728 - protein, 20 aa, Staphylococcus epidermidis
LEENKYVFILKHSETCPISA

SEQ ID NO: 1829729 - protein, 23 aa, Staphylococcus epidermidis
LEEQILPVMKKLNQIHVIINAKF

SEQ ID NO: 1829730 - protein, 23 aa, Staphylococcus epidermidis
LEERGYHLSKTEYRGREATDFKE

SEQ ID NO: 1829731 - protein, 18 aa, Staphylococcus epidermidis
LEERGYQLSKTEYRGREA

SEQ ID NO: 1829732 - protein, 23 aa, Staphylococcus epidermidis
LEESLDLYQRGMKLSANCDSTLK

SEQ ID NO: 1829733 - protein, 26 aa, Staphylococcus epidermidis
LEFGSPKAIIPKKLAHDVGADLIMSG

SEQ ID NO: 1829734 - protein, 17 aa, Staphylococcus epidermidis
LEFINYYQNHRGKRLKF

SEQ ID NO: 1829735 - protein, 17 aa, Staphylococcus epidermidis
LEFIRSRDTFVPAICYN

SEQ ID NO: 1829736 - protein, 17 aa, Staphylococcus epidermidis
LEFIRSRNTFVPAICYN

SEQ ID NO: 1829737 - protein, 27 aa, Staphylococcus epidermidis
LEGDAMPQLLIPELVKFFKRGQYPMDK

SEQ ID NO: 1829738 - protein, 21 aa, Staphylococcus epidermidis
LEGFKNLGFETYFAIPRSKEE

SEQ ID NO: 1829739 - protein, 18 aa, Staphylococcus epidermidis
LEGKNIALLFEKTSTRTR

SEQ ID NO: 1829740 - protein, 19 aa, Staphylococcus epidermidis
LEGLEFMGVYWDPKKNESL

SEQ ID NO: 1829741 - protein, 29 aa, Staphylococcus epidermidis
LEHRDDIENIFFLIKNWKNKEIYLEEKLY

SEQ ID NO: 1829742 - protein, 18 aa, Staphylococcus epidermidis
LEIATSPDLKYILNSITD

SEQ ID NO: 1829743 - protein, 18 aa, Staphylococcus epidermidis
LEIATSPDLKYILNSITN

SEQ ID NO: 1829744 - protein, 24 aa, Staphylococcus epidermidis
LEIKNYNIPLFPSISKLKDDFVKL

SEQ ID NO: 1829745 - protein, 19 aa, Staphylococcus epidermidis
LEILDLLSCGELCACDLLI

SEQ ID NO: 1829746 - protein, 18 aa, Staphylococcus epidermidis
LEIPKIAMEGILSRIVEI

SEQ ID NO: 1829747 - protein, 21 aa, Staphylococcus epidermidis
LEKEIPLTQPKVAIAGAGSAQ

SEQ ID NO: 1829748 - protein, 24 aa, Staphylococcus epidermidis
LEKFDNAVILFMGAGDIQKLLKAY

SEQ ID NO: 1829749 - protein, 28 aa, Staphylococcus epidermidis
LEKFENAVILFMGAGDIQKLLKAYFEKL

SEQ ID NO: 1829750 - protein, 19 aa, Staphylococcus epidermidis
LEKFKPVLSALLDGGLVCE

SEQ ID NO: 1829751 - protein, 21 aa, Staphylococcus epidermidis
LEKGDVCIALPGGPGTLEEIT

SEQ ID NO: 1829752 - protein, 24 aa, Staphylococcus epidermidis
LEKGLYRKRMLSYGGLLKQKHKIL

SEQ ID NO: 1829753 - protein, 25 aa, Staphylococcus epidermidis
LEKGLYRKRMLSYGGLLKQKHKILN

SEQ ID NO: 1829754 - protein, 23 aa, Staphylococcus epidermidis
LEKKLLLVDVPLRNFGGFKSYRL

SEQ ID NO: 1829755 - protein, 25 aa, Staphylococcus epidermidis
LEKLENKFTYLDRKMDKRFEVVDYN

SEQ ID NO: 1829756 - protein, 18 aa, Staphylococcus epidermidis
LEKLIRLPGKFKYFEHNV

SEQ ID NO: 1829757 - protein, 18 aa, Staphylococcus epidermidis
LEKLLKENEELKAEKALS

SEQ ID NO: 1829758 - protein, 18 aa, Staphylococcus epidermidis
LEKLLYPKKVYQREFRKI

SEQ ID NO: 1829759 - protein, 17 aa, Staphylococcus epidermidis
LELFKPFVMKELVQREI

SEQ ID NO: 1829760 - protein, 25 aa, Staphylococcus epidermidis
LELTPKEFELLLYLIERQGRVITRE

SEQ ID NO: 1829761 - protein, 20 aa, Staphylococcus epidermidis
LEMKPSPMTADMYYLMQLLY

SEQ ID NO: 1829762 - protein, 18 aa, Staphylococcus epidermidis
LEMMKLPYRLYVGGKLGS

SEQ ID NO: 1829763 - protein, 20 aa, Staphylococcus epidermidis
LEMNRPLQRYYRDIRAGLHN

SEQ ID NO: 1829764 - protein, 17 aa, Staphylococcus epidermidis
LEPDTTYPKGTFKVAHV

SEQ ID NO: 1829765 - protein, 22 aa, Staphylococcus epidermidis
LEPKQLIDVKAFMGDTADGYPG

SEQ ID NO: 1829766 - protein, 23 aa, Staphylococcus epidermidis
LEPLDYDAYIVRLNFTGDNTTEP

SEQ ID NO: 1829767 - protein, 30 aa, Staphylococcus epidermidis
LEPNDPIIHFALAELLYYDGQYLRATTEYE

SEQ ID NO: 1829768 - protein, 17 aa, Staphylococcus epidermidis
LEQADLIVLGPGSLYTS

SEQ ID NO: 1829769 - protein, 19 aa, Staphylococcus epidermidis
LEQEHFVVLLLNSKNIVIK

SEQ ID NO: 1829770 - protein, 18 aa, Staphylococcus epidermidis
LEQEHFVVLLLNSKNIVT

SEQ ID NO: 1829771 - protein, 18 aa, Staphylococcus epidermidis
LEQFFRNYEDMKGQLLYR

SEQ ID NO: 1829772 - protein, 25 aa, Staphylococcus epidermidis
LEQQKTRVKLYKSGKSWVKASINEI

SEQ ID NO: 1829773 - protein, 19 aa, Staphylococcus epidermidis
LERDFFEEGLTIEKLGLDK

SEQ ID NO: 1829774 - protein, 24 aa, Staphylococcus epidermidis
LESNLTALSFKYLTSHDAMGSIIV

SEQ ID NO: 1829775 - protein, 18 aa, Staphylococcus epidermidis
LESWKIFSLEDKADFIKM

SEQ ID NO: 1829776 - protein, 18 aa, Staphylococcus epidermidis
LETDLPFNRNDVIYVDCQ

SEQ ID NO: 1829777 - protein, 17 aa, Staphylococcus epidermidis
LETLIFAEIGRQNYSAK

SEQ ID NO: 1829778 - protein, 25 aa, Staphylococcus epidermidis
LETYKMRIPQLFRFNEVLVTSDGIN

SEQ ID NO: 1829779 - protein, 25 aa, Staphylococcus epidermidis
LEVAHYFDRLFSQYGIRSHIDTVTD

SEQ ID NO: 1829780 - protein, 25 aa, Staphylococcus epidermidis
LEVAHYFERLFSQYGIRSHIDTVTD

SEQ ID NO: 1829781 - protein, 21 aa, Staphylococcus epidermidis
LEVTLELKLLADVGLVGFPSV

SEQ ID NO: 1829782 - protein, 26 aa, Staphylococcus epidermidis
LEWLKRYDDNLIIIFKDVESTHLQIL

SEQ ID NO: 1829783 - protein, 19 aa, Staphylococcus epidermidis
LEYIGLSYLTLNRVTTTLS

SEQ ID NO: 1829784 - protein, 29 aa, Staphylococcus epidermidis
LFAQMFTIDVLYYRYIALNYQSSLDFITQ

SEQ ID NO: 1829785 - protein, 24 aa, Staphylococcus epidermidis
LFAVSELIQFIFRGCIRNGKVLNC

SEQ ID NO: 1829786 - protein, 18 aa, Staphylococcus epidermidis
LFDALRAWLDQEDVDIRW

SEQ ID NO: 1829787 - protein, 19 aa, Staphylococcus epidermidis
LFEGFSMGNPKIQTGNLLE

SEQ ID NO: 1829788 - protein, 25 aa, Staphylococcus epidermidis
LFFDGYSMFQLFREWQHFYTNPNDT

SEQ ID NO: 1829789 - protein, 18 aa, Staphylococcus epidermidis
LFHFLERVPSHIPVLIDE

SEQ ID NO: 1829790 - protein, 20 aa, Staphylococcus epidermidis
LFKAKVDSMLFRGVHYEICC

SEQ ID NO: 1829791 - protein, 27 aa, Staphylococcus epidermidis
LFKEHQLLYILIMHAFANTYVSKRQTS

SEQ ID NO: 1829792 - protein, 33 aa, Staphylococcus epidermidis
LFKIVSASLVQYYYRTPRIPRSLLNEYREGILV

SEQ ID NO: 1829793 - protein, 27 aa, Staphylococcus epidermidis
LFKKYVGLTPFQYLLHYRLEKAAKQLT

SEQ ID NO: 1829794 - protein, 17 aa, Staphylococcus epidermidis
LFKLDPERAHGMTIDAL

SEQ ID NO: 1829795 - protein, 17 aa, Staphylococcus epidermidis
LFKYYFEHRFKQNDIVF

SEQ ID NO: 1829796 - protein, 19 aa, Staphylococcus epidermidis
LFLDAKQIKHPILNELVHD

SEQ ID NO: 1829797 - protein, 19 aa, Staphylococcus epidermidis
LFLLDVFEGNIFKVNPATK

SEQ ID NO: 1829798 - protein, 17 aa, Staphylococcus epidermidis
LFLLHQDGLITLPEHKY

SEQ ID NO: 1829799 - protein, 18 aa, Staphylococcus epidermidis
LFMGAGDIQKLLKAYFEK

SEQ ID NO: 1829800 - protein, 25 aa, Staphylococcus epidermidis
LFNDPQYEIYSKLFRSWSGTIHTSI

SEQ ID NO: 1829801 - protein, 19 aa, Staphylococcus epidermidis
LFNKIYNKLKSNPIVSKQL

SEQ ID NO: 1829802 - protein, 25 aa, Staphylococcus epidermidis
LFNNHPLDEVLPSTSSLFLPQTLYI

SEQ ID NO: 1829803 - protein, 33 aa, Staphylococcus epidermidis
LFNNNPYSDLPGWHFKFIIIANMLLNGQSFVEI

SEQ ID NO: 1829804 - protein, 17 aa, Staphylococcus epidermidis
LFNPENCEWTRDVGDTF

SEQ ID NO: 1829805 - protein, 20 aa, Staphylococcus epidermidis
LFRNQWAGKFLKSLNAFPVD

SEQ ID NO: 1829806 - protein, 26 aa, Staphylococcus epidermidis
LFYNTPARLKYIKSLYTELGKITDIV

SEQ ID NO: 1829807 - protein, 29 aa, Staphylococcus epidermidis
LFYSYTELYKTLPFDFLSDVVYQWERFAN

SEQ ID NO: 1829808 - protein, 23 aa, Staphylococcus epidermidis
LGAKRVLPLAVSGPFHSSMMSVI

SEQ ID NO: 1829809 - protein, 20 aa, Staphylococcus epidermidis
LGALGFLDWSALDPQFDYNN

SEQ ID NO: 1829810 - protein, 33 aa, Staphylococcus epidermidis
LGDAVFYATQFQPHLILDFATLTGAAVVALGED

SEQ ID NO: 1829811 - protein, 17 aa, Staphylococcus epidermidis
LGDLAPTLLDLLNVEQP

SEQ ID NO: 1829812 - protein, 21 aa, Staphylococcus epidermidis
LGDNLFVLLCIANSLGIDMTE

SEQ ID NO: 1829813 - protein, 24 aa, Staphylococcus epidermidis
LGDTFNALIAFLIDNIDKLSEFKE

SEQ ID NO: 1829814 - protein, 17 aa, Staphylococcus epidermidis
LGEVFRRYTIENFRELK

SEQ ID NO: 1829815 - protein, 20 aa, Staphylococcus epidermidis
LGFLVIHIPHISEGHFKQFK

SEQ ID NO: 1829816 - protein, 28 aa, Staphylococcus epidermidis
LGFRGDIFGGYILYNIGFIESEDRYFVN

SEQ ID NO: 1829817 - protein, 27 aa, Staphylococcus epidermidis
LGGGGSLAIGWQLGYISALDQAGIDVR

SEQ ID NO: 1829818 - protein, 18 aa, Staphylococcus epidermidis
LGGIGLNAIIGAKLAGAN

SEQ ID NO: 1829819 - protein, 24 aa, Staphylococcus epidermidis
LGGKFGIGPMFSKVFESLFSIEGN

SEQ ID NO: 1829820 - protein, 28 aa, Staphylococcus epidermidis
LGGTFKFTNVNTLHFDLPLQVFSEDTKQ

SEQ ID NO: 1829821 - protein, 25 aa, Staphylococcus epidermidis
LGHRKNPFYVMKQSNLFALTSHYEG

SEQ ID NO: 1829822 - protein, 19 aa, Staphylococcus epidermidis
LGIEAAFNSYFKQFEENYG

SEQ ID NO: 1829823 - protein, 17 aa, Staphylococcus epidermidis
LGIGGDGDPWFVVGKNL

SEQ ID NO: 1829824 - protein, 20 aa, Staphylococcus epidermidis
LGINEPFMYKLVDIVAEIME

SEQ ID NO: 1829825 - protein, 18 aa, Staphylococcus epidermidis
LGISILPATIAQLLNDDV

SEQ ID NO: 1829826 - protein, 17 aa, Staphylococcus epidermidis
LGKAIMLYHSKVVNKCH

SEQ ID NO: 1829827 - protein, 24 aa, Staphylococcus epidermidis
LGKFDVVFDPYFDLHLEKAVNQME

SEQ ID NO: 1829828 - protein, 30 aa, Staphylococcus epidermidis
LGKTPKEFVLFSQWLLMKNIKLDIVDMKIS

SEQ ID NO: 1829829 - protein, 30 aa, Staphylococcus epidermidis
LGLAVTGYRPVMEIQFLGFVFEVFDEVAGQ

SEQ ID NO: 1829830 - protein, 26 aa, Staphylococcus epidermidis
LGLDYLDLYLMHWPGTNEAVMIDSWR

SEQ ID NO: 1829831 - protein, 26 aa, Staphylococcus epidermidis
LGLDYLDLYLMHWPGTNEAVMIDTWQ

SEQ ID NO: 1829832 - protein, 18 aa, Staphylococcus epidermidis
LGMPKRPYTEEAVDFMTK

SEQ ID NO: 1829833 - protein, 24 aa, Staphylococcus epidermidis
LGNPVHAVHWLIKKLHSHGKQLKK

SEQ ID NO: 1829834 - protein, 22 aa, Staphylococcus epidermidis
LGQPSYFPIPEVIGVRLTHSLP

SEQ ID NO: 1829835 - protein, 24 aa, Staphylococcus epidermidis
LGQTFIVELYLYDYDYKRTHFFLR

SEQ ID NO: 1829836 - protein, 20 aa, Staphylococcus epidermidis
LGRRPYFLATKYNEKHQILF

SEQ ID NO: 1829837 - protein, 33 aa, Staphylococcus epidermidis
LGSTIPQMMNKILSVYAPLWKLGHVDGKIIDVK

SEQ ID NO: 1829838 - protein, 17 aa, Staphylococcus epidermidis
LGSVSHKVAKRATIPVL

SEQ ID NO: 1829839 - protein, 29 aa, Staphylococcus epidermidis
LGVAKRAQSFGMKILAFDPYLTEDKAKSL

SEQ ID NO: 1829840 - protein, 30 aa, Staphylococcus epidermidis
LGVAKRAQSFGMKILAFDPYLTEDKAKSLD

SEQ ID NO: 1829841 - protein, 26 aa, Staphylococcus epidermidis
LGVLARKYNLPIYANENTWKAIEKKD

SEQ ID NO: 1829842 - protein, 28 aa, Staphylococcus epidermidis
LGVNAGSYLLKFLSSLNLDKSAKDFVEF

SEQ ID NO: 1829843 - protein, 17 aa, Staphylococcus epidermidis
LGVRYPIIQAGMAGSTT

SEQ ID NO: 1829844 - protein, 17 aa, Staphylococcus epidermidis
LGYLRYWVAEHHQVYSV

SEQ ID NO: 1829845 - protein, 18 aa, Staphylococcus epidermidis
LHAPQIQGFFDIPIDHLM

SEQ ID NO: 1829846 - protein, 22 aa, Staphylococcus epidermidis
LHDRIQFVILGHYQLIDALLDQ

SEQ ID NO: 1829847 - protein, 19 aa, Staphylococcus epidermidis
LHEVFKEYGVLFIDAQYTD

SEQ ID NO: 1829848 - protein, 19 aa, Staphylococcus epidermidis
LHEYLEGPIFISTDKPDPL

SEQ ID NO: 1829849 - protein, 19 aa, Staphylococcus epidermidis
LHIQKKRIDLFFKENMNNY

SEQ ID NO: 1829850 - protein, 22 aa, Staphylococcus epidermidis
LHKEYWHFSEYLAYQTKQKEQI

SEQ ID NO: 1829851 - protein, 18 aa, Staphylococcus epidermidis
LHKFIDLEDKKKVYDTGD

SEQ ID NO: 1829852 - protein, 26 aa, Staphylococcus epidermidis
LHNITGIPLNTLWYQKDRGTYNDKLK

SEQ ID NO: 1829853 - protein, 18 aa, Staphylococcus epidermidis
LHQVQGLGPVIIKVNELS

SEQ ID NO: 1829854 - protein, 18 aa, Staphylococcus epidermidis
LHRLRTKWDIHIIDIFNN

SEQ ID NO: 1829855 - protein, 17 aa, Staphylococcus epidermidis
LHTIPLELDNFNLYDID

SEQ ID NO: 1829856 - protein, 19 aa, Staphylococcus epidermidis
LHVLKRFKAMLIQKNETVE

SEQ ID NO: 1829857 - protein, 19 aa, Staphylococcus epidermidis
LHVLKRFKAVLIQKNETVE

SEQ ID NO: 1829858 - protein, 24 aa, Staphylococcus epidermidis
LHVQLYLSEFIYNLLVQITLDYPN

SEQ ID NO: 1829859 - protein, 19 aa, Staphylococcus epidermidis
LHWQYGHVLTIFEQALSLG

SEQ ID NO: 1829860 - protein, 17 aa, Staphylococcus epidermidis
LIAIGPLTNIAILLTSY

SEQ ID NO: 1829861 - protein, 17 aa, Staphylococcus epidermidis
LIAYLEKHILSRDDLYF

SEQ ID NO: 1829862 - protein, 19 aa, Staphylococcus epidermidis
LIDISLYDHSRITCAIASC

SEQ ID NO: 1829863 - protein, 22 aa, Staphylococcus epidermidis
LIDKLAFTPHFNKVYVTENDNT

SEQ ID NO: 1829864 - protein, 19 aa, Staphylococcus epidermidis
LIDNCDLNFYPGYVNHIVG

SEQ ID NO: 1829865 - protein, 24 aa, Staphylococcus epidermidis
LIDNIRQYGHLKAGIYPVNPPERK

SEQ ID NO: 1829866 - protein, 22 aa, Staphylococcus epidermidis
LIDVLKRFRIILKKKNESVQYM

SEQ ID NO: 1829867 - protein, 36 aa, Staphylococcus epidermidis
LIEDDVIHSLILKPLYYFKDKWTQLTYNLPIKDEWL

SEQ ID NO: 1829868 - protein, 24 aa, Staphylococcus epidermidis
LIEGALNILAPEGSLLLCTNSSAF

SEQ ID NO: 1829869 - protein, 18 aa, Staphylococcus epidermidis
LIEHNLSVMCEADWIIDV

SEQ ID NO: 1829870 - protein, 18 aa, Staphylococcus epidermidis
LIEIAKIFQEVLPKGVVN

SEQ ID NO: 1829871 - protein, 18 aa, Staphylococcus epidermidis
LIEILDQSNLTEINIEDN

SEQ ID NO: 1829872 - protein, 25 aa, Staphylococcus epidermidis
LIELKLNYYLYNRFINKTWDFKEPH

SEQ ID NO: 1829873 - protein, 18 aa, Staphylococcus epidermidis
LIELSQWFDENSIDLHII

SEQ ID NO: 1829874 - protein, 18 aa, Staphylococcus epidermidis
LIEQGLTPEGILNEVLGE

SEQ ID NO: 1829875 - protein, 18 aa, Staphylococcus epidermidis
LIEQLTGLIRKRYHKTII

SEQ ID NO: 1829876 - protein, 25 aa, Staphylococcus epidermidis
LIERGVIEIAPLAYMRGRTLDDAFV

SEQ ID NO: 1829877 - protein, 17 aa, Staphylococcus epidermidis
LIFALPGSTGAVKLAIE

SEQ ID NO: 1829878 - protein, 18 aa, Staphylococcus epidermidis
LIIDALNKNHFEPSKKII

SEQ ID NO: 1829879 - protein, 20 aa, Staphylococcus epidermidis
LIINKLGITILPATISELLN

SEQ ID NO: 1829880 - protein, 25 aa, Staphylococcus epidermidis
LIITPKKQYLITDFRYIDQATEQAQ

SEQ ID NO: 1829881 - protein, 27 aa, Staphylococcus epidermidis
LIITRETFFHYAYLVKKLNSKIKIVGE

SEQ ID NO: 1829882 - protein, 24 aa, Staphylococcus epidermidis
LIKDIYRVYKYKFGITFPIHAKIN

SEQ ID NO: 1829883 - protein, 23 aa, Staphylococcus epidermidis
LIKDVADIFYLQEEDLLPLERMG

SEQ ID NO: 1829884 - protein, 19 aa, Staphylococcus epidermidis
LIKEFPNIQLHLYGFGKEE

SEQ ID NO: 1829885 - protein, 24 aa, Staphylococcus epidermidis
LIKHPPQHFIALAAIGTIADLVSL

SEQ ID NO: 1829886 - protein, 18 aa, Staphylococcus epidermidis
LIKLHRKGKLPKGKKVVA

SEQ ID NO: 1829887 - protein, 28 aa, Staphylococcus epidermidis
LIKQLIKQYGLLYIIDDKFNYSTNLNAD

SEQ ID NO: 1829888 - protein, 19 aa, Staphylococcus epidermidis
LIKVYLKENDFEVLDVTEG

SEQ ID NO: 1829889 - protein, 19 aa, Staphylococcus epidermidis
LILISNHSVPYYAGLSFRT

SEQ ID NO: 1829890 - protein, 18 aa, Staphylococcus epidermidis
LILNFYRNKTIQDVLNDI

SEQ ID NO: 1829891 - protein, 18 aa, Staphylococcus epidermidis
LILNLMKSAGISPNQEKE

SEQ ID NO: 1829892 - protein, 33 aa, Staphylococcus epidermidis
LILPGGESTTLRRLMDLYGFKEVLQNSDLPMFG

SEQ ID NO: 1829893 - protein, 19 aa, Staphylococcus epidermidis
LIMYGQMTAGSWIYIGSQG

SEQ ID NO: 1829894 - protein, 26 aa, Staphylococcus epidermidis
LINDFSYKYGIPWIYGGVVQSTYVEA

SEQ ID NO: 1829895 - protein, 25 aa, Staphylococcus epidermidis
LINQKVFDTFYKSLKGKQILVYSGL

SEQ ID NO: 1829896 - protein, 23 aa, Staphylococcus epidermidis
LIQLKHSISEIPHIKALLNELDA

SEQ ID NO: 1829897 - protein, 34 aa, Staphylococcus epidermidis
LIRAADVILFDRLVNPFILQYASSQTKVINVGKK

SEQ ID NO: 1829898 - protein, 33 aa, Staphylococcus epidermidis
LIRAADVILYDRLVNPLILQYAPPHTEMIDVGK

SEQ ID NO: 1829899 - protein, 17 aa, Staphylococcus epidermidis
LIRILKENTLNQLQLLP

SEQ ID NO: 1829900 - protein, 20 aa, Staphylococcus epidermidis
LIRSVKWTDIIFKNVSFKNV

SEQ ID NO: 1829901 - protein, 18 aa, Staphylococcus epidermidis
LIVMDKDAILIVSGTGEV

SEQ ID NO: 1829902 - protein, 17 aa, Staphylococcus epidermidis
LIVMSHVGVFFDEKLCQ

SEQ ID NO: 1829903 - protein, 18 aa, Staphylococcus epidermidis
LIYKGKKPVYWSPSSESS

SEQ ID NO: 1829904 - protein, 20 aa, Staphylococcus epidermidis
LKAIYDMINHYDYVLIAYEE

SEQ ID NO: 1829905 - protein, 26 aa, Staphylococcus epidermidis
LKANIQAMLRGHFYLRELAASESEIK

SEQ ID NO: 1829906 - protein, 26 aa, Staphylococcus epidermidis
LKANIQAMLRGHFYLRELATSESEVK

SEQ ID NO: 1829907 - protein, 17 aa, Staphylococcus epidermidis
LKAYPGKVNVKVVGVAA

SEQ ID NO: 1829908 - protein, 28 aa, Staphylococcus epidermidis
LKDAILDIEILFPYLTINHFGSSVDKIK

SEQ ID NO: 1829909 - protein, 21 aa, Staphylococcus epidermidis
LKDAPFDLYITNKPSANFPTI

SEQ ID NO: 1829910 - protein, 24 aa, Staphylococcus epidermidis
LKDDYIEVKIIRNVFDKMLTDSQF

SEQ ID NO: 1829911 - protein, 21 aa, Staphylococcus epidermidis
LKDLFYRYFLKLRQKVKTVTI

SEQ ID NO: 1829912 - protein, 22 aa, Staphylococcus epidermidis
LKDQMLEQIPLARFGEDTDIAN

SEQ ID NO: 1829913 - protein, 22 aa, Staphylococcus epidermidis
LKDQMLEQIPLKRFGEDTDIAN

SEQ ID NO: 1829914 - protein, 22 aa, Staphylococcus epidermidis
LKEKLFEYMTLNPRVYKHFEEY

SEQ ID NO: 1829915 - protein, 25 aa, Staphylococcus epidermidis
LKEKVDPYLRPLYDGLNTVLGREQT

SEQ ID NO: 1829916 - protein, 19 aa, Staphylococcus epidermidis
LKENIEYKNACFKGMFNET

SEQ ID NO: 1829917 - protein, 24 aa, Staphylococcus epidermidis
LKESKPYLFAESKPSGRTPDDGKS

SEQ ID NO: 1829918 - protein, 24 aa, Staphylococcus epidermidis
LKESNLEFFQFKEKIKELVSAEFL

SEQ ID NO: 1829919 - protein, 19 aa, Staphylococcus epidermidis
LKETLIRLESRREELKNRE

SEQ ID NO: 1829920 - protein, 18 aa, Staphylococcus epidermidis
LKEYRKYYEPLINKNEKD

SEQ ID NO: 1829921 - protein, 17 aa, Staphylococcus epidermidis
LKGIECIYALYKKNRRS

SEQ ID NO: 1829922 - protein, 28 aa, Staphylococcus epidermidis
LKGKDEKFPFLMFGPGNGPHQINECVEK

SEQ ID NO: 1829923 - protein, 24 aa, Staphylococcus epidermidis
LKGLDSLLSIVQMPGGIPVATTAI

SEQ ID NO: 1829924 - protein, 25 aa, Staphylococcus epidermidis
LKGSWNVVCFYPADFSFVCPTELED

SEQ ID NO: 1829925 - protein, 24 aa, Staphylococcus epidermidis
LKHSQIETLMSQFNLIDNRPESLL

SEQ ID NO: 1829926 - protein, 19 aa, Staphylococcus epidermidis
LKINLRDFFPFIEIQEVNE

SEQ ID NO: 1829927 - protein, 20 aa, Staphylococcus epidermidis
LKINRQFIFATHNANIPVFG

SEQ ID NO: 1829928 - protein, 23 aa, Staphylococcus epidermidis
LKKGDVCIALPGGPGTLEEITEV

SEQ ID NO: 1829929 - protein, 32 aa, Staphylococcus epidermidis
LKKGGILIIDLMNPAFFYKNFEEQMIFNFKDY

SEQ ID NO: 1829930 - protein, 18 aa, Staphylococcus epidermidis
LKLKDYFIKQIRAYMKGD

SEQ ID NO: 1829931 - protein, 27 aa, Staphylococcus epidermidis
LKMIQESKVLITYFTRLQSLKKDKDEL

SEQ ID NO: 1829932 - protein, 19 aa, Staphylococcus epidermidis
LKNIIFKYIILIEQTLKTN

SEQ ID NO: 1829933 - protein, 24 aa, Staphylococcus epidermidis
LKNKNIALLFEKDSTRTRCSFEVA

SEQ ID NO: 1829934 - protein, 19 aa, Staphylococcus epidermidis
LKNMIENYGLIALKDDYIE

SEQ ID NO: 1829935 - protein, 24 aa, Staphylococcus epidermidis
LKNNEWVTLYHALLKPQFIHDFDD

SEQ ID NO: 1829936 - protein, 21 aa, Staphylococcus epidermidis
LKPPLNVYFSGYRSLEGFEGY

SEQ ID NO: 1829937 - protein, 29 aa, Staphylococcus epidermidis
LKPQTNLVDIMRALFPCGSITGAPKLSTM

SEQ ID NO: 1829938 - protein, 24 aa, Staphylococcus epidermidis
LKQEVRLHIIQLNTPLFEQYQNVD

SEQ ID NO: 1829939 - protein, 27 aa, Staphylococcus epidermidis
LKQFGWFVADSLNNKPLFKLKKRDALR

SEQ ID NO: 1829940 - protein, 17 aa, Staphylococcus epidermidis
LKQGYTFLGYRYQILKE

SEQ ID NO: 1829941 - protein, 28 aa, Staphylococcus epidermidis
LKQHSRQYAKRQLTWFKNKMNVHWLNKE

SEQ ID NO: 1829942 - protein, 21 aa, Staphylococcus epidermidis
LKQNEFVLFDLGVVYHHYCSD

SEQ ID NO: 1829943 - protein, 19 aa, Staphylococcus epidermidis
LKQTLIIEIARFIPSMKLK

SEQ ID NO: 1829944 - protein, 28 aa, Staphylococcus epidermidis
LKRQNPSPYMFYINKDIPIIVGSSPESF

SEQ ID NO: 1829945 - protein, 24 aa, Staphylococcus epidermidis
LKSQYYFVLAIGNNTVREKIFNKN

SEQ ID NO: 1829946 - protein, 23 aa, Staphylococcus epidermidis
LKSRGFKVLVPPAYLGGQNDKNF

SEQ ID NO: 1829947 - protein, 27 aa, Staphylococcus epidermidis
LKSTYAKNMFRLLKQYKHTGYIKINIS

SEQ ID NO: 1829948 - protein, 23 aa, Staphylococcus epidermidis
LKTFNIVPHYDLNIMKTGQTLSG

SEQ ID NO: 1829949 - protein, 20 aa, Staphylococcus epidermidis
LKTNLTLANIKLLLEADILS

SEQ ID NO: 1829950 - protein, 19 aa, Staphylococcus epidermidis
LKVKKYSFGMKKKLGIIQA

SEQ ID NO: 1829951 - protein, 24 aa, Staphylococcus epidermidis
LKVRQRVMDLLLLTDEKTYYSYRM

SEQ ID NO: 1829952 - protein, 18 aa, Staphylococcus epidermidis
LKWRDLFNDFEMHFYRYV

SEQ ID NO: 1829953 - protein, 17 aa, Staphylococcus epidermidis
LKWRGLIYQQTDEQGIE

SEQ ID NO: 1829954 - protein, 27 aa, Staphylococcus epidermidis
LKYEQHPNWILNPYPVAIPHLRDDMFK

SEQ ID NO: 1829955 - protein, 24 aa, Staphylococcus epidermidis
LKYRYGNRKFWCKGFYVDTVGRNK

SEQ ID NO: 1829956 - protein, 21 aa, Staphylococcus epidermidis
LLADNFMRGKFRLLIREEQAE

SEQ ID NO: 1829957 - protein, 18 aa, Staphylococcus epidermidis
LLDEGFIYSKPRSGYYVS

SEQ ID NO: 1829958 - protein, 22 aa, Staphylococcus epidermidis
LLDIRVVITRPANDPALFDATV

SEQ ID NO: 1829959 - protein, 23 aa, Staphylococcus epidermidis
LLDNQLIAFYILKEPVEREYIEN

SEQ ID NO: 1829960 - protein, 17 aa, Staphylococcus epidermidis
LLDQYPGLQVAMEPFGA

SEQ ID NO: 1829961 - protein, 24 aa, Staphylococcus epidermidis
LLEKGYIVCPYISNDLVLAQRLEK

SEQ ID NO: 1829962 - protein, 17 aa, Staphylococcus epidermidis
LLEKIAIYMELKGENTF

SEQ ID NO: 1829963 - protein, 18 aa, Staphylococcus epidermidis
LLEKIAIYMELKGENTFK

SEQ ID NO: 1829964 - protein, 22 aa, Staphylococcus epidermidis
LLELDILRFSLGKPVKIYAAQL

SEQ ID NO: 1829965 - protein, 18 aa, Staphylococcus epidermidis
LLELIRHENILVTPHIAF

SEQ ID NO: 1829966 - protein, 18 aa, Staphylococcus epidermidis
LLGLLRLHLSLFEKYDKD

SEQ ID NO: 1829967 - protein, 26 aa, Staphylococcus epidermidis
LLHKFEVETIFDLALFTILKGHVAVD

SEQ ID NO: 1829968 - protein, 17 aa, Staphylococcus epidermidis
LLHLRRLVELKGEKIGV

SEQ ID NO: 1829969 - protein, 21 aa, Staphylococcus epidermidis
LLIAILKGYKGIKLDRLTLII

SEQ ID NO: 1829970 - protein, 17 aa, Staphylococcus epidermidis
LLIGGEVLNAKWVNLLN

SEQ ID NO: 1829971 - protein, 18 aa, Staphylococcus epidermidis
LLINFVTRTEGIPEGVLI

SEQ ID NO: 1829972 - protein, 20 aa, Staphylococcus epidermidis
LLKNGKSYILYYGYSGNSHI

SEQ ID NO: 1829973 - protein, 19 aa, Staphylococcus epidermidis
LLKSAFMLNKNPNLKVLEY

SEQ ID NO: 1829974 - protein, 17 aa, Staphylococcus epidermidis
LLKSLSQKEVYPKYIET

SEQ ID NO: 1829975 - protein, 17 aa, Staphylococcus epidermidis
LLLEIPKSRKIHSDGIH

SEQ ID NO: 1829976 - protein, 17 aa, Staphylococcus epidermidis
LLLIMEESLAKRLGFKE

SEQ ID NO: 1829977 - protein, 17 aa, Staphylococcus epidermidis
LLMAGGQGTRLGYKGPK

SEQ ID NO: 1829978 - protein, 17 aa, Staphylococcus epidermidis
LLNDPNGLIYYKGYYYI

SEQ ID NO: 1829979 - protein, 18 aa, Staphylococcus epidermidis
LLPKHFHSLWKATKDREK

SEQ ID NO: 1829980 - protein, 19 aa, Staphylococcus epidermidis
LLQHFDSTAFLNFNTYRDD

SEQ ID NO: 1829981 - protein, 17 aa, Staphylococcus epidermidis
LLRKKLLSLTKQIKTHE

SEQ ID NO: 1829982 - protein, 18 aa, Staphylococcus epidermidis
LLSAMSRLFNCDNGTISI

SEQ ID NO: 1829983 - protein, 17 aa, Staphylococcus epidermidis
LLSGDWIHKNLYKVAKE

SEQ ID NO: 1829984 - protein, 35 aa, Staphylococcus epidermidis
LLTGLTHGITELGTTAPIFGMVGGAASLMSKNVRS

SEQ ID NO: 1829985 - protein, 27 aa, Staphylococcus epidermidis
LLTRLESDLMQLIIDLENCKPIHFNWK

SEQ ID NO: 1829986 - protein, 20 aa, Staphylococcus epidermidis
LLTVMIGRALMLPRGTVFSC

SEQ ID NO: 1829987 - protein, 30 aa, Staphylococcus epidermidis
LLTYKIMTMFEPYFRDYKLIFINCPSRGRS

SEQ ID NO: 1829988 - protein, 28 aa, Staphylococcus epidermidis
LLTYKIMTMFEPYFRDYKLIFINSPSRG

SEQ ID NO: 1829989 - protein, 17 aa, Staphylococcus epidermidis
LLVQSSIYDKLIPKLKE

SEQ ID NO: 1829990 - protein, 17 aa, Staphylococcus epidermidis
LLYGFINEEEKEMFLSL

SEQ ID NO: 1829991 - protein, 27 aa, Staphylococcus epidermidis
LLYNKYKSYWKLFLKPFETLEAFNYHK

SEQ ID NO: 1829992 - protein, 22 aa, Staphylococcus epidermidis
LMDEMSLRLVDFKVEFGKTHDG

SEQ ID NO: 1829993 - protein, 18 aa, Staphylococcus epidermidis
LMDKALTDMLINLLGYVA

SEQ ID NO: 1829994 - protein, 21 aa, Staphylococcus epidermidis
LMDKDEVIFSELLRFAGIGES

SEQ ID NO: 1829995 - protein, 24 aa, Staphylococcus epidermidis
LMEAREIFLVITGANKRDMVEKLY

SEQ ID NO: 1829996 - protein, 17 aa, Staphylococcus epidermidis
LMEYLNRYDTQIATTFG

SEQ ID NO: 1829997 - protein, 18 aa, Staphylococcus epidermidis
LMFDEYLKRNYSVMIPDS

SEQ ID NO: 1829998 - protein, 25 aa, Staphylococcus epidermidis
LMITHYQRLLNYITPDQVHVMYGGK

SEQ ID NO: 1829999 - protein, 21 aa, Staphylococcus epidermidis
LMQLINDLAMIFMKAGYEELQ

SEQ ID NO: 1830000 - protein, 19 aa, Staphylococcus epidermidis
LMSVYAETLARWSKSQKFT

SEQ ID NO: 1830001 - protein, 19 aa, Staphylococcus epidermidis
LMTALTYPTIFSQVAMLSP

SEQ ID NO: 1830002 - protein, 19 aa, Staphylococcus epidermidis
LMTDKVGLVTCMYVNNIMG

SEQ ID NO: 1830003 - protein, 24 aa, Staphylococcus epidermidis
LNATYDPKFLYGDKIVPFEGESRE

SEQ ID NO: 1830004 - protein, 25 aa, Staphylococcus epidermidis
LNDESYIGLIDRLHPTPALGGYPKE

SEQ ID NO: 1830005 - protein, 30 aa, Staphylococcus epidermidis
LNDIGFIFQSSHLIPYLTVEEQLLIVGKEA

SEQ ID NO: 1830006 - protein, 26 aa, Staphylococcus epidermidis
LNDKPESLFNYFKQLFAQVTNPPIDA

SEQ ID NO: 1830007 - protein, 18 aa, Staphylococcus epidermidis
LNDLYGDYGDLFARLIEF

SEQ ID NO: 1830008 - protein, 18 aa, Staphylococcus epidermidis
LNDRIRMVWLSQNLKHSY

SEQ ID NO: 1830009 - protein, 23 aa, Staphylococcus epidermidis
LNDTFIKTFGDISYMISQTPQAC

SEQ ID NO: 1830010 - protein, 19 aa, Staphylococcus epidermidis
LNDYLTFYQKEMNYRKLGK

SEQ ID NO: 1830011 - protein, 23 aa, Staphylococcus epidermidis
LNECQTFYIEYVPKFDPTTINTI

SEQ ID NO: 1830012 - protein, 25 aa, Staphylococcus epidermidis
LNEDAIKFPSFRPDSWRGKRYLYTG

SEQ ID NO: 1830013 - protein, 33 aa, Staphylococcus epidermidis; identical to SEQ ID NO: 1689765

SEQ ID NO: 1830014 - protein, 17 aa, Staphylococcus epidermidis
LNEFKFTVKDALINSVS

SEQ ID NO: 1830015 - protein, 31 aa, Staphylococcus epidermidis
LNEFYEMQLSNLYIYKLAVIANMKLQSLSSC

SEQ ID NO: 1830016 - protein, 27 aa, Staphylococcus epidermidis
LNEGYHVIMDIPLLYENDLQDTVDEVW

SEQ ID NO: 1830017 - protein, 30 aa, Staphylococcus epidermidis
LNFKFMKRINEVGIPIIFVINQIDKHNEEE

SEQ ID NO: 1830018 - protein, 33 aa, Staphylococcus epidermidis
LNFKFMKRINEVGIPIIFVINQIDKHNEEEITF

SEQ ID NO: 1830019 - protein, 19 aa, Staphylococcus epidermidis
LNFKFMKRINEVGIPVVFV

SEQ ID NO: 1830020 - protein, 35 aa, Staphylococcus epidermidis
LNGKNVVLIHGFKHYVALLFHKGAILEDKYGTLIQ

SEQ ID NO: 1830021 - protein, 32 aa, Staphylococcus epidermidis
LNGLDNLLAGIRYAKRTYGGRMLSVIGHGHGY

SEQ ID NO: 1830022 - protein, 20 aa, Staphylococcus epidermidis
LNIHTVEDLVLYLPTRYEDN

SEQ ID NO: 1830023 - protein, 17 aa, Staphylococcus epidermidis
LNILEGCRHHKVGNLIY

SEQ ID NO: 1830024 - protein, 18 aa, Staphylococcus epidermidis
LNIPLHKVSNYKKNNIHF

SEQ ID NO: 1830025 - protein, 21 aa, Staphylococcus epidermidis
LNKERILLIAYLEKHILSRDD

SEQ ID NO: 1830026 - protein, 17 aa, Staphylococcus epidermidis
LNKLIDGQEFEEAAIVR

SEQ ID NO: 1830027 - protein, 30 aa, Staphylococcus epidermidis
LNKLNLDNIELTKYLFFTGKGGVGKTTISS

SEQ ID NO: 1830028 - protein, 26 aa, Staphylococcus epidermidis
LNKSYDLIILDLMLPNINGLEICRQI

SEQ ID NO: 1830029 - protein, 26 aa, Staphylococcus epidermidis
LNLPQTRLRKLLKKMDYYIKFEESTN

SEQ ID NO: 1830030 - protein, 17 aa, Staphylococcus epidermidis
LNLTQLEKLLKAINNTF

SEQ ID NO: 1830031 - protein, 23 aa, Staphylococcus epidermidis
LNNIIYDLIGLKVVSFHSDLSTV

SEQ ID NO: 1830032 - protein, 21 aa, Staphylococcus epidermidis
LNNTMKALRDAIKDNQQVLQS

SEQ ID NO: 1830033 - protein, 17 aa, Staphylococcus epidermidis
LNPDFFMYQAYAAQVQR

SEQ ID NO: 1830034 - protein, 27 aa, Staphylococcus epidermidis
LNPDNIELTKYLFFTGKGGVGKTTISS

SEQ ID NO: 1830035 - protein, 19 aa, Staphylococcus epidermidis
LNPLFSSAYLSEVKGLIEE

SEQ ID NO: 1830036 - protein, 20 aa, Staphylococcus epidermidis
LNPNLKAFAPVREWAWSREE

SEQ ID NO: 1830037 - protein, 28 aa, Staphylococcus epidermidis
LNPNTTASNYFFWYSVPTSTEGTMFNKT

SEQ ID NO: 1830038 - protein, 17 aa, Staphylococcus epidermidis
LNPVELRRSIGYVIQQI

SEQ ID NO: 1830039 - protein, 17 aa, Staphylococcus epidermidis
LNQALADAQAMIDKAHG

SEQ ID NO: 1830040 - protein, 17 aa, Staphylococcus epidermidis
LNQLFHGIEYRMQLEMM

SEQ ID NO: 1830041 - protein, 17 aa, Staphylococcus epidermidis
LNQLLIENHYDISTALT

SEQ ID NO: 1830042 - protein, 19 aa, Staphylococcus epidermidis
LNQQFVEYALKVTLRREHF

SEQ ID NO: 1830043 - protein, 19 aa, Staphylococcus epidermidis
LNRAPTLHRLGIQAFEPTL

SEQ ID NO: 1830044 - protein, 24 aa, Staphylococcus epidermidis
LNRAPTLHRLGIQAFEPTLVEGRA

SEQ ID NO: 1830045 - protein, 24 aa, Staphylococcus epidermidis
LNRHKMGILFQKTEFPKYIKVCEL

SEQ ID NO: 1830046 - protein, 25 aa, Staphylococcus epidermidis
LNSNWDMLFIVFSIHLIDKAKQLKP

SEQ ID NO: 1830047 - protein, 25 aa, Staphylococcus epidermidis
LNSSKYLNEDPKYQQPYDQTIAAAE

SEQ ID NO: 1830048 - protein, 17 aa, Staphylococcus epidermidis
LNTKRSLALLLMAEVDI

SEQ ID NO: 1830049 - protein, 29 aa, Staphylococcus epidermidis
LNTLNIDNIILPYWLMNSEELESLFIETN

SEQ ID NO: 1830050 - protein, 25 aa, Staphylococcus epidermidis
LNTRIIIVTTFKRPGYFEKAVANDV

SEQ ID NO: 1830051 - protein, 18 aa, Staphylococcus epidermidis
LNTTSTIRNNNLTTIQIT

SEQ ID NO: 1830052 - protein, 23 aa, Staphylococcus epidermidis
LNTYVDWSFVLEYMKYVNKFVRI

SEQ ID NO: 1830053 - protein, 20 aa, Staphylococcus epidermidis
LNVAFAYIDWKNSEFGPMAR

SEQ ID NO: 1830054 - protein, 26 aa, Staphylococcus epidermidis
LNVPNEPIIPFIIGDGIGPDIWKAAS

SEQ ID NO: 1830055 - protein, 22 aa, Staphylococcus epidermidis
LNVVPPLHFIITDNSGHTVAVE

SEQ ID NO: 1830056 - protein, 26 aa, Staphylococcus epidermidis
LNVYQDVFYLKYVAVVKVDGIGTIKI

SEQ ID NO: 1830057 - protein, 17 aa, Staphylococcus epidermidis
LNYFNQLNYFDDDCIEA

SEQ ID NO: 1830058 - protein, 18 aa, Staphylococcus epidermidis
LNYILKKLAQYSEQLKIE

SEQ ID NO: 1830059 - protein, 29 aa, Staphylococcus epidermidis
LNYNPILEGFTLPKMLWVQQHEPDIWEQV

SEQ ID NO: 1830060 - protein, 17 aa, Staphylococcus epidermidis
LNYRQIKSFLMKHLSRQ

SEQ ID NO: 1830061 - protein, 30 aa, Staphylococcus epidermidis
LPANEGRGYVLRRLLRRAVRFSQSLGINEP

SEQ ID NO: 1830062 - protein, 17 aa, Staphylococcus epidermidis
LPCKVNKLLILINSSDY

SEQ ID NO: 1830063 - protein, 18 aa, Staphylococcus epidermidis
LPDYTFPLFGMAVGEPAE

SEQ ID NO: 1830064 - protein, 17 aa, Staphylococcus epidermidis
LPEVLSLYNTQFPNVEI

SEQ ID NO: 1830065 - protein, 19 aa, Staphylococcus epidermidis
LPIYNSFGMTETCSQFLTA

SEQ ID NO: 1830066 - protein, 24 aa, Staphylococcus epidermidis
LPKGRYFLEIVYNQMKFPSRDYKT

SEQ ID NO: 1830067 - protein, 21 aa, Staphylococcus epidermidis
LPKNKLIVMTGLSGSGKSSLA

SEQ ID NO: 1830068 - protein, 29 aa, Staphylococcus epidermidis
LPKQQLPYLISFLSFHNYAIYQILLPSRV

SEQ ID NO: 1830069 - protein, 26 aa, Staphylococcus epidermidis
LPKQQLPYLISFLSFHNYSIYQILSP

SEQ ID NO: 1830070 - protein, 23 aa, Staphylococcus epidermidis
LPLTSIYNRLGFDFGIVGNHEFN

SEQ ID NO: 1830071 - protein, 17 aa, Staphylococcus epidermidis
LPLVVFTGQVATPGIGK

SEQ ID NO: 1830072 - protein, 19 aa, Staphylococcus epidermidis
LPMMNGVIGNPLLDKFMKD

SEQ ID NO: 1830073 - protein, 22 aa, Staphylococcus epidermidis
LPQEIIDKYNIPIAPLSVTFDD

SEQ ID NO: 1830074 - protein, 19 aa, Staphylococcus epidermidis
LPQMYTLLNLLETGKWINE

SEQ ID NO: 1830075 - protein, 28 aa, Staphylococcus epidermidis
LPQNDPALVDLLISTLGWSPDTQVLIND

SEQ ID NO: 1830076 - protein, 27 aa, Staphylococcus epidermidis
LPQNNPAIVDLLISTLGWSPETQVLIN

SEQ ID NO: 1830077 - protein, 19 aa, Staphylococcus epidermidis
LPRTGAYHEIWLDGEKVLD

SEQ ID NO: 1830078 - protein, 26 aa, Staphylococcus epidermidis
LPSFTYTFLGFLPRKEKEKIEVLDDR

SEQ ID NO: 1830079 - protein, 28 aa, Staphylococcus epidermidis
LPSIHQEYLLYVRYTAILIDPFSQPDEK

SEQ ID NO: 1830080 - protein, 18 aa, Staphylococcus epidermidis
LPSYRYAQIYYEDNDLAI

SEQ ID NO: 1830081 - protein, 17 aa, Staphylococcus epidermidis
LPVGYPRVNYLLNRAQD

SEQ ID NO: 1830082 - protein, 18 aa, Staphylococcus epidermidis
LPYLIELGAIEISPKYRH

SEQ ID NO: 1830083 - protein, 19 aa, Staphylococcus epidermidis
LQAKLGYPPNNLPDFFELQ

SEQ ID NO: 1830084 - protein, 19 aa, Staphylococcus epidermidis
LQALQAPVRQIAENAGLEG

SEQ ID NO: 1830085 - protein, 19 aa, Staphylococcus epidermidis
LQALSYIGLNYLTLSRETT

SEQ ID NO: 1830086 - protein, 21 aa, Staphylococcus epidermidis
LQDDLIYLQTQIKKTIVFVTH

SEQ ID NO: 1830087 - protein, 28 aa, Staphylococcus epidermidis
LQERTQRDYLFFKFAIHTGVKLTELLNM

SEQ ID NO: 1830088 - protein, 25 aa, Staphylococcus epidermidis
LQETFDNAFLLRTFSKAYGLAGLRV

SEQ ID NO: 1830089 - protein, 26 aa, Staphylococcus epidermidis
LQFDKERIIVIPPLNKSHGINIERVL

SEQ ID NO: 1830090 - protein, 26 aa, Staphylococcus epidermidis
LQGEWPHLSCQWLQQWYHLLFEKFDA

SEQ ID NO: 1830091 - protein, 18 aa, Staphylococcus epidermidis
LQGLLTFQDLPVDSYIIW

SEQ ID NO: 1830092 - protein, 26 aa, Staphylococcus epidermidis
LQGNLDPSLLLAPWDVIETRLKEILD

SEQ ID NO: 1830093 - protein, 21 aa, Staphylococcus epidermidis
LQIIAEFQNKLNKPLSDHQTA

SEQ ID NO: 1830094 - protein, 18 aa, Staphylococcus epidermidis
LQILASFAEFERNTIVEN

SEQ ID NO: 1830095 - protein, 17 aa, Staphylococcus epidermidis
LQILLWNMVKERDNQPH

SEQ ID NO: 1830096 - protein, 17 aa, Staphylococcus epidermidis
LQLEGLNFNREGQLFLL

SEQ ID NO: 1830097 - protein, 19 aa, Staphylococcus epidermidis
LQLIGFDNVAGYRLPKSEV

SEQ ID NO: 1830098 - protein, 20 aa, Staphylococcus epidermidis
LQLSRQIAIQTAPQIRMIQN

SEQ ID NO: 1830099 - protein, 25 aa, Staphylococcus epidermidis
LQNKTIGIFGFGRIGQLVAERLKPF

SEQ ID NO: 1830100 - protein, 25 aa, Staphylococcus epidermidis
LQNSDLPMFGTCAGLIVLAKDVEGE

SEQ ID NO: 1830101 - protein, 24 aa, Staphylococcus epidermidis
LQQIALFPHMTIKENIAQVPQMKK

SEQ ID NO: 1830102 - protein, 27 aa, Staphylococcus epidermidis
LQQTTKNLIIPIYGKAESLNVAIAGSI

SEQ ID NO: 1830103 - protein, 23 aa, Staphylococcus epidermidis
LQRLNIIRSLISQPDILICDEIT

SEQ ID NO: 1830104 - protein, 19 aa, Staphylococcus epidermidis
LQRLNIIRSLLAQPDILVC

SEQ ID NO: 1830105 - protein, 25 aa, Staphylococcus epidermidis
LQSPNNLLGMSYLKAINQFAPQIEA

SEQ ID NO: 1830106 - protein, 33 aa, Staphylococcus epidermidis
LQSTNLVPFLTIKQQFHLLKKYKKDVLSTEEFD

SEQ ID NO: 1830107 - protein, 18 aa, Staphylococcus epidermidis
LQTIQFPYFDSNGDGIFE

SEQ ID NO: 1830108 - protein, 20 aa, Staphylococcus epidermidis
LQYEDFISPLTGLKYERHEY

SEQ ID NO: 1830109 - protein, 17 aa, Staphylococcus epidermidis
LQYVSGLTSTIAQNIID

SEQ ID NO: 1830110 - protein, 23 aa, Staphylococcus epidermidis
LRDDKAIEGIPQELALKNAKETE

SEQ ID NO: 1830111 - protein, 22 aa, Staphylococcus epidermidis
LRDKSFFVLSETGKLKMPFNKF

SEQ ID NO: 1830112 - protein, 26 aa, Staphylococcus epidermidis
LRDNLQLFVVIGQLNQLIKGGRISKT

SEQ ID NO: 1830113 - protein, 22 aa, Staphylococcus epidermidis
LRDYKEKLIIPGFFGISKQNDI

SEQ ID NO: 1830114 - protein, 26 aa, Staphylococcus epidermidis
LRENIQLFVVIGQLNQLIKGGRISKT

SEQ ID NO: 1830115 - protein, 19 aa, Staphylococcus epidermidis
LREYLDDFPIVAIGGINES

SEQ ID NO: 1830116 - protein, 20 aa, Staphylococcus epidermidis
LRGEIILGNLKYSSGPNHQL

SEQ ID NO: 1830117 - protein, 27 aa, Staphylococcus epidermidis
LRGKDENFPFLMFGPGTGPHQVDECVD

SEQ ID NO: 1830118 - protein, 25 aa, Staphylococcus epidermidis
LRHKQLPAFSVQYHPEARPGPSDSN

SEQ ID NO: 1830119 - protein, 22 aa, Staphylococcus epidermidis
LRIVEHIKFYFGLLDKKPNHFK

SEQ ID NO: 1830120 - protein, 24 aa, Staphylococcus epidermidis
LRKLEVDVPIYYYGFKESDDIYAK

SEQ ID NO: 1830121 - protein, 21 aa, Staphylococcus epidermidis
LRKPDWLKIKLNTNENYTGLK

SEQ ID NO: 1830122 - protein, 19 aa, Staphylococcus epidermidis
LRLPLIPLENAERKVLEQA

SEQ ID NO: 1830123 - protein, 18 aa, Staphylococcus epidermidis
LRNMKSTFANSLYKDINL

SEQ ID NO: 1830124 - protein, 19 aa, Staphylococcus epidermidis
LRNMKSTFANSLYKDINLM

SEQ ID NO: 1830125 - protein, 17 aa, Staphylococcus epidermidis
LRPFIGLDEPVYNYVMK

SEQ ID NO: 1830126 - protein, 31 aa, Staphylococcus epidermidis
LRPIDKMFDYSYLYFLLRDDAINTFMKHYRV

SEQ ID NO: 1830127 - protein, 30 aa, Staphylococcus epidermidis
LRQELDLFTCLRPVRWFQGVPSPVKRPEDV

SEQ ID NO: 1830128 - protein, 22 aa, Staphylococcus epidermidis
LRQLEAMLIVMNKDAILVVSGT

SEQ ID NO: 1830129 - protein, 26 aa, Staphylococcus epidermidis
LRRGQVLLHNPILIIISTAGTNLNGP

SEQ ID NO: 1830130 - protein, 19 aa, Staphylococcus epidermidis
LRTLYEESFLIKATLKEGI

SEQ ID NO: 1830131 - protein, 25 aa, Staphylococcus epidermidis
LRTQIIEYLTYFQTSSPSYLVMSSL

SEQ ID NO: 1830132 - protein, 19 aa, Staphylococcus epidermidis
LRVCSFLKQGTLADIGSDH

SEQ ID NO: 1830133 - protein, 24 aa, Staphylococcus epidermidis
LSAHDSWALAKHLKTLPVRFKQSV

SEQ ID NO: 1830134 - protein, 19 aa, Staphylococcus epidermidis
LSAKRFLIATGASPSLPQI

SEQ ID NO: 1830135 - protein, 19 aa, Staphylococcus epidermidis
LSDEPVYVLGSSSGAIVAM

SEQ ID NO: 1830136 - protein, 27 aa, Staphylococcus epidermidis
LSEAQVLKIFKYFYSHRGPVLDFNNEK

SEQ ID NO: 1830137 - protein, 21 aa, Staphylococcus epidermidis
LSEGYIYFKDKPISDYPVYEM

SEQ ID NO: 1830138 - protein, 21 aa, Staphylococcus epidermidis
LSEGYIYFKEKPISDYPVYEM

SEQ ID NO: 1830139 - protein, 24 aa, Staphylococcus epidermidis
LSELTMYYLNLVSVSRLKRNPTVK

SEQ ID NO: 1830140 - protein, 17 aa, Staphylococcus epidermidis
LSFNYMSDVFHIIKNKG

SEQ ID NO: 1830141 - protein, 25 aa, Staphylococcus epidermidis
LSGKPLFERNLKLVKYAYQETQGKF

SEQ ID NO: 1830142 - protein, 26 aa, Staphylococcus epidermidis
LSGQKLPIWIADYVLSTYGTGAVMAV

SEQ ID NO: 1830143 - protein, 21 aa, Staphylococcus epidermidis
LSHNNYIKRLPVSTYRSQNRG

SEQ ID NO: 1830144 - protein, 20 aa, Staphylococcus epidermidis
LSHQHDLPVWNKPALCSLAS

SEQ ID NO: 1830145 - protein, 29 aa, Staphylococcus epidermidis
LSHRFINRDLFKYIPFDGSIITISELQEL

SEQ ID NO: 1830146 - protein, 23 aa, Staphylococcus epidermidis
LSIASHLIGVKRIKALDIDEMAV

SEQ ID NO: 1830147 - protein, 18 aa, Staphylococcus epidermidis
LSIMCEADWIIDVGPGPG

SEQ ID NO: 1830148 - protein, 18 aa, Staphylococcus epidermidis
LSIPYYVIYSMEGEIKDM

SEQ ID NO: 1830149 - protein, 30 aa, Staphylococcus epidermidis
LSITVSLVSRLIFDFSFYYSKLKHENMSEN

SEQ ID NO: 1830150 - protein, 22 aa, Staphylococcus epidermidis
LSKDKVYVVYDWTGGTILGKQA

SEQ ID NO: 1830151 - protein, 22 aa, Staphylococcus epidermidis
LSKGLSFIRKGSTNTPIIQEER

SEQ ID NO: 1830152 - protein, 21 aa, Staphylococcus epidermidis
LSKRLHFIRDKRLLQISLKKD

SEQ ID NO: 1830153 - protein, 29 aa, Staphylococcus epidermidis
LSKSRFIYLSPEYILQPHNFKYIAHINFG

SEQ ID NO: 1830154 - protein, 25 aa, Staphylococcus epidermidis
LSLGENQIAALYWSNGHLANELEIG

SEQ ID NO: 1830155 - protein, 29 aa, Staphylococcus epidermidis
LSLRNTDTYIALLLGYYDATKKYDNKPST

SEQ ID NO: 1830156 - protein, 17 aa, Staphylococcus epidermidis
LSLYEKLKKQIIEGLYH

SEQ ID NO: 1830157 - protein, 25 aa, Staphylococcus epidermidis
LSNELIYHFISFIVAYTLEENETES

SEQ ID NO: 1830158 - protein, 21 aa, Staphylococcus epidermidis
LSNELLLHLDAKYSQFIATKS

SEQ ID NO: 1830159 - protein, 26 aa, Staphylococcus epidermidis
LSNLHNTVFLGIDRIKLHALHYSFNE

SEQ ID NO: 1830160 - protein, 21 aa, Staphylococcus epidermidis
LSNMAQMVFLLGDLNVKDLSD

SEQ ID NO: 1830161 - protein, 28 aa, Staphylococcus epidermidis
LSQDRPTIVRLLDPPLHEFLPSSDEDIQ

SEQ ID NO: 1830162 - protein, 17 aa, Staphylococcus epidermidis
LSQLGISLRAIMDRVGH

SEQ ID NO: 1830163 - protein, 28 aa, Staphylococcus epidermidis
LSRDRVDIILPAVSVFKTLFKKIDATQF

SEQ ID NO: 1830164 - protein, 24 aa, Staphylococcus epidermidis
LSREDLFITSKLWLTDFGRQNVEE

SEQ ID NO: 1830165 - protein, 26 aa, Staphylococcus epidermidis
LSRKRLLLLTVDSIEFILVKGSDVPT

SEQ ID NO: 1830166 - protein, 20 aa, Staphylococcus epidermidis
LSRTKIFIDDTPGIRITDLR

SEQ ID NO: 1830167 - protein, 23 aa, Staphylococcus epidermidis
LSRTQGFDGWAPLFFRGREVSGK

SEQ ID NO: 1830168 - protein, 31 aa, Staphylococcus epidermidis
LSSFMSIEPQIRLWDILQTKFKAKALQEKVY

SEQ ID NO: 1830169 - protein, 17 aa, Staphylococcus epidermidis
LSSIMDIYNREIVAYKI

SEQ ID NO: 1830170 - protein, 32 aa, Staphylococcus epidermidis
LSSLKIYNRWHKFKILIAKKYARLYRIFNKNK

SEQ ID NO: 1830171 - protein, 26 aa, Staphylococcus epidermidis
LSSSQQKLLKYLTALSMAEGLNQLVE

SEQ ID NO: 1830172 - protein, 23 aa, Staphylococcus epidermidis
LSTLYTIPYIIQDLAARYCHHKV

SEQ ID NO: 1830173 - protein, 31 aa, Staphylococcus epidermidis
LSVDDFVRILTEPKLSLIKQYEALLQTEEVT

SEQ ID NO: 1830174 - protein, 22 aa, Staphylococcus epidermidis
LSVELSDRIKLNIPVISAGMDT

SEQ ID NO: 1830175 - protein, 19 aa, Staphylococcus epidermidis
LSVFDIFSPLIQGATMCYV

SEQ ID NO: 1830176 - protein, 18 aa, Staphylococcus epidermidis
LSVMCEADWIIDVGPGPG

SEQ ID NO: 1830177 - protein, 31 aa, Staphylococcus epidermidis
LSVVIFNSLAMPFIALYRMDTIGKGILVWQE

SEQ ID NO: 1830178 - protein, 17 aa, Staphylococcus epidermidis
LSYLLADSSKRDAHASY

SEQ ID NO: 1830179 - protein, 24 aa, Staphylococcus epidermidis
LTATMPLYLNALTGKRAFLITTND

SEQ ID NO: 1830180 - protein, 18 aa, Staphylococcus epidermidis
LTAVQQLNYNPTVCLAIE

SEQ ID NO: 1830181 - protein, 26 aa, Staphylococcus epidermidis
LTDDEMLAHLLKYDTMQGRFTGEVEV

SEQ ID NO: 1830182 - protein, 25 aa, Staphylococcus epidermidis
LTDIEIVELLAFISFTHCQQEFGAM

SEQ ID NO: 1830183 - protein, 24 aa, Staphylococcus epidermidis
LTDLEIVELLAFVSFTHCQQEFGA

SEQ ID NO: 1830184 - protein, 17 aa, Staphylococcus epidermidis
LTDLFVSVIFELNIVKA

SEQ ID NO: 1830185 - protein, 27 aa, Staphylococcus epidermidis
LTEARSLKFFKYFYTHRGPVMDYRNLT

SEQ ID NO: 1830186 - protein, 20 aa, Staphylococcus epidermidis
LTEKYATWSSSYRNSLKAEN

SEQ ID NO: 1830187 - protein, 20 aa, Staphylococcus epidermidis
LTELQILKLLFQNENKYVSR

SEQ ID NO: 1830188 - protein, 23 aa, Staphylococcus epidermidis
LTERSFEMIACMVASWKVGASYV

SEQ ID NO: 1830189 - protein, 20 aa, Staphylococcus epidermidis
LTFQLYQKLKRQNPSPYMFY

SEQ ID NO: 1830190 - protein, 23 aa, Staphylococcus epidermidis
LTGVDLVVELPLLASLSSGDTFA

SEQ ID NO: 1830191 - protein, 17 aa, Staphylococcus epidermidis
LTHIKHYYQQPKFIKYW

SEQ ID NO: 1830192 - protein, 17 aa, Staphylococcus epidermidis
LTHYVFMNELKINLLDF

SEQ ID NO: 1830193 - protein, 20 aa, Staphylococcus epidermidis
LTIEQFKLLQFIYQFTHHHS

SEQ ID NO: 1830194 - protein, 21 aa, Staphylococcus epidermidis
LTIEVFSKYFNKVYVVLGNHD

SEQ ID NO: 1830195 - protein, 30 aa, Staphylococcus epidermidis
LTIITNCLPVFNILMKKQTLHFRVYLLGGE

SEQ ID NO: 1830196 - protein, 22 aa, Staphylococcus epidermidis
LTISVDLPFAQKRWCASSGLEN

SEQ ID NO: 1830197 - protein, 18 aa, Staphylococcus epidermidis
LTLICKLHDKIYFEQLIL

SEQ ID NO: 1830198 - protein, 25 aa, Staphylococcus epidermidis
LTLIDRMPFHGLKPEFYALAAGTKS

SEQ ID NO: 1830199 - protein, 21 aa, Staphylococcus epidermidis
LTPLIGKKVIVNEKEIGIFLT

SEQ ID NO: 1830200 - protein, 27 aa, Staphylococcus epidermidis
LTPNEIYNLVVYQLGALSGFCKINHVK

SEQ ID NO: 1830201 - protein, 27 aa, Staphylococcus epidermidis
LTQAIETLGYPFIVKTRFGGYDGKGQI

SEQ ID NO: 1830202 - protein, 20 aa, Staphylococcus epidermidis
LTQIAFYERGELVDADSIEM

SEQ ID NO: 1830203 - protein, 22 aa, Staphylococcus epidermidis
LTQPFSLEKILLGGAKLSPQLI

SEQ ID NO: 1830204 - protein, 23 aa, Staphylococcus epidermidis
LTQPYSIEKILLGGAKLSSHLIN

SEQ ID NO: 1830205 - protein, 23 aa, Staphylococcus epidermidis
LTQYVGHLNVVLFAPEDLNIVKG

SEQ ID NO: 1830206 - protein, 17 aa, Staphylococcus epidermidis
LTSELNVAQLKRALNQL

SEQ ID NO: 1830207 - protein, 23 aa, Staphylococcus epidermidis
LTTEYYWHWDLDNAQLDVFEYKK

SEQ ID NO: 1830208 - protein, 17 aa, Staphylococcus epidermidis
LTTLILKELGVKKVTAK

SEQ ID NO: 1830209 - protein, 17 aa, Staphylococcus epidermidis
LTTQYIPHWEQPEYIKT

SEQ ID NO: 1830210 - protein, 27 aa, Staphylococcus epidermidis
LTVINELAWHNLFAHNMFIRPDSKEEA

SEQ ID NO: 1830211 - protein, 35 aa, Staphylococcus epidermidis
LTWKDLFHDFEMHFYRYVFPYYDTLYTLEKLSEHD

SEQ ID NO: 1830212 - protein, 17 aa, Staphylococcus epidermidis
LTWNLKKGPKGGIIEVF

SEQ ID NO: 1830213 - protein, 28 aa, Staphylococcus epidermidis
LTYKIMTMFEPYFRDYKLIFINCPSRGR

SEQ ID NO: 1830214 - protein, 17 aa, Staphylococcus epidermidis
LTYLATLKGLSSKEIRQ

SEQ ID NO: 1830215 - protein, 19 aa, Staphylococcus epidermidis
LTYPTIFSQVAMLSPMYNQ

SEQ ID NO: 1830216 - protein, 20 aa, Staphylococcus epidermidis
LVAMIDLIKKSEPGYGPLLA

SEQ ID NO: 1830217 - protein, 18 aa, Staphylococcus epidermidis
LVAYFIRQLRLNSEDIII

SEQ ID NO: 1830218 - protein, 22 aa, Staphylococcus epidermidis
LVEAGTNLLEFIRSRNTFVPAI

SEQ ID NO: 1830219 - protein, 35 aa, Staphylococcus epidermidis
LVECFFTGLTRYLKRHKGLFVLVDPYILENNRDAD

SEQ ID NO: 1830220 - protein, 26 aa, Staphylococcus epidermidis
LVEEFFRALIINARLTVHIDLLRGGN

SEQ ID NO: 1830221 - protein, 24 aa, Staphylococcus epidermidis
LVEGRAIRLHPLVTTAYNADFDGD

SEQ ID NO: 1830222 - protein, 17 aa, Staphylococcus epidermidis
LVEKLRLLIQQLKQSIH

SEQ ID NO: 1830223 - protein, 21 aa, Staphylococcus epidermidis
LVFLDSVVIPLMDAFHIDEET

SEQ ID NO: 1830224 - protein, 18 aa, Staphylococcus epidermidis
LVGAKFVKLFTDVNLEDD

SEQ ID NO: 1830225 - protein, 27 aa, Staphylococcus epidermidis
LVGEIDKWVSLLNDLKIASPILENHLD

SEQ ID NO: 1830226 - protein, 17 aa, Staphylococcus epidermidis
LVGLPRAEKRFKAYPHQ

SEQ ID NO: 1830227 - protein, 18 aa, Staphylococcus epidermidis
LVGPLRNAGLIRSVRGAK

SEQ ID NO: 1830228 - protein, 20 aa, Staphylococcus epidermidis
LVISTYLANYFMSQSNHVAL

SEQ ID NO: 1830229 - protein, 18 aa, Staphylococcus epidermidis
LVKHLIHTMYPVQPFYEG

SEQ ID NO: 1830230 - protein, 25 aa, Staphylococcus epidermidis
LVKHYRKLIESLAYKYSKGQSHHED

SEQ ID NO: 1830231 - protein, 25 aa, Staphylococcus epidermidis
LVKLNILQEKFGPFLLRDCNNIFQK

SEQ ID NO: 1830232 - protein, 28 aa, Staphylococcus epidermidis
LVKNKYLIDYRYNGYRDIFVIDDIKKSA

SEQ ID NO: 1830233 - protein, 32 aa, Staphylococcus epidermidis
LVKTVHKYLPLLHRYTKLRKELLGIEDLKMYD

SEQ ID NO: 1830234 - protein, 17 aa, Staphylococcus epidermidis
LVLVYKLDRLTRNVRDL

SEQ ID NO: 1830235 - protein, 30 aa, Staphylococcus epidermidis
LVMKQLFEHRGLPQLPYISFLRSEYEKYEN

SEQ ID NO: 1830236 - protein, 17 aa, Staphylococcus epidermidis
LVNKWIDIYRTISFDDK

SEQ ID NO: 1830237 - protein, 25 aa, Staphylococcus epidermidis
LVNQKVFDAFYKALKGKQVLVYSGL

SEQ ID NO: 1830238 - protein, 27 aa, Staphylococcus epidermidis
LVQAKSFLYDLKLKPKLSRHRTKLVKL

SEQ ID NO: 1830239 - protein, 17 aa, Staphylococcus epidermidis
LVRFFNHYFNKGDIYQA

SEQ ID NO: 1830240 - protein, 18 aa, Staphylococcus epidermidis
LVRIINLSLRAKYLFDYN

SEQ ID NO: 1830241 - protein, 19 aa, Staphylococcus epidermidis
LVRPQIISGTHAITLALQS

SEQ ID NO: 1830242 - protein, 25 aa, Staphylococcus epidermidis
LVSAASSCYIISLAATLERAGYTDI

SEQ ID NO: 1830243 - protein, 24 aa, Staphylococcus epidermidis
LVSDIVYNPYKTPILIEAEQKGNP

SEQ ID NO: 1830244 - protein, 26 aa, Staphylococcus epidermidis
LVSVVTMQLISYYAALHRDLDVDKPR

SEQ ID NO: 1830245 - protein, 25 aa, Staphylococcus epidermidis
LVTHYRKLIESLAYKYSKGQSHHED

SEQ ID NO: 1830246 - protein, 26 aa, Staphylococcus epidermidis
LVTLSIPVFYFYNEDNQFFKCYFDRH

SEQ ID NO: 1830247 - protein, 17 aa, Staphylococcus epidermidis
LVVRLEGTNVERGKEIL

SEQ ID NO: 1830248 - protein, 17 aa, Staphylococcus epidermidis
LVVTRRLYRSGESEYYL

SEQ ID NO: 1830249 - protein, 34 aa, Staphylococcus epidermidis
LVWATAAPGWQKWVWSPFLSILGTGATAFVYNGR

SEQ ID NO: 1830250 - protein, 19 aa, Staphylococcus epidermidis
LWDILQTKFKAKALQEKVY

SEQ ID NO: 1830251 - protein, 26 aa, Staphylococcus epidermidis
LWDLPNYIFNRYWHFKTTGNAIAMAW

SEQ ID NO: 1830252 - protein, 19 aa, Staphylococcus epidermidis
LYAHDIIYTTNGRLGFDYL

SEQ ID NO: 1830253 - protein, 25 aa, Staphylococcus epidermidis
LYDNKSGLYNLKLFAQVLGKGFDKE

SEQ ID NO: 1830254 - protein, 20 aa, Staphylococcus epidermidis
LYEDLFQFLVKIKDIYKTKL

SEQ ID NO: 1830255 - protein, 19 aa, Staphylococcus epidermidis
LYEEINQLKNDRPVVKVGI

SEQ ID NO: 1830256 - protein, 19 aa, Staphylococcus epidermidis
LYEELFGAKTLYIQRIKDR

SEQ ID NO: 1830257 - protein, 19 aa, Staphylococcus epidermidis
LYGPEGLGFLFVKKSIRNQ

SEQ ID NO: 1830258 - protein, 22 aa, Staphylococcus epidermidis
LYIDEQTFVPCTPLGIMEILKH

SEQ ID NO: 1830259 - protein, 18 aa, Staphylococcus epidermidis
LYKDLLIVADTCLCEYTD

SEQ ID NO: 1830260 - protein, 26 aa, Staphylococcus epidermidis
LYKEHQYKHFIYTPVGFVCEHLEVLY

SEQ ID NO: 1830261 - protein, 21 aa, Staphylococcus epidermidis
LYKEIIDSKEQTILSLKKINK

SEQ ID NO: 1830262 - protein, 21 aa, Staphylococcus epidermidis
LYKFLFEDSTFNKLSIKAKLL

SEQ ID NO: 1830263 - protein, 25 aa, Staphylococcus epidermidis
LYQKTNFPKLFKVKELFHLHQSFYK

SEQ ID NO: 1830264 - protein, 22 aa, Staphylococcus epidermidis
LYQTEWQEWLEDGTLSKLDIAF

SEQ ID NO: 1830265 - protein, 18 aa, Staphylococcus epidermidis
LYRSEDVVNWTFLGEIQT

SEQ ID NO: 1830266 - protein, 18 aa, Staphylococcus epidermidis
LYTLLKREKPGLFGSPIK

SEQ ID NO: 1830267 - protein, 29 aa, Staphylococcus epidermidis
LYTYEKQLEDWIWTYRRKGLYKTCKHCNE

SEQ ID NO: 1830268 - protein, 24 aa, Staphylococcus epidermidis
LYYEKMIELIKPLGHIATIVAFND

SEQ ID NO: 1830269 - protein, 17 aa, Staphylococcus epidermidis
LYYIHFPDEETPKDKAV

SEQ ID NO: 1830270 - protein, 24 aa, Staphylococcus epidermidis
MADDPIIFAMANPNPEIKPDDAKA

SEQ ID NO: 1830271 - protein, 26 aa, Staphylococcus epidermidis
MADNLFNDEFFMYGLQTYAESNNSDV

SEQ ID NO: 1830272 - protein, 25 aa, Staphylococcus epidermidis
MAEGKALFFVKGQYVAGAGGKASLQ

SEQ ID NO: 1830273 - protein, 25 aa, Staphylococcus epidermidis
MAKRLLDFGVHPPTIYFPLNVEEGM

SEQ ID NO: 1830274 - protein, 26 aa, Staphylococcus epidermidis
MALAAKDIRIEAPIPGTSLVGIEVPN

SEQ ID NO: 1830275 - protein, 30 aa, Staphylococcus epidermidis
MALERGALDTYYTPIFMKKGRPSTHLTVIC

SEQ ID NO: 1830276 - protein, 27 aa, Staphylococcus epidermidis
MALKLTFQMLFIMLREFNQLEIEFIVE

SEQ ID NO: 1830277 - protein, 26 aa, Staphylococcus epidermidis
MAQEGHDFFGLLYIGAILTKDGPKVI

SEQ ID NO: 1830278 - protein, 27 aa, Staphylococcus epidermidis
MAQRVAFIMSLIRRPDYLFLDEPTSAL

SEQ ID NO: 1830279 - protein, 22 aa, Staphylococcus epidermidis
MASPLGWHKYVGIEGKVIGIDS

SEQ ID NO: 1830280 - protein, 32 aa, Staphylococcus epidermidis
MAYVSESIHLLPFNVFFVPARGGLGENMVYQA

SEQ ID NO: 1830281 - protein, 24 aa, Staphylococcus epidermidis
MCYADCVPVYFYSEPHGYIGLAHA

SEQ ID NO: 1830282 - protein, 23 aa, Staphylococcus epidermidis
MDAAEYKNVALGLIFLKYVSDSF

SEQ ID NO: 1830283 - protein, 30 aa, Staphylococcus epidermidis
MDADLVFDVRFLPNPYYVEELRPFIGLDEP

SEQ ID NO: 1830284 - protein, 24 aa, Staphylococcus epidermidis
MDAGNMLKPMLARGELHCIGATTL

SEQ ID NO: 1830285 - protein, 25 aa, Staphylococcus epidermidis
MDGNSNPIWIYRALCDYYLNKKKDL

SEQ ID NO: 1830286 - protein, 19 aa, Staphylococcus epidermidis
MDLFVKLNKEKKTTMIMVT

SEQ ID NO: 1830287 - protein, 27 aa, Staphylococcus epidermidis
MDNLERFLKYYLLYSEYNNYSIKTAEL

SEQ ID NO: 1830288 - protein, 17 aa, Staphylococcus epidermidis
MDYERILHLESIELENI

SEQ ID NO: 1830289 - protein, 30 aa, Staphylococcus epidermidis
MDYRNLTLVRFFFKSLTDYLKKRNCLYVLV

SEQ ID NO: 1830290 - protein, 17 aa, Staphylococcus epidermidis
MEALIRFSKAEGIIPAI

SEQ ID NO: 1830291 - protein, 17 aa, Staphylococcus epidermidis
MEAREIFLVVTGSNKRD

SEQ ID NO: 1830292 - protein, 28 aa, Staphylococcus epidermidis
MEGYNDARWVLIDLANVVVHIFHKDERN

SEQ ID NO: 1830293 - protein, 20 aa, Staphylococcus epidermidis
MEHLASISPLLNLKERKGVV

SEQ ID NO: 1830294 - protein, 28 aa, Staphylococcus epidermidis
MELMHDALVYRIERLKDAIPNNAPILYK

SEQ ID NO: 1830295 - protein, 23 aa, Staphylococcus epidermidis
MENNYACILLDLMLPEMDGIEVA

SEQ ID NO: 1830296 - protein, 29 aa, Staphylococcus epidermidis
MEPEKAAMLLIPEPWLYNKSNDKNVRAFY

SEQ ID NO: 1830297 - protein, 17 aa, Staphylococcus epidermidis
MEPGCIDVDRSFHAQCM

SEQ ID NO: 1830298 - protein, 17 aa, Staphylococcus epidermidis
MESRGMVLYMNRNTRKT

SEQ ID NO: 1830299 - protein, 33 aa, Staphylococcus epidermidis
MESYMLKEYYQNYYVLMAVLNSILKDINFMNDE

SEQ ID NO: 1830300 - protein, 25 aa, Staphylococcus epidermidis
METWDFAHCLPYFKKLETTYGASPY

SEQ ID NO: 1830301 - protein, 26 aa, Staphylococcus epidermidis
MFDDEEYLFHMLKSGAKGYILKNSPD

SEQ ID NO: 1830302 - protein, 26 aa, Staphylococcus epidermidis
MFDDEEYLFHVLKSGAKGYILKNSPD

SEQ ID NO: 1830303 - protein, 18 aa, Staphylococcus epidermidis
MFDNDYFMYGLETFAESN

SEQ ID NO: 1830304 - protein, 18 aa, Staphylococcus epidermidis
MFGVGNLMMRYVMKKKNV

SEQ ID NO: 1830305 - protein, 17 aa, Staphylococcus epidermidis
MFKEKERLRELKERMRA

SEQ ID NO: 1830306 - protein, 27 aa, Staphylococcus epidermidis
MFNDLTPDEIFPYAPPQGVEELRDLWQ

SEQ ID NO: 1830307 - protein, 17 aa, Staphylococcus epidermidis
MFNIHDLKWDDELLEIL

SEQ ID NO: 1830308 - protein, 26 aa, Staphylococcus epidermidis
MFVKKQAHPIPLHWDAETLVTNYFQC

SEQ ID NO: 1830309 - protein, 18 aa, Staphylococcus epidermidis
MFYSILYAINENESIIAS

SEQ ID NO: 1830310 - protein, 18 aa, Staphylococcus epidermidis
MGDRFIVESIDRLGRNYD

SEQ ID NO: 1830311 - protein, 27 aa, Staphylococcus epidermidis
MGEPDEVWQERLKLLKPYQVNQTLLEK

SEQ ID NO: 1830312 - protein, 23 aa, Staphylococcus epidermidis
MGFEDYFLIVSDLIHYAKTHDVM

SEQ ID NO: 1830313 - protein, 24 aa, Staphylococcus epidermidis
MGGRVALYYALYGSVALRGLLLES

SEQ ID NO: 1830314 - protein, 22 aa, Staphylococcus epidermidis
MGIQVKRFYDVGVSGIHRLFNH

SEQ ID NO: 1830315 - protein, 17 aa, Staphylococcus epidermidis
MGIYFKNEPLNIVNQTT

SEQ ID NO: 1830316 - protein, 23 aa, Staphylococcus epidermidis
MGKDLTLEKALFKGLTGSGVEVK

SEQ ID NO: 1830317 - protein, 33 aa, Staphylococcus epidermidis
MGKEDFQNLILLFLESWYLRASFSQKFGVIEEN

SEQ ID NO: 1830318 - protein, 17 aa, Staphylococcus epidermidis
MGLSYPDLIAKLIDLAK

SEQ ID NO: 1830319 - protein, 21 aa, Staphylococcus epidermidis
MGTTLVCAIVYDKKVVVANVG

SEQ ID NO: 1830320 - protein, 17 aa, Staphylococcus epidermidis
MGYRRESVVSHIGKFSL

SEQ ID NO: 1830321 - protein, 17 aa, Staphylococcus epidermidis
MHFGKIVEIGPADDIYK

SEQ ID NO: 1830322 - protein, 17 aa, Staphylococcus epidermidis
MHFYFKGYNMTTNKTKN

SEQ ID NO: 1830323 - protein, 17 aa, Staphylococcus epidermidis
MHKIAKSVQLLFNVECE

SEQ ID NO: 1830324 - protein, 27 aa, Staphylococcus epidermidis
MHPNFEYPFKYLCGAGVAYKLAQGLIK

SEQ ID NO: 1830325 - protein, 18 aa, Staphylococcus epidermidis
MHVKPHGALYQMGARNKE

SEQ ID NO: 1830326 - protein, 26 aa, Staphylococcus epidermidis
MIDQMFIRNELFQRGLVSFVANDAIL

SEQ ID NO: 1830327 - protein, 30 aa, Staphylococcus epidermidis
MIEAILKDQKRLLPSIAYLDGEYGFSDICL

SEQ ID NO: 1830328 - protein, 25 aa, Staphylococcus epidermidis
MIEGQPIDHIWLKVPQRYYNKRRRI

SEQ ID NO: 1830329 - protein, 23 aa, Staphylococcus epidermidis
MIEIDVEPYYVLSKKHKLLTIID

SEQ ID NO: 1830330 - protein, 19 aa, Staphylococcus epidermidis
MIEKNLGIPVIIVTNYENV

SEQ ID NO: 1830331 - protein, 18 aa, Staphylococcus epidermidis
MIEMRRYLHEHPELSFHE

SEQ ID NO: 1830332 - protein, 26 aa, Staphylococcus epidermidis
MIGEDFSHYLKVRPGAFFLTGCGNED

SEQ ID NO: 1830333 - protein, 25 aa, Staphylococcus epidermidis
MIHHRYPSIPFYLQVGNPYLEDDVE

SEQ ID NO: 1830334 - protein, 17 aa, Staphylococcus epidermidis
MIHNAWTVAIGDSNGMS

SEQ ID NO: 1830335 - protein, 19 aa, Staphylococcus epidermidis
MIINKIDLISDKALEKLEN

SEQ ID NO: 1830336 - protein, 17 aa, Staphylococcus epidermidis
MIIPSKFRYDLNERFII

SEQ ID NO: 1830337 - protein, 19 aa, Staphylococcus epidermidis
MIKDFFFEGKSTSDIAWEL

SEQ ID NO: 1830338 - protein, 18 aa, Staphylococcus epidermidis
MILGIFAAGLAELAKEYN

SEQ ID NO: 1830339 - protein, 33 aa, Staphylococcus epidermidis
MINGILGKIPFFGICLGHQLFALSQGATSFKMK

SEQ ID NO: 1830340 - protein, 24 aa, Staphylococcus epidermidis
MINRYFDEYQLIYRFKKGQYEEVD

SEQ ID NO: 1830341 - protein, 27 aa, Staphylococcus epidermidis
MIQALDYFLLSLKNWNYSYASSIKLVD

SEQ ID NO: 1830342 - protein, 25 aa, Staphylococcus epidermidis
MIQESKVLITYFTRLQSLKKGKDEL

SEQ ID NO: 1830343 - protein, 17 aa, Staphylococcus epidermidis
MISMFIPDNQKIARFVS

SEQ ID NO: 1830344 - protein, 18 aa, Staphylococcus epidermidis
MISVLRAPKTFTKEDIIE

SEQ ID NO: 1830345 - protein, 19 aa, Staphylococcus epidermidis
MITAKQYIQSGDYKNILVV

SEQ ID NO: 1830346 - protein, 20 aa, Staphylococcus epidermidis
MITKQFYDIGIAVSTDDGLL

SEQ ID NO: 1830347 - protein, 17 aa, Staphylococcus epidermidis
MIYGMEGMLVDDGVPIA

SEQ ID NO: 1830348 - protein, 17 aa, Staphylococcus epidermidis
MKAFQIDAPVNPGNSGG

SEQ ID NO: 1830349 - protein, 34 aa, Staphylococcus epidermidis
MKEEPIKLLALITSNYRLYYQCKILGQKGYSGQQ

SEQ ID NO: 1830350 - protein, 32 aa, Staphylococcus epidermidis
MKEYGLSNIIVHAPYIINIANTTKPEVFNLGV

SEQ ID NO: 1830351 - protein, 27 aa, Staphylococcus epidermidis
MKEYKQKYLILRIFNVSGKEPQFYFID

SEQ ID NO: 1830352 - protein, 17 aa, Staphylococcus epidermidis
MKFLPEDGSLELTSGWT

SEQ ID NO: 1830353 - protein, 20 aa, Staphylococcus epidermidis
MKGYLYPKYLKDTFDNDGYF

SEQ ID NO: 1830354 - protein, 18 aa, Staphylococcus epidermidis
MKIIYDKDTHRILGGQVM

SEQ ID NO: 1830355 - protein, 17 aa, Staphylococcus epidermidis
MKISQKENEKSGKQSEL

SEQ ID NO: 1830356 - protein, 33 aa, Staphylococcus epidermidis
MKKQDYIYDFYNSKVYMINGNKLVKFLKRKNLL

SEQ ID NO: 1830357 - protein, 24 aa, Staphylococcus epidermidis
MKMIQGFSLSALLYNACKLHLFDE

SEQ ID NO: 1830358 - protein, 23 aa, Staphylococcus epidermidis
MKNQTYMIDLLEDQQKFFQAIEE

SEQ ID NO: 1830359 - protein, 24 aa, Staphylococcus epidermidis
MKQKLAIAVSLINKPHYLILDEPT

SEQ ID NO: 1830360 - protein, 25 aa, Staphylococcus epidermidis
MKQSLDVFLKFKFENSDLLNCIEES

SEQ ID NO: 1830361 - protein, 23 aa, Staphylococcus epidermidis
MKSISIPLQYLIAAALEVTDVNL

SEQ ID NO: 1830362 - protein, 29 aa, Staphylococcus epidermidis
MKTFKHWIHTNHYWKYVEKYGVLGIALDN

SEQ ID NO: 1830363 - protein, 31 aa, Staphylococcus epidermidis
MLDMLTTDNGLTRLIFMVPARGMIGYTTEFM

SEQ ID NO: 1830364 - protein, 24 aa, Staphylococcus epidermidis
MLENEKLFLRTYITKVIGKPNPDN

SEQ ID NO: 1830365 - protein, 24 aa, Staphylococcus epidermidis
MLHNPELLILDEPFSGLDPVNVEL

SEQ ID NO: 1830366 - protein, 18 aa, Staphylococcus epidermidis
MLKELIWNPLIEDEQFNE

SEQ ID NO: 1830367 - protein, 26 aa, Staphylococcus epidermidis
MLKGEPIQYIVGFQSFYGYKFKVDAN

SEQ ID NO: 1830368 - protein, 27 aa, Staphylococcus epidermidis
MLLENILSRDIIPIITSLGVNEQGEYL

SEQ ID NO: 1830369 - protein, 20 aa, Staphylococcus epidermidis
MLMFMEDYIYSETKIVLCIE

SEQ ID NO: 1830370 - protein, 18 aa, Staphylococcus epidermidis
MLNLIAQIQLQSGYPYIM

SEQ ID NO: 1830371 - protein, 28 aa, Staphylococcus epidermidis
MLNSRLKVSIYFYFAPPKSWTKNQKLIS

SEQ ID NO: 1830372 - protein, 18 aa, Staphylococcus epidermidis
MLRNMGFAEYHKKGKIVF

SEQ ID NO: 1830373 - protein, 17 aa, Staphylococcus epidermidis
MLYLIKPEVTEDDIYKI

SEQ ID NO: 1830374 - protein, 32 aa, Staphylococcus epidermidis
MMNEVIGNPLLDKFMKDLIIQILAMVSEQERN

SEQ ID NO: 1830375 - protein, 25 aa, Staphylococcus epidermidis
MMTQADWFIDIGPYAGDKGGQLLYS

SEQ ID NO: 1830376 - protein, 17 aa, Staphylococcus epidermidis
MMVFTNFFRDQMDRFGE

SEQ ID NO: 1830377 - protein, 20 aa, Staphylococcus epidermidis
MNHPLLQLPNAVVLPHIGSA

SEQ ID NO: 1830378 - protein, 23 aa, Staphylococcus epidermidis
MNKLIDAVKPFVKQKLIFLVGMA

SEQ ID NO: 1830379 - protein, 29 aa, Staphylococcus epidermidis
MNKLIDAVQPFVKQKLIFLVGMAGERDMT

SEQ ID NO: 1830380 - protein, 29 aa, Staphylococcus epidermidis
MNLPNKEFQLLFLLASNPKHIFTRDDIIG

SEQ ID NO: 1830381 - protein, 19 aa, Staphylococcus epidermidis
MNLVPLRKFNNTEVNLFFT

SEQ ID NO: 1830382 - protein, 26 aa, Staphylococcus epidermidis
MNMGFIDDMRFIMDKIPADQRQTMLF

SEQ ID NO: 1830383 - protein, 19 aa, Staphylococcus epidermidis
MNMGLTMRSIAPSVTFSTG

SEQ ID NO: 1830384 - protein, 18 aa, Staphylococcus epidermidis
MNMNNTYFRALLVQKVRE

SEQ ID NO: 1830385 - protein, 22 aa, Staphylococcus epidermidis
MNNRYFINLAAGGRLTQVSYET

SEQ ID NO: 1830386 - protein, 19 aa, Staphylococcus epidermidis
MNRLFRLGKSLDDLSALGI

SEQ ID NO: 1830387 - protein, 26 aa, Staphylococcus epidermidis
MNTETLMPSILAYNFAMLWNGNNVAY

SEQ ID NO: 1830388 - protein, 23 aa, Staphylococcus epidermidis
MPKEIFGDDFVFLPKDELLTFDE

SEQ ID NO: 1830389 - protein, 23 aa, Staphylococcus epidermidis
MQDTWDFPYIAHALDEVLSQFDT

SEQ ID NO: 1830390 - protein, 19 aa, Staphylococcus epidermidis
MQEEIFGPVVGFIKVDNFD

SEQ ID NO: 1830391 - protein, 20 aa, Staphylococcus epidermidis
MQEEIFGPVVGFVKVKDFDE

SEQ ID NO: 1830392 - protein, 17 aa, Staphylococcus epidermidis
MQKIFSQELRFKDENGN

SEQ ID NO: 1830393 - protein, 18 aa, Staphylococcus epidermidis
MQLTRNPSMLIKDIQLCN

SEQ ID NO: 1830394 - protein, 19 aa, Staphylococcus epidermidis
MQMFNLTIKLIIDENDKYF

SEQ ID NO: 1830395 - protein, 25 aa, Staphylococcus epidermidis
MQTVLYQILVDMTKLLAPILVHTAE

SEQ ID NO: 1830396 - protein, 25 aa, Staphylococcus epidermidis
MRLMWQEMMMILKQLKVPSVNLLKF

SEQ ID NO: 1830397 - protein, 20 aa, Staphylococcus epidermidis
MRLVYVALTRAKEQLILVGR

SEQ ID NO: 1830398 - protein, 21 aa, Staphylococcus epidermidis
MRQRVMIAMAISCSPKLLIAD

SEQ ID NO: 1830399 - protein, 19 aa, Staphylococcus epidermidis
MRRNIGMIFQHFNLVKRST

SEQ ID NO: 1830400 - protein, 19 aa, Staphylococcus epidermidis
MRSFIGNSDREHLILICMN

SEQ ID NO: 1830401 - protein, 25 aa, Staphylococcus epidermidis
MRTGRIWVNTYNQFPAGAPFGGYKK

SEQ ID NO: 1830402 - protein, 26 aa, Staphylococcus epidermidis
MSAADFWQRVIYKLIYNNEVLIVVND

SEQ ID NO: 1830403 - protein, 23 aa, Staphylococcus epidermidis
MSGAGKWFKGLGSSASKAWGNVN

SEQ ID NO: 1830404 - protein, 17 aa, Staphylococcus epidermidis
MSGKIAGLLSFVDSEIL

SEQ ID NO: 1830405 - protein, 24 aa, Staphylococcus epidermidis
MSGMQKWFHGLTVDSKKAWDKMGK

SEQ ID NO: 1830406 - protein, 17 aa, Staphylococcus epidermidis
MSIRRIEGRDWEFLYYS

SEQ ID NO: 1830407 - protein, 25 aa, Staphylococcus epidermidis
MSKEEILILLTLWEEGSMTLKEMDD

SEQ ID NO: 1830408 - protein, 30 aa, Staphylococcus epidermidis
MSKNERLMEGLLAIPLPGASFLKSTGKSMS

SEQ ID NO: 1830409 - protein, 25 aa, Staphylococcus epidermidis
MSQSPMLLKNSRFGFKMGNQALEDS

SEQ ID NO: 1830410 - protein, 23 aa, Staphylococcus epidermidis
MSSKKVTLLFTGPLTDLAKAIRH

SEQ ID NO: 1830411 - protein, 18 aa, Staphylococcus epidermidis
MSSLFYVLERLKQEGRRP

SEQ ID NO: 1830412 - protein, 18 aa, Staphylococcus epidermidis
MSVVQIEVLYVKPEYRKQ

SEQ ID NO: 1830413 - protein, 18 aa, Staphylococcus epidermidis
MSYFITQPVYSKEKIKQV

SEQ ID NO: 1830414 - protein, 25 aa, Staphylococcus epidermidis
MTAGTYVIKGLKLPNNTILSGEGKG

SEQ ID NO: 1830415 - protein, 20 aa, Staphylococcus epidermidis
MTDVYHYLVNLLTKNKADVS

SEQ ID NO: 1830416 - protein, 19 aa, Staphylococcus epidermidis
MTDVYRYLVGLLEKNQLDV

SEQ ID NO: 1830417 - protein, 29 aa, Staphylococcus epidermidis
MTEEIKTQMLEWILPYYKGLSKEGMKDIV

SEQ ID NO: 1830418 - protein, 18 aa, Staphylococcus epidermidis
MTEIPFKFFDQLTDIKVP

SEQ ID NO: 1830419 - protein, 24 aa, Staphylococcus epidermidis
MTKLKQIYPNILALSNVAFEHSEN

SEQ ID NO: 1830420 - protein, 25 aa, Staphylococcus epidermidis
MTKTEKLIFIADYIEPGRKTPGVEE

SEQ ID NO: 1830421 - protein, 19 aa, Staphylococcus epidermidis
MTMAPLTDDLSYIRNLFKE

SEQ ID NO: 1830422 - protein, 19 aa, Staphylococcus epidermidis
MTNMFWRQNISQMWVETEF

SEQ ID NO: 1830423 - protein, 18 aa, Staphylococcus epidermidis
MTPGQIRYYFPNHSELLN

SEQ ID NO: 1830424 - protein, 18 aa, Staphylococcus epidermidis
MTSILWDVVKKQQKEIEQ

SEQ ID NO: 1830425 - protein, 22 aa, Staphylococcus epidermidis
MTYLFCVAYCELLGIDLTVNLK

SEQ ID NO: 1830426 - protein, 23 aa, Staphylococcus epidermidis
MVFQSYNLFPHKSALENVMEGLV

SEQ ID NO: 1830427 - protein, 18 aa, Staphylococcus epidermidis
MVRLSQDWKLRHVLIEMH

SEQ ID NO: 1830428 - protein, 32 aa, Staphylococcus epidermidis
MVSKDDVSLVLFWYFLAVKKFTHFGESMKRIK

SEQ ID NO: 1830429 - protein, 17 aa, Staphylococcus epidermidis
MVTDLDDLKELGKEMEQ

SEQ ID NO: 1830430 - protein, 32 aa, Staphylococcus epidermidis
MVVSQFLTKDLFIDWIWGESFFKQKLIDYDAA

SEQ ID NO: 1830431 - protein, 32 aa, Staphylococcus epidermidis
MVVSQFLTKDLFIDWIWGESFFKQKLIDYYAA

SEQ ID NO: 1830432 - protein, 30 aa, Staphylococcus epidermidis
MVVSQFLTKDLFIDWTWGEEYFRQKLIDYD

SEQ ID NO: 1830433 - protein, 27 aa, Staphylococcus epidermidis
MVYIYKNRFNLEWIYVSLEKKGLEQGF

SEQ ID NO: 1830434 - protein, 21 aa, Staphylococcus epidermidis
MWADKRQYLGVDFLGTSYAAV

SEQ ID NO: 1830435 - protein, 17 aa, Staphylococcus epidermidis
MYAAMKQAARVKKPIVA

SEQ ID NO: 1830436 - protein, 21 aa, Staphylococcus epidermidis
MYDFDHIFIDVPPTINSDFTN

SEQ ID NO: 1830437 - protein, 20 aa, Staphylococcus epidermidis
MYHSPIRLLVVIQAPDSHIQ

SEQ ID NO: 1830438 - protein, 24 aa, Staphylococcus epidermidis
MYKERGFEIKPEIAGLMISAIISD

SEQ ID NO: 1830439 - protein, 18 aa, Staphylococcus epidermidis
MYLVYQNPELQFITNSVY

SEQ ID NO: 1830440 - protein, 27 aa, Staphylococcus epidermidis
MYQEQPGYKLMFNTLRAMYSKHPIRVD

SEQ ID NO: 1830441 - protein, 17 aa, Staphylococcus epidermidis
MYVPKSHPLAMTVHPPL

SEQ ID NO: 1830442 - protein, 25 aa, Staphylococcus epidermidis
NAAKALAFAYDKPIIPVHHIAGHIY

SEQ ID NO: 1830443 - protein, 24 aa, Staphylococcus epidermidis
NAAQNVLINLGFKQVFNLSGGNKN

SEQ ID NO: 1830444 - protein, 18 aa, Staphylococcus epidermidis
NADFITINAAYNPDLHHL

SEQ ID NO: 1830445 - protein, 29 aa, Staphylococcus epidermidis
NAEAILEELGLPYRRVILCTGDIGFSASK

SEQ ID NO: 1830446 - protein, 27 aa, Staphylococcus epidermidis
NAEQFRQLFILPQGEFKKFLQSNSKDK

SEQ ID NO: 1830447 - protein, 23 aa, Staphylococcus epidermidis
NAFDGLEIYNYLKDLDAHVIVEV

SEQ ID NO: 1830448 - protein, 22 aa, Staphylococcus epidermidis
NAFELTIAVLLSAQCTDNLVNR

SEQ ID NO: 1830449 - protein, 24 aa, Staphylococcus epidermidis
NAHHYTLALLESLKLREIKRYAST

SEQ ID NO: 1830450 - protein, 19 aa, Staphylococcus epidermidis
NAHVHMIGFSRGGLQGLLT

SEQ ID NO: 1830451 - protein, 17 aa, Staphylococcus epidermidis
NAKKLEKSIFKQGLLKA

SEQ ID NO: 1830452 - protein, 34 aa, Staphylococcus epidermidis
NAKLSIYSIKTMLKNPAIITALKASPFSPSIVIS

SEQ ID NO: 1830453 - protein, 23 aa, Staphylococcus epidermidis
NAKPPVARIMDYGKYKFEQQKKE

SEQ ID NO: 1830454 - protein, 22 aa, Staphylococcus epidermidis
NAKSLKTMLLLHGLSSDTSSYM

SEQ ID NO: 1830455 - protein, 19 aa, Staphylococcus epidermidis
NALGQALLAKRMGKKKLVA

SEQ ID NO: 1830456 - protein, 23 aa, Staphylococcus epidermidis
NALLKEIRRMIKVLNLYSSQKNQ

SEQ ID NO: 1830457 - protein, 29 aa, Staphylococcus epidermidis
NALQKSLVNFFMFEAGFSLMFVKANSGTD

SEQ ID NO: 1830458 - protein, 20 aa, Staphylococcus epidermidis
NAMGWYLDGRVSAVVGTHTH

SEQ ID NO: 1830459 - protein, 17 aa, Staphylococcus epidermidis
NAMVTDLDDLKELGKEM

SEQ ID NO: 1830460 - protein, 18 aa, Staphylococcus epidermidis
NAPILYKSGAFKYKLKAS

SEQ ID NO: 1830461 - protein, 30 aa, Staphylococcus epidermidis
NAPNGFFGNQLQRFIHLVWDIRDVMNSNIK

SEQ ID NO: 1830462 - protein, 17 aa, Staphylococcus epidermidis
NAQARELVFERVRYAYN

SEQ ID NO: 1830463 - protein, 23 aa, Staphylococcus epidermidis
NASVILNNLYKQTPLQSSFGVNM

SEQ ID NO: 1830464 - protein, 23 aa, Staphylococcus epidermidis
NATLRTEVKQLLQQAKDLNSVMK

SEQ ID NO: 1830465 - protein, 22 aa, Staphylococcus epidermidis
NATMSYIHYLKERLLIQHQQFQ

SEQ ID NO: 1830466 - protein, 24 aa, Staphylococcus epidermidis
NATNHWYEWLKHNLTLEGYHVTLF

SEQ ID NO: 1830467 - protein, 20 aa, Staphylococcus epidermidis
NAYSRIFKRVGINARPVVAD

SEQ ID NO: 1830468 - protein, 22 aa, Staphylococcus epidermidis
NCKKKMTLFGRGKEAVYRCVCG

SEQ ID NO: 1830469 - protein, 17 aa, Staphylococcus epidermidis
NCKYHIVFVPKYRRQVI

SEQ ID NO: 1830470 - protein, 25 aa, Staphylococcus epidermidis
NCLMEVLGLALPYNGTALSVSDQRR

SEQ ID NO: 1830471 - protein, 34 aa, Staphylococcus epidermidis
NCSTIQSVVPLKILKDAYGLKRVAYTTYQAVSGS

SEQ ID NO: 1830472 - protein, 25 aa, Staphylococcus epidermidis
NDAFIQQIKAWHLENKKIIIVHGGG

SEQ ID NO: 1830473 - protein, 17 aa, Staphylococcus epidermidis
NDARFLDKPLLKQTHRT

SEQ ID NO: 1830474 - protein, 20 aa, Staphylococcus epidermidis
NDCHLDDETFIYLITGPNMS

SEQ ID NO: 1830475 - protein, 24 aa, Staphylococcus epidermidis
NDDDKLLNYLKQKRKDILENAYIM

SEQ ID NO: 1830476 - protein, 29 aa, Staphylococcus epidermidis
NDDFNRILHPNVVLDWILTEAPELDNEAS

SEQ ID NO: 1830477 - protein, 30 aa, Staphylococcus epidermidis
NDDKESFIDFYHKRLLIADKKPNIVHQWIA

SEQ ID NO: 1830478 - protein, 25 aa, Staphylococcus epidermidis
NDDKRIDLAVTKSLPRFIDVLETVL

SEQ ID NO: 1830479 - protein, 26 aa, Staphylococcus epidermidis
NDEAIILTSLPFNASWLNQRYSEIMQ

SEQ ID NO: 1830480 - protein, 23 aa, Staphylococcus epidermidis
NDEAIIQFLIQQFTQQFNNRLEV

SEQ ID NO: 1830481 - protein, 25 aa, Staphylococcus epidermidis
NDEEIIQFLIQQFTQQFNNRLEIAT

SEQ ID NO: 1830482 - protein, 25 aa, Staphylococcus epidermidis
NDEIAFFKAVKAGLVKLLQPPKEGK

SEQ ID NO: 1830483 - protein, 18 aa, Staphylococcus epidermidis
NDENHKVIFASARPIRDL

SEQ ID NO: 1830484 - protein, 24 aa, Staphylococcus epidermidis
NDEVLEYYGLKVLVDKYDAPVLNG

SEQ ID NO: 1830485 - protein, 29 aa, Staphylococcus epidermidis
NDIEKRDDFLTWFPQKELFVKASKKIESI

SEQ ID NO: 1830486 - protein, 23 aa, Staphylococcus epidermidis
NDIIKIIIEYHLHVAFSIDKIEQ

SEQ ID NO: 1830487 - protein, 28 aa, Staphylococcus epidermidis
NDILKFIKFNIYHMAPILLYVNDKTFST

SEQ ID NO: 1830488 - protein, 22 aa, Staphylococcus epidermidis
NDILNMPFAFFMELVDESNKKN

SEQ ID NO: 1830489 - protein, 18 aa, Staphylococcus epidermidis
NDISIVEPIDNGSFKILA

SEQ ID NO: 1830490 - protein, 20 aa, Staphylococcus epidermidis
NDKAFLYWSTVNRNCVICGK

SEQ ID NO: 1830491 - protein, 17 aa, Staphylococcus epidermidis
NDKFGIINGLMTTVHAI

SEQ ID NO: 1830492 - protein, 28 aa, Staphylococcus epidermidis
NDKNVRAFYEYYSYLMEPWDGPTMISFC

SEQ ID NO: 1830493 - protein, 23 aa, Staphylococcus epidermidis
NDKQDLNLLKPKSVKFTHEFMFA

SEQ ID NO: 1830494 - protein, 20 aa, Staphylococcus epidermidis
NDLNSLKLAFEKYGDDIAGV

SEQ ID NO: 1830495 - protein, 18 aa, Staphylococcus epidermidis
NDLRIGEALLRGIDTTTN

SEQ ID NO: 1830496 - protein, 25 aa, Staphylococcus epidermidis
NDLSQGFLVLILLEGYEGVYFWDDG

SEQ ID NO: 1830497 - protein, 27 aa, Staphylococcus epidermidis
NDLVIAIYYKEILKLLFQSWFDVCKRT

SEQ ID NO: 1830498 - protein, 26 aa, Staphylococcus epidermidis
NDMAKGLQDGLLFKGIHKLFNGIHSA

SEQ ID NO: 1830499 - protein, 29 aa, Staphylococcus epidermidis
NDNEEKYLRLYAEFENYKRRIQNENQINK

SEQ ID NO: 1830500 - protein, 23 aa, Staphylococcus epidermidis
NDNEFEEWYKWLQKHNVNILEGR

SEQ ID NO: 1830501 - protein, 24 aa, Staphylococcus epidermidis
NDNERTLYDWASKQTYIALGNMMT

SEQ ID NO: 1830502 - protein, 31 aa, Staphylococcus epidermidis
NDNILDVMVEPFFEWVIEKDAWYGEELNHIK

SEQ ID NO: 1830503 - protein, 30 aa, Staphylococcus epidermidis
NDNRIVQALPTIKYIIEQGGKLVLFSHLGK

SEQ ID NO: 1830504 - protein, 22 aa, Staphylococcus epidermidis
NDNVVFLRKWEDFGIRYGDVSE

SEQ ID NO: 1830505 - protein, 23 aa, Staphylococcus epidermidis
NDPFDMVYVMMNEKLFGHVYIKD

SEQ ID NO: 1830506 - protein, 22 aa, Staphylococcus epidermidis
NDQKNIDNPHKDLRRARSCNES

SEQ ID NO: 1830507 - protein, 24 aa, Staphylococcus epidermidis
NDQRILISHLGMAGGFFVVDDLED

SEQ ID NO: 1830508 - protein, 29 aa, Staphylococcus epidermidis
NDRARLKDIIEIFLDSGLGKEAFSIISQG

SEQ ID NO: 1830509 - protein, 23 aa, Staphylococcus epidermidis
NDRPLALCAALLHDLGHGPFSHS

SEQ ID NO: 1830510 - protein, 19 aa, Staphylococcus epidermidis
NDRTILVSIMFVNNEIGTV

SEQ ID NO: 1830511 - protein, 23 aa, Staphylococcus epidermidis
NDSSTHFPLLTKILDAHDQLSVQ

SEQ ID NO: 1830512 - protein, 29 aa, Staphylococcus epidermidis
NDSTLVQQLLQENAFLRAQIEEKDALLKT

SEQ ID NO: 1830513 - protein, 26 aa, Staphylococcus epidermidis
NDTEFGLAAYFFTNDYHTGFHLYESL

SEQ ID NO: 1830514 - protein, 22 aa, Staphylococcus epidermidis
NDTIMILTHSKALAEYVYYKIF

SEQ ID NO: 1830515 - protein, 23 aa, Staphylococcus epidermidis
NDVHVGSYILLDDGLVELQVKEI

SEQ ID NO: 1830516 - protein, 17 aa, Staphylococcus epidermidis
NDVILPFKENALSIVYG

SEQ ID NO: 1830517 - protein, 24 aa, Staphylococcus epidermidis
NDVPDWYLDSCRKIKYMFPKAHAA

SEQ ID NO: 1830518 - protein, 21 aa, Staphylococcus epidermidis
NDVTQLIRLLHHQYPNAHVHM

SEQ ID NO: 1830519 - protein, 26 aa, Staphylococcus epidermidis
NDVYGYKLKCKCLFPFDANVPFIKSP

SEQ ID NO: 1830520 - protein, 20 aa, Staphylococcus epidermidis
NDYCLFYPRWANQKNNNMTH

SEQ ID NO: 1830521 - protein, 18 aa, Staphylococcus epidermidis
NDYLKIIEKITKKEKTTH

SEQ ID NO: 1830522 - protein, 19 aa, Staphylococcus epidermidis
NDYNGIQMVLLKNLGKPVV

SEQ ID NO: 1830523 - protein, 24 aa, Staphylococcus epidermidis
NDYTLREIFQYLKLPKKDLHQLNM

SEQ ID NO: 1830524 - protein, 27 aa, Staphylococcus epidermidis
NEAIIDIEVLFPYITISHFKDDVDKFV

SEQ ID NO: 1830525 - protein, 23 aa, Staphylococcus epidermidis
NEALRVFRDYLSKLDLDKYEVKT

SEQ ID NO: 1830526 - protein, 18 aa, Staphylococcus epidermidis
NEASLQYEYTHPLADLIG

SEQ ID NO: 1830527 - protein, 24 aa, Staphylococcus epidermidis
NEASRGWLKLHKSKLIKIPDHMDN

SEQ ID NO: 1830528 - protein, 27 aa, Staphylococcus epidermidis
NEELGITILINLHFVDLAREYGSRIIG

SEQ ID NO: 1830529 - protein, 24 aa, Staphylococcus epidermidis
NEFKNLTFLSRQLAPGLKKVDIDV

SEQ ID NO: 1830530 - protein, 23 aa, Staphylococcus epidermidis
NEFKNLTFLSRQLSPGLKKVDID

SEQ ID NO: 1830531 - protein, 18 aa, Staphylococcus epidermidis
NEFLIAGFNYEGQLAATI

SEQ ID NO: 1830532 - protein, 35 aa, Staphylococcus epidermidis
NEGAIYIEAAIKDSLKRLIMPSIEREIRGDLTQKA

SEQ ID NO: 1830533 - protein, 29 aa, Staphylococcus epidermidis
NEGIFKDLPLYFNVMRYHSLMADPLQIPH

SEQ ID NO: 1830534 - protein, 33 aa, Staphylococcus epidermidis
NEGPAIEYTVIGPKIHFLRDNTFTIIGGTSNAK

SEQ ID NO: 1830535 - protein, 26 aa, Staphylococcus epidermidis
NEHQIPYVDYMSELISIIKKHTHAKP

SEQ ID NO: 1830536 - protein, 21 aa, Staphylococcus epidermidis
NEIEVCQYLQKLLSKHDIDSN

SEQ ID NO: 1830537 - protein, 19 aa, Staphylococcus epidermidis
NEIIAGNVNFYGASRGKAF

SEQ ID NO: 1830538 - protein, 25 aa, Staphylococcus epidermidis
NEIKEILLELPLVSIDHLGLTNEGF

SEQ ID NO: 1830539 - protein, 26 aa, Staphylococcus epidermidis
NEILNSLRPLLISYGKERLDGEHFGD

SEQ ID NO: 1830540 - protein, 23 aa, Staphylococcus epidermidis
NEKKLLLNVLYERCIIDKKVVRL

SEQ ID NO: 1830541 - protein, 23 aa, Staphylococcus epidermidis
NEKKLWLHAKLDTGMGRLGMKDV

SEQ ID NO: 1830542 - protein, 23 aa, Staphylococcus epidermidis
NEKNADRIGVWIGSGIGGMETFE

SEQ ID NO: 1830543 - protein, 30 aa, Staphylococcus epidermidis
NELAITTSILTRVFGLDLFAEYLPSEDADE

SEQ ID NO: 1830544 - protein, 18 aa, Staphylococcus epidermidis
NELEDIFTIMLENSFPSH

SEQ ID NO: 1830545 - protein, 17 aa, Staphylococcus epidermidis
NELKPLCLNSNFVAIEE

SEQ ID NO: 1830546 - protein, 26 aa, Staphylococcus epidermidis
NELNTLLNSKLVFGDTLYITDLCIIA

SEQ ID NO: 1830547 - protein, 24 aa, Staphylococcus epidermidis
NELSDYLPLMLQFLQIADWENDDR

SEQ ID NO: 1830548 - protein, 25 aa, Staphylococcus epidermidis
NELSLKFFIPELNNDKLKSFYSDIL

SEQ ID NO: 1830549 - protein, 20 aa, Staphylococcus epidermidis
NELSVLFDYMKINDYKKLAN

SEQ ID NO: 1830550 - protein, 24 aa, Staphylococcus epidermidis
NEMLKPRGYLIMIEATLESYSLLT

SEQ ID NO: 1830551 - protein, 20 aa, Staphylococcus epidermidis
NEMNLVPLRKFTSTEIDILF

SEQ ID NO: 1830552 - protein, 22 aa, Staphylococcus epidermidis
NEMSLRLVDFKVEFGKTNSGKI

SEQ ID NO: 1830553 - protein, 27 aa, Staphylococcus epidermidis
NENDLTVISIFVNPLQFGPNEDFDAYP

SEQ ID NO: 1830554 - protein, 26 aa, Staphylococcus epidermidis
NENNWTPLMQSFVDALYTSIHNIYPE

SEQ ID NO: 1830555 - protein, 22 aa, Staphylococcus epidermidis
NENWLSIAGMTQKYLYKGNKGI

SEQ ID NO: 1830556 - protein, 19 aa, Staphylococcus epidermidis
NEQFQVSKQFWAHLVRTGQ

SEQ ID NO: 1830557 - protein, 25 aa, Staphylococcus epidermidis
NEQQYLFMNGPAPQLMKRAMKMSYI

SEQ ID NO: 1830558 - protein, 25 aa, Staphylococcus epidermidis
NETDKILMALRPYQVYAVEALIKRA

SEQ ID NO: 1830559 - protein, 21 aa, Staphylococcus epidermidis
NETLAQYHFRLYKNKEEMGLS

SEQ ID NO: 1830560 - protein, 25 aa, Staphylococcus epidermidis
NETLIRTILARMHFFRDDVYKPINV

SEQ ID NO: 1830561 - protein, 24 aa, Staphylococcus epidermidis
NETQTLIHLPFDYMFFTGSEKVGK

SEQ ID NO: 1830562 - protein, 26 aa, Staphylococcus epidermidis
NETTGFFDMCHILNLLVNQWEKYPQL

SEQ ID NO: 1830563 - protein, 18 aa, Staphylococcus epidermidis
NEVSKYDRLLNKGKIDIK

SEQ ID NO: 1830564 - protein, 19 aa, Staphylococcus epidermidis
NEYIIYSYALLWGQNACNP

SEQ ID NO: 1830565 - protein, 18 aa, Staphylococcus epidermidis
NEYQGELIFLHKVKDGAV

SEQ ID NO: 1830566 - protein, 25 aa, Staphylococcus epidermidis
NEYVELIEIPIKPSDRLRARDMLGK

SEQ ID NO: 1830567 - protein, 17 aa, Staphylococcus epidermidis
NFANYLIDELEFINFKA

SEQ ID NO: 1830568 - protein, 18 aa, Staphylococcus epidermidis
NFDELERKKAIDIGNAML

SEQ ID NO: 1830569 - protein, 18 aa, Staphylococcus epidermidis
NFDLTGRLALYTSLPVIA

SEQ ID NO: 1830570 - protein, 22 aa, Staphylococcus epidermidis
NFDLTGRLALYTSLPVIASGGI

SEQ ID NO: 1830571 - protein, 17 aa, Staphylococcus epidermidis
NFDLVRIINLSLRAKYL

SEQ ID NO: 1830572 - protein, 17 aa, Staphylococcus epidermidis
NFDVSRILGLPAFIDIL

SEQ ID NO: 1830573 - protein, 25 aa, Staphylococcus epidermidis
NFEEKLRYFLIEDYNQKEHSAIHTT

SEQ ID NO: 1830574 - protein, 25 aa, Staphylococcus epidermidis
NFEEKLRYFLIEDYNQKEHSAIQST

SEQ ID NO: 1830575 - protein, 17 aa, Staphylococcus epidermidis
NFETAGPLYYRAEPVGC

SEQ ID NO: 1830576 - protein, 21 aa, Staphylococcus epidermidis
NFFNIDEQLIFVDVPGYGYAK

SEQ ID NO: 1830577 - protein, 17 aa, Staphylococcus epidermidis
NFFNYLSGYSIKPEYNK

SEQ ID NO: 1830578 - protein, 24 aa, Staphylococcus epidermidis
NFFTNTIIQIAYWQEQLSIAEKEN

SEQ ID NO: 1830579 - protein, 22 aa, Staphylococcus epidermidis
NFGCPYFVVRRLSPNEFIEEMD

SEQ ID NO: 1830580 - protein, 27 aa, Staphylococcus epidermidis
NFGDSVPTGFFIYPVSQAADITAFKAS

SEQ ID NO: 1830581 - protein, 19 aa, Staphylococcus epidermidis
NFGEKPKDTLLKLHPGRGK

SEQ ID NO: 1830582 - protein, 37 aa, Staphylococcus epidermidis
NFIKDKKALFIVYANPLALGLLTPPGAFGADIVVGDT

SEQ ID NO: 1830583 - protein, 24 aa, Staphylococcus epidermidis
NFKVRFLINEVCHKYQIPWVYGAA

SEQ ID NO: 1830584 - protein, 18 aa, Staphylococcus epidermidis
NFLSSSRAKWGERSGLTL

SEQ ID NO: 1830585 - protein, 20 aa, Staphylococcus epidermidis
NFMPSPGKITQYLAPGGFGV

SEQ ID NO: 1830586 - protein, 32 aa, Staphylococcus epidermidis
NFSERLKLGHMLYFIVNYLFVGRGFVVKHEGK

SEQ ID NO: 1830587 - protein, 23 aa, Staphylococcus epidermidis
NFTDYKLFLDSEQIQLPILNELI

SEQ ID NO: 1830588 - protein, 26 aa, Staphylococcus epidermidis
NFTVDDLFKILKAYKNTLFKFTNEII

SEQ ID NO: 1830589 - protein, 28 aa, Staphylococcus epidermidis
NFVHLNLGYAIVPRFYYQSYFAKNLDSI

SEQ ID NO: 1830590 - protein, 29 aa, Staphylococcus epidermidis
NFVKAYIVQLISMLDMIGGKKLKIVNYIL

SEQ ID NO: 1830591 - protein, 21 aa, Staphylococcus epidermidis
NFYIISIEIVFFHLSKNFMSR

SEQ ID NO: 1830592 - protein, 21 aa, Staphylococcus epidermidis
NFYMLHKALFVNEKYKKLSDS

SEQ ID NO: 1830593 - protein, 21 aa, Staphylococcus epidermidis
NFYVPKYYVDMAKLAEARQVD

SEQ ID NO: 1830594 - protein, 23 aa, Staphylococcus epidermidis
NGADFNILVALHMLADISEEKAV

SEQ ID NO: 1830595 - protein, 18 aa, Staphylococcus epidermidis
NGAILPRKSGVSDLPMNN

SEQ ID NO: 1830596 - protein, 20 aa, Staphylococcus epidermidis
NGCNGIFTVIYKNKKYRAAD

SEQ ID NO: 1830597 - protein, 25 aa, Staphylococcus epidermidis
NGDIGVIVGIFWAKENALNKDVLVV

SEQ ID NO: 1830598 - protein, 28 aa, Staphylococcus epidermidis
NGDLLFGTIDSWLVWKLSGKEAHITDYT

SEQ ID NO: 1830599 - protein, 26 aa, Staphylococcus epidermidis
NGEHRYLFTGDFLCYEGDEWRTVVLP

SEQ ID NO: 1830600 - protein, 25 aa, Staphylococcus epidermidis
NGEIKIPEFINPNVKFAMISSIDIA

SEQ ID NO: 1830601 - protein, 27 aa, Staphylococcus epidermidis
NGELDDHFPLVVWQTGSGTQSNMNVNE

SEQ ID NO: 1830602 - protein, 36 aa, Staphylococcus epidermidis
NGERSLLFGPFAGFSPKFLKTGSYLDLIKSVKPNNI

SEQ ID NO: 1830603 - protein, 29 aa, Staphylococcus epidermidis
NGETSKDYLWTILIHRLQKWELNDKTYFD

SEQ ID NO: 1830604 - protein, 28 aa, Staphylococcus epidermidis
NGETSKDYLWTILIHRLREWELNDKTYF

SEQ ID NO: 1830605 - protein, 21 aa, Staphylococcus epidermidis
NGEWYNMEKEWRKAIDKGKNV

SEQ ID NO: 1830606 - protein, 25 aa, Staphylococcus epidermidis
NGFKTTFGLIFNHLSWMINQNQIQQ

SEQ ID NO: 1830607 - protein, 19 aa, Staphylococcus epidermidis
NGFKTTLGLIFNDLSWMIN

SEQ ID NO: 1830608 - protein, 22 aa, Staphylococcus epidermidis
NGGIFVYVPKNTVVEHPIQYVV

SEQ ID NO: 1830609 - protein, 24 aa, Staphylococcus epidermidis
NGHKSAVIWFTGLSGSGKSTVSVA

SEQ ID NO: 1830610 - protein, 21 aa, Staphylococcus epidermidis
NGHVLPIIAQFLLDNTNDVTS

SEQ ID NO: 1830611 - protein, 17 aa, Staphylococcus epidermidis
NGIIRYPQATLGKLFKE

SEQ ID NO: 1830612 - protein, 17 aa, Staphylococcus epidermidis
NGKQIFYILNTKNKVSF

SEQ ID NO: 1830613 - protein, 26 aa, Staphylococcus epidermidis
NGKSRSIPIFVFMNDSYEQITVWGPR

SEQ ID NO: 1830614 - protein, 23 aa, Staphylococcus epidermidis
NGKTFYYTFSDMYTLKDVRETLE

SEQ ID NO: 1830615 - protein, 24 aa, Staphylococcus epidermidis
NGKTIGVMPTFLKQRELAHDKLDE

SEQ ID NO: 1830616 - protein, 25 aa, Staphylococcus epidermidis
NGKTTLLHILYKKIVPEEGIVKQFS

SEQ ID NO: 1830617 - protein, 25 aa, Staphylococcus epidermidis
NGKVIQLWHGTPIKRLFLDSKEPHQ

SEQ ID NO: 1830618 - protein, 24 aa, Staphylococcus epidermidis
NGLRNECMIGEFFKIPPGEHGISA

SEQ ID NO: 1830619 - protein, 22 aa, Staphylococcus epidermidis
NGLSLYPEYAFNMARYVDDNQD

SEQ ID NO: 1830620 - protein, 31 aa, Staphylococcus epidermidis
NGMPIIVNGVMKPIPTLYKPLNSVDINSKED

SEQ ID NO: 1830621 - protein, 25 aa, Staphylococcus epidermidis
NGMQTLGVALPWAISAALVRPNTQV

SEQ ID NO: 1830622 - protein, 17 aa, Staphylococcus epidermidis
NGNFIFDFLNLAKCKDE

SEQ ID NO: 1830623 - protein, 19 aa, Staphylococcus epidermidis
NGQFYYRNIRYDEINQIHF

SEQ ID NO: 1830624 - protein, 26 aa, Staphylococcus epidermidis
NGRHELMDSVFLWQSGSKYRVKAHDA

SEQ ID NO: 1830625 - protein, 18 aa, Staphylococcus epidermidis
NGSFFTDNYTYEVVAKNN

SEQ ID NO: 1830626 - protein, 17 aa, Staphylococcus epidermidis
NGVAQAGIYNKPSYRLV

SEQ ID NO: 1830627 - protein, 23 aa, Staphylococcus epidermidis
NGVELRNRFVLAPLTHISSNDDG

SEQ ID NO: 1830628 - protein, 17 aa, Staphylococcus epidermidis
NGVFILDGLAGSGKTSS

SEQ ID NO: 1830629 - protein, 20 aa, Staphylococcus epidermidis
NGYKLLNITIKQIEERAFPH

SEQ ID NO: 1830630 - protein, 19 aa, Staphylococcus epidermidis
NHDMAFWESVRSIEILDIY

SEQ ID NO: 1830631 - protein, 19 aa, Staphylococcus epidermidis
NHDSVLFLVVDDKGIKAFS

SEQ ID NO: 1830632 - protein, 25 aa, Staphylococcus epidermidis
NHEYGTDIDILFILGGDGTVNELVN

SEQ ID NO: 1830633 - protein, 19 aa, Staphylococcus epidermidis
NHGGRIIYIGAGTSGRLGV

SEQ ID NO: 1830634 - protein, 17 aa, Staphylococcus epidermidis
NHIVINSIDLETGKKFN

SEQ ID NO: 1830635 - protein, 33 aa, Staphylococcus epidermidis
NHKRLDAMIVLSDFNRRYLSGFTGTSGGLIITH

SEQ ID NO: 1830636 - protein, 25 aa, Staphylococcus epidermidis
NHLQLLLNFLNIPSKITPIIKIAIS

SEQ ID NO: 1830637 - protein, 17 aa, Staphylococcus epidermidis
NHMLQMVALLAMEAPIS

SEQ ID NO: 1830638 - protein, 24 aa, Staphylococcus epidermidis
NHNLSYNNLIALSIHKGIGAGLII

SEQ ID NO: 1830639 - protein, 24 aa, Staphylococcus epidermidis
NHSPNELLMFLYDLEQRFNNFINR

SEQ ID NO: 1830640 - protein, 24 aa, Staphylococcus epidermidis
NHTETLFAHFNIPISIQGKTIQTL

SEQ ID NO: 1830641 - protein, 25 aa, Staphylococcus epidermidis
NHYEHLLTEYGVWHPKAWDNAPRPV

SEQ ID NO: 1830642 - protein, 19 aa, Staphylococcus epidermidis
NIAMVFQNYALYPHMTVYK

SEQ ID NO: 1830643 - protein, 21 aa, Staphylococcus epidermidis
NICSLFDAVAIYNNINRTISF

SEQ ID NO: 1830644 - protein, 25 aa, Staphylococcus epidermidis
NIDDDTAFNILLKKLEQQINVLSVT

SEQ ID NO: 1830645 - protein, 27 aa, Staphylococcus epidermidis
NIDDPHRFKSLLATPLIPTAPEMYILG

SEQ ID NO: 1830646 - protein, 20 aa, Staphylococcus epidermidis
NIDFLNLKIEKVKAPIQTLV

SEQ ID NO: 1830647 - protein, 23 aa, Staphylococcus epidermidis
NIDIEPSYFYTLLGPSGCGKTTI

SEQ ID NO: 1830648 - protein, 18 aa, Staphylococcus epidermidis
NIDIRDTMKLAPPGSPLA

SEQ ID NO: 1830649 - protein, 20 aa, Staphylococcus epidermidis
NIDMKDDLPIFTSAKRWLDH

SEQ ID NO: 1830650 - protein, 17 aa, Staphylococcus epidermidis
NIDSSLMAMQLMLTAKA

SEQ ID NO: 1830651 - protein, 27 aa, Staphylococcus epidermidis
NIDVTEKWIIQIAYDTLIIMAKSVDRE

SEQ ID NO: 1830652 - protein, 29 aa, Staphylococcus epidermidis
NIEHRRWGAPFPVIEIVKRGINKARGIEY

SEQ ID NO: 1830653 - protein, 29 aa, Staphylococcus epidermidis
NIEHRRWGAPFPVIEIVKRGINKARGIKH

SEQ ID NO: 1830654 - protein, 21 aa, Staphylococcus epidermidis
NIEKYMLLVQRAQQKGLEVVL

SEQ ID NO: 1830655 - protein, 25 aa, Staphylococcus epidermidis
NIETYPMNWPIGMGQNFFGIIDRES

SEQ ID NO: 1830656 - protein, 24 aa, Staphylococcus epidermidis
NIHWDNYKIKYLRPIDIHDDIRFF

SEQ ID NO: 1830657 - protein, 26 aa, Staphylococcus epidermidis
NIIATLMVINYLDKYILSEDNMRILL

SEQ ID NO: 1830658 - protein, 21 aa, Staphylococcus epidermidis
NIIHLSKNIGWFLVERIMSRA

SEQ ID NO: 1830659 - protein, 19 aa, Staphylococcus epidermidis
NIIPDFTHARFYTRATTRK

SEQ ID NO: 1830660 - protein, 17 aa, Staphylococcus epidermidis
NIKKLNSKIRIIKAIPA

SEQ ID NO: 1830661 - protein, 23 aa, Staphylococcus epidermidis
NIKNPLLHIGFTSGTTGLPKAYY

SEQ ID NO: 1830662 - protein, 28 aa, Staphylococcus epidermidis
NIKQVSKIPLSLTFDHQILDGAGAADFL

SEQ ID NO: 1830663 - protein, 19 aa, Staphylococcus epidermidis
NIKSLINRSLSFFDRVGEV

SEQ ID NO: 1830664 - protein, 20 aa, Staphylococcus epidermidis
NIKYKLYAYFPNLDKGSHVF

SEQ ID NO: 1830665 - protein, 18 aa, Staphylococcus epidermidis
NILEVKMDLGYQRKDFID

SEQ ID NO: 1830666 - protein, 26 aa, Staphylococcus epidermidis
NILEVNYKLAILISLMNSVFEFEEDD

SEQ ID NO: 1830667 - protein, 18 aa, Staphylococcus epidermidis
NILFIFEGVLMYFDESVM

SEQ ID NO: 1830668 - protein, 17 aa, Staphylococcus epidermidis
NILGLLEAPTEGQIIYK

SEQ ID NO: 1830669 - protein, 18 aa, Staphylococcus epidermidis
NILLEYVSANPTGDLHIG

SEQ ID NO: 1830670 - protein, 21 aa, Staphylococcus epidermidis
NILPIIAKSFAPYLKEKKNHV

SEQ ID NO: 1830671 - protein, 18 aa, Staphylococcus epidermidis
NIMMRYVMKKKNVDSLPS

SEQ ID NO: 1830672 - protein, 20 aa, Staphylococcus epidermidis
NINDWWEQVTAAYQFLRNEG

SEQ ID NO: 1830673 - protein, 23 aa, Staphylococcus epidermidis
NIQEYEEMMADPGFWDDQNKAQD

SEQ ID NO: 1830674 - protein, 19 aa, Staphylococcus epidermidis
NIQHYINYMKKLKYPLSII

SEQ ID NO: 1830675 - protein, 18 aa, Staphylococcus epidermidis
NIQVFKIGEGGLGGELHL

SEQ ID NO: 1830676 - protein, 25 aa, Staphylococcus epidermidis
NIRVNAISAGPFRTLSAKGVGGFNT

SEQ ID NO: 1830677 - protein, 25 aa, Staphylococcus epidermidis
NISGIPCILYGELYTRYGAILNKVY

SEQ ID NO: 1830678 - protein, 19 aa, Staphylococcus epidermidis
NITAYWKGFVEYHDKKKTQ

SEQ ID NO: 1830679 - protein, 24 aa, Staphylococcus epidermidis
NITNYLRRINRKTALLIQLATEVG

SEQ ID NO: 1830680 - protein, 32 aa, Staphylococcus epidermidis
NITWYSNRHLLEKDLLYLNKPDSLTLLKSSAG

SEQ ID NO: 1830681 - protein, 21 aa, Staphylococcus epidermidis
NIVIKQSWIYKGTLNSSIIHP

SEQ ID NO: 1830682 - protein, 27 aa, Staphylococcus epidermidis
NIVVATRRKYNIPIIAQLTASNTNYLV

SEQ ID NO: 1830683 - protein, 26 aa, Staphylococcus epidermidis
NKDDFYKKYGIKKTFFKDKKLVYGGG

SEQ ID NO: 1830684 - protein, 28 aa, Staphylococcus epidermidis
NKEIKTIQNVWYYKLVDVYDITQTNAKP

SEQ ID NO: 1830685 - protein, 20 aa, Staphylococcus epidermidis
NKEILNYASLSTKFFYCGKD

SEQ ID NO: 1830686 - protein, 21 aa, Staphylococcus epidermidis
NKFYKFAIYGKFGTGKTTFLT

SEQ ID NO: 1830687 - protein, 27 aa, Staphylococcus epidermidis
NKGDKLAQLVIVPIWTPELKEVEEFSS

SEQ ID NO: 1830688 - protein, 23 aa, Staphylococcus epidermidis
NKHKMGILFQKTEFPKYIKVCEL

SEQ ID NO: 1830689 - protein, 18 aa, Staphylococcus epidermidis
NKKAPYEQRMPKIVIVID

SEQ ID NO: 1830690 - protein, 21 aa, Staphylococcus epidermidis
NKKARKLLFWVIMNIIRGQHH

SEQ ID NO: 1830691 - protein, 25 aa, Staphylococcus epidermidis
NKKFKTYYLEWLVANGKDKLSIKQQ

SEQ ID NO: 1830692 - protein, 18 aa, Staphylococcus epidermidis
NKKFVLGSVSHKVAKRAT

SEQ ID NO: 1830693 - protein, 23 aa, Staphylococcus epidermidis
NKKNLYPIYEKLSEYIDLEENRT

SEQ ID NO: 1830694 - protein, 25 aa, Staphylococcus epidermidis
NKKPMLVAGDIYRPAAIDQLQTVGK

SEQ ID NO: 1830695 - protein, 28 aa, Staphylococcus epidermidis
NKKRNILDVLLNEKLVPGDMLYVTDLCI

SEQ ID NO: 1830696 - protein, 25 aa, Staphylococcus epidermidis
NKKRNILDVLLNEKLVSGDMLYVTD

SEQ ID NO: 1830697 - protein, 22 aa, Staphylococcus epidermidis
NKKVRGRKLGEDYNKGGIQHGF

SEQ ID NO: 1830698 - protein, 24 aa, Staphylococcus epidermidis
NKLGGNPIVFFRNQKNTSFVSTVK

SEQ ID NO: 1830699 - protein, 19 aa, Staphylococcus epidermidis
NKLLDERGPIDIQILGIGE

SEQ ID NO: 1830700 - protein, 24 aa, Staphylococcus epidermidis
NKLWWAKMTYPQNKEIKYFYCALG

SEQ ID NO: 1830701 - protein, 24 aa, Staphylococcus epidermidis
NKMKFAMEMEAVWWGETESAFFNF

SEQ ID NO: 1830702 - protein, 19 aa, Staphylococcus epidermidis
NKNFILLTAHRRENIGKPM

SEQ ID NO: 1830703 - protein, 24 aa, Staphylococcus epidermidis
NKNKKEIWLKKQGIDKANDYFKVH

SEQ ID NO: 1830704 - protein, 24 aa, Staphylococcus epidermidis
NKNKNAFFNLYNPKIFQAFDDIYI

SEQ ID NO: 1830705 - protein, 20 aa, Staphylococcus epidermidis
NKPIALFLVVPDYDSSRNVI

SEQ ID NO: 1830706 - protein, 26 aa, Staphylococcus epidermidis
NKPKPRYLIGFAAKPLVFLHAILPTR

SEQ ID NO: 1830707 - protein, 21 aa, Staphylococcus epidermidis
NKPLTLIGPKGIQNYIETSLK

SEQ ID NO: 1830708 - protein, 26 aa, Staphylococcus epidermidis
NKPNSRYMVFYNDDLNLYTKTNVNSL

SEQ ID NO: 1830709 - protein, 25 aa, Staphylococcus epidermidis
NKPNSRYMVFYNDDLTLYTKTNINS

SEQ ID NO: 1830710 - protein, 25 aa, Staphylococcus epidermidis
NKPSTSFWALLRTFEQILNNTLWTN

SEQ ID NO: 1830711 - protein, 30 aa, Staphylococcus epidermidis
NKQKANIRMSLFTSLFILHNINRNNETKTE

SEQ ID NO: 1830712 - protein, 43 aa, Staphylococcus epidermidis
NKQSWDVSMYSYLSVPRGDTGYFFNTAYLPDGALNKGNYSNTK

SEQ ID NO: 1830713 - protein, 24 aa, Staphylococcus epidermidis
NKRIKLGVIPSFSLYKLHEKKYIN

SEQ ID NO: 1830714 - protein, 22 aa, Staphylococcus epidermidis
NKRIQFLNHLAAELGLEDVSFV

SEQ ID NO: 1830715 - protein, 24 aa, Staphylococcus epidermidis
NKRIQFLNHLAAELGLQDVSFVHD

SEQ ID NO: 1830716 - protein, 27 aa, Staphylococcus epidermidis
NKSIIDEIHDFYRNGGYYDEKEIDFGK

SEQ ID NO: 1830717 - protein, 29 aa, Staphylococcus epidermidis
NKTVNKMVTLPNYLVVIGKKQGINFSQTL

SEQ ID NO: 1830718 - protein, 21 aa, Staphylococcus epidermidis
NKVFDLNYQGGQMYLGDYQYY

SEQ ID NO: 1830719 - protein, 24 aa, Staphylococcus epidermidis
NLAVYYQQLWNLPEKVQISPYMID

SEQ ID NO: 1830720 - protein, 28 aa, Staphylococcus epidermidis
NLDDKTAVLRFYVTKNKKPLLISEENTE

SEQ ID NO: 1830721 - protein, 17 aa, Staphylococcus epidermidis
NLDYIYEILKDGSNQAR

SEQ ID NO: 1830722 - protein, 25 aa, Staphylococcus epidermidis
NLEELSQTLFKRWFVDFEFPDENGN

SEQ ID NO: 1830723 - protein, 32 aa, Staphylococcus epidermidis
NLEFELGVLLSKKQYWYKLPNFKEIAKVADYA

SEQ ID NO: 1830724 - protein, 22 aa, Staphylococcus epidermidis
NLEKSFQILKPHGVIASISGLP

SEQ ID NO: 1830725 - protein, 30 aa, Staphylococcus epidermidis
NLELDFKKWGINLVLLGDKLAIHAAATVYC

SEQ ID NO: 1830726 - protein, 26 aa, Staphylococcus epidermidis
NLELNRRFPRIYWQTACLNVDSDSIS

SEQ ID NO: 1830727 - protein, 24 aa, Staphylococcus epidermidis
NLETRGVVLFLNRNNKKATGKFYI

SEQ ID NO: 1830728 - protein, 27 aa, Staphylococcus epidermidis
NLEVIDKPTPFLFGEDFSFYGQQLAPS

SEQ ID NO: 1830729 - protein, 23 aa, Staphylococcus epidermidis
NLEWAFKSYVFNLQNKKLFNLQS

SEQ ID NO: 1830730 - protein, 24 aa, Staphylococcus epidermidis
NLEYLNGVIWVIDPIDGTLNFVHQ

SEQ ID NO: 1830731 - protein, 17 aa, Staphylococcus epidermidis
NLFSFLMDMRILVEELF

SEQ ID NO: 1830732 - protein, 20 aa, Staphylococcus epidermidis
NLGLWYEKICKLAGKDKALP

SEQ ID NO: 1830733 - protein, 23 aa, Staphylococcus epidermidis
NLIELLEYKNLCQYYSFIDPESD

SEQ ID NO: 1830734 - protein, 25 aa, Staphylococcus epidermidis
NLIGAFYRPNAVIYDLDFLETLPYS

SEQ ID NO: 1830735 - protein, 20 aa, Staphylococcus epidermidis
NLIKAIILALLVQCDLNNEL

SEQ ID NO: 1830736 - protein, 18 aa, Staphylococcus epidermidis
NLITGDPIYRPLGSTANK

SEQ ID NO: 1830737 - protein, 18 aa, Staphylococcus epidermidis
NLKEFIRWSEENGFSDKL

SEQ ID NO: 1830738 - protein, 23 aa, Staphylococcus epidermidis
NLKGLVSLYPYFDKLVSVSEATS

SEQ ID NO: 1830739 - protein, 23 aa, Staphylococcus epidermidis
NLKHLKKERPECLIGVCGCMSQE

SEQ ID NO: 1830740 - protein, 21 aa, Staphylococcus epidermidis
NLKIIASCPFAKDVLEKDDHA

SEQ ID NO: 1830741 - protein, 18 aa, Staphylococcus epidermidis
NLKKYTAMKITKVEKNPM

SEQ ID NO: 1830742 - protein, 26 aa, Staphylococcus epidermidis
NLKPKRRLDYYYGCTHFIVPPISSNN

SEQ ID NO: 1830743 - protein, 19 aa, Staphylococcus epidermidis
NLLGFNLQPTHDGLIIHPS

SEQ ID NO: 1830744 - protein, 18 aa, Staphylococcus epidermidis
NLLIQKRQGLNKPNLLYL

SEQ ID NO: 1830745 - protein, 19 aa, Staphylococcus epidermidis
NLLLNLFRNQINQQRFTLV

SEQ ID NO: 1830746 - protein, 20 aa, Staphylococcus epidermidis
NLLYKVLRPQFVQHAHIIGI

SEQ ID NO: 1830747 - protein, 19 aa, Staphylococcus epidermidis
NLMFEYSVINQTGMAKTGV

SEQ ID NO: 1830748 - protein, 18 aa, Staphylococcus epidermidis
NLMMRYVMKKKNVDDLPS

SEQ ID NO: 1830749 - protein, 40 aa, Staphylococcus epidermidis
NLNHADYLLAFAQYYPYGPEYFIFGGLYKIKKIEPEVFDE

SEQ ID NO: 1830750 - protein, 18 aa, Staphylococcus epidermidis
NLNHDRIDFRHCSEKIEM

SEQ ID NO: 1830751 - protein, 24 aa, Staphylococcus epidermidis
NLNNYRVMLIHPWQYNHTIGEQFE

SEQ ID NO: 1830752 - protein, 38 aa, Staphylococcus epidermidis
NLNSYHFNQLPLFNFKIYQFLDEAYLLLDFHATIFNES

SEQ ID NO: 1830753 - protein, 17 aa, Staphylococcus epidermidis
NLNSYYNINGKKMKVIE

SEQ ID NO: 1830754 - protein, 19 aa, Staphylococcus epidermidis
NLPFIAMWTDENVAESYLL

SEQ ID NO: 1830755 - protein, 28 aa, Staphylococcus epidermidis
NLPNKEFQLIFLLVSNPKHIFTRDDIIE

SEQ ID NO: 1830756 - protein, 27 aa, Staphylococcus epidermidis
NLQKANKIIFFGLPNRVSFFEQSRKRT

SEQ ID NO: 1830757 - protein, 24 aa, Staphylococcus epidermidis
NLQNYHLMMVHPWQVKHILQSDYQ

SEQ ID NO: 1830758 - protein, 17 aa, Staphylococcus epidermidis
NLQRLGLGNIDTLPVIS

SEQ ID NO: 1830759 - protein, 20 aa, Staphylococcus epidermidis
NLRELGFDVVRFKTGTPPRV

SEQ ID NO: 1830760 - protein, 19 aa, Staphylococcus epidermidis
NLRHKLEINPIKNGEYRKA

SEQ ID NO: 1830761 - protein, 24 aa, Staphylococcus epidermidis
NLRHKYVWSTPFLMRVEENFRPYM

SEQ ID NO: 1830762 - protein, 26 aa, Staphylococcus epidermidis
NLRKLGKWLVPQTKHYSWLKSADIIG

SEQ ID NO: 1830763 - protein, 19 aa, Staphylococcus epidermidis
NLRLFLHRHDLFESDYWSV

SEQ ID NO: 1830764 - protein, 23 aa, Staphylococcus epidermidis
NLRTIHAIPLKIKEPLNFEVRGE

SEQ ID NO: 1830765 - protein, 25 aa, Staphylococcus epidermidis
NLSEKLVDQKLIYVPKKGENSMKID

SEQ ID NO: 1830766 - protein, 18 aa, Staphylococcus epidermidis
NLSFVYKYNLLLEKRKQN

SEQ ID NO: 1830767 - protein, 26 aa, Staphylococcus epidermidis
NLSLSLLTIIYLRKPWRIESLLKKID

SEQ ID NO: 1830768 - protein, 26 aa, Staphylococcus epidermidis
NLSLSLLTIIYLRKPWRIESLLKKIN

SEQ ID NO: 1830769 - protein, 24 aa, Staphylococcus epidermidis
NLSNEQLFLGSGIGITPLVPMFNE

SEQ ID NO: 1830770 - protein, 24 aa, Staphylococcus epidermidis
NLSYAANFLYMLRGELPTDIEVEA

SEQ ID NO: 1830771 - protein, 25 aa, Staphylococcus epidermidis
NLTNYRKYYEPLIKKKDSEFKLGMK

SEQ ID NO: 1830772 - protein, 18 aa, Staphylococcus epidermidis
NLVFYIYGSTLDGFMEWI

SEQ ID NO: 1830773 - protein, 18 aa, Staphylococcus epidermidis
NLVGLPRAEKRFKAYPHQ

SEQ ID NO: 1830774 - protein, 26 aa, Staphylococcus epidermidis
NLVKRAYEHLFINKYSLDGGINRFHP

SEQ ID NO: 1830775 - protein, 27 aa, Staphylococcus epidermidis
NLVPDYLDGLLFDDIPFLKVAQQEHDR

SEQ ID NO: 1830776 - protein, 26 aa, Staphylococcus epidermidis
NLVPDYLDGLLFDDIPYLKVAQQEHD

SEQ ID NO: 1830777 - protein, 17 aa, Staphylococcus epidermidis
NLWFDNMVIPKTAQNKE

SEQ ID NO: 1830778 - protein, 17 aa, Staphylococcus epidermidis
NLYDIIDEFKSLGGYEY

SEQ ID NO: 1830779 - protein, 27 aa, Staphylococcus epidermidis
NMALTECDLLINLGSRFDDRLASKPDA

SEQ ID NO: 1830780 - protein, 18 aa, Staphylococcus epidermidis
NMEAFWERFSPSKPNSIP

SEQ ID NO: 1830781 - protein, 17 aa, Staphylococcus epidermidis
NMESRGMVLFINRNTRT

SEQ ID NO: 1830782 - protein, 24 aa, Staphylococcus epidermidis
NMFGVGNLMMRYVMKKKNVDDLPS

SEQ ID NO: 1830783 - protein, 19 aa, Staphylococcus epidermidis
NMFGYTGTYKGKEVSVMGS

SEQ ID NO: 1830784 - protein, 24 aa, Staphylococcus epidermidis
NMIPMTYHMDAWYFDGQKVADASS

SEQ ID NO: 1830785 - protein, 30 aa, Staphylococcus epidermidis
NMKEIQAFNYIPFFKAFNMNKVFINEPLSF

SEQ ID NO: 1830786 - protein, 17 aa, Staphylococcus epidermidis
NMLYERILKLESIELEN

SEQ ID NO: 1830787 - protein, 24 aa, Staphylococcus epidermidis
NMNAYQGYYLSKELQKVLEARRCW

SEQ ID NO: 1830788 - protein, 25 aa, Staphylococcus epidermidis
NMYEWLSNFELFKVPKTLITKNPKY

SEQ ID NO: 1830789 - protein, 18 aa, Staphylococcus epidermidis
NMYVDRDFIFTNHKGNPI

SEQ ID NO: 1830790 - protein, 25 aa, Staphylococcus epidermidis
NNAHSPLFIELLVTRNDFINRVRKY

SEQ ID NO: 1830791 - protein, 24 aa, Staphylococcus epidermidis
NNATLPFAQILANKGYREAFKSNH

SEQ ID NO: 1830792 - protein, 18 aa, Staphylococcus epidermidis
NNATLPYAQLLANKGYRE

SEQ ID NO: 1830793 - protein, 20 aa, Staphylococcus epidermidis
NNEFLIAGFNYEGQLAATIE

SEQ ID NO: 1830794 - protein, 23 aa, Staphylococcus epidermidis
NNEPLEFEPLKELIDNMIKSVNV

SEQ ID NO: 1830795 - protein, 25 aa, Staphylococcus epidermidis
NNFENWFPFIHNKSTAYISPNKHTW

SEQ ID NO: 1830796 - protein, 25 aa, Staphylococcus epidermidis
NNFETTVFPFILRGTSIIGIDSVFT

SEQ ID NO: 1830797 - protein, 17 aa, Staphylococcus epidermidis
NNFKKSPMKGYFIDGYI

SEQ ID NO: 1830798 - protein, 18 aa, Staphylococcus epidermidis
NNFKKYWNKNVRGGVNEF

SEQ ID NO: 1830799 - protein, 22 aa, Staphylococcus epidermidis
NNFYDVLQLLKKYGFIIYFKDP

SEQ ID NO: 1830800 - protein, 22 aa, Staphylococcus epidermidis
NNGRFSPVVFKLASEHGIDLTQ

SEQ ID NO: 1830801 - protein, 23 aa, Staphylococcus epidermidis
NNGRFSPVVFKLASEHNIDLTQV

SEQ ID NO: 1830802 - protein, 23 aa, Staphylococcus epidermidis
NNHSILMYPIDIESLYTIDDWID

SEQ ID NO: 1830803 - protein, 32 aa, Staphylococcus epidermidis
NNIDKTFGLIFSQRVLLALINKGMVREEAYDK

SEQ ID NO: 1830804 - protein, 18 aa, Staphylococcus epidermidis
NNIDLYQQAFSHSSFIND

SEQ ID NO: 1830805 - protein, 19 aa, Staphylococcus epidermidis
NNIDNVLVKVLDPLFAGYT

SEQ ID NO: 1830806 - protein, 31 aa, Staphylococcus epidermidis
NNIIKLVNDKLTYPVFVKPANLGSSVGISKC

SEQ ID NO: 1830807 - protein, 25 aa, Staphylococcus epidermidis
NNIKKPIPKFPKKIAVLTASTGAAI

SEQ ID NO: 1830808 - protein, 23 aa, Staphylococcus epidermidis
NNINIRGFSNAMADIKIFGGANR

SEQ ID NO: 1830809 - protein, 25 aa, Staphylococcus epidermidis
NNINVRNFKNADVDIRLFGGSNRPS

SEQ ID NO: 1830810 - protein, 19 aa, Staphylococcus epidermidis
NNINVRNFKNAEVDIRLFG

SEQ ID NO: 1830811 - protein, 18 aa, Staphylococcus epidermidis
NNIVGRTILPTYGLFRSI

SEQ ID NO: 1830812 - protein, 23 aa, Staphylococcus epidermidis
NNIVMGYAGTGPLSMKIVCYFTS

SEQ ID NO: 1830813 - protein, 20 aa, Staphylococcus epidermidis
NNKELIWKDLKLDKDKRKVT

SEQ ID NO: 1830814 - protein, 27 aa, Staphylococcus epidermidis
NNKKRNELDLLLKKKLVSGDAVYITDL

SEQ ID NO: 1830815 - protein, 17 aa, Staphylococcus epidermidis
NNKPLFKLKKRDALRYM

SEQ ID NO: 1830816 - protein, 37 aa, Staphylococcus epidermidis
NNLNGIARLDEARPKALDYINSLDKINNSQKAALIDK

SEQ ID NO: 1830817 - protein, 19 aa, Staphylococcus epidermidis
NNLPHWRHLTKERPELPKM

SEQ ID NO: 1830818 - protein, 27 aa, Staphylococcus epidermidis
NNPLTSQIKRLYPFVFNTLYDSIRQLS

SEQ ID NO: 1830819 - protein, 19 aa, Staphylococcus epidermidis
NNRELSWLDFNYRVLQEAY

SEQ ID NO: 1830820 - protein, 23 aa, Staphylococcus epidermidis
NNRSVVRVIANRIEFLDSKGSNQ

SEQ ID NO: 1830821 - protein, 24 aa, Staphylococcus epidermidis
NNRSVVRVIANRIEFLDSKGSNQQ

SEQ ID NO: 1830822 - protein, 25 aa, Staphylococcus epidermidis
NNSRKYLNLIYYDNLKMMTNDLYLH

SEQ ID NO: 1830823 - protein, 35 aa, Staphylococcus epidermidis
NNVDYQLIVLSFSPYLRTFLHRYDLYESHYWSVFD

SEQ ID NO: 1830824 - protein, 20 aa, Staphylococcus epidermidis
NNVKNRKFMPNQSNYKPVVF

SEQ ID NO: 1830825 - protein, 28 aa, Staphylococcus epidermidis
NNWIDDNGNVYLIFTTKDLCELLNCGTQ

SEQ ID NO: 1830826 - protein, 19 aa, Staphylococcus epidermidis
NNWTDIFKGLLHEVFKEYG

SEQ ID NO: 1830827 - protein, 17 aa, Staphylococcus epidermidis
NNYRKYYEPLIKKNSKN

SEQ ID NO: 1830828 - protein, 23 aa, Staphylococcus epidermidis
NPDYRVKPPFFIEWDNSRKQNLS

SEQ ID NO: 1830829 - protein, 25 aa, Staphylococcus epidermidis
NPETLRKHLIDHYSIGIIALNDTDI

SEQ ID NO: 1830830 - protein, 32 aa, Staphylococcus epidermidis
NPEYNQFMGAYRLQWDMIKFALNNNIPRYNFY

SEQ ID NO: 1830831 - protein, 21 aa, Staphylococcus epidermidis
NPFGMVLSLALCLRESLNQID

SEQ ID NO: 1830832 - protein, 23 aa, Staphylococcus epidermidis
NPFIKGLDIIIPQAGIYTSYVVR

SEQ ID NO: 1830833 - protein, 19 aa, Staphylococcus epidermidis
NPFKKGNLVNWLSKVQNYD

SEQ ID NO: 1830834 - protein, 28 aa, Staphylococcus epidermidis
NPGNTDAMIKYLLPKATVVTPNLFEAGQ

SEQ ID NO: 1830835 - protein, 24 aa, Staphylococcus epidermidis
NPGRPNFDQLAKSKPELILASFRQ

SEQ ID NO: 1830836 - protein, 26 aa, Staphylococcus epidermidis
NPIHDVLHIYNFFKPPRQFCEECEKK

SEQ ID NO: 1830837 - protein, 32 aa, Staphylococcus epidermidis
NPKIFQAFDDIYILTYLFDGQFLKYYFDFFKI

SEQ ID NO: 1830838 - protein, 18 aa, Staphylococcus epidermidis
NPKPRMYRLLEDDALINR

SEQ ID NO: 1830839 - protein, 18 aa, Staphylococcus epidermidis
NPLLDKFMKDLIVQILAM

SEQ ID NO: 1830840 - protein, 23 aa, Staphylococcus epidermidis
NPNLIPRKPYQVRNILLNPNYCG

SEQ ID NO: 1830841 - protein, 31 aa, Staphylococcus epidermidis
NPNLLYEMLLEKGFITKLFSKGVRITIGLPE

SEQ ID NO: 1830842 - protein, 26 aa, Staphylococcus epidermidis
NPNMKFSLKFGGRALAIYLMQYKYFY

SEQ ID NO: 1830843 - protein, 23 aa, Staphylococcus epidermidis
NPNPVIRIVQYDSAVFKIELYDN

SEQ ID NO: 1830844 - protein, 17 aa, Staphylococcus epidermidis
NPQLKEAFYQLTPGRQH

SEQ ID NO: 1830845 - protein, 28 aa, Staphylococcus epidermidis
NPSKAYEEWLRVLKPHGHLLNFDADYGK

SEQ ID NO: 1830846 - protein, 27 aa, Staphylococcus epidermidis
NPSPMTAYGIYIAMKRTAKEKFENESL

SEQ ID NO: 1830847 - protein, 29 aa, Staphylococcus epidermidis
NPTEDDVLMYNYLKHFDIPTLVICTKEDK

SEQ ID NO: 1830848 - protein, 19 aa, Staphylococcus epidermidis
NPTFKPGPLLPNYNDYIVF

SEQ ID NO: 1830849 - protein, 19 aa, Staphylococcus epidermidis
NPTLLNKVGKLIASIYMDE

SEQ ID NO: 1830850 - protein, 36 aa, Staphylococcus epidermidis
NPYLDKFYHDFERWSFHLQIYFLAERFKEQKRMFEY

SEQ ID NO: 1830851 - protein, 25 aa, Staphylococcus epidermidis
NQDCLYMINTFYPYIETVKKFIQFA

SEQ ID NO: 1830852 - protein, 22 aa, Staphylococcus epidermidis
NQDKAMRWYQRQKLYSRPTPED

SEQ ID NO: 1830853 - protein, 20 aa, Staphylococcus epidermidis
NQDLPNLQRLGLGNIDTLPV

SEQ ID NO: 1830854 - protein, 28 aa, Staphylococcus epidermidis
NQDPYIYIKFTCLNYAIFLEYTIAKKDF

SEQ ID NO: 1830855 - protein, 22 aa, Staphylococcus epidermidis
NQEPWTSCEFDFTNKGKLNVAF

SEQ ID NO: 1830856 - protein, 25 aa, Staphylococcus epidermidis
NQGLFYLDWLLDHKAEFELIVMKKL

SEQ ID NO: 1830857 - protein, 26 aa, Staphylococcus epidermidis
NQIEIDIAFTSLLTRALETTQHILAG

SEQ ID NO: 1830858 - protein, 17 aa, Staphylococcus epidermidis
NQIIRHAYLDVFENEPL

SEQ ID NO: 1830859 - protein, 28 aa, Staphylococcus epidermidis
NQILKEIISRLSFLNNVGLEYLTLNRSS

SEQ ID NO: 1830860 - protein, 19 aa, Staphylococcus epidermidis
NQIVFFTGAGISVASGIPD

SEQ ID NO: 1830861 - protein, 24 aa, Staphylococcus epidermidis
NQKEYRILAYKLKGNKIKINGLYN

SEQ ID NO: 1830862 - protein, 22 aa, Staphylococcus epidermidis
NQKLNFVYLYHCFEFSNNIVKA

SEQ ID NO: 1830863 - protein, 26 aa, Staphylococcus epidermidis
NQKSRLLKWHIDLPKVVKLQKDIEKK

SEQ ID NO: 1830864 - protein, 17 aa, Staphylococcus epidermidis
NQLIDISLYDHSRITCA

SEQ ID NO: 1830865 - protein, 21 aa, Staphylococcus epidermidis
NQLMTLPKRIGLRDAIISFKP

SEQ ID NO: 1830866 - protein, 25 aa, Staphylococcus epidermidis
NQLPRYIEMTVKGKKILFIHYEIEN

SEQ ID NO: 1830867 - protein, 17 aa, Staphylococcus epidermidis
NQLSKITSLPVLCKDFI

SEQ ID NO: 1830868 - protein, 17 aa, Staphylococcus epidermidis
NQNIFAFPGASSGVIDL

SEQ ID NO: 1830869 - protein, 22 aa, Staphylococcus epidermidis
NQNIINFREEIKDILSLVEEII

SEQ ID NO: 1830870 - protein, 26 aa, Staphylococcus epidermidis
NQNSPFVWILPITNRLKRFPSDISIE

SEQ ID NO: 1830871 - protein, 25 aa, Staphylococcus epidermidis
NQPNRLYPKKPYDKYFYAYDVDEFY

SEQ ID NO: 1830872 - protein, 26 aa, Staphylococcus epidermidis
NQPSWMQIMLKFYQLCPRTLEKFCPK

SEQ ID NO: 1830873 - protein, 26 aa, Staphylococcus epidermidis
NQQKGRIELFMKYNVKGYKNTHFTKI

SEQ ID NO: 1830874 - protein, 25 aa, Staphylococcus epidermidis
NQQTNHLMLYLLENYDFYNFDMNFS

SEQ ID NO: 1830875 - protein, 25 aa, Staphylococcus epidermidis
NQRKIRRDLYDSRGFLSCSRTLTTN

SEQ ID NO: 1830876 - protein, 22 aa, Staphylococcus epidermidis
NQSIFGGIIALNRTVDTKLAET

SEQ ID NO: 1830877 - protein, 21 aa, Staphylococcus epidermidis
NQSPLLPPPTLSIADAILSFN

SEQ ID NO: 1830878 - protein, 32 aa, Staphylococcus epidermidis; identical to SEQ ID NO: 1755091

SEQ ID NO: 1830879 - protein, 33 aa, Staphylococcus epidermidis
NQTLDIIKRHRLLELFLIEILHYNWEEVHQEAE

SEQ ID NO: 1830880 - protein, 20 aa, Staphylococcus epidermidis
NQVIKKVYLNQFTASFVGHF

SEQ ID NO: 1830881 - protein, 37 aa, Staphylococcus epidermidis
NQWEKYPQLTYLRKNVRLIYVPMVNPWGFANQERENV

SEQ ID NO: 1830882 - protein, 27 aa, Staphylococcus epidermidis
NQYAKLKSIFGVRDMFFISENGAVIYK

SEQ ID NO: 1830883 - protein, 17 aa, Staphylococcus epidermidis
NQYCKHEFVLSGTLQKQ

SEQ ID NO: 1830884 - protein, 19 aa, Staphylococcus epidermidis
NQYIKKVYPDYVFTSFVIS

SEQ ID NO: 1830885 - protein, 25 aa, Staphylococcus epidermidis
NQYPVKVVVLKPFRLGGIDKVIEAM

SEQ ID NO: 1830886 - protein, 24 aa, Staphylococcus epidermidis
NRAARIIDQLEQLGYISGANGSKP

SEQ ID NO: 1830887 - protein, 24 aa, Staphylococcus epidermidis
NREINEFKFFAQYANFKELKDYKN

SEQ ID NO: 1830888 - protein, 18 aa, Staphylococcus epidermidis
NRFEEQFQQLSPKVEKFA

SEQ ID NO: 1830889 - protein, 19 aa, Staphylococcus epidermidis
NRFSIMMHELLKTSSIGEY

SEQ ID NO: 1830890 - protein, 20 aa, Staphylococcus epidermidis
NRGISWSVEKFPYVVKNSME

SEQ ID NO: 1830891 - protein, 18 aa, Staphylococcus epidermidis
NRHSLNHSLYLKNKNFAL

SEQ ID NO: 1830892 - protein, 27 aa, Staphylococcus epidermidis
NRINLILIPLIAKHFIVEKKEILMLTP

SEQ ID NO: 1830893 - protein, 29 aa, Staphylococcus epidermidis
NRKAFRGVELYGKTLGIIGAGRIGLGVAK

SEQ ID NO: 1830894 - protein, 22 aa, Staphylococcus epidermidis
NRKLKLFNQAIVTFLKDFKGVY

SEQ ID NO: 1830895 - protein, 20 aa, Staphylococcus epidermidis
NRKQFDFRGLQCPGPIVNIS

SEQ ID NO: 1830896 - protein, 18 aa, Staphylococcus epidermidis
NRLIKIINVLGYEYNKDT

SEQ ID NO: 1830897 - protein, 26 aa, Staphylococcus epidermidis
NRLIPLSEGYIYFKDKPISDYPVYEM

SEQ ID NO: 1830898 - protein, 19 aa, Staphylococcus epidermidis
NRLKFQILELFHQTFPGLE

SEQ ID NO: 1830899 - protein, 22 aa, Staphylococcus epidermidis
NRLKFQILELFHQTFPGLERLF

SEQ ID NO: 1830900 - protein, 23 aa, Staphylococcus epidermidis
NRLKFQILELFHQTFPGLERLFS

SEQ ID NO: 1830901 - protein, 24 aa, Staphylococcus epidermidis
NRLKFQILELFHQTFPGLERLFSS

SEQ ID NO: 1830902 - protein, 23 aa, Staphylococcus epidermidis
NRLKFQILELLHQTFPGLERLFS

SEQ ID NO: 1830903 - protein, 39 aa, Staphylococcus epidermidis
NRLKLFKDNLVPNKLIFTSWSPRLYMHAHSLNIDSKDIF

SEQ ID NO: 1830904 - protein, 29 aa, Staphylococcus epidermidis
NRMRELQFALYERKIPLVLVFEGMDAAGK

SEQ ID NO: 1830905 - protein, 22 aa, Staphylococcus epidermidis
NRNDVIYVDCQSGIRSSIAIGI

SEQ ID NO: 1830906 - protein, 23 aa, Staphylococcus epidermidis
NRNDVIYVHCQSGIRSSIAIGIL

SEQ ID NO: 1830907 - protein, 34 aa, Staphylococcus epidermidis
NRNIELYRYKYFENKFLMLDLVNATFTFKSKEKT

SEQ ID NO: 1830908 - protein, 27 aa, Staphylococcus epidermidis
NRNVTGKWSWLAPPLSPTLTSNYHHGY

SEQ ID NO: 1830909 - protein, 25 aa, Staphylococcus epidermidis
NRPEHGLLKLRKSLNLYANIRPTIV

SEQ ID NO: 1830910 - protein, 26 aa, Staphylococcus epidermidis
NRRTIFYNTLFDENASCHLAIGSAYG

SEQ ID NO: 1830911 - protein, 21 aa, Staphylococcus epidermidis
NRRVPDPLVYAYCYMWNENCK

SEQ ID NO: 1830912 - protein, 32 aa, Staphylococcus epidermidis
NRSIKTNKIKMLNLFNFLLLSECFNNPILQEV

SEQ ID NO: 1830913 - protein, 23 aa, Staphylococcus epidermidis
NRSSMVTILAIHGGGIEPATTEL

SEQ ID NO: 1830914 - protein, 27 aa, Staphylococcus epidermidis
NRSTFYRYFQDKYDLLYSLPQYMTGEI

SEQ ID NO: 1830915 - protein, 18 aa, Staphylococcus epidermidis
NRVKPLYEHHDVSTILIV

SEQ ID NO: 1830916 - protein, 24 aa, Staphylococcus epidermidis
NRVSSLMFRYEVYEDYETVGDASE

SEQ ID NO: 1830917 - protein, 18 aa, Staphylococcus epidermidis
NRWLGYYGFNVSSEWMIP

SEQ ID NO: 1830918 - protein, 21 aa, Staphylococcus epidermidis
NRYGCALAIDVLNRLKDENID

SEQ ID NO: 1830919 - protein, 24 aa, Staphylococcus epidermidis
NRYNQINHLWNSLATYENDNLSKL

SEQ ID NO: 1830920 - protein, 19 aa, Staphylococcus epidermidis
NRYVGNIYTGSLYLSLISL

SEQ ID NO: 1830921 - protein, 20 aa, Staphylococcus epidermidis
NSAPLLFQAISKLKKHFKGY

SEQ ID NO: 1830922 - protein, 22 aa, Staphylococcus epidermidis
NSDIEKVFLKKLSFIDKQSQII

SEQ ID NO: 1830923 - protein, 25 aa, Staphylococcus epidermidis
NSDNKMLQRIYGTAFFDKKDLKAHL

SEQ ID NO: 1830924 - protein, 22 aa, Staphylococcus epidermidis
NSFKAILRCDPDVILIGEIRDA

SEQ ID NO: 1830925 - protein, 19 aa, Staphylococcus epidermidis
NSILKEKQFFVIENLAKTM

SEQ ID NO: 1830926 - protein, 20 aa, Staphylococcus epidermidis
NSILKFLEEPPKNTIAILLS

SEQ ID NO: 1830927 - protein, 23 aa, Staphylococcus epidermidis
NSKCLVLFTSYKMMHMVQDMLNE

SEQ ID NO: 1830928 - protein, 22 aa, Staphylococcus epidermidis
NSKERVWLKRRIETPYKANLNN

SEQ ID NO: 1830929 - protein, 23 aa, Staphylococcus epidermidis
NSKITVYNFGDKPVYPTFTFEST

SEQ ID NO: 1830930 - protein, 26 aa, Staphylococcus epidermidis
NSKNHWYEWLRHNLTLEGYDVSLFNL

SEQ ID NO: 1830931 - protein, 29 aa, Staphylococcus epidermidis
NSKSVFRSTSKWFGNAFKSLKGNMGNMLS

SEQ ID NO: 1830932 - protein, 34 aa, Staphylococcus epidermidis
NSLVIPCSRPNLTPGFFMFVHTNNGLHMNKVTRH

SEQ ID NO: 1830933 - protein, 24 aa, Staphylococcus epidermidis
NSLYGDIPFVIKLYNLVDRIKQTR

SEQ ID NO: 1830934 - protein, 19 aa, Staphylococcus epidermidis
NSMIRLSSKLSLLPADSSL

SEQ ID NO: 1830935 - protein, 26 aa, Staphylococcus epidermidis
NSMKLHALIDGLALHKLLNPNGVSND

SEQ ID NO: 1830936 - protein, 19 aa, Staphylococcus epidermidis
NSNYFTFKGLKPKNNRTLH

SEQ ID NO: 1830937 - protein, 24 aa, Staphylococcus epidermidis
NSPETPIFQKRRLLYNLDKARKSI

SEQ ID NO: 1830938 - protein, 23 aa, Staphylococcus epidermidis
NSPKLLKTLILLHGLSSDETTYI

SEQ ID NO: 1830939 - protein, 24 aa, Staphylococcus epidermidis
NSPNLLKRKFPITNAYDSSKMVPT

SEQ ID NO: 1830940 - protein, 24 aa, Staphylococcus epidermidis
NSQSTRIVLLLNDKNKKFWETTKS

SEQ ID NO: 1830941 - protein, 23 aa, Staphylococcus epidermidis
NSSDLMYGLPWQSVMAGDNDMYH

SEQ ID NO: 1830942 - protein, 18 aa, Staphylococcus epidermidis
NSSELKMYMLNDKHIVKE

SEQ ID NO: 1830943 - protein, 26 aa, Staphylococcus epidermidis
NSSFRGLFQFIRFIDELIDRGRDFGE

SEQ ID NO: 1830944 - protein, 25 aa, Staphylococcus epidermidis
NSSNNPRFKRWVIGSILSRTYYHNM

SEQ ID NO: 1830945 - protein, 25 aa, Staphylococcus epidermidis
NSTQAKVWNFFKSKGLSDHAVAGIM

SEQ ID NO: 1830946 - protein, 26 aa, Staphylococcus epidermidis
NSTVIYQKRFYKSWSKWERVGSDVVD

SEQ ID NO: 1830947 - protein, 21 aa, Staphylococcus epidermidis
NSVLFEAINLQRASLRQGTHS

SEQ ID NO: 1830948 - protein, 32 aa, Staphylococcus epidermidis
NSYLNGTQGALKYIQDIWGYIAPNTKKEQQPK

SEQ ID NO: 1830949 - protein, 17 aa, Staphylococcus epidermidis
NTDIYELSLLQQKYDNQ

SEQ ID NO: 1830950 - protein, 25 aa, Staphylococcus epidermidis
NTDKLAEWHITLPNIIRLQIDFEHK

SEQ ID NO: 1830951 - protein, 18 aa, Staphylococcus epidermidis
NTEIFYDRGLAYGKDDPA

SEQ ID NO: 1830952 - protein, 23 aa, Staphylococcus epidermidis
NTERRIQRLYKALDSLGDSKPDW

SEQ ID NO: 1830953 - protein, 27 aa, Staphylococcus epidermidis
NTGVQLELTTALRKAFFKNGDTSTKNR

SEQ ID NO: 1830954 - protein, 41 aa, Staphylococcus epidermidis
NTGYQNEFYYISADLTSLKNYRIYFEPLIKKNDKEFKEGVK

SEQ ID NO: 1830955 - protein, 24 aa, Staphylococcus epidermidis
NTHDEDIRFIPLKEYSNIETKIIT

SEQ ID NO: 1830956 - protein, 18 aa, Staphylococcus epidermidis
NTIIKKYALQYDVDYVFF

SEQ ID NO: 1830957 - protein, 20 aa, Staphylococcus epidermidis
NTIISGPALVAQWINLQYYA

SEQ ID NO: 1830958 - protein, 20 aa, Staphylococcus epidermidis
NTIKSVHFTSLKQGPMGDAV

SEQ ID NO: 1830959 - protein, 18 aa, Staphylococcus epidermidis
NTIKYWVLDPHRISVEEL

SEQ ID NO: 1830960 - protein, 17 aa, Staphylococcus epidermidis
NTILENVSIPLIYNGMG

SEQ ID NO: 1830961 - protein, 30 aa, Staphylococcus epidermidis
NTILKYVEKGVLYPLSYYDGDWYGKDEVNS

SEQ ID NO: 1830962 - protein, 22 aa, Staphylococcus epidermidis
NTKLIYVETPSNPLFKITDIRA

SEQ ID NO: 1830963 - protein, 22 aa, Staphylococcus epidermidis
NTKSTVQYSWKDEIREVIDQSQ

SEQ ID NO: 1830964 - protein, 18 aa, Staphylococcus epidermidis
NTLPQKGNINIYFRSWYS

SEQ ID NO: 1830965 - protein, 29 aa, Staphylococcus epidermidis
NTLPQKGNINIYFRSWYSHFLDYKENKIK

SEQ ID NO: 1830966 - protein, 26 aa, Staphylococcus epidermidis
NTLQPSPFHWRLLDKLALNTLNEVVL

SEQ ID NO: 1830967 - protein, 21 aa, Staphylococcus epidermidis
NTLYSYIMFSGQISMPTWLEL

SEQ ID NO: 1830968 - protein, 24 aa, Staphylococcus epidermidis
NTNERYKLIILRKGRGLAGTVMKT

SEQ ID NO: 1830969 - protein, 20 aa, Staphylococcus epidermidis
NTNWPVCGIPEKFYTDHGSD

SEQ ID NO: 1830970 - protein, 26 aa, Staphylococcus epidermidis
NTNYHAKLLLQVHDELIFELPKSEVE

SEQ ID NO: 1830971 - protein, 25 aa, Staphylococcus epidermidis
NTPKQLMIYEAFGWEPPRFGHMALI

SEQ ID NO: 1830972 - protein, 38 aa, Staphylococcus epidermidis
NTQAIQRVLYLFSGFHRSILPLKLEKYMLSLKLSDFIY

SEQ ID NO: 1830973 - protein, 36 aa, Staphylococcus epidermidis
NTQDTVLVFTNKGRYLFIPVHKLADIRWKELGQHVS

SEQ ID NO: 1830974 - protein, 20 aa, Staphylococcus epidermidis
NTSMFIINNLTRMGIDTTVL

SEQ ID NO: 1830975 - protein, 25 aa, Staphylococcus epidermidis
NTSTYYGHIWLVDKGATQMTMPVIE

SEQ ID NO: 1830976 - protein, 20 aa, Staphylococcus epidermidis
NTTSLLTKMKFIGSLSDHDI

SEQ ID NO: 1830977 - protein, 21 aa, Staphylococcus epidermidis
NTVFTYLDAFCKDKKYLAEMK

SEQ ID NO: 1830978 - protein, 24 aa, Staphylococcus epidermidis
NTVFTYLDVFCKDKKYLAEMKEHY

SEQ ID NO: 1830979 - protein, 17 aa, Staphylococcus epidermidis
NTWLRKPDKFYVNIIEL

SEQ ID NO: 1830980 - protein, 20 aa, Staphylococcus epidermidis
NTWRYRISLGKDAKTGKYKY

SEQ ID NO: 1830981 - protein, 18 aa, Staphylococcus epidermidis
NTYPIITYSLHNNKKIFV

SEQ ID NO: 1830982 - protein, 23 aa, Staphylococcus epidermidis
NVADFTNILLLDIDMRYSTTLTE

SEQ ID NO: 1830983 - protein, 33 aa, Staphylococcus epidermidis
NVAIKSKLLGQINLVLIGQHYLNKNGSFTLTSG

SEQ ID NO: 1830984 - protein, 25 aa, Staphylococcus epidermidis
NVCIAGMLLLLDLIEKLEPYCEIIQ

SEQ ID NO: 1830985 - protein, 23 aa, Staphylococcus epidermidis
NVDFYCFPAHKWLYGPEGLGFLF

SEQ ID NO: 1830986 - protein, 17 aa, Staphylococcus epidermidis
NVESIYPPGADLHSYEP

SEQ ID NO: 1830987 - protein, 30 aa, Staphylococcus epidermidis
NVESSGIIKKLFLLGIMANINQSLDEETLE

SEQ ID NO: 1830988 - protein, 24 aa, Staphylococcus epidermidis
NVETFSNLLNKIVQSNVERALRQD

SEQ ID NO: 1830989 - protein, 17 aa, Staphylococcus epidermidis
NVFASGGLRTPLDAVKS

SEQ ID NO: 1830990 - protein, 18 aa, Staphylococcus epidermidis
NVFINTNCYLMDGGGITF

SEQ ID NO: 1830991 - protein, 20 aa, Staphylococcus epidermidis
NVFIVSRRGKILGSSLNELL

SEQ ID NO: 1830992 - protein, 26 aa, Staphylococcus epidermidis
NVFKDEIFGPVLAITTYRDFEQVIED

SEQ ID NO: 1830993 - protein, 23 aa, Staphylococcus epidermidis
NVGRWFAYFVKHAPRVPFIIIGK

SEQ ID NO: 1830994 - protein, 24 aa, Staphylococcus epidermidis
NVGRWFAYFVKHAPRVPFIIIGKD

SEQ ID NO: 1830995 - protein, 21 aa, Staphylococcus epidermidis
NVGYKFGRWLDLSFYQYDLSD

SEQ ID NO: 1830996 - protein, 21 aa, Staphylococcus epidermidis
NVGYKFNRWLDLSFYQYDLSD

SEQ ID NO: 1830997 - protein, 20 aa, Staphylococcus epidermidis
NVHASLLPKYRGGAPIHQAI

SEQ ID NO: 1830998 - protein, 26 aa, Staphylococcus epidermidis
NVIDKQLIYDEWIANGIKPLEFKIYH

SEQ ID NO: 1830999 - protein, 29 aa, Staphylococcus epidermidis
NVIFIGLLCKYGQWNAVIFDIGRGHTREL

SEQ ID NO: 1831000 - protein, 25 aa, Staphylococcus epidermidis
NVIHLMSRVRRYPLPLVLEVSNVES

SEQ ID NO: 1831001 - protein, 19 aa, Staphylococcus epidermidis
NVIVEGAIFDPVSIRHTSR

SEQ ID NO: 1831002 - protein, 22 aa, Staphylococcus epidermidis
NVKHHQVFIAGNYFDDASQTLH

SEQ ID NO: 1831003 - protein, 17 aa, Staphylococcus epidermidis
NVKKFMHYLIKAQEHYQ

SEQ ID NO: 1831004 - protein, 23 aa, Staphylococcus epidermidis
NVKRALIPLRGYHLKGKRDRMYI

SEQ ID NO: 1831005 - protein, 20 aa, Staphylococcus epidermidis
NVKVYNVLTGFKYISEILNS

SEQ ID NO: 1831006 - protein, 23 aa, Staphylococcus epidermidis
NVLDPTFNWISDKAKKIYSLEKS

SEQ ID NO: 1831007 - protein, 21 aa, Staphylococcus epidermidis
NVMFDSNLIRSVKWTDIIFKN

SEQ ID NO: 1831008 - protein, 24 aa, Staphylococcus epidermidis
NVNAHPIIVGPITFVKLSKGGHQS

SEQ ID NO: 1831009 - protein, 25 aa, Staphylococcus epidermidis
NVNFLRKRYETLRTLPMFDTIEYTE

SEQ ID NO: 1831010 - protein, 26 aa, Staphylococcus epidermidis
NVNQNMFVTMFYGLYEEMNHLLYCSS

SEQ ID NO: 1831011 - protein, 25 aa, Staphylococcus epidermidis
NVQNINYILYVRKQLEDFPMCVEFR

SEQ ID NO: 1831012 - protein, 18 aa, Staphylococcus epidermidis
NVRYRSFYEHIWVYEKDG

SEQ ID NO: 1831013 - protein, 17 aa, Staphylococcus epidermidis
NVSFGYIDWKKSDLGQV

SEQ ID NO: 1831014 - protein, 18 aa, Staphylococcus epidermidis
NVSVNYLLYGVKVTYKDI

SEQ ID NO: 1831015 - protein, 17 aa, Staphylococcus epidermidis
NVTAVYTIEQVKAITDV

SEQ ID NO: 1831016 - protein, 17 aa, Staphylococcus epidermidis
NVVVAEKDLWYFQDDEI

SEQ ID NO: 1831017 - protein, 21 aa, Staphylococcus epidermidis
NVYKFTFEPQNYNKTLLITSC

SEQ ID NO: 1831018 - protein, 17 aa, Staphylococcus epidermidis
NWEFLYYSSELEGLPKD

SEQ ID NO: 1831019 - protein, 21 aa, Staphylococcus epidermidis
NWRRTFHQYPELSKKEFETTK

SEQ ID NO: 1831020 - protein, 17 aa, Staphylococcus epidermidis
NYARRYGYEAALPLRII

SEQ ID NO: 1831021 - protein, 21 aa, Staphylococcus epidermidis
NYDAFATPFILLKGEPMYSVD

SEQ ID NO: 1831022 - protein, 25 aa, Staphylococcus epidermidis
NYDDDLQYFLFQHTAVLLTADTKYR

SEQ ID NO: 1831023 - protein, 25 aa, Staphylococcus epidermidis
NYDEFYQLLLIKMWELILDYDNQKA

SEQ ID NO: 1831024 - protein, 25 aa, Staphylococcus epidermidis
NYDGRHWIYNSFPEWQKHFPFWSVM

SEQ ID NO: 1831025 - protein, 18 aa, Staphylococcus epidermidis
NYDKLVELLGDFKAPMGC

SEQ ID NO: 1831026 - protein, 32 aa, Staphylococcus epidermidis
NYDTLAHPIYSKLLIYMKFKSGLDVSSQQVAQ

SEQ ID NO: 1831027 - protein, 26 aa, Staphylococcus epidermidis
NYEVNILKMQLLIWITETNTGDIQEL

SEQ ID NO: 1831028 - protein, 20 aa, Staphylococcus epidermidis
NYFMLKLDPKYCKLVGISDG

SEQ ID NO: 1831029 - protein, 19 aa, Staphylococcus epidermidis
NYGARIVSWKYHDNNIILG

SEQ ID NO: 1831030 - protein, 25 aa, Staphylococcus epidermidis
NYGISLREFYVLYELYKAKDKKYKI

SEQ ID NO: 1831031 - protein, 19 aa, Staphylococcus epidermidis
NYILDCTLPEGIDPYDMHE

SEQ ID NO: 1831032 - protein, 18 aa, Staphylococcus epidermidis
NYKIKRDTDISYGGISEL

SEQ ID NO: 1831033 - protein, 20 aa, Staphylococcus epidermidis
NYKYFLKKYFNLNVSIIPFE

SEQ ID NO: 1831034 - protein, 26 aa, Staphylococcus epidermidis
NYMKKLKYPLSIIKQLHFEDTYHFML

SEQ ID NO: 1831035 - protein, 22 aa, Staphylococcus epidermidis
NYMRIQSLEFAWSLLEDERQKL

SEQ ID NO: 1831036 - protein, 25 aa, Staphylococcus epidermidis
NYNKDKVVMLLNYPNNPTGYTPNVE

SEQ ID NO: 1831037 - protein, 30 aa, Staphylococcus epidermidis
NYSIDDLPLGIYRFLKNKPKIYARTLDHPV

SEQ ID NO: 1831038 - protein, 21 aa, Staphylococcus epidermidis
NYSTPAWIAGEKYDTAPTVGK

SEQ ID NO: 1831039 - protein, 18 aa, Staphylococcus epidermidis
NYSTPAWIAGEKYDTPPT

SEQ ID NO: 1831040 - protein, 24 aa, Staphylococcus epidermidis
NYTIDLFNKKRRLFISAKSKVSFD

SEQ ID NO: 1831041 - protein, 18 aa, Staphylococcus epidermidis
NYTLGIKEQLIFPEIDYD

SEQ ID NO: 1831042 - protein, 17 aa, Staphylococcus epidermidis
PAALRCSQFVYKEQKNQ

SEQ ID NO: 1831043 - protein, 24 aa, Staphylococcus epidermidis
PADQLYEKFGFKSTEPYSKGMYIK

SEQ ID NO: 1831044 - protein, 25 aa, Staphylococcus epidermidis
PADVDVFLVAPKGPGHLVRRTFVEG

SEQ ID NO: 1831045 - protein, 29 aa, Staphylococcus epidermidis
PAEDTVLTAYKLIEILEEAGLPKGVVNFV

SEQ ID NO: 1831046 - protein, 17 aa, Staphylococcus epidermidis
PAFLSPEPGLQSGAMIM

SEQ ID NO: 1831047 - protein, 21 aa, Staphylococcus epidermidis
PAGLFASFYSGLRGMSVRIID

SEQ ID NO: 1831048 - protein, 26 aa, Staphylococcus epidermidis
PAIHQEYLLYVRYTAILIDPFSNPDD

SEQ ID NO: 1831049 - protein, 23 aa, Staphylococcus epidermidis
PANIYTLEIWVDNKYVFPSDKKT

SEQ ID NO: 1831050 - protein, 18 aa, Staphylococcus epidermidis
PAQKEAYNQAIQKAKDLI

SEQ ID NO: 1831051 - protein, 33 aa, Staphylococcus epidermidis
PAQQNAYNQAVAKALDIVNDRPTPTLSNETVQK

SEQ ID NO: 1831052 - protein, 20 aa, Staphylococcus epidermidis
PAQVIIRWNVQHGVVVIPKS

SEQ ID NO: 1831053 - protein, 23 aa, Staphylococcus epidermidis
PAQVVLRWHLAHDRIIIPKSKTP

SEQ ID NO: 1831054 - protein, 25 aa, Staphylococcus epidermidis
PASDVIELPYGAVPIDFAYAIHSEV

SEQ ID NO: 1831055 - protein, 19 aa, Staphylococcus epidermidis
PASILMSVYAETLARWSKS

SEQ ID NO: 1831056 - protein, 23 aa, Staphylococcus epidermidis
PCVTYNKVNTYDWFKEHLTNIDD

SEQ ID NO: 1831057 - protein, 25 aa, Staphylococcus epidermidis
PDARYKNWFPNFTLGDLISDNTATG

SEQ ID NO: 1831058 - protein, 24 aa, Staphylococcus epidermidis
PDDKRIMQDIFIPKGQNLGAIDGH

SEQ ID NO: 1831059 - protein, 24 aa, Staphylococcus epidermidis
PDDKRIMQDIFIPKGQSLGAVDGH

SEQ ID NO: 1831060 - protein, 22 aa, Staphylococcus epidermidis
PDDVTSPYRFFAAYQIYEDDTP

SEQ ID NO: 1831061 - protein, 19 aa, Staphylococcus epidermidis
PDEYLITELSSFQLLGIEK

SEQ ID NO: 1831062 - protein, 28 aa, Staphylococcus epidermidis
PDLFVKRTHFYDFLLLNSDGLTDYVRDY

SEQ ID NO: 1831063 - protein, 26 aa, Staphylococcus epidermidis
PDMEEELKILLIPKDPNDEKDVIVEI

SEQ ID NO: 1831064 - protein, 24 aa, Staphylococcus epidermidis
PDMPASRIANYIRRDIYEQTQLTA

SEQ ID NO: 1831065 - protein, 17 aa, Staphylococcus epidermidis
PDNIRVNAISAGPFRTL

SEQ ID NO: 1831066 - protein, 20 aa, Staphylococcus epidermidis
PDPFPTMVRDFQSVIGNEIK

SEQ ID NO: 1831067 - protein, 19 aa, Staphylococcus epidermidis
PDQIFDIALYRKASVKEGA

SEQ ID NO: 1831068 - protein, 17 aa, Staphylococcus epidermidis
PDQLDITLKVGRLAEVL

SEQ ID NO: 1831069 - protein, 17 aa, Staphylococcus epidermidis
PDRYFVDPTQLGEGGLK

SEQ ID NO: 1831070 - protein, 23 aa, Staphylococcus epidermidis
PDSKRHVSLKQLKYLAKIVPDHI

SEQ ID NO: 1831071 - protein, 18 aa, Staphylococcus epidermidis
PDSLLSLTDIIIPNETEA

SEQ ID NO: 1831072 - protein, 18 aa, Staphylococcus epidermidis
PDTTYPKGTFKVAHVENN

SEQ ID NO: 1831073 - protein, 24 aa, Staphylococcus epidermidis
PEDFPEYYPDRRYNFYVKNTEVID

SEQ ID NO: 1831074 - protein, 23 aa, Staphylococcus epidermidis
PEDPLKLIISYDGFKGYEVQQWF

SEQ ID NO: 1831075 - protein, 21 aa, Staphylococcus epidermidis
PEDYDALLIPGGFSPDHLRGD

SEQ ID NO: 1831076 - protein, 25 aa, Staphylococcus epidermidis
PEEDMPYLPDGRPIDIMLNPLGVPS

SEQ ID NO: 1831077 - protein, 17 aa, Staphylococcus epidermidis
PEELRKHLINNYSIGII

SEQ ID NO: 1831078 - protein, 22 aa, Staphylococcus epidermidis
PEFDHYFAIGKQTARTILKFNA

SEQ ID NO: 1831079 - protein, 18 aa, Staphylococcus epidermidis
PEFKNKHLRLAIAQAINK

SEQ ID NO: 1831080 - protein, 18 aa, Staphylococcus epidermidis
PEGKYSIFVAIKKSLYPL

SEQ ID NO: 1831081 - protein, 19 aa, Staphylococcus epidermidis
PEILLLDESLSALDLKLRT

SEQ ID NO: 1831082 - protein, 26 aa, Staphylococcus epidermidis
PEILNRMDDIVLFKPLSVSDMSMIVD

SEQ ID NO: 1831083 - protein, 20 aa, Staphylococcus epidermidis
PEKKLAYDNALSKAEQLLNQ

SEQ ID NO: 1831084 - protein, 26 aa, Staphylococcus epidermidis
PELDTYYHKVMLLSGALFNETKENAQ

SEQ ID NO: 1831085 - protein, 31 aa, Staphylococcus epidermidis
PEQALPKFAVLNEQLLVLSLLRTGTGKQIDP

SEQ ID NO: 1831086 - protein, 18 aa, Staphylococcus epidermidis
PEQLFAAGYSACFNSALS

SEQ ID NO: 1831087 - protein, 23 aa, Staphylococcus epidermidis
PETKMLYIETPSNPLLRVTDIKA

SEQ ID NO: 1831088 - protein, 25 aa, Staphylococcus epidermidis
PEYDSTFVKDLFEKVIRHVGENYLT

SEQ ID NO: 1831089 - protein, 18 aa, Staphylococcus epidermidis
PEYLIEKLTFMHAYNCIC

SEQ ID NO: 1831090 - protein, 18 aa, Staphylococcus epidermidis
PEYMIPVHFMKVDRIPIT

SEQ ID NO: 1831091 - protein, 17 aa, Staphylococcus epidermidis
PFAFDEWRYLPDGSDNP

SEQ ID NO: 1831092 - protein, 18 aa, Staphylococcus epidermidis
PFAILDIVGLNTAYNIAL

SEQ ID NO: 1831093 - protein, 30 aa, Staphylococcus epidermidis
PFESFAGFKSYRLLRPLEGNTYKIYFGFAS

SEQ ID NO: 1831094 - protein, 18 aa, Staphylococcus epidermidis
PFFELYREGDTESDNYIT

SEQ ID NO: 1831095 - protein, 18 aa, Staphylococcus epidermidis
PFHNNTRMLLRDLMIEGQ

SEQ ID NO: 1831096 - protein, 21 aa, Staphylococcus epidermidis
PFIKEAIQDSLKRLILPSIER

SEQ ID NO: 1831097 - protein, 23 aa, Staphylococcus epidermidis
PFKTIENLYKAYKFFEKNYSNIE

SEQ ID NO: 1831098 - protein, 21 aa, Staphylococcus epidermidis
PFPNTFKVLELSGNDIKRAIE

SEQ ID NO: 1831099 - protein, 23 aa, Staphylococcus epidermidis
PFVHSKGGIYIWLHTPPGYDSEA

SEQ ID NO: 1831100 - protein, 24 aa, Staphylococcus epidermidis
PFVHSKGGLYIWLHTPPGYDSEAF

SEQ ID NO: 1831101 - protein, 29 aa, Staphylococcus epidermidis
PGITGLEILSYIRKKQLNTRIIIVTTFKR

SEQ ID NO: 1831102 - protein, 17 aa, Staphylococcus epidermidis
PGLDFSPDKVLQGRLFS

SEQ ID NO: 1831103 - protein, 18 aa, Staphylococcus epidermidis
PGLIRFKLQVIPKKISFS

SEQ ID NO: 1831104 - protein, 23 aa, Staphylococcus epidermidis
PGLTICGGYQFLGTKYITPDGTE

SEQ ID NO: 1831105 - protein, 25 aa, Staphylococcus epidermidis
PGPREALDYMYKLGKRDGFSTHDVD

SEQ ID NO: 1831106 - protein, 19 aa, Staphylococcus epidermidis
PHCGYFATTKKLMRKVPGR

SEQ ID NO: 1831107 - protein, 25 aa, Staphylococcus epidermidis
PHECVMHSIRLFGEKVKPIVDKYFE

SEQ ID NO: 1831108 - protein, 20 aa, Staphylococcus epidermidis
PHESLVEQVLAYLINKGEKS

SEQ ID NO: 1831109 - protein, 28 aa, Staphylococcus epidermidis
PHIAFYTEAAIQHLIFDALDATMEVLNT

SEQ ID NO: 1831110 - protein, 19 aa, Staphylococcus epidermidis
PHINWDNVIFFTLQQNPST

SEQ ID NO: 1831111 - protein, 26 aa, Staphylococcus epidermidis
PHQFDEFIASFYYLKGQNFVVTHINS

SEQ ID NO: 1831112 - protein, 27 aa, Staphylococcus epidermidis
PHRGPIHFNLPFREPLTPDLNRVDLLT

SEQ ID NO: 1831113 - protein, 23 aa, Staphylococcus epidermidis
PHVETLIRLHKDYQFHIGAKTEM

SEQ ID NO: 1831114 - protein, 27 aa, Staphylococcus epidermidis
PHYTERLFYELLSEGYVPIIAHPERNK

SEQ ID NO: 1831115 - protein, 19 aa, Staphylococcus epidermidis
PIARLGYYDYTVVDEIFEM

SEQ ID NO: 1831116 - protein, 22 aa, Staphylococcus epidermidis
PIDRQIKALKRGPQIVVGTPGR

SEQ ID NO: 1831117 - protein, 34 aa, Staphylococcus epidermidis
PIGVVTQITPWNYPLLQASWKIAPALATGCSLVM

SEQ ID NO: 1831118 - protein, 25 aa, Staphylococcus epidermidis
PIIGICLGMQLLFQHSAEGDISGLE

SEQ ID NO: 1831119 - protein, 25 aa, Staphylococcus epidermidis
PIIGICLGMQLLFQHSAEGDVSGLE

SEQ ID NO: 1831120 - protein, 32 aa, Staphylococcus epidermidis
PIKDDDLFCGECGHKISRHPQSVRNAESEITK

SEQ ID NO: 1831121 - protein, 21 aa, Staphylococcus epidermidis
PIKDEWLVYWGGDNELFNYHY

SEQ ID NO: 1831122 - protein, 26 aa, Staphylococcus epidermidis
PILLKVNHLYGYFISLDLTYSSVEVM

SEQ ID NO: 1831123 - protein, 19 aa, Staphylococcus epidermidis
PILQEVNYWGTFPSSEKSN

SEQ ID NO: 1831124 - protein, 19 aa, Staphylococcus epidermidis
PILTKRRFSAFTGSGLEVF

SEQ ID NO: 1831125 - protein, 17 aa, Staphylococcus epidermidis
PILYQIWKKKHKKAYYK

SEQ ID NO: 1831126 - protein, 20 aa, Staphylococcus epidermidis
PIMRHHLNIYLNVDAPKGFK

SEQ ID NO: 1831127 - protein, 20 aa, Staphylococcus epidermidis
PIMVLMRKVIPAIVTGCSVV

SEQ ID NO: 1831128 - protein, 26 aa, Staphylococcus epidermidis
PINDSGKYLFHRKSMLKFLNDYAEEI

SEQ ID NO: 1831129 - protein, 17 aa, Staphylococcus epidermidis
PINLLKEHKTVGIFPTG

SEQ ID NO: 1831130 - protein, 17 aa, Staphylococcus epidermidis
PIPRFPGVTRDIALEVN

SEQ ID NO: 1831131 - protein, 22 aa, Staphylococcus epidermidis
PIQLKTDVPLYLIVIGKHLKQI

SEQ ID NO: 1831132 - protein, 25 aa, Staphylococcus epidermidis
PIQQGYLPLSWINKWKLYSPVQLPK

SEQ ID NO: 1831133 - protein, 24 aa, Staphylococcus epidermidis
PISAGYFVINPFEVVYYAGGTSNR

SEQ ID NO: 1831134 - protein, 30 aa, Staphylococcus epidermidis
PISFAHHVLTYFWMLERDKGRFEDSLKRID

SEQ ID NO: 1831135 - protein, 18 aa, Staphylococcus epidermidis
PITIWNSVPTLFQMLLEN

SEQ ID NO: 1831136 - protein, 18 aa, Staphylococcus epidermidis
PITMIGLDLAREAMFTHD

SEQ ID NO: 1831137 - protein, 17 aa, Staphylococcus epidermidis
PIVEKELIQRIGFVIEP

SEQ ID NO: 1831138 - protein, 18 aa, Staphylococcus epidermidis
PIVEKELIQRIGFVIEPE

SEQ ID NO: 1831139 - protein, 17 aa, Staphylococcus epidermidis
PIWTDRISQHLLDGETV

SEQ ID NO: 1831140 - protein, 20 aa, Staphylococcus epidermidis
PKAFYQVETLPYTSTGKLQR

SEQ ID NO: 1831141 - protein, 24 aa, Staphylococcus epidermidis
PKDFEYNKWFRMTASTAIPSTNSE

SEQ ID NO: 1831142 - protein, 25 aa, Staphylococcus epidermidis
PKEDLPLIYHALVDKVGKHLIHQLK

SEQ ID NO: 1831143 - protein, 18 aa, Staphylococcus epidermidis
PKEIFGDDYTFLPKDELL

SEQ ID NO: 1831144 - protein, 18 aa, Staphylococcus epidermidis
PKGKKIVAILTGNGLKDP

SEQ ID NO: 1831145 - protein, 24 aa, Staphylococcus epidermidis
PKGKTGLYILMPTPELKTGQINWK

SEQ ID NO: 1831146 - protein, 26 aa, Staphylococcus epidermidis
PKKAYQFVNRFTKRWLRKPEAKLTIE

SEQ ID NO: 1831147 - protein, 17 aa, Staphylococcus epidermidis
PKKYYQVKSLPYTSTGK

SEQ ID NO: 1831148 - protein, 22 aa, Staphylococcus epidermidis
PKLIEHLLEIRGLGIINVMTLF

SEQ ID NO: 1831149 - protein, 17 aa, Staphylococcus epidermidis
PKLKEIFNIVLTSQKKA

SEQ ID NO: 1831150 - protein, 24 aa, Staphylococcus epidermidis
PKMEDALVLGKYFDVPHQEFLDSE

SEQ ID NO: 1831151 - protein, 18 aa, Staphylococcus epidermidis
PKMILVTKLPLVVPKIPI

SEQ ID NO: 1831152 - protein, 21 aa, Staphylococcus epidermidis
PKMMLKVVLYAYTQSVFSGRK

SEQ ID NO: 1831153 - protein, 17 aa, Staphylococcus epidermidis
PKPRMYRLVEDNALINR

SEQ ID NO: 1831154 - protein, 19 aa, Staphylococcus epidermidis
PKQISFRVSESEYLKLRQS

SEQ ID NO: 1831155 - protein, 26 aa, Staphylococcus epidermidis
PKSASRERIFISPLARNMAEDKGLDI

SEQ ID NO: 1831156 - protein, 27 aa, Staphylococcus epidermidis
PKSERLRQFFDFITNFGIMIKGTGEDI

SEQ ID NO: 1831157 - protein, 17 aa, Staphylococcus epidermidis
PKTAHVTGSRLLKKKHI

SEQ ID NO: 1831158 - protein, 24 aa, Staphylococcus epidermidis
PKTIRTLITRLYKKGFIDRKKDNK

SEQ ID NO: 1831159 - protein, 23 aa, Staphylococcus epidermidis
PKYRRQVIYGKIKRDIGVILRQL

SEQ ID NO: 1831160 - protein, 20 aa, Staphylococcus epidermidis
PLANIQVYILSGTKLCGVGI

SEQ ID NO: 1831161 - protein, 25 aa, Staphylococcus epidermidis
PLCVKIGMELFYQTGPALIKSIKKR

SEQ ID NO: 1831162 - protein, 18 aa, Staphylococcus epidermidis
PLDIKGAARYQLTNLHYV

SEQ ID NO: 1831163 - protein, 19 aa, Staphylococcus epidermidis
PLFHSWHQYNTKASLSQLV

SEQ ID NO: 1831164 - protein, 20 aa, Staphylococcus epidermidis
PLFMKQLNEYCKQKDILIVV

SEQ ID NO: 1831165 - protein, 30 aa, Staphylococcus epidermidis
PLGAVHGLKYWFNYKSKDLLHFEPQGTLLK

SEQ ID NO: 1831166 - protein, 24 aa, Staphylococcus epidermidis
PLHDYQFLTFNVIGSPFGSSSKLN

SEQ ID NO: 1831167 - protein, 21 aa, Staphylococcus epidermidis
PLIASSIMSKKIAAGADAIVL

SEQ ID NO: 1831168 - protein, 18 aa, Staphylococcus epidermidis
PLIRFDLEYIKNNAKSVI

SEQ ID NO: 1831169 - protein, 19 aa, Staphylococcus epidermidis
PLIRIAFIDNEESVTFIVM

SEQ ID NO: 1831170 - protein, 17 aa, Staphylococcus epidermidis
PLKIVFKTTNPIVLMRT

SEQ ID NO: 1831171 - protein, 26 aa, Staphylococcus epidermidis
PLKNYNVPDFCQLIFITTPEVLNTSE

SEQ ID NO: 1831172 - protein, 17 aa, Staphylococcus epidermidis
PLKYNNLPHWRHLTKER

SEQ ID NO: 1831173 - protein, 25 aa, Staphylococcus epidermidis
PLLEPEIMFIVKEDLPYDADLQTIV

SEQ ID NO: 1831174 - protein, 17 aa, Staphylococcus epidermidis
PLLLDDDSHYRLYGIFL

SEQ ID NO: 1831175 - protein, 19 aa, Staphylococcus epidermidis
PLLQERLLHDFLGINRKLD

SEQ ID NO: 1831176 - protein, 19 aa, Staphylococcus epidermidis
PLPLMHIYKMVASFVDEPL

SEQ ID NO: 1831177 - protein, 29 aa, Staphylococcus epidermidis
PLPVEHQVLIIFALTKGYLDDIPVQDITR

SEQ ID NO: 1831178 - protein, 27 aa, Staphylococcus epidermidis
PLPVEYQVLIIYALTKGYLDDIPVEDI

SEQ ID NO: 1831179 - protein, 17 aa, Staphylococcus epidermidis
PLTLAYMGDAVLDQHIR

SEQ ID NO: 1831180 - protein, 17 aa, Staphylococcus epidermidis
PLTSIYNRLGFDFGTVG

SEQ ID NO: 1831181 - protein, 29 aa, Staphylococcus epidermidis
PLVKGRHYIIITLWNSRQAFYDWQNSQAY

SEQ ID NO: 1831182 - protein, 20 aa, Staphylococcus epidermidis
PLYHKYCELHDLLGRQYPEL

SEQ ID NO: 1831183 - protein, 22 aa, Staphylococcus epidermidis
PLYSDIVLPAATWYEKHDLSST

SEQ ID NO: 1831184 - protein, 18 aa, Staphylococcus epidermidis
PMAIKYYKVFKEMREAGL

SEQ ID NO: 1831185 - protein, 22 aa, Staphylococcus epidermidis
PMGCQTGFYVSFINHDDYEDVL

SEQ ID NO: 1831186 - protein, 18 aa, Staphylococcus epidermidis
PMGGLQERIWNSLQIMND

SEQ ID NO: 1831187 - protein, 29 aa, Staphylococcus epidermidis
PMHPEFSYPFQYLCGAGVAYKLAQALISH

SEQ ID NO: 1831188 - protein, 21 aa, Staphylococcus epidermidis
PMKRPGVPEELQGAALYLASD

SEQ ID NO: 1831189 - protein, 23 aa, Staphylococcus epidermidis
PMMKLKQIYPNTLALTNKTFEIN

SEQ ID NO: 1831190 - protein, 25 aa, Staphylococcus epidermidis
PMRIKEFELLWYLASRENDVISKSE

SEQ ID NO: 1831191 - protein, 18 aa, Staphylococcus epidermidis
PMSNKALFKFEHGAIIRG

SEQ ID NO: 1831192 - protein, 28 aa, Staphylococcus epidermidis
PMTADMYYLMQLLYCNNYTYDTLIEHHT

SEQ ID NO: 1831193 - protein, 17 aa, Staphylococcus epidermidis
PMVIKMGRYGKFMACSN

SEQ ID NO: 1831194 - protein, 20 aa, Staphylococcus epidermidis
PNDPMQALKLMFEATEQTKE

SEQ ID NO: 1831195 - protein, 30 aa, Staphylococcus epidermidis
PNEKYPIISQFRTFFKTTYKERTITNGTTE

SEQ ID NO: 1831196 - protein, 18 aa, Staphylococcus epidermidis
PNETGALYYREGFITQLM

SEQ ID NO: 1831197 - protein, 17 aa, Staphylococcus epidermidis
PNFFSLHTKFEELYDEA

SEQ ID NO: 1831198 - protein, 40 aa, Staphylococcus epidermidis
PNGLIYFDGRYYISHQWFPLGAVHGLKYWFNYTSDDLVHF

SEQ ID NO: 1831199 - protein, 20 aa, Staphylococcus epidermidis
PNHFHSGFELIYMLDGEMTT

SEQ ID NO: 1831200 - protein, 20 aa, Staphylococcus epidermidis
PNHSKFLGIGLRLIPKPLRD

SEQ ID NO: 1831201 - protein, 20 aa, Staphylococcus epidermidis
PNIFAYTRTLNNQTILVVGN

SEQ ID NO: 1831202 - protein, 26 aa, Staphylococcus epidermidis
PNMKVSEVLYYLGFLSKINQKDFDKY

SEQ ID NO: 1831203 - protein, 17 aa, Staphylococcus epidermidis
PNMLYLIKPEVTEDDIY

SEQ ID NO: 1831204 - protein, 22 aa, Staphylococcus epidermidis
PNNILGISYLKAMQQFAPRMSA

SEQ ID NO: 1831205 - protein, 28 aa, Staphylococcus epidermidis
PNQNKTNQSYHQPAQSTPQQSSQHNNQS

SEQ ID NO: 1831206 - protein, 17 aa, Staphylococcus epidermidis
PNRIMFQSIVSGGLAKS

SEQ ID NO: 1831207 - protein, 21 aa, Staphylococcus epidermidis
PNRLYPKKPYDEYFYVHDVDE

SEQ ID NO: 1831208 - protein, 20 aa, Staphylococcus epidermidis
PNSIFVKQLLVTQPQTFGRA

SEQ ID NO: 1831209 - protein, 24 aa, Staphylococcus epidermidis
PNVKKEHWGFDDPAGKSWSEFQRV

SEQ ID NO: 1831210 - protein, 18 aa, Staphylococcus epidermidis
PNVRRLTEALFMTRGAVS

SEQ ID NO: 1831211 - protein, 26 aa, Staphylococcus epidermidis
PPELSEQFPYIRQLLDAYHIKRYELE

SEQ ID NO: 1831212 - protein, 19 aa, Staphylococcus epidermidis
PPFSTMFEPLLDLNDYKKL

SEQ ID NO: 1831213 - protein, 28 aa, Staphylococcus epidermidis
PPGVYAKDIILYLINQYGVDFGTGYALE

SEQ ID NO: 1831214 - protein, 17 aa, Staphylococcus epidermidis
PPLSITKKQLEKGIEIL

SEQ ID NO: 1831215 - protein, 24 aa, Staphylococcus epidermidis
PPRLQNGTSWFYFATDQWKYEESN

SEQ ID NO: 1831216 - protein, 20 aa, Staphylococcus epidermidis
PPVKPVVMAFTKSYDRPYEQ

SEQ ID NO: 1831217 - protein, 24 aa, Staphylococcus epidermidis
PQCFNTAYKILKMIQRQFDVIIDE

SEQ ID NO: 1831218 - protein, 20 aa, Staphylococcus epidermidis
PQFIGKPEPIIMNKAIEILG

SEQ ID NO: 1831219 - protein, 28 aa, Staphylococcus epidermidis
PQIQGFFDIPIDHLMGVPILAQHFENDP

SEQ ID NO: 1831220 - protein, 26 aa, Staphylococcus epidermidis
PQKGNINIYFRSWYSHFLDYKENKIK

SEQ ID NO: 1831221 - protein, 28 aa, Staphylococcus epidermidis
PQKNSTLQLVIYYLMGKASQKPMFENIR

SEQ ID NO: 1831222 - protein, 26 aa, Staphylococcus epidermidis
PQPNGWILHIPSCYLGIAQAARDYAV

SEQ ID NO: 1831223 - protein, 29 aa, Staphylococcus epidermidis
PQPTRAEHVKLLIPLLEKNRDEIAQLYVK

SEQ ID NO: 1831224 - protein, 20 aa, Staphylococcus epidermidis
PQSWKNFDELERKKAIDIGN

SEQ ID NO: 1831225 - protein, 18 aa, Staphylococcus epidermidis
PQYPMIPCNESCSVVGKV

SEQ ID NO: 1831226 - protein, 19 aa, Staphylococcus epidermidis
PRAIDYLDLNWPKDTEFVY

SEQ ID NO: 1831227 - protein, 20 aa, Staphylococcus epidermidis
PRDEWVFPIQTHDSRIVEVT

SEQ ID NO: 1831228 - protein, 20 aa, Staphylococcus epidermidis
PREHSFPTPPVKPVVMAFTK

SEQ ID NO: 1831229 - protein, 23 aa, Staphylococcus epidermidis
PRFTDRFELFIVGREHANAFTEL

SEQ ID NO: 1831230 - protein, 17 aa, Staphylococcus epidermidis
PRGLFRKKKFSPVVGDI

SEQ ID NO: 1831231 - protein, 18 aa, Staphylococcus epidermidis
PRGLFRKKKFSPVVGDIV

SEQ ID NO: 1831232 - protein, 25 aa, Staphylococcus epidermidis
PRLDDLILMQLIHSPSYSSYVQDLY

SEQ ID NO: 1831233 - protein, 25 aa, Staphylococcus epidermidis
PRVENGELPIWIATGGTPESSLRAG

SEQ ID NO: 1831234 - protein, 20 aa, Staphylococcus epidermidis
PRVKFEKVFAEHFLKLYDET

SEQ ID NO: 1831235 - protein, 17 aa, Staphylococcus epidermidis
PSALFRLTEQEAGDRFY

SEQ ID NO: 1831236 - protein, 29 aa, Staphylococcus epidermidis
PSDETVLRLITFKLIPLLNQTQGKKKPIQ

SEQ ID NO: 1831237 - protein, 34 aa, Staphylococcus epidermidis
PSEETTLLTLRLAELFRASTIPAGLFQIVPGTGE

SEQ ID NO: 1831238 - protein, 17 aa, Staphylococcus epidermidis
PSEETTLLTVRLAELFR

SEQ ID NO: 1831239 - protein, 18 aa, Staphylococcus epidermidis
PSFDFIKGDKKFLLERIK

SEQ ID NO: 1831240 - protein, 22 aa, Staphylococcus epidermidis
PSIDYIIFTDGFEIAGLNRAKA

SEQ ID NO: 1831241 - protein, 33 aa, Staphylococcus epidermidis
PSIDYIMFTDGFNLKGLNRATATYKFAGGKGIN

SEQ ID NO: 1831242 - protein, 21 aa, Staphylococcus epidermidis
PSKIERLDYSCSAFMMYIGID

SEQ ID NO: 1831243 - protein, 22 aa, Staphylococcus epidermidis
PSKLPLDKRMHAIRQRLGNVEW

SEQ ID NO: 1831244 - protein, 26 aa, Staphylococcus epidermidis
PSLDIDAWIVSIYLAHHFISQSSDVT

SEQ ID NO: 1831245 - protein, 19 aa, Staphylococcus epidermidis
PSLPIDLIIDYAHTADGMN

SEQ ID NO: 1831246 - protein, 29 aa, Staphylococcus epidermidis
PSLRWDNYYGLTHFIVPPVAKEIEAPKKD

SEQ ID NO: 1831247 - protein, 17 aa, Staphylococcus epidermidis
PSMNMIPMTYHMDAWYF

SEQ ID NO: 1831248 - protein, 23 aa, Staphylococcus epidermidis
PSMNMVPMTYNMDAWYFDGQKVA

SEQ ID NO: 1831249 - protein, 25 aa, Staphylococcus epidermidis
PSPTGYLHIGNARTALFNYLFAKHY

SEQ ID NO: 1831250 - protein, 23 aa, Staphylococcus epidermidis
PSSEILSSVLMLEHLGWQEAADK

SEQ ID NO: 1831251 - protein, 20 aa, Staphylococcus epidermidis
PSTDVPLDLYLSVLGMPGQT

SEQ ID NO: 1831252 - protein, 32 aa, Staphylococcus epidermidis
PSTRYNNYLFNENIFQMFKKGVVFVNCARGSL

SEQ ID NO: 1831253 - protein, 18 aa, Staphylococcus epidermidis
PTAALLNQLIYWSDRTHR

SEQ ID NO: 1831254 - protein, 23 aa, Staphylococcus epidermidis
PTAKYIIDPLKKQLEALEYIGLS

SEQ ID NO: 1831255 - protein, 17 aa, Staphylococcus epidermidis
PTAYQFFNDPMLSVFLY

SEQ ID NO: 1831256 - protein, 26 aa, Staphylococcus epidermidis
PTDVELNHHYLWRFAKKMPKSGHIEI

SEQ ID NO: 1831257 - protein, 23 aa, Staphylococcus epidermidis
PTEQAPKLLLKGTGDLKGSSTGS

SEQ ID NO: 1831258 - protein, 21 aa, Staphylococcus epidermidis
PTEYIYQIFYTWNKKEYLASE

SEQ ID NO: 1831259 - protein, 25 aa, Staphylococcus epidermidis
PTEYIYQIFYVWNQKEYLASEIYDL

SEQ ID NO: 1831260 - protein, 27 aa, Staphylococcus epidermidis
PTFSDTGWLPLVLSNGVQPYSTGYTPQ

SEQ ID NO: 1831261 - protein, 36 aa, Staphylococcus epidermidis; identical to SEQ ID NO: 1680621

SEQ ID NO: 1831262 - protein, 28 aa, Staphylococcus epidermidis
PTGVYAKDIILYLINQYGVDFGTGYAPK

SEQ ID NO: 1831263 - protein, 30 aa, Staphylococcus epidermidis
PTIIDLIPEYAHLNIFPVGRLDKDTEGLLL

SEQ ID NO: 1831264 - protein, 25 aa, Staphylococcus epidermidis
PTLTNIPASYWTTASKREAHLGDLY

SEQ ID NO: 1831265 - protein, 23 aa, Staphylococcus epidermidis
PTNQAPKLLLKGSGDLKGSSIGS

SEQ ID NO: 1831266 - protein, 17 aa, Staphylococcus epidermidis
PTQFDVIVTENLFGDIL

SEQ ID NO: 1831267 - protein, 20 aa, Staphylococcus epidermidis
PTQQAPKLLLKGTGDLKGSS

SEQ ID NO: 1831268 - protein, 32 aa, Staphylococcus epidermidis
PTSFHDKYEWLLEFFPFLDPQHFVFCGRKNII

SEQ ID NO: 1831269 - protein, 33 aa, Staphylococcus epidermidis
PTSFHDKYEWLLEFFPFLNPQHFVFCGRKNIVN

SEQ ID NO: 1831270 - protein, 26 aa, Staphylococcus epidermidis
PTSGKELFKRVLPDVLIKLEKAGYET

SEQ ID NO: 1831271 - protein, 17 aa, Staphylococcus epidermidis
PTSHRIFDFFNAFIGTH

SEQ ID NO: 1831272 - protein, 17 aa, Staphylococcus epidermidis
PTTILQGLDIKPVNLPK

SEQ ID NO: 1831273 - protein, 18 aa, Staphylococcus epidermidis
PTVEVIFTILHAGGKFGQ

SEQ ID NO: 1831274 - protein, 24 aa, Staphylococcus epidermidis
PVCGFPWIHWVVANVSVNSDTIDI

SEQ ID NO: 1831275 - protein, 17 aa, Staphylococcus epidermidis
PVDDVTKYGPVDGDPIT

SEQ ID NO: 1831276 - protein, 21 aa, Staphylococcus epidermidis
PVLALSLSFDHRQIDGATGQN

SEQ ID NO: 1831277 - protein, 17 aa, Staphylococcus epidermidis
PVLLPKFVELMEQGNPS

SEQ ID NO: 1831278 - protein, 27 aa, Staphylococcus epidermidis
PVLTKILSFHILKVDGTMILLWRNGEM

SEQ ID NO: 1831279 - protein, 20 aa, Staphylococcus epidermidis
PVMNTFFKRNDKLVQLRFAN

SEQ ID NO: 1831280 - protein, 24 aa, Staphylococcus epidermidis
PVNPTIIQLMQYLKKRHIPMAIAT

SEQ ID NO: 1831281 - protein, 18 aa, Staphylococcus epidermidis
PVPLAPMSNKALFKFEHG

SEQ ID NO: 1831282 - protein, 20 aa, Staphylococcus epidermidis
PVRYDLLPIGTRRSGEALHT

SEQ ID NO: 1831283 - protein, 22 aa, Staphylococcus epidermidis
PVSFEDFIYYIGNNKKIFKHLL

SEQ ID NO: 1831284 - protein, 21 aa, Staphylococcus epidermidis
PVTIISVFRGTDSPYFELHSA

SEQ ID NO: 1831285 - protein, 19 aa, Staphylococcus epidermidis
PVVGFIGGQTAPPGKRMGH

SEQ ID NO: 1831286 - protein, 29 aa, Staphylococcus epidermidis
PVVKGRHYIIITLWNSRQAFYDWQNSKAY

SEQ ID NO: 1831287 - protein, 17 aa, Staphylococcus epidermidis
PWDKIQTHETLKRYLLE

SEQ ID NO: 1831288 - protein, 18 aa, Staphylococcus epidermidis
PYEGHLWIMDPIDGTSNL

SEQ ID NO: 1831289 - protein, 21 aa, Staphylococcus epidermidis
PYENELYYLPKPLIKIDSKEE

SEQ ID NO: 1831290 - protein, 18 aa, Staphylococcus epidermidis
PYETPVFDFIKMNKESEY

SEQ ID NO: 1831291 - protein, 31 aa, Staphylococcus epidermidis
PYGTVLIIGPFNYPVQLVFEPLIGAIAAGNT

SEQ ID NO: 1831292 - protein, 18 aa, Staphylococcus epidermidis
PYIKLTQPILDKHDIHTG

SEQ ID NO: 1831293 - protein, 25 aa, Staphylococcus epidermidis
PYPDNFDFTTLDKSFRENYGTLGLA

SEQ ID NO: 1831294 - protein, 20 aa, Staphylococcus epidermidis
PYRQHLIPEFNQVRQLSRQH

SEQ ID NO: 1831295 - protein, 19 aa, Staphylococcus epidermidis
PYRRLPEEEWRRVYNAHQP

SEQ ID NO: 1831296 - protein, 19 aa, Staphylococcus epidermidis
PYRVKRWTSYDASFGAMEP

SEQ ID NO: 1831297 - protein, 18 aa, Staphylococcus epidermidis
PYSLRHTHASYLLSKGIP

SEQ ID NO: 1831298 - protein, 24 aa, Staphylococcus epidermidis
PYSNFKVGAYLKTKDGRCFYGANV

SEQ ID NO: 1831299 - protein, 24 aa, Staphylococcus epidermidis
PYSNFKVGAYLRTKDGRCFHGANV

SEQ ID NO: 1831300 - protein, 29 aa, Staphylococcus epidermidis
PYSPNGPPPGYAFHWAHPGIDLPYHYEKV

SEQ ID NO: 1831301 - protein, 20 aa, Staphylococcus epidermidis
PYSSIYFLLTHEKISHFHRI

SEQ ID NO: 1831302 - protein, 17 aa, Staphylococcus epidermidis
PYVFVGYHTEKIKHLLD

SEQ ID NO: 1831303 - protein, 25 aa, Staphylococcus epidermidis
QAAILGMHSIITRPIAIDKDTIENR

SEQ ID NO: 1831304 - protein, 25 aa, Staphylococcus epidermidis
QACLDFQLFNKSEGLYIVWDSIDEL

SEQ ID NO: 1831305 - protein, 25 aa, Staphylococcus epidermidis
QADAINKVYGLDTLNPAQKSKEVQD

SEQ ID NO: 1831306 - protein, 24 aa, Staphylococcus epidermidis
QAEKEIEILFAKRLKEIKQIIANM

SEQ ID NO: 1831307 - protein, 38 aa, Staphylococcus epidermidis
QAGYENIPIMSYGIKYASSFFGPFRDAADSAPSFGDRK

SEQ ID NO: 1831308 - protein, 32 aa, Staphylococcus epidermidis
QAHGTALTYAERYFLMKFFNIPTDEDDADAKQ

SEQ ID NO: 1831309 - protein, 30 aa, Staphylococcus epidermidis
QAHTQMFVYGLFIYNKWRGMGTLNSVDVIN

SEQ ID NO: 1831310 - protein, 20 aa, Staphylococcus epidermidis
QAIIYNITIAQGGDLKITFD

SEQ ID NO: 1831311 - protein, 28 aa, Staphylococcus epidermidis
QAKGSTYYGIALALLRISKALLNNENSV

SEQ ID NO: 1831312 - protein, 24 aa, Staphylococcus epidermidis
QANNHLVILIMVFSSGHVENIHVV

SEQ ID NO: 1831313 - protein, 20 aa, Staphylococcus epidermidis
QANNLYTHTLKKSNNQNNQH

SEQ ID NO: 1831314 - protein, 19 aa, Staphylococcus epidermidis
QAQINQLLQKFKGERQQID

SEQ ID NO: 1831315 - protein, 17 aa, Staphylococcus epidermidis
QARAFYIDELGLEHISN

SEQ ID NO: 1831316 - protein, 17 aa, Staphylococcus epidermidis
QARELVFERVRYAYNDV

SEQ ID NO: 1831317 - protein, 26 aa, Staphylococcus epidermidis
QARRILDRLVGYNISPVLWKKVKKGL

SEQ ID NO: 1831318 - protein, 18 aa, Staphylococcus epidermidis
QASLALALGLSEIVQQES

SEQ ID NO: 1831319 - protein, 22 aa, Staphylococcus epidermidis
QAVFEMMNWWFEKGIDGFRVDA

SEQ ID NO: 1831320 - protein, 33 aa, Staphylococcus epidermidis
QAYRAKLLRQLHYPIKFVFLDFIQSENIQTLTS

SEQ ID NO: 1831321 - protein, 19 aa, Staphylococcus epidermidis
QAYSRIFKRVGINARPVVA

SEQ ID NO: 1831322 - protein, 29 aa, Staphylococcus epidermidis
QCFDLANQYWYYVTGHALRGLYAKDIPFA

SEQ ID NO: 1831323 - protein, 24 aa, Staphylococcus epidermidis
QCNKHRYQLLLNYTGLEIDGEISA

SEQ ID NO: 1831324 - protein, 18 aa, Staphylococcus epidermidis
QDAIPDNAPILYKSGAFK

SEQ ID NO: 1831325 - protein, 23 aa, Staphylococcus epidermidis
QDAKVLFELNKNILLKGPTGSGK

SEQ ID NO: 1831326 - protein, 24 aa, Staphylococcus epidermidis
QDASTNLPYIYLSAGVSAELFQET

SEQ ID NO: 1831327 - protein, 24 aa, Staphylococcus epidermidis
QDDERLFFIGEAIRRGTTLEEIHE

SEQ ID NO: 1831328 - protein, 18 aa, Staphylococcus epidermidis
QDELIERLVLGHNGDGIQ

SEQ ID NO: 1831329 - protein, 27 aa, Staphylococcus epidermidis
QDEYLAENIFWVPKEARWQYINDNAKK

SEQ ID NO: 1831330 - protein, 27 aa, Staphylococcus epidermidis
QDIANPFGMILSLALCLRESLNQPKAA

SEQ ID NO: 1831331 - protein, 24 aa, Staphylococcus epidermidis
QDIQRIEHMIRNALIIEDNGDNNV

SEQ ID NO: 1831332 - protein, 17 aa, Staphylococcus epidermidis
QDLGYFRATNHLGGFEG

SEQ ID NO: 1831333 - protein, 18 aa, Staphylococcus epidermidis
QDMMLISGKQFEVGNAVY

SEQ ID NO: 1831334 - protein, 25 aa, Staphylococcus epidermidis
QDNERMLTLFRGGPVVWISNEDAEA

SEQ ID NO: 1831335 - protein, 27 aa, Staphylococcus epidermidis
QDQPYHSWFNIVQHFLPSDSHDLLDIG

SEQ ID NO: 1831336 - protein, 23 aa, Staphylococcus epidermidis
QDSLKRLILPSIEREIRGDLTQN

SEQ ID NO: 1831337 - protein, 23 aa, Staphylococcus epidermidis
QDTRKVIIPFEELKYLSNYYTRS

SEQ ID NO: 1831338 - protein, 23 aa, Staphylococcus epidermidis
QDVWSVLFDNRKYKDLLDEVNKL

SEQ ID NO: 1831339 - protein, 21 aa, Staphylococcus epidermidis
QDWAGMLLRMYQRYCEQNGFK

SEQ ID NO: 1831340 - protein, 24 aa, Staphylococcus epidermidis
QDWASMLLRMYQRYGEQKGFKVET

SEQ ID NO: 1831341 - protein, 22 aa, Staphylococcus epidermidis
QDYAIIINAFMSTGHAIVEHGD

SEQ ID NO: 1831342 - protein, 24 aa, Staphylococcus epidermidis
QDYALFPHLNVYDNIAYGLKLKKQ

SEQ ID NO: 1831343 - protein, 24 aa, Staphylococcus epidermidis
QDYFNTGAAFQLLLKQRLIANQID

SEQ ID NO: 1831344 - protein, 20 aa, Staphylococcus epidermidis
QEAKFKGYLKEKEALEQNKS

SEQ ID NO: 1831345 - protein, 17 aa, Staphylococcus epidermidis
QEAPISLEFYKQFIGGE

SEQ ID NO: 1831346 - protein, 25 aa, Staphylococcus epidermidis
QEAPLDFYDVFKEKSVLFKDIFNST

SEQ ID NO: 1831347 - protein, 28 aa, Staphylococcus epidermidis
QEAQLSNKIGGYFLNKLDLNMINSSDEL

SEQ ID NO: 1831348 - protein, 23 aa, Staphylococcus epidermidis
QECYQFLRDLIFQDTELEETYKW

SEQ ID NO: 1831349 - protein, 19 aa, Staphylococcus epidermidis
QEEDYTYFFNGVKHILKAK

SEQ ID NO: 1831350 - protein, 17 aa, Staphylococcus epidermidis
QEFESYLLKRHRELKSK

SEQ ID NO: 1831351 - protein, 25 aa, Staphylococcus epidermidis
QEGDTVPIYLKRNPNFKFPQNEETP

SEQ ID NO: 1831352 - protein, 26 aa, Staphylococcus epidermidis
QEILKLSHIQLVGLAFNFMCFKSEAP

SEQ ID NO: 1831353 - protein, 26 aa, Staphylococcus epidermidis
QEKDRLLPGGYLFLSDLVGNPSLLNR

SEQ ID NO: 1831354 - protein, 23 aa, Staphylococcus epidermidis
QEKEPEVIPQKRSITILYGSETG

SEQ ID NO: 1831355 - protein, 24 aa, Staphylococcus epidermidis
QEKINELPKLKEKLKHFNELGIGK

SEQ ID NO: 1831356 - protein, 25 aa, Staphylococcus epidermidis
QEKNYQALHYISEGTDLIVGLPEGH

SEQ ID NO: 1831357 - protein, 21 aa, Staphylococcus epidermidis
QELINLIGFVIEPQDLFSHLI

SEQ ID NO: 1831358 - protein, 24 aa, Staphylococcus epidermidis
QEMRPLIVMSPKSLLRNKTVAKPI

SEQ ID NO: 1831359 - protein, 27 aa, Staphylococcus epidermidis
QEQLLDDYRWQFGIPPKGNANYAWIEH

SEQ ID NO: 1831360 - protein, 25 aa, Staphylococcus epidermidis
QERGITFGLFRLSVGLEDPEEIIAD

SEQ ID NO: 1831361 - protein, 26 aa, Staphylococcus epidermidis
QERKINQFFTLILSNHYIKYELKIDE

SEQ ID NO: 1831362 - protein, 23 aa, Staphylococcus epidermidis
QERQAVWVIYAVCRIIDDSIDVH

SEQ ID NO: 1831363 - protein, 18 aa, Staphylococcus epidermidis
QESFHIADNERTLYDWAS

SEQ ID NO: 1831364 - protein, 33 aa, Staphylococcus epidermidis
QETMKYFLIGYKPKNMFFHIAVSPINLITSDNP

SEQ ID NO: 1831365 - protein, 19 aa, Staphylococcus epidermidis
QETQGKFLIIGTGGIFSSE

SEQ ID NO: 1831366 - protein, 25 aa, Staphylococcus epidermidis
QEVNELINFYKKVLARIENEVLQKL

SEQ ID NO: 1831367 - protein, 26 aa, Staphylococcus epidermidis
QEVPRKLFLLSPLLDATLTNPNITQT

SEQ ID NO: 1831368 - protein, 18 aa, Staphylococcus epidermidis
QEYAPILYQIWKKKHKKA

SEQ ID NO: 1831369 - protein, 18 aa, Staphylococcus epidermidis
QEYGLKFEPCATKYLKIS

SEQ ID NO: 1831370 - protein, 22 aa, Staphylococcus epidermidis
QEYLDDLGFNLVGYGCTTCIGN

SEQ ID NO: 1831371 - protein, 21 aa, Staphylococcus epidermidis
QFDETFMMYLPRLCEHCLNPS

SEQ ID NO: 1831372 - protein, 20 aa, Staphylococcus epidermidis
QFDNLKWLGLDWDESIDKDK

SEQ ID NO: 1831373 - protein, 19 aa, Staphylococcus epidermidis
QFELIKFRKGVDEKDLSIN

SEQ ID NO: 1831374 - protein, 18 aa, Staphylococcus epidermidis
QFERFCRDNALWDSMRSC

SEQ ID NO: 1831375 - protein, 26 aa, Staphylococcus epidermidis
QFGAEFTLQTYLISKGQRVIKNEEET

SEQ ID NO: 1831376 - protein, 24 aa, Staphylococcus epidermidis
QFGESLPIYKPTLPPMVFGTRDKK

SEQ ID NO: 1831377 - protein, 30 aa, Staphylococcus epidermidis
QFHHSQFFSDLFDFYYDLFHDGHDERWATF

SEQ ID NO: 1831378 - protein, 24 aa, Staphylococcus epidermidis
QFINDLLQLEGVKSIFYVMDFLAI

SEQ ID NO: 1831379 - protein, 22 aa, Staphylococcus epidermidis
QFKALRRFFKIYVRGIKGASQL

SEQ ID NO: 1831380 - protein, 17 aa, Staphylococcus epidermidis
QFKIIKRYNEDPIIKDI

SEQ ID NO: 1831381 - protein, 24 aa, Staphylococcus epidermidis
QFKTQDRVLIIFGPEGGLSDSEIA

SEQ ID NO: 1831382 - protein, 19 aa, Staphylococcus epidermidis
QFLIENLRKSLVNKRNVIE

SEQ ID NO: 1831383 - protein, 18 aa, Staphylococcus epidermidis
QFMYTSNILFYTVDYNHV

SEQ ID NO: 1831384 - protein, 19 aa, Staphylococcus epidermidis
QFNDKYVSNLFFENSTRTK

SEQ ID NO: 1831385 - protein, 35 aa, Staphylococcus epidermidis
QFNGQTFLETFLAPTKLYVKPILELKKHVDIKAMS

SEQ ID NO: 1831386 - protein, 20 aa, Staphylococcus epidermidis
QFNKFLYERDIDGYYLIVQQ

SEQ ID NO: 1831387 - protein, 29 aa, Staphylococcus epidermidis
QFNLLNSSAYYKYLSRRIGSIVETTLSAL

SEQ ID NO: 1831388 - protein, 21 aa, Staphylococcus epidermidis
QFNPNAIYINCPLFNEMPEIL

SEQ ID NO: 1831389 - protein, 18 aa, Staphylococcus epidermidis
QFRLNDIGFIFQSSHLIP

SEQ ID NO: 1831390 - protein, 19 aa, Staphylococcus epidermidis
QFRYDHYLQLFNEISNRKV

SEQ ID NO: 1831391 - protein, 30 aa, Staphylococcus epidermidis
QFSGGMKRRLSLAMALLGQPDLIILDEPTV

SEQ ID NO: 1831392 - protein, 30 aa, Staphylococcus epidermidis
QFSTQLLDRFLVIAHSYHLEPRILITKRDL

SEQ ID NO: 1831393 - protein, 25 aa, Staphylococcus epidermidis
QFSTSKFKGYLKYINDEKSNKANHD

SEQ ID NO: 1831394 - protein, 28 aa, Staphylococcus epidermidis
QFTGDTIEHLWRVTSLNQAVTLGIDDVK

SEQ ID NO: 1831395 - protein, 27 aa, Staphylococcus epidermidis
QFTQRISMPFLRSPFVHHIHPQPFHLK

SEQ ID NO: 1831396 - protein, 28 aa, Staphylococcus epidermidis
QFVEKSGWTDIFIYPGFEYKAIDGLITN

SEQ ID NO: 1831397 - protein, 18 aa, Staphylococcus epidermidis
QFVILGHYQLIDALLEKN

SEQ ID NO: 1831398 - protein, 29 aa, Staphylococcus epidermidis
QGEAVSMEWLFRPLLKMLAEGDPVPVEDI

SEQ ID NO: 1831399 - protein, 25 aa, Staphylococcus epidermidis
QGECIDALQLRFILDWNSQSHRPQF

SEQ ID NO: 1831400 - protein, 17 aa, Staphylococcus epidermidis
QGEGRVIGRKTMFVRTA

SEQ ID NO: 1831401 - protein, 17 aa, Staphylococcus epidermidis
QGFVEYHNKKNTQLPQM

SEQ ID NO: 1831402 - protein, 20 aa, Staphylococcus epidermidis
QGHTYLPRTIVIETTQNLLN

SEQ ID NO: 1831403 - protein, 27 aa, Staphylococcus epidermidis
QGIARNFNQYIKLLNTRKLRNELSVDD

SEQ ID NO: 1831404 - protein, 25 aa, Staphylococcus epidermidis
QGKPNRLYILYPLTELELRQLESTR

SEQ ID NO: 1831405 - protein, 19 aa, Staphylococcus epidermidis
QGLTQAQNALQGSHLLENA

SEQ ID NO: 1831406 - protein, 26 aa, Staphylococcus epidermidis
QGMIKSDFFIINKTDLAPYVGASLNQ

SEQ ID NO: 1831407 - protein, 24 aa, Staphylococcus epidermidis
QGNKFFPESFFREPLYDRDRNERE

SEQ ID NO: 1831408 - protein, 25 aa, Staphylococcus epidermidis
QGNLDPSLLLAPWDVIESRLKDILN

SEQ ID NO: 1831409 - protein, 17 aa, Staphylococcus epidermidis
QGPAIEYTLVGPNIEFL

SEQ ID NO: 1831410 - protein, 26 aa, Staphylococcus epidermidis
QGPDFPTAGLILGKSGIRRAYETGRG

SEQ ID NO: 1831411 - protein, 29 aa, Staphylococcus epidermidis
QGQFRKNGLPYIMHPIQVAGILTEMRLDG

SEQ ID NO: 1831412 - protein, 40 aa, Staphylococcus epidermidis
QGSEFPIVIMPIVKQYFRMLQRPILYTGLTRAKQSLVLLG

SEQ ID NO: 1831413 - protein, 27 aa, Staphylococcus epidermidis
QGTIRAPQWRGGGIVFGPTPRSYSYKM

SEQ ID NO: 1831414 - protein, 24 aa, Staphylococcus epidermidis
QGVRLKAYFNELTFDDTLRTNIKN

SEQ ID NO: 1831415 - protein, 18 aa, Staphylococcus epidermidis
QGWSLVNPDYSKTLNWQK

SEQ ID NO: 1831416 - protein, 24 aa, Staphylococcus epidermidis
QHFSQLMRHYFPNKTLKTLTSDDI

SEQ ID NO: 1831417 - protein, 19 aa, Staphylococcus epidermidis
QHFVELFRKTDVSAGLAAS

SEQ ID NO: 1831418 - protein, 21 aa, Staphylococcus epidermidis
QHHAKFIYISTISVGAVFEAH

SEQ ID NO: 1831419 - protein, 24 aa, Staphylococcus epidermidis
QHLNQYLPKYMIPNTLTAISEIPL

SEQ ID NO: 1831420 - protein, 17 aa, Staphylococcus epidermidis
QHNVIVSLYLAGGDVDL

SEQ ID NO: 1831421 - protein, 31 aa, Staphylococcus epidermidis
QHQGIRKGPNIKLPSFDLLEEPEPHEINEEW

SEQ ID NO: 1831422 - protein, 18 aa, Staphylococcus epidermidis
QHQTAIIEMAVASGLDLL

SEQ ID NO: 1831423 - protein, 26 aa, Staphylococcus epidermidis
QHRTNLYMTMFRFREYRIVAFSGGRF

SEQ ID NO: 1831424 - protein, 22 aa, Staphylococcus epidermidis
QHSGLMYYTIGQRHGLGIGGDG

SEQ ID NO: 1831425 - protein, 35 aa, Staphylococcus epidermidis
QHTETVDYLKWTIYKFYWITALNIIIKKKINTDIS

SEQ ID NO: 1831426 - protein, 27 aa, Staphylococcus epidermidis
QIDELRSKNNFPKNLDYVDSYTDPKTG

SEQ ID NO: 1831427 - protein, 20 aa, Staphylococcus epidermidis
QIDFQPFMKLTTKIQDERIL

SEQ ID NO: 1831428 - protein, 17 aa, Staphylococcus epidermidis
QIDIVKLAIHEGYNPKK

SEQ ID NO: 1831429 - protein, 21 aa, Staphylococcus epidermidis
QIDKYKSLIADLTKYVNDNMK

SEQ ID NO: 1831430 - protein, 20 aa, Staphylococcus epidermidis
QIDQYELQLLLDGPHDANNA

SEQ ID NO: 1831431 - protein, 23 aa, Staphylococcus epidermidis
QIDTIIEEAKTYQFKSVCINPSH

SEQ ID NO: 1831432 - protein, 20 aa, Staphylococcus epidermidis
QIDYFELLSFLKNLADKYAV

SEQ ID NO: 1831433 - protein, 20 aa, Staphylococcus epidermidis
QIEEFYTIVKELEKFDTFTN

SEQ ID NO: 1831434 - protein, 18 aa, Staphylococcus epidermidis
QIFDIALYRKVTSKVGVE

SEQ ID NO: 1831435 - protein, 21 aa, Staphylococcus epidermidis
QIFIQTWHGFPLKKMVNDLNE

SEQ ID NO: 1831436 - protein, 34 aa, Staphylococcus epidermidis
QIHTQQPYLIYMLGFMPGFPYLGGLDKKLHTPRR

SEQ ID NO: 1831437 - protein, 27 aa, Staphylococcus epidermidis
QIICYDLRFPELLRYPAKSGAKIAFYV

SEQ ID NO: 1831438 - protein, 22 aa, Staphylococcus epidermidis
QIIPKVHLKRISKTGFGPFAFD

SEQ ID NO: 1831439 - protein, 38 aa, Staphylococcus epidermidis; identical to SEQ ID NO: 1685228

SEQ ID NO: 1831440 - protein, 25 aa, Staphylococcus epidermidis
QIKRLKFDYLYIDNAQLTSPYLMGS

SEQ ID NO: 1831441 - protein, 26 aa, Staphylococcus epidermidis
QIKSYPRDIVALFYEQLRHCSTLFIN

SEQ ID NO: 1831442 - protein, 24 aa, Staphylococcus epidermidis
QILELVPFLISLVKGMTVIIDEID

SEQ ID NO: 1831443 - protein, 19 aa, Staphylococcus epidermidis
QILIQKLIKTYHMTAIFVT

SEQ ID NO: 1831444 - protein, 19 aa, Staphylococcus epidermidis
QINELLHTLSSNQQVWLSG

SEQ ID NO: 1831445 - protein, 20 aa, Staphylococcus epidermidis
QIPTEVLNFLNSYKFSTSQV

SEQ ID NO: 1831446 - protein, 17 aa, Staphylococcus epidermidis
QIRIIANDIAWWSIIDQ

SEQ ID NO: 1831447 - protein, 27 aa, Staphylococcus epidermidis
QIRVHMKYIGFPLVGDPKYGPKKTLDI

SEQ ID NO: 1831448 - protein, 26 aa, Staphylococcus epidermidis
QIRVHMKYIGYPLVGDPKYGPKKTLD

SEQ ID NO: 1831449 - protein, 17 aa, Staphylococcus epidermidis
QISKLLQHIFQDIKHME

SEQ ID NO: 1831450 - protein, 25 aa, Staphylococcus epidermidis
QISKQIFDLILKFADYGFPRAHAVS

SEQ ID NO: 1831451 - protein, 17 aa, Staphylococcus epidermidis
QIVKWHEQNKQMIIVHG

SEQ ID NO: 1831452 - protein, 25 aa, Staphylococcus epidermidis
QIVRHELLRMISWKVGIETGFKLSV

SEQ ID NO: 1831453 - protein, 20 aa, Staphylococcus epidermidis
QIYINTWHGTPLKYMGLDMD

SEQ ID NO: 1831454 - protein, 24 aa, Staphylococcus epidermidis
QKAKDLINKQPPTMDKHEIDQALD

SEQ ID NO: 1831455 - protein, 25 aa, Staphylococcus epidermidis
QKDDKVSLFDYMKRTMLKHGLDEVT

SEQ ID NO: 1831456 - protein, 26 aa, Staphylococcus epidermidis
QKDISLYVINLNRYIYKNIQGEFLEI

SEQ ID NO: 1831457 - protein, 26 aa, Staphylococcus epidermidis
QKEDALDFTLWKKAKPGEISWDSPFG

SEQ ID NO: 1831458 - protein, 24 aa, Staphylococcus epidermidis
QKEDKQFIFLTLTTPNVTSEHLES

SEQ ID NO: 1831459 - protein, 25 aa, Staphylococcus epidermidis
QKEDKQFIFLTLTTPNVTVEHLESE

SEQ ID NO: 1831460 - protein, 27 aa, Staphylococcus epidermidis
QKERITLYMRYNVKGFKSIKFTEIKKN

SEQ ID NO: 1831461 - protein, 21 aa, Staphylococcus epidermidis
QKEVDFIIIAGDLFDNENRTL

SEQ ID NO: 1831462 - protein, 20 aa, Staphylococcus epidermidis
QKFLDLFDKHELDSAVIGEV

SEQ ID NO: 1831463 - protein, 24 aa, Staphylococcus epidermidis
QKFNVITIFCDSLNYLSTIDDVRN

SEQ ID NO: 1831464 - protein, 26 aa, Staphylococcus epidermidis
QKFRAKQIFEWLYQKRVNSIDEMTNL

SEQ ID NO: 1831465 - protein, 28 aa, Staphylococcus epidermidis
QKGVQMVHESLLRALKDNGLEEIQAEGQ

SEQ ID NO: 1831466 - protein, 17 aa, Staphylococcus epidermidis
QKIDILPVGYPRNNYLL

SEQ ID NO: 1831467 - protein, 33 aa, Staphylococcus epidermidis
QKKDPMLLNKLITPYNMSALLNLALKGLKRTLE

SEQ ID NO: 1831468 - protein, 33 aa, Staphylococcus epidermidis
QKKELQYLIPDSIFPLFMYSKGNINLLDFDKSR

SEQ ID NO: 1831469 - protein, 26 aa, Staphylococcus epidermidis
QKLKETDVLVCTVIGFPLGATTTNAK

SEQ ID NO: 1831470 - protein, 20 aa, Staphylococcus epidermidis
QKMGMVFQNFNLFPHKKVIE

SEQ ID NO: 1831471 - protein, 20 aa, Staphylococcus epidermidis
QKMGMVFQSFNLFPHKKVIE

SEQ ID NO: 1831472 - protein, 30 aa, Staphylococcus epidermidis
QKNMFEIRLSKIWEKLLNKSPILKDDFFQL

SEQ ID NO: 1831473 - protein, 29 aa, Staphylococcus epidermidis
QKNVFSKYPNIKWIVPHCGALLPVIAQRV

SEQ ID NO: 1831474 - protein, 17 aa, Staphylococcus epidermidis
QKPHRLEYLDYFATPQG

SEQ ID NO: 1831475 - protein, 22 aa, Staphylococcus epidermidis
QKRGYMQKIFSQQLRFKDEKGN

SEQ ID NO: 1831476 - protein, 23 aa, Staphylococcus epidermidis
QKRKRLFSISIRKDIDNGKFEFL

SEQ ID NO: 1831477 - protein, 21 aa, Staphylococcus epidermidis
QKSHIWFHTKDIPGSHVVILN

SEQ ID NO: 1831478 - protein, 26 aa, Staphylococcus epidermidis
QKSTISLLRLFTFNDAIFLGNTLRDI

SEQ ID NO: 1831479 - protein, 27 aa, Staphylococcus epidermidis
QKTDKPHVIFIDYLTLMQSDVPQRDRR

SEQ ID NO: 1831480 - protein, 27 aa, Staphylococcus epidermidis
QKTEKPHVIFIDYLTLMQSDVPQRDRR

SEQ ID NO: 1831481 - protein, 19 aa, Staphylococcus epidermidis
QKVANGLIKIITYAPEVDG

SEQ ID NO: 1831482 - protein, 21 aa, Staphylococcus epidermidis
QKVKLSYTMPIKDKMNTVDAY

SEQ ID NO: 1831483 - protein, 20 aa, Staphylococcus epidermidis
QKYIQDAFEKNWIAPLGENV

SEQ ID NO: 1831484 - protein, 22 aa, Staphylococcus epidermidis
QKYLDFFVEKGHMVEPSAPLVP

SEQ ID NO: 1831485 - protein, 30 aa, Staphylococcus epidermidis
QLAHALKEIANSDTLTKLARIVDKANVLDE

SEQ ID NO: 1831486 - protein, 27 aa, Staphylococcus epidermidis
QLDHSKIYYKWLAQLSEALESGEIFNY

SEQ ID NO: 1831487 - protein, 29 aa, Staphylococcus epidermidis
QLDIYTISIFLRELIKIYMISKLTNQNLL

SEQ ID NO: 1831488 - protein, 20 aa, Staphylococcus epidermidis
QLEFTNDMSMKLLDKVSSGE

SEQ ID NO: 1831489 - protein, 19 aa, Staphylococcus epidermidis
QLENHFVLGYVGRIVKDKG

SEQ ID NO: 1831490 - protein, 27 aa, Staphylococcus epidermidis
QLERVYIASVLMLKPPLIIADEPVASL

SEQ ID NO: 1831491 - protein, 18 aa, Staphylococcus epidermidis
QLFENLKLHFAIPQKTYD

SEQ ID NO: 1831492 - protein, 17 aa, Staphylococcus epidermidis
QLFITLLEELRPFIFRK

SEQ ID NO: 1831493 - protein, 17 aa, Staphylococcus epidermidis
QLFQYRFGENQVDGHSL

SEQ ID NO: 1831494 - protein, 26 aa, Staphylococcus epidermidis
QLFYSTQIPVCLWFISNNKGQNGKKE

SEQ ID NO: 1831495 - protein, 25 aa, Staphylococcus epidermidis
QLGAQVGWYIPNRFSEGYGPNALAF

SEQ ID NO: 1831496 - protein, 29 aa, Staphylococcus epidermidis
QLGVVLFETLKLPVIKKTKTGYSTAVDVL

SEQ ID NO: 1831497 - protein, 21 aa, Staphylococcus epidermidis
QLIEGLIHFVSRQAMNIDGLG

SEQ ID NO: 1831498 - protein, 17 aa, Staphylococcus epidermidis
QLIIYNVTITQSGDLKI

SEQ ID NO: 1831499 - protein, 20 aa, Staphylococcus epidermidis
QLIKEISPVDLTELMKLTLK

SEQ ID NO: 1831500 - protein, 20 aa, Staphylococcus epidermidis
QLKILSHYLPEQHPAMGSIQ

SEQ ID NO: 1831501 - protein, 25 aa, Staphylococcus epidermidis
QLKNTLNPFNFIKDKQEAIDARGSM

SEQ ID NO: 1831502 - protein, 18 aa, Staphylococcus epidermidis
QLLDEGLEWVLIQGQMGI

SEQ ID NO: 1831503 - protein, 19 aa, Staphylococcus epidermidis
QLLIKLEKYNNIDQEKVIE

SEQ ID NO: 1831504 - protein, 17 aa, Staphylococcus epidermidis
QLLIKLIENFENLPILG

SEQ ID NO: 1831505 - protein, 19 aa, Staphylococcus epidermidis
QLLYIDLHLIHEVTSPQAF

SEQ ID NO: 1831506 - protein, 19 aa, Staphylococcus epidermidis
QLLYRRYELLYQPQDTNTG

SEQ ID NO: 1831507 - protein, 19 aa, Staphylococcus epidermidis
QLMITSLPMMNGVIGNPLL

SEQ ID NO: 1831508 - protein, 21 aa, Staphylococcus epidermidis
QLNGDLPAFLSPEPGLQSGAM

SEQ ID NO: 1831509 - protein, 18 aa, Staphylococcus epidermidis
QLNKAIEVSLAKEKAIKP

SEQ ID NO: 1831510 - protein, 22 aa, Staphylococcus epidermidis
QLNKMKFDCLLPLDKDSSEVLK

SEQ ID NO: 1831511 - protein, 25 aa, Staphylococcus epidermidis
QLNQCANLLAYKLRLNNQIEPNDMV

SEQ ID NO: 1831512 - protein, 18 aa, Staphylococcus epidermidis
QLPKLYSFDIFDTLIQRK

SEQ ID NO: 1831513 - protein, 22 aa, Staphylococcus epidermidis
QLPNIQYYPISSGKLRRYLSFE

SEQ ID NO: 1831514 - protein, 18 aa, Staphylococcus epidermidis
QLPSITLADNLRELGFDV

SEQ ID NO: 1831515 - protein, 20 aa, Staphylococcus epidermidis
QLPTYIRKNFDSIKVLAITL

SEQ ID NO: 1831516 - protein, 29 aa, Staphylococcus epidermidis
QLQDDIQLIDMMRALFPCGSITGAPKINT

SEQ ID NO: 1831517 - protein, 25 aa, Staphylococcus epidermidis
QLQVDLERPVPYINELLALNTFNPQ

SEQ ID NO: 1831518 - protein, 24 aa, Staphylococcus epidermidis
QLQYYLEQFTYLHQLVLEDSQHIV

SEQ ID NO: 1831519 - protein, 26 aa, Staphylococcus epidermidis
QLRKRYDIPIKRAPKLILKGDGDLKG

SEQ ID NO: 1831520 - protein, 20 aa, Staphylococcus epidermidis
QLSFMGLPTPNIFTGCGNFH

SEQ ID NO: 1831521 - protein, 26 aa, Staphylococcus epidermidis
QLSNRTLYLLNILQQLPISKINHLNI

SEQ ID NO: 1831522 - protein, 26 aa, Staphylococcus epidermidis
QLSSKQFYWYERSIKLFSEYFGENML

SEQ ID NO: 1831523 - protein, 27 aa, Staphylococcus epidermidis
QLSSKQFYWYERSIKLFSEYFGENMLV

SEQ ID NO: 1831524 - protein, 31 aa, Staphylococcus epidermidis
QLSSVIQPLYDIGAVGMRLLTKYMNEEDIEE

SEQ ID NO: 1831525 - protein, 18 aa, Staphylococcus epidermidis
QLSYIFITHDIQAATYIC

SEQ ID NO: 1831526 - protein, 20 aa, Staphylococcus epidermidis
QLSYIFITHDIQAATYICDD

SEQ ID NO: 1831527 - protein, 18 aa, Staphylococcus epidermidis
QLTKVNIFFGRNGSGKSS

SEQ ID NO: 1831528 - protein, 19 aa, Staphylococcus epidermidis
QLVFMRDGQIILKESKEIL

SEQ ID NO: 1831529 - protein, 19 aa, Staphylococcus epidermidis
QLYEKFGFKSTEPYSKGMY

SEQ ID NO: 1831530 - protein, 21 aa, Staphylococcus epidermidis
QLYKQFTVTTYVADKLSMALD

SEQ ID NO: 1831531 - protein, 31 aa, Staphylococcus epidermidis
QMDADLVFDVRFLPNPYYVKELRPLTGLDEP

SEQ ID NO: 1831532 - protein, 17 aa, Staphylococcus epidermidis
QMELEFFCKPGEEIEWQ

SEQ ID NO: 1831533 - protein, 18 aa, Staphylococcus epidermidis
QMHYWLKKSNHNYDGRHW

SEQ ID NO: 1831534 - protein, 23 aa, Staphylococcus epidermidis
QMIKDRLARERRKSEERMKDAIQ

SEQ ID NO: 1831535 - protein, 17 aa, Staphylococcus epidermidis
QMLFKHIGNRGQEKIEQ

SEQ ID NO: 1831536 - protein, 17 aa, Staphylococcus epidermidis
QMMVKTMEDRLNEYNKK

SEQ ID NO: 1831537 - protein, 23 aa, Staphylococcus epidermidis
QMQKPSVFFLKDGKAREVIKRQS

SEQ ID NO: 1831538 - protein, 25 aa, Staphylococcus epidermidis
QMSKQIFDLILKFADYGFPRAHAVS

SEQ ID NO: 1831539 - protein, 18 aa, Staphylococcus epidermidis
QMSLDVITRVGVAVVTAA

SEQ ID NO: 1831540 - protein, 27 aa, Staphylococcus epidermidis
QMWTDEGALIIKFFLCLDKKEQLKRFK

SEQ ID NO: 1831541 - protein, 25 aa, Staphylococcus epidermidis
QNARAKRVLNINKLIPIFIDNDTIL

SEQ ID NO: 1831542 - protein, 27 aa, Staphylococcus epidermidis
QNAVNEMRALIWQLKPVGLEHGLVHAL

SEQ ID NO: 1831543 - protein, 20 aa, Staphylococcus epidermidis
QNDDALKPFILLVVEKKEEG

SEQ ID NO: 1831544 - protein, 26 aa, Staphylococcus epidermidis
QNDILGIPSFLIFKEGQLLGSYIGKE

SEQ ID NO: 1831545 - protein, 26 aa, Staphylococcus epidermidis
QNEEINTLFFRRLFEAALKERQYYFN

SEQ ID NO: 1831546 - protein, 19 aa, Staphylococcus epidermidis
QNFNLFPHKKVIENVMLAP

SEQ ID NO: 1831547 - protein, 17 aa, Staphylococcus epidermidis
QNFNNLIDEKIEQNYTG

SEQ ID NO: 1831548 - protein, 23 aa, Staphylococcus epidermidis
QNFYMLHKALFVNEKYKKLSDSA

SEQ ID NO: 1831549 - protein, 24 aa, Staphylococcus epidermidis
QNFYMLHKALFVNEKYKKLSDSAK

SEQ ID NO: 1831550 - protein, 18 aa, Staphylococcus epidermidis
QNGYIFHNFINFISYSAI

SEQ ID NO: 1831551 - protein, 17 aa, Staphylococcus epidermidis
QNIGYQNNYFYITTSST

SEQ ID NO: 1831552 - protein, 27 aa, Staphylococcus epidermidis
QNIGYQNNYFYLTTSSTKLRDYRKHFE

SEQ ID NO: 1831553 - protein, 26 aa, Staphylococcus epidermidis
QNIKKGLNNIFKLLDIKYIKNENITA

SEQ ID NO: 1831554 - protein, 25 aa, Staphylococcus epidermidis
QNILANLIGYTRDEWVFPIQTHDNR

SEQ ID NO: 1831555 - protein, 21 aa, Staphylococcus epidermidis
QNIVKSYHRQGQTIGFVPTMG

SEQ ID NO: 1831556 - protein, 17 aa, Staphylococcus epidermidis
QNMLLDTGKYIYGYFPH

SEQ ID NO: 1831557 - protein, 25 aa, Staphylococcus epidermidis
QNNDIYNRPRGKFRFPMQVSEETSA

SEQ ID NO: 1831558 - protein, 26 aa, Staphylococcus epidermidis
QNNIIPIPAIYLKITEDYPTAALLNQ

SEQ ID NO: 1831559 - protein, 21 aa, Staphylococcus epidermidis
QNNYFYITTSSTKLRDYRKHF

SEQ ID NO: 1831560 - protein, 23 aa, Staphylococcus epidermidis
QNPNLNLPHSLYLHQNYLHFHFQ

SEQ ID NO: 1831561 - protein, 23 aa, Staphylococcus epidermidis
QNTHSLYNQYFIREFWGYTICRI

SEQ ID NO: 1831562 - protein, 28 aa, Staphylococcus epidermidis
QNTKRFIRMTIKPLLNLIVTELNAKLFD

SEQ ID NO: 1831563 - protein, 17 aa, Staphylococcus epidermidis
QNVFLLTEFIQKGRKNK

SEQ ID NO: 1831564 - protein, 18 aa, Staphylococcus epidermidis
QNYLLTPEKWMQNSTGYF

SEQ ID NO: 1831565 - protein, 17 aa, Staphylococcus epidermidis
QNYYAFVVFNMMFGGDP

SEQ ID NO: 1831566 - protein, 26 aa, Staphylococcus epidermidis
QPAPADHPWRTMPRNGMTIHYSGMTL

SEQ ID NO: 1831567 - protein, 18 aa, Staphylococcus epidermidis
QPDDRFLLETLLFTDMIT

SEQ ID NO: 1831568 - protein, 31 aa, Staphylococcus epidermidis
QPDFINRLFEIDGVKSIFYVMDFISVDKEDD

SEQ ID NO: 1831569 - protein, 21 aa, Staphylococcus epidermidis
QPDLLLLDEPTNHLDFESINW

SEQ ID NO: 1831570 - protein, 22 aa, Staphylococcus epidermidis
QPEFIGKPEPIIMSKSLDILGL

SEQ ID NO: 1831571 - protein, 33 aa, Staphylococcus epidermidis
QPGYREAGLFHIAFLLPTRRDLANFLYHAIQLN

SEQ ID NO: 1831572 - protein, 20 aa, Staphylococcus epidermidis
QPIIELAAVIYRAILDEVRK

SEQ ID NO: 1831573 - protein, 48 aa, Staphylococcus epidermidis
QPPGKKLQHLSLLSGGERALSAIALLFAILKVRSAPFVILDEVEAALD

SEQ ID NO: 1831574 - protein, 31 aa, Staphylococcus epidermidis
QPPLTQFENKPLYCLMPFSNTIKNKLEYLIK

SEQ ID NO: 1831575 - protein, 27 aa, Staphylococcus epidermidis
QPRDYMRYLFMDYVEVLYGYEKRLSLS

SEQ ID NO: 1831576 - protein, 26 aa, Staphylococcus epidermidis
QPRDYMRYLFMDYVEVLYGYKKRLSL

SEQ ID NO: 1831577 - protein, 26 aa, Staphylococcus epidermidis
QPSANSLYYALNGFPRNLRTDIEGLE

SEQ ID NO: 1831578 - protein, 21 aa, Staphylococcus epidermidis
QPSRAMALPVYQKDKYPFLYK

SEQ ID NO: 1831579 - protein, 24 aa, Staphylococcus epidermidis
QPSSNLIPYQKALEIIFEDDFLVI

SEQ ID NO: 1831580 - protein, 28 aa, Staphylococcus epidermidis
QPTEAQWDAMLLGWKVVSSVKSNAVILS

SEQ ID NO: 1831581 - protein, 33 aa, Staphylococcus epidermidis
QPTLPVFKQVYSLYFKFVMPIFGKMFAKSKEEY

SEQ ID NO: 1831582 - protein, 19 aa, Staphylococcus epidermidis
QPVFISLYAPIEGEKEWLG

SEQ ID NO: 1831583 - protein, 25 aa, Staphylococcus epidermidis
QPVKLYYNGPMFRYERKQKGRYRQF

SEQ ID NO: 1831584 - protein, 26 aa, Staphylococcus epidermidis
QPYPDNFDFTTLDKAFRENYGTLGIA

SEQ ID NO: 1831585 - protein, 23 aa, Staphylococcus epidermidis
QQAYYIIDGLLDKGLINDREAKM

SEQ ID NO: 1831586 - protein, 23 aa, Staphylococcus epidermidis
QQCTAILNLLTLSNDDPLLVDQP

SEQ ID NO: 1831587 - protein, 20 aa, Staphylococcus epidermidis
QQCTAILNLLTLSNNDPLLV

SEQ ID NO: 1831588 - protein, 24 aa, Staphylococcus epidermidis
QQEDYCIILGYFVDGAPQLSYIYD

SEQ ID NO: 1831589 - protein, 25 aa, Staphylococcus epidermidis
QQEKQKSLYKKELAWMRAGVKARTT

SEQ ID NO: 1831590 - protein, 24 aa, Staphylococcus epidermidis
QQELINLIGFVIEPQDLFSHLIQK

SEQ ID NO: 1831591 - protein, 18 aa, Staphylococcus epidermidis
QQIALFPHMTIKENIAQV

SEQ ID NO: 1831592 - protein, 20 aa, Staphylococcus epidermidis
QQIALFPHMTIKENIAQVPQ

SEQ ID NO: 1831593 - protein, 19 aa, Staphylococcus epidermidis
QQIRNLYPQANLIEFFGTS

SEQ ID NO: 1831594 - protein, 21 aa, Staphylococcus epidermidis
QQKYNYFYLNTLNKNVDIITY

SEQ ID NO: 1831595 - protein, 30 aa, Staphylococcus epidermidis
QQLEAFIPRMKKWDYILTSSDINTTLLKSA

SEQ ID NO: 1831596 - protein, 18 aa, Staphylococcus epidermidis
QQLIDATSIYLEAIYSLC

SEQ ID NO: 1831597 - protein, 24 aa, Staphylococcus epidermidis
QQLRKRYDIPTKKVPKLLLKGDGD

SEQ ID NO: 1831598 - protein, 22 aa, Staphylococcus epidermidis
QQLRLKADLIRSFLDKVVPSLK

SEQ ID NO: 1831599 - protein, 26 aa, Staphylococcus epidermidis
QQLRLKAGLIRSFLDKVVPSLKEDSD

SEQ ID NO: 1831600 - protein, 18 aa, Staphylococcus epidermidis
QQQFEKILKRMHKRHVRI

SEQ ID NO: 1831601 - protein, 18 aa, Staphylococcus epidermidis
QQRFYNCSIYGFGGDPMT

SEQ ID NO: 1831602 - protein, 23 aa, Staphylococcus epidermidis
QQSGHYIMIATGRPYRASQIYYH

SEQ ID NO: 1831603 - protein, 28 aa, Staphylococcus epidermidis
QQSIFKNIRYIGIFNPRLNRIYTYDMTQ

SEQ ID NO: 1831604 - protein, 46 aa, Staphylococcus epidermidis
QQTQQTVQTPQRPTTQTPVRQNPQTGEKRAKEPKTDERKKTRQDSS

SEQ ID NO: 1831605 - protein, 19 aa, Staphylococcus epidermidis
QQYWCVKDLKEWGFGLFEG

SEQ ID NO: 1831606 - protein, 23 aa, Staphylococcus epidermidis
QRADTFLPYMKDALKVRQRVMDL

SEQ ID NO: 1831607 - protein, 18 aa, Staphylococcus epidermidis
QREPAFLHKAKYKNYPRE

SEQ ID NO: 1831608 - protein, 22 aa, Staphylococcus epidermidis
QRFDYVLTNPPIRAGKDIVHRI

SEQ ID NO: 1831609 - protein, 18 aa, Staphylococcus epidermidis
QRFIHNDYTIMVLVETET

SEQ ID NO: 1831610 - protein, 20 aa, Staphylococcus epidermidis
QRIDDMYALHYPRMFIDPYT

SEQ ID NO: 1831611 - protein, 23 aa, Staphylococcus epidermidis
QRIKLIRHLNSPLSDLVYIIDEP

SEQ ID NO: 1831612 - protein, 18 aa, Staphylococcus epidermidis
QRIYHKNKKIIWEIVCMS

SEQ ID NO: 1831613 - protein, 22 aa, Staphylococcus epidermidis
QRKMMLESIRYVDLVIPEEGWG

SEQ ID NO: 1831614 - protein, 20 aa, Staphylococcus epidermidis
QRLEYVIKQCLSRFDTIVLT

SEQ ID NO: 1831615 - protein, 27 aa, Staphylococcus epidermidis
QRQRAYIAMTIAQDTDYILLDEPLNNL

SEQ ID NO: 1831616 - protein, 31 aa, Staphylococcus epidermidis
QRQVAFKLEELKQGVLYPYTTNEEYKNLMFE

SEQ ID NO: 1831617 - protein, 30 aa, Staphylococcus epidermidis
QRQVAFKLEELKQGVLYPYTTNEEYNNLMF

SEQ ID NO: 1831618 - protein, 26 aa, Staphylococcus epidermidis
QRSADIFLGVPFNIASYALLTHLIAK

SEQ ID NO: 1831619 - protein, 19 aa, Staphylococcus epidermidis
QRTSAARAFINVPSIIFAD

SEQ ID NO: 1831620 - protein, 18 aa, Staphylococcus epidermidis
QRVAIARAIINNPKFVIA

SEQ ID NO: 1831621 - protein, 23 aa, Staphylococcus epidermidis
QRVAIARALIAQPKLLLADEPTG

SEQ ID NO: 1831622 - protein, 20 aa, Staphylococcus epidermidis
QRVAIARALVTNPKILLCDE

SEQ ID NO: 1831623 - protein, 22 aa, Staphylococcus epidermidis
QRVGFFYPEIAMYFKNPSRILG

SEQ ID NO: 1831624 - protein, 20 aa, Staphylococcus epidermidis
QRVKHIILVSPTLGSHMLIE

SEQ ID NO: 1831625 - protein, 18 aa, Staphylococcus epidermidis
QRVLIARALISNPSVLVL

SEQ ID NO: 1831626 - protein, 26 aa, Staphylococcus epidermidis
QRVLVNQLPHLLRKYNIHKIEKLSHE

SEQ ID NO: 1831627 - protein, 26 aa, Staphylococcus epidermidis
QSEKKEIFLYLMYVYQQIVKADIEYL

SEQ ID NO: 1831628 - protein, 25 aa, Staphylococcus epidermidis
QSFNLFPHKKVIENIMLAPKLLHKD

SEQ ID NO: 1831629 - protein, 23 aa, Staphylococcus epidermidis
QSFPTLEVFDWLQKQGNISTNEM

SEQ ID NO: 1831630 - protein, 19 aa, Staphylococcus epidermidis
QSFYQTFISFHQFKEITQF

SEQ ID NO: 1831631 - protein, 17 aa, Staphylococcus epidermidis
QSHGYIPGNMKVMLSQN

SEQ ID NO: 1831632 - protein, 21 aa, Staphylococcus epidermidis
QSIALNLEPYSNSVWLFDVGE

SEQ ID NO: 1831633 - protein, 17 aa, Staphylococcus epidermidis
QSIARIAQKARACGIHM

SEQ ID NO: 1831634 - protein, 24 aa, Staphylococcus epidermidis
QSIKRYLNILKSYYKDELKATQSH

SEQ ID NO: 1831635 - protein, 35 aa, Staphylococcus epidermidis
QSIRKSIATPTIFNLIGPLINPFKLTYQVMGVYEA

SEQ ID NO: 1831636 - protein, 26 aa, Staphylococcus epidermidis
QSKCKRAIILPNNKNILMASEQAASI

SEQ ID NO: 1831637 - protein, 26 aa, Staphylococcus epidermidis
QSKCKRAIILPNNKNIMMASEQAASI

SEQ ID NO: 1831638 - protein, 24 aa, Staphylococcus epidermidis
QSKLRKQYLDSFRKGFKQQIENTK

SEQ ID NO: 1831639 - protein, 21 aa, Staphylococcus epidermidis
QSKQLLVMLHGFISDATTYHS

SEQ ID NO: 1831640 - protein, 19 aa, Staphylococcus epidermidis
QSKYRDEKRPRFGLLRGRE

SEQ ID NO: 1831641 - protein, 26 aa, Staphylococcus epidermidis
QSLKKRGHDIFLDLKLHDIPNTVSKA

SEQ ID NO: 1831642 - protein, 22 aa, Staphylococcus epidermidis
QSNHIHLPKINASDFLMYYANE

SEQ ID NO: 1831643 - protein, 17 aa, Staphylococcus epidermidis
QSPNNILGISYLKAMQQ

SEQ ID NO: 1831644 - protein, 25 aa, Staphylococcus epidermidis
QSQCKRAIILPNNKNIMMASEQAAS

SEQ ID NO: 1831645 - protein, 25 aa, Staphylococcus epidermidis
QSTAILTGNFLLAMGLKYLSEISDT

SEQ ID NO: 1831646 - protein, 25 aa, Staphylococcus epidermidis
QSTLIKKQAMMRGFLVAEFADDFKN

SEQ ID NO: 1831647 - protein, 25 aa, Staphylococcus epidermidis
QSVFHLHFHLIPRYENDIDGFGYKW

SEQ ID NO: 1831648 - protein, 22 aa, Staphylococcus epidermidis
QSVIHKVFTLPQDFTIVALTAT

SEQ ID NO: 1831649 - protein, 24 aa, Staphylococcus epidermidis
QSVIQKVFTLPQSFTIVALTATAT

SEQ ID NO: 1831650 - protein, 25 aa, Staphylococcus epidermidis
QSVKNVTMELGGLAPLIVHEDANVD

SEQ ID NO: 1831651 - protein, 23 aa, Staphylococcus epidermidis
QSVKSYFLFGNKNAKTLLSKGYA

SEQ ID NO: 1831652 - protein, 27 aa, Staphylococcus epidermidis
QSVVPLKILQDAYGLKRVAYTTYQAVS

SEQ ID NO: 1831653 - protein, 25 aa, Staphylococcus epidermidis
QSYRLTIPNIYFKSNLKAIYDMINH

SEQ ID NO: 1831654 - protein, 20 aa, Staphylococcus epidermidis
QTAILIPGDLRDEQFNYDMV

SEQ ID NO: 1831655 - protein, 17 aa, Staphylococcus epidermidis
QTDVYFVHSYQAEMSEH

SEQ ID NO: 1831656 - protein, 26 aa, Staphylococcus epidermidis
QTECNTIPVYMPYVTAYFMPRAYKDR

SEQ ID NO: 1831657 - protein, 24 aa, Staphylococcus epidermidis
QTGDYFFERGISTVLITLGEQGTY

SEQ ID NO: 1831658 - protein, 29 aa, Staphylococcus epidermidis
QTIAMLPKEFVRNLVFFSISAPRNKNNGR

SEQ ID NO: 1831659 - protein, 22 aa, Staphylococcus epidermidis
QTILGYIPLHWHNDLQLMVVTH

SEQ ID NO: 1831660 - protein, 22 aa, Staphylococcus epidermidis
QTILPSQFKKVYTIDFKSFEPS

SEQ ID NO: 1831661 - protein, 21 aa, Staphylococcus epidermidis
QTILSTWHGTPLKRLVFDMDN

SEQ ID NO: 1831662 - protein, 24 aa, Staphylococcus epidermidis
QTKQLQGIYFKNSPLNIVEQSHLI

SEQ ID NO: 1831663 - protein, 23 aa, Staphylococcus epidermidis
QTLQLAIYYLMGKASQQSIFKNI

SEQ ID NO: 1831664 - protein, 29 aa, Staphylococcus epidermidis
QTLQRDRHAYYIATLALIATSLEKFAVEI

SEQ ID NO: 1831665 - protein, 30 aa, Staphylococcus epidermidis
QTNQDLLKAIDKLGFPFIVKTRFGGYDGKG

SEQ ID NO: 1831666 - protein, 24 aa, Staphylococcus epidermidis
QTNSLAMMLDYLKNEILNNDVTLA

SEQ ID NO: 1831667 - protein, 25 aa, Staphylococcus epidermidis
QTRWMANIHYDTDNIHIHISTTELK

SEQ ID NO: 1831668 - protein, 21 aa, Staphylococcus epidermidis
QTSSFGVEGLFWNIPDYKYSN

SEQ ID NO: 1831669 - protein, 39 aa, Staphylococcus epidermidis
QTTRSVLSYVLDKIMKMLHPFMPFVTETIWQSLPHEGET

SEQ ID NO: 1831670 - protein, 25 aa, Staphylococcus epidermidis
QTVFNNIKRLNIETIKQDNTSFIKN

SEQ ID NO: 1831671 - protein, 24 aa, Staphylococcus epidermidis
QTVKKLNLELGGNAPVLVTPHADL

SEQ ID NO: 1831672 - protein, 18 aa, Staphylococcus epidermidis
QTVTYGKVPIQISGLEQL

SEQ ID NO: 1831673 - protein, 22 aa, Staphylococcus epidermidis
QTYDVFLLGYSMGGRVALYYAI

SEQ ID NO: 1831674 - protein, 19 aa, Staphylococcus epidermidis
QVAFRDDALRLAHEDLYET

SEQ ID NO: 1831675 - protein, 20 aa, Staphylococcus epidermidis
QVAKAFGLPVSKLGIETVNT

SEQ ID NO: 1831676 - protein, 22 aa, Staphylococcus epidermidis
QVARFNYYRYKKFGIPPEFEYE

SEQ ID NO: 1831677 - protein, 18 aa, Staphylococcus epidermidis
QVARLLYLGIVGDTGRFL

SEQ ID NO: 1831678 - protein, 23 aa, Staphylococcus epidermidis
QVASMSDHHLLISKASNADRTIT

SEQ ID NO: 1831679 - protein, 23 aa, Staphylococcus epidermidis
QVASMSDHHLLISKASNDDRTTT

SEQ ID NO: 1831680 - protein, 30 aa, Staphylococcus epidermidis
QVDIAGPGFINFYLDNQYLTDIIPEAITKG

SEQ ID NO: 1831681 - protein, 18 aa, Staphylococcus epidermidis
QVDSLFYNTPARLKYIKS

SEQ ID NO: 1831682 - protein, 21 aa, Staphylococcus epidermidis
QVDYIDLYYIHFPDEETPKDK

SEQ ID NO: 1831683 - protein, 21 aa, Staphylococcus epidermidis
QVEFKAKKDGFITEIIANEIG

SEQ ID NO: 1831684 - protein, 18 aa, Staphylococcus epidermidis
QVEKNLPGVTLKIKQMPF

SEQ ID NO: 1831685 - protein, 18 aa, Staphylococcus epidermidis
QVESLFYNTPARLKYIKS

SEQ ID NO: 1831686 - protein, 27 aa, Staphylococcus epidermidis
QVHKVIDPIIGLIPSIGLKSLEEYISE

SEQ ID NO: 1831687 - protein, 30 aa, Staphylococcus epidermidis
QVHTGRYYIQRFLARSFGFEVDDIKDMSQV

SEQ ID NO: 1831688 - protein, 29 aa, Staphylococcus epidermidis
QVHTGRYYIQRFLARSFGFEVDDMKDMSQ

SEQ ID NO: 1831689 - protein, 35 aa, Staphylococcus epidermidis
QVKIQKFPYYNPFSNTLITSWFWSHRPPQVEQAGL

SEQ ID NO: 1831690 - protein, 36 aa, Staphylococcus epidermidis
QVKIQKFPYYNPYSNTLIASWFWSHRPKHIEQAGLK

SEQ ID NO: 1831691 - protein, 31 aa, Staphylococcus epidermidis
QVKNLGPLDDIMKMIPGMNKMKGLDKLNMSD

SEQ ID NO: 1831692 - protein, 18 aa, Staphylococcus epidermidis
QVKSLMKDYLTPVSDEIV

SEQ ID NO: 1831693 - protein, 25 aa, Staphylococcus epidermidis
QVKTERFYQLPKYLFEDAYFKKMSA

SEQ ID NO: 1831694 - protein, 18 aa, Staphylococcus epidermidis
QVLAPMYKGNAGIKRLNQ

SEQ ID NO: 1831695 - protein, 17 aa, Staphylococcus epidermidis
QVLLIDRIQDPGNLGTL

SEQ ID NO: 1831696 - protein, 26 aa, Staphylococcus epidermidis
QVMKNLYFDLAGKVLPYQLPTLLEMV

SEQ ID NO: 1831697 - protein, 20 aa, Staphylococcus epidermidis
QVNFDYVRYMNKASIRRNAS

SEQ ID NO: 1831698 - protein, 17 aa, Staphylococcus epidermidis
QVRNREKYYFPGGKIDD

SEQ ID NO: 1831699 - protein, 17 aa, Staphylococcus epidermidis
QVRRMFEYFGHQVNKLT

SEQ ID NO: 1831700 - protein, 17 aa, Staphylococcus epidermidis
QVSRFFTGIEIHPGAKI

SEQ ID NO: 1831701 - protein, 21 aa, Staphylococcus epidermidis
QVVNLFHRKGPFENTIIKETI

SEQ ID NO: 1831702 - protein, 19 aa, Staphylococcus epidermidis
QVYDDLESAYILILGAGGA

SEQ ID NO: 1831703 - protein, 18 aa, Staphylococcus epidermidis
QVYQFESNAWYFGEGGNQ

SEQ ID NO: 1831704 - protein, 39 aa, Staphylococcus epidermidis
QWDTMIDVNVKGTLYVLQAALPYLLNQSSGHIINIASIS

SEQ ID NO: 1831705 - protein, 19 aa, Staphylococcus epidermidis
QWFIQGRIDFQIKLNGYRM

SEQ ID NO: 1831706 - protein, 21 aa, Staphylococcus epidermidis
QYEIVMKLSNGKVIKGMGIPK

SEQ ID NO: 1831707 - protein, 19 aa, Staphylococcus epidermidis
QYEIYSKLFKSWSGTIHTS

SEQ ID NO: 1831708 - protein, 26 aa, Staphylococcus epidermidis
QYHESNLPLEIYVELVYGIQQEMVYK

SEQ ID NO: 1831709 - protein, 19 aa, Staphylococcus epidermidis
QYIFLNNIDNVLVKVLDPL

SEQ ID NO: 1831710 - protein, 19 aa, Staphylococcus epidermidis
QYKHNPIHHMERRVKEMHS

SEQ ID NO: 1831711 - protein, 23 aa, Staphylococcus epidermidis
QYMESIGYVANFYKEIYGENSNA

SEQ ID NO: 1831712 - protein, 20 aa, Staphylococcus epidermidis
QYNESIYQYCKTNNISIIGL

SEQ ID NO: 1831713 - protein, 24 aa, Staphylococcus epidermidis
QYNSLKQFFFCGEILPHKTAKVLV

SEQ ID NO: 1831714 - protein, 24 aa, Staphylococcus epidermidis
QYPHTVLFVTHDRYFLNEVSTRII

SEQ ID NO: 1831715 - protein, 26 aa, Staphylococcus epidermidis
QYPKLAELGLKWYAVPIISNMDLKIG

SEQ ID NO: 1831716 - protein, 21 aa, Staphylococcus epidermidis
QYSDVLYTFLKEWYAHPQSYK

SEQ ID NO: 1831717 - protein, 28 aa, Staphylococcus epidermidis
QYSFLQLMNYMFKQEPYRYIATGQLEQI

SEQ ID NO: 1831718 - protein, 33 aa, Staphylococcus epidermidis
QYTFSGPIDRQLFYQFILRLPDEVLRLKGYVQF

SEQ ID NO: 1831719 - protein, 19 aa, Staphylococcus epidermidis
QYTSALKQFGWFVADSLNN

SEQ ID NO: 1831720 - protein, 21 aa, Staphylococcus epidermidis
QYVDDLAERILAIGGNPIGTL

SEQ ID NO: 1831721 - protein, 17 aa, Staphylococcus epidermidis
QYYRETGIYAERTAPWL

SEQ ID NO: 1831722 - protein, 24 aa, Staphylococcus epidermidis
RAAAALILAGLVADGTTQVTELKH

SEQ ID NO: 1831723 - protein, 18 aa, Staphylococcus epidermidis
RAFYIDELGLEHISNFPQ

SEQ ID NO: 1831724 - protein, 25 aa, Staphylococcus epidermidis
RAGASIILLIVNILSDDQLKEFYSY

SEQ ID NO: 1831725 - protein, 29 aa, Staphylococcus epidermidis
RAGDSQIMNWLPYVKTLAERNKLYPNPEN

SEQ ID NO: 1831726 - protein, 21 aa, Staphylococcus epidermidis
RAGTLLRYYTGLLESSRDNHF

SEQ ID NO: 1831727 - protein, 25 aa, Staphylococcus epidermidis
RAGTLLRYYTGLLESSRETPFGFKI

SEQ ID NO: 1831728 - protein, 19 aa, Staphylococcus epidermidis
RAIAGYFLSFDAPNAQNTA

SEQ ID NO: 1831729 - protein, 19 aa, Staphylococcus epidermidis
RAIKIFPGLVTYVAETHEQ

SEQ ID NO: 1831730 - protein, 17 aa, Staphylococcus epidermidis
RAILIYFDKSGINGTEL

SEQ ID NO: 1831731 - protein, 17 aa, Staphylococcus epidermidis
RAIRIQAKIASLVTAFA

SEQ ID NO: 1831732 - protein, 18 aa, Staphylococcus epidermidis
RAMFPQLSKSLLDETGID

SEQ ID NO: 1831733 - protein, 29 aa, Staphylococcus epidermidis
RAMSQEGYHFFGLLYIGAILTKEGPKVIE

SEQ ID NO: 1831734 - protein, 27 aa, Staphylococcus epidermidis
RARHDIEMLLGSKVYLELWVKVQRDWR

SEQ ID NO: 1831735 - protein, 26 aa, Staphylococcus epidermidis
RARRDIEMLLGSKVYLELWVKVQRDW

SEQ ID NO: 1831736 - protein, 28 aa, Staphylococcus epidermidis
RARRRESIFMTYILKHHPRFKDKDVPVW

SEQ ID NO: 1831737 - protein, 18 aa, Staphylococcus epidermidis
RASQMYYHELNMSTPVVN

SEQ ID NO: 1831738 - protein, 27 aa, Staphylococcus epidermidis
RASQQYKLLIILSPSGAYYGGDTLKAT

SEQ ID NO: 1831739 - protein, 29 aa, Staphylococcus epidermidis
RATEWHHFINQLPYYKVIDQYIFVHAGID

SEQ ID NO: 1831740 - protein, 26 aa, Staphylococcus epidermidis
RATLKRLPLYYRFVSILKGKGIDRVN

SEQ ID NO: 1831741 - protein, 26 aa, Staphylococcus epidermidis
RATLKRLPLYYRFVSTLKSKGIDRVN

SEQ ID NO: 1831742 - protein, 25 aa, Staphylococcus epidermidis
RAWQSAPRPIPLPNQTKNLLFHFDD

SEQ ID NO: 1831743 - protein, 17 aa, Staphylococcus epidermidis
RAYNIRHIGHHNAKTDS

SEQ ID NO: 1831744 - protein, 18 aa, Staphylococcus epidermidis
RDAIREQIKDYKIKGEFP

SEQ ID NO: 1831745 - protein, 19 aa, Staphylococcus epidermidis
RDCNNIFQKKWKRELQALR

SEQ ID NO: 1831746 - protein, 31 aa, Staphylococcus epidermidis
RDEEFKFLFTDIDFLPPVTPPNNVIAFGRNY

SEQ ID NO: 1831747 - protein, 19 aa, Staphylococcus epidermidis
RDELIKDIAELRRKLEACN

SEQ ID NO: 1831748 - protein, 20 aa, Staphylococcus epidermidis
RDFTLKDLGILINKHGRIAE

SEQ ID NO: 1831749 - protein, 25 aa, Staphylococcus epidermidis
RDGNKWLEIIQKYPITIWNSVPTLF

SEQ ID NO: 1831750 - protein, 23 aa, Staphylococcus epidermidis
RDGVRYYLSHYPTLIGRKNLYNI

SEQ ID NO: 1831751 - protein, 17 aa, Staphylococcus epidermidis
RDIFFHHPYESFEPIVD

SEQ ID NO: 1831752 - protein, 23 aa, Staphylococcus epidermidis
RDIIDRFQHWLEEPSLHDTIHQA

SEQ ID NO: 1831753 - protein, 18 aa, Staphylococcus epidermidis
RDIKPISALIMYGTKDKI

SEQ ID NO: 1831754 - protein, 25 aa, Staphylococcus epidermidis
RDKGFYTAWLHLAQYDPMFKKEQRQ

SEQ ID NO: 1831755 - protein, 26 aa, Staphylococcus epidermidis
RDKTGLLLDPYFAGTKVKWILDHVDG

SEQ ID NO: 1831756 - protein, 25 aa, Staphylococcus epidermidis
RDLEMTFFYELIFGEETDFYQDLLN

SEQ ID NO: 1831757 - protein, 24 aa, Staphylococcus epidermidis
RDLEMTFFYELVFGEETEFYQQLL

SEQ ID NO: 1831758 - protein, 20 aa, Staphylococcus epidermidis
RDNLLAFYEQLKVIDPKVID

SEQ ID NO: 1831759 - protein, 19 aa, Staphylococcus epidermidis
RDQFNIVDHYTYVLASDGD

SEQ ID NO: 1831760 - protein, 28 aa, Staphylococcus epidermidis
RDQLGDIMIGDEIQFILTKRLESYIMFE

SEQ ID NO: 1831761 - protein, 26 aa, Staphylococcus epidermidis
RDTSYPYISFIPLNGEVILSLDGFKY

SEQ ID NO: 1831762 - protein, 30 aa, Staphylococcus epidermidis; identical to SEQ ID NO: 1685036

SEQ ID NO: 1831763 - protein, 22 aa, Staphylococcus epidermidis
RDYLIDAINYMFPSVDVKDEDI

SEQ ID NO: 1831764 - protein, 23 aa, Staphylococcus epidermidis
REDAQLLYGFISEEEKDMFLSLI

SEQ ID NO: 1831765 - protein, 35 aa, Staphylococcus epidermidis
REDDIKAFVLIFRDLARLMQMLKTFDEFKFDKEKI

SEQ ID NO: 1831766 - protein, 24 aa, Staphylococcus epidermidis
REDDVDFAIFGPGVPLEAHQVDEY

SEQ ID NO: 1831767 - protein, 19 aa, Staphylococcus epidermidis
REDEEFFKLLDETFTEYNQ

SEQ ID NO: 1831768 - protein, 24 aa, Staphylococcus epidermidis
REDKIPMNIADDIKFHVVIYSENN

SEQ ID NO: 1831769 - protein, 27 aa, Staphylococcus epidermidis
REEGRECKFIAVKLPYGIQKDADEVED

SEQ ID NO: 1831770 - protein, 20 aa, Staphylococcus epidermidis
REFCTKIAWIEGGKLKDFGE

SEQ ID NO: 1831771 - protein, 18 aa, Staphylococcus epidermidis
REGHLFLLDVFEGNIFKV

SEQ ID NO: 1831772 - protein, 18 aa, Staphylococcus epidermidis
REILKLGERTREIGYSLI

SEQ ID NO: 1831773 - protein, 29 aa, Staphylococcus epidermidis
REISLNLTTKFKLLVPKKSKLTFRDYVNL

SEQ ID NO: 1831774 - protein, 22 aa, Staphylococcus epidermidis
REKHLELIMKWCAQELKNNFQL

SEQ ID NO: 1831775 - protein, 22 aa, Staphylococcus epidermidis
REKIKIIIINNTDLYKKIKQVL

SEQ ID NO: 1831776 - protein, 17 aa, Staphylococcus epidermidis
RELDVEAHVLFLGKQND

SEQ ID NO: 1831777 - protein, 24 aa, Staphylococcus epidermidis
RELGFLALHGFLHLLGYDHMNDND

SEQ ID NO: 1831778 - protein, 25 aa, Staphylococcus epidermidis
RELINDFAYKHQIPWIYGGVVQSTY

SEQ ID NO: 1831779 - protein, 25 aa, Staphylococcus epidermidis
RELLDTYFDLIINYFKQINNIDEIH

SEQ ID NO: 1831780 - protein, 21 aa, Staphylococcus epidermidis
RELNDSLFKLLLNKSSNKNNS

SEQ ID NO: 1831781 - protein, 27 aa, Staphylococcus epidermidis
REMFQDLLHHYIIITRYVKFYDYQYDK

SEQ ID NO: 1831782 - protein, 28 aa, Staphylococcus epidermidis
REMSVDSKFIYIILLDRAKLSFQNDWFD

SEQ ID NO: 1831783 - protein, 21 aa, Staphylococcus epidermidis
REMYDLRLMLESFAFSRLKDQ

SEQ ID NO: 1831784 - protein, 27 aa, Staphylococcus epidermidis
RENDQSYEAFLYLKSKMNYSDDSNTRM

SEQ ID NO: 1831785 - protein, 28 aa, Staphylococcus epidermidis
RENDQSYEAFLYLKSKMNYSDDSNTRMM

SEQ ID NO: 1831786 - protein, 26 aa, Staphylococcus epidermidis
RENEDLIFIDLHLLHEINTPQSFDSL

SEQ ID NO: 1831787 - protein, 23 aa, Staphylococcus epidermidis
RENYEALLIYYKNSIDNPVVDGA

SEQ ID NO: 1831788 - protein, 18 aa, Staphylococcus epidermidis
RENYGTLGLAFIKQYESK

SEQ ID NO: 1831789 - protein, 29 aa, Staphylococcus epidermidis
REQHIDLIDMVVVNLYPFQQTVAQPEVTE

SEQ ID NO: 1831790 - protein, 19 aa, Staphylococcus epidermidis
REQQNLTIVLITHEMHVIR

SEQ ID NO: 1831791 - protein, 23 aa, Staphylococcus epidermidis
REQQNLTIVLITHEMHVIRRICD

SEQ ID NO: 1831792 - protein, 23 aa, Staphylococcus epidermidis
REQQNLTIVLITHEMHVIRRMCD

SEQ ID NO: 1831793 - protein, 30 aa, Staphylococcus epidermidis
RESLRCLIGTFLFIIVDYIIDGIYSNSLIV

SEQ ID NO: 1831794 - protein, 30 aa, Staphylococcus epidermidis
RETGIYAERTAPWLERMGFENVKNVLLNQE

SEQ ID NO: 1831795 - protein, 25 aa, Staphylococcus epidermidis
RETSTLDIPLAANQFKYFASVLTTD

SEQ ID NO: 1831796 - protein, 31 aa, Staphylococcus epidermidis
RETVYDTETFIKWLHLFINEQLTYSDGIAMR

SEQ ID NO: 1831797 - protein, 18 aa, Staphylococcus epidermidis
REVDEFYYYCYMHSIDEM

SEQ ID NO: 1831798 - protein, 21 aa, Staphylococcus epidermidis
REVFKFAVRIMGDASTRVVDK

SEQ ID NO: 1831799 - protein, 21 aa, Staphylococcus epidermidis
REVFKFAVRIMGDASTRVVEK

SEQ ID NO: 1831800 - protein, 22 aa, Staphylococcus epidermidis
REVKGILDMKGGFADSVTNAFS

SEQ ID NO: 1831801 - protein, 27 aa, Staphylococcus epidermidis
REVYQHYALSELPFPKKTKFETKGESK

SEQ ID NO: 1831802 - protein, 28 aa, Staphylococcus epidermidis
REYSKAILGLVMPLYSKYGIALEAHLQN

SEQ ID NO: 1831803 - protein, 25 aa, Staphylococcus epidermidis
RFAEKYRLQLFTYAYDQDTEAIAKD

SEQ ID NO: 1831804 - protein, 20 aa, Staphylococcus epidermidis
RFAGICAISFFMNASLEDIK

SEQ ID NO: 1831805 - protein, 27 aa, Staphylococcus epidermidis
RFAGVKGGFMRRIKSYDSLLHSFDVTY

SEQ ID NO: 1831806 - protein, 41 aa, Staphylococcus epidermidis
RFAYDCYRRLLQMFGEVVYGIPMLAFDTYFDDFKNQHNYEN

SEQ ID NO: 1831807 - protein, 18 aa, Staphylococcus epidermidis
RFDKVLCTADFPYAAEKL

SEQ ID NO: 1831808 - protein, 24 aa, Staphylococcus epidermidis
RFDLSFDRKFEAFLVPTVIGEIKR

SEQ ID NO: 1831809 - protein, 18 aa, Staphylococcus epidermidis
RFDTIVLTGGLGPTKDDL

SEQ ID NO: 1831810 - protein, 17 aa, Staphylococcus epidermidis
RFFNHYFNKGDIYQAPF

SEQ ID NO: 1831811 - protein, 27 aa, Staphylococcus epidermidis
RFGGSRPFNVLMTPSDKKRMMDSKKEH

SEQ ID NO: 1831812 - protein, 26 aa, Staphylococcus epidermidis
RFHRHPLPVPQFKYFKLNQSRVQPQL

SEQ ID NO: 1831813 - protein, 18 aa, Staphylococcus epidermidis
RFIDVLAEKAKNYKYTLM

SEQ ID NO: 1831814 - protein, 27 aa, Staphylococcus epidermidis
RFIERGIIEIAPLAYMRGRTLDDAFVI

SEQ ID NO: 1831815 - protein, 18 aa, Staphylococcus epidermidis
RFILESHARSHYKIEYAT

SEQ ID NO: 1831816 - protein, 18 aa, Staphylococcus epidermidis
RFIREFRNVNVDEYEVGQ

SEQ ID NO: 1831817 - protein, 17 aa, Staphylococcus epidermidis
RFKSFVLERSEGNIVIF

SEQ ID NO: 1831818 - protein, 18 aa, Staphylococcus epidermidis
RFLQVRIPVRMDDGTVKT

SEQ ID NO: 1831819 - protein, 32 aa, Staphylococcus epidermidis
RFNNAYMQYASTSPFYPLFASLDINAKMQEGE

SEQ ID NO: 1831820 - protein, 17 aa, Staphylococcus epidermidis
RFSVYLRKATPEAKNQL

SEQ ID NO: 1831821 - protein, 26 aa, Staphylococcus epidermidis
RGAGKSTFIELIRYALDINPMSRNAN

SEQ ID NO: 1831822 - protein, 23 aa, Staphylococcus epidermidis
RGAMSSDLYRLWQNAFVVGKDDP

SEQ ID NO: 1831823 - protein, 21 aa, Staphylococcus epidermidis
RGCIPSKALISASERVKHIKH

SEQ ID NO: 1831824 - protein, 17 aa, Staphylococcus epidermidis
RGDDTYLVLNEEDILAV

SEQ ID NO: 1831825 - protein, 27 aa, Staphylococcus epidermidis
RGELITIHMIKLLQYYSNLGIKVEGLK

SEQ ID NO: 1831826 - protein, 28 aa, Staphylococcus epidermidis
RGENGFGYDPVFFVPDKDRTMAEISNEE

SEQ ID NO: 1831827 - protein, 24 aa, Staphylococcus epidermidis
RGFTAVCNPLVNSYKRLVPGYEAP

SEQ ID NO: 1831828 - protein, 25 aa, Staphylococcus epidermidis
RGGGRDRFFKKGNLQFVILKMLKEE

SEQ ID NO: 1831829 - protein, 21 aa, Staphylococcus epidermidis
RGIEPFIKSAKIEKVTFAKNV

SEQ ID NO: 1831830 - protein, 29 aa, Staphylococcus epidermidis
RGKTMKNYDLIIIGFGKAGKTLAAHAAGH

SEQ ID NO: 1831831 - protein, 17 aa, Staphylococcus epidermidis
RGLLVPVVKHADRKSIF

SEQ ID NO: 1831832 - protein, 18 aa, Staphylococcus epidermidis
RGLSPWPVAYTTMNEKNL

SEQ ID NO: 1831833 - protein, 17 aa, Staphylococcus epidermidis
RGLTLYSAGGAIGLQAA

SEQ ID NO: 1831834 - protein, 20 aa, Staphylococcus epidermidis
RGMVLFINRNTRTSKGYFIV

SEQ ID NO: 1831835 - protein, 20 aa, Staphylococcus epidermidis
RGMVLYMDRNTRTTHGYFIL

SEQ ID NO: 1831836 - protein, 25 aa, Staphylococcus epidermidis
RGNAKQAIDNPLPKGWKIIRNERAT

SEQ ID NO: 1831837 - protein, 25 aa, Staphylococcus epidermidis
RGPATNPLFKSFFNAGVEAGYHKTP

SEQ ID NO: 1831838 - protein, 17 aa, Staphylococcus epidermidis
RGPLFKGLPTIESHRSA

SEQ ID NO: 1831839 - protein, 23 aa, Staphylococcus epidermidis
RGQEVDAALWGARAAFIGGFDST

SEQ ID NO: 1831840 - protein, 18 aa, Staphylococcus epidermidis
RGQSLDELFDAILALENR

SEQ ID NO: 1831841 - protein, 18 aa, Staphylococcus epidermidis
RGRGPVNHFAYMKKVGLD

SEQ ID NO: 1831842 - protein, 18 aa, Staphylococcus epidermidis
RGTYYFRITYYDKTNTRK

SEQ ID NO: 1831843 - protein, 19 aa, Staphylococcus epidermidis
RGYAKKAFKMAIDYAFLVL

SEQ ID NO: 1831844 - protein, 18 aa, Staphylococcus epidermidis
RGYRKVVASPLPISILEH

SEQ ID NO: 1831845 - protein, 23 aa, Staphylococcus epidermidis
RGYRRVVPSPQPISIIELKSIKT

SEQ ID NO: 1831846 - protein, 20 aa, Staphylococcus epidermidis
RHEILPKDFEYNKWFRMTAS

SEQ ID NO: 1831847 - protein, 18 aa, Staphylococcus epidermidis
RHENILVTPHIAFFSDEA

SEQ ID NO: 1831848 - protein, 19 aa, Staphylococcus epidermidis
RHFNVTPESIYLIDYKLSK

SEQ ID NO: 1831849 - protein, 18 aa, Staphylococcus epidermidis
RHKLYSGWKKAVKATQVF

SEQ ID NO: 1831850 - protein, 25 aa, Staphylococcus epidermidis
RHNTKVLSKMIYELALELTSTIRFT

SEQ ID NO: 1831851 - protein, 23 aa, Staphylococcus epidermidis
RHPNLNMIIGHWGEFVPFFLERM

SEQ ID NO: 1831852 - protein, 17 aa, Staphylococcus epidermidis
RHSFLVEKLRLLIQQLK

SEQ ID NO: 1831853 - protein, 19 aa, Staphylococcus epidermidis
RHTHCALLIEAGVHIKEIQ

SEQ ID NO: 1831854 - protein, 27 aa, Staphylococcus epidermidis
RHVGKVLTYQILLKSLFGYVNKCEMAS

SEQ ID NO: 1831855 - protein, 22 aa, Staphylococcus epidermidis
RIASKYRLRLIELGFSMKQFSL

SEQ ID NO: 1831856 - protein, 26 aa, Staphylococcus epidermidis
RIEGRDWEFLYYSPELESLPKDESNY

SEQ ID NO: 1831857 - protein, 26 aa, Staphylococcus epidermidis
RIEIPHVDIILTIPPYELRTEDSRRV

SEQ ID NO: 1831858 - protein, 19 aa, Staphylococcus epidermidis
RIELFMKHNVKGYKTIHFS

SEQ ID NO: 1831859 - protein, 17 aa, Staphylococcus epidermidis
RIGIARAIALRPKLIVA

SEQ ID NO: 1831860 - protein, 25 aa, Staphylococcus epidermidis
RIGLLKIDFLGLRNLSIIHQIVTQV

SEQ ID NO: 1831861 - protein, 28 aa, Staphylococcus epidermidis
RIGQERPCFYYYMLTLGTYEWKNYQTLV

SEQ ID NO: 1831862 - protein, 20 aa, Staphylococcus epidermidis
RIGRMVSIPKFMLKVAKQKR

SEQ ID NO: 1831863 - protein, 20 aa, Staphylococcus epidermidis
RIIGILKFISPKYSKDFEND

SEQ ID NO: 1831864 - protein, 17 aa, Staphylococcus epidermidis
RIIGRRKGYKANIEKLM

SEQ ID NO: 1831865 - protein, 19 aa, Staphylococcus epidermidis
RIIRIEGNFWDIGEGPSGP

SEQ ID NO: 1831866 - protein, 32 aa, Staphylococcus epidermidis
RIKDGTMILKPIFRDYLLKLAQENQIAYQYYI

SEQ ID NO: 1831867 - protein, 21 aa, Staphylococcus epidermidis
RIKEVYADDLSLLDGGRNSYA

SEQ ID NO: 1831868 - protein, 25 aa, Staphylococcus epidermidis
RIKSYPQDIAALFYEQLRHCATLFV

SEQ ID NO: 1831869 - protein, 24 aa, Staphylococcus epidermidis
RIKSYPQDIAALFYEQLRHCSTLF

SEQ ID NO: 1831870 - protein, 17 aa, Staphylococcus epidermidis
RIKTLSSPYYLTGKNYR

SEQ ID NO: 1831871 - protein, 26 aa, Staphylococcus epidermidis
RILESYHISILDLPLETGLVAEIGQG

SEQ ID NO: 1831872 - protein, 30 aa, Staphylococcus epidermidis
RILKGELDEHFPLVVWQTGSGTQSNMNVNE

SEQ ID NO: 1831873 - protein, 22 aa, Staphylococcus epidermidis
RIMRLHYEGILQERLDELGDMP

SEQ ID NO: 1831874 - protein, 22 aa, Staphylococcus epidermidis
RIMRLHYEGILQERLDELGEMP

SEQ ID NO: 1831875 - protein, 19 aa, Staphylococcus epidermidis
RINCQLQKLWKKRGNRFSH

SEQ ID NO: 1831876 - protein, 17 aa, Staphylococcus epidermidis
RINLLTKELVYLRVKKE

SEQ ID NO: 1831877 - protein, 20 aa, Staphylococcus epidermidis
RINRLFDITGLKDLMHVNEG

SEQ ID NO: 1831878 - protein, 18 aa, Staphylococcus epidermidis
RIQHENLPFIAMWTDENV

SEQ ID NO: 1831879 - protein, 20 aa, Staphylococcus epidermidis
RIQNIQKALSPIGGISISEN

SEQ ID NO: 1831880 - protein, 24 aa, Staphylococcus epidermidis
RIQSWSYPFVIKPGDDLPTAGGYG

SEQ ID NO: 1831881 - protein, 20 aa, Staphylococcus epidermidis
RIRMVWLSQNLKHSYKTINR

SEQ ID NO: 1831882 - protein, 25 aa, Staphylococcus epidermidis
RISKTKGLIGNIMKIKPIGTLNDGR

SEQ ID NO: 1831883 - protein, 24 aa, Staphylococcus epidermidis
RISKTKGLIGNIMKIKPIGTLRDG

SEQ ID NO: 1831884 - protein, 17 aa, Staphylococcus epidermidis
RISYAYEMEMLKEGMRR

SEQ ID NO: 1831885 - protein, 21 aa, Staphylococcus epidermidis
RITRHFYFPPVMADITKWSDQ

SEQ ID NO: 1831886 - protein, 26 aa, Staphylococcus epidermidis
RIVEIDYMQRFLVSKTFLKSEDKAFF

SEQ ID NO: 1831887 - protein, 27 aa, Staphylococcus epidermidis
RIVGNKKIILAANKLDLLPKQINKRRV

SEQ ID NO: 1831888 - protein, 26 aa, Staphylococcus epidermidis
RIVGNKKIILVANKIDLLPKQINHRR

SEQ ID NO: 1831889 - protein, 17 aa, Staphylococcus epidermidis
RIVIHELRHSHASMLVN

SEQ ID NO: 1831890 - protein, 18 aa, Staphylococcus epidermidis
RIVQGFLIGLYDEQDSIE

SEQ ID NO: 1831891 - protein, 22 aa, Staphylococcus epidermidis
RKDFYSYVRTFSEYYAPFEKRA

SEQ ID NO: 1831892 - protein, 24 aa, Staphylococcus epidermidis
RKELIDFILELFDIEKPTGLILKQ

SEQ ID NO: 1831893 - protein, 25 aa, Staphylococcus epidermidis
RKELLGIEDLKMYDLYTPLVKDVKF

SEQ ID NO: 1831894 - protein, 18 aa, Staphylococcus epidermidis
RKFMPNQSNYKPVVFDSD

SEQ ID NO: 1831895 - protein, 25 aa, Staphylococcus epidermidis
RKGGNYHFLLFNKINDRYLSDSKQK

SEQ ID NO: 1831896 - protein, 25 aa, Staphylococcus epidermidis
RKGINQFIKLGFVKPFYNGYHKDAK

SEQ ID NO: 1831897 - protein, 26 aa, Staphylococcus epidermidis
RKGINQFIKLGFVKPFYNGYHKDAKK

SEQ ID NO: 1831898 - protein, 17 aa, Staphylococcus epidermidis
RKIDVEPVFGFMKAILG

SEQ ID NO: 1831899 - protein, 28 aa, Staphylococcus epidermidis
RKIKVNPGDFYFIPAGTIHSIGAGIMAY

SEQ ID NO: 1831900 - protein, 19 aa, Staphylococcus epidermidis
RKILKSYGIRILDAPLKTG

SEQ ID NO: 1831901 - protein, 18 aa, Staphylococcus epidermidis
RKIVQHLEERGYQLSKTE

SEQ ID NO: 1831902 - protein, 25 aa, Staphylococcus epidermidis
RKKDIGFIFQDYNILHTLTVKENIM

SEQ ID NO: 1831903 - protein, 26 aa, Staphylococcus epidermidis
RKKDTYFVTHGFGSIAALKFLAETHH

SEQ ID NO: 1831904 - protein, 30 aa, Staphylococcus epidermidis
RKKLPSYMIPKIYHKIIKFPLTINGKVDCK

SEQ ID NO: 1831905 - protein, 23 aa, Staphylococcus epidermidis
RKLKINRQFIFATHNANIPVFGD

SEQ ID NO: 1831906 - protein, 25 aa, Staphylococcus epidermidis
RKMCALKEFIKYLSSYGYDIDINII

SEQ ID NO: 1831907 - protein, 19 aa, Staphylococcus epidermidis
RKMLNLTGKVDTIFLHCLP

SEQ ID NO: 1831908 - protein, 21 aa, Staphylococcus epidermidis
RKMMTTYLPKIKQAYHPTVSI

SEQ ID NO: 1831909 - protein, 21 aa, Staphylococcus epidermidis
RKMVRNLCLSILTFDKDGDMV

SEQ ID NO: 1831910 - protein, 24 aa, Staphylococcus epidermidis
RKNHQLLLSIHPSFSRLQITNKKY

SEQ ID NO: 1831911 - protein, 20 aa, Staphylococcus epidermidis
RKQTACNIIFRTAIVKAHHI

SEQ ID NO: 1831912 - protein, 26 aa, Staphylococcus epidermidis
RKVVASPLPISILEHQLISTLVEQKN

SEQ ID NO: 1831913 - protein, 26 aa, Staphylococcus epidermidis
RKYDTYFVTHGFGTIAALKFIEGTDH

SEQ ID NO: 1831914 - protein, 20 aa, Staphylococcus epidermidis
RKYHPLEKLGRYLMDSFVNI

SEQ ID NO: 1831915 - protein, 19 aa, Staphylococcus epidermidis
RLAIMDHMLQTIDAPRKEL

SEQ ID NO: 1831916 - protein, 17 aa, Staphylococcus epidermidis
RLAKNLTLTMNFYLCIQ

SEQ ID NO: 1831917 - protein, 27 aa, Staphylococcus epidermidis
RLAMKIVTFIFGKRRRLKWVNQLLNKT

SEQ ID NO: 1831918 - protein, 22 aa, Staphylococcus epidermidis
RLARRIFQDPLSTFKKVVAIEI

SEQ ID NO: 1831919 - protein, 27 aa, Staphylococcus epidermidis
RLEFGSPKAIIPKKLARDVGADLIMSG

SEQ ID NO: 1831920 - protein, 21 aa, Staphylococcus epidermidis
RLEGVQIFIDQPLSMIDKSLS

SEQ ID NO: 1831921 - protein, 20 aa, Staphylococcus epidermidis
RLEKLGVHAVMPLASPIGTG

SEQ ID NO: 1831922 - protein, 18 aa, Staphylococcus epidermidis
RLESDLMQLIIDLENCQP

SEQ ID NO: 1831923 - protein, 20 aa, Staphylococcus epidermidis
RLESMNLYQKKLQSYKRVVG

SEQ ID NO: 1831924 - protein, 23 aa, Staphylococcus epidermidis
RLESYIMFELTRIKGATVKLNSI

SEQ ID NO: 1831925 - protein, 31 aa, Staphylococcus epidermidis
RLGKSRPYIANMLRLLHLPSEIMTMVREGEL

SEQ ID NO: 1831926 - protein, 27 aa, Staphylococcus epidermidis
RLGVRGDFINPYITLTPEYEAAQIRLF

SEQ ID NO: 1831927 - protein, 17 aa, Staphylococcus epidermidis
RLHFIRDKRLLQISLKK

SEQ ID NO: 1831928 - protein, 33 aa, Staphylococcus epidermidis
RLIEAGDLPTIVRRLLVISYEDVGLASPSAGQR

SEQ ID NO: 1831929 - protein, 17 aa, Staphylococcus epidermidis
RLIPLSEGYIYFKDKPI

SEQ ID NO: 1831930 - protein, 18 aa, Staphylococcus epidermidis
RLKADLIREFLDSVIPHL

SEQ ID NO: 1831931 - protein, 18 aa, Staphylococcus epidermidis
RLKDLIKVYLKENDFEVL

SEQ ID NO: 1831932 - protein, 17 aa, Staphylococcus epidermidis
RLKFQILELLHQTFPGL

SEQ ID NO: 1831933 - protein, 19 aa, Staphylococcus epidermidis
RLKGIIKKEFSISFEEFAV

SEQ ID NO: 1831934 - protein, 20 aa, Staphylococcus epidermidis
RLKIIDGVYKLVAPDGYKFI

SEQ ID NO: 1831935 - protein, 25 aa, Staphylococcus epidermidis
RLKNHFEIPFNQYCKHEFVLSGTLQ

SEQ ID NO: 1831936 - protein, 19 aa, Staphylococcus epidermidis
RLKSIIKKEFSISFEEFAV

SEQ ID NO: 1831937 - protein, 17 aa, Staphylococcus epidermidis
RLLKSFIEYLQQVNQID

SEQ ID NO: 1831938 - protein, 21 aa, Staphylococcus epidermidis
RLLYLGIVGDTGRFLFNNTTP

SEQ ID NO: 1831939 - protein, 17 aa, Staphylococcus epidermidis
RLMKQAEKFNRPVFTFI

SEQ ID NO: 1831940 - protein, 22 aa, Staphylococcus epidermidis
RLNQLSKVTSLPVLCKDFIIDK

SEQ ID NO: 1831941 - protein, 17 aa, Staphylococcus epidermidis
RLNVTAVYTIEQVKAIT

SEQ ID NO: 1831942 - protein, 18 aa, Staphylococcus epidermidis
RLPVELAQFIRLDYQDTT

SEQ ID NO: 1831943 - protein, 19 aa, Staphylococcus epidermidis
RLREGKITERHARAVLVLP

SEQ ID NO: 1831944 - protein, 17 aa, Staphylococcus epidermidis
RLRVQLDILDRESQDIE

SEQ ID NO: 1831945 - protein, 19 aa, Staphylococcus epidermidis
RLSDLEKLIRLPGKFKYFE

SEQ ID NO: 1831946 - protein, 25 aa, Staphylococcus epidermidis
RLTAKNSFKLIYSILAKHQSASLPH

SEQ ID NO: 1831947 - protein, 19 aa, Staphylococcus epidermidis
RLTATNPFVLIYGILAKHQ

SEQ ID NO: 1831948 - protein, 26 aa, Staphylococcus epidermidis
RLTATNPFVLIYGILAKHQSASLPND

SEQ ID NO: 1831949 - protein, 29 aa, Staphylococcus epidermidis
RLTGIQFLELFTDDLYFKISKHAIDMAKK

SEQ ID NO: 1831950 - protein, 26 aa, Staphylococcus epidermidis
RLTGVQFLELFTDDLYFDISRHAIEM

SEQ ID NO: 1831951 - protein, 19 aa, Staphylococcus epidermidis
RLYDMIFIDAAKAQSKKFF

SEQ ID NO: 1831952 - protein, 18 aa, Staphylococcus epidermidis
RLYHYWALGHIHQREQLS

SEQ ID NO: 1831953 - protein, 18 aa, Staphylococcus epidermidis
RMCKPDFLLNVALNKSKE

SEQ ID NO: 1831954 - protein, 19 aa, Staphylococcus epidermidis
RMELLKRNITNKQLADMLG

SEQ ID NO: 1831955 - protein, 17 aa, Staphylococcus epidermidis
RMGLLLDMSPRALEEVI

SEQ ID NO: 1831956 - protein, 19 aa, Staphylococcus epidermidis
RMHAFFMDALPILNETRTP

SEQ ID NO: 1831957 - protein, 18 aa, Staphylococcus epidermidis
RMIDFQIVGMPLPKNDKS

SEQ ID NO: 1831958 - protein, 17 aa, Staphylococcus epidermidis
RMKAYLRDNRECQHCKA

SEQ ID NO: 1831959 - protein, 18 aa, Staphylococcus epidermidis
RMLELPSAWTDYLNTTSN

SEQ ID NO: 1831960 - protein, 24 aa, Staphylococcus epidermidis
RMNERSFVLIPLNDIASNQIEPRS

SEQ ID NO: 1831961 - protein, 19 aa, Staphylococcus epidermidis
RMPHITFLEESELVIYAAN

SEQ ID NO: 1831962 - protein, 26 aa, Staphylococcus epidermidis
RMTAIFPKLVFSIKKGVNFNPTDPNY

SEQ ID NO: 1831963 - protein, 18 aa, Staphylococcus epidermidis
RMVLFMNRNTRTSKGKFM

SEQ ID NO: 1831964 - protein, 22 aa, Staphylococcus epidermidis
RNAFDLTIAVLLSAQCTDNLVN

SEQ ID NO: 1831965 - protein, 19 aa, Staphylococcus epidermidis
RNAHKRELAYTRYSWPKNN

SEQ ID NO: 1831966 - protein, 23 aa, Staphylococcus epidermidis
RNAVFEMMNWWFEKGIDGFRVDA

SEQ ID NO: 1831967 - protein, 25 aa, Staphylococcus epidermidis
RNDIYDFYSLGFGDPYPISGSHGLG

SEQ ID NO: 1831968 - protein, 25 aa, Staphylococcus epidermidis
RNEKDYIYLMYSLTNPNMKFSLKFG

SEQ ID NO: 1831969 - protein, 19 aa, Staphylococcus epidermidis
RNFIGGIYAVFKISHTKRN

SEQ ID NO: 1831970 - protein, 17 aa, Staphylococcus epidermidis
RNIFYRDFELKEIMRMW

SEQ ID NO: 1831971 - protein, 30 aa, Staphylococcus epidermidis
RNKHNHIPPWILIIPLNFGETIKWFSILKP

SEQ ID NO: 1831972 - protein, 22 aa, Staphylococcus epidermidis
RNLINGGTLAIYMGIKRLGHII

SEQ ID NO: 1831973 - protein, 29 aa, Staphylococcus epidermidis
RNLVGIITNRDLRFIEDFSIKISDVMTKE

SEQ ID NO: 1831974 - protein, 19 aa, Staphylococcus epidermidis
RNMFGYTGTYKGKEVSVMG

SEQ ID NO: 1831975 - protein, 20 aa, Staphylococcus epidermidis
RNMFGYTGTYKGKEVSVMGS

SEQ ID NO: 1831976 - protein, 25 aa, Staphylococcus epidermidis
RNMVNLCISIDHRILDGLQTGQFMN

SEQ ID NO: 1831977 - protein, 23 aa, Staphylococcus epidermidis
RNPENLPWRELDIDLVIEATGKF

SEQ ID NO: 1831978 - protein, 26 aa, Staphylococcus epidermidis
RPAATHALHYDKLPDRLVTVFAGQDK

SEQ ID NO: 1831979 - protein, 31 aa, Staphylococcus epidermidis
RPEDLQSYGLIPEFIGRVPIVANLETLDIAA

SEQ ID NO: 1831980 - protein, 32 aa, Staphylococcus epidermidis
RPEHGLLKLRKSLNLFANIRPTFVTKGASHLS

SEQ ID NO: 1831981 - protein, 20 aa, Staphylococcus epidermidis
RPIARLGYYDYTVVDEIFEM

SEQ ID NO: 1831982 - protein, 17 aa, Staphylococcus epidermidis
RPIFLKIKRNRYKDING

SEQ ID NO: 1831983 - protein, 27 aa, Staphylococcus epidermidis
RPIRDLLPVIPEFADYTLIGGNGSIIS

SEQ ID NO: 1831984 - protein, 28 aa, Staphylococcus epidermidis
RPLRDKTTILLQKFNLLLQSLSFGDNMK

SEQ ID NO: 1831985 - protein, 18 aa, Staphylococcus epidermidis
RPMNCPHHMMIYNNKPHS

SEQ ID NO: 1831986 - protein, 25 aa, Staphylococcus epidermidis
RPQQLYLSEIILDQLMHSDKAMIEA

SEQ ID NO: 1831987 - protein, 19 aa, Staphylococcus epidermidis
RPSGFSVLYEIGSARHSRY

SEQ ID NO: 1831988 - protein, 26 aa, Staphylococcus epidermidis
RPVKIGLATLVDRGHRELPIRADFVG

SEQ ID NO: 1831989 - protein, 17 aa, Staphylococcus epidermidis
RPVRIYTVRGLRLETVH

SEQ ID NO: 1831990 - protein, 30 aa, Staphylococcus epidermidis
RPVVKGRHYIIITLWNSRQAFYDWQNSQAY

SEQ ID NO: 1831991 - protein, 25 aa, Staphylococcus epidermidis
RPVWKPMHLQPLYEGYEFFKEDKDN

SEQ ID NO: 1831992 - protein, 40 aa, Staphylococcus epidermidis
RQFKTIGVMLFQPDKQFIYPLIHIPAIDSLIWENSCGSGA

SEQ ID NO: 1831993 - protein, 21 aa, Staphylococcus epidermidis
RQFNQWGIDYVSCSPFRVPGA

SEQ ID NO: 1831994 - protein, 23 aa, Staphylococcus epidermidis
RQGKQLLEYLKAPKHLYEKVPTA

SEQ ID NO: 1831995 - protein, 19 aa, Staphylococcus epidermidis
RQGLNKPNLLYLMKPEIKE

SEQ ID NO: 1831996 - protein, 19 aa, Staphylococcus epidermidis
RQHLNPVIFVINNDGYTVE

SEQ ID NO: 1831997 - protein, 28 aa, Staphylococcus epidermidis
RQHRNGHKSAVIWFTGLSGSGKSTVSVA

SEQ ID NO: 1831998 - protein, 17 aa, Staphylococcus epidermidis
RQIIKFNEDLRTMTKQG

SEQ ID NO: 1831999 - protein, 26 aa, Staphylococcus epidermidis
RQIKGGFTFAILTKDALYGAVDPNAI

SEQ ID NO: 1832000 - protein, 20 aa, Staphylococcus epidermidis
RQLEAMLIVMDKDAILIVSG

SEQ ID NO: 1832001 - protein, 18 aa, Staphylococcus epidermidis
RQLIYCHNYYPRPDTGLS

SEQ ID NO: 1832002 - protein, 23 aa, Staphylococcus epidermidis
RQLVKVAAWYDNEMSYTSQLVRT

SEQ ID NO: 1832003 - protein, 30 aa, Staphylococcus epidermidis
RQNEPYSILNSLLVPFISAASYLIGNDVAD

SEQ ID NO: 1832004 - protein, 18 aa, Staphylococcus epidermidis
RQNIKNIILNYLIEFNLS

SEQ ID NO: 1832005 - protein, 17 aa, Staphylococcus epidermidis
RQNLNPVIFVINNDGYT

SEQ ID NO: 1832006 - protein, 20 aa, Staphylococcus epidermidis
RQPFLLIDKIVEYDEGKRCV

SEQ ID NO: 1832007 - protein, 17 aa, Staphylococcus epidermidis
RQQAVLLLHSFTGTVRD

SEQ ID NO: 1832008 - protein, 32 aa, Staphylococcus epidermidis
RQQQLDAFIPRMKKWDYILTSSDINTTLLESA

SEQ ID NO: 1832009 - protein, 17 aa, Staphylococcus epidermidis
RQQQLEAFIPRMKKWDY

SEQ ID NO: 1832010 - protein, 17 aa, Staphylococcus epidermidis
RQRLWNEVDKVEKHNAK

SEQ ID NO: 1832011 - protein, 22 aa, Staphylococcus epidermidis
RQTYDELFPYDLPTIYTKTLRE

SEQ ID NO: 1832012 - protein, 24 aa, Staphylococcus epidermidis
RQTYEKLFPYDIPTIYTKTLRERS

SEQ ID NO: 1832013 - protein, 24 aa, Staphylococcus epidermidis
RQVRRMFEYFGHQVNKLVRIQFGP

SEQ ID NO: 1832014 - protein, 22 aa, Staphylococcus epidermidis
RQVRRYFPSLLSYRRSELDMRK

SEQ ID NO: 1832015 - protein, 22 aa, Staphylococcus epidermidis
RRANLYGLINKAIEFENSSFRG

SEQ ID NO: 1832016 - protein, 25 aa, Staphylococcus epidermidis
RREANYYILSLYPQVLSKKYSYNTN

SEQ ID NO: 1832017 - protein, 22 aa, Staphylococcus epidermidis
RRGELVSCFLLEVDDSLNSINF

SEQ ID NO: 1832018 - protein, 22 aa, Staphylococcus epidermidis
RRIYRDKLNYILKKLAQYSEQL

SEQ ID NO: 1832019 - protein, 27 aa, Staphylococcus epidermidis
RRKTLTGYIYTFPYLRKNHMTIKYQSK

SEQ ID NO: 1832020 - protein, 18 aa, Staphylococcus epidermidis
RRLIWYNSGPWKRTIVYK

SEQ ID NO: 1832021 - protein, 20 aa, Staphylococcus epidermidis
RRMVLFMNRNTRTSKGKFMI

SEQ ID NO: 1832022 - protein, 17 aa, Staphylococcus epidermidis
RRPDLTFATLDHNVPTI

SEQ ID NO: 1832023 - protein, 25 aa, Staphylococcus epidermidis
RRQRKRDFRKLWITRINAAARQHDM

SEQ ID NO: 1832024 - protein, 24 aa, Staphylococcus epidermidis
RRTAIEDIIFAPTIDYKCVTTMRL

SEQ ID NO: 1832025 - protein, 17 aa, Staphylococcus epidermidis
RRVAKEEGILAGISSGA

SEQ ID NO: 1832026 - protein, 20 aa, Staphylococcus epidermidis
RRVNFLFGDIVKVTPSSKVV

SEQ ID NO: 1832027 - protein, 25 aa, Staphylococcus epidermidis
RRVQTLLDYTTLIHVVSPTLTETIE

SEQ ID NO: 1832028 - protein, 23 aa, Staphylococcus epidermidis
RSALGMSLISNYKHYRVCRPLLE

SEQ ID NO: 1832029 - protein, 27 aa, Staphylococcus epidermidis
RSDEDYLGMAWLATAFNVGARRSEIIQ

SEQ ID NO: 1832030 - protein, 20 aa, Staphylococcus epidermidis
RSEIQKMREERQMLGQMINQ

SEQ ID NO: 1832031 - protein, 26 aa, Staphylococcus epidermidis
RSFKEKGDWYKLEKGWQKAIKEGKEV

SEQ ID NO: 1832032 - protein, 21 aa, Staphylococcus epidermidis
RSFLMDDVIYLTYNNNQLNTF

SEQ ID NO: 1832033 - protein, 23 aa, Staphylococcus epidermidis
RSIADWLVGMNFTRYVTLEMKQL

SEQ ID NO: 1832034 - protein, 19 aa, Staphylococcus epidermidis
RSKALLPEKGMGRLPGIDG

SEQ ID NO: 1832035 - protein, 28 aa, Staphylococcus epidermidis
RSLLNYFIDMARFYYVIDPLFSSDSKMS

SEQ ID NO: 1832036 - protein, 27 aa, Staphylococcus epidermidis
RSMQTVLYQILIDMTKLLAPILVHTAE

SEQ ID NO: 1832037 - protein, 37 aa, Staphylococcus epidermidis
RSNKHYISIFINGRYIKNFLLNKAIIEGYHTLLTIGR

SEQ ID NO: 1832038 - protein, 26 aa, Staphylococcus epidermidis
RSPARLQLFEHVMAPLADFPVRKIVD

SEQ ID NO: 1832039 - protein, 25 aa, Staphylococcus epidermidis
RSRAQIFELYPLNQDDIRLALDRAI

SEQ ID NO: 1832040 - protein, 17 aa, Staphylococcus epidermidis
RSRVKLETDGKLLTGKD

SEQ ID NO: 1832041 - protein, 19 aa, Staphylococcus epidermidis
RSTHPQFIPGTNQLLICTN

SEQ ID NO: 1832042 - protein, 19 aa, Staphylococcus epidermidis
RSVKRLLKKYGYPSDLETI

SEQ ID NO: 1832043 - protein, 20 aa, Staphylococcus epidermidis
RSYRLLRVGSFLLSKDGYKI

SEQ ID NO: 1832044 - protein, 25 aa, Staphylococcus epidermidis
RTADRAIVFMLLSDEEEWGKLHRNS

SEQ ID NO: 1832045 - protein, 21 aa, Staphylococcus epidermidis
RTALFNYLFAKHYDGDFVVRI

SEQ ID NO: 1832046 - protein, 23 aa, Staphylococcus epidermidis
RTDKNLPILFISGKDDPFGEYGK

SEQ ID NO: 1832047 - protein, 32 aa, Staphylococcus epidermidis
RTDNKLLDFFIIDILNKLYLPSLNKRINHKIT

SEQ ID NO: 1832048 - protein, 21 aa, Staphylococcus epidermidis
RTIELLPSYVKDCYPHINEIT

SEQ ID NO: 1832049 - protein, 17 aa, Staphylococcus epidermidis
RTIEPSALFRLTEQEAG

SEQ ID NO: 1832050 - protein, 22 aa, Staphylococcus epidermidis
RTIKSPLKFNPDLAKKNWREAQ

SEQ ID NO: 1832051 - protein, 28 aa, Staphylococcus epidermidis
RTIQVQPGDFYFIPAGTIHSIGAGIMAY

SEQ ID NO: 1832052 - protein, 18 aa, Staphylococcus epidermidis
RTKMINNFRTILNYYNEL

SEQ ID NO: 1832053 - protein, 24 aa, Staphylococcus epidermidis
RTLAMNFWATIEHTLRYKYDGDYP

SEQ ID NO: 1832054 - protein, 21 aa, Staphylococcus epidermidis
RTLVSLLHQLSDAKPTGVTSL

SEQ ID NO: 1832055 - protein, 17 aa, Staphylococcus epidermidis
RTMMDGVIFPDKFKKFE

SEQ ID NO: 1832056 - protein, 18 aa, Staphylococcus epidermidis
RTMMDGVIFPDKFKKFET

SEQ ID NO: 1832057 - protein, 22 aa, Staphylococcus epidermidis
RTNAILLPHVIRYNAKDPQKHT

SEQ ID NO: 1832058 - protein, 23 aa, Staphylococcus epidermidis
RTQAILPLRGKILNVEKARLDRI

SEQ ID NO: 1832059 - protein, 40 aa, Staphylococcus epidermidis
RTQLSFVDQFREAMTKFPVWMGATTLFFGAINGAKEMLDV

SEQ ID NO: 1832060 - protein, 27 aa, Staphylococcus epidermidis
RTQQTYERIFPYNIPTTFTKSLRERSL

SEQ ID NO: 1832061 - protein, 22 aa, Staphylococcus epidermidis
RTQSLLRRIKLIDEELGLPTKI

SEQ ID NO: 1832062 - protein, 29 aa, Staphylococcus epidermidis
RTREIGYSLIPLKLYLKHGQCKVLLGVAR

SEQ ID NO: 1832063 - protein, 17 aa, Staphylococcus epidermidis
RTRMGLENYTREGKRLG

SEQ ID NO: 1832064 - protein, 34 aa, Staphylococcus epidermidis
RTTGNAIAMAWYRYPKGFKFYRNTRNFVPKPGDM

SEQ ID NO: 1832065 - protein, 23 aa, Staphylococcus epidermidis
RTTHGYFILTKIKDTGKVKTDDS

SEQ ID NO: 1832066 - protein, 18 aa, Staphylococcus epidermidis
RTYDKILVDAPCSGLGVL

SEQ ID NO: 1832067 - protein, 34 aa, Staphylococcus epidermidis
RTYGNAETFYPMPFLSPETMWYYKSAFNTDQMKL

SEQ ID NO: 1832068 - protein, 21 aa, Staphylococcus epidermidis
RTYLRLMRHVYLNNPLTSQIK

SEQ ID NO: 1832069 - protein, 22 aa, Staphylococcus epidermidis
RVAIIKWYRGLGYGKKLIHAIE

SEQ ID NO: 1832070 - protein, 22 aa, Staphylococcus epidermidis
RVAIIKWYRGLGYGKNLIHAIE

SEQ ID NO: 1832071 - protein, 37 aa, Staphylococcus epidermidis
RVANKLKLGTVWINDFHPYFAQAPWGGYKQSGVGREL

SEQ ID NO: 1832072 - protein, 28 aa, Staphylococcus epidermidis
RVDGVPAGLLTYPPLMAADIVIYNTNIV

SEQ ID NO: 1832073 - protein, 25 aa, Staphylococcus epidermidis
RVDPEQLYYLMSRGISRTEAERLVI

SEQ ID NO: 1832074 - protein, 25 aa, Staphylococcus epidermidis
RVENEFDFKILDHRLTFHGVCSDCQ

SEQ ID NO: 1832075 - protein, 17 aa, Staphylococcus epidermidis
RVFKGQKMPGRMGGNTV

SEQ ID NO: 1832076 - protein, 18 aa, Staphylococcus epidermidis
RVGEVILRTWQVAHRMKA

SEQ ID NO: 1832077 - protein, 20 aa, Staphylococcus epidermidis
RVGPIKLHIVPFTELQKQIN

SEQ ID NO: 1832078 - protein, 20 aa, Staphylococcus epidermidis
RVIGYQNQLPWHLPNDLKHI

SEQ ID NO: 1832079 - protein, 18 aa, Staphylococcus epidermidis
RVKFEKVFADHFLKLYDE

SEQ ID NO: 1832080 - protein, 19 aa, Staphylococcus epidermidis
RVKPPFFIQWDESEASREA

SEQ ID NO: 1832081 - protein, 30 aa, Staphylococcus epidermidis
RVKQLLHALQLWLMRINYLNQPKSYPSIET

SEQ ID NO: 1832082 - protein, 22 aa, Staphylococcus epidermidis
RVLNHSGFFKQKSRLFWTQMNS

SEQ ID NO: 1832083 - protein, 27 aa, Staphylococcus epidermidis
RVLSDRLVFLLQRMMWEVLGFGETSSI

SEQ ID NO: 1832084 - protein, 19 aa, Staphylococcus epidermidis
RVMHTLGDFLIQYCIEQWG

SEQ ID NO: 1832085 - protein, 26 aa, Staphylococcus epidermidis
RVNPNVRIIFRRGPLLASLKECYKVD

SEQ ID NO: 1832086 - protein, 17 aa, Staphylococcus epidermidis
RVRILFQASEELGDGAI

SEQ ID NO: 1832087 - protein, 17 aa, Staphylococcus epidermidis
RVRLYKSGKNWIKAGIK

SEQ ID NO: 1832088 - protein, 20 aa, Staphylococcus epidermidis
RVRQYRIGVATYERPRFLSQ

SEQ ID NO: 1832089 - protein, 22 aa, Staphylococcus epidermidis
RVSDIEGVLKYIEKWTDKRESL

SEQ ID NO: 1832090 - protein, 24 aa, Staphylococcus epidermidis
RVSIEEKRLRELRPGEALVKTEYC

SEQ ID NO: 1832091 - protein, 17 aa, Staphylococcus epidermidis
RVSLNNINIWNSSKNIG

SEQ ID NO: 1832092 - protein, 19 aa, Staphylococcus epidermidis
RVSVWSEEPYYRGTIKYDA

SEQ ID NO: 1832093 - protein, 19 aa, Staphylococcus epidermidis
RVTKILRYLCHTVGYDNEE

SEQ ID NO: 1832094 - protein, 17 aa, Staphylococcus epidermidis
RVYDWVQEVELLGAGEL

SEQ ID NO: 1832095 - protein, 20 aa, Staphylococcus epidermidis
RVYLAVGGGFKLDNWLNSTS

SEQ ID NO: 1832096 - protein, 21 aa, Staphylococcus epidermidis
RWIYKTMNEIRFFEEKVHKIF

SEQ ID NO: 1832097 - protein, 31 aa, Staphylococcus epidermidis
RWMEEIRDWTISRQLWWGHQIPAWYHKETNE

SEQ ID NO: 1832098 - protein, 28 aa, Staphylococcus epidermidis
RWNKSHHQLIFFGRYHCLARKPKCDICP

SEQ ID NO: 1832099 - protein, 21 aa, Staphylococcus epidermidis
RYDWFGEIIQKIDADALLTAH

SEQ ID NO: 1832100 - protein, 18 aa, Staphylococcus epidermidis
RYEMLKARLKYSQDAIFV

SEQ ID NO: 1832101 - protein, 18 aa, Staphylococcus epidermidis
RYFEANQLCFSLFSNRNR

SEQ ID NO: 1832102 - protein, 29 aa, Staphylococcus epidermidis
RYHQLETPYLDSVYIFLKSYHRQFTQTES

SEQ ID NO: 1832103 - protein, 20 aa, Staphylococcus epidermidis
RYIEIKTGIEFIKQNILISE

SEQ ID NO: 1832104 - protein, 18 aa, Staphylococcus epidermidis
RYMYLKKYASFIDRNIYV

SEQ ID NO: 1832105 - protein, 18 aa, Staphylococcus epidermidis
RYRILKSLHLLDQHYKHY

SEQ ID NO: 1832106 - protein, 22 aa, Staphylococcus epidermidis
RYSDIPYVIDPVMLAKSGDSLM

SEQ ID NO: 1832107 - protein, 22 aa, Staphylococcus epidermidis
RYSERQGGYTRILKVGPRRGDG

SEQ ID NO: 1832108 - protein, 24 aa, Staphylococcus epidermidis
RYTQTYIQRVLMNVLLNITKDDVN

SEQ ID NO: 1832109 - protein, 20 aa, Staphylococcus epidermidis
RYYRSFLKELSRIKSKLTPF

SEQ ID NO: 1832110 - protein, 18 aa, Staphylococcus epidermidis
RYYTGLLESSRDNHFAFK

SEQ ID NO: 1832111 - protein, 26 aa, Staphylococcus epidermidis
SAADPAPLLYIAPYAGVTMGEEFMFN

SEQ ID NO: 1832112 - protein, 21 aa, Staphylococcus epidermidis
SAAFYSHTYAKDNILIQMNGE

SEQ ID NO: 1832113 - protein, 23 aa, Staphylococcus epidermidis
SAANMTFALSYQYFKMCDDRAPL

SEQ ID NO: 1832114 - protein, 26 aa, Staphylococcus epidermidis
SADQALLQRLDLMKFQFEELTEASLK

SEQ ID NO: 1832115 - protein, 25 aa, Staphylococcus epidermidis
SAENNNIVFWYGWNEQAFNVVSSIV

SEQ ID NO: 1832116 - protein, 28 aa, Staphylococcus epidermidis
SAGKSTLINLLLEQNILPSSPVPTTSNT

SEQ ID NO: 1832117 - protein, 25 aa, Staphylococcus epidermidis
SAHSIGLYVNLSYSFPYIACAIDNQ

SEQ ID NO: 1832118 - protein, 19 aa, Staphylococcus epidermidis
SAIHFPITALYDKLTAHQN

SEQ ID NO: 1832119 - protein, 26 aa, Staphylococcus epidermidis
SAKESLRLRTLFPYIKEASENHKKRV

SEQ ID NO: 1832120 - protein, 29 aa, Staphylococcus epidermidis
SALFYQRRKMLIDLLINIGFTVIEPEDPL

SEQ ID NO: 1832121 - protein, 18 aa, Staphylococcus epidermidis
SALKLAYIDLKKYLNQLN

SEQ ID NO: 1832122 - protein, 18 aa, Staphylococcus epidermidis
SAMGYYPPDLFYSYTELY

SEQ ID NO: 1832123 - protein, 25 aa, Staphylococcus epidermidis
SANKKYDLFVLVVTDIINSDSKILV

SEQ ID NO: 1832124 - protein, 26 aa, Staphylococcus epidermidis
SAQTYNFKHAIIATGSRPIEIPNFEF

SEQ ID NO: 1832125 - protein, 19 aa, Staphylococcus epidermidis
SARGMFDKGWLFVDDEDVV

SEQ ID NO: 1832126 - protein, 21 aa, Staphylococcus epidermidis
SARLHPWLLQIYKKRGYEIYA

SEQ ID NO: 1832127 - protein, 20 aa, Staphylococcus epidermidis
SASALVGALFIANYFGNIQL

SEQ ID NO: 1832128 - protein, 17 aa, Staphylococcus epidermidis
SASWDAHKLLFQTYSCA

SEQ ID NO: 1832129 - protein, 24 aa, Staphylococcus epidermidis
SATKGAIVSFTRSLATTLMEKSIR

SEQ ID NO: 1832130 - protein, 20 aa, Staphylococcus epidermidis
SAWYVRVLSSLFTFYEDFSI

SEQ ID NO: 1832131 - protein, 21 aa, Staphylococcus epidermidis
SAYAFIKRLIKQFGKPQKVIT

SEQ ID NO: 1832132 - protein, 22 aa, Staphylococcus epidermidis
SAYAFIKRLIKQFGKPQKVITD

SEQ ID NO: 1832133 - protein, 22 aa, Staphylococcus epidermidis
SAYKYHFQYLIITKSNYQVCPR

SEQ ID NO: 1832134 - protein, 24 aa, Staphylococcus epidermidis
SCDPLKINGTFRKWIKRVEDEQLD

SEQ ID NO: 1832135 - protein, 23 aa, Staphylococcus epidermidis
SCKAYIDAHAKYISEYELKEGIR

SEQ ID NO: 1832136 - protein, 20 aa, Staphylococcus epidermidis
SCNYRDKAIILKAALNMQED

SEQ ID NO: 1832137 - protein, 17 aa, Staphylococcus epidermidis
SCYYLTNGSCWCVQAYQ

SEQ ID NO: 1832138 - protein, 23 aa, Staphylococcus epidermidis
SDDPKFKRWVIGSILSRTYYHNM

SEQ ID NO: 1832139 - protein, 24 aa, Staphylococcus epidermidis
SDDTWGQVPILYYVTNQDINRNEL

SEQ ID NO: 1832140 - protein, 28 aa, Staphylococcus epidermidis
SDEDVIKFLKYFTFLDKEEIDRLEQSKE

SEQ ID NO: 1832141 - protein, 22 aa, Staphylococcus epidermidis
SDEELFFVVSVDTPMITSKAVS

SEQ ID NO: 1832142 - protein, 18 aa, Staphylococcus epidermidis
SDFYPTLLKRVCEVYRIN

SEQ ID NO: 1832143 - protein, 31 aa, Staphylococcus epidermidis
SDGEAFAKFFKLMLHQGINLAPSKFEAWFLT

SEQ ID NO: 1832144 - protein, 23 aa, Staphylococcus epidermidis
SDGMLVKRPLAISGEKITLGFKE

SEQ ID NO: 1832145 - protein, 23 aa, Staphylococcus epidermidis
SDGNIMNRYGIPSVILGVGYENI

SEQ ID NO: 1832146 - protein, 17 aa, Staphylococcus epidermidis
SDGTSLTHLLYPHQYEK

SEQ ID NO: 1832147 - protein, 29 aa, Staphylococcus epidermidis
SDHIIDAFGMRPYIKKKVKKYSMGMKQKL

SEQ ID NO: 1832148 - protein, 23 aa, Staphylococcus epidermidis
SDIETMYMMTSTKYSFISSSIVK

SEQ ID NO: 1832149 - protein, 22 aa, Staphylococcus epidermidis
SDISYSVCGIPYYIGGNVSDID

SEQ ID NO: 1832150 - protein, 22 aa, Staphylococcus epidermidis
SDIVYNPYKTPILIEAEQRGNP

SEQ ID NO: 1832151 - protein, 18 aa, Staphylococcus epidermidis
SDIYIINPSMRKYLNVSV

SEQ ID NO: 1832152 - protein, 17 aa, Staphylococcus epidermidis
SDKFPSNLKYIDSYTDP

SEQ ID NO: 1832153 - protein, 23 aa, Staphylococcus epidermidis
SDKRFSFYQHGVYLLLNEDFSKL

SEQ ID NO: 1832154 - protein, 20 aa, Staphylococcus epidermidis
SDLDYTIIRPGWLTDKNENV

SEQ ID NO: 1832155 - protein, 25 aa, Staphylococcus epidermidis
SDLIDIDALIRGKVFAKNTARTGKN

SEQ ID NO: 1832156 - protein, 24 aa, Staphylococcus epidermidis
SDQIFIQTWHGFPLKKMVNDLNEQ

SEQ ID NO: 1832157 - protein, 20 aa, Staphylococcus epidermidis
SDQIGFFATLPLPLAEESVN

SEQ ID NO: 1832158 - protein, 17 aa, Staphylococcus epidermidis
SDRNAYILDRQFGRYNG

SEQ ID NO: 1832159 - protein, 17 aa, Staphylococcus epidermidis
SDRSMVFMLLNDEEEWG

SEQ ID NO: 1832160 - protein, 29 aa, Staphylococcus epidermidis
SDSKINRYTFLTTLLTQIIHRFDQFLHQT

SEQ ID NO: 1832161 - protein, 18 aa, Staphylococcus epidermidis
SDVLLNYKQARSFKSFVG

SEQ ID NO: 1832162 - protein, 23 aa, Staphylococcus epidermidis
SDVMRPYAVAKHFSDLYIENSGL

SEQ ID NO: 1832163 - protein, 27 aa, Staphylococcus epidermidis
SDWFNAAYIIMWGSNVPLTRTPDAHFM

SEQ ID NO: 1832164 - protein, 29 aa, Staphylococcus epidermidis
SEAHSTLRQSLLPHLIEAVAYNVARKNTD

SEQ ID NO: 1832165 - protein, 19 aa, Staphylococcus epidermidis
SEALEDPLIRIAFIDNEES

SEQ ID NO: 1832166 - protein, 17 aa, Staphylococcus epidermidis
SEALLALQALGYSKREL

SEQ ID NO: 1832167 - protein, 31 aa, Staphylococcus epidermidis
SECNTIPVYMPYITAYFMPRAYKDRPLVVPN

SEQ ID NO: 1832168 - protein, 18 aa, Staphylococcus epidermidis
SEDPSIYVYVPAVGDSSL

SEQ ID NO: 1832169 - protein, 27 aa, Staphylococcus epidermidis
SEEEKDMFLSLIKVTGIGPKSALAILA

SEQ ID NO: 1832170 - protein, 28 aa, Staphylococcus epidermidis
SEEGFAMPMLLALSHIHQLLIREELRME

SEQ ID NO: 1832171 - protein, 25 aa, Staphylococcus epidermidis
SEEMAELYNFLGLSVGLNLNSKSTE

SEQ ID NO: 1832172 - protein, 24 aa, Staphylococcus epidermidis
SEEMRLIYVALTRAKEQLILIGRV

SEQ ID NO: 1832173 - protein, 26 aa, Staphylococcus epidermidis
SEEVALVMMVLRLNTLLKGHSGVTLE

SEQ ID NO: 1832174 - protein, 17 aa, Staphylococcus epidermidis
SEFIEQIVKWHEQNKQM

SEQ ID NO: 1832175 - protein, 26 aa, Staphylococcus epidermidis
SEFKYPLYMDFLGTKGKLEFLIIGYT

SEQ ID NO: 1832176 - protein, 19 aa, Staphylococcus epidermidis
SEFNTVLFNAAQYVRDLYQ

SEQ ID NO: 1832177 - protein, 25 aa, Staphylococcus epidermidis
SEGAALAMSILDYVRNLGSLVMATT

SEQ ID NO: 1832178 - protein, 25 aa, Staphylococcus epidermidis
SEGDIVVGMLPWKKINTVSTETIDK

SEQ ID NO: 1832179 - protein, 26 aa, Staphylococcus epidermidis
SEGFYRRMVIIPMLRKFGKGGQKKDP

SEQ ID NO: 1832180 - protein, 22 aa, Staphylococcus epidermidis
SEGILDGLAASFKGLSSLSKEL

SEQ ID NO: 1832181 - protein, 26 aa, Staphylococcus epidermidis
SEGLEQLLPLLKKGGTLVSTLNTVTD

SEQ ID NO: 1832182 - protein, 24 aa, Staphylococcus epidermidis
SEGQILFQNLPIDSQNKREVRKHI

SEQ ID NO: 1832183 - protein, 25 aa, Staphylococcus epidermidis
SEHLSLDLQILLWNMVKERDNQPHT

SEQ ID NO: 1832184 - protein, 18 aa, Staphylococcus epidermidis
SEHYGLWAFKRVWGTYLS

SEQ ID NO: 1832185 - protein, 30 aa, Staphylococcus epidermidis
SEIDKYVFKPIIKELGFLFKNLNINKIKAK

SEQ ID NO: 1832186 - protein, 31 aa, Staphylococcus epidermidis
SEIDKYVFKPIIKELGFLFKNLNINKIKAKK

SEQ ID NO: 1832187 - protein, 17 aa, Staphylococcus epidermidis
SEIYDYIKKIVQTKGYP

SEQ ID NO: 1832188 - protein, 43 aa, Staphylococcus epidermidis
SEKDGRQAIQYLKQRGLGRATFLPLNVIKPRQIASDIKDIARN

SEQ ID NO: 1832189 - protein, 26 aa, Staphylococcus epidermidis
SEKDPKLLPFQGYILQNFELDDEGYC

SEQ ID NO: 1832190 - protein, 25 aa, Staphylococcus epidermidis
SEKHKNIMFILAQIQYFSLEDHTTV

SEQ ID NO: 1832191 - protein, 17 aa, Staphylococcus epidermidis
SEKTYLLGYTEEPLKFK

SEQ ID NO: 1832192 - protein, 19 aa, Staphylococcus epidermidis
SELKQRIPLILEVSSNQYQ

SEQ ID NO: 1832193 - protein, 21 aa, Staphylococcus epidermidis
SELRKSLFVNHKSSRKSRENR

SEQ ID NO: 1832194 - protein, 24 aa, Staphylococcus epidermidis
SELSYAANFLYMLRGELPTEVEVE

SEQ ID NO: 1832195 - protein, 19 aa, Staphylococcus epidermidis
SENGVISNPFFLTPDESVY

SEQ ID NO: 1832196 - protein, 20 aa, Staphylococcus epidermidis
SENGVITNPFFLTPDESVYE

SEQ ID NO: 1832197 - protein, 26 aa, Staphylococcus epidermidis
SENLPGTKWAKLIINSAFSGMSAATG

SEQ ID NO: 1832198 - protein, 26 aa, Staphylococcus epidermidis
SENTKSRFEAYGWNYILVKDGNDLEE

SEQ ID NO: 1832199 - protein, 17 aa, Staphylococcus epidermidis
SEQGPYYAGVTACYLLV

SEQ ID NO: 1832200 - protein, 23 aa, Staphylococcus epidermidis
SEQIFIQTWHGFPLKKMVNDLNE

SEQ ID NO: 1832201 - protein, 29 aa, Staphylococcus epidermidis
SEQLGTLFRNNFYRFIPDNVVPVIPSSLV

SEQ ID NO: 1832202 - protein, 17 aa, Staphylococcus epidermidis
SEQLKRVGASLFNPQVK

SEQ ID NO: 1832203 - protein, 25 aa, Staphylococcus epidermidis
SEQYHKQIVPVFWIAGEDHDFDEVN

SEQ ID NO: 1832204 - protein, 31 aa, Staphylococcus epidermidis
SEQYKEKFYQLPKVFFTNPDYMKLSNDAKIA

SEQ ID NO: 1832205 - protein, 23 aa, Staphylococcus epidermidis
SERALVNYIYENLSFIFDEDVSN

SEQ ID NO: 1832206 - protein, 23 aa, Staphylococcus epidermidis
SERIVQHIKYYFNLTNDRPNHFE

SEQ ID NO: 1832207 - protein, 23 aa, Staphylococcus epidermidis
SESFKAFIYYIEQHKKVFKHLLV

SEQ ID NO: 1832208 - protein, 24 aa, Staphylococcus epidermidis
SESKYLNEDPTIKANYDNAVQRAE

SEQ ID NO: 1832209 - protein, 25 aa, Staphylococcus epidermidis
SETAKVRVLPYASITKRQAGKELVD

SEQ ID NO: 1832210 - protein, 20 aa, Staphylococcus epidermidis
SETSSFLRAFKKWTGQTITE

SEQ ID NO: 1832211 - protein, 19 aa, Staphylococcus epidermidis
SEVFSRFQDKYVSLTIKEN

SEQ ID NO: 1832212 - protein, 18 aa, Staphylococcus epidermidis
SEVGLLPRVHGSGLFTRG

SEQ ID NO: 1832213 - protein, 17 aa, Staphylococcus epidermidis
SEVGLYFEPEAIHIMVP

SEQ ID NO: 1832214 - protein, 21 aa, Staphylococcus epidermidis
SEYEDKLYQAYRYNEKLKSRI

SEQ ID NO: 1832215 - protein, 26 aa, Staphylococcus epidermidis
SEYEDLLYMINNQYYYSIYFDDSVSQ

SEQ ID NO: 1832216 - protein, 29 aa, Staphylococcus epidermidis
SEYFNHQFMELFPNQPLFNTPIKNIVCDS

SEQ ID NO: 1832217 - protein, 20 aa, Staphylococcus epidermidis
SEYLSLDLQILLWNMVKERD

SEQ ID NO: 1832218 - protein, 18 aa, Staphylococcus epidermidis
SEYVGRETPLTFAESYTK

SEQ ID NO: 1832219 - protein, 31 aa, Staphylococcus epidermidis
SFDALLENHAVAYFTLFTSSMQVPLQHIIKF

SEQ ID NO: 1832220 - protein, 17 aa, Staphylococcus epidermidis
SFDMERILRLMRPSKDE

SEQ ID NO: 1832221 - protein, 23 aa, Staphylococcus epidermidis
SFDMGFIDTGYERLGFGPSTNGV

SEQ ID NO: 1832222 - protein, 32 aa, Staphylococcus epidermidis
SFERDRFYQIPQSQYFLPSQANFVFVKTSRSQ

SEQ ID NO: 1832223 - protein, 17 aa, Staphylococcus epidermidis
SFGLTLLEAMKTGVLPL

SEQ ID NO: 1832224 - protein, 20 aa, Staphylococcus epidermidis
SFHNFKKFTMPIVQALQSLG

SEQ ID NO: 1832225 - protein, 21 aa, Staphylococcus epidermidis
SFIERYVYELYDKHTTHITVV

SEQ ID NO: 1832226 - protein, 21 aa, Staphylococcus epidermidis
SFIGVYRPYIKLTQPILDKHD

SEQ ID NO: 1832227 - protein, 30 aa, Staphylococcus epidermidis
SFIRELIFREFYYVLMTYYPETAHQSFKDK

SEQ ID NO: 1832228 - protein, 21 aa, Staphylococcus epidermidis
SFIRQQWAKLGLGLDYSRERF

SEQ ID NO: 1832229 - protein, 37 aa, Staphylococcus epidermidis
SFKLFESTFFDHQLLRRLVAFMYEKPSTLIDYFQKNA

SEQ ID NO: 1832230 - protein, 18 aa, Staphylococcus epidermidis
SFKSFSKPKWSKLINKLS

SEQ ID NO: 1832231 - protein, 24 aa, Staphylococcus epidermidis
SFLAKILYSILSKLQFRNGYDEWT

SEQ ID NO: 1832232 - protein, 17 aa, Staphylococcus epidermidis
SFLIDKKSGYFYIVNDE

SEQ ID NO: 1832233 - protein, 24 aa, Staphylococcus epidermidis
SFLNDLYRIHLLLDKYSSNKDIEP

SEQ ID NO: 1832234 - protein, 18 aa, Staphylococcus epidermidis
SFMGLPTPNIFTGCGNFH

SEQ ID NO: 1832235 - protein, 26 aa, Staphylococcus epidermidis
SFNDISPIIQYKLDKGVTALWMGDLT

SEQ ID NO: 1832236 - protein, 21 aa, Staphylococcus epidermidis
SFNVDLFLRNAHRIPDYASNR

SEQ ID NO: 1832237 - protein, 26 aa, Staphylococcus epidermidis
SFPDTKILILTMFDDEEYLFHVLKSG

SEQ ID NO: 1832238 - protein, 17 aa, Staphylococcus epidermidis
SFQTEMFFLCNRYKQIR

SEQ ID NO: 1832239 - protein, 20 aa, Staphylococcus epidermidis
SFRNGKLLRKKLLSLTKQIK

SEQ ID NO: 1832240 - protein, 22 aa, Staphylococcus epidermidis
SFSMYPSLWENMGLSYPDLIAK

SEQ ID NO: 1832241 - protein, 27 aa, Staphylococcus epidermidis
SFSPTEFKFFDKLLEIVQKLKEKFEAK

SEQ ID NO: 1832242 - protein, 22 aa, Staphylococcus epidermidis
SFSTDALLLGYLTEVRKNDKVM

SEQ ID NO: 1832243 - protein, 20 aa, Staphylococcus epidermidis
SFYVPKYYVDMAKLAEARQV

SEQ ID NO: 1832244 - protein, 26 aa, Staphylococcus epidermidis
SGAALVTRLFYMKHQFRTIATMGIGG

SEQ ID NO: 1832245 - protein, 17 aa, Staphylococcus epidermidis
SGAFMKTLDDAEALAHA

SEQ ID NO: 1832246 - protein, 26 aa, Staphylococcus epidermidis
SGAGFLLNYLLGITQINPLKYNNLPH

SEQ ID NO: 1832247 - protein, 28 aa, Staphylococcus epidermidis
SGAHLTNPFILLNWSNTVSDLYTLVHEF

SEQ ID NO: 1832248 - protein, 23 aa, Staphylococcus epidermidis
SGDTLIVYKLDRISRKYDDVQTV

SEQ ID NO: 1832249 - protein, 29 aa, Staphylococcus epidermidis
SGEKIPKALALDYIYGYTIINDITDRTAQ

SEQ ID NO: 1832250 - protein, 17 aa, Staphylococcus epidermidis
SGFAFGMGPDRIAMLKY

SEQ ID NO: 1832251 - protein, 23 aa, Staphylococcus epidermidis
SGGDDLFLIGAWDDIIEASIYIN

SEQ ID NO: 1832252 - protein, 26 aa, Staphylococcus epidermidis
SGGIQLLKPLTDITLLDVYRAVEVVE

SEQ ID NO: 1832253 - protein, 25 aa, Staphylococcus epidermidis
SGGQFQRVWIAKALILEPEILILDE

SEQ ID NO: 1832254 - protein, 23 aa, Staphylococcus epidermidis
SGIVFYNLDINTAVLEFTISKNN

SEQ ID NO: 1832255 - protein, 23 aa, Staphylococcus epidermidis
SGIYSYLPLATRVLNNISKIVRE

SEQ ID NO: 1832256 - protein, 27 aa, Staphylococcus epidermidis
SGKCKDFLVHRLVAFAFIPAVVGKECI

SEQ ID NO: 1832257 - protein, 30 aa, Staphylococcus epidermidis; identical to SEQ ID NO: 1681585

SEQ ID NO: 1832258 - protein, 17 aa, Staphylococcus epidermidis
SGLSYNISYASKAFTCI

SEQ ID NO: 1832259 - protein, 26 aa, Staphylococcus epidermidis
SGMSLTRDTSRFYQYWLDHVDQDLAD

SEQ ID NO: 1832260 - protein, 30 aa, Staphylococcus epidermidis
SGNNPSWMILDVLPIIPPEIRPMVQLDGGR

SEQ ID NO: 1832261 - protein, 17 aa, Staphylococcus epidermidis
SGPAALRCSQFVYKEQK

SEQ ID NO: 1832262 - protein, 25 aa, Staphylococcus epidermidis
SGRYKNLIIWYLKEKDRRYKQIKKF

SEQ ID NO: 1832263 - protein, 24 aa, Staphylococcus epidermidis
SGSGLNGILIKNFNMWRAASTESY

SEQ ID NO: 1832264 - protein, 21 aa, Staphylococcus epidermidis
SGSIFGVIGFSGAGKSTLIRM

SEQ ID NO: 1832265 - protein, 30 aa, Staphylococcus epidermidis
SGTEQPAQQPNYHQYPNNNQQSGSNKNNSS

SEQ ID NO: 1832266 - protein, 19 aa, Staphylococcus epidermidis
SGTPTLKLTNSSQTVIYKF

SEQ ID NO: 1832267 - protein, 24 aa, Staphylococcus epidermidis
SGTVNLPMAISMVKAIKQAVQGTE

SEQ ID NO: 1832268 - protein, 20 aa, Staphylococcus epidermidis
SGVKKFIRYIYDYDKYMENR

SEQ ID NO: 1832269 - protein, 20 aa, Staphylococcus epidermidis
SGVQFFTLPFATVSEVQNYF

SEQ ID NO: 1832270 - protein, 26 aa, Staphylococcus epidermidis
SGVSQTQISLPFISAGESGPLHLEMS

SEQ ID NO: 1832271 - protein, 18 aa, Staphylococcus epidermidis
SGWFGRLGGSLLTTIDRF

SEQ ID NO: 1832272 - protein, 27 aa, Staphylococcus epidermidis
SGYSFNLFELELFKILLNTIEDFPVPT

SEQ ID NO: 1832273 - protein, 25 aa, Staphylococcus epidermidis
SHDAIDPQFYIFNNNYKKFTMLTDT

SEQ ID NO: 1832274 - protein, 21 aa, Staphylococcus epidermidis
SHDELFNFLKRVPSDIPVLID

SEQ ID NO: 1832275 - protein, 18 aa, Staphylococcus epidermidis
SHDIIKTWKKAYQEIADV

SEQ ID NO: 1832276 - protein, 17 aa, Staphylococcus epidermidis
SHFVTREEKMKVAIQRI

SEQ ID NO: 1832277 - protein, 17 aa, Staphylococcus epidermidis
SHGTILYYEDQSVINAL

SEQ ID NO: 1832278 - protein, 18 aa, Staphylococcus epidermidis
SHINFNLLNRCFEKLFEK

SEQ ID NO: 1832279 - protein, 26 aa, Staphylococcus epidermidis
SHIQAWSYPFVIKPGDDLPTAGGYGV

SEQ ID NO: 1832280 - protein, 20 aa, Staphylococcus epidermidis
SHISLLSQLGISLRAIMDRV

SEQ ID NO: 1832281 - protein, 48 aa, Staphylococcus epidermidis
SHKLTLENYVLIYYLEKIIFQANQRLLQMSGNRYQLVRREAISQGFSG

SEQ ID NO: 1832282 - protein, 19 aa, Staphylococcus epidermidis
SHPANCLMARIGKRISLDQ

SEQ ID NO: 1832283 - protein, 18 aa, Staphylococcus epidermidis
SHQIEFIHPLTHELISVS

SEQ ID NO: 1832284 - protein, 19 aa, Staphylococcus epidermidis
SHQLKLLKSTYLVKSKRQG

SEQ ID NO: 1832285 - protein, 18 aa, Staphylococcus epidermidis
SHSFIQTLVLGISGGQDS

SEQ ID NO: 1832286 - protein, 21 aa, Staphylococcus epidermidis
SHTPVWFMRQAGRSQPEYRKL

SEQ ID NO: 1832287 - protein, 18 aa, Staphylococcus epidermidis
SHVLPTNQTARFSNGLTV

SEQ ID NO: 1832288 - protein, 19 aa, Staphylococcus epidermidis
SHWFYKATSQGIYLSLGTI

SEQ ID NO: 1832289 - protein, 25 aa, Staphylococcus epidermidis
SHYVTNEHLIFFNIAASMGSIRFMN

SEQ ID NO: 1832290 - protein, 31 aa, Staphylococcus epidermidis
SICKKWYINSFRYFRNMYKRFYYSRPNELDK

SEQ ID NO: 1832291 - protein, 27 aa, Staphylococcus epidermidis
SIDGLYQFLFEFIFDIDERYIRLYVQL

SEQ ID NO: 1832292 - protein, 26 aa, Staphylococcus epidermidis
SIDGLYQFLFKFIFDVDERYIKLYVQ

SEQ ID NO: 1832293 - protein, 23 aa, Staphylococcus epidermidis
SIDHSYFNVTYLSTLYTGDLESS

SEQ ID NO: 1832294 - protein, 17 aa, Staphylococcus epidermidis
SIDPLHIVLWFDRMRET

SEQ ID NO: 1832295 - protein, 18 aa, Staphylococcus epidermidis
SIDPVKWLKTHNGSKGGG

SEQ ID NO: 1832296 - protein, 17 aa, Staphylococcus epidermidis
SIENEVLELKRIKIANL

SEQ ID NO: 1832297 - protein, 19 aa, Staphylococcus epidermidis
SIFELLNEKVEHQLPGESG

SEQ ID NO: 1832298 - protein, 18 aa, Staphylococcus epidermidis
SIFVAIKKSLYPLEITNT

SEQ ID NO: 1832299 - protein, 17 aa, Staphylococcus epidermidis
SIFYPKMFEANPELLNM

SEQ ID NO: 1832300 - protein, 23 aa, Staphylococcus epidermidis
SIGKHLEFYKLMFNIGKDSNLHE

SEQ ID NO: 1832301 - protein, 30 aa, Staphylococcus epidermidis
SIGKLNVWYITTIELLIELITYCSSKYTRS

SEQ ID NO: 1832302 - protein, 23 aa, Staphylococcus epidermidis
SIGTLNIWYITTIEQLIDLITYC

SEQ ID NO: 1832303 - protein, 24 aa, Staphylococcus epidermidis
SIGVDLLVIRHSQNAYYEELENLN

SEQ ID NO: 1832304 - protein, 24 aa, Staphylococcus epidermidis
SIGVDLLVIRHSQNSYYEELNQLN

SEQ ID NO: 1832305 - protein, 18 aa, Staphylococcus epidermidis
SIIAFDKVIEILGAIKEG

SEQ ID NO: 1832306 - protein, 33 aa, Staphylococcus epidermidis; identical to SEQ ID NO: 1689461

SEQ ID NO: 1832307 - protein, 17 aa, Staphylococcus epidermidis
SIIAYNQPLTRSDIEMI

SEQ ID NO: 1832308 - protein, 25 aa, Staphylococcus epidermidis
SIIETLQPYLFEKTARRPMILPVIM

SEQ ID NO: 1832309 - protein, 19 aa, Staphylococcus epidermidis
SIIETPKFKNTESKLTVAM

SEQ ID NO: 1832310 - protein, 24 aa, Staphylococcus epidermidis
SIIGNGFSVIYLISQRLVKKSLDD

SEQ ID NO: 1832311 - protein, 25 aa, Staphylococcus epidermidis
SIILIHACWLARVEIAMINTRLTEQ

SEQ ID NO: 1832312 - protein, 20 aa, Staphylococcus epidermidis
SIIPAHVRYDKELKPMEVIM

SEQ ID NO: 1832313 - protein, 25 aa, Staphylococcus epidermidis
SIKDEPYYHVMVDYFGGTAFEIYAQ

SEQ ID NO: 1832314 - protein, 24 aa, Staphylococcus epidermidis
SIKDINYRVLQDKTIIVFNSKLES

SEQ ID NO: 1832315 - protein, 25 aa, Staphylococcus epidermidis
SIKEGTFPSLLQWTESLWQYVPSST

SEQ ID NO: 1832316 - protein, 21 aa, Staphylococcus epidermidis
SIKGKMRNLLAKHFGLKMKQE

SEQ ID NO: 1832317 - protein, 19 aa, Staphylococcus epidermidis
SIKKKLFQLDLHRPTRKIT

SEQ ID NO: 1832318 - protein, 21 aa, Staphylococcus epidermidis
SIKLILEVLNIPKSTYYRWKN

SEQ ID NO: 1832319 - protein, 22 aa, Staphylococcus epidermidis
SIKLILEVLNIPKSTYYRWKNK

SEQ ID NO: 1832320 - protein, 20 aa, Staphylococcus epidermidis
SIKQQYWYEHSLDLFLDHFG

SEQ ID NO: 1832321 - protein, 26 aa, Staphylococcus epidermidis
SILKAKRIILLAFGEKKKEAIHKLMT

SEQ ID NO: 1832322 - protein, 18 aa, Staphylococcus epidermidis
SILNAKFINKEQFTFYGD

SEQ ID NO: 1832323 - protein, 19 aa, Staphylococcus epidermidis
SILNIFPKGWKIVKNTPDY

SEQ ID NO: 1832324 - protein, 22 aa, Staphylococcus epidermidis
SILSIHQLIKNIAQSGTTIFLT

SEQ ID NO: 1832325 - protein, 22 aa, Staphylococcus epidermidis
SIMETLYLQQSPVNAKRLAQSM

SEQ ID NO: 1832326 - protein, 23 aa, Staphylococcus epidermidis
SIMGIGPVEAIRKALKRSNKVID

SEQ ID NO: 1832327 - protein, 19 aa, Staphylococcus epidermidis
SINTFLFSGLKNIKQRTQY

SEQ ID NO: 1832328 - protein, 19 aa, Staphylococcus epidermidis
SIPVYNDQLLFTQHKIRGI

SEQ ID NO: 1832329 - protein, 19 aa, Staphylococcus epidermidis
SIQDYILEYCNFGCPYFVV

SEQ ID NO: 1832330 - protein, 18 aa, Staphylococcus epidermidis
SIQDYLLEYCNFGCPYFV

SEQ ID NO: 1832331 - protein, 19 aa, Staphylococcus epidermidis
SIQLIRNIKKLNSKIRIIK

SEQ ID NO: 1832332 - protein, 24 aa, Staphylococcus epidermidis
SIQRLMGIIISENLIECVKTAEEN

SEQ ID NO: 1832333 - protein, 19 aa, Staphylococcus epidermidis
SIQTGVIVTIFPDGSDRYM

SEQ ID NO: 1832334 - protein, 25 aa, Staphylococcus epidermidis
SIQTQILDLLKKLRQTRQLSYIFIT

SEQ ID NO: 1832335 - protein, 20 aa, Staphylococcus epidermidis
SIQVLYPLLDILNQSLEGLS

SEQ ID NO: 1832336 - protein, 18 aa, Staphylococcus epidermidis
SIRADRFAEKYRLQLFTY

SEQ ID NO: 1832337 - protein, 33 aa, Staphylococcus epidermidis
SIRKSIATPTIFNLIGPLINPFKLTYQVMGVYE

SEQ ID NO: 1832338 - protein, 17 aa, Staphylococcus epidermidis
SIRMMWLSQNQKPSYKT

SEQ ID NO: 1832339 - protein, 18 aa, Staphylococcus epidermidis
SIRMMWLSQNQKPSYKTI

SEQ ID NO: 1832340 - protein, 25 aa, Staphylococcus epidermidis
SISLDLMYHLPQQTLDDFKQSLELA

SEQ ID NO: 1832341 - protein, 23 aa, Staphylococcus epidermidis
SISTTLLIEKFNPDLIINTGSAG

SEQ ID NO: 1832342 - protein, 25 aa, Staphylococcus epidermidis
SITKLSQLLGIQIHYIFTGHVHHHF

SEQ ID NO: 1832343 - protein, 17 aa, Staphylococcus epidermidis
SIVCSFIKRGTLADIGS

SEQ ID NO: 1832344 - protein, 19 aa, Staphylococcus epidermidis
SIVCSFIKRGTLADIGSDH

SEQ ID NO: 1832345 - protein, 18 aa, Staphylococcus epidermidis
SIVKYAYNNNIPVTYLGN

SEQ ID NO: 1832346 - protein, 20 aa, Staphylococcus epidermidis
SKDFPLMAKIVDAEAPLSIH

SEQ ID NO: 1832347 - protein, 23 aa, Staphylococcus epidermidis
SKDPDFIQGYFYLQSLYENEKNY

SEQ ID NO: 1832348 - protein, 22 aa, Staphylococcus epidermidis
SKEEIEFFIKGYTKGDIPDYQA

SEQ ID NO: 1832349 - protein, 17 aa, Staphylococcus epidermidis
SKEIIDELKSMNVEVSN

SEQ ID NO: 1832350 - protein, 22 aa, Staphylococcus epidermidis
SKFDLALHRMLKGEPIQYIVGF

SEQ ID NO: 1832351 - protein, 18 aa, Staphylococcus epidermidis
SKFDLFIVTMGEEADRYA

SEQ ID NO: 1832352 - protein, 26 aa, Staphylococcus epidermidis
SKFGHQLRFDLSKGFPLLTTKKVSFK

SEQ ID NO: 1832353 - protein, 26 aa, Staphylococcus epidermidis
SKGEPIPSMIPIGQPLANIQVYILSG

SEQ ID NO: 1832354 - protein, 39 aa, Staphylococcus epidermidis
SKGFKPYMEASQKNQFPWVVAAFPTRDWAHRVYPELDVE

SEQ ID NO: 1832355 - protein, 39 aa, Staphylococcus epidermidis
SKGFKPYMEASQKNQFPWVVAAFPTRDWARRVYPDLDEE

SEQ ID NO: 1832356 - protein, 20 aa, Staphylococcus epidermidis
SKGFMYCKRYFHNNEKNKIN

SEQ ID NO: 1832357 - protein, 22 aa, Staphylococcus epidermidis
SKGKFVGMPKLIEQFRDGMKGM

SEQ ID NO: 1832358 - protein, 24 aa, Staphylococcus epidermidis
SKHREDVVFILWGKPAQQKEKLID

SEQ ID NO: 1832359 - protein, 22 aa, Staphylococcus epidermidis
SKIAYIMSYLKVHYPHYFYANI

SEQ ID NO: 1832360 - protein, 23 aa, Staphylococcus epidermidis
SKIAYIMSYLKVHYPHYFYANIL

SEQ ID NO: 1832361 - protein, 31 aa, Staphylococcus epidermidis
SKIAYIMSYLKVYYPNYFYANILSNVIGSEK

SEQ ID NO: 1832362 - protein, 23 aa, Staphylococcus epidermidis
SKIKEFKLLSTAGAYWRGNSDNK

SEQ ID NO: 1832363 - protein, 23 aa, Staphylococcus epidermidis
SKIKPVVVYFYGGGFTQGHGTAD

SEQ ID NO: 1832364 - protein, 40 aa, Staphylococcus epidermidis
SKKDRVMIQLPNSIEFIAVLFACNLLELEPVLMLPTHRHS

SEQ ID NO: 1832365 - protein, 24 aa, Staphylococcus epidermidis
SKKKAPDFYMLPGGKYDGSENDFE

SEQ ID NO: 1832366 - protein, 25 aa, Staphylococcus epidermidis
SKKRFEEMLGWFKYEIRQYTESDIS

SEQ ID NO: 1832367 - protein, 30 aa, Staphylococcus epidermidis
SKKRQLITFKYLLPFRMPIKEIENIDFIAE

SEQ ID NO: 1832368 - protein, 24 aa, Staphylococcus epidermidis
SKKTPFGFKIYNDPFDMVYVVMEG

SEQ ID NO: 1832369 - protein, 20 aa, Staphylococcus epidermidis
SKKVGAMYKPPRSHKKFPSQ

SEQ ID NO: 1832370 - protein, 18 aa, Staphylococcus epidermidis
SKKYLDQFDFLFGSSQRE

SEQ ID NO: 1832371 - protein, 18 aa, Staphylococcus epidermidis
SKLAHLLQDSKKPMILYG

SEQ ID NO: 1832372 - protein, 20 aa, Staphylococcus epidermidis
SKLKQLSYILHKALRKISFN

SEQ ID NO: 1832373 - protein, 24 aa, Staphylococcus epidermidis
SKLPNSINFIAWLQHLQDSGMTDD

SEQ ID NO: 1832374 - protein, 29 aa, Staphylococcus epidermidis
SKMISSTIVYLPEFIRTLKSGFKDGSFER

SEQ ID NO: 1832375 - protein, 39 aa, Staphylococcus epidermidis
SKMKEEPQWMLNFRLKALKLFYKMPMPQWGGDLSELNFD

SEQ ID NO: 1832376 - protein, 28 aa, Staphylococcus epidermidis
SKNIKLTDLFIYKQLPMLIEDRQQLDFE

SEQ ID NO: 1832377 - protein, 25 aa, Staphylococcus epidermidis
SKNKPYIGIGISTNLWMCDYDYASQ

SEQ ID NO: 1832378 - protein, 17 aa, Staphylococcus epidermidis
SKNLYKDLLIVADTCLC

SEQ ID NO: 1832379 - protein, 21 aa, Staphylococcus epidermidis
SKNMFRLLKQYKHTGYFKIQI

SEQ ID NO: 1832380 - protein, 25 aa, Staphylococcus epidermidis
SKNTKELFILNWAKFNWNNSEKVVN

SEQ ID NO: 1832381 - protein, 28 aa, Staphylococcus epidermidis
SKNYDDLIIVPLFLFDGRLVNKVKRLIS

SEQ ID NO: 1832382 - protein, 21 aa, Staphylococcus epidermidis
SKQLCFLFYVSSKEIIKKYTN

SEQ ID NO: 1832383 - protein, 20 aa, Staphylococcus epidermidis
SKQLLVMLHGFISDSTTYDS

SEQ ID NO: 1832384 - protein, 23 aa, Staphylococcus epidermidis
SKQTIFNNIKRLNIETVKQENTS

SEQ ID NO: 1832385 - protein, 17 aa, Staphylococcus epidermidis
SKQTVFNNIKRLNIETI

SEQ ID NO: 1832386 - protein, 17 aa, Staphylococcus epidermidis
SKRLHFIRDKRLLQISL

SEQ ID NO: 1832387 - protein, 24 aa, Staphylococcus epidermidis
SKSDTQIIEILKNQIDTLNSQMEK

SEQ ID NO: 1832388 - protein, 22 aa, Staphylococcus epidermidis
SKSKYLTYSFSRTAFNELNVNI

SEQ ID NO: 1832389 - protein, 33 aa, Staphylococcus epidermidis
SKSLASYINFYIKQLERQLKLTGKNHELQQKVK

SEQ ID NO: 1832390 - protein, 31 aa, Staphylococcus epidermidis
SKTNLVTFEEYVDMFESYTSAISNYESIVSQ

SEQ ID NO: 1832391 - protein, 19 aa, Staphylococcus epidermidis
SKVAFVFPQSQRSLIPENS

SEQ ID NO: 1832392 - protein, 22 aa, Staphylococcus epidermidis
SKVRLALKRGTKVERAGREGLQ

SEQ ID NO: 1832393 - protein, 22 aa, Staphylococcus epidermidis
SKYTRSKLRKALPEQFVYIIEE

SEQ ID NO: 1832394 - protein, 17 aa, Staphylococcus epidermidis
SLAITLKAKQLILMTDV

SEQ ID NO: 1832395 - protein, 18 aa, Staphylococcus epidermidis
SLALLLMAEVDISILSMV

SEQ ID NO: 1832396 - protein, 20 aa, Staphylococcus epidermidis
SLDLQIILWNMVKERDNHSH

SEQ ID NO: 1832397 - protein, 27 aa, Staphylococcus epidermidis
SLDNAARIMAYLTKFWKINYKNEMPGH

SEQ ID NO: 1832398 - protein, 17 aa, Staphylococcus epidermidis
SLDWECFIISKTDMLLD

SEQ ID NO: 1832399 - protein, 27 aa, Staphylococcus epidermidis
SLEELKFIYFKMQKLSPQYLKLAVMPH

SEQ ID NO: 1832400 - protein, 24 aa, Staphylococcus epidermidis
SLEESLDLYQRGMKLSANCDSTLK

SEQ ID NO: 1832401 - protein, 20 aa, Staphylococcus epidermidis
SLEFQILLWHMVEEREKSPH

SEQ ID NO: 1832402 - protein, 23 aa, Staphylococcus epidermidis
SLETPIEIEVLPKAIQLLTFPDP

SEQ ID NO: 1832403 - protein, 18 aa, Staphylococcus epidermidis
SLEVTDLVTAKKVPMKIA

SEQ ID NO: 1832404 - protein, 18 aa, Staphylococcus epidermidis
SLFIPKINEDTLLYQDFD

SEQ ID NO: 1832405 - protein, 27 aa, Staphylococcus epidermidis
SLFYNTPARLKYIKSLYTELGKITDIV

SEQ ID NO: 1832406 - protein, 23 aa, Staphylococcus epidermidis
SLGHRKNILNTHYKNLGLGVDFN

SEQ ID NO: 1832407 - protein, 21 aa, Staphylococcus epidermidis
SLGQQFNSLLPPKEVPERTEG

SEQ ID NO: 1832408 - protein, 20 aa, Staphylococcus epidermidis
SLIADLTKYVNDNMKEIGRS

SEQ ID NO: 1832409 - protein, 17 aa, Staphylococcus epidermidis
SLIEFAEWMVSLNKAGE

SEQ ID NO: 1832410 - protein, 18 aa, Staphylococcus epidermidis
SLIINDPNVYYDNGYISL

SEQ ID NO: 1832411 - protein, 17 aa, Staphylococcus epidermidis
SLILYNKYSREDFVKLL

SEQ ID NO: 1832412 - protein, 22 aa, Staphylococcus epidermidis
SLIQRHFQIGYNRAARIIDQLE

SEQ ID NO: 1832413 - protein, 28 aa, Staphylococcus epidermidis
SLKGALFTSLLLEKLNMKTSPKYNVYRT

SEQ ID NO: 1832414 - protein, 27 aa, Staphylococcus epidermidis
SLKLSDFIYVFRMFSLGIADYTLSMKY

SEQ ID NO: 1832415 - protein, 20 aa, Staphylococcus epidermidis
SLKRIDISPLGAAALSGTTH

SEQ ID NO: 1832416 - protein, 19 aa, Staphylococcus epidermidis
SLKVIHAIKLLLSTDDSIN

SEQ ID NO: 1832417 - protein, 22 aa, Staphylococcus epidermidis
SLLPREEILLKQYMIKIKQFTN

SEQ ID NO: 1832418 - protein, 18 aa, Staphylococcus epidermidis
SLLTVLPLDKERLADMEV

SEQ ID NO: 1832419 - protein, 26 aa, Staphylococcus epidermidis
SLNDDQLVMLKLTIPTEANLYKELAD

SEQ ID NO: 1832420 - protein, 27 aa, Staphylococcus epidermidis
SLNDDQLVMLKLTIPTEPNLYKELAEH

SEQ ID NO: 1832421 - protein, 43 aa, Staphylococcus epidermidis
SLNNCLALNPKFNGVYPGSTPRALVISAYRNVSVNNFTAIGTS

SEQ ID NO: 1832422 - protein, 24 aa, Staphylococcus epidermidis
SLNPPHLKAMIPWEGLNDMYREIA

SEQ ID NO: 1832423 - protein, 18 aa, Staphylococcus epidermidis
SLPNDRKYHPLEKLGRYL

SEQ ID NO: 1832424 - protein, 22 aa, Staphylococcus epidermidis
SLPSLINQAIAQDIKLIACTMS

SEQ ID NO: 1832425 - protein, 23 aa, Staphylococcus epidermidis
SLPVYKPTLLPMVFGARDKKVKG

SEQ ID NO: 1832426 - protein, 24 aa, Staphylococcus epidermidis
SLQEKLFPIEYGLKGLQHIEVSDD

SEQ ID NO: 1832427 - protein, 25 aa, Staphylococcus epidermidis
SLQKAEYILLHEAPVAPVYQKGEAH

SEQ ID NO: 1832428 - protein, 17 aa, Staphylococcus epidermidis
SLQLGGYMVVIDTGVKG

SEQ ID NO: 1832429 - protein, 17 aa, Staphylococcus epidermidis
SLQQIDRSLFWVNPDCG

SEQ ID NO: 1832430 - protein, 25 aa, Staphylococcus epidermidis
SLRGGIIDIYPLIGTPVRIELFDTE

SEQ ID NO: 1832431 - protein, 25 aa, Staphylococcus epidermidis
SLSAGLKNLLFKKINQKLSGYVSEI

SEQ ID NO: 1832432 - protein, 25 aa, Staphylococcus epidermidis
SLSDKPFYHVMLDYFGGQAYEIHAE

SEQ ID NO: 1832433 - protein, 26 aa, Staphylococcus epidermidis
SLSGHKFNGLKGQGLLLIKNIQNIEP

SEQ ID NO: 1832434 - protein, 26 aa, Staphylococcus epidermidis
SLSGHKFNGLKGQGLLLLKNIQNIEP

SEQ ID NO: 1832435 - protein, 17 aa, Staphylococcus epidermidis
SLSPFQMSGGQMRKIAI

SEQ ID NO: 1832436 - protein, 20 aa, Staphylococcus epidermidis
SLSPVMHNANFSKLGLDYTY

SEQ ID NO: 1832437 - protein, 21 aa, Staphylococcus epidermidis
SLSYKTFGIPMSYNDYIQIMN

SEQ ID NO: 1832438 - protein, 25 aa, Staphylococcus epidermidis
SLTMVFFSGKLIQMLNNPTLVVVTD

SEQ ID NO: 1832439 - protein, 19 aa, Staphylococcus epidermidis
SLVIFANKIDLNELILLGK

SEQ ID NO: 1832440 - protein, 36 aa, Staphylococcus epidermidis
SLVMVHLYDYIPKLFWPIYYFIQAPIQGLFMRGFEI

SEQ ID NO: 1832441 - protein, 17 aa, Staphylococcus epidermidis
SLYSLIDQAIDQDIKLI

SEQ ID NO: 1832442 - protein, 26 aa, Staphylococcus epidermidis
SLYYRDKNYWLDKIKEMPLQPELTVN

SEQ ID NO: 1832443 - protein, 18 aa, Staphylococcus epidermidis
SMAFLNKDTGKVTVGMAV

SEQ ID NO: 1832444 - protein, 22 aa, Staphylococcus epidermidis
SMASFLNSFPMFKDDTRNTHPK

SEQ ID NO: 1832445 - protein, 25 aa, Staphylococcus epidermidis
SMCGQTFLFRLPKHAFDYANHFPGN

SEQ ID NO: 1832446 - protein, 23 aa, Staphylococcus epidermidis
SMGAMALFGEKYGDIVRVVNMAP

SEQ ID NO: 1832447 - protein, 32 aa, Staphylococcus epidermidis
SMGHRKNILNTHFDYLGVGVYFNDRRQPFWTE

SEQ ID NO: 1832448 - protein, 20 aa, Staphylococcus epidermidis
SMKHVAVNFAKLILCDENHQ

SEQ ID NO: 1832449 - protein, 23 aa, Staphylococcus epidermidis
SMLIHEGLNIYYISKRLGHSSID

SEQ ID NO: 1832450 - protein, 17 aa, Staphylococcus epidermidis
SMLLKSIKLMRKELKNW

SEQ ID NO: 1832451 - protein, 23 aa, Staphylococcus epidermidis
SMMGYSPGFPYLTGMHKKLHVNH

SEQ ID NO: 1832452 - protein, 21 aa, Staphylococcus epidermidis
SMMYAAMKQAVKVKKPIVAHC

SEQ ID NO: 1832453 - protein, 28 aa, Staphylococcus epidermidis
SMNGRVLDLVMFLRKTAFSDLSRMIEQE

SEQ ID NO: 1832454 - protein, 24 aa, Staphylococcus epidermidis
SMRKFIGILGEFHQLYPNITYNLI

SEQ ID NO: 1832455 - protein, 26 aa, Staphylococcus epidermidis
SMTQGMIGYWLETEINRALSEIGSDR

SEQ ID NO: 1832456 - protein, 34 aa, Staphylococcus epidermidis
SMVKTVLEIIKMKKLKALKIIFSNPKKLYSLITM

SEQ ID NO: 1832457 - protein, 17 aa, Staphylococcus epidermidis
SMYPIKNLEDLYDKEGY

SEQ ID NO: 1832458 - protein, 18 aa, Staphylococcus epidermidis
SMYPIKNLEDLYDKQGYR

SEQ ID NO: 1832459 - protein, 25 aa, Staphylococcus epidermidis
SNDASVFSLIRLLPKGKQQYERQLN

SEQ ID NO: 1832460 - protein, 24 aa, Staphylococcus epidermidis
SNDPVLYFEHKKAYRFLKEEVPEA

SEQ ID NO: 1832461 - protein, 30 aa, Staphylococcus epidermidis
SNEGIFKGLPLYFNVMRYHSLMADPSTISS

SEQ ID NO: 1832462 - protein, 20 aa, Staphylococcus epidermidis
SNEKYRTWEWNYGSNPKYNI

SEQ ID NO: 1832463 - protein, 24 aa, Staphylococcus epidermidis
SNEVSYDKLFLSPGGKPVTPPVDG

SEQ ID NO: 1832464 - protein, 31 aa, Staphylococcus epidermidis
SNFSGGMKRRLSLAITLLSNPNLIILDEPTV

SEQ ID NO: 1832465 - protein, 25 aa, Staphylococcus epidermidis
SNFSVNEIKIIKLVLLKAKTSFNNS

SEQ ID NO: 1832466 - protein, 19 aa, Staphylococcus epidermidis
SNGDLIIITAGVPTGEKGT

SEQ ID NO: 1832467 - protein, 28 aa, Staphylococcus epidermidis
SNGKQLLKKLNAFGYTEQDVRDALLDEE

SEQ ID NO: 1832468 - protein, 26 aa, Staphylococcus epidermidis
SNGKYLFEAVYGAGLARIYKLNEITG

SEQ ID NO: 1832469 - protein, 32 aa, Staphylococcus epidermidis; identical to SEQ ID NO: 1688736

SEQ ID NO: 1832470 - protein, 23 aa, Staphylococcus epidermidis
SNIGIKYLTLYAFSTENWSRPES

SEQ ID NO: 1832471 - protein, 30 aa, Staphylococcus epidermidis
SNIITAPKYDGFLTSLPFVGQHFIGTYDSF

SEQ ID NO: 1832472 - protein, 19 aa, Staphylococcus epidermidis
SNIKFILAHAGGTLPYLKW

SEQ ID NO: 1832473 - protein, 27 aa, Staphylococcus epidermidis
SNIPKGRGFVKWLAFKTIPEQYQQIEQ

SEQ ID NO: 1832474 - protein, 22 aa, Staphylococcus epidermidis
SNIQRAIYFQKVNNEYIITHGF

SEQ ID NO: 1832475 - protein, 23 aa, Staphylococcus epidermidis
SNKKARKLLFWVIMNIIRGQHHY

SEQ ID NO: 1832476 - protein, 18 aa, Staphylococcus epidermidis
SNKQDDLKPRYALNVLVE

SEQ ID NO: 1832477 - protein, 26 aa, Staphylococcus epidermidis
SNKSMALIGIIDLLKQAKNRKLQLLT

SEQ ID NO: 1832478 - protein, 24 aa, Staphylococcus epidermidis
SNLLTYLNIFDDVRSFFSQHTGMK

SEQ ID NO: 1832479 - protein, 24 aa, Staphylococcus epidermidis
SNNIKLAEPILVIGNPLGTDFKGS

SEQ ID NO: 1832480 - protein, 23 aa, Staphylococcus epidermidis
SNNLKLLPKQTLLIAMYGGFNQI

SEQ ID NO: 1832481 - protein, 24 aa, Staphylococcus epidermidis
SNNNYNIFTLILPKNINSKLLKEH

SEQ ID NO: 1832482 - protein, 26 aa, Staphylococcus epidermidis
SNPDNYFHIFHKITFYYESGRLTLND

SEQ ID NO: 1832483 - protein, 25 aa, Staphylococcus epidermidis
SNQIARLRYLVEEDYYIDVFKDYSE

SEQ ID NO: 1832484 - protein, 22 aa, Staphylococcus epidermidis
SNQIPLRSFGTRVELGIALGKG

SEQ ID NO: 1832485 - protein, 19 aa, Staphylococcus epidermidis
SNVAWFWHTSFSHTTEQSR

SEQ ID NO: 1832486 - protein, 21 aa, Staphylococcus epidermidis
SNVELLAILLNTGRKGFSSID

SEQ ID NO: 1832487 - protein, 25 aa, Staphylococcus epidermidis
SNVKKEHWGFDDPAGKPWSEFQRVR

SEQ ID NO: 1832488 - protein, 28 aa, Staphylococcus epidermidis
SNVPKGRGFVKWLAFKTIPEQYQQIERY

SEQ ID NO: 1832489 - protein, 24 aa, Staphylococcus epidermidis
SNWNINAMLRLFKTDILTSQLKNS

SEQ ID NO: 1832490 - protein, 17 aa, Staphylococcus epidermidis
SPEFVNESPYEKAWMVK

SEQ ID NO: 1832491 - protein, 18 aa, Staphylococcus epidermidis
SPEFVNESPYEKAWMVKI

SEQ ID NO: 1832492 - protein, 21 aa, Staphylococcus epidermidis
SPGFTYLNHGFKSSEVPSAIF

SEQ ID NO: 1832493 - protein, 28 aa, Staphylococcus epidermidis
SPIRRYPDLTVHRLIRKYLIENSMDKKE

SEQ ID NO: 1832494 - protein, 29 aa, Staphylococcus epidermidis
SPIRRYPDLTVHRLIRKYLIENSMDKKEL

SEQ ID NO: 1832495 - protein, 30 aa, Staphylococcus epidermidis
SPIRRYPDLTVHRLIRKYLIENSMDKKKYV

SEQ ID NO: 1832496 - protein, 21 aa, Staphylococcus epidermidis
SPKLVMKVFLFVLRSKLNLQD

SEQ ID NO: 1832497 - protein, 21 aa, Staphylococcus epidermidis
SPLCLFCPIQEHCEAFHMGTA

SEQ ID NO: 1832498 - protein, 21 aa, Staphylococcus epidermidis
SPLSAFRGFFGSKPYSRTNDY

SEQ ID NO: 1832499 - protein, 19 aa, Staphylococcus epidermidis
SPLTGLKYERHEYNLFGQL

SEQ ID NO: 1832500 - protein, 20 aa, Staphylococcus epidermidis
SPNDLYTWSSGIKSPIYCDN

SEQ ID NO: 1832501 - protein, 18 aa, Staphylococcus epidermidis
SPNKWLKKGGEIKVDENG

SEQ ID NO: 1832502 - protein, 21 aa, Staphylococcus epidermidis
SPQEAYAYLEKLRSIIQYTGV

SEQ ID NO: 1832503 - protein, 18 aa, Staphylococcus epidermidis
SPRNGIIGGAKFVRKQYF

SEQ ID NO: 1832504 - protein, 24 aa, Staphylococcus epidermidis
SPSKPIGLFYTKEEAHRIQQEKGY

SEQ ID NO: 1832505 - protein, 18 aa, Staphylococcus epidermidis
SPVLWKKVKKGLSAGRVQ

SEQ ID NO: 1832506 - protein, 25 aa, Staphylococcus epidermidis
SQDVWSVLFDSRKYKDLLDEVNKLI

SEQ ID NO: 1832507 - protein, 18 aa, Staphylococcus epidermidis
SQEILPFKVKGEYFNQDE

SEQ ID NO: 1832508 - protein, 23 aa, Staphylococcus epidermidis
SQELEKLMLFLGDRPTINKDDVN

SEQ ID NO: 1832509 - protein, 19 aa, Staphylococcus epidermidis
SQENNIYDSIKEKVNENKE

SEQ ID NO: 1832510 - protein, 21 aa, Staphylococcus epidermidis
SQFHILMGMGFKKYVDTLKIS

SEQ ID NO: 1832511 - protein, 17 aa, Staphylococcus epidermidis
SQGLLEGFKNLGFETYF

SEQ ID NO: 1832512 - protein, 20 aa, Staphylococcus epidermidis
SQHPLLQTDVYFVHSYQAEM

SEQ ID NO: 1832513 - protein, 22 aa, Staphylococcus epidermidis
SQHRGYGTRLLEAGLKRFKDQY

SEQ ID NO: 1832514 - protein, 29 aa, Staphylococcus epidermidis
SQINDKYDIVLLLTKQVFNKDVLPTVKEI

SEQ ID NO: 1832515 - protein, 25 aa, Staphylococcus epidermidis
SQKHIYAIGDLIKGYQLAHAASAHG

SEQ ID NO: 1832516 - protein, 17 aa, Staphylococcus epidermidis
SQKLKLYVYQERQNKNI

SEQ ID NO: 1832517 - protein, 23 aa, Staphylococcus epidermidis
SQLAKDFILNNSGNIPKELSNKV

SEQ ID NO: 1832518 - protein, 24 aa, Staphylococcus epidermidis
SQLPDIKYYPISSGKLRRYLSFEN

SEQ ID NO: 1832519 - protein, 23 aa, Staphylococcus epidermidis
SQLPTHGLAIRILAHRTQAIEKI

SEQ ID NO: 1832520 - protein, 21 aa, Staphylococcus epidermidis
SQMAWDGFQPFKIEKINQISS

SEQ ID NO: 1832521 - protein, 32 aa, Staphylococcus epidermidis
SQNFFDIPTIHPLFDDILVSMYQYLPNIFQNQ

SEQ ID NO: 1832522 - protein, 24 aa, Staphylococcus epidermidis
SQPIFNDIEWIIVSLGSEGAFAKH

SEQ ID NO: 1832523 - protein, 23 aa, Staphylococcus epidermidis
SQPVNIKFYKEGYIDFVQLNIHR

SEQ ID NO: 1832524 - protein, 23 aa, Staphylococcus epidermidis
SQQKLDLLILNIQKLSVDCHFPR

SEQ ID NO: 1832525 - protein, 28 aa, Staphylococcus epidermidis
SQREFKIYMLIVERFLESLMKPYEYEGV

SEQ ID NO: 1832526 - protein, 20 aa, Staphylococcus epidermidis
SQSPMLLKNSRFGFKMGNQT

SEQ ID NO: 1832527 - protein, 17 aa, Staphylococcus epidermidis
SQWIVKFLNNGKSTYLT

SEQ ID NO: 1832528 - protein, 17 aa, Staphylococcus epidermidis
SQYFKRKYNFLYSEEEI

SEQ ID NO: 1832529 - protein, 23 aa, Staphylococcus epidermidis
SRAEYRLLLRHDNADLRLTDVGY

SEQ ID NO: 1832530 - protein, 25 aa, Staphylococcus epidermidis
SRAIEKDMLFIPFKGENVDGHRFID

SEQ ID NO: 1832531 - protein, 17 aa, Staphylococcus epidermidis
SRAIGGTAKDKLIFALP

SEQ ID NO: 1832532 - protein, 20 aa, Staphylococcus epidermidis
SRAKFSFRLTAIDKAILGIG

SEQ ID NO: 1832533 - protein, 22 aa, Staphylococcus epidermidis
SRDGFLLAQDISSYSLTIVAHE

SEQ ID NO: 1832534 - protein, 33 aa, Staphylococcus epidermidis
SRENYFAFGAFAQNLMLLLYEAGIGTCWKSPHY

SEQ ID NO: 1832535 - protein, 26 aa, Staphylococcus epidermidis
SREPNINKVIFLVDRKDLDSQTLAEF

SEQ ID NO: 1832536 - protein, 24 aa, Staphylococcus epidermidis
SRETPFGFKIYNDPFDMVYVVMNG

SEQ ID NO: 1832537 - protein, 18 aa, Staphylococcus epidermidis
SREYAVWALKDYGFKIIV

SEQ ID NO: 1832538 - protein, 24 aa, Staphylococcus epidermidis
SREYDLLLFLVNNRNQVLSKDQIY

SEQ ID NO: 1832539 - protein, 25 aa, Staphylococcus epidermidis
SRGKSKLYIIFKTKTGDTTLHQEIV

SEQ ID NO: 1832540 - protein, 18 aa, Staphylococcus epidermidis
SRGTPRVANRLLKRVRDF

SEQ ID NO: 1832541 - protein, 25 aa, Staphylococcus epidermidis
SRGVKSLGNYHFQMGYNADGTPKES

SEQ ID NO: 1832542 - protein, 20 aa, Staphylococcus epidermidis
SRIKGTKPYFAGKQKKLRKT

SEQ ID NO: 1832543 - protein, 26 aa, Staphylococcus epidermidis
SRIQTWSYPFVIKPGDDLPTAGGYGV

SEQ ID NO: 1832544 - protein, 19 aa, Staphylococcus epidermidis
SRIYPVGRLDYDTSGVLLL

SEQ ID NO: 1832545 - protein, 20 aa, Staphylococcus epidermidis
SRLDLYFKYNLRKYGSMKIT

SEQ ID NO: 1832546 - protein, 18 aa, Staphylococcus epidermidis
SRLHTNPMRILDCKVDRD

SEQ ID NO: 1832547 - protein, 19 aa, Staphylococcus epidermidis
SRLKDGILAIDLLRRPEMT

SEQ ID NO: 1832548 - protein, 22 aa, Staphylococcus epidermidis
SRQDEINYFKSEKYYTLSINVD

SEQ ID NO: 1832549 - protein, 25 aa, Staphylococcus epidermidis
SRRKIKRELYDTRGFLSCTRILSTD

SEQ ID NO: 1832550 - protein, 27 aa, Staphylococcus epidermidis
SRSERPEWNIIGLIGQVFIRVDETVSA

SEQ ID NO: 1832551 - protein, 18 aa, Staphylococcus epidermidis
SRTTIYRYLNKLNNQENK

SEQ ID NO: 1832552 - protein, 24 aa, Staphylococcus epidermidis
SSAEWEVMNIIWMKKYASANNIIE

SEQ ID NO: 1832553 - protein, 21 aa, Staphylococcus epidermidis
SSDPFKILSKRELEILPLIAK

SEQ ID NO: 1832554 - protein, 27 aa, Staphylococcus epidermidis
SSDVPLHLYLSVLGMPGQTAYHGLLDI

SEQ ID NO: 1832555 - protein, 18 aa, Staphylococcus epidermidis
SSELISQLEKRKAKELKL

SEQ ID NO: 1832556 - protein, 23 aa, Staphylococcus epidermidis
SSEWYQENLGFKSIFKFKNEQNQ

SEQ ID NO: 1832557 - protein, 31 aa, Staphylococcus epidermidis
SSFKSYLFIRLKFYLIDLFRQKDTTLNICSI

SEQ ID NO: 1832558 - protein, 24 aa, Staphylococcus epidermidis
SSFVYRRKLPFNADRFKEWFDHLP

SEQ ID NO: 1832559 - protein, 19 aa, Staphylococcus epidermidis
SSHLINQALNYQLPIYNSF

SEQ ID NO: 1832560 - protein, 20 aa, Staphylococcus epidermidis
SSHNQFGHIPSRIPLRASFN

SEQ ID NO: 1832561 - protein, 25 aa, Staphylococcus epidermidis
SSINLKEFLGFIRNVLLDSFNCKVI

SEQ ID NO: 1832562 - protein, 24 aa, Staphylococcus epidermidis
SSIQRLMGIIISENLVECVKMSEE

SEQ ID NO: 1832563 - protein, 17 aa, Staphylococcus epidermidis
SSLLLKKAIDVLGVNYV

SEQ ID NO: 1832564 - protein, 25 aa, Staphylococcus epidermidis
SSLQRLMGIIISENLIECVNSANDN

SEQ ID NO: 1832565 - protein, 17 aa, Staphylococcus epidermidis
SSLYKKVGLKGMYYIRD

SEQ ID NO: 1832566 - protein, 25 aa, Staphylococcus epidermidis
SSMEGRKILILADVLELGTNSQQMH

SEQ ID NO: 1832567 - protein, 29 aa, Staphylococcus epidermidis
SSNCPYRNFLFSWYYKKYDKEPDFIEFDT

SEQ ID NO: 1832568 - protein, 22 aa, Staphylococcus epidermidis
SSNERWLRNAISKLIDDYSYPI

SEQ ID NO: 1832569 - protein, 24 aa, Staphylococcus epidermidis
SSNKLKIKNLKASSDYYDKIANAI

SEQ ID NO: 1832570 - protein, 22 aa, Staphylococcus epidermidis
SSNSFLRIYDKKIQQIDTKGID

SEQ ID NO: 1832571 - protein, 18 aa, Staphylococcus epidermidis
SSNTWFYKMMPSMNQWLE

SEQ ID NO: 1832572 - protein, 30 aa, Staphylococcus epidermidis
SSPSYALFKGQNLVHFIPREHIEGRDINDI

SEQ ID NO: 1832573 - protein, 23 aa, Staphylococcus epidermidis
SSQPLFLYAIFRLFLMNEDVVPF

SEQ ID NO: 1832574 - protein, 23 aa, Staphylococcus epidermidis
SSQQKLLECLTALSIAEGLNQLV

SEQ ID NO: 1832575 - protein, 23 aa, Staphylococcus epidermidis
SSRLEILDLLSCGELCACDLLEH

SEQ ID NO: 1832576 - protein, 26 aa, Staphylococcus epidermidis
SSTGQLLFHLFAAFAEFERNLILERS

SEQ ID NO: 1832577 - protein, 25 aa, Staphylococcus epidermidis
SSVIQPLYDIGAVGMRLLTKYMNDE

SEQ ID NO: 1832578 - protein, 17 aa, Staphylococcus epidermidis
SSVLEIFHRHVPILGVC

SEQ ID NO: 1832579 - protein, 21 aa, Staphylococcus epidermidis
SSWTMPQRDKGFYTAWLHLAQ

SEQ ID NO: 1832580 - protein, 26 aa, Staphylococcus epidermidis
SSYKKNIYPIFKQLGLDTYIDVVVDR

SEQ ID NO: 1832581 - protein, 26 aa, Staphylococcus epidermidis
SSYKKNIYPIFNQLGLDTYIDVVVGR

SEQ ID NO: 1832582 - protein, 17 aa, Staphylococcus epidermidis
SSYLIKPNIAIVTGIGA

SEQ ID NO: 1832583 - protein, 28 aa, Staphylococcus epidermidis
STALKLYHFYFDYWATIVGIDIGTSEFL

SEQ ID NO: 1832584 - protein, 25 aa, Staphylococcus epidermidis
STCFGAPFLPLNPTKYADLLGNLID

SEQ ID NO: 1832585 - protein, 26 aa, Staphylococcus epidermidis
STCFGAPFLPLNPTVYADLLGELIDK

SEQ ID NO: 1832586 - protein, 24 aa, Staphylococcus epidermidis
STEDRLIIFYQYNLEKEAIENVVK

SEQ ID NO: 1832587 - protein, 25 aa, Staphylococcus epidermidis
STEKQWDLLRLLESELQTLGLSTDI

SEQ ID NO: 1832588 - protein, 22 aa, Staphylococcus epidermidis
STETLIELTEKYGDEILAVAGD

SEQ ID NO: 1832589 - protein, 24 aa, Staphylococcus epidermidis
STEVDLFFTLCNKLKEQDTRKVII

SEQ ID NO: 1832590 - protein, 17 aa, Staphylococcus epidermidis
STFHTVVPCATLIIDEN

SEQ ID NO: 1832591 - protein, 22 aa, Staphylococcus epidermidis
STFKEYVLPDAVTRFRQGLGRL

SEQ ID NO: 1832592 - protein, 23 aa, Staphylococcus epidermidis
STIELLVPRIAELVHQHHYDITG

SEQ ID NO: 1832593 - protein, 23 aa, Staphylococcus epidermidis
STIGEKLSIRRFAIRTKTDNDAF

SEQ ID NO: 1832594 - protein, 20 aa, Staphylococcus epidermidis
STIQLVHEMGLEKARRIYGE

SEQ ID NO: 1832595 - protein, 23 aa, Staphylococcus epidermidis
STKYPILSQAIILSPLQSNTYLS

SEQ ID NO: 1832596 - protein, 19 aa, Staphylococcus epidermidis
STLLRCMNLLDVPSKGKVI

SEQ ID NO: 1832597 - protein, 23 aa, Staphylococcus epidermidis
STLVGLGPRILRAETAPLYALSA

SEQ ID NO: 1832598 - protein, 24 aa, Staphylococcus epidermidis
STMFYINNQPKRLLTVGLGNLKNL

SEQ ID NO: 1832599 - protein, 27 aa, Staphylococcus epidermidis
STNVTLPQLFSDILIYCTERNVMLVDY

SEQ ID NO: 1832600 - protein, 18 aa, Staphylococcus epidermidis
STPSFIEMCLLLPNLNEQ

SEQ ID NO: 1832601 - protein, 23 aa, Staphylococcus epidermidis
STPSFIEMCLLLPNLNEQQYNSL

SEQ ID NO: 1832602 - protein, 19 aa, Staphylococcus epidermidis
STQFLIYKDVAGQSDVDLN

SEQ ID NO: 1832603 - protein, 17 aa, Staphylococcus epidermidis
STQKVILAKGLSKGKHS

SEQ ID NO: 1832604 - protein, 18 aa, Staphylococcus epidermidis
STRKKLIHLCKEITFCES

SEQ ID NO: 1832605 - protein, 22 aa, Staphylococcus epidermidis
STVAYLRTALIENGYSVGTFTS

SEQ ID NO: 1832606 - protein, 20 aa, Staphylococcus epidermidis
STVFQKVIKACWGETLDWST

SEQ ID NO: 1832607 - protein, 24 aa, Staphylococcus epidermidis
STVIYQKRFYKTWSGWERVGSDVV

SEQ ID NO: 1832608 - protein, 27 aa, Staphylococcus epidermidis
STVVVVPDYQLSLAIGKRGQNARLAAK

SEQ ID NO: 1832609 - protein, 22 aa, Staphylococcus epidermidis
STYKIYFGFANRTAYEDFKASD

SEQ ID NO: 1832610 - protein, 26 aa, Staphylococcus epidermidis
STYRRRKHDLFEFIEETVAPIVNERT

SEQ ID NO: 1832611 - protein, 19 aa, Staphylococcus epidermidis
SVAERTNLFVNDRKTYDTL

SEQ ID NO: 1832612 - protein, 23 aa, Staphylococcus epidermidis
SVANFGMFIELPNTIEGMVHIAN

SEQ ID NO: 1832613 - protein, 30 aa, Staphylococcus epidermidis
SVDDDQYWQYPPFQLTEVGGWLYGRGVSDM

SEQ ID NO: 1832614 - protein, 34 aa, Staphylococcus epidermidis
SVEAGKFADLVMWEPAFFGVKPELIVKGGLINSA

SEQ ID NO: 1832615 - protein, 29 aa, Staphylococcus epidermidis
SVEDITKLQHILFLRELDLTLSQIKDYFS

SEQ ID NO: 1832616 - protein, 24 aa, Staphylococcus epidermidis
SVHDTIPWPNYVNYAASKGGMKLM

SEQ ID NO: 1832617 - protein, 20 aa, Staphylococcus epidermidis
SVHRGDYLAVLSTGAYHYSM

SEQ ID NO: 1832618 - protein, 21 aa, Staphylococcus epidermidis
SVIVAIFGHPVEFNPLLQMNK

SEQ ID NO: 1832619 - protein, 23 aa, Staphylococcus epidermidis
SVKAGTKILPHSKVLLLTDGDVT

SEQ ID NO: 1832620 - protein, 17 aa, Staphylococcus epidermidis
SVKFALREGKILKMKPE

SEQ ID NO: 1832621 - protein, 17 aa, Staphylococcus epidermidis
SVKTVSELYAPISGKIV

SEQ ID NO: 1832622 - protein, 18 aa, Staphylococcus epidermidis
SVLEIVLLRAQDAMETVL

SEQ ID NO: 1832623 - protein, 26 aa, Staphylococcus epidermidis
SVMDSGFDGFFLIAANPVDILTRYVK

SEQ ID NO: 1832624 - protein, 18 aa, Staphylococcus epidermidis
SVMGIGPVEAVRQALKRS

SEQ ID NO: 1832625 - protein, 23 aa, Staphylococcus epidermidis
SVMKDAIWEAIFGESAPSSDPKE

SEQ ID NO: 1832626 - protein, 19 aa, Staphylococcus epidermidis
SVNGACLTVIDFNDSTFSV

SEQ ID NO: 1832627 - protein, 23 aa, Staphylococcus epidermidis
SVNGACLTVIDFTDSSFSVQVIK

SEQ ID NO: 1832628 - protein, 26 aa, Staphylococcus epidermidis
SVNNSAIFYYALPQLERGSKPTEWSL

SEQ ID NO: 1832629 - protein, 19 aa, Staphylococcus epidermidis
SVNPFRIEGQKTGAFEVVE

SEQ ID NO: 1832630 - protein, 21 aa, Staphylococcus epidermidis
SVNQMLFSLKLTAHAAQGMTE

SEQ ID NO: 1832631 - protein, 24 aa, Staphylococcus epidermidis
SVQKNIIFIIKHLSYQNGRNNDVT

SEQ ID NO: 1832632 - protein, 25 aa, Staphylococcus epidermidis
SVQRGDYLAILSTGAYHYSMASNYN

SEQ ID NO: 1832633 - protein, 17 aa, Staphylococcus epidermidis
SVRLIQDYLRSLNYEVH

SEQ ID NO: 1832634 - protein, 29 aa, Staphylococcus epidermidis
SVRSISGYPFVWWFATKPAYDGQGYGSRL

SEQ ID NO: 1832635 - protein, 19 aa, Staphylococcus epidermidis
SVSDRLYDMIFIDAAKAQS

SEQ ID NO: 1832636 - protein, 20 aa, Staphylococcus epidermidis
SVSKLYKWLKNEYPYKHTDE

SEQ ID NO: 1832637 - protein, 33 aa, Staphylococcus epidermidis
SVTSMFYTFKLMKHNVLPSLLLPELSGPFLSIS

SEQ ID NO: 1832638 - protein, 18 aa, Staphylococcus epidermidis
SVYHEMTFFVSQQNGLYR

SEQ ID NO: 1832639 - protein, 20 aa, Staphylococcus epidermidis
SVYTSYAYYQLCEEKGIIRS

SEQ ID NO: 1832640 - protein, 21 aa, Staphylococcus epidermidis
SVYTSYAYYQLCEEKGIIRSM

SEQ ID NO: 1832641 - protein, 19 aa, Staphylococcus epidermidis
SWLTILKKKESYEQAFYNF

SEQ ID NO: 1832642 - protein, 21 aa, Staphylococcus epidermidis
SWQYDFRFEGKRYRKTSFKTK

SEQ ID NO: 1832643 - protein, 20 aa, Staphylococcus epidermidis
SYAPWYIVLADHKKTSRIEV

SEQ ID NO: 1832644 - protein, 23 aa, Staphylococcus epidermidis
SYDIVLLDLMLPGISGETLLPLI

SEQ ID NO: 1832645 - protein, 20 aa, Staphylococcus epidermidis
SYHSLWHQYTNAIIYYYMVD

SEQ ID NO: 1832646 - protein, 18 aa, Staphylococcus epidermidis
SYHVIIEYPIETLNGQKH

SEQ ID NO: 1832647 - protein, 18 aa, Staphylococcus epidermidis
SYIAILKYKVFDLFSQKA

SEQ ID NO: 1832648 - protein, 21 aa, Staphylococcus epidermidis
SYIQEGKWKSWGPYLLSGKDV

SEQ ID NO: 1832649 - protein, 19 aa, Staphylococcus epidermidis
SYIQFHLNQQPRPKVKKIK

SEQ ID NO: 1832650 - protein, 24 aa, Staphylococcus epidermidis
SYKMKRLYYLRISTLPLSLGNESC

SEQ ID NO: 1832651 - protein, 27 aa, Staphylococcus epidermidis
SYKQLPLTLFQIQSKYRDEKRPRFGLL

SEQ ID NO: 1832652 - protein, 34 aa, Staphylococcus epidermidis
SYKRLPLTLFQIQSKFRDEKRPRFGLLRGREFIM

SEQ ID NO: 1832653 - protein, 20 aa, Staphylococcus epidermidis
SYNHILFINNDDINNYVYFD

SEQ ID NO: 1832654 - protein, 19 aa, Staphylococcus epidermidis
SYNMLFYDNQIPVNLGVSA

SEQ ID NO: 1832655 - protein, 22 aa, Staphylococcus epidermidis
SYPELKLGIITPFLGHTNRWNE

SEQ ID NO: 1832656 - protein, 20 aa, Staphylococcus epidermidis
SYPFIKITKEKHPRLIVTRT

SEQ ID NO: 1832657 - protein, 18 aa, Staphylococcus epidermidis
SYPFIKITKEKHPRLLVT

SEQ ID NO: 1832658 - protein, 20 aa, Staphylococcus epidermidis
SYSYLIFVQETWSMLHENRD

SEQ ID NO: 1832659 - protein, 25 aa, Staphylococcus epidermidis
SYVCDVVINQIIPANIYTLEIWVDN

SEQ ID NO: 1832660 - protein, 19 aa, Staphylococcus epidermidis
SYVLITPTYDFGEVPAPVE

SEQ ID NO: 1832661 - protein, 22 aa, Staphylococcus epidermidis
SYVNAKFYIIGNKISHNVSSHR

SEQ ID NO: 1832662 - protein, 26 aa, Staphylococcus epidermidis
SYYGKSNYYAFIILNMMFGGDPSSVL

SEQ ID NO: 1832663 - protein, 21 aa, Staphylococcus epidermidis
SYYQVKLLYRDKKGIKPTPEG

SEQ ID NO: 1832664 - protein, 24 aa, Staphylococcus epidermidis
TACYLLVNRSIRRGYKSMPEHVNM

SEQ ID NO: 1832665 - protein, 24 aa, Staphylococcus epidermidis
TADMLGMLGFRLQPTSDGLIIHPS

SEQ ID NO: 1832666 - protein, 23 aa, Staphylococcus epidermidis
TADRAIVFMLLSDEEEWGKLHRN

SEQ ID NO: 1832667 - protein, 20 aa, Staphylococcus epidermidis
TADRIGVWIGSGIGGMETFE

SEQ ID NO: 1832668 - protein, 30 aa, Staphylococcus epidermidis; identical to SEQ ID NO: 1680752

SEQ ID NO: 1832669 - protein, 24 aa, Staphylococcus epidermidis
TAEKIELFKKLEFKQLLADIDTPS

SEQ ID NO: 1832670 - protein, 21 aa, Staphylococcus epidermidis
TAGDIIRLLEGPITFVESIDS

SEQ ID NO: 1832671 - protein, 18 aa, Staphylococcus epidermidis
TAGIRSTEDFQFDGDITS

SEQ ID NO: 1832672 - protein, 20 aa, Staphylococcus epidermidis
TAGIRSVENFKFEGDITSSA

SEQ ID NO: 1832673 - protein, 19 aa, Staphylococcus epidermidis
TAHLGFGNYELRLPLIPLE

SEQ ID NO: 1832674 - protein, 19 aa, Staphylococcus epidermidis
TAIDIIGLPHVACALSGKA

SEQ ID NO: 1832675 - protein, 23 aa, Staphylococcus epidermidis
TAISPRPAFILKSSKHKDLAKKY

SEQ ID NO: 1832676 - protein, 28 aa, Staphylococcus epidermidis
TAKFEGLIHRFRRSFLLNDNFEKKRFKA

SEQ ID NO: 1832677 - protein, 24 aa, Staphylococcus epidermidis
TALKFAAHKLKKWGLPANRNTVRL

SEQ ID NO: 1832678 - protein, 22 aa, Staphylococcus epidermidis
TALSIPHAFMPRKFIDVKGSEA

SEQ ID NO: 1832679 - protein, 25 aa, Staphylococcus epidermidis
TALVRSVLGLIMNYIDRLGYTVHSV

SEQ ID NO: 1832680 - protein, 20 aa, Staphylococcus epidermidis
TAMDMARRVAKEEGILAGIS

SEQ ID NO: 1832681 - protein, 19 aa, Staphylococcus epidermidis
TAMTRVFNEYARRINELKD

SEQ ID NO: 1832682 - protein, 23 aa, Staphylococcus epidermidis
TAPKRFIREFRNLNVDEYEVGQE

SEQ ID NO: 1832683 - protein, 18 aa, Staphylococcus epidermidis
TAPKRFIREFRNVNVDEY

SEQ ID NO: 1832684 - protein, 21 aa, Staphylococcus epidermidis
TAPSNLAIMGRYVLTPEIFDY

SEQ ID NO: 1832685 - protein, 33 aa, Staphylococcus epidermidis
TARIDEYVVLRFGWLYGPGTWYGKDGMIYNQFI

SEQ ID NO: 1832686 - protein, 22 aa, Staphylococcus epidermidis
TARRIYSLIKRIFNVEVEILVR

SEQ ID NO: 1832687 - protein, 23 aa, Staphylococcus epidermidis
TASGKYPILKRANAKFNTVAELE

SEQ ID NO: 1832688 - protein, 23 aa, Staphylococcus epidermidis
TASKSLLQYVSGLSSTIAQNIID

SEQ ID NO: 1832689 - protein, 31 aa, Staphylococcus epidermidis; identical to SEQ ID NO: 1691630

SEQ ID NO: 1832690 - protein, 19 aa, Staphylococcus epidermidis
TAVAVWAAHHVLPLNISGY

SEQ ID NO: 1832691 - protein, 24 aa, Staphylococcus epidermidis
TAVSTSVLYLIEDIPQHAQDLKEV

SEQ ID NO: 1832692 - protein, 28 aa, Staphylococcus epidermidis
TAYENGIYRQLNLKRMVRPVKNIRNLTK

SEQ ID NO: 1832693 - protein, 18 aa, Staphylococcus epidermidis
TAYFLQQGTPFIYQGQEI

SEQ ID NO: 1832694 - protein, 18 aa, Staphylococcus epidermidis
TCDNTLIFALPGSTGAIK

SEQ ID NO: 1832695 - protein, 18 aa, Staphylococcus epidermidis
TCVLVFKKCRQADDDVVF

SEQ ID NO: 1832696 - protein, 22 aa, Staphylococcus epidermidis
TCYVPNYPGHGLPLDQFTQYDI

SEQ ID NO: 1832697 - protein, 17 aa, Staphylococcus epidermidis
TDALLLGYLTEVRKNDK

SEQ ID NO: 1832698 - protein, 17 aa, Staphylococcus epidermidis
TDATIDGLLPLLDDDDI

SEQ ID NO: 1832699 - protein, 26 aa, Staphylococcus epidermidis
TDDIRNEFQFLDYAQIAFVSAKEGLR

SEQ ID NO: 1832700 - protein, 19 aa, Staphylococcus epidermidis
TDEILAYDQLKQFLSTLDL

SEQ ID NO: 1832701 - protein, 29 aa, Staphylococcus epidermidis
TDETDTYMPLPIFLSHQLAKRLSDVRKDE

SEQ ID NO: 1832702 - protein, 23 aa, Staphylococcus epidermidis
TDFEKPMNLKYTSPTFTFTQNKS

SEQ ID NO: 1832703 - protein, 29 aa, Staphylococcus epidermidis
TDFKEEDIELFRDIADKVKQTNSYDLAFD

SEQ ID NO: 1832704 - protein, 47 aa, Staphylococcus epidermidis
TDGAHIQVLLLTFFFKYMKPLVQAGRVFIALPPLYKLEKGKGKSKKV

SEQ ID NO: 1832705 - protein, 32 aa, Staphylococcus epidermidis
TDGLLVVGTVKYDIPFQLKLIFVESDNGLTIT

SEQ ID NO: 1832706 - protein, 24 aa, Staphylococcus epidermidis
TDIEYKFPFGWGELWGIASRTDFD

SEQ ID NO: 1832707 - protein, 22 aa, Staphylococcus epidermidis
TDIEYRFPFGWGELWGIASRTD

SEQ ID NO: 1832708 - protein, 24 aa, Staphylococcus epidermidis
TDIKTFYGAFYSAISKIKSNNPKS

SEQ ID NO: 1832709 - protein, 23 aa, Staphylococcus epidermidis
TDKPFGVNLFVPSENHYLPDQVE

SEQ ID NO: 1832710 - protein, 28 aa, Staphylococcus epidermidis
TDNNLTFVDFYYRWLEITKLDIINDTSY

SEQ ID NO: 1832711 - protein, 23 aa, Staphylococcus epidermidis
TDPFSIHDIFTDAQLRFYNNTKK

SEQ ID NO: 1832712 - protein, 22 aa, Staphylococcus epidermidis
TDPVIIKFEADWCPDCKAMDMW

SEQ ID NO: 1832713 - protein, 19 aa, Staphylococcus epidermidis
TDQLPRIDYFVAGVGSGGT

SEQ ID NO: 1832714 - protein, 20 aa, Staphylococcus epidermidis
TDQNVAQLVEDLRSEIQKMR

SEQ ID NO: 1832715 - protein, 17 aa, Staphylococcus epidermidis
TDRGLLVPVVKHADRKS

SEQ ID NO: 1832716 - protein, 26 aa, Staphylococcus epidermidis
TDSSNYIFVIFVKNPILKEKMITDLR

SEQ ID NO: 1832717 - protein, 23 aa, Staphylococcus epidermidis
TDTKLLTWVTMNLKDNLNISQYD

SEQ ID NO: 1832718 - protein, 24 aa, Staphylococcus epidermidis
TDTKTFYGAFYSAITKIKSNNPNS

SEQ ID NO: 1832719 - protein, 18 aa, Staphylococcus epidermidis
TDVYHYLVNLLTKNKADV

SEQ ID NO: 1832720 - protein, 20 aa, Staphylococcus epidermidis
TDWTYFQIKLVIVGIERGDL

SEQ ID NO: 1832721 - protein, 17 aa, Staphylococcus epidermidis
TDYKSINVLIYFKDITE

SEQ ID NO: 1832722 - protein, 26 aa, Staphylococcus epidermidis
TEAERLVIHGFLDPVVRELPIEDVKR

SEQ ID NO: 1832723 - protein, 27 aa, Staphylococcus epidermidis
TEAKRKGLEPLAQWLIQGKLDKKIEDK

SEQ ID NO: 1832724 - protein, 27 aa, Staphylococcus epidermidis
TEAQAEAIVMLQLYRLTNTDIVALEEE

SEQ ID NO: 1832725 - protein, 27 aa, Staphylococcus epidermidis
TEARSLKFFKYFYTHRGPVMNFNNLVL

SEQ ID NO: 1832726 - protein, 23 aa, Staphylococcus epidermidis
TEDDYIYLISRYESYCKTYDVDS

SEQ ID NO: 1832727 - protein, 30 aa, Staphylococcus epidermidis
TEDSRKVIYILPSQPLKYASNTWIYKTMPT

SEQ ID NO: 1832728 - protein, 30 aa, Staphylococcus epidermidis
TEDTRKVIYLLPSQPLKYASNTWIYKTMPT

SEQ ID NO: 1832729 - protein, 26 aa, Staphylococcus epidermidis
TEDVRNEFQFLDYAQIAFVSAKESLR

SEQ ID NO: 1832730 - protein, 20 aa, Staphylococcus epidermidis
TEEAIKHLIFDALDATMEVL

SEQ ID NO: 1832731 - protein, 24 aa, Staphylococcus epidermidis
TEEDLKNMYKWMDLGRKVDERLWL

SEQ ID NO: 1832732 - protein, 27 aa, Staphylococcus epidermidis
TEEEEFYIFIGQFYSLNQHLLPKEVHV

SEQ ID NO: 1832733 - protein, 26 aa, Staphylococcus epidermidis
TEEMRIAILPIGYADGYLRAMQGAYV

SEQ ID NO: 1832734 - protein, 24 aa, Staphylococcus epidermidis
TEEYHELLAFYNFKAEVNPSKVEY

SEQ ID NO: 1832735 - protein, 30 aa, Staphylococcus epidermidis
TEFEIITTMMFLYFGEIHPVDFVIIEAGLG

SEQ ID NO: 1832736 - protein, 27 aa, Staphylococcus epidermidis
TEFEIITTMMFLYFGEINPVDFVVIEA

SEQ ID NO: 1832737 - protein, 24 aa, Staphylococcus epidermidis
TEGAELFGYIYYADNKTIYIHDDA

SEQ ID NO: 1832738 - protein, 23 aa, Staphylococcus epidermidis
TEGSIYEGFLEYGRNFKKYEGKD

SEQ ID NO: 1832739 - protein, 24 aa, Staphylococcus epidermidis
TEGTIYEGFLEYARNFKKYEGKDQ

SEQ ID NO: 1832740 - protein, 27 aa, Staphylococcus epidermidis
TEGVYMVPAFVGLGTPYWDSDARGAFF

SEQ ID NO: 1832741 - protein, 25 aa, Staphylococcus epidermidis
TEHLEILNRLFTPLIGPQSIGLYHF

SEQ ID NO: 1832742 - protein, 25 aa, Staphylococcus epidermidis
TEHMFFGPERLVEMRRFILASNHDE

SEQ ID NO: 1832743 - protein, 20 aa, Staphylococcus epidermidis
TEIHDLLMKALIDGLMDIET

SEQ ID NO: 1832744 - protein, 21 aa, Staphylococcus epidermidis
TEIYSMMQGALRLLINGSDFS

SEQ ID NO: 1832745 - protein, 21 aa, Staphylococcus epidermidis
TEKIVFVNHLGKIIAMNDAAS

SEQ ID NO: 1832746 - protein, 23 aa, Staphylococcus epidermidis
TEKIYKQLLREGVDFMTMGNHTY

SEQ ID NO: 1832747 - protein, 17 aa, Staphylococcus epidermidis
TELPSLDIDAWIVSIYL

SEQ ID NO: 1832748 - protein, 22 aa, Staphylococcus epidermidis
TELQQLIDYLNTYSDEKISLLV

SEQ ID NO: 1832749 - protein, 17 aa, Staphylococcus epidermidis
TENLRTIHAIPLKIKEP

SEQ ID NO: 1832750 - protein, 26 aa, Staphylococcus epidermidis
TENQPPQGIILPCYYDGKQWVGQTQD

SEQ ID NO: 1832751 - protein, 27 aa, Staphylococcus epidermidis
TENRGLIPYTVFIDPPLSRVGLTAIEA

SEQ ID NO: 1832752 - protein, 18 aa, Staphylococcus epidermidis
TEQAPKLLLKGTGDLKGS

SEQ ID NO: 1832753 - protein, 24 aa, Staphylococcus epidermidis
TEQPDIILLDLGLPDIDGLSLIQQ

SEQ ID NO: 1832754 - protein, 19 aa, Staphylococcus epidermidis
TEREKLLHLGDILHKRVVG

SEQ ID NO: 1832755 - protein, 17 aa, Staphylococcus epidermidis
TERFIERGIIEIAPLAY

SEQ ID NO: 1832756 - protein, 24 aa, Staphylococcus epidermidis
TERNATMRYTQAEKGLIEKDKSSW

SEQ ID NO: 1832757 - protein, 27 aa, Staphylococcus epidermidis
TESEFEKHMYAIHTLTSLYTSNDSQTS

SEQ ID NO: 1832758 - protein, 23 aa, Staphylococcus epidermidis
TESFRRLFKYKKVSKNLIGFMRS

SEQ ID NO: 1832759 - protein, 37 aa, Staphylococcus epidermidis
TESKRQFMLNQIRALIYGVWLLSWSKIKLSESSIKAD

SEQ ID NO: 1832760 - protein, 37 aa, Staphylococcus epidermidis
TESKRQFMLNQIRALIYGVWLLSWSKVKLSESSIKAD

SEQ ID NO: 1832761 - protein, 25 aa, Staphylococcus epidermidis
TESLLLELNLIKQYQPRYNILLKDD

SEQ ID NO: 1832762 - protein, 25 aa, Staphylococcus epidermidis
TEVRKICLYLDISADIYFLNEGREN

SEQ ID NO: 1832763 - protein, 38 aa, Staphylococcus epidermidis
TEVRLVLSFLRTVDNPLQDIYLVGLMRSVIYQFTEDEL

SEQ ID NO: 1832764 - protein, 18 aa, Staphylococcus epidermidis
TEWSLSRLDVFSTEQLAA

SEQ ID NO: 1832765 - protein, 20 aa, Staphylococcus epidermidis
TFDQVALWLKDVRDIDIYPN

SEQ ID NO: 1832766 - protein, 19 aa, Staphylococcus epidermidis
TFEPFSSIEYKIFGNQLTP

SEQ ID NO: 1832767 - protein, 17 aa, Staphylococcus epidermidis
TFEVMKDLRILASELRN

SEQ ID NO: 1832768 - protein, 17 aa, Staphylococcus epidermidis
TFGHFGIFSFNGNKIIT

SEQ ID NO: 1832769 - protein, 25 aa, Staphylococcus epidermidis
TFGQPAIAIPFNAGKIKILIESMEE

SEQ ID NO: 1832770 - protein, 23 aa, Staphylococcus epidermidis
TFIAKGVIYPHPPISKIESAEKE

SEQ ID NO: 1832771 - protein, 19 aa, Staphylococcus epidermidis
TFIAKSVIYPHPPKSKTEA

SEQ ID NO: 1832772 - protein, 21 aa, Staphylococcus epidermidis
TFIQQLVEFCNQHHILVIIDE

SEQ ID NO: 1832773 - protein, 19 aa, Staphylococcus epidermidis
TFKFMAPLDYETITSRSIL

SEQ ID NO: 1832774 - protein, 17 aa, Staphylococcus epidermidis
TFKLGIVLSYLKQYRAS

SEQ ID NO: 1832775 - protein, 18 aa, Staphylococcus epidermidis
TFKSVYQHLTNDGVFLFD

SEQ ID NO: 1832776 - protein, 17 aa, Staphylococcus epidermidis
TFLFDKTAKKFAKDEQD

SEQ ID NO: 1832777 - protein, 19 aa, Staphylococcus epidermidis
TFLSILEVLGTSASDFFKE

SEQ ID NO: 1832778 - protein, 18 aa, Staphylococcus epidermidis
TFMTPLGQSPLALGADIV

SEQ ID NO: 1832779 - protein, 26 aa, Staphylococcus epidermidis
TFMYSQLDNYLAKHKLKYFSKDNFDI

SEQ ID NO: 1832780 - protein, 18 aa, Staphylococcus epidermidis
TFPNIFKRNRLTIGVSTE

SEQ ID NO: 1832781 - protein, 21 aa, Staphylococcus epidermidis
TFQYDFYFKGKRYRKSGYLTK

SEQ ID NO: 1832782 - protein, 26 aa, Staphylococcus epidermidis
TFTRNLTDWIKNSGGTTFSLSMTAST

SEQ ID NO: 1832783 - protein, 27 aa, Staphylococcus epidermidis
TGADKTLLVDLLGAKKAVDFALNHNVK

SEQ ID NO: 1832784 - protein, 24 aa, Staphylococcus epidermidis
TGAEPLYFLDYIATNKVVPEIIEQ

SEQ ID NO: 1832785 - protein, 20 aa, Staphylococcus epidermidis
TGAGFIVALTGAIMTMPGLP

SEQ ID NO: 1832786 - protein, 21 aa, Staphylococcus epidermidis
TGAIIVYTLVKPEIKKYMLAK

SEQ ID NO: 1832787 - protein, 34 aa, Staphylococcus epidermidis
TGAYCASPYFTHSYVFISWTGKMAETFVLAHELG

SEQ ID NO: 1832788 - protein, 24 aa, Staphylococcus epidermidis
TGDLSHRKLFPSIFHLFQQDNLDE

SEQ ID NO: 1832789 - protein, 17 aa, Staphylococcus epidermidis
TGDMFRKAIKDETDLGK

SEQ ID NO: 1832790 - protein, 17 aa, Staphylococcus epidermidis
TGDWMNRNIEVDGDTKG

SEQ ID NO: 1832791 - protein, 32 aa, Staphylococcus epidermidis
TGEIVFKIKGPLPFLQLTHFLLKFGEFSGSGI

SEQ ID NO: 1832792 - protein, 25 aa, Staphylococcus epidermidis
TGESTLPLIKSLSSKQVRLNVTAVY

SEQ ID NO: 1832793 - protein, 29 aa, Staphylococcus epidermidis
TGHMPNLWPHLSLIRIPTLILVGEKDKKF

SEQ ID NO: 1832794 - protein, 21 aa, Staphylococcus epidermidis
TGIFVTVLRSFSHFSHQIQPE

SEQ ID NO: 1832795 - protein, 23 aa, Staphylococcus epidermidis
TGIRMIKHYATLTTTAHILNQSL

SEQ ID NO: 1832796 - protein, 26 aa, Staphylococcus epidermidis
TGIYAERTAPWLNRLGFENVKEVLLD

SEQ ID NO: 1832797 - protein, 25 aa, Staphylococcus epidermidis
TGKSHSFLLPLMQKIDVDVQEPQAI

SEQ ID NO: 1832798 - protein, 24 aa, Staphylococcus epidermidis
TGKSTLIELIRYALDIAPTSQNTN

SEQ ID NO: 1832799 - protein, 17 aa, Staphylococcus epidermidis
TGKSTSLVFYQIKIDLD

SEQ ID NO: 1832800 - protein, 23 aa, Staphylococcus epidermidis
TGKTFLAVVYAAKQLRKGSVKRI

SEQ ID NO: 1832801 - protein, 17 aa, Staphylococcus epidermidis
TGKTGAFGIPLIEKVVG

SEQ ID NO: 1832802 - protein, 22 aa, Staphylococcus epidermidis
TGKTGAFGIPLIEKVVGQEGVQ

SEQ ID NO: 1832803 - protein, 22 aa, Staphylococcus epidermidis
TGLEILSYVRKKQLNTRIIIVT

SEQ ID NO: 1832804 - protein, 22 aa, Staphylococcus epidermidis
TGLIKANIPTRIAFMVSSSVDS

SEQ ID NO: 1832805 - protein, 26 aa, Staphylococcus epidermidis
TGLKAIICIHDTTLGPALGGCRVRND

SEQ ID NO: 1832806 - protein, 24 aa, Staphylococcus epidermidis
TGLKRIGLNVIWIIKDVPLKDKYV

SEQ ID NO: 1832807 - protein, 22 aa, Staphylococcus epidermidis
TGLWLSELVHFYDAFKHTNVDI

SEQ ID NO: 1832808 - protein, 21 aa, Staphylococcus epidermidis
TGLYIQSLLYNYAFEDETVSP

SEQ ID NO: 1832809 - protein, 24 aa, Staphylococcus epidermidis
TGMINLCFEIFDDKIKIVISDQGE

SEQ ID NO: 1832810 - protein, 24 aa, Staphylococcus epidermidis
TGMINLCFEIFDDRIKIVISDQGE

SEQ ID NO: 1832811 - protein, 36 aa, Staphylococcus epidermidis
TGNQTNLRIYFTSTWPSKLVYIAKPQLEKGTVASDW

SEQ ID NO: 1832812 - protein, 20 aa, Staphylococcus epidermidis
TGQWLVLRDIANFQPTTLVK

SEQ ID NO: 1832813 - protein, 20 aa, Staphylococcus epidermidis
TGQWLVLRDIANYQPTTLVK

SEQ ID NO: 1832814 - protein, 20 aa, Staphylococcus epidermidis
TGRKDIMLPTAKAALAVGAD

SEQ ID NO: 1832815 - protein, 22 aa, Staphylococcus epidermidis
TGRVLGYKLSFNPLTQKNDLVI

SEQ ID NO: 1832816 - protein, 29 aa, Staphylococcus epidermidis
TGSGKSYFLYFLIFQLVIKNADVYVIDRK

SEQ ID NO: 1832817 - protein, 29 aa, Staphylococcus epidermidis
TGSVVLPGRFFVDIIKKLPGKDVKLSTNE

SEQ ID NO: 1832818 - protein, 24 aa, Staphylococcus epidermidis
TGTDWVGRNVLDPAFDRVKHIYSI

SEQ ID NO: 1832819 - protein, 28 aa, Staphylococcus epidermidis
TGTPIHPMSPLSKIFWMRHEEPEIFKQT

SEQ ID NO: 1832820 - protein, 29 aa, Staphylococcus epidermidis
TGTPIHPMSPLSKIFWMRHEEPKIFKQTA

SEQ ID NO: 1832821 - protein, 26 aa, Staphylococcus epidermidis
TGTPLHPMSPLSKIFWMKHEQPEIYN

SEQ ID NO: 1832822 - protein, 21 aa, Staphylococcus epidermidis
TGTYTMPCARTLVPVEVPLDV

SEQ ID NO: 1832823 - protein, 41 aa, Staphylococcus epidermidis
TGVHDGFLIFMRPKFNLYFMFNWLENFQLKWNKYGQPGSQV

SEQ ID NO: 1832824 - protein, 22 aa, Staphylococcus epidermidis
TGVLTNQIYFDPNAKDPFWNDS

SEQ ID NO: 1832825 - protein, 18 aa, Staphylococcus epidermidis
TGVSLGGLFTLRLAEHFN

SEQ ID NO: 1832826 - protein, 25 aa, Staphylococcus epidermidis
TGYQNEYYYLVGDIPTLKEYRKYYE

SEQ ID NO: 1832827 - protein, 22 aa, Staphylococcus epidermidis
TGYTLNVPLFVNEGDILVINTG

SEQ ID NO: 1832828 - protein, 17 aa, Staphylococcus epidermidis
THEEMLWLKQNIINYME

SEQ ID NO: 1832829 - protein, 29 aa, Staphylococcus epidermidis
THENSYAMPILLALSHVHQLLIREGLRME

SEQ ID NO: 1832830 - protein, 26 aa, Staphylococcus epidermidis
THEQRRLEFLAGRFTVKEAFSKALGT

SEQ ID NO: 1832831 - protein, 23 aa, Staphylococcus epidermidis
THETLKRYLLEETFELFEAIDNE

SEQ ID NO: 1832832 - protein, 29 aa, Staphylococcus epidermidis
THFFKSHESFIIYYLKQLNVDLSVVIFNS

SEQ ID NO: 1832833 - protein, 19 aa, Staphylococcus epidermidis
THFPLNAQGKLDVSRAVGT

SEQ ID NO: 1832834 - protein, 20 aa, Staphylococcus epidermidis
THFVKSWLLDARAPKVTPPS

SEQ ID NO: 1832835 - protein, 25 aa, Staphylococcus epidermidis
THKNNLAIFDSFKKLENLLTHDERF

SEQ ID NO: 1832836 - protein, 21 aa, Staphylococcus epidermidis
THLLISNRFKTDSSFWKAVYN

SEQ ID NO: 1832837 - protein, 21 aa, Staphylococcus epidermidis
THLSRVIVSTKINPDLIGGFR

SEQ ID NO: 1832838 - protein, 17 aa, Staphylococcus epidermidis
THLYMKNENVVYPVAHG

SEQ ID NO: 1832839 - protein, 27 aa, Staphylococcus epidermidis
THPIEWQLQYLLLRRDFKSYEACQLLM

SEQ ID NO: 1832840 - protein, 24 aa, Staphylococcus epidermidis
THPQFVVPTPHRIFDFFNAFIGTR

SEQ ID NO: 1832841 - protein, 17 aa, Staphylococcus epidermidis
THPVNNFILNGITRRVI

SEQ ID NO: 1832842 - protein, 18 aa, Staphylococcus epidermidis
THTLQLIGFDNVAGYRLP

SEQ ID NO: 1832843 - protein, 19 aa, Staphylococcus epidermidis
THVLFLNMHGKPLSRQGIW

SEQ ID NO: 1832844 - protein, 19 aa, Staphylococcus epidermidis
TIAAIKKVNGLSPTTILQG

SEQ ID NO: 1832845 - protein, 19 aa, Staphylococcus epidermidis
TIADIRGLKIWMFGVDEGD

SEQ ID NO: 1832846 - protein, 23 aa, Staphylococcus epidermidis
TIADIRGLKIWMFGVDEGDQIRC

SEQ ID NO: 1832847 - protein, 18 aa, Staphylococcus epidermidis
TIAILLSTKPEQILDTIH

SEQ ID NO: 1832848 - protein, 25 aa, Staphylococcus epidermidis
TIANEVKLPVVLYNVPSRTNMTIEP

SEQ ID NO: 1832849 - protein, 23 aa, Staphylococcus epidermidis
TIAPFGATVPYYFTGHEGPDSCC

SEQ ID NO: 1832850 - protein, 18 aa, Staphylococcus epidermidis
TIARLGYYDYTVVDEIFE

SEQ ID NO: 1832851 - protein, 25 aa, Staphylococcus epidermidis
TIDAIFNDRKRLLPSIAYLEGEYGC

SEQ ID NO: 1832852 - protein, 17 aa, Staphylococcus epidermidis
TIDPHKMGYIPYSAGGI

SEQ ID NO: 1832853 - protein, 41 aa, Staphylococcus epidermidis
TIDRFGGLGRAISVGIKFLGKLTIPLTIATTIFGVSYEKMD

SEQ ID NO: 1832854 - protein, 24 aa, Staphylococcus epidermidis
TIDVDMYIIVSYGVKISEVASNLQ

SEQ ID NO: 1832855 - protein, 26 aa, Staphylococcus epidermidis
TIDVTKRIRYLLFQMNMYQTSSQLDD

SEQ ID NO: 1832856 - protein, 19 aa, Staphylococcus epidermidis
TIEQLPNLNNAQKGLEDTM

SEQ ID NO: 1832857 - protein, 29 aa, Staphylococcus epidermidis
TIEQSLREPLLFYRQLIRQNIKNIILNYL

SEQ ID NO: 1832858 - protein, 31 aa, Staphylococcus epidermidis
TIFGVSYEKMDWFRRGFSDMGKLVNQVGESI

SEQ ID NO: 1832859 - protein, 17 aa, Staphylococcus epidermidis
TIFIYGYGASFVVATDL

SEQ ID NO: 1832860 - protein, 33 aa, Staphylococcus epidermidis
TIFKAMIAIKTGNPIIFAFHPSAQQSSKHAVKV

SEQ ID NO: 1832861 - protein, 17 aa, Staphylococcus epidermidis
TIFLISSHILSELVKIT

SEQ ID NO: 1832862 - protein, 17 aa, Staphylococcus epidermidis
TIFLNGYMKELISEISN

SEQ ID NO: 1832863 - protein, 36 aa, Staphylococcus epidermidis
TIGIMLFQQNKQFIYPLIHIPAIDSLIWENSCGSGA

SEQ ID NO: 1832864 - protein, 19 aa, Staphylococcus epidermidis
TIGKLLGYISDYLYTDLNI

SEQ ID NO: 1832865 - protein, 32 aa, Staphylococcus epidermidis
TIHQQQFLNAYYRIFPSYTGVGLAFESMEEIA

SEQ ID NO: 1832866 - protein, 20 aa, Staphylococcus epidermidis
TIIAHHPLIFKGIKNIVQTG

SEQ ID NO: 1832867 - protein, 18 aa, Staphylococcus epidermidis
TIIDYFRDDAIIAVDEFN

SEQ ID NO: 1832868 - protein, 28 aa, Staphylococcus epidermidis
TIKDLMGYLFEIIDPYSLNRQGPDIGEK

SEQ ID NO: 1832869 - protein, 26 aa, Staphylococcus epidermidis
TIKGRKTILYFYPRDNTLTCTTEACE

SEQ ID NO: 1832870 - protein, 24 aa, Staphylococcus epidermidis
TIKQLYNQVAIYKEQSNRDKEQIN

SEQ ID NO: 1832871 - protein, 29 aa, Staphylococcus epidermidis
TIKRKYTLDYILKPFVKTKIKGWMRQLLW

SEQ ID NO: 1832872 - protein, 21 aa, Staphylococcus epidermidis
TIKRYYICSLFNRSGSSACHS

SEQ ID NO: 1832873 - protein, 23 aa, Staphylococcus epidermidis
TIKSIRKQLLYLNDRFKQIEQSL

SEQ ID NO: 1832874 - protein, 24 aa, Staphylococcus epidermidis
TILHLRKIYHNAQLYFIIGTDQYK

SEQ ID NO: 1832875 - protein, 21 aa, Staphylococcus epidermidis
TILLPTHNWGNYKLVFNTRHN

SEQ ID NO: 1832876 - protein, 26 aa, Staphylococcus epidermidis
TINHINWVGFYLIENKELILGPFQGH

SEQ ID NO: 1832877 - protein, 19 aa, Staphylococcus epidermidis
TINIPFNKTFINQIGWYLD

SEQ ID NO: 1832878 - protein, 17 aa, Staphylococcus epidermidis
TINITLDMDDRIPINVW

SEQ ID NO: 1832879 - protein, 24 aa, Staphylococcus epidermidis
TINKVFGKGFIFKFDVRKGSKFEG

SEQ ID NO: 1832880 - protein, 17 aa, Staphylococcus epidermidis
TINLFERVPDALEYYQN

SEQ ID NO: 1832881 - protein, 18 aa, Staphylococcus epidermidis
TINPKFLNVESLIQYIQS

SEQ ID NO: 1832882 - protein, 18 aa, Staphylococcus epidermidis
TINPLLRHKLNINCTLTA

SEQ ID NO: 1832883 - protein, 25 aa, Staphylococcus epidermidis
TINPQINNLLLLLKERVKIAILTNG

SEQ ID NO: 1832884 - protein, 20 aa, Staphylococcus epidermidis
TINRATFKGPKGPTGYMIPT

SEQ ID NO: 1832885 - protein, 17 aa, Staphylococcus epidermidis
TINSPTFNIIKSYKGDE

SEQ ID NO: 1832886 - protein, 23 aa, Staphylococcus epidermidis
TIQPYLKDTFKKMGLNVIEDEAS

SEQ ID NO: 1832887 - protein, 18 aa, Staphylococcus epidermidis
TIRDALRTALTSLELELL

SEQ ID NO: 1832888 - protein, 17 aa, Staphylococcus epidermidis
TIREIYEVILEDKTKYS

SEQ ID NO: 1832889 - protein, 26 aa, Staphylococcus epidermidis
TISDIYASVRLLWSRIGEPFVGYSDI

SEQ ID NO: 1832890 - protein, 19 aa, Staphylococcus epidermidis
TISGFKNNFKKYWNKNVRG

SEQ ID NO: 1832891 - protein, 18 aa, Staphylococcus epidermidis
TISHSSFDFIKQLKAIDS

SEQ ID NO: 1832892 - protein, 17 aa, Staphylococcus epidermidis
TISMGYIGLYEAATMFY

SEQ ID NO: 1832893 - protein, 32 aa, Staphylococcus epidermidis
TISNWIKEIKYPRIKRIQLLADYFNVPKSELT

SEQ ID NO: 1832894 - protein, 21 aa, Staphylococcus epidermidis
TISNWIKEVKYPRIKRIQTLA

SEQ ID NO: 1832895 - protein, 22 aa, Staphylococcus epidermidis
TISVDNGIWKVIDFQHVKPGKG

SEQ ID NO: 1832896 - protein, 25 aa, Staphylococcus epidermidis
TISYIENVYIMLNKPKGVISATEDD

SEQ ID NO: 1832897 - protein, 21 aa, Staphylococcus epidermidis
TITDKTILVSIMFVNNEIGTV

SEQ ID NO: 1832898 - protein, 24 aa, Staphylococcus epidermidis
TITPLRYVLPFNEQNRYLVMPALS

SEQ ID NO: 1832899 - protein, 22 aa, Staphylococcus epidermidis
TIVGLGPRILRAETAPLYALSA

SEQ ID NO: 1832900 - protein, 17 aa, Staphylococcus epidermidis
TIVNMIFEPSHYDDMFI

SEQ ID NO: 1832901 - protein, 18 aa, Staphylococcus epidermidis
TIVNNAKRLNISFEKENG

SEQ ID NO: 1832902 - protein, 32 aa, Staphylococcus epidermidis
TIYDTLSFPIYKKLLIYMKFQSGLDVSTQHRA

SEQ ID NO: 1832903 - protein, 25 aa, Staphylococcus epidermidis
TIYEISKRTVLFLIEKDITVYDATI

SEQ ID NO: 1832904 - protein, 18 aa, Staphylococcus epidermidis
TIYGILQDGTKELVFENG

SEQ ID NO: 1832905 - protein, 22 aa, Staphylococcus epidermidis
TKDDLIIFLGDYIDRGKQSNRV

SEQ ID NO: 1832906 - protein, 23 aa, Staphylococcus epidermidis
TKDKHLRYIRKEVGVVFQFPESQ

SEQ ID NO: 1832907 - protein, 17 aa, Staphylococcus epidermidis
TKDQAMYHFLSGFTSKL

SEQ ID NO: 1832908 - protein, 21 aa, Staphylococcus epidermidis
TKEQMISFCQSIQHASPINAH

SEQ ID NO: 1832909 - protein, 17 aa, Staphylococcus epidermidis
TKFFAFRDSFDQEPYMC

SEQ ID NO: 1832910 - protein, 22 aa, Staphylococcus epidermidis
TKFNILQFILDLSLKDSKLTNR

SEQ ID NO: 1832911 - protein, 23 aa, Staphylococcus epidermidis
TKFNILQFILDLSLKDSKLTNRC

SEQ ID NO: 1832912 - protein, 17 aa, Staphylococcus epidermidis
TKFVIFPSIIPNSKQII

SEQ ID NO: 1832913 - protein, 24 aa, Staphylococcus epidermidis
TKGAFPTWLAPKQVEIIPVNVDIH

SEQ ID NO: 1832914 - protein, 24 aa, Staphylococcus epidermidis
TKGAFPTWLAPMQVEIIPVNVDLH

SEQ ID NO: 1832915 - protein, 24 aa, Staphylococcus epidermidis
TKGKVIYISTFSKSLFPSCRIAYI

SEQ ID NO: 1832916 - protein, 35 aa, Staphylococcus epidermidis; identical to SEQ ID NO: 1700326

SEQ ID NO: 1832917 - protein, 25 aa, Staphylococcus epidermidis
TKHQIPTVTTLLGLGAIPYEHPLFL

SEQ ID NO: 1832918 - protein, 22 aa, Staphylococcus epidermidis
TKIKYIRMFDELKRQINARATE

SEQ ID NO: 1832919 - protein, 22 aa, Staphylococcus epidermidis
TKKVYTNLKPWDRVQIARLQER

SEQ ID NO: 1832920 - protein, 18 aa, Staphylococcus epidermidis
TKLNQTILGYIPLHWHND

SEQ ID NO: 1832921 - protein, 23 aa, Staphylococcus epidermidis
TKLPVYVYKLFPEGPITMTLIHE

SEQ ID NO: 1832922 - protein, 23 aa, Staphylococcus epidermidis
TKLRKQYLEEFRKGFKQQIENTK

SEQ ID NO: 1832923 - protein, 24 aa, Staphylococcus epidermidis
TKNDVPTFAICHGPLVLIDTDDLN

SEQ ID NO: 1832924 - protein, 23 aa, Staphylococcus epidermidis
TKQQPVLMPGWNTFRTTKKLQKI

SEQ ID NO: 1832925 - protein, 33 aa, Staphylococcus epidermidis
TKRMYPDILNYDKLIELLGDFKAPMGCRSFLPS

SEQ ID NO: 1832926 - protein, 23 aa, Staphylococcus epidermidis
TKRYGMYWAARQGFDQIVEFHLD

SEQ ID NO: 1832927 - protein, 26 aa, Staphylococcus epidermidis
TKSETFVIISFKHKVILIGGTEYAGE

SEQ ID NO: 1832928 - protein, 18 aa, Staphylococcus epidermidis
TKSKSMIILSESIDTNFK

SEQ ID NO: 1832929 - protein, 20 aa, Staphylococcus epidermidis
TKTKKLFQRFNKNDYQKVTK

SEQ ID NO: 1832930 - protein, 32 aa, Staphylococcus epidermidis
TKTVYTDLLFLYLERAFLSQNFFDIPTIHPLF

SEQ ID NO: 1832931 - protein, 22 aa, Staphylococcus epidermidis
TKYKNLIKEISPVDLTDLMKST

SEQ ID NO: 1832932 - protein, 17 aa, Staphylococcus epidermidis
TKYWILKLLEMHCIQKT

SEQ ID NO: 1832933 - protein, 19 aa, Staphylococcus epidermidis
TLAHRPADKPLKGYKKMNP

SEQ ID NO: 1832934 - protein, 24 aa, Staphylococcus epidermidis
TLAYALQTRLYGVSSLKALAATVK

SEQ ID NO: 1832935 - protein, 25 aa, Staphylococcus epidermidis
TLDEVYILPYSKFEFYWERYIQEIK

SEQ ID NO: 1832936 - protein, 22 aa, Staphylococcus epidermidis
TLDKARIEQALTELQHAREALH

SEQ ID NO: 1832937 - protein, 22 aa, Staphylococcus epidermidis
TLDLLAKKLFGPEREIRLRPSY

SEQ ID NO: 1832938 - protein, 21 aa, Staphylococcus epidermidis
TLEELYLLGLLIISDNKTTFK

SEQ ID NO: 1832939 - protein, 17 aa, Staphylococcus epidermidis
TLELQVDEKGLYFKCHL

SEQ ID NO: 1832940 - protein, 37 aa, Staphylococcus epidermidis
TLEQLAVQDFFFQPDYDRPWHYLNVLAQQALGDTFGS

SEQ ID NO: 1832941 - protein, 18 aa, Staphylococcus epidermidis
TLGPQFVYVAAYEGGIVA

SEQ ID NO: 1832942 - protein, 18 aa, Staphylococcus epidermidis
TLGVLPTGGGKSICYQVP

SEQ ID NO: 1832943 - protein, 18 aa, Staphylococcus epidermidis
TLHRLGIQAFEPTLVEGR

SEQ ID NO: 1832944 - protein, 17 aa, Staphylococcus epidermidis
TLIKNQAMMRGFLVAEF

SEQ ID NO: 1832945 - protein, 17 aa, Staphylococcus epidermidis
TLILKELGVKKVTAKAQ

SEQ ID NO: 1832946 - protein, 20 aa, Staphylococcus epidermidis
TLILKKVVFILFEKSFNTNL

SEQ ID NO: 1832947 - protein, 19 aa, Staphylococcus epidermidis
TLKEPLINYKFDKASYQDR

SEQ ID NO: 1832948 - protein, 25 aa, Staphylococcus epidermidis
TLKETKLIYLTYPNNPTGSTATQSV

SEQ ID NO: 1832949 - protein, 19 aa, Staphylococcus epidermidis
TLKMINRLIPLSEGYIYFK

SEQ ID NO: 1832950 - protein, 17 aa, Staphylococcus epidermidis
TLKRPINLLKEHKTVGI

SEQ ID NO: 1832951 - protein, 28 aa, Staphylococcus epidermidis
TLKSQYYVYAFIKLFKEKYNNDVDEYLH

SEQ ID NO: 1832952 - protein, 27 aa, Staphylococcus epidermidis
TLLEKRPVAYFTLFTSSMQVPLEHIIK

SEQ ID NO: 1832953 - protein, 17 aa, Staphylococcus epidermidis
TLLFEDNSKRKIWLNSI

SEQ ID NO: 1832954 - protein, 17 aa, Staphylococcus epidermidis
TLLKETSVHIPTHDMSQ

SEQ ID NO: 1832955 - protein, 19 aa, Staphylococcus epidermidis
TLLKLLSRNLKPSSGVIYL

SEQ ID NO: 1832956 - protein, 26 aa, Staphylococcus epidermidis
TLLLDEGAILLRQGKDALLKNGRRLK

SEQ ID NO: 1832957 - protein, 23 aa, Staphylococcus epidermidis
TLMAHAVSFLKEKGYTVVTIKHH

SEQ ID NO: 1832958 - protein, 20 aa, Staphylococcus epidermidis
TLNEVVLPIYPKAPEYHLED

SEQ ID NO: 1832959 - protein, 18 aa, Staphylococcus epidermidis
TLNISEKVFLLVLENIER

SEQ ID NO: 1832960 - protein, 26 aa, Staphylococcus epidermidis
TLPDYMIPIHFKKIDQIPITINGKLD

SEQ ID NO: 1832961 - protein, 32 aa, Staphylococcus epidermidis
TLPKANVIKIYFNEGFIALRPSGTEPKIKLYV

SEQ ID NO: 1832962 - protein, 17 aa, Staphylococcus epidermidis
TLQIRQLHPFPKDTIQQ

SEQ ID NO: 1832963 - protein, 21 aa, Staphylococcus epidermidis
TLRLYEMFMGPLDAAIAWSEN

SEQ ID NO: 1832964 - protein, 22 aa, Staphylococcus epidermidis
TLRMNYLFDFYQSLLTQKQRNY

SEQ ID NO: 1832965 - protein, 25 aa, Staphylococcus epidermidis
TLRPDGIFYYVKDKLLRISTDIPIY

SEQ ID NO: 1832966 - protein, 28 aa, Staphylococcus epidermidis
TLRVASLLAHTLFDFPSHQLTTYGVTGT

SEQ ID NO: 1832967 - protein, 23 aa, Staphylococcus epidermidis
TLSHNNYIKRLPVSTYRSQNRGG

SEQ ID NO: 1832968 - protein, 26 aa, Staphylococcus epidermidis
TLSIGLIVPSLFFDLAKEDKDLYMFE

SEQ ID NO: 1832969 - protein, 36 aa, Staphylococcus epidermidis
TLSSNFKMNILIGPLVKLWKIGFKDALKPKEEDIQR

SEQ ID NO: 1832970 - protein, 27 aa, Staphylococcus epidermidis
TLSTAQLDFLLPERFELTYIGSDGEQH

SEQ ID NO: 1832971 - protein, 27 aa, Staphylococcus epidermidis
TLSVMKGRKILILADVLELGPNSQVMH

SEQ ID NO: 1832972 - protein, 17 aa, Staphylococcus epidermidis
TLSVVPKGLEGKTILLY

SEQ ID NO: 1832973 - protein, 29 aa, Staphylococcus epidermidis
TLTALQELLQYIIDFYRLDVKVQDIEITF

SEQ ID NO: 1832974 - protein, 27 aa, Staphylococcus epidermidis
TLTTQKYLDYLGLSRFITDSLGVCIKN

SEQ ID NO: 1832975 - protein, 27 aa, Staphylococcus epidermidis
TLTTQRYLDYLGLSRFITDSLGVCIKN

SEQ ID NO: 1832976 - protein, 31 aa, Staphylococcus epidermidis
TLTVITNCLPVFKILMKKQSLHFRVYLLGGE

SEQ ID NO: 1832977 - protein, 21 aa, Staphylococcus epidermidis
TLVDREIIFMILSHNDFSFAD

SEQ ID NO: 1832978 - protein, 25 aa, Staphylococcus epidermidis
TLVDRMPFHGLKPEFYALAAGTKSD

SEQ ID NO: 1832979 - protein, 34 aa, Staphylococcus epidermidis
TLVERGPRRVSPFFVPMLIPDMATGQVSIDLGAK

SEQ ID NO: 1832980 - protein, 22 aa, Staphylococcus epidermidis
TLVGLGPRILRAETAPLYALSA

SEQ ID NO: 1832981 - protein, 19 aa, Staphylococcus epidermidis
TLVKYMTYINLKQPEIILD

SEQ ID NO: 1832982 - protein, 20 aa, Staphylococcus epidermidis
TLWKNLANQSPEFGRPEKFC

SEQ ID NO: 1832983 - protein, 17 aa, Staphylococcus epidermidis
TMAGLINALRIVDKDLS

SEQ ID NO: 1832984 - protein, 22 aa, Staphylococcus epidermidis
TMDTFGHIDILFNNAGINEHVK

SEQ ID NO: 1832985 - protein, 24 aa, Staphylococcus epidermidis
TMEELLTIYEWPEKLLNKELKKLS

SEQ ID NO: 1832986 - protein, 24 aa, Staphylococcus epidermidis
TMELIDKYEFVYGIIGWHPVDAID

SEQ ID NO: 1832987 - protein, 26 aa, Staphylococcus epidermidis
TMIRQDLKPIIFVINNDGYTVERMIH

SEQ ID NO: 1832988 - protein, 22 aa, Staphylococcus epidermidis
TMKHCHAFSKNFKSSAKGDWVD

SEQ ID NO: 1832989 - protein, 17 aa, Staphylococcus epidermidis
TMKINNFKKSPMKGYFI

SEQ ID NO: 1832990 - protein, 24 aa, Staphylococcus epidermidis
TMNEMLMANYLFNSSDDPKFKRWV

SEQ ID NO: 1832991 - protein, 22 aa, Staphylococcus epidermidis
TMNMGLTMRSIAPSVTFSTGHF

SEQ ID NO: 1832992 - protein, 24 aa, Staphylococcus epidermidis
TMPAQFECNCSHEKFLNAIKGLGE

SEQ ID NO: 1832993 - protein, 26 aa, Staphylococcus epidermidis
TMPEQAYLYSLPYHYYEDYGIRKYGF

SEQ ID NO: 1832994 - protein, 22 aa, Staphylococcus epidermidis
TMRDIINNYPFPNTFKVLELSG

SEQ ID NO: 1832995 - protein, 20 aa, Staphylococcus epidermidis
TMRVDTNLKKRLSQMALDQD

SEQ ID NO: 1832996 - protein, 21 aa, Staphylococcus epidermidis
TMSHCHAFSKNFKGSAKGDWV

SEQ ID NO: 1832997 - protein, 17 aa, Staphylococcus epidermidis
TNALKYPYPKGNKKFKM

SEQ ID NO: 1832998 - protein, 26 aa, Staphylococcus epidermidis
TNDDELFLKDVFFIEVSHFEAHHTYY

SEQ ID NO: 1832999 - protein, 19 aa, Staphylococcus epidermidis
TNEEKVLIEFILETGITDQ

SEQ ID NO: 1833000 - protein, 26 aa, Staphylococcus epidermidis
TNEEMMKVIHFFNKIENYYESSVKGE

SEQ ID NO: 1833001 - protein, 28 aa, Staphylococcus epidermidis
TNEIKKILIMPTWRDWLNSTYAFDNSDY

SEQ ID NO: 1833002 - protein, 29 aa, Staphylococcus epidermidis
TNETDTYMPLPIFLSHQLAKRLSDVRKDE

SEQ ID NO: 1833003 - protein, 28 aa, Staphylococcus epidermidis
TNEVQNLLIPLTFHFSKDEQMIIDQYKD

SEQ ID NO: 1833004 - protein, 27 aa, Staphylococcus epidermidis
TNEVQNLLIPLTFHFSKDEQMIIDQYQ

SEQ ID NO: 1833005 - protein, 27 aa, Staphylococcus epidermidis
TNGVSYLAVTQWWVASLNPPHLKAMIP

SEQ ID NO: 1833006 - protein, 29 aa, Staphylococcus epidermidis
TNHLDFESINWLINYVKQYPHTVLFVTHD

SEQ ID NO: 1833007 - protein, 19 aa, Staphylococcus epidermidis
TNIILPFNENYNQQIKHVE

SEQ ID NO: 1833008 - protein, 25 aa, Staphylococcus epidermidis
TNKAQYTLVKLLASKFKNLCVVGDS

SEQ ID NO: 1833009 - protein, 25 aa, Staphylococcus epidermidis
TNKYGEYFVVTLKFTYNTPKDIMAY

SEQ ID NO: 1833010 - protein, 17 aa, Staphylococcus epidermidis
TNLKGVFNCIQKVTPQM

SEQ ID NO: 1833011 - protein, 29 aa, Staphylococcus epidermidis
TNLMTHPRYHIKKKYIAKLKGYLMREEIK

SEQ ID NO: 1833012 - protein, 27 aa, Staphylococcus epidermidis
TNLMTHPRYHIKKKYVAKLKGYLMREE

SEQ ID NO: 1833013 - protein, 25 aa, Staphylococcus epidermidis
TNLNDIMHDLAQAIIDNYAPTKASI

SEQ ID NO: 1833014 - protein, 18 aa, Staphylococcus epidermidis
TNNYYIYLTKSNFPINIT

SEQ ID NO: 1833015 - protein, 22 aa, Staphylococcus epidermidis
TNPFVLIYGILAKHQSPSLPND

SEQ ID NO: 1833016 - protein, 24 aa, Staphylococcus epidermidis
TNRSLYLLDILQKLPINKMNSLSI

SEQ ID NO: 1833017 - protein, 26 aa, Staphylococcus epidermidis
TNSETFVIISFKHKVILIGGTEYAGE

SEQ ID NO: 1833018 - protein, 22 aa, Staphylococcus epidermidis
TNTIIAHHPLIFKGVKRIVEDG

SEQ ID NO: 1833019 - protein, 18 aa, Staphylococcus epidermidis
TNTSFLCLLHNSNNFFIK

SEQ ID NO: 1833020 - protein, 18 aa, Staphylococcus epidermidis
TNTSYAPWYIVLADHKKT

SEQ ID NO: 1833021 - protein, 22 aa, Staphylococcus epidermidis
TNVIRLLPPLSITKKQLEKGIE

SEQ ID NO: 1833022 - protein, 22 aa, Staphylococcus epidermidis
TNYDFITLAPGWNEILIRGHNI

SEQ ID NO: 1833023 - protein, 27 aa, Staphylococcus epidermidis
TNYDNPNLLYWNQFMNVTIAIHGYSSS

SEQ ID NO: 1833024 - protein, 21 aa, Staphylococcus epidermidis
TNYPVVLKPIYGSGSMDVFIA

SEQ ID NO: 1833025 - protein, 26 aa, Staphylococcus epidermidis
TPAQIVLRWHLAHNRIIIPKSQTPQR

SEQ ID NO: 1833026 - protein, 23 aa, Staphylococcus epidermidis
TPDDFYVTPPLYVDYGRHVNIGE

SEQ ID NO: 1833027 - protein, 20 aa, Staphylococcus epidermidis
TPDQKVWLSGYLIANQQSNV

SEQ ID NO: 1833028 - protein, 23 aa, Staphylococcus epidermidis
TPEFPDMFKPTAAGQGRNLQELK

SEQ ID NO: 1833029 - protein, 25 aa, Staphylococcus epidermidis
TPENEVLLVKQFRKAADQPLLEIPA

SEQ ID NO: 1833030 - protein, 29 aa, Staphylococcus epidermidis
TPENEVLLVKQFRKPAEKPLLEIPAGKLE

SEQ ID NO: 1833031 - protein, 18 aa, Staphylococcus epidermidis
TPGPWHIHRMLEAAEELP

SEQ ID NO: 1833032 - protein, 22 aa, Staphylococcus epidermidis
TPKDDIFKFEKELKRLGINATI

SEQ ID NO: 1833033 - protein, 27 aa, Staphylococcus epidermidis
TPKKNDLYYLYFYIKSMKKYIEDLGSG

SEQ ID NO: 1833034 - protein, 18 aa, Staphylococcus epidermidis
TPKSLPFIDFDHERILSS

SEQ ID NO: 1833035 - protein, 24 aa, Staphylococcus epidermidis
TPLHLDKEWYIAIAKKRINDFKGE

SEQ ID NO: 1833036 - protein, 29 aa, Staphylococcus epidermidis
TPLKVYVNGRFDDVTFPESFKVFGSADSK

SEQ ID NO: 1833037 - protein, 26 aa, Staphylococcus epidermidis
TPLTPKTRGIIGEAFFKKAKPNLQII

SEQ ID NO: 1833038 - protein, 26 aa, Staphylococcus epidermidis
TPSQASEVFTPINPITITATDNSGKV

SEQ ID NO: 1833039 - protein, 17 aa, Staphylococcus epidermidis
TPTMEEFINALYEGINQ

SEQ ID NO: 1833040 - protein, 19 aa, Staphylococcus epidermidis
TPVFLYVLQKLLSEMKRCD

SEQ ID NO: 1833041 - protein, 21 aa, Staphylococcus epidermidis
TQDLLKRLKLMNEKFNTTIIM

SEQ ID NO: 1833042 - protein, 27 aa, Staphylococcus epidermidis
TQDQPYHSWFNIVEHFLPSDSHDLLDI

SEQ ID NO: 1833043 - protein, 23 aa, Staphylococcus epidermidis
TQEEWVNLWQKALQVNYRPVANI

SEQ ID NO: 1833044 - protein, 27 aa, Staphylococcus epidermidis
TQFQHNFQHNLLFTHIPLQEYKEVENI

SEQ ID NO: 1833045 - protein, 27 aa, Staphylococcus epidermidis
TQFQHNFQHNLLFTHIPLQEYREVENI

SEQ ID NO: 1833046 - protein, 32 aa, Staphylococcus epidermidis
TQIDKDGYIYFTPIGGWWNQVMLSQKVTITTE

SEQ ID NO: 1833047 - protein, 25 aa, Staphylococcus epidermidis
TQKELFEQWFYPEGASVEVYQFNAV

SEQ ID NO: 1833048 - protein, 24 aa, Staphylococcus epidermidis
TQKQRNYLELFYLQDYSLSEIADT

SEQ ID NO: 1833049 - protein, 25 aa, Staphylococcus epidermidis
TQMRRYHEAFKKSGLKYNISYASKA

SEQ ID NO: 1833050 - protein, 20 aa, Staphylococcus epidermidis
TQNIGYQNNYFYITTSSTKL

SEQ ID NO: 1833051 - protein, 26 aa, Staphylococcus epidermidis
TQNNSIIVLPILDEGLFNDLKNAFNI

SEQ ID NO: 1833052 - protein, 18 aa, Staphylococcus epidermidis
TQNYIFEEANYDGLSNLI

SEQ ID NO: 1833053 - protein, 24 aa, Staphylococcus epidermidis
TQPALLTHSVALLTALKDLNADYT

SEQ ID NO: 1833054 - protein, 19 aa, Staphylococcus epidermidis
TQQWIDFIQERGFELGLME

SEQ ID NO: 1833055 - protein, 21 aa, Staphylococcus epidermidis
TQSEFLGDYYFYLLEIGHKDK

SEQ ID NO: 1833056 - protein, 26 aa, Staphylococcus epidermidis
TQSFPTLKVFDWLQQQAKISTDEMYH

SEQ ID NO: 1833057 - protein, 23 aa, Staphylococcus epidermidis
TQTLVKPLIAYIQDYGIALEAHM

SEQ ID NO: 1833058 - protein, 22 aa, Staphylococcus epidermidis
TQTYIQRVLMNVLLNITKDDVN

SEQ ID NO: 1833059 - protein, 17 aa, Staphylococcus epidermidis
TQVGCRIGCTFCASTLG

SEQ ID NO: 1833060 - protein, 30 aa, Staphylococcus epidermidis
TQVNTVIDYYYRFIHRFPTIQSLSEASEDE

SEQ ID NO: 1833061 - protein, 30 aa, Staphylococcus epidermidis
TQVNTVIDYYYRFIHRFPTVASLSEAHEDE

SEQ ID NO: 1833062 - protein, 24 aa, Staphylococcus epidermidis
TQVRRYFPSLLSYRRSEIDMESMD

SEQ ID NO: 1833063 - protein, 18 aa, Staphylococcus epidermidis
TQYIAWTLIDYDAVPVCG

SEQ ID NO: 1833064 - protein, 32 aa, Staphylococcus epidermidis
TRAATLAVNGLKLAFRGLLAATGVGLAITGVS

SEQ ID NO: 1833065 - protein, 33 aa, Staphylococcus epidermidis
TRAPEMYIDKVKYVGALFLGHFSPEVIGDYVAG

SEQ ID NO: 1833066 - protein, 32 aa, Staphylococcus epidermidis
TRAPEMYINKVKYVGALFLGHFSPEVIGDYVA

SEQ ID NO: 1833067 - protein, 24 aa, Staphylococcus epidermidis
TRDKPYGKLTERDWKKIEDEAMES

SEQ ID NO: 1833068 - protein, 18 aa, Staphylococcus epidermidis
TREGIILSKLSWIDDTTF

SEQ ID NO: 1833069 - protein, 27 aa, Staphylococcus epidermidis
TRELSRLYVYAHYKGLKSLYYTRNKLL

SEQ ID NO: 1833070 - protein, 18 aa, Staphylococcus epidermidis
TRFVNGERSLLFGPFAGF

SEQ ID NO: 1833071 - protein, 25 aa, Staphylococcus epidermidis
TRGQAPYKFLLSHGFFMDGEGKKMS

SEQ ID NO: 1833072 - protein, 22 aa, Staphylococcus epidermidis
TRKIVKVLLENNWIVATQGNDK

SEQ ID NO: 1833073 - protein, 23 aa, Staphylococcus epidermidis
TRKLDSLVLIDIAVPRDIEPGID

SEQ ID NO: 1833074 - protein, 23 aa, Staphylococcus epidermidis
TRLESSVYFPPYKGKFKYIKAFF

SEQ ID NO: 1833075 - protein, 27 aa, Staphylococcus epidermidis
TRLGHVKGYFIYPYQEELKNSNIKLFN

SEQ ID NO: 1833076 - protein, 36 aa, Staphylococcus epidermidis
TRLIMVHLYDYIPRLFWPIYYFVQAPIQGLLMRGFE

SEQ ID NO: 1833077 - protein, 25 aa, Staphylococcus epidermidis
TRLSLAQMLLNEPDLLLLDEPTNHL

SEQ ID NO: 1833078 - protein, 25 aa, Staphylococcus epidermidis
TRNINRIILMFSLTNDLKITINGET

SEQ ID NO: 1833079 - protein, 29 aa, Staphylococcus epidermidis
TRRTHGYDFPMWFIRPFYAKETTKNKVKS

SEQ ID NO: 1833080 - protein, 17 aa, Staphylococcus epidermidis
TRTILGMEKASLTYEGH

SEQ ID NO: 1833081 - protein, 19 aa, Staphylococcus epidermidis
TRVKLYFKLIHNDSISYPS

SEQ ID NO: 1833082 - protein, 24 aa, Staphylococcus epidermidis
TSDDIDLFIPHQANIRIMESARER

SEQ ID NO: 1833083 - protein, 31 aa, Staphylococcus epidermidis
TSDDILHFRYITLDGYVGYSPLYALAHEIGI

SEQ ID NO: 1833084 - protein, 21 aa, Staphylococcus epidermidis
TSDFEYLIKQFLGYINKSNVT

SEQ ID NO: 1833085 - protein, 27 aa, Staphylococcus epidermidis
TSDVPLHLYLSVLGMPGQTAYHGLLDI

SEQ ID NO: 1833086 - protein, 23 aa, Staphylococcus epidermidis
TSECFSFFISYHYNKFDLGVQQL

SEQ ID NO: 1833087 - protein, 34 aa, Staphylococcus epidermidis
TSEDGDIRFTKVKLWLMHTGLNLNGSVFNKDVVE

SEQ ID NO: 1833088 - protein, 24 aa, Staphylococcus epidermidis
TSENLELFFSYRVEKGNTGRMLAF

SEQ ID NO: 1833089 - protein, 24 aa, Staphylococcus epidermidis
TSFTVAIPNYTSLAPMLEQLNRSF

SEQ ID NO: 1833090 - protein, 21 aa, Staphylococcus epidermidis
TSGLQLFDYKFGQTGIHGTEI

SEQ ID NO: 1833091 - protein, 24 aa, Staphylococcus epidermidis
TSIEQVLALIHYKGKNKKIYSDVN

SEQ ID NO: 1833092 - protein, 27 aa, Staphylococcus epidermidis
TSIQPDKLVLSLAWKYAETLMNTGAEE

SEQ ID NO: 1833093 - protein, 28 aa, Staphylococcus epidermidis
TSISITQLLERFLFPSSTHGKKIYKLSG

SEQ ID NO: 1833094 - protein, 24 aa, Staphylococcus epidermidis
TSKIKEFKLLSTAGAYWRGDSNNK

SEQ ID NO: 1833095 - protein, 22 aa, Staphylococcus epidermidis
TSKLTPETFIKKNLPFLIQHIT

SEQ ID NO: 1833096 - protein, 17 aa, Staphylococcus epidermidis
TSKYDGYYPSYLKQYTK

SEQ ID NO: 1833097 - protein, 23 aa, Staphylococcus epidermidis
TSLFKLKSPLWTLAKDIYQEWYL

SEQ ID NO: 1833098 - protein, 41 aa, Staphylococcus epidermidis
TSNGIKKIVVYNPAPLAIKGTRILKTPLSPLLSSYFDTKND

SEQ ID NO: 1833099 - protein, 33 aa, Staphylococcus epidermidis
TSNQNFQRIRKGPNIKLPSYQLLEEPEPHEKDQ

SEQ ID NO: 1833100 - protein, 17 aa, Staphylococcus epidermidis
TSPEYVKELKRKARAFD

SEQ ID NO: 1833101 - protein, 22 aa, Staphylococcus epidermidis
TSPYDFQGLGVEGLKILKNVKD

SEQ ID NO: 1833102 - protein, 17 aa, Staphylococcus epidermidis
TSQFYPTQFIKFEEATI

SEQ ID NO: 1833103 - protein, 26 aa, Staphylococcus epidermidis
TSSYREDILPTFKKLGLDDYIDVIVG

SEQ ID NO: 1833104 - protein, 24 aa, Staphylococcus epidermidis
TSVPVYVYKLFPEGPITMTLIREM

SEQ ID NO: 1833105 - protein, 18 aa, Staphylococcus epidermidis
TTAYLTIGHTWIALNQEK

SEQ ID NO: 1833106 - protein, 18 aa, Staphylococcus epidermidis
TTCKLGIFDTQLEQLHKW

SEQ ID NO: 1833107 - protein, 24 aa, Staphylococcus epidermidis
TTEDIRWLRCDIKSLNLLGNVLAK

SEQ ID NO: 1833108 - protein, 20 aa, Staphylococcus epidermidis
TTEHPLLSEIGLKNAGLRLK

SEQ ID NO: 1833109 - protein, 19 aa, Staphylococcus epidermidis
TTELPFDKRFRFKSFVLER

SEQ ID NO: 1833110 - protein, 27 aa, Staphylococcus epidermidis
TTFPTFLEMLMATYKLIQKAKATHRQK

SEQ ID NO: 1833111 - protein, 24 aa, Staphylococcus epidermidis
TTGTIFNHLFKQAITFAKRAHSET

SEQ ID NO: 1833112 - protein, 22 aa, Staphylococcus epidermidis
TTHDRRLGGFSTGPHLHVQVNL

SEQ ID NO: 1833113 - protein, 20 aa, Staphylococcus epidermidis
TTIFKPLLGEDCRRTMEIFK

SEQ ID NO: 1833114 - protein, 27 aa, Staphylococcus epidermidis
TTILNPAPAIDLPDSLLSLTDIIIPNE

SEQ ID NO: 1833115 - protein, 25 aa, Staphylococcus epidermidis
TTKGESTLPLIKKLSADNVRLNVTA

SEQ ID NO: 1833116 - protein, 25 aa, Staphylococcus epidermidis
TTKKGLNWLFNHACERIPELKHSRI

SEQ ID NO: 1833117 - protein, 20 aa, Staphylococcus epidermidis
TTLGLIFNDLSWMINQNKCE

SEQ ID NO: 1833118 - protein, 17 aa, Staphylococcus epidermidis
TTLQLVDIIKEGIPAKA

SEQ ID NO: 1833119 - protein, 18 aa, Staphylococcus epidermidis
TTLVVCGDTPLITSKTLQ

SEQ ID NO: 1833120 - protein, 19 aa, Staphylococcus epidermidis
TTMRVDSSIKKRLGQMALD

SEQ ID NO: 1833121 - protein, 24 aa, Staphylococcus epidermidis
TTNAAFLIYLIAKDGPNHDELMTL

SEQ ID NO: 1833122 - protein, 25 aa, Staphylococcus epidermidis
TTQIAHMIIRYFKDGPIRAHEVSYN

SEQ ID NO: 1833123 - protein, 25 aa, Staphylococcus epidermidis
TTQTLQSFNSMKAFIATPALDAVKG

SEQ ID NO: 1833124 - protein, 25 aa, Staphylococcus epidermidis
TTRALLNNMVLGVSQGFEKTLELVG

SEQ ID NO: 1833125 - protein, 17 aa, Staphylococcus epidermidis
TTRLESMNLYQKKLQSY

SEQ ID NO: 1833126 - protein, 25 aa, Staphylococcus epidermidis
TTRQAFQFHGILKRNLKQSMKEINN

SEQ ID NO: 1833127 - protein, 25 aa, Staphylococcus epidermidis
TTSILTQVFQLDLFAEYLPHEDAQQ

SEQ ID NO: 1833128 - protein, 19 aa, Staphylococcus epidermidis
TTSKPFFLEFMAKNVSKGN

SEQ ID NO: 1833129 - protein, 25 aa, Staphylococcus epidermidis
TTTADFLYAVLSYPLYAEGDARDVD

SEQ ID NO: 1833130 - protein, 19 aa, Staphylococcus epidermidis
TVCILEAMKLFNEIQAETS

SEQ ID NO: 1833131 - protein, 24 aa, Staphylococcus epidermidis
TVDGYKLQFLLNYAHENEKEVEVK

SEQ ID NO: 1833132 - protein, 20 aa, Staphylococcus epidermidis
TVEEELTYLATLKGLSSKEI

SEQ ID NO: 1833133 - protein, 25 aa, Staphylococcus epidermidis
TVFNEILRRKLDLSKTINLIITHTH

SEQ ID NO: 1833134 - protein, 17 aa, Staphylococcus epidermidis
TVGLGNLKNLSYQQLLK

SEQ ID NO: 1833135 - protein, 24 aa, Staphylococcus epidermidis
TVHGFKYKILYAMEKLAMFCATDV

SEQ ID NO: 1833136 - protein, 30 aa, Staphylococcus epidermidis
TVIDLIPEYSHLGIFPVGRLDKDTEGLLLL

SEQ ID NO: 1833137 - protein, 26 aa, Staphylococcus epidermidis
TVIFASPVYWYSISASLKAFIDHWSE

SEQ ID NO: 1833138 - protein, 29 aa, Staphylococcus epidermidis
TVILGCTHYPLLYKPIYDYFDGTKTVISS

SEQ ID NO: 1833139 - protein, 17 aa, Staphylococcus epidermidis
TVITMYPHLDGVLSLDL

SEQ ID NO: 1833140 - protein, 17 aa, Staphylococcus epidermidis
TVKENIMLPLSVQKFHK

SEQ ID NO: 1833141 - protein, 17 aa, Staphylococcus epidermidis
TVKENIMLPLSVQKVQK

SEQ ID NO: 1833142 - protein, 25 aa, Staphylococcus epidermidis
TVKPESMILTPQHAPDWTKDRQRLW

SEQ ID NO: 1833143 - protein, 19 aa, Staphylococcus epidermidis
TVLPIKKEQPGYILNTLLV

SEQ ID NO: 1833144 - protein, 18 aa, Staphylococcus epidermidis
TVMYLLICKMFEDEDVEI

SEQ ID NO: 1833145 - protein, 28 aa, Staphylococcus epidermidis
TVNRMFWRARRRESIFISYILKHHPRFK

SEQ ID NO: 1833146 - protein, 34 aa, Staphylococcus epidermidis
TVNRMFWRARRRESIFISYILKYHPRFKDADVPV

SEQ ID NO: 1833147 - protein, 18 aa, Staphylococcus epidermidis
TVPFGVIPETNNAKFETR

SEQ ID NO: 1833148 - protein, 25 aa, Staphylococcus epidermidis
TVSSWVNAVKYPRRDKIELLADYFG

SEQ ID NO: 1833149 - protein, 28 aa, Staphylococcus epidermidis
TVTLKTLGLIIVMAQSGLLVPTLDGSQL

SEQ ID NO: 1833150 - protein, 17 aa, Staphylococcus epidermidis
TVVTLIILAQQHDMTLQ

SEQ ID NO: 1833151 - protein, 27 aa, Staphylococcus epidermidis
TVVVVPDYQLSLAIGKRGQNARLAAKL

SEQ ID NO: 1833152 - protein, 22 aa, Staphylococcus epidermidis
TVVYRVVQEGLFNALKYAGVNE

SEQ ID NO: 1833153 - protein, 24 aa, Staphylococcus epidermidis
TVYKGLEMFINFQPDTIIALGGGS

SEQ ID NO: 1833154 - protein, 18 aa, Staphylococcus epidermidis
TWAGVRPLILEEGKDPSE

SEQ ID NO: 1833155 - protein, 18 aa, Staphylococcus epidermidis
TWFALMNHLVDISITYVV

SEQ ID NO: 1833156 - protein, 20 aa, Staphylococcus epidermidis
TWSSWQLMNAQPTFSDTGWL

SEQ ID NO: 1833157 - protein, 19 aa, Staphylococcus epidermidis
TYCGIGTIGLYMAPQAKHV

SEQ ID NO: 1833158 - protein, 28 aa, Staphylococcus epidermidis
TYDADGVFIYIGMKPLTAPFTNLGITND

SEQ ID NO: 1833159 - protein, 19 aa, Staphylococcus epidermidis
TYDLEVWLPSYNDYKEISS

SEQ ID NO: 1833160 - protein, 28 aa, Staphylococcus epidermidis
TYDLSVPIYLPLKTLIPLIIDSLGIDIH

SEQ ID NO: 1833161 - protein, 27 aa, Staphylococcus epidermidis
TYFPNSNYYILLWKLEVLDTYQRRGYA

SEQ ID NO: 1833162 - protein, 18 aa, Staphylococcus epidermidis
TYGDLACFSFYPNKNITT

SEQ ID NO: 1833163 - protein, 31 aa, Staphylococcus epidermidis
TYGFGYRLNLYMSLIILNNKEMLFLEDCDLQ

SEQ ID NO: 1833164 - protein, 18 aa, Staphylococcus epidermidis
TYGHLDIIERSADRFDEI

SEQ ID NO: 1833165 - protein, 17 aa, Staphylococcus epidermidis
TYIKDYDKVFLIIDDNV

SEQ ID NO: 1833166 - protein, 23 aa, Staphylococcus epidermidis
TYIPNDYKKVVLWAYDEVMKGNS

SEQ ID NO: 1833167 - protein, 21 aa, Staphylococcus epidermidis
TYKMEYIKGYLPVHNHPQAYE

SEQ ID NO: 1833168 - protein, 24 aa, Staphylococcus epidermidis
TYLDQIHQRLYLEQSLITERIKKY

SEQ ID NO: 1833169 - protein, 20 aa, Staphylococcus epidermidis
TYLDRDVLLPAIGQGALGIE

SEQ ID NO: 1833170 - protein, 20 aa, Staphylococcus epidermidis
TYLKYRTLIPNLISVSSEDA

SEQ ID NO: 1833171 - protein, 20 aa, Staphylococcus epidermidis
TYLLGYTEEPLKFKVRLLFD

SEQ ID NO: 1833172 - protein, 29 aa, Staphylococcus epidermidis
TYMNSLYDKPLPENYFLQNADDYLQILEQ

SEQ ID NO: 1833173 - protein, 26 aa, Staphylococcus epidermidis
TYNDVNFKLYLGLKHISPYIEDAVKK

SEQ ID NO: 1833174 - protein, 25 aa, Staphylococcus epidermidis
TYNDWLVIGYTPLQLFFPDREDFTL

SEQ ID NO: 1833175 - protein, 34 aa, Staphylococcus epidermidis
TYPITHMSLVPQTLKWLMDAGLTQPFSLEKILLG

SEQ ID NO: 1833176 - protein, 18 aa, Staphylococcus epidermidis
TYQHLGLRALSEIANLPV

SEQ ID NO: 1833177 - protein, 25 aa, Staphylococcus epidermidis
TYRNIYCSFYLSINSIYMVNQVEDF

SEQ ID NO: 1833178 - protein, 19 aa, Staphylococcus epidermidis
TYSDFTQEQLELLKPNWTD

SEQ ID NO: 1833179 - protein, 33 aa, Staphylococcus epidermidis
TYSDLYDLPTTGLRFFTVYGPWGRPDMALFKFT

SEQ ID NO: 1833180 - protein, 17 aa, Staphylococcus epidermidis
TYSKIYELYFKNQSPFK

SEQ ID NO: 1833181 - protein, 17 aa, Staphylococcus epidermidis
TYSRLSLNNLNRLKEDY

SEQ ID NO: 1833182 - protein, 25 aa, Staphylococcus epidermidis
TYSTVYDMPILADPLSQLRKSNHPN

SEQ ID NO: 1833183 - protein, 25 aa, Staphylococcus epidermidis
TYTHDVPRIRTIPVGSLHTLMYPQH

SEQ ID NO: 1833184 - protein, 24 aa, Staphylococcus epidermidis
TYTVKKYWGSLIIKGQIGYNTEIR

SEQ ID NO: 1833185 - protein, 17 aa, Staphylococcus epidermidis
TYYHQLIEIDSLQTLPD

SEQ ID NO: 1833186 - protein, 24 aa, Staphylococcus epidermidis
TYYSYRMDNLIVSYLIQAHLMKNS

SEQ ID NO: 1833187 - protein, 23 aa, Staphylococcus epidermidis
VADTMPYIQQVFLDIRGVENVEK

SEQ ID NO: 1833188 - protein, 24 aa, Staphylococcus epidermidis
VAEADIWLRENPLEFEWGGESMIE

SEQ ID NO: 1833189 - protein, 28 aa, Staphylococcus epidermidis
VAEHAVMDLLIVLRNFMEGHRQSVEGEW

SEQ ID NO: 1833190 - protein, 26 aa, Staphylococcus epidermidis
VAEQFGTMETMFPRRVDLGLGRAPGT

SEQ ID NO: 1833191 - protein, 26 aa, Staphylococcus epidermidis
VAETEVINVFPIRFVVDKDNEVSDPK

SEQ ID NO: 1833192 - protein, 22 aa, Staphylococcus epidermidis
VAFDKLGYRIGYGGGYYDRFLS

SEQ ID NO: 1833193 - protein, 24 aa, Staphylococcus epidermidis
VAGLVTPWNFPTNQTSLKLAAAFA

SEQ ID NO: 1833194 - protein, 23 aa, Staphylococcus epidermidis
VAGNVLRFQPPLVITYEQLDQAL

SEQ ID NO: 1833195 - protein, 24 aa, Staphylococcus epidermidis
VAGSIYYTLLQLSNSFPTTPIGVM

SEQ ID NO: 1833196 - protein, 33 aa, Staphylococcus epidermidis
VAGSQQLIDWLKAQSRPFLFSTSLAPGDTKAIT

SEQ ID NO: 1833197 - protein, 19 aa, Staphylococcus epidermidis
VAHNISFDLNFIKNAFDNC

SEQ ID NO: 1833198 - protein, 17 aa, Staphylococcus epidermidis
VAILDIEIPGMTGLEIL

SEQ ID NO: 1833199 - protein, 17 aa, Staphylococcus epidermidis
VAIRSMLIKGDQATLFA

SEQ ID NO: 1833200 - protein, 19 aa, Staphylococcus epidermidis
VAKDLKLNHNESFIISYNG

SEQ ID NO: 1833201 - protein, 25 aa, Staphylococcus epidermidis
VAKEYLWSVLIDKLNEWNLHNDQYL

SEQ ID NO: 1833202 - protein, 26 aa, Staphylococcus epidermidis
VAKRLDKTVALLLDTKGPEIRTHNMK

SEQ ID NO: 1833203 - protein, 23 aa, Staphylococcus epidermidis
VALGCEILLDYDFVAKIKEGRED

SEQ ID NO: 1833204 - protein, 33 aa, Staphylococcus epidermidis; identical to SEQ ID NO: 1700588

SEQ ID NO: 1833205 - protein, 19 aa, Staphylococcus epidermidis
VANYCDIFYIGGTKIGALC

SEQ ID NO: 1833206 - protein, 18 aa, Staphylococcus epidermidis
VAPGPIYTPLIPSTFDEE

SEQ ID NO: 1833207 - protein, 17 aa, Staphylococcus epidermidis
VAPREHSFPTPPVKPVV

SEQ ID NO: 1833208 - protein, 17 aa, Staphylococcus epidermidis
VAQAGIYNKPSYRLVSI

SEQ ID NO: 1833209 - protein, 24 aa, Staphylococcus epidermidis
VARDYVLTGLEFACGIPGSIGGAV

SEQ ID NO: 1833210 - protein, 23 aa, Staphylococcus epidermidis
VARVLYLGIVGDTGRFLFNNTTQ

SEQ ID NO: 1833211 - protein, 18 aa, Staphylococcus epidermidis
VATKAGVIGLTKTAAREL

SEQ ID NO: 1833212 - protein, 27 aa, Staphylococcus epidermidis
VATVTEIYDYIRLLYARVGKPYCPYHD

SEQ ID NO: 1833213 - protein, 18 aa, Staphylococcus epidermidis
VAVPLWLDEQMYGVLLLG

SEQ ID NO: 1833214 - protein, 23 aa, Staphylococcus epidermidis
VCGDTPLITYQTLQSLIAHHEST

SEQ ID NO: 1833215 - protein, 24 aa, Staphylococcus epidermidis
VCHKYQIPWVYGAAVGSKGTIYGI

SEQ ID NO: 1833216 - protein, 22 aa, Staphylococcus epidermidis
VCNHVLYQLGYLADKSYPGLRF

SEQ ID NO: 1833217 - protein, 24 aa, Staphylococcus epidermidis
VCNVMKDFYISKLFTGGATSTPAF

SEQ ID NO: 1833218 - protein, 17 aa, Staphylococcus epidermidis
VCSFIKRGTLADIGSDH

SEQ ID NO: 1833219 - protein, 17 aa, Staphylococcus epidermidis
VCTHIINGLPGENYDMM

SEQ ID NO: 1833220 - protein, 18 aa, Staphylococcus epidermidis
VCVGILKGSVMFMADLIK

SEQ ID NO: 1833221 - protein, 33 aa, Staphylococcus epidermidis
VDAVRKHFDLRPAGIIKMLDLKQPIYKQTAAYG

SEQ ID NO: 1833222 - protein, 25 aa, Staphylococcus epidermidis
VDDNGDIYFIFTNESLQNILDKSKN

SEQ ID NO: 1833223 - protein, 24 aa, Staphylococcus epidermidis
VDDQYLLYLIEKGYFKELHYKGIG

SEQ ID NO: 1833224 - protein, 21 aa, Staphylococcus epidermidis
VDEFYRLPHSLFSNPKYKNLK

SEQ ID NO: 1833225 - protein, 24 aa, Staphylococcus epidermidis
VDENRIYFGITEYGRLLLGADYFL

SEQ ID NO: 1833226 - protein, 25 aa, Staphylococcus epidermidis
VDFGSDLLIQTFLKEHPPGPSKHIA

SEQ ID NO: 1833227 - protein, 22 aa, Staphylococcus epidermidis
VDGNKFIDYLQAYGPIITGHAH

SEQ ID NO: 1833228 - protein, 32 aa, Staphylococcus epidermidis
VDHSRSHHLITTDLFLNVFGIENLEALPTTEE

SEQ ID NO: 1833229 - protein, 33 aa, Staphylococcus epidermidis
VDHSRSHHLLTTDLFLNVFGIENLDALPTTEED

SEQ ID NO: 1833230 - protein, 31 aa, Staphylococcus epidermidis
VDIAGPGFINFYLDNHYLTEVIPEAIHKGDK

SEQ ID NO: 1833231 - protein, 23 aa, Staphylococcus epidermidis
VDIKDVFLKLPIIGTEVYDESNE

SEQ ID NO: 1833232 - protein, 23 aa, Staphylococcus epidermidis
VDIKEVFLKLPIIGTEVYDESNE

SEQ ID NO: 1833233 - protein, 24 aa, Staphylococcus epidermidis
VDIKTLVYPGFATDLQQPITPLLF

SEQ ID NO: 1833234 - protein, 23 aa, Staphylococcus epidermidis
VDKSDLIYISQKGKFDAVVEDVV

SEQ ID NO: 1833235 - protein, 23 aa, Staphylococcus epidermidis
VDKTYDYILTVVKVGMSEREIKA

SEQ ID NO: 1833236 - protein, 17 aa, Staphylococcus epidermidis
VDKVMDFMKVNFGQGAN

SEQ ID NO: 1833237 - protein, 19 aa, Staphylococcus epidermidis
VDLALFYNEAGADELVFLD

SEQ ID NO: 1833238 - protein, 17 aa, Staphylococcus epidermidis
VDLLVIGAGSGGYVAAI

SEQ ID NO: 1833239 - protein, 26 aa, Staphylococcus epidermidis
VDNELSDFLPLMLQFLQVADFKNDSR

SEQ ID NO: 1833240 - protein, 29 aa, Staphylococcus epidermidis
VDPSMISQLRLYIHDFPIVAIGGINETNV

SEQ ID NO: 1833241 - protein, 17 aa, Staphylococcus epidermidis
VDQKLIYVPKKGENSMK

SEQ ID NO: 1833242 - protein, 28 aa, Staphylococcus epidermidis
VDSANADRLYFLKQHTLVTELIFDETQA

SEQ ID NO: 1833243 - protein, 27 aa, Staphylococcus epidermidis
VDSVNADRLYFLKQHTLVSELYFNEEN

SEQ ID NO: 1833244 - protein, 17 aa, Staphylococcus epidermidis
VDTILHTIPLELDNFNL

SEQ ID NO: 1833245 - protein, 24 aa, Staphylococcus epidermidis
VDTMVVMRVAIPRMKYLEPSMKVE

SEQ ID NO: 1833246 - protein, 26 aa, Staphylococcus epidermidis
VDYCRDRGFLVLTYDNGYIIHDSDHE

SEQ ID NO: 1833247 - protein, 26 aa, Staphylococcus epidermidis
VEAGETVYFILKETPFYAVSGGQVAD

SEQ ID NO: 1833248 - protein, 20 aa, Staphylococcus epidermidis
VEAIKKFGKFLKSLTDRLNK

SEQ ID NO: 1833249 - protein, 23 aa, Staphylococcus epidermidis
VEATIKVRCKYPVWVNNQITASE

SEQ ID NO: 1833250 - protein, 23 aa, Staphylococcus epidermidis
VEATMKVRCKYPVWVNNQITASD

SEQ ID NO: 1833251 - protein, 33 aa, Staphylococcus epidermidis
VEAVRNHFDLRPAGIIKMLDLKQPIYKQTAAYG

SEQ ID NO: 1833252 - protein, 19 aa, Staphylococcus epidermidis
VEDLRYLMDALNVSSAHIL

SEQ ID NO: 1833253 - protein, 23 aa, Staphylococcus epidermidis
VEDNYTPLIIKPSTIKGIDYQME

SEQ ID NO: 1833254 - protein, 24 aa, Staphylococcus epidermidis
VEDTFPFIKHQLITQPKESLHSIY

SEQ ID NO: 1833255 - protein, 23 aa, Staphylococcus epidermidis
VEEFFRALVINARLTVHIDLIRG

SEQ ID NO: 1833256 - protein, 18 aa, Staphylococcus epidermidis
VEERSAVSIGRRVQDPLS

SEQ ID NO: 1833257 - protein, 29 aa, Staphylococcus epidermidis
VEETLIQPTFIYGHPIEISPLAKKNPEDP

SEQ ID NO: 1833258 - protein, 18 aa, Staphylococcus epidermidis
VEEYLAPLKEMFAKYVPA

SEQ ID NO: 1833259 - protein, 18 aa, Staphylococcus epidermidis
VEHLPSHLSPLLKKLLLK

SEQ ID NO: 1833260 - protein, 17 aa, Staphylococcus epidermidis
VEHLRRIRDSFTSYDTN

SEQ ID NO: 1833261 - protein, 26 aa, Staphylococcus epidermidis
VEHMNAWLKPYRRAFNLEEPVVNVTE

SEQ ID NO: 1833262 - protein, 23 aa, Staphylococcus epidermidis
VEIFDRSWYGRVLVERVEGFAEQ

SEQ ID NO: 1833263 - protein, 19 aa, Staphylococcus epidermidis
VEIVLKLLKILLKELERVL

SEQ ID NO: 1833264 - protein, 25 aa, Staphylococcus epidermidis
VEKDEILPFCLHITGQPIINSRAFK

SEQ ID NO: 1833265 - protein, 24 aa, Staphylococcus epidermidis
VEKNHKLVMLFGDNLLDFTDPKKS

SEQ ID NO: 1833266 - protein, 23 aa, Staphylococcus epidermidis
VEKNLYDAVLVVDLDRLSRGNGT

SEQ ID NO: 1833267 - protein, 25 aa, Staphylococcus epidermidis
VELAQLDYLLPRLQGHGKSLSRLGG

SEQ ID NO: 1833268 - protein, 18 aa, Staphylococcus epidermidis
VELLADLELPLAKILSEM

SEQ ID NO: 1833269 - protein, 19 aa, Staphylococcus epidermidis
VELRLLKYKHRDKVLAETS

SEQ ID NO: 1833270 - protein, 26 aa, Staphylococcus epidermidis
VENEDRYLLYLFDWRVIESESKGDNF

SEQ ID NO: 1833271 - protein, 30 aa, Staphylococcus epidermidis
VENRYLTEDIAFGLVLWSSLGRVIDVPTPN

SEQ ID NO: 1833272 - protein, 21 aa, Staphylococcus epidermidis
VEPGTNLLEFIRSRDTFVPAI

SEQ ID NO: 1833273 - protein, 34 aa, Staphylococcus epidermidis
VEQHQMTDFMFFASAIMVLLHKYSRQDDIVIGSV

SEQ ID NO: 1833274 - protein, 17 aa, Staphylococcus epidermidis
VEQLMSKTVKRKYTALV

SEQ ID NO: 1833275 - protein, 27 aa, Staphylococcus epidermidis
VEREYLTCEGILWNKWDDAVEILQSKG

SEQ ID NO: 1833276 - protein, 31 aa, Staphylococcus epidermidis
VERPTLKFELFYFDIFKYGTSFITLQVPREE

SEQ ID NO: 1833277 - protein, 28 aa, Staphylococcus epidermidis
VERRSKYIIFYIAYHDEDRILVSHLGMA

SEQ ID NO: 1833278 - protein, 26 aa, Staphylococcus epidermidis
VETAYKAVMKPVEGTILTVAKDAAQA

SEQ ID NO: 1833279 - protein, 27 aa, Staphylococcus epidermidis
VEVSNHMQALEDDQIKALDKKFKKEQN

SEQ ID NO: 1833280 - protein, 22 aa, Staphylococcus epidermidis
VEYARDNNLKIIASCPFAKDVL

SEQ ID NO: 1833281 - protein, 28 aa, Staphylococcus epidermidis
VEYGDHYERRFMKPKKLKANIEYTTPHG

SEQ ID NO: 1833282 - protein, 18 aa, Staphylococcus epidermidis
VEYKTIKKIWTILENDSK

SEQ ID NO: 1833283 - protein, 17 aa, Staphylococcus epidermidis
VFANLDLNITKARAQVV

SEQ ID NO: 1833284 - protein, 20 aa, Staphylococcus epidermidis
VFANLDLNITKARAQVVKAL

SEQ ID NO: 1833285 - protein, 23 aa, Staphylococcus epidermidis
VFDIRDYFAARHLLKESIIHLTS

SEQ ID NO: 1833286 - protein, 27 aa, Staphylococcus epidermidis
VFDLHETTFDIHLIPETRKSTILSGKK

SEQ ID NO: 1833287 - protein, 19 aa, Staphylococcus epidermidis
VFDMMNWWFEKGIDGFRVD

SEQ ID NO: 1833288 - protein, 23 aa, Staphylococcus epidermidis
VFDTFQQLFNYYDNDDLGYSDNV

SEQ ID NO: 1833289 - protein, 19 aa, Staphylococcus epidermidis
VFGDGIYEYIRAYDGKLFT

SEQ ID NO: 1833290 - protein, 18 aa, Staphylococcus epidermidis
VFGDGIYEYIRAYEGKLF

SEQ ID NO: 1833291 - protein, 21 aa, Staphylococcus epidermidis
VFGLIIPDLPFELIEKFKKDF

SEQ ID NO: 1833292 - protein, 17 aa, Staphylococcus epidermidis
VFHHLLQHFDSTAFLNF

SEQ ID NO: 1833293 - protein, 25 aa, Staphylococcus epidermidis
VFKDEIFGPVLAITTYRNFEQVIED

SEQ ID NO: 1833294 - protein, 27 aa, Staphylococcus epidermidis
VFKEHQLLYILIMHAFANTYVSKRQTS

SEQ ID NO: 1833295 - protein, 19 aa, Staphylococcus epidermidis
VFKSFQNLYNKHYKQDFAI

SEQ ID NO: 1833296 - protein, 20 aa, Staphylococcus epidermidis
VFLKEQFERLRKEQIFVYVC

SEQ ID NO: 1833297 - protein, 33 aa, Staphylococcus epidermidis
VFLNSRTTIFPILGGGERLGTLVLGRVQDDFNE

SEQ ID NO: 1833298 - protein, 20 aa, Staphylococcus epidermidis
VFMNELKINLLDFRKQMDYL

SEQ ID NO: 1833299 - protein, 24 aa, Staphylococcus epidermidis
VFNLNGFFEPLQALIEHMIKEGFI

SEQ ID NO: 1833300 - protein, 28 aa, Staphylococcus epidermidis
VFNQTYLGMIHYSPEPFLGNIRVFNPIE

SEQ ID NO: 1833301 - protein, 20 aa, Staphylococcus epidermidis
VFPNTLHWQYGHVLTVFEEA

SEQ ID NO: 1833302 - protein, 17 aa, Staphylococcus epidermidis
VFQEALNFVRMGDRFVV

SEQ ID NO: 1833303 - protein, 27 aa, Staphylococcus epidermidis
VFQMELSNKLTKYQPIPNLSIANFDPI

SEQ ID NO: 1833304 - protein, 23 aa, Staphylococcus epidermidis
VFSKLLKHPTIASKHYLYEQYDQ

SEQ ID NO: 1833305 - protein, 23 aa, Staphylococcus epidermidis
VFSKNWLHYWRNECGYTIKPVSE

SEQ ID NO: 1833306 - protein, 35 aa, Staphylococcus epidermidis; identical to SEQ ID NO: 1693606

SEQ ID NO: 1833307 - protein, 19 aa, Staphylococcus epidermidis
VFVDLYNKGIIYRGERIIN

SEQ ID NO: 1833308 - protein, 19 aa, Staphylococcus epidermidis
VFVKIPIVTTKGESTLPLI

SEQ ID NO: 1833309 - protein, 18 aa, Staphylococcus epidermidis
VFVYVPKNVVVEHPIQYV

SEQ ID NO: 1833310 - protein, 40 aa, Staphylococcus epidermidis
VGALSFSDYMLLSRQFLYTMLTRTINQCFLFAETSAVHYS

SEQ ID NO: 1833311 - protein, 31 aa, Staphylococcus epidermidis
VGAVVAWNFPTLLASWKLGPALAAGNTVVIQ

SEQ ID NO: 1833312 - protein, 17 aa, Staphylococcus epidermidis
VGCRIGCTFCASTLGGL

SEQ ID NO: 1833313 - protein, 19 aa, Staphylococcus epidermidis
VGCTRVSVWSEEPYYRGTI

SEQ ID NO: 1833314 - protein, 25 aa, Staphylococcus epidermidis
VGEEQFDIWKIADLGDIVGIEGVMF

SEQ ID NO: 1833315 - protein, 25 aa, Staphylococcus epidermidis
VGESIDFSWIPNMGKAWDDFKNDMA

SEQ ID NO: 1833316 - protein, 18 aa, Staphylococcus epidermidis
VGFEDKQAYKKGSKSNKY

SEQ ID NO: 1833317 - protein, 23 aa, Staphylococcus epidermidis
VGFNPFYLVIDELGSLIAELNNK

SEQ ID NO: 1833318 - protein, 18 aa, Staphylococcus epidermidis
VGGMYEFGLSRYFTAMLA

SEQ ID NO: 1833319 - protein, 22 aa, Staphylococcus epidermidis
VGKNELDKLEWAPADIPAVRRI

SEQ ID NO: 1833320 - protein, 23 aa, Staphylococcus epidermidis
VGKNELDKLEWAPADIPAVRRII

SEQ ID NO: 1833321 - protein, 26 aa, Staphylococcus epidermidis
VGNKKPIQRLWISSVTKKAIQEGFKH

SEQ ID NO: 1833322 - protein, 18 aa, Staphylococcus epidermidis
VGNWRDRFFTERKGKYQT

SEQ ID NO: 1833323 - protein, 21 aa, Staphylococcus epidermidis
VGPKGIIRRMVDTKRLSSMIF

SEQ ID NO: 1833324 - protein, 28 aa, Staphylococcus epidermidis
VGQHQMWAAQFYPFKNHGQWVTSGGLGT

SEQ ID NO: 1833325 - protein, 25 aa, Staphylococcus epidermidis
VGRTILPTYGLFRSIAIKNLELDFK

SEQ ID NO: 1833326 - protein, 26 aa, Staphylococcus epidermidis
VGSNYLYIHKIDGKTFLFTKTNDKSL

SEQ ID NO: 1833327 - protein, 26 aa, Staphylococcus epidermidis
VGTGELTVGFLLAKLSWHERHHLEHI

SEQ ID NO: 1833328 - protein, 22 aa, Staphylococcus epidermidis
VGTYDFTRTHYPIFGKKVGEEV

SEQ ID NO: 1833329 - protein, 18 aa, Staphylococcus epidermidis
VGVLKEEILKFVDLMKSL

SEQ ID NO: 1833330 - protein, 20 aa, Staphylococcus epidermidis
VGVMADLHFAPTYNAAQNLV

SEQ ID NO: 1833331 - protein, 23 aa, Staphylococcus epidermidis
VGYLIEHPKLYGNKTGLFNLKLF

SEQ ID NO: 1833332 - protein, 34 aa, Staphylococcus epidermidis
VGYLIEHPKLYGNKTGLFNLKLFAQVLGDGFDKE

SEQ ID NO: 1833333 - protein, 27 aa, Staphylococcus epidermidis
VGYQNKYFYITYLSRNLKEYRKYYEPL

SEQ ID NO: 1833334 - protein, 20 aa, Staphylococcus epidermidis
VHALCHYTLLLYNTNEMDKY

SEQ ID NO: 1833335 - protein, 19 aa, Staphylococcus epidermidis
VHDFTPKSKIRKVKTIGTI

SEQ ID NO: 1833336 - protein, 31 aa, Staphylococcus epidermidis
VHDVTIAPSPIWMQARLMKAGIRPINNVVDI

SEQ ID NO: 1833337 - protein, 17 aa, Staphylococcus epidermidis
VHFAKQTHIDWVVIGPE

SEQ ID NO: 1833338 - protein, 19 aa, Staphylococcus epidermidis
VHGILQLEALLKDINSIFD

SEQ ID NO: 1833339 - protein, 28 aa, Staphylococcus epidermidis
VHHMNANIPLIRLMNKFELKKASNQDLK

SEQ ID NO: 1833340 - protein, 17 aa, Staphylococcus epidermidis
VHHSLGEGTFDDYRKMF

SEQ ID NO: 1833341 - protein, 26 aa, Staphylococcus epidermidis
VHKITFNISYLLNVFEYLKDDVKTQD

SEQ ID NO: 1833342 - protein, 20 aa, Staphylococcus epidermidis
VHKSTFMYGSKLKFNNNFVS

SEQ ID NO: 1833343 - protein, 17 aa, Staphylococcus epidermidis
VHNHIMINSIDLETGKK

SEQ ID NO: 1833344 - protein, 20 aa, Staphylococcus epidermidis
VHNHIVLNSIDLETGKKFNN

SEQ ID NO: 1833345 - protein, 19 aa, Staphylococcus epidermidis
VHNHIVLNSIDLNTGKKFN

SEQ ID NO: 1833346 - protein, 17 aa, Staphylococcus epidermidis
VHRLYSDTSLLADLEIY

SEQ ID NO: 1833347 - protein, 19 aa, Staphylococcus epidermidis
VHRNHRNELWFDMSKKLEG

SEQ ID NO: 1833348 - protein, 18 aa, Staphylococcus epidermidis
VHSPSHPYLLKLQDLYRE

SEQ ID NO: 1833349 - protein, 19 aa, Staphylococcus epidermidis
VHYPHYFYANILSNVIGSE

SEQ ID NO: 1833350 - protein, 25 aa, Staphylococcus epidermidis
VIADNFRMDLLRPLFEDYGIEIEVI

SEQ ID NO: 1833351 - protein, 25 aa, Staphylococcus epidermidis
VIDFQAMPFVIFSDPEVAYTGLTEK

SEQ ID NO: 1833352 - protein, 23 aa, Staphylococcus epidermidis
VIDTNFFIKLFEKALEEREYYFN

SEQ ID NO: 1833353 - protein, 17 aa, Staphylococcus epidermidis
VIEAMKILKAKGIQFVV

SEQ ID NO: 1833354 - protein, 18 aa, Staphylococcus epidermidis
VIEENFTFYNVDLNDGLM

SEQ ID NO: 1833355 - protein, 17 aa, Staphylococcus epidermidis
VIEKIDVPVIIVGQEHD

SEQ ID NO: 1833356 - protein, 18 aa, Staphylococcus epidermidis
VIEKIDVPVIIVGQEHDQ

SEQ ID NO: 1833357 - protein, 18 aa, Staphylococcus epidermidis
VIELAPLGASIKAVVSLA

SEQ ID NO: 1833358 - protein, 18 aa, Staphylococcus epidermidis
VIENLIINKLGITILPAT

SEQ ID NO: 1833359 - protein, 25 aa, Staphylococcus epidermidis
VIENVMLAPLLLHKDSKDQLKEKAL

SEQ ID NO: 1833360 - protein, 35 aa, Staphylococcus epidermidis
VIFNTLSTPFLAIYHLPTLKKGILFWQEQSHGYIP

SEQ ID NO: 1833361 - protein, 19 aa, Staphylococcus epidermidis
VIFTILHAGGKFGQGGYKT

SEQ ID NO: 1833362 - protein, 27 aa, Staphylococcus epidermidis
VIFYHFDVKKFFRKGILRSIKDTFIGD

SEQ ID NO: 1833363 - protein, 23 aa, Staphylococcus epidermidis
VIGTSTCHLMLDPKQKPIPAITG

SEQ ID NO: 1833364 - protein, 18 aa, Staphylococcus epidermidis
VIHELRHSHASMLVNHGA

SEQ ID NO: 1833365 - protein, 21 aa, Staphylococcus epidermidis
VIHLMSRVRRYPLPLALEVSN

SEQ ID NO: 1833366 - protein, 18 aa, Staphylococcus epidermidis
VIILDTYYLMMGGYQKKK

SEQ ID NO: 1833367 - protein, 18 aa, Staphylococcus epidermidis
VIINPKGFTLKKDGVVKF

SEQ ID NO: 1833368 - protein, 30 aa, Staphylococcus epidermidis
VIISEYSIPYYAGLSFRTLVPELPNEAPHI

SEQ ID NO: 1833369 - protein, 18 aa, Staphylococcus epidermidis
VIKLVKANDVKKFKYKDA

SEQ ID NO: 1833370 - protein, 23 aa, Staphylococcus epidermidis
VILCFDGLDFLRFGRIQRAYEQL

SEQ ID NO: 1833371 - protein, 17 aa, Staphylococcus epidermidis
VILLTVTFDLVECLRDC

SEQ ID NO: 1833372 - protein, 18 aa, Staphylococcus epidermidis
VILNNLYKQTPLQTSFGV

SEQ ID NO: 1833373 - protein, 18 aa, Staphylococcus epidermidis
VIMGIANKRSIGFGVAKV

SEQ ID NO: 1833374 - protein, 17 aa, Staphylococcus epidermidis
VINGHKVACFYPKSVGS

SEQ ID NO: 1833375 - protein, 24 aa, Staphylococcus epidermidis
VINLKKQLIAFGLLEEIRLGKNKP

SEQ ID NO: 1833376 - protein, 21 aa, Staphylococcus epidermidis
VINRNNRLKRLLDLGAPGIIV

SEQ ID NO: 1833377 - protein, 17 aa, Staphylococcus epidermidis
VIPFAMSPKDLKLIESI

SEQ ID NO: 1833378 - protein, 28 aa, Staphylococcus epidermidis
VIREREHFTIFPASHFVTREEKMKVAIQ

SEQ ID NO: 1833379 - protein, 19 aa, Staphylococcus epidermidis
VIRLIPGLENVDIVRYGVM

SEQ ID NO: 1833380 - protein, 18 aa, Staphylococcus epidermidis
VIRLKYWNKDHKLKMDQI

SEQ ID NO: 1833381 - protein, 17 aa, Staphylococcus epidermidis
VIRLLPPLTITNEQIEE

SEQ ID NO: 1833382 - protein, 24 aa, Staphylococcus epidermidis
VISRHFKIRDALRTALKALELELL

SEQ ID NO: 1833383 - protein, 22 aa, Staphylococcus epidermidis
VISYVLYPKVYEQYIQTKAQYG

SEQ ID NO: 1833384 - protein, 18 aa, Staphylococcus epidermidis
VITIDKTWMKATGDLQGP

SEQ ID NO: 1833385 - protein, 23 aa, Staphylococcus epidermidis
VITQDYGLASLLIDKVHTVMHHK

SEQ ID NO: 1833386 - protein, 21 aa, Staphylococcus epidermidis
VITQDYGLASLLIDKVRVVMH

SEQ ID NO: 1833387 - protein, 19 aa, Staphylococcus epidermidis
VIVPDTLRVASLLAHTLFD

SEQ ID NO: 1833388 - protein, 17 aa, Staphylococcus epidermidis
VIWTDAQWRSIYAKGQD

SEQ ID NO: 1833389 - protein, 17 aa, Staphylococcus epidermidis
VIYAIKDTTLVSKGDEI

SEQ ID NO: 1833390 - protein, 18 aa, Staphylococcus epidermidis
VKDIRTIKSVLLKGKKFF

SEQ ID NO: 1833391 - protein, 25 aa, Staphylococcus epidermidis
VKDNKIEMVLSWKLNRISRSMRDVF

SEQ ID NO: 1833392 - protein, 24 aa, Staphylococcus epidermidis
VKDQKVIDWLWETQDKTFFNSKED

SEQ ID NO: 1833393 - protein, 24 aa, Staphylococcus epidermidis
VKDVDFLIAGGLDFEKIKRLEKYS

SEQ ID NO: 1833394 - protein, 27 aa, Staphylococcus epidermidis
VKEKPKARWLFLTLSTRNAIDGDTLER

SEQ ID NO: 1833395 - protein, 18 aa, Staphylococcus epidermidis
VKELRPLTGLDEPVYNYV

SEQ ID NO: 1833396 - protein, 21 aa, Staphylococcus epidermidis
VKEPFIFVDNSTQKVLAIYIV

SEQ ID NO: 1833397 - protein, 29 aa, Staphylococcus epidermidis
VKETFMTNIFGMMFLSQAAVPHLSEGDAI

SEQ ID NO: 1833398 - protein, 20 aa, Staphylococcus epidermidis
VKFEMPYEEAKSWMLKALEP

SEQ ID NO: 1833399 - protein, 25 aa, Staphylococcus epidermidis
VKGENPYFVSFIGDAPKKNPKVIVY

SEQ ID NO: 1833400 - protein, 23 aa, Staphylococcus epidermidis
VKGILDMKGGFTDSFTNAFSSGN

SEQ ID NO: 1833401 - protein, 24 aa, Staphylococcus epidermidis
VKKDFTGISFLNLVDFDALYGHRR

SEQ ID NO: 1833402 - protein, 24 aa, Staphylococcus epidermidis
VKKLRKTYNIPTKKAPKLTMSGNE

SEQ ID NO: 1833403 - protein, 19 aa, Staphylococcus epidermidis
VKLKRGPATNPLFKSFFNA

SEQ ID NO: 1833404 - protein, 24 aa, Staphylococcus epidermidis
VKLRKRFYPINNRNYYIRFHGNGG

SEQ ID NO: 1833405 - protein, 23 aa, Staphylococcus epidermidis
VKLRLKGYPAIVFQHEIDHLNGV

SEQ ID NO: 1833406 - protein, 17 aa, Staphylococcus epidermidis
VKMIIVPGSMRVRKQAV

SEQ ID NO: 1833407 - protein, 25 aa, Staphylococcus epidermidis
VKNYKHFAYVIKMLPQIIEKLRDNG

SEQ ID NO: 1833408 - protein, 21 aa, Staphylococcus epidermidis
VKPIYSILRDLLNKPSKRLKI

SEQ ID NO: 1833409 - protein, 24 aa, Staphylococcus epidermidis
VKQLYSPVQFIQSTEWLINQGVDH

SEQ ID NO: 1833410 - protein, 26 aa, Staphylococcus epidermidis
VKQSDLVIGAVLIPGAKAPSLVTEDM

SEQ ID NO: 1833411 - protein, 21 aa, Staphylococcus epidermidis
VKSIFYVMDFLAIDKQPKADW

SEQ ID NO: 1833412 - protein, 25 aa, Staphylococcus epidermidis
VKSNYILKYVFANGISRDIIYPLLE

SEQ ID NO: 1833413 - protein, 21 aa, Staphylococcus epidermidis
VKTDIAINLPYGYEAQVRPRS

SEQ ID NO: 1833414 - protein, 24 aa, Staphylococcus epidermidis
VKTERFYQLPKYLFEDAYFKKMSA

SEQ ID NO: 1833415 - protein, 32 aa, Staphylococcus epidermidis
VKTKIKGWMRQLLWMSIYQYVYLDKVPDHAII

SEQ ID NO: 1833416 - protein, 21 aa, Staphylococcus epidermidis
VKYSNWLNQLFHGIEYRMQLE

SEQ ID NO: 1833417 - protein, 18 aa, Staphylococcus epidermidis
VLANLMLPLNISKKDMPK

SEQ ID NO: 1833418 - protein, 23 aa, Staphylococcus epidermidis
VLAPIIKELGFIFNNLHINKIKA

SEQ ID NO: 1833419 - protein, 25 aa, Staphylococcus epidermidis
VLDCIHQGIYLLDVPLSEYQSHHSS

SEQ ID NO: 1833420 - protein, 18 aa, Staphylococcus epidermidis
VLDPSLPIDLIIDYAHTA

SEQ ID NO: 1833421 - protein, 25 aa, Staphylococcus epidermidis
VLDSARFRYLISQELNVVPSSVHAS

SEQ ID NO: 1833422 - protein, 20 aa, Staphylococcus epidermidis
VLEPLTYLLIGGEVLNAKWV

SEQ ID NO: 1833423 - protein, 17 aa, Staphylococcus epidermidis
VLEVEKVDFIPTGNGDV

SEQ ID NO: 1833424 - protein, 17 aa, Staphylococcus epidermidis
VLFIEPMTMMNLSGEAV

SEQ ID NO: 1833425 - protein, 18 aa, Staphylococcus epidermidis
VLFLVVDDKGIKAFSSNG

SEQ ID NO: 1833426 - protein, 18 aa, Staphylococcus epidermidis
VLFNASAMGYYPPDLFYS

SEQ ID NO: 1833427 - protein, 17 aa, Staphylococcus epidermidis
VLGEFRLQDRYMKAVNT

SEQ ID NO: 1833428 - protein, 28 aa, Staphylococcus epidermidis
VLGIDTTIPFHLRLLNNDIFRSGEFNTK

SEQ ID NO: 1833429 - protein, 18 aa, Staphylococcus epidermidis
VLKNLVNEFEKMYFIKCL

SEQ ID NO: 1833430 - protein, 23 aa, Staphylococcus epidermidis
VLLPTHNWGNYKLVFSTRHGAHI

SEQ ID NO: 1833431 - protein, 28 aa, Staphylococcus epidermidis
VLLSTKFKAPRWLVNPIKNYSLRKHREI

SEQ ID NO: 1833432 - protein, 17 aa, Staphylococcus epidermidis
VLLYSRWPMLEQQTINI

SEQ ID NO: 1833433 - protein, 17 aa, Staphylococcus epidermidis
VLMILNIRKVPAQRAEN

SEQ ID NO: 1833434 - protein, 17 aa, Staphylococcus epidermidis
VLNAEPSNLFETKIRHA

SEQ ID NO: 1833435 - protein, 26 aa, Staphylococcus epidermidis
VLNDSLMDVLALFESLSLVDVDALSE

SEQ ID NO: 1833436 - protein, 21 aa, Staphylococcus epidermidis
VLNHSGFFKQKSRLFWTQMNS

SEQ ID NO: 1833437 - protein, 17 aa, Staphylococcus epidermidis
VLNKSMGQLQQFINDAQ

SEQ ID NO: 1833438 - protein, 17 aa, Staphylococcus epidermidis
VLNLLTSYENKPIYLHV

SEQ ID NO: 1833439 - protein, 20 aa, Staphylococcus epidermidis
VLNLPFPIYAIGGISQQTIA

SEQ ID NO: 1833440 - protein, 22 aa, Staphylococcus epidermidis
VLNPQLIFYGLGGATEASIWSN

SEQ ID NO: 1833441 - protein, 17 aa, Staphylococcus epidermidis
VLNSLKPGMYYGNNFIN

SEQ ID NO: 1833442 - protein, 25 aa, Staphylococcus epidermidis
VLNTFALFNINLSWIESRPLKTQLG

SEQ ID NO: 1833443 - protein, 20 aa, Staphylococcus epidermidis
VLPITFIEGNIAKTGAYITQ

SEQ ID NO: 1833444 - protein, 18 aa, Staphylococcus epidermidis
VLPIYPKAPEYHLEDTYQ

SEQ ID NO: 1833445 - protein, 17 aa, Staphylococcus epidermidis
VLQEALNFVRMGDRFIV

SEQ ID NO: 1833446 - protein, 17 aa, Staphylococcus epidermidis
VLRELGLSDESIEKGFE

SEQ ID NO: 1833447 - protein, 28 aa, Staphylococcus epidermidis
VLSERLQESAFLLKNLKITLTDLRSGKE

SEQ ID NO: 1833448 - protein, 25 aa, Staphylococcus epidermidis
VLTAYKLMEILEEAGLPQGVVNFVP

SEQ ID NO: 1833449 - protein, 31 aa, Staphylococcus epidermidis
VLTTDITYLPFGHSMLYLSSIMDIYNREIVA

SEQ ID NO: 1833450 - protein, 18 aa, Staphylococcus epidermidis
VLTTTVTGLPSGLSFDQT

SEQ ID NO: 1833451 - protein, 27 aa, Staphylococcus epidermidis
VLYGHMSPYMIVGMIGAIKAGCGYVPI

SEQ ID NO: 1833452 - protein, 32 aa, Staphylococcus epidermidis
VMAHLVENIRFSAVLLQPFLTHAPREMFKQLN

SEQ ID NO: 1833453 - protein, 33 aa, Staphylococcus epidermidis
VMARLDELVATEYPILLATSRKRFIKEMIGTDT

SEQ ID NO: 1833454 - protein, 33 aa, Staphylococcus epidermidis
VMESYMLKEYYQNYYVLMAVLNSILKDVNFMND

SEQ ID NO: 1833455 - protein, 18 aa, Staphylococcus epidermidis
VMIVHPWQYEHTIGEKYK

SEQ ID NO: 1833456 - protein, 18 aa, Staphylococcus epidermidis
VMKDGVCVAFFTLHEGDG

SEQ ID NO: 1833457 - protein, 30 aa, Staphylococcus epidermidis
VMKEGLKELLAKWLFKYENQFPIYASEINT

SEQ ID NO: 1833458 - protein, 21 aa, Staphylococcus epidermidis
VMKGYLYPKYLKDTFDNDGYF

SEQ ID NO: 1833459 - protein, 18 aa, Staphylococcus epidermidis
VMLRPTKSSIIFIQQLGR

SEQ ID NO: 1833460 - protein, 18 aa, Staphylococcus epidermidis
VMNEELAQWFAKNDYFYI

SEQ ID NO: 1833461 - protein, 31 aa, Staphylococcus epidermidis
VMNFNNLVLVRFFFKSLTAYLKKHNCLYVLV

SEQ ID NO: 1833462 - protein, 17 aa, Staphylococcus epidermidis
VMNYFDPKDKTLLKEGQ

SEQ ID NO: 1833463 - protein, 17 aa, Staphylococcus epidermidis
VMSPELISWINQRGLHL

SEQ ID NO: 1833464 - protein, 22 aa, Staphylococcus epidermidis
VMTKLLHTIIKKFGDHNLAFAI

SEQ ID NO: 1833465 - protein, 23 aa, Staphylococcus epidermidis
VNADPTKISAYDQALQNAENIIN

SEQ ID NO: 1833466 - protein, 26 aa, Staphylococcus epidermidis
VNATVKIKCKFPVWLNKHTTVEDEKE

SEQ ID NO: 1833467 - protein, 24 aa, Staphylococcus epidermidis
VNDGDAVVFYNFRPDRAAQLSEIF

SEQ ID NO: 1833468 - protein, 18 aa, Staphylococcus epidermidis
VNDLYINIIKDYSSKKLE

SEQ ID NO: 1833469 - protein, 17 aa, Staphylococcus epidermidis
VNEIFRDLKAPIRMHRL

SEQ ID NO: 1833470 - protein, 27 aa, Staphylococcus epidermidis
VNETDKFLMALRPYQVYAVEAILNRAL

SEQ ID NO: 1833471 - protein, 27 aa, Staphylococcus epidermidis
VNETDKILMALRPYQVYAVEAILNRAL

SEQ ID NO: 1833472 - protein, 28 aa, Staphylococcus epidermidis
VNEWSYEALVKIFYRYGEEKFSKQIARR

SEQ ID NO: 1833473 - protein, 17 aa, Staphylococcus epidermidis
VNGRPKLINLKEALIHY

SEQ ID NO: 1833474 - protein, 22 aa, Staphylococcus epidermidis
VNHMAMFEFKQNVQLFGKSIIL

SEQ ID NO: 1833475 - protein, 25 aa, Staphylococcus epidermidis
VNIADKILIGGGMAYTFMKAQGKEI

SEQ ID NO: 1833476 - protein, 27 aa, Staphylococcus epidermidis
VNINDILPNFLFLEAKASFPTSNNDNI

SEQ ID NO: 1833477 - protein, 19 aa, Staphylococcus epidermidis
VNKYRELLLGYKEITIPFL

SEQ ID NO: 1833478 - protein, 25 aa, Staphylococcus epidermidis
VNLDGIFVQIGLVPNTAWLQDAVEL

SEQ ID NO: 1833479 - protein, 27 aa, Staphylococcus epidermidis
VNLLRQKRLGLNKPNMLYLIKPEVTED

SEQ ID NO: 1833480 - protein, 20 aa, Staphylococcus epidermidis
VNMIALVNGRPKLINLKEAL

SEQ ID NO: 1833481 - protein, 21 aa, Staphylococcus epidermidis
VNMIALVNGRPKLINLKEALI

SEQ ID NO: 1833482 - protein, 22 aa, Staphylococcus epidermidis
VNMIALVNSRPKLINLKEALIH

SEQ ID NO: 1833483 - protein, 29 aa, Staphylococcus epidermidis
VNNRDVRDYLPFESLILDLNQPFDVTETK

SEQ ID NO: 1833484 - protein, 17 aa, Staphylococcus epidermidis
VNPFGTFIAKGVIYPHP

SEQ ID NO: 1833485 - protein, 25 aa, Staphylococcus epidermidis
VNQCSFFYTLPPNDSTARTWQNIDN

SEQ ID NO: 1833486 - protein, 23 aa, Staphylococcus epidermidis
VNQINTMWLTSSLFNQIASERIE

SEQ ID NO: 1833487 - protein, 25 aa, Staphylococcus epidermidis
VNQNVHFEVLLVKLAEMIKAQPQTV

SEQ ID NO: 1833488 - protein, 23 aa, Staphylococcus epidermidis
VNRAGSMIGYFLNEGPVTNFDEA

SEQ ID NO: 1833489 - protein, 24 aa, Staphylococcus epidermidis
VNRAGSMIGYFLNKGPVTNFDEAN

SEQ ID NO: 1833490 - protein, 24 aa, Staphylococcus epidermidis
VNRLINDMIYFVRDTIMNKTSNET

SEQ ID NO: 1833491 - protein, 17 aa, Staphylococcus epidermidis
VNRVVEYARDNNLKIIA

SEQ ID NO: 1833492 - protein, 25 aa, Staphylococcus epidermidis
VNSFVKDKLVFKGKFKMFYISEDEF

SEQ ID NO: 1833493 - protein, 19 aa, Staphylococcus epidermidis
VNSPIYPLTEIYFRDREYL

SEQ ID NO: 1833494 - protein, 18 aa, Staphylococcus epidermidis
VNSVTPYGYIVNKTTKKL

SEQ ID NO: 1833495 - protein, 17 aa, Staphylococcus epidermidis
VNSYKRLVPGYEAPCYI

SEQ ID NO: 1833496 - protein, 18 aa, Staphylococcus epidermidis
VNTPFDQSVFNNTLFQNV

SEQ ID NO: 1833497 - protein, 22 aa, Staphylococcus epidermidis
VNTQEPLTLIAIGPLTNIAILL

SEQ ID NO: 1833498 - protein, 19 aa, Staphylococcus epidermidis
VNVLKRFKAMLLQKNETVE

SEQ ID NO: 1833499 - protein, 20 aa, Staphylococcus epidermidis
VNVRYRSFYEHIWVYEKDGV

SEQ ID NO: 1833500 - protein, 19 aa, Staphylococcus epidermidis
VNWKKFFKEKAVVTYWKQG

SEQ ID NO: 1833501 - protein, 29 aa, Staphylococcus epidermidis
VNYKNIKEIYFWGFSLSDVDKPYIEKIFI

SEQ ID NO: 1833502 - protein, 18 aa, Staphylococcus epidermidis
VNYWIDFGVDGFRFDVIN

SEQ ID NO: 1833503 - protein, 26 aa, Staphylococcus epidermidis
VNYYNHMDVLLFPTYREGFGNVSIEA

SEQ ID NO: 1833504 - protein, 18 aa, Staphylococcus epidermidis
VPDHLSGLLFDDIPYLKV

SEQ ID NO: 1833505 - protein, 19 aa, Staphylococcus epidermidis
VPDHLSGLLFDDIPYLKVA

SEQ ID NO: 1833506 - protein, 25 aa, Staphylococcus epidermidis
VPDRDIPRFVNLYNQGRLNIDSLIS

SEQ ID NO: 1833507 - protein, 32 aa, Staphylococcus epidermidis
VPEDFTNSYLKRIFSYLYDYYSKNDYYTISDM

SEQ ID NO: 1833508 - protein, 17 aa, Staphylococcus epidermidis
VPEPFKLSDGTLATQII

SEQ ID NO: 1833509 - protein, 19 aa, Staphylococcus epidermidis
VPEWANWDHFNELDKKGLI

SEQ ID NO: 1833510 - protein, 17 aa, Staphylococcus epidermidis
VPFRTLTGRQSYYLDHE

SEQ ID NO: 1833511 - protein, 24 aa, Staphylococcus epidermidis
VPKALQTMINLLDAKSELVRYQAS

SEQ ID NO: 1833512 - protein, 24 aa, Staphylococcus epidermidis
VPKKGTLVIFPYEYGNGSGHVAII

SEQ ID NO: 1833513 - protein, 23 aa, Staphylococcus epidermidis
VPKVDIIITIPPYELKTEDSRNA

SEQ ID NO: 1833514 - protein, 19 aa, Staphylococcus epidermidis
VPMGIFSGDFIFVGDIGRP

SEQ ID NO: 1833515 - protein, 18 aa, Staphylococcus epidermidis
VPNQQYWCVKDLKEWGFG

SEQ ID NO: 1833516 - protein, 23 aa, Staphylococcus epidermidis
VPNQRYWCVKDLKEWGFGLFEGE

SEQ ID NO: 1833517 - protein, 34 aa, Staphylococcus epidermidis
VPPGAWGDWINGGGWLVINGYHVDLILRDIKRVE

SEQ ID NO: 1833518 - protein, 30 aa, Staphylococcus epidermidis
VPQPTRAEHVKLLIPLLEQNRDEIAQLYVK

SEQ ID NO: 1833519 - protein, 25 aa, Staphylococcus epidermidis
VPRTDWDWMIYPKGLYDQIMRVVKD

SEQ ID NO: 1833520 - protein, 25 aa, Staphylococcus epidermidis
VPRTDWDWMIYPQGLYDQIMRVVKD

SEQ ID NO: 1833521 - protein, 20 aa, Staphylococcus epidermidis
VPSAIFGTKKRRPIENGVIP

SEQ ID NO: 1833522 - protein, 23 aa, Staphylococcus epidermidis
VPSYRAILIYFDNSEINGAELLE

SEQ ID NO: 1833523 - protein, 18 aa, Staphylococcus epidermidis
VPVIVKEVGFGMSKETFK

SEQ ID NO: 1833524 - protein, 30 aa, Staphylococcus epidermidis
VQDAPGFKHVYPYMLKFIDQLPVVAHNAAF

SEQ ID NO: 1833525 - protein, 29 aa, Staphylococcus epidermidis
VQDAPGFKHVYPYMLQFIDQLPVVAHNAA

SEQ ID NO: 1833526 - protein, 20 aa, Staphylococcus epidermidis
VQDHNFTWAAPIMSKPVKNM

SEQ ID NO: 1833527 - protein, 24 aa, Staphylococcus epidermidis
VQEYAPILYQIWKKKHKKAYYKWR

SEQ ID NO: 1833528 - protein, 43 aa, Staphylococcus epidermidis
VQFKQNEGYNLTFFAFFVKAVAEALKANPLLNSTWQGDEIVIH

SEQ ID NO: 1833529 - protein, 17 aa, Staphylococcus epidermidis
VQIPSLIPRFLTLNEGA

SEQ ID NO: 1833530 - protein, 36 aa, Staphylococcus epidermidis
VQMIQAQSAFFNKGNMLKPWFVSSIDNPVTKKNYYS

SEQ ID NO: 1833531 - protein, 33 aa, Staphylococcus epidermidis; identical to SEQ ID NO: 1681339

SEQ ID NO: 1833532 - protein, 32 aa, Staphylococcus epidermidis
VQQLASISVPEARLLVISPYDKTSVDDIEKAI

SEQ ID NO: 1833533 - protein, 19 aa, Staphylococcus epidermidis
VQVIGSMIVLYRESEENKE

SEQ ID NO: 1833534 - protein, 25 aa, Staphylococcus epidermidis
VQYDLPMTIFVLNNKQLSFIKYEQQ

SEQ ID NO: 1833535 - protein, 25 aa, Staphylococcus epidermidis
VQYDYLVEDLLKQLGIPYSHEDRKV

SEQ ID NO: 1833536 - protein, 23 aa, Staphylococcus epidermidis
VQYYTDIVFKHALKRKLIQTADS

SEQ ID NO: 1833537 - protein, 24 aa, Staphylococcus epidermidis
VRAEVLMFKGIPYQIKLTTSKEEK

SEQ ID NO: 1833538 - protein, 24 aa, Staphylococcus epidermidis
VRAVLGRFLFVQEDVKKIINDLSG

SEQ ID NO: 1833539 - protein, 27 aa, Staphylococcus epidermidis
VRDEIIGPLLHYRMVHELPTFFSSNFD

SEQ ID NO: 1833540 - protein, 25 aa, Staphylococcus epidermidis
VRDFTAVGLLFREGDDYYWKTHSFA

SEQ ID NO: 1833541 - protein, 19 aa, Staphylococcus epidermidis
VRDKTELLVYLSSKDIYIG

SEQ ID NO: 1833542 - protein, 30 aa, Staphylococcus epidermidis
VREYQIHMTLPSLVYYYEYKEDLKGIHVHL

SEQ ID NO: 1833543 - protein, 19 aa, Staphylococcus epidermidis
VRFCLKYKYDKYTLKSLRH

SEQ ID NO: 1833544 - protein, 19 aa, Staphylococcus epidermidis
VRGKNLGEQFDKGALENEF

SEQ ID NO: 1833545 - protein, 22 aa, Staphylococcus epidermidis
VRILDRKIFYAIKQLNELEGIK

SEQ ID NO: 1833546 - protein, 32 aa, Staphylococcus epidermidis
VRKDELFVINFYRQVERWLNRKIRYGNIVAKN

SEQ ID NO: 1833547 - protein, 18 aa, Staphylococcus epidermidis
VRKKQLNTRIIIVTTFKR

SEQ ID NO: 1833548 - protein, 18 aa, Staphylococcus epidermidis
VRNAHKRELAYTRYTWPK

SEQ ID NO: 1833549 - protein, 20 aa, Staphylococcus epidermidis
VRNFKNAEVDIRLFGGDNRP

SEQ ID NO: 1833550 - protein, 25 aa, Staphylococcus epidermidis
VRNGLARVKYVFPPNDTYESKLKES

SEQ ID NO: 1833551 - protein, 22 aa, Staphylococcus epidermidis
VRNKVLIFSGRISSEILIKAAK

SEQ ID NO: 1833552 - protein, 24 aa, Staphylococcus epidermidis
VRPVTYWVATMPELKQREILMARE

SEQ ID NO: 1833553 - protein, 21 aa, Staphylococcus epidermidis
VRSLVEKLITLGKKGDLASRR

SEQ ID NO: 1833554 - protein, 22 aa, Staphylococcus epidermidis
VRTIVFILAWVNQFLATKHISP

SEQ ID NO: 1833555 - protein, 22 aa, Staphylococcus epidermidis
VRWGPRTLDVDILLYGNQIIEE

SEQ ID NO: 1833556 - protein, 30 aa, Staphylococcus epidermidis
VSAPAVLGIYPHTVFELAKRIIPSEKVASI

SEQ ID NO: 1833557 - protein, 18 aa, Staphylococcus epidermidis
VSDDLHYTTGYYASPKLG

SEQ ID NO: 1833558 - protein, 22 aa, Staphylococcus epidermidis
VSDIFMYKTIIDALDKRLSDTQ

SEQ ID NO: 1833559 - protein, 24 aa, Staphylococcus epidermidis
VSDKCDFYIKIPMVGHVNSLNASV

SEQ ID NO: 1833560 - protein, 23 aa, Staphylococcus epidermidis
VSDKELIILGALTTHRLETQFQN

SEQ ID NO: 1833561 - protein, 22 aa, Staphylococcus epidermidis
VSDLFMYKTIIDALDKRLSDTQ

SEQ ID NO: 1833562 - protein, 20 aa, Staphylococcus epidermidis
VSDMKGGMSSLFYVLEQLHQ

SEQ ID NO: 1833563 - protein, 22 aa, Staphylococcus epidermidis
VSDMKGGMSSLFYVLERLKQEG

SEQ ID NO: 1833564 - protein, 17 aa, Staphylococcus epidermidis
VSDMLVFKGKFKMYYTS

SEQ ID NO: 1833565 - protein, 24 aa, Staphylococcus epidermidis
VSEKDILEIIYPNAIQDIANLSIK

SEQ ID NO: 1833566 - protein, 18 aa, Staphylococcus epidermidis
VSELLTAYGFRIVDADIA

SEQ ID NO: 1833567 - protein, 25 aa, Staphylococcus epidermidis
VSGFKALRFLRPLVKGRHYIIITLW

SEQ ID NO: 1833568 - protein, 27 aa, Staphylococcus epidermidis
VSGGKRPLICFFSNDLNIHRTKTEKAN

SEQ ID NO: 1833569 - protein, 18 aa, Staphylococcus epidermidis
VSHLFKVKVSPMEITYVP

SEQ ID NO: 1833570 - protein, 18 aa, Staphylococcus epidermidis
VSHQLRFLKNLRLVKFRR

SEQ ID NO: 1833571 - protein, 18 aa, Staphylococcus epidermidis
VSIVKGLVHHFAAIENEE

SEQ ID NO: 1833572 - protein, 23 aa, Staphylococcus epidermidis
VSKDDYFKEIYKFIPTSATKAEK

SEQ ID NO: 1833573 - protein, 17 aa, Staphylococcus epidermidis
VSKLNDYFLLPKIVKEK

SEQ ID NO: 1833574 - protein, 34 aa, Staphylococcus epidermidis
VSKMRASILVMGPLLARLGHAIVALPGGCAIGSR

SEQ ID NO: 1833575 - protein, 25 aa, Staphylococcus epidermidis
VSKNVKRLIFVAAPGIYDELPESFN

SEQ ID NO: 1833576 - protein, 17 aa, Staphylococcus epidermidis
VSKQFWAHLVRTGQLES

SEQ ID NO: 1833577 - protein, 26 aa, Staphylococcus epidermidis
VSKTSGIFFMIKGDEQYIFGDCAINP

SEQ ID NO: 1833578 - protein, 17 aa, Staphylococcus epidermidis
VSLASTERKIDKYQSMT

SEQ ID NO: 1833579 - protein, 28 aa, Staphylococcus epidermidis
VSLEESLDLYQRGMKLSTACDSTLKDAE

SEQ ID NO: 1833580 - protein, 24 aa, Staphylococcus epidermidis
VSNDFFTIVKWEISGTLNYMKPRE

SEQ ID NO: 1833581 - protein, 21 aa, Staphylococcus epidermidis
VSNIVYVRWFEDLRTVFINQH

SEQ ID NO: 1833582 - protein, 28 aa, Staphylococcus epidermidis
VSQFPVRIKCATLAWKALEKGTVEKEGK

SEQ ID NO: 1833583 - protein, 17 aa, Staphylococcus epidermidis
VSQFTLYADVKKGNRPG

SEQ ID NO: 1833584 - protein, 27 aa, Staphylococcus epidermidis
VSRAKRVITPLSPISIFAARNPWEGLE

SEQ ID NO: 1833585 - protein, 25 aa, Staphylococcus epidermidis
VSRFRIVPLLIFRAMHYIGDIPEIL

SEQ ID NO: 1833586 - protein, 17 aa, Staphylococcus epidermidis
VSRIKNAIPDIALTTDI

SEQ ID NO: 1833587 - protein, 18 aa, Staphylococcus epidermidis
VSRILGLPAFIDILTILE

SEQ ID NO: 1833588 - protein, 18 aa, Staphylococcus epidermidis
VSRTTIYRYLNKLNNQEN

SEQ ID NO: 1833589 - protein, 24 aa, Staphylococcus epidermidis
VSSDFFTMVKWDISGTLNYMKSRE

SEQ ID NO: 1833590 - protein, 24 aa, Staphylococcus epidermidis
VSSDYLLCKAFGKTATNIEKYTSQ

SEQ ID NO: 1833591 - protein, 26 aa, Staphylococcus epidermidis
VSTIPKRIRILKKCKLYTDVTFKNEP

SEQ ID NO: 1833592 - protein, 19 aa, Staphylococcus epidermidis
VSTPSFIEMCLLLPNLNEE

SEQ ID NO: 1833593 - protein, 26 aa, Staphylococcus epidermidis
VSVKRAFIGSFLFGGRYSSSKFKINQ

SEQ ID NO: 1833594 - protein, 26 aa, Staphylococcus epidermidis
VSVSKTLIQILLKYIENHTSSIEGYV

SEQ ID NO: 1833595 - protein, 25 aa, Staphylococcus epidermidis
VSYADILEILKIKKAFNVKQCGNVL

SEQ ID NO: 1833596 - protein, 22 aa, Staphylococcus epidermidis
VSYELCRLLNEDGVNLIVTDIN

SEQ ID NO: 1833597 - protein, 26 aa, Staphylococcus epidermidis
VTAARLGWLPSYPQFNKNSLLFGEEA

SEQ ID NO: 1833598 - protein, 25 aa, Staphylococcus epidermidis
VTAIFPKLVFSIKKGINFGPEDPNY

SEQ ID NO: 1833599 - protein, 18 aa, Staphylococcus epidermidis
VTAILEIHFPKSDVYLYA

SEQ ID NO: 1833600 - protein, 25 aa, Staphylococcus epidermidis
VTATPVLRPLLTLDKEDIIKKAKEL

SEQ ID NO: 1833601 - protein, 19 aa, Staphylococcus epidermidis
VTAYFMPRAYKDRPLVVPN

SEQ ID NO: 1833602 - protein, 18 aa, Staphylococcus epidermidis
VTEVVCDSVQFLEPKNSQ

SEQ ID NO: 1833603 - protein, 26 aa, Staphylococcus epidermidis
VTEYDIHRMLPHPINIVRIRLTGKQL

SEQ ID NO: 1833604 - protein, 25 aa, Staphylococcus epidermidis
VTEYDIHRMLPHPINLVRVRLTGDE

SEQ ID NO: 1833605 - protein, 21 aa, Staphylococcus epidermidis
VTFDDCDIFFIGGGSDREQAL

SEQ ID NO: 1833606 - protein, 25 aa, Staphylococcus epidermidis
VTGEPIQYIVGFQSFYGYQFKVNQH

SEQ ID NO: 1833607 - protein, 17 aa, Staphylococcus epidermidis
VTGLRQVYDDLESAYIL

SEQ ID NO: 1833608 - protein, 25 aa, Staphylococcus epidermidis
VTHSKKGVKLLWASCREVINVIQAD

SEQ ID NO: 1833609 - protein, 24 aa, Staphylococcus epidermidis
VTKHLNYLGLNRFMTDALGLHSRE

SEQ ID NO: 1833610 - protein, 18 aa, Staphylococcus epidermidis
VTLPYEFTPTLPVNDVYS

SEQ ID NO: 1833611 - protein, 25 aa, Staphylococcus epidermidis
VTNNLQLAMAIAALKLKLSPNEVWN

SEQ ID NO: 1833612 - protein, 19 aa, Staphylococcus epidermidis
VTNPKILLCDEATSALDPA

SEQ ID NO: 1833613 - protein, 23 aa, Staphylococcus epidermidis
VTSLPVLCKDFIIDKIQIDVAKR

SEQ ID NO: 1833614 - protein, 25 aa, Staphylococcus epidermidis
VTSTPVLRPLLTLDKEDIIKKAKEI

SEQ ID NO: 1833615 - protein, 17 aa, Staphylococcus epidermidis
VTTLLAYIASEKYKKKV

SEQ ID NO: 1833616 - protein, 17 aa, Staphylococcus epidermidis
VTTQVGCRIGCTFCAST

SEQ ID NO: 1833617 - protein, 17 aa, Staphylococcus epidermidis
VTTYLDRDVLLPAIGQG

SEQ ID NO: 1833618 - protein, 40 aa, Staphylococcus epidermidis
VTVDVGSHYIWMARKFRSYNPRHLLFSNGMQTLGVALPWA

SEQ ID NO: 1833619 - protein, 23 aa, Staphylococcus epidermidis
VTVISVFVNPLQFGPNEDFDAYP

SEQ ID NO: 1833620 - protein, 24 aa, Staphylococcus epidermidis
VTVVNKLFNIVQPDYAYFGKKDAQ

SEQ ID NO: 1833621 - protein, 25 aa, Staphylococcus epidermidis
VTVVNKLFNIVQPDYAYFGKKDAQQ

SEQ ID NO: 1833622 - protein, 26 aa, Staphylococcus epidermidis
VTVVNKLFNIVRPDFAYFGKKDAQQL

SEQ ID NO: 1833623 - protein, 22 aa, Staphylococcus epidermidis
VVAAICMYALKTAGYQSALMVP

SEQ ID NO: 1833624 - protein, 21 aa, Staphylococcus epidermidis
VVCNYLDDIYVIEKMLLKQED

SEQ ID NO: 1833625 - protein, 18 aa, Staphylococcus epidermidis
VVCQSGMRSKRAMKILLK

SEQ ID NO: 1833626 - protein, 26 aa, Staphylococcus epidermidis
VVDACFTPVLAPFITIRSMVGMIDAS

SEQ ID NO: 1833627 - protein, 26 aa, Staphylococcus epidermidis
VVDELLLIDVLRNQIIRHAYLDVFEN

SEQ ID NO: 1833628 - protein, 28 aa, Staphylococcus epidermidis
VVDPDAKFIIWTTTPWTIPSNVAITVHP

SEQ ID NO: 1833629 - protein, 33 aa, Staphylococcus epidermidis
VVDQIHTGRYYIQRFLARSFGFEVDDIKEMSEV

SEQ ID NO: 1833630 - protein, 24 aa, Staphylococcus epidermidis
VVDVYIRYLRNKLKPFNKEKSIET

SEQ ID NO: 1833631 - protein, 18 aa, Staphylococcus epidermidis
VVEFLGIKKQMDAILLPD

SEQ ID NO: 1833632 - protein, 23 aa, Staphylococcus epidermidis
VVEGKPYDVIYGHLSKWLVKNGE

SEQ ID NO: 1833633 - protein, 19 aa, Staphylococcus epidermidis
VVELINFKIYISKEDNNIE

SEQ ID NO: 1833634 - protein, 24 aa, Staphylococcus epidermidis
VVGAPTQMKIYTTIKGKTAHASTP

SEQ ID NO: 1833635 - protein, 20 aa, Staphylococcus epidermidis
VVGFFVLHQFYQHEGYDTPE

SEQ ID NO: 1833636 - protein, 18 aa, Staphylococcus epidermidis
VVGNKKALASFQDKFNEY

SEQ ID NO: 1833637 - protein, 17 aa, Staphylococcus epidermidis
VVGNTYGRIRAMVNDLG

SEQ ID NO: 1833638 - protein, 24 aa, Staphylococcus epidermidis
VVHKHYWNIGIAADTDRGLLVPVV

SEQ ID NO: 1833639 - protein, 18 aa, Staphylococcus epidermidis
VVISKTNRQFKIVKSLIL

SEQ ID NO: 1833640 - protein, 24 aa, Staphylococcus epidermidis
VVKNSIDIFPKTRLNLSLSTNDVI

SEQ ID NO: 1833641 - protein, 24 aa, Staphylococcus epidermidis
VVKWNQPMYTYNDTFIIAFSKAKH

SEQ ID NO: 1833642 - protein, 24 aa, Staphylococcus epidermidis
VVLTISVDLPFAQKRWCASNGLDN

SEQ ID NO: 1833643 - protein, 17 aa, Staphylococcus epidermidis
VVMAFTKSYDRPYEQLE

SEQ ID NO: 1833644 - protein, 19 aa, Staphylococcus epidermidis
VVNLLLKLQRERDITLMFI

SEQ ID NO: 1833645 - protein, 29 aa, Staphylococcus epidermidis
VVNQWSYEALVRIFFRYGEEKFSKQIARR

SEQ ID NO: 1833646 - protein, 23 aa, Staphylococcus epidermidis
VVRDLQTKLPIIPGSSIKGKMRN

SEQ ID NO: 1833647 - protein, 26 aa, Staphylococcus epidermidis
VVRLANFGAFVEIAPAVQGLVHISEI

SEQ ID NO: 1833648 - protein, 26 aa, Staphylococcus epidermidis
VVRRNLNLDLFYSIKVSLPCIEEQNK

SEQ ID NO: 1833649 - protein, 17 aa, Staphylococcus epidermidis
VVTFTNLSAREMKHRVD

SEQ ID NO: 1833650 - protein, 26 aa, Staphylococcus epidermidis
VVTNDDFTHWRKIMGAAPISDEEREN

SEQ ID NO: 1833651 - protein, 33 aa, Staphylococcus epidermidis
VVTNPPFSLFREYLDQLIKYDKKFLIIANVNSI

SEQ ID NO: 1833652 - protein, 25 aa, Staphylococcus epidermidis
VVTRPIMEEWLFNTVAFIGGPSEIK

SEQ ID NO: 1833653 - protein, 19 aa, Staphylococcus epidermidis
VWFKLVLNDTSEFHNIKQD

SEQ ID NO: 1833654 - protein, 17 aa, Staphylococcus epidermidis
VWLDCDIEIIFKRVKND

SEQ ID NO: 1833655 - protein, 20 aa, Staphylococcus epidermidis
VWVLPITNREKRYPLDIEVK

SEQ ID NO: 1833656 - protein, 17 aa, Staphylococcus epidermidis
VYDYAYPIGCSYKRNER

SEQ ID NO: 1833657 - protein, 21 aa, Staphylococcus epidermidis
VYEDLLLLRSLSDLNEHQKMD

SEQ ID NO: 1833658 - protein, 17 aa, Staphylococcus epidermidis
VYELYDKHTTHITVVTS

SEQ ID NO: 1833659 - protein, 24 aa, Staphylococcus epidermidis
VYEMRWDIGYVLQQIALFPHMTIK

SEQ ID NO: 1833660 - protein, 24 aa, Staphylococcus epidermidis
VYEPFLIQKGFLERTPRGRKATAF

SEQ ID NO: 1833661 - protein, 24 aa, Staphylococcus epidermidis
VYEPFLIQKGFLERTPRGRKATAL

SEQ ID NO: 1833662 - protein, 33 aa, Staphylococcus epidermidis
VYEQLIFIERLSKKKIYDLFIQDVSNYYDLDEE

SEQ ID NO: 1833663 - protein, 18 aa, Staphylococcus epidermidis
VYFICGTQDIPEGRTIEQ

SEQ ID NO: 1833664 - protein, 23 aa, Staphylococcus epidermidis
VYGTNWYTYYSNDYNQFLMVSYI

SEQ ID NO: 1833665 - protein, 18 aa, Staphylococcus epidermidis
VYIEPLTHDFIARIIRKE

SEQ ID NO: 1833666 - protein, 23 aa, Staphylococcus epidermidis
VYKPYIEGFVKMLAPIAPHIGEE

SEQ ID NO: 1833667 - protein, 19 aa, Staphylococcus epidermidis
VYLAGPIQLLNRPKHDEFS

SEQ ID NO: 1833668 - protein, 21 aa, Staphylococcus epidermidis
VYNDYLDPILFTFESGYEEAI

SEQ ID NO: 1833669 - protein, 26 aa, Staphylococcus epidermidis
VYQKDKYPFLYKYNDALILDTKTLNQ

SEQ ID NO: 1833670 - protein, 18 aa, Staphylococcus epidermidis
VYRFKRGFNVKIEELIGD

SEQ ID NO: 1833671 - protein, 20 aa, Staphylococcus epidermidis
VYRIERLQDAIPDNAPILYK

SEQ ID NO: 1833672 - protein, 25 aa, Staphylococcus epidermidis
VYRIQRLQDAIPDNAPILYKSGAFK

SEQ ID NO: 1833673 - protein, 27 aa, Staphylococcus epidermidis
VYSDAYNYGFILTPTEKELGACVIDIG

SEQ ID NO: 1833674 - protein, 17 aa, Staphylococcus epidermidis
VYSVLINVTSINKLFLY

SEQ ID NO: 1833675 - protein, 20 aa, Staphylococcus epidermidis
VYTNLKPWDRVQIARLPERP

SEQ ID NO: 1833676 - protein, 18 aa, Staphylococcus epidermidis
VYVVGDCANLPYAPSAQL

SEQ ID NO: 1833677 - protein, 17 aa, Staphylococcus epidermidis
WAAPIMSKPVKNMTVAI

SEQ ID NO: 1833678 - protein, 26 aa, Staphylococcus epidermidis
WANEWKNYFHPFKASERFTIVPSWET

SEQ ID NO: 1833679 - protein, 20 aa, Staphylococcus epidermidis
WDAHKLLFQTYSCAMVIVKE

SEQ ID NO: 1833680 - protein, 17 aa, Staphylococcus epidermidis
WDHISYKQAFYIAEHYI

SEQ ID NO: 1833681 - protein, 22 aa, Staphylococcus epidermidis
WDRYYLENVGIDRLKTILSNHT

SEQ ID NO: 1833682 - protein, 19 aa, Staphylococcus epidermidis
WDSQIKKFIFASSAAVYGD

SEQ ID NO: 1833683 - protein, 25 aa, Staphylococcus epidermidis
WEDELSMIFVVINNKSKKVSSRSGM

SEQ ID NO: 1833684 - protein, 18 aa, Staphylococcus epidermidis
WEDRLNDYTYIPRIKEIS

SEQ ID NO: 1833685 - protein, 17 aa, Staphylococcus epidermidis
WEHAYYLKYQNKRPDYI

SEQ ID NO: 1833686 - protein, 25 aa, Staphylococcus epidermidis
WEKDLSMIFVVINNQSKKVSSRSGM

SEQ ID NO: 1833687 - protein, 18 aa, Staphylococcus epidermidis
WELGTIFRPSVIGMINVL

SEQ ID NO: 1833688 - protein, 23 aa, Staphylococcus epidermidis
WESEQAFTDWLKSDVFRKAHKNV

SEQ ID NO: 1833689 - protein, 20 aa, Staphylococcus epidermidis
WESYFKDQGFYPVAVDAKHG

SEQ ID NO: 1833690 - protein, 19 aa, Staphylococcus epidermidis
WFTIAMYELGKWIGRELYY

SEQ ID NO: 1833691 - protein, 19 aa, Staphylococcus epidermidis
WFTIAMYELGKWIGREVYY

SEQ ID NO: 1833692 - protein, 17 aa, Staphylococcus epidermidis
WFTISVYELGKWLGREL

SEQ ID NO: 1833693 - protein, 23 aa, Staphylococcus epidermidis
WGKNPLMNWYTFNVYKNVTKDGN

SEQ ID NO: 1833694 - protein, 19 aa, Staphylococcus epidermidis
WGRPDMALFKFTKAVVNDE

SEQ ID NO: 1833695 - protein, 17 aa, Staphylococcus epidermidis
WHQYTNAIIYYYMVDKQ

SEQ ID NO: 1833696 - protein, 17 aa, Staphylococcus epidermidis
WHVIYDTPTDNYYFGDD

SEQ ID NO: 1833697 - protein, 18 aa, Staphylococcus epidermidis
WIAHFDIPTILYGPGSLE

SEQ ID NO: 1833698 - protein, 18 aa, Staphylococcus epidermidis
WIEEQPYWQQVIAKKILD

SEQ ID NO: 1833699 - protein, 28 aa, Staphylococcus epidermidis
WIENEIYGKYLMGAFRFDVKQADKNAGF

SEQ ID NO: 1833700 - protein, 28 aa, Staphylococcus epidermidis
WIKNHQSFNLPKFINLIKDRDSEAIYDE

SEQ ID NO: 1833701 - protein, 18 aa, Staphylococcus epidermidis
WINSGVATLKKYFDGRET

SEQ ID NO: 1833702 - protein, 18 aa, Staphylococcus epidermidis
WIVKFLNNGKSTYLTMDS

SEQ ID NO: 1833703 - protein, 19 aa, Staphylococcus epidermidis
WIYKTMPTMNQWLKDIEVQ

SEQ ID NO: 1833704 - protein, 18 aa, Staphylococcus epidermidis
WKDNTLPFYYKPDKTEFD

SEQ ID NO: 1833705 - protein, 19 aa, Staphylococcus epidermidis
WKGFVEYHDKKKTQLPQLF

SEQ ID NO: 1833706 - protein, 18 aa, Staphylococcus epidermidis
WKLAKMNLAIRGIDNDLG

SEQ ID NO: 1833707 - protein, 17 aa, Staphylococcus epidermidis
WLKKKYFNLDIISVLLF

SEQ ID NO: 1833708 - protein, 17 aa, Staphylococcus epidermidis
WLSEIANHFPGKIYLSV

SEQ ID NO: 1833709 - protein, 20 aa, Staphylococcus epidermidis
WMERMIAYGFEENIDYIIQS

SEQ ID NO: 1833710 - protein, 17 aa, Staphylococcus epidermidis
WMIATQSKKGPFAILDI

SEQ ID NO: 1833711 - protein, 17 aa, Staphylococcus epidermidis
WNAIFWCNHDQPRVVSR

SEQ ID NO: 1833712 - protein, 18 aa, Staphylococcus epidermidis
WNCKYHIVFVPKYRRQVI

SEQ ID NO: 1833713 - protein, 27 aa, Staphylococcus epidermidis
WNDPSGSFYIWFEFSISINVKKLFNES

SEQ ID NO: 1833714 - protein, 19 aa, Staphylococcus epidermidis
WNDRYCCYYPNHLNHGYYF

SEQ ID NO: 1833715 - protein, 25 aa, Staphylococcus epidermidis
WNGVPVYTDFLPYGTRRTGQPLDTG

SEQ ID NO: 1833716 - protein, 17 aa, Staphylococcus epidermidis
WNHFEKGIYVDKLSGKP

SEQ ID NO: 1833717 - protein, 22 aa, Staphylococcus epidermidis
WNNYYEYQFRNAKFVDFFITAT

SEQ ID NO: 1833718 - protein, 27 aa, Staphylococcus epidermidis
WNRKAFRGIELYGKTLGVIGAGRIGLG

SEQ ID NO: 1833719 - protein, 22 aa, Staphylococcus epidermidis
WPHLSSIRIPTLIIVGEKDKKF

SEQ ID NO: 1833720 - protein, 19 aa, Staphylococcus epidermidis
WPKSVTPFDIHLITINPKK

SEQ ID NO: 1833721 - protein, 19 aa, Staphylococcus epidermidis
WPKSVTPFELHLITINPKK

SEQ ID NO: 1833722 - protein, 24 aa, Staphylococcus epidermidis
WQDCYKFLRNLIFNETELEENYKW

SEQ ID NO: 1833723 - protein, 24 aa, Staphylococcus epidermidis
WQKHFPFWSVMTIKRAVYSLEKQN

SEQ ID NO: 1833724 - protein, 21 aa, Staphylococcus epidermidis
WQVSRTTIYRYLNKLEAKENK

SEQ ID NO: 1833725 - protein, 24 aa, Staphylococcus epidermidis
WREYGLNHFVLPKVLISNEGERTF

SEQ ID NO: 1833726 - protein, 18 aa, Staphylococcus epidermidis
WRGKRYLYTGLFDNDKKL

SEQ ID NO: 1833727 - protein, 19 aa, Staphylococcus epidermidis
WRVVPRAWSHVFLSLIGEP

SEQ ID NO: 1833728 - protein, 30 aa, Staphylococcus epidermidis
WRYQDVPEKLWPIQPLRDFWGINRRTEAKL

SEQ ID NO: 1833729 - protein, 19 aa, Staphylococcus epidermidis
WSHLVAHKLYNKKRYVAAR

SEQ ID NO: 1833730 - protein, 24 aa, Staphylococcus epidermidis
WSKDDYQFEYLSTYSGYIAKNMPE

SEQ ID NO: 1833731 - protein, 17 aa, Staphylococcus epidermidis
WSVYILTHKKGELSKLN

SEQ ID NO: 1833732 - protein, 28 aa, Staphylococcus epidermidis
WTDNKPPQGIILPCYYDGKQWVGQTEEE

SEQ ID NO: 1833733 - protein, 26 aa, Staphylococcus epidermidis
WTLAKDIYQEWYLGKALFNQVEYKKD

SEQ ID NO: 1833734 - protein, 18 aa, Staphylococcus epidermidis
WTSPAHKTVRFKLNKSVK

SEQ ID NO: 1833735 - protein, 31 aa, Staphylococcus epidermidis
WTVAYTKLHNFHWYVKGPNFFSLHTKFEELY

SEQ ID NO: 1833736 - protein, 26 aa, Staphylococcus epidermidis
WVDENGDIFFIYTNEKLKSILNISSP

SEQ ID NO: 1833737 - protein, 17 aa, Staphylococcus epidermidis
WVLGEQSAKSLRGAKME

SEQ ID NO: 1833738 - protein, 30 aa, Staphylococcus epidermidis
WVQDEDVLDTWFSSALWPFSTLGWPDTDSE

SEQ ID NO: 1833739 - protein, 38 aa, Staphylococcus epidermidis
WVQEEPKNQGAWLFVYPYLKALVADRYDLSYHGRIQRA

SEQ ID NO: 1833740 - protein, 18 aa, Staphylococcus epidermidis
WVRSFKLRGAYNAISVLS

SEQ ID NO: 1833741 - protein, 19 aa, Staphylococcus epidermidis
YADDYLRTSNLNYTIVHPG

SEQ ID NO: 1833742 - protein, 19 aa, Staphylococcus epidermidis
YADITPLKRLGYSPQFNIH

SEQ ID NO: 1833743 - protein, 17 aa, Staphylococcus epidermidis
YAFDFLPEQERQAVWVI

SEQ ID NO: 1833744 - protein, 19 aa, Staphylococcus epidermidis
YAFLVLNMNKVYLYVDIKN

SEQ ID NO: 1833745 - protein, 19 aa, Staphylococcus epidermidis
YAGDVWYPQPAPADHPWRT

SEQ ID NO: 1833746 - protein, 30 aa, Staphylococcus epidermidis
YAIDFSGYSMFWANLILASNAKRKLVYLHS

SEQ ID NO: 1833747 - protein, 17 aa, Staphylococcus epidermidis
YAIDYFPDNLNLTINEY

SEQ ID NO: 1833748 - protein, 22 aa, Staphylococcus epidermidis
YAKELNLKSKEIIDELKSMNVE

SEQ ID NO: 1833749 - protein, 17 aa, Staphylococcus epidermidis
YAKLLDDTKRKAFESVI

SEQ ID NO: 1833750 - protein, 20 aa, Staphylococcus epidermidis
YALQGLLDQYPGLQVAMEPF

SEQ ID NO: 1833751 - protein, 26 aa, Staphylococcus epidermidis
YANHLEQPLTFPLISLIVSGGHTELV

SEQ ID NO: 1833752 - protein, 18 aa, Staphylococcus epidermidis
YANKFKRKLHPYEGKQYE

SEQ ID NO: 1833753 - protein, 22 aa, Staphylococcus epidermidis
YANMDCMFLDVNYINIGNNVMF

SEQ ID NO: 1833754 - protein, 23 aa, Staphylococcus epidermidis
YANNFLLKNNYAVEATPGNLKQL

SEQ ID NO: 1833755 - protein, 18 aa, Staphylococcus epidermidis
YAPWYIVPADHKKTGRIE

SEQ ID NO: 1833756 - protein, 25 aa, Staphylococcus epidermidis
YAQMANELFHFPVMYIEYSGEYGDI

SEQ ID NO: 1833757 - protein, 19 aa, Staphylococcus epidermidis
YAQYGIRINNISPGAIFTE

SEQ ID NO: 1833758 - protein, 20 aa, Staphylococcus epidermidis
YAQYGIRINNISPGAIVTEH

SEQ ID NO: 1833759 - protein, 17 aa, Staphylococcus epidermidis
YARVIAFIFKKLSEQSK

SEQ ID NO: 1833760 - protein, 26 aa, Staphylococcus epidermidis
YASNFNQSIDWWRTLYTDEDAYFDKV

SEQ ID NO: 1833761 - protein, 25 aa, Staphylococcus epidermidis
YATDPLAFVRWHYDKKKRIIYAVDE

SEQ ID NO: 1833762 - protein, 28 aa, Staphylococcus epidermidis
YAVNFEEEYWDKVFTYFLDEYKKGRTPN

SEQ ID NO: 1833763 - protein, 27 aa, Staphylococcus epidermidis
YAVNFEEQYWDKVFTYFLDEYKKGRTP

SEQ ID NO: 1833764 - protein, 19 aa, Staphylococcus epidermidis
YAVWALKDYGFKIIVAENF

SEQ ID NO: 1833765 - protein, 18 aa, Staphylococcus epidermidis
YCFKPKLHKPITICISNY

SEQ ID NO: 1833766 - protein, 27 aa, Staphylococcus epidermidis
YCINSAAIQFIPYEKLEELGYGELIPH

SEQ ID NO: 1833767 - protein, 21 aa, Staphylococcus epidermidis
YCKKKMTLFGKGKEAVYRCVC

SEQ ID NO: 1833768 - protein, 22 aa, Staphylococcus epidermidis
YCKKKMTLFGKGKEAVYRCVCG

SEQ ID NO: 1833769 - protein, 29 aa, Staphylococcus epidermidis
YCYKNHAPITIYYWNNGYISNLYCYIKAV

SEQ ID NO: 1833770 - protein, 21 aa, Staphylococcus epidermidis
YCYNYAIWLIQNGLSHRYEFA

SEQ ID NO: 1833771 - protein, 17 aa, Staphylococcus epidermidis
YDAAMKYKEDGTGLAVL

SEQ ID NO: 1833772 - protein, 24 aa, Staphylococcus epidermidis
YDANDLLQMMIKTMEDRLNEHNER

SEQ ID NO: 1833773 - protein, 26 aa, Staphylococcus epidermidis
YDDDYYYYIDPLWSRLSKFVIFPSII

SEQ ID NO: 1833774 - protein, 24 aa, Staphylococcus epidermidis
YDDEEYLFHVLKSGAKGYILKNAP

SEQ ID NO: 1833775 - protein, 17 aa, Staphylococcus epidermidis
YDDEGIAFVILDDNQGT

SEQ ID NO: 1833776 - protein, 20 aa, Staphylococcus epidermidis
YDECFGYVPILPLGGKEVVE

SEQ ID NO: 1833777 - protein, 19 aa, Staphylococcus epidermidis
YDEIPSTLPVFKDVTSGEL

SEQ ID NO: 1833778 - protein, 26 aa, Staphylococcus epidermidis
YDETHYYYIDPLWTRIAKGIILPSII

SEQ ID NO: 1833779 - protein, 25 aa, Staphylococcus epidermidis
YDEYDKGYILNWLVTNSNEFDMEPL

SEQ ID NO: 1833780 - protein, 22 aa, Staphylococcus epidermidis
YDEYDRGYILNWLVTDSNEFEM

SEQ ID NO: 1833781 - protein, 20 aa, Staphylococcus epidermidis
YDFIKLQKRSDYGLGIIGEL

SEQ ID NO: 1833782 - protein, 17 aa, Staphylococcus epidermidis
YDFYHYFGDIDKYEIIR

SEQ ID NO: 1833783 - protein, 19 aa, Staphylococcus epidermidis
YDGHRFEDCPNFVKGHVPE

SEQ ID NO: 1833784 - protein, 17 aa, Staphylococcus epidermidis
YDIKKGMHFILTSEDQT

SEQ ID NO: 1833785 - protein, 23 aa, Staphylococcus epidermidis
YDKQIINMPYMTPTKFNLLISNI

SEQ ID NO: 1833786 - protein, 18 aa, Staphylococcus epidermidis
YDKWLVGFKETKGGRRFA

SEQ ID NO: 1833787 - protein, 25 aa, Staphylococcus epidermidis
YDLGHFRGAIRPDITRFRDLPEWVR

SEQ ID NO: 1833788 - protein, 18 aa, Staphylococcus epidermidis
YDLGIRAIMFFGVPNEKD

SEQ ID NO: 1833789 - protein, 17 aa, Staphylococcus epidermidis
YDLITTASKYKSGEEAL

SEQ ID NO: 1833790 - protein, 17 aa, Staphylococcus epidermidis
YDLKYDMANSVINQIKD

SEQ ID NO: 1833791 - protein, 30 aa, Staphylococcus epidermidis
YDLTEKRMILERILPILSDRERQIIQCTFI

SEQ ID NO: 1833792 - protein, 18 aa, Staphylococcus epidermidis
YDLYYDGQQFYQLTTDMF

SEQ ID NO: 1833793 - protein, 24 aa, Staphylococcus epidermidis
YDMHEFLIHLTGVLETGYFLDMTD

SEQ ID NO: 1833794 - protein, 18 aa, Staphylococcus epidermidis
YDMLFEHGIFVSYLRYPT

SEQ ID NO: 1833795 - protein, 25 aa, Staphylococcus epidermidis
YDNKELVHFFFNELSKYVKKHNCLY

SEQ ID NO: 1833796 - protein, 23 aa, Staphylococcus epidermidis
YDNSLEFLALFEKLSLEMNDVVN

SEQ ID NO: 1833797 - protein, 18 aa, Staphylococcus epidermidis
YDPRLFEGFSMGNPKIQT

SEQ ID NO: 1833798 - protein, 31 aa, Staphylococcus epidermidis
YDQDTKWLSVLPIYHISGLSVILRSVIEGFT

SEQ ID NO: 1833799 - protein, 17 aa, Staphylococcus epidermidis
YDRGLAYGKDDPAEEMY

SEQ ID NO: 1833800 - protein, 22 aa, Staphylococcus epidermidis
YDRNLYTPYSLPITNKNLFKYN

SEQ ID NO: 1833801 - protein, 24 aa, Staphylococcus epidermidis
YDSERYIPVLAIAIGKKAQEAHSS

SEQ ID NO: 1833802 - protein, 23 aa, Staphylococcus epidermidis
YDVNLIGFNLLYKVLRPQFVQHA

SEQ ID NO: 1833803 - protein, 20 aa, Staphylococcus epidermidis
YDVSGLGLDLFAGSGALGIE

SEQ ID NO: 1833804 - protein, 22 aa, Staphylococcus epidermidis
YDVYLLGYSMGGRVALYYALYG

SEQ ID NO: 1833805 - protein, 17 aa, Staphylococcus epidermidis
YDYIKHIVQTKGYPPSV

SEQ ID NO: 1833806 - protein, 18 aa, Staphylococcus epidermidis
YDYMLVNPKIVSYSVQEA

SEQ ID NO: 1833807 - protein, 22 aa, Staphylococcus epidermidis
YEALLTEYGVWHPRAWQSAPRP

SEQ ID NO: 1833808 - protein, 17 aa, Staphylococcus epidermidis
YEAMTERDEAEYVVREI

SEQ ID NO: 1833809 - protein, 28 aa, Staphylococcus epidermidis
YEANSFASCLLFPLNVRYKYRNVLNEYD

SEQ ID NO: 1833810 - protein, 18 aa, Staphylococcus epidermidis
YECRQYIKSLKIEPSDKQ

SEQ ID NO: 1833811 - protein, 25 aa, Staphylococcus epidermidis
YEDCSAVIKSLEGPLSTLGGAIMNS

SEQ ID NO: 1833812 - protein, 23 aa, Staphylococcus epidermidis
YEDILIQLDRLYNYPELRVSVDA

SEQ ID NO: 1833813 - protein, 25 aa, Staphylococcus epidermidis
YEDLWIYAMENRFDDWFPLLADNGT

SEQ ID NO: 1833814 - protein, 24 aa, Staphylococcus epidermidis
YEDYSFHIVGYINGVPMATARIRS

SEQ ID NO: 1833815 - protein, 20 aa, Staphylococcus epidermidis
YEELFNEKLQMLLKINKHEI

SEQ ID NO: 1833816 - protein, 23 aa, Staphylococcus epidermidis
YEEMNHLLYCSSAGHEPGYVYRA

SEQ ID NO: 1833817 - protein, 25 aa, Staphylococcus epidermidis
YEETGAIAKFIYYFAQYRIKTEHDE

SEQ ID NO: 1833818 - protein, 19 aa, Staphylococcus epidermidis
YEFDLKLINEKRPHILDAN

SEQ ID NO: 1833819 - protein, 18 aa, Staphylococcus epidermidis
YEFDLKLINEKRPHILDT

SEQ ID NO: 1833820 - protein, 26 aa, Staphylococcus epidermidis
YEFKLHNQIFKVHREAPFIKEGNTTK

SEQ ID NO: 1833821 - protein, 18 aa, Staphylococcus epidermidis
YEGFSMGNPKIQTGNLLE

SEQ ID NO: 1833822 - protein, 25 aa, Staphylococcus epidermidis
YEGKSYFFESYTEWIKFYLSEMGVE

SEQ ID NO: 1833823 - protein, 22 aa, Staphylococcus epidermidis
YEGNMFYRDQLLSKIKQAAKHM

SEQ ID NO: 1833824 - protein, 26 aa, Staphylococcus epidermidis
YEGRMLNIHPSLLPKYKGLDAIGQAY

SEQ ID NO: 1833825 - protein, 17 aa, Staphylococcus epidermidis
YEIKHFMTIQLLSDMAG

SEQ ID NO: 1833826 - protein, 24 aa, Staphylococcus epidermidis
YEINEKVIMLITKQQPIATDLRMM

SEQ ID NO: 1833827 - protein, 19 aa, Staphylococcus epidermidis
YEIVVLSNRKAEDNKKFVL

SEQ ID NO: 1833828 - protein, 28 aa, Staphylococcus epidermidis
YEKVRGLNPFYYEIPKKYKFADETSLIQ

SEQ ID NO: 1833829 - protein, 19 aa, Staphylococcus epidermidis
YEKVRNLLLNPELQKMYSK

SEQ ID NO: 1833830 - protein, 18 aa, Staphylococcus epidermidis
YELFVVSCPLDEGLEIFV

SEQ ID NO: 1833831 - protein, 17 aa, Staphylococcus epidermidis
YELSLLQQKYDNQLNES

SEQ ID NO: 1833832 - protein, 32 aa, Staphylococcus epidermidis
YEMLRRFKEWIKENGYWRYVETNGIIGVALDN

SEQ ID NO: 1833833 - protein, 22 aa, Staphylococcus epidermidis
YENDYVYAFLDISQVTKGHTLL

SEQ ID NO: 1833834 - protein, 18 aa, Staphylococcus epidermidis
YENEADYFTFDWTNKTIE

SEQ ID NO: 1833835 - protein, 18 aa, Staphylococcus epidermidis
YENEANYFTFDWSNQTID

SEQ ID NO: 1833836 - protein, 24 aa, Staphylococcus epidermidis
YENEIIIYPLKNCTRIIPFSSISY

SEQ ID NO: 1833837 - protein, 26 aa, Staphylococcus epidermidis
YENIWEALFLCHQLFRAVSGEVAERL

SEQ ID NO: 1833838 - protein, 18 aa, Staphylococcus epidermidis
YENNGLFNLAVLNVVAHH

SEQ ID NO: 1833839 - protein, 25 aa, Staphylococcus epidermidis
YENNLDYVFLGHIFPTASHPDTPPR

SEQ ID NO: 1833840 - protein, 24 aa, Staphylococcus epidermidis
YEPYIDQKHLILLGQYNGNYYVQD

SEQ ID NO: 1833841 - protein, 19 aa, Staphylococcus epidermidis
YEQHLLKLLSSEEVQWIVL

SEQ ID NO: 1833842 - protein, 27 aa, Staphylococcus epidermidis
YEQRMPKIVIVIDELADLMMMAPQEVE

SEQ ID NO: 1833843 - protein, 31 aa, Staphylococcus epidermidis
YERHEYNLFGQLHRKIFYYSDSSLRHSDELI

SEQ ID NO: 1833844 - protein, 17 aa, Staphylococcus epidermidis
YERYFNDPEFKDFRHSF

SEQ ID NO: 1833845 - protein, 20 aa, Staphylococcus epidermidis
YESDGQFYFVDYKTDAFNRR

SEQ ID NO: 1833846 - protein, 30 aa, Staphylococcus epidermidis
YETTEYILDQLPCWLTYTNGETHKVIDDNL

SEQ ID NO: 1833847 - protein, 24 aa, Staphylococcus epidermidis
YEVSILKMQLLIWITETATGDIQE

SEQ ID NO: 1833848 - protein, 18 aa, Staphylococcus epidermidis
YFARPTIFINVDNQMTIA

SEQ ID NO: 1833849 - protein, 24 aa, Staphylococcus epidermidis
YFDDVTLYIAAAQRKKQQIQSETI

SEQ ID NO: 1833850 - protein, 19 aa, Staphylococcus epidermidis
YFIQTNYPNQPFYNKAMCV

SEQ ID NO: 1833851 - protein, 17 aa, Staphylococcus epidermidis
YFKDRVLVPLAYIDFNE

SEQ ID NO: 1833852 - protein, 21 aa, Staphylococcus epidermidis
YFKGAIVIISHDRYFLDKIVT

SEQ ID NO: 1833853 - protein, 17 aa, Staphylococcus epidermidis
YFKIFFSKLLSSITINP

SEQ ID NO: 1833854 - protein, 20 aa, Staphylococcus epidermidis
YFKIVLYKKNGEKIKTMIIE

SEQ ID NO: 1833855 - protein, 35 aa, Staphylococcus epidermidis
YFKQEAIEFAWEFLTSDKWMGMEPEKLYVTIHPED

SEQ ID NO: 1833856 - protein, 18 aa, Staphylococcus epidermidis
YFNEQIVPLKDNMKTRSI

SEQ ID NO: 1833857 - protein, 19 aa, Staphylococcus epidermidis
YFNMMQDFIQLDDVLIAEQ

SEQ ID NO: 1833858 - protein, 19 aa, Staphylococcus epidermidis
YFTQNDVPTFAICHGPLLL

SEQ ID NO: 1833859 - protein, 17 aa, Staphylococcus epidermidis
YFYLLEIGQKEKALLIL

SEQ ID NO: 1833860 - protein, 21 aa, Staphylococcus epidermidis
YFYNFINHYGDKVLLPLAYID

SEQ ID NO: 1833861 - protein, 17 aa, Staphylococcus epidermidis
YGALLIFDEVMTGFRVG

SEQ ID NO: 1833862 - protein, 22 aa, Staphylococcus epidermidis
YGCDKFCTYCIVPFTRGKERSR

SEQ ID NO: 1833863 - protein, 20 aa, Staphylococcus epidermidis
YGFLARPFVRDKDAIQIVPL

SEQ ID NO: 1833864 - protein, 17 aa, Staphylococcus epidermidis
YGHGDLFVNIKVVTPTK

SEQ ID NO: 1833865 - protein, 24 aa, Staphylococcus epidermidis
YGKAEHTFVPHFTIAQGLSSQEFE

SEQ ID NO: 1833866 - protein, 26 aa, Staphylococcus epidermidis
YGKKQSLVFYHLKLDSKYASIFGLTK

SEQ ID NO: 1833867 - protein, 17 aa, Staphylococcus epidermidis
YGKLDFLNCAFGLVPTE

SEQ ID NO: 1833868 - protein, 20 aa, Staphylococcus epidermidis
YGLEFAVKQFLKAGINTFST

SEQ ID NO: 1833869 - protein, 24 aa, Staphylococcus epidermidis
YGLQMQMMTYMDIVLQNQERLGLT

SEQ ID NO: 1833870 - protein, 27 aa, Staphylococcus epidermidis
YGLYRDNFLQVAFFYYSPGGNGKTTLL

SEQ ID NO: 1833871 - protein, 27 aa, Staphylococcus epidermidis
YGNLSLLDTPTFLFGMRNGETVEIEID

SEQ ID NO: 1833872 - protein, 22 aa, Staphylococcus epidermidis
YGQGRVLVFNKKGYPIGQILMP

SEQ ID NO: 1833873 - protein, 19 aa, Staphylococcus epidermidis
YGRFPHQKGFGRLSAEDKK

SEQ ID NO: 1833874 - protein, 18 aa, Staphylococcus epidermidis
YGSIIRKLIQNNINLIAL

SEQ ID NO: 1833875 - protein, 28 aa, Staphylococcus epidermidis
YGSQLGLKYYLKIKYPDKNIYAVGNNEP

SEQ ID NO: 1833876 - protein, 21 aa, Staphylococcus epidermidis
YGTNWYTYYDKDYNNFIMISY

SEQ ID NO: 1833877 - protein, 20 aa, Staphylococcus epidermidis
YGVKHWYVGNFMTSLDMQGF

SEQ ID NO: 1833878 - protein, 22 aa, Staphylococcus epidermidis
YGVPRIVFVNKMDKLGANFDYS

SEQ ID NO: 1833879 - protein, 20 aa, Staphylococcus epidermidis
YGYAKYLRDALPNATFVGFT

SEQ ID NO: 1833880 - protein, 19 aa, Staphylococcus epidermidis
YGYCIQRHISVRNKVLIFS

SEQ ID NO: 1833881 - protein, 32 aa, Staphylococcus epidermidis
YGYLNLAPEEFIVWVLGFIKNVDELKQKVKTI

SEQ ID NO: 1833882 - protein, 18 aa, Staphylococcus epidermidis
YHDMNGLLMAKLNDININ

SEQ ID NO: 1833883 - protein, 19 aa, Staphylococcus epidermidis
YHEEENAMVTDLDDLKELG

SEQ ID NO: 1833884 - protein, 25 aa, Staphylococcus epidermidis
YHGENIIIPFVYTSTIGMPHDNNDK

SEQ ID NO: 1833885 - protein, 24 aa, Staphylococcus epidermidis
YHHYMDEVLFNAYPHFKKGNIHIP

SEQ ID NO: 1833886 - protein, 20 aa, Staphylococcus epidermidis
YHIFNMGIGYTIIVDKKDVQ

SEQ ID NO: 1833887 - protein, 17 aa, Staphylococcus epidermidis
YHIFQTYAPKIWDELIG

SEQ ID NO: 1833888 - protein, 18 aa, Staphylococcus epidermidis
YHKGHRHIIFINESGQYA

SEQ ID NO: 1833889 - protein, 25 aa, Staphylococcus epidermidis
YHPKMMLKVILYAYTQSVFSGRKIE

SEQ ID NO: 1833890 - protein, 18 aa, Staphylococcus epidermidis
YHPMIYKLQFRENQEIVQ

SEQ ID NO: 1833891 - protein, 19 aa, Staphylococcus epidermidis
YHTWNYHLKNKFGQKIFKV

SEQ ID NO: 1833892 - protein, 17 aa, Staphylococcus epidermidis
YIDEILITKSKTLMGIY

SEQ ID NO: 1833893 - protein, 26 aa, Staphylococcus epidermidis
YIDLIEEYGFDLIRGEASFIDDKTIQ

SEQ ID NO: 1833894 - protein, 22 aa, Staphylococcus epidermidis
YIEDFSYFMSPFKRDNNRNVLQ

SEQ ID NO: 1833895 - protein, 44 aa, Staphylococcus epidermidis
YIEEPFWTIDTLFYTIVNENLVIPKYLYYKLSQIDFNYYNEGTT

SEQ ID NO: 1833896 - protein, 24 aa, Staphylococcus epidermidis
YIENDRIKIRYLMCPCKIKHDEER

SEQ ID NO: 1833897 - protein, 17 aa, Staphylococcus epidermidis
YIEVWGKFTPRGGISID

SEQ ID NO: 1833898 - protein, 33 aa, Staphylococcus epidermidis
YIEYAGDDILLRRIYKLPIGFKWENQPNVTLIG

SEQ ID NO: 1833899 - protein, 19 aa, Staphylococcus epidermidis
YIFKHILLEVYKAQCEQKT

SEQ ID NO: 1833900 - protein, 28 aa, Staphylococcus epidermidis
YIIKYVQMKWRCPIIFYTCIRENDENYR

SEQ ID NO: 1833901 - protein, 22 aa, Staphylococcus epidermidis
YIKNDLDSIILIHACWLARVEI

SEQ ID NO: 1833902 - protein, 20 aa, Staphylococcus epidermidis
YIKNQHLFLVGRESDRIIVG

SEQ ID NO: 1833903 - protein, 23 aa, Staphylococcus epidermidis
YIKNQHLFLVGRESDRIIVGGVN

SEQ ID NO: 1833904 - protein, 20 aa, Staphylococcus epidermidis
YIMENVVNFVKKLIEEVQKL

SEQ ID NO: 1833905 - protein, 18 aa, Staphylococcus epidermidis
YINFIELIVHRIDSINYE

SEQ ID NO: 1833906 - protein, 19 aa, Staphylococcus epidermidis
YIPHWEQPDYIKTLTFNSA

SEQ ID NO: 1833907 - protein, 19 aa, Staphylococcus epidermidis
YIQELYNDYFSSVFKAMEE

SEQ ID NO: 1833908 - protein, 17 aa, Staphylococcus epidermidis
YIQFLYECRQYIKSLKI

SEQ ID NO: 1833909 - protein, 20 aa, Staphylococcus epidermidis
YISSYFIPYVSWSIKKAIKE

SEQ ID NO: 1833910 - protein, 17 aa, Staphylococcus epidermidis
YIVNSYPVWFPKGDAEE

SEQ ID NO: 1833911 - protein, 28 aa, Staphylococcus epidermidis
YKAVIDALSYYQFYILKLVVGEKRIEEA

SEQ ID NO: 1833912 - protein, 28 aa, Staphylococcus epidermidis
YKAVIDSLSYYQFYILKLVVGEQRIKKA

SEQ ID NO: 1833913 - protein, 18 aa, Staphylococcus epidermidis
YKCALQVNPYSYIKYRGL

SEQ ID NO: 1833914 - protein, 26 aa, Staphylococcus epidermidis
YKDARNYLSYLYSNNLKRTTVSRKIS

SEQ ID NO: 1833915 - protein, 26 aa, Staphylococcus epidermidis
YKDRTTVAIKKSTRALLNDLADENRT

SEQ ID NO: 1833916 - protein, 37 aa, Staphylococcus epidermidis
YKEWKLEDLPIIPKYMKTIVIGKTSKQFKIVKSLILD

SEQ ID NO: 1833917 - protein, 18 aa, Staphylococcus epidermidis
YKGIFIKCHLKNTAHSVL

SEQ ID NO: 1833918 - protein, 24 aa, Staphylococcus epidermidis
YKGKSYFFDSYTEWIKFYLSEMGI

SEQ ID NO: 1833919 - protein, 19 aa, Staphylococcus epidermidis
YKGLEMFMNFQPDTIIALG

SEQ ID NO: 1833920 - protein, 20 aa, Staphylococcus epidermidis
YKGNRPITYFLTDRPQETGK

SEQ ID NO: 1833921 - protein, 30 aa, Staphylococcus epidermidis
YKHFYDKYDLLVYLFKLLTKDYFSTDLKER

SEQ ID NO: 1833922 - protein, 18 aa, Staphylococcus epidermidis
YKHNIRYFKIFNGSKDTI

SEQ ID NO: 1833923 - protein, 18 aa, Staphylococcus epidermidis
YKIVFNGPLRIMAEYKYQ

SEQ ID NO: 1833924 - protein, 17 aa, Staphylococcus epidermidis
YKKDFVTMGEAEKFWDF

SEQ ID NO: 1833925 - protein, 17 aa, Staphylococcus epidermidis
YKLFLDAKQIKHPILNE

SEQ ID NO: 1833926 - protein, 17 aa, Staphylococcus epidermidis
YKLIDSKIIERYTIDIN

SEQ ID NO: 1833927 - protein, 24 aa, Staphylococcus epidermidis
YKLNSNDILVLRLGGEYTVKRVRR

SEQ ID NO: 1833928 - protein, 25 aa, Staphylococcus epidermidis
YKMPKKMRRLALRSALSFKVQEKGF

SEQ ID NO: 1833929 - protein, 19 aa, Staphylococcus epidermidis
YKNACFKGMFNETCPTFDE

SEQ ID NO: 1833930 - protein, 30 aa, Staphylococcus epidermidis
YKNERHLAALSFLTFVALDSDGKPTSVPDV

SEQ ID NO: 1833931 - protein, 18 aa, Staphylococcus epidermidis
YKNIALGLIFLKYISDCF

SEQ ID NO: 1833932 - protein, 29 aa, Staphylococcus epidermidis
YKNKSMFKNYWFYKFVIPIYNEPNIENVI

SEQ ID NO: 1833933 - protein, 21 aa, Staphylococcus epidermidis
YKNLMFEYSVINQTGMAKTGV

SEQ ID NO: 1833934 - protein, 25 aa, Staphylococcus epidermidis
YKNSIINKLLPLKVEYKTIKKIWTI

SEQ ID NO: 1833935 - protein, 18 aa, Staphylococcus epidermidis
YKQKLYQLGIEPKIIDHY

SEQ ID NO: 1833936 - protein, 32 aa, Staphylococcus epidermidis
YKSFIQLLRVLDYPFRYEAFEQVNFDYVRYMN

SEQ ID NO: 1833937 - protein, 25 aa, Staphylococcus epidermidis
YKSRDAMQFIKKDSPPILIIHGGKD

SEQ ID NO: 1833938 - protein, 18 aa, Staphylococcus epidermidis
YKSVLIAVDRFVTAAIEA

SEQ ID NO: 1833939 - protein, 24 aa, Staphylococcus epidermidis
YKTFDCKWGNETLTWNLKKGPKGG

SEQ ID NO: 1833940 - protein, 17 aa, Staphylococcus epidermidis
YKTIYVEDFLLSQITLI

SEQ ID NO: 1833941 - protein, 29 aa, Staphylococcus epidermidis
YKVFTSFYRKWRPYLMIRDEYDYHLEDIS

SEQ ID NO: 1833942 - protein, 29 aa, Staphylococcus epidermidis
YKVFTSFYRKWRPYLMIRDEYDYHLEDIT

SEQ ID NO: 1833943 - protein, 18 aa, Staphylococcus epidermidis
YKVLVKVHPFIYEEAKKD

SEQ ID NO: 1833944 - protein, 23 aa, Staphylococcus epidermidis
YKYKKMVRIIKEIRYQLIDSKNR

SEQ ID NO: 1833945 - protein, 20 aa, Staphylococcus epidermidis
YKYKNLIKEISPVDLTELMK

SEQ ID NO: 1833946 - protein, 31 aa, Staphylococcus epidermidis
YLADKSYPGLRFGFIHVPFIPEQTINKPDKP

SEQ ID NO: 1833947 - protein, 24 aa, Staphylococcus epidermidis
YLDGKSIDILFTYGTEAEYIFNTG

SEQ ID NO: 1833948 - protein, 26 aa, Staphylococcus epidermidis
YLDTENPFDLYPKTFTTLLIESEHLT

SEQ ID NO: 1833949 - protein, 18 aa, Staphylococcus epidermidis
YLEISTSPNLKHILNSIT

SEQ ID NO: 1833950 - protein, 34 aa, Staphylococcus epidermidis
YLHQHQCLYVKLDPYWMYQLYDKDINPLTEKNDA

SEQ ID NO: 1833951 - protein, 17 aa, Staphylococcus epidermidis
YLIEKGAKTFSLIGGEY

SEQ ID NO: 1833952 - protein, 18 aa, Staphylococcus epidermidis
YLINDSTFPLYFAKKENQ

SEQ ID NO: 1833953 - protein, 24 aa, Staphylococcus epidermidis
YLKDRNFNIEFITKLEGAHLDYEK

SEQ ID NO: 1833954 - protein, 26 aa, Staphylococcus epidermidis
YLKEHSNIPYVIDPVMLAKSGDSLMD

SEQ ID NO: 1833955 - protein, 18 aa, Staphylococcus epidermidis
YLKLRQSAETLNMSVPAF

SEQ ID NO: 1833956 - protein, 17 aa, Staphylococcus epidermidis
YLLNREDVFTYLSLNKE

SEQ ID NO: 1833957 - protein, 20 aa, Staphylococcus epidermidis
YLLTKDGFTLYMFNIQGHNE

SEQ ID NO: 1833958 - protein, 26 aa, Staphylococcus epidermidis
YLMDKDEVIFSELLRFAGIGESKLET

SEQ ID NO: 1833959 - protein, 21 aa, Staphylococcus epidermidis
YLNHIRLKFCLIDILTTHRPI

SEQ ID NO: 1833960 - protein, 25 aa, Staphylococcus epidermidis
YLNKFEIREIRIIKSVLLKGKKSFN

SEQ ID NO: 1833961 - protein, 21 aa, Staphylococcus epidermidis
YLPQHIIDQYNIPVASLSVTF

SEQ ID NO: 1833962 - protein, 19 aa, Staphylococcus epidermidis
YLQDAHDFCPYSKATRGNI

SEQ ID NO: 1833963 - protein, 25 aa, Staphylococcus epidermidis
YLQKGIVFLMIRFKTLDEVYILPYS

SEQ ID NO: 1833964 - protein, 27 aa, Staphylococcus epidermidis
YLQPDLDTWVIFPWTAGQGKVARLICD

SEQ ID NO: 1833965 - protein, 18 aa, Staphylococcus epidermidis
YLRSLAHNTDPTFQIGKG

SEQ ID NO: 1833966 - protein, 25 aa, Staphylococcus epidermidis
YLSNFEIREIRIIKSVLLKGKKSFN

SEQ ID NO: 1833967 - protein, 19 aa, Staphylococcus epidermidis
YLSTQWFVKMKPLAQRALD

SEQ ID NO: 1833968 - protein, 20 aa, Staphylococcus epidermidis
YLVFATKRGIVKRSALSNFS

SEQ ID NO: 1833969 - protein, 18 aa, Staphylococcus epidermidis
YLYFCGQLDIPLTERGIK

SEQ ID NO: 1833970 - protein, 23 aa, Staphylococcus epidermidis
YMDEELFFIVSVDTPMITSKAVN

SEQ ID NO: 1833971 - protein, 19 aa, Staphylococcus epidermidis
YMEFMAGGILRIIYAWLKE

SEQ ID NO: 1833972 - protein, 18 aa, Staphylococcus epidermidis
YMGAYRLQWEMIKFAKEH

SEQ ID NO: 1833973 - protein, 18 aa, Staphylococcus epidermidis
YMGPYAMHWHMINYCFDN

SEQ ID NO: 1833974 - protein, 18 aa, Staphylococcus epidermidis
YMLLHQKVPMHDNANKDY

SEQ ID NO: 1833975 - protein, 22 aa, Staphylococcus epidermidis
YMQKPFYTNVLIAKLQAIYRRV

SEQ ID NO: 1833976 - protein, 24 aa, Staphylococcus epidermidis
YMQRLDYPLDIISQLNFDDTYRFM

SEQ ID NO: 1833977 - protein, 19 aa, Staphylococcus epidermidis
YMSDELCHALLDYQEFYAS

SEQ ID NO: 1833978 - protein, 20 aa, Staphylococcus epidermidis
YMVSRKYHFMGYRQMKTLKS

SEQ ID NO: 1833979 - protein, 18 aa, Staphylococcus epidermidis
YNAKTKTFHLYDIVQRKA

SEQ ID NO: 1833980 - protein, 27 aa, Staphylococcus epidermidis
YNDFKYLYIVTMFNGFNTLIGFKFSSV

SEQ ID NO: 1833981 - protein, 19 aa, Staphylococcus epidermidis
YNDILVKPEIRMPKVGGRV

SEQ ID NO: 1833982 - protein, 24 aa, Staphylococcus epidermidis
YNEKHQILFPFRSNGNRTPNLYSF

SEQ ID NO: 1833983 - protein, 21 aa, Staphylococcus epidermidis
YNERQGGYTRILKVGPRRGDG

SEQ ID NO: 1833984 - protein, 23 aa, Staphylococcus epidermidis
YNGSIIFVSHDRKFIEKVATRIM

SEQ ID NO: 1833985 - protein, 21 aa, Staphylococcus epidermidis
YNIAYTLYNDLKDPEIPIRLI

SEQ ID NO: 1833986 - protein, 21 aa, Staphylococcus epidermidis
YNILHTLTVKENIMLPLSVQK

SEQ ID NO: 1833987 - protein, 19 aa, Staphylococcus epidermidis
YNKIDLTLLPLEELDNYLK

SEQ ID NO: 1833988 - protein, 20 aa, Staphylococcus epidermidis
YNKLLDERGPIDIQILGIGE

SEQ ID NO: 1833989 - protein, 18 aa, Staphylococcus epidermidis
YNKPLHPYTQALISSIPQ

SEQ ID NO: 1833990 - protein, 34 aa, Staphylococcus epidermidis
YNMAHQYHHFPSEKDFLHFRKVNQAHWEAFQQNK

SEQ ID NO: 1833991 - protein, 24 aa, Staphylococcus epidermidis
YNNIEVYGIYHGYQGLLDDDIHKL

SEQ ID NO: 1833992 - protein, 18 aa, Staphylococcus epidermidis
YNNINRTISFYHKDNVGT

SEQ ID NO: 1833993 - protein, 17 aa, Staphylococcus epidermidis
YNNMGEQRWWPAESPIE

SEQ ID NO: 1833994 - protein, 28 aa, Staphylococcus epidermidis
YNNYLFNENMFQMFKKGAVFVNCARGSL

SEQ ID NO: 1833995 - protein, 18 aa, Staphylococcus epidermidis
YNPLIQQLLDEDKAYKCY

SEQ ID NO: 1833996 - protein, 17 aa, Staphylococcus epidermidis
YNQAIQKAKDLINKQPP

SEQ ID NO: 1833997 - protein, 26 aa, Staphylococcus epidermidis
YNQQEIPIYLEDLIIIFTDGVTEARD

SEQ ID NO: 1833998 - protein, 30 aa, Staphylococcus epidermidis
YNSNVLYINMKYLSTWQGWSLVNPDYSKTL

SEQ ID NO: 1833999 - protein, 26 aa, Staphylococcus epidermidis
YNTINAPMVGTFYKSPSPDEEAYVQV

SEQ ID NO: 1834000 - protein, 19 aa, Staphylococcus epidermidis
YNTLPITHMIYLHSAAKIT

SEQ ID NO: 1834001 - protein, 17 aa, Staphylococcus epidermidis
YNTLVEEGYFITSGIIE

SEQ ID NO: 1834002 - protein, 24 aa, Staphylococcus epidermidis
YNVNEIYLIAHAFLESGYGRSNFA

SEQ ID NO: 1834003 - protein, 17 aa, Staphylococcus epidermidis
YNVQFIFNLDEKSIREI

SEQ ID NO: 1834004 - protein, 18 aa, Staphylococcus epidermidis
YNVYPSLDNERIAFDLRS

SEQ ID NO: 1834005 - protein, 26 aa, Staphylococcus epidermidis
YNYEDKPSIYPKFILGFGGIKQDELE

SEQ ID NO: 1834006 - protein, 26 aa, Staphylococcus epidermidis
YPFKELPLYEIGWRLIPEVWGNGIAT

SEQ ID NO: 1834007 - protein, 17 aa, Staphylococcus epidermidis
YPHLDGVLSLDLTTVLI

SEQ ID NO: 1834008 - protein, 33 aa, Staphylococcus epidermidis
YPHMLSGGMLQRLMIALALALKPKLIIADEPTT

SEQ ID NO: 1834009 - protein, 18 aa, Staphylococcus epidermidis
YPHQYWLAKLKSKESQQA

SEQ ID NO: 1834010 - protein, 20 aa, Staphylococcus epidermidis
YPIEAVFGIHVNPFAEEGKV

SEQ ID NO: 1834011 - protein, 17 aa, Staphylococcus epidermidis
YPILVLPTLATEIGLNE

SEQ ID NO: 1834012 - protein, 29 aa, Staphylococcus epidermidis
YPLLLKEIYHFPYVIFYKGTKQLFNQPHT

SEQ ID NO: 1834013 - protein, 20 aa, Staphylococcus epidermidis
YPNYRYVWSLKNPDKSVIPG

SEQ ID NO: 1834014 - protein, 20 aa, Staphylococcus epidermidis
YPQFNICKKIYLNLETPPII

SEQ ID NO: 1834015 - protein, 17 aa, Staphylococcus epidermidis
YPQPAPADHPWRTMPRN

SEQ ID NO: 1834016 - protein, 24 aa, Staphylococcus epidermidis
YPRRDKIELLADYFGVMPSDITED

SEQ ID NO: 1834017 - protein, 18 aa, Staphylococcus epidermidis
YPYIDLIEFFGTSEASFI

SEQ ID NO: 1834018 - protein, 19 aa, Staphylococcus epidermidis
YPYRYLKRDFGVLGVDMHL

SEQ ID NO: 1834019 - protein, 29 aa, Staphylococcus epidermidis
YQAELKRTYPGRFKCLALLPMPHVKETIK

SEQ ID NO: 1834020 - protein, 22 aa, Staphylococcus epidermidis
YQAIILGTRGLNSFQKMVLGSV

SEQ ID NO: 1834021 - protein, 25 aa, Staphylococcus epidermidis
YQASQNLLYPLYKKGKFLSIQMYNA

SEQ ID NO: 1834022 - protein, 28 aa, Staphylococcus epidermidis
YQAVLNQLNLIWHSPNLYLSSIQEEVAQ

SEQ ID NO: 1834023 - protein, 24 aa, Staphylococcus epidermidis
YQDILIKMYLALQNFDFSRSIPFK

SEQ ID NO: 1834024 - protein, 25 aa, Staphylococcus epidermidis
YQDKIFIYGHSFGALLAFYVTYQLE

SEQ ID NO: 1834025 - protein, 23 aa, Staphylococcus epidermidis
YQFNNWNIDYVSCSPFRVPGAIL

SEQ ID NO: 1834026 - protein, 31 aa, Staphylococcus epidermidis
YQGKSYFFASKREFIKFYLQEIHIDLDQVIF

SEQ ID NO: 1834027 - protein, 17 aa, Staphylococcus epidermidis
YQLKPQHLAQSSLGHVL

SEQ ID NO: 1834028 - protein, 23 aa, Staphylococcus epidermidis
YQLNNQLLLQIKLELDSLVTLHE

SEQ ID NO: 1834029 - protein, 18 aa, Staphylococcus epidermidis
YQLSKTEYRGREATDFKE

SEQ ID NO: 1834030 - protein, 26 aa, Staphylococcus epidermidis
YQNKRPDYISAFWNVVNWEKVDELYK

SEQ ID NO: 1834031 - protein, 18 aa, Staphylococcus epidermidis
YQNYIDSGAKIVEFGGWA

SEQ ID NO: 1834032 - protein, 24 aa, Staphylococcus epidermidis
YQQKGLKVFGLTASPNYIANIRRN

SEQ ID NO: 1834033 - protein, 26 aa, Staphylococcus epidermidis
YQSIQFAATLPDYIQIWPGHGAGSPC

SEQ ID NO: 1834034 - protein, 25 aa, Staphylococcus epidermidis
YQVNRKMFNLTGKVNTIFLHCLPAF

SEQ ID NO: 1834035 - protein, 25 aa, Staphylococcus epidermidis
YRASQNLLYPLYKKGKFVSIQLYNA

SEQ ID NO: 1834036 - protein, 30 aa, Staphylococcus epidermidis
YRDDALKKSLFHYLLLNMRYNRLDVAETLI

SEQ ID NO: 1834037 - protein, 18 aa, Staphylococcus epidermidis
YRDRTMLELLYATGMRVS

SEQ ID NO: 1834038 - protein, 26 aa, Staphylococcus epidermidis
YREMAKEGVFLPPSQFEGTFLSMAHT

SEQ ID NO: 1834039 - protein, 27 aa, Staphylococcus epidermidis
YRGKGYASILLGQALNYLKSLNVETVL

SEQ ID NO: 1834040 - protein, 27 aa, Staphylococcus epidermidis
YRHNELYNLYYIPTSEILNLVYTIEKN

SEQ ID NO: 1834041 - protein, 19 aa, Staphylococcus epidermidis
YRIQPKLISDLYQPQTSIS

SEQ ID NO: 1834042 - protein, 20 aa, Staphylococcus epidermidis
YRITILFWFYKLFFNASQNK

SEQ ID NO: 1834043 - protein, 18 aa, Staphylococcus epidermidis
YRKALRLMKQAEKFNRPI

SEQ ID NO: 1834044 - protein, 19 aa, Staphylococcus epidermidis
YRKFDILMCNSKLYHQEGK

SEQ ID NO: 1834045 - protein, 21 aa, Staphylococcus epidermidis
YRMKHRTLPLFITYDKHENIS

SEQ ID NO: 1834046 - protein, 31 aa, Staphylococcus epidermidis
YRRFDDKYDLLKLLIQKLIFRVREKHSTTLN

SEQ ID NO: 1834047 - protein, 25 aa, Staphylococcus epidermidis
YRRKIKRELYDTRGFLSCVRVLSTD

SEQ ID NO: 1834048 - protein, 20 aa, Staphylococcus epidermidis
YRRQVIYGKIKRDIGVILRQ

SEQ ID NO: 1834049 - protein, 17 aa, Staphylococcus epidermidis
YRVIEKRDDTQNGKIYL

SEQ ID NO: 1834050 - protein, 17 aa, Staphylococcus epidermidis
YSDFYLSPNDYLQTLYE

SEQ ID NO: 1834051 - protein, 17 aa, Staphylococcus epidermidis
YSDYFEGAQKYLSYLKS

SEQ ID NO: 1834052 - protein, 28 aa, Staphylococcus epidermidis
YSEETLLELLDYAYSFGFEFQSFMAASK

SEQ ID NO: 1834053 - protein, 17 aa, Staphylococcus epidermidis
YSEPHGYIGLAHAGWRG

SEQ ID NO: 1834054 - protein, 25 aa, Staphylococcus epidermidis
YSEWMANRDLSKQRRYWLQQFEDDV

SEQ ID NO: 1834055 - protein, 24 aa, Staphylococcus epidermidis
YSGDFFERTFLFEPDSDLAKVGNY

SEQ ID NO: 1834056 - protein, 23 aa, Staphylococcus epidermidis
YSGFAFGMGPDRIAMLKYGIEDI

SEQ ID NO: 1834057 - protein, 24 aa, Staphylococcus epidermidis
YSGSEIYTTLKAYPGKVNVKVVGV

SEQ ID NO: 1834058 - protein, 17 aa, Staphylococcus epidermidis
YSGVPTLTNIPASYWTT

SEQ ID NO: 1834059 - protein, 18 aa, Staphylococcus epidermidis
YSILRSFINKELAIHGFE

SEQ ID NO: 1834060 - protein, 17 aa, Staphylococcus epidermidis
YSKAVIELAPLGASIKA

SEQ ID NO: 1834061 - protein, 45 aa, Staphylococcus epidermidis
YSKHVFNQIKDLPMVMVMLYASLGSVLLREFGLQPFIVEISGSTS

SEQ ID NO: 1834062 - protein, 22 aa, Staphylococcus epidermidis
YSKNMFRLLKQYKHTGYFKIQI

SEQ ID NO: 1834063 - protein, 17 aa, Staphylococcus epidermidis
YSLEKFNYILRLSKYEN

SEQ ID NO: 1834064 - protein, 31 aa, Staphylococcus epidermidis
YSLQAGGKRIRPVLLLLTLNMLKGDYDKGVQ

SEQ ID NO: 1834065 - protein, 19 aa, Staphylococcus epidermidis
YSPVQFIKSTEWLIEQGVD

SEQ ID NO: 1834066 - protein, 21 aa, Staphylococcus epidermidis
YSQEHQIILDFYKNKNITDVL

SEQ ID NO: 1834067 - protein, 24 aa, Staphylococcus epidermidis
YSSIFFDYLVTNKPIIFYTPDYDD

SEQ ID NO: 1834068 - protein, 24 aa, Staphylococcus epidermidis
YSSLPIEASLLNKPTLFYNYDEED

SEQ ID NO: 1834069 - protein, 23 aa, Staphylococcus epidermidis
YSSNIAMVLTKIAKRNPREIAQA

SEQ ID NO: 1834070 - protein, 17 aa, Staphylococcus epidermidis
YSSTIFDYIHLNKPVFI

SEQ ID NO: 1834071 - protein, 31 aa, Staphylococcus epidermidis
YSSVFFDYANLKRPILFYTYDLDKYKDELRG

SEQ ID NO: 1834072 - protein, 21 aa, Staphylococcus epidermidis
YSWKPLTDQVIVSSLKQAKNA

SEQ ID NO: 1834073 - protein, 31 aa, Staphylococcus epidermidis
YSYALHVRQFIRLSRYFVDTLRKSNNGRIIV

SEQ ID NO: 1834074 - protein, 24 aa, Staphylococcus epidermidis
YSYELYNFFDVDTIIRVGSCGALQ

SEQ ID NO: 1834075 - protein, 18 aa, Staphylococcus epidermidis
YSYPELIERERINEQIFI

SEQ ID NO: 1834076 - protein, 29 aa, Staphylococcus epidermidis
YTAKKLNLKAVIFMPVTTPLQKINQVQFF

SEQ ID NO: 1834077 - protein, 21 aa, Staphylococcus epidermidis
YTELYQTLPFDFLSEIVYQWE

SEQ ID NO: 1834078 - protein, 28 aa, Staphylococcus epidermidis
YTEQEQYIKYKLYFKKKIFGEIKDIPTS

SEQ ID NO: 1834079 - protein, 29 aa, Staphylococcus epidermidis
YTFEERPTPKLWLCKPDGTRIERIADFSK

SEQ ID NO: 1834080 - protein, 19 aa, Staphylococcus epidermidis
YTGMRAGELLALKWSDIDF

SEQ ID NO: 1834081 - protein, 34 aa, Staphylococcus epidermidis
YTGYFDGENMIFETFSFYGACLLGDDVTPAMKNS

SEQ ID NO: 1834082 - protein, 27 aa, Staphylococcus epidermidis
YTHDNPLIRTIPVGSLNKLIHPEKKRQ

SEQ ID NO: 1834083 - protein, 26 aa, Staphylococcus epidermidis
YTHIQRILMTILLNIKSQDVHKDIHA

SEQ ID NO: 1834084 - protein, 23 aa, Staphylococcus epidermidis
YTQTYIQRVLMNVLLNITKDDVN

SEQ ID NO: 1834085 - protein, 18 aa, Staphylococcus epidermidis
YTRILKVGPRRGDGAESV

SEQ ID NO: 1834086 - protein, 17 aa, Staphylococcus epidermidis
YTRSKLRKALPEQYVYI

SEQ ID NO: 1834087 - protein, 24 aa, Staphylococcus epidermidis
YTTELTPHFSFSEKIILISNKEVH

SEQ ID NO: 1834088 - protein, 19 aa, Staphylococcus epidermidis
YTVIQAIGLIQWYEEQKRY

SEQ ID NO: 1834089 - protein, 26 aa, Staphylococcus epidermidis
YTVKSVYRWYLQGLGYKKISQHLDSN

SEQ ID NO: 1834090 - protein, 17 aa, Staphylococcus epidermidis
YTVLRELGLSDESIEKG

SEQ ID NO: 1834091 - protein, 20 aa, Staphylococcus epidermidis
YTYFFNGVKHILKAKNNELN

SEQ ID NO: 1834092 - protein, 17 aa, Staphylococcus epidermidis
YVEDFLLSQITLIEGLD

SEQ ID NO: 1834093 - protein, 19 aa, Staphylococcus epidermidis
YVEELRPFIGLDEPVYNYV

SEQ ID NO: 1834094 - protein, 18 aa, Staphylococcus epidermidis
YVFILKHSETCPISANAY

SEQ ID NO: 1834095 - protein, 17 aa, Staphylococcus epidermidis
YVFINSYDPRLFEGFSM

SEQ ID NO: 1834096 - protein, 27 aa, Staphylococcus epidermidis
YVFKPKSLFVLYDILSNNSVYLHFFKN

SEQ ID NO: 1834097 - protein, 28 aa, Staphylococcus epidermidis
YVFKPKSLFVLYDILSNNSVYLHFFKNG

SEQ ID NO: 1834098 - protein, 18 aa, Staphylococcus epidermidis
YVFNLQNKKLFNLQSFIN

SEQ ID NO: 1834099 - protein, 20 aa, Staphylococcus epidermidis
YVGQLLEDVGFKAGISKENE

SEQ ID NO: 1834100 - protein, 23 aa, Staphylococcus epidermidis
YVHPALFMNDFSLHAIFEGTSVP

SEQ ID NO: 1834101 - protein, 19 aa, Staphylococcus epidermidis
YVIREDDVDAFYYVMLLPE

SEQ ID NO: 1834102 - protein, 20 aa, Staphylococcus epidermidis
YVKSIVFPTVPRGTGRVRNM

SEQ ID NO: 1834103 - protein, 18 aa, Staphylococcus epidermidis
YVLNAEPSNLFETKIRHA

SEQ ID NO: 1834104 - protein, 18 aa, Staphylococcus epidermidis
YVLNQPLYHLVEKVKPRL

SEQ ID NO: 1834105 - protein, 19 aa, Staphylococcus epidermidis
YVLPILGIHNMKNAAIAIA

SEQ ID NO: 1834106 - protein, 18 aa, Staphylococcus epidermidis
YVNELYDDKLKMIQRNNN

SEQ ID NO: 1834107 - protein, 18 aa, Staphylococcus epidermidis
YVNQLYNDKLKMIQRDNN

SEQ ID NO: 1834108 - protein, 17 aa, Staphylococcus epidermidis
YVPVIKHADEKSIKGIA

SEQ ID NO: 1834109 - protein, 18 aa, Staphylococcus epidermidis
YVSDMLVFKGKFKMYYTS

SEQ ID NO: 1834110 - protein, 23 aa, Staphylococcus epidermidis
YVSSLDNWRIISHANLSIVNFRY

SEQ ID NO: 1834111 - protein, 18 aa, Staphylococcus epidermidis
YVTVLLREVGLKSDCLYC

SEQ ID NO: 1834112 - protein, 28 aa, Staphylococcus epidermidis
YVVDNGYLFVFVLDYYRHSLVNENAESD

SEQ ID NO: 1834113 - protein, 23 aa, Staphylococcus epidermidis
YVVSTLILIFNSDLVRHLEFILT

SEQ ID NO: 1834114 - protein, 17 aa, Staphylococcus epidermidis
YVWSLKNPDKSVIPGNA

SEQ ID NO: 1834115 - protein, 36 aa, Staphylococcus epidermidis
YWAELKEVFQLLKVEMPIVLPRLRISYMYERTEKLL

SEQ ID NO: 1834116 - protein, 18 aa, Staphylococcus epidermidis
YWNKLRFLQEASNKSELM

SEQ ID NO: 1834117 - protein, 18 aa, Staphylococcus epidermidis
YYAFVVFNMMFGGDPSSV

SEQ ID NO: 1834118 - protein, 22 aa, Staphylococcus epidermidis
YYDEEIQLILNFYRNKTIQDVL

SEQ ID NO: 1834119 - protein, 17 aa, Staphylococcus epidermidis
YYEDYGIRKYGFHGTSH

SEQ ID NO: 1834120 - protein, 20 aa, Staphylococcus epidermidis
YYEFKYHSTVLYGCRCISLD

SEQ ID NO: 1834121 - protein, 25 aa, Staphylococcus epidermidis
YYIAGHVFRIVSCLNQVLFACNNAY

SEQ ID NO: 1834122 - protein, 19 aa, Staphylococcus epidermidis
YYIKPAMEKLISGIKAHHD

SEQ ID NO: 1834123 - protein, 18 aa, Staphylococcus epidermidis
YYKVQTFIPKNYVEDFKD

SEQ ID NO: 1834124 - protein, 17 aa, Staphylococcus epidermidis
YYLPKPLIKIDSKEEDN

SEQ ID NO: 1834125 - protein, 20 aa, Staphylococcus epidermidis
YYLREYVGRETPLTYAKSYS

SEQ ID NO: 1834126 - protein, 20 aa, Staphylococcus epidermidis
YYLTCREIVNIMWKDDECGG

SEQ ID NO: 1834127 - protein, 20 aa, Staphylococcus epidermidis
YYNHVHVYDVNWGEAVVVDD

SEQ ID NO: 1834128 - protein, 22 aa, Staphylococcus epidermidis
YYPETQLFHCYTGCGSFDVFTL

SEQ ID NO: 1834129 - protein, 17 aa, Staphylococcus epidermidis
YYREGFITQLMPNKDKN

SEQ ID NO: 1834130 - protein, 18 aa, Staphylococcus epidermidis
YYTPLEFGKMRKVAMDKG

SEQ ID NO: 1834131 - protein, 17 aa, Staphylococcus epidermidis
YYVVLASGRPTEGMLPT

SEQ ID NO: 1834132 - protein, 20 aa, Staphylococcus epidermidis
YYVYSYISSYFIPYVSWSIK

SEQ ID NO: 1834133 - protein, 20 aa, Staphylococcus epidermidis
YYYEYKKFGVLPEKEYAINK

SEQ ID NO: 1834134 - protein, 22 aa, Staphylococcus epidermidis
YYYKVQTFIPKNYIEDFKDSLN

SEQ ID NO: 1834135 - protein, 20 aa, Staphylococcus epidermidis
QVETWWRWYRNEESYRFSQH

SEQ ID NO: 1834136 - protein, 24 aa, Staphylococcus epidermidis
AEQFRQLFILPQGEFKKFLQSNSK

SEQ ID NO: 1834137 - protein, 24 aa, Staphylococcus epidermidis
DGTKLGFMSFFTKAAVAALKKYPE

SEQ ID NO: 1834138 - protein, 18 aa, Staphylococcus epidermidis
DRRKAMLEDLAILTGAQV

SEQ ID NO: 1834139 - protein, 19 aa, Staphylococcus epidermidis
DVLDTWFSSALWPFSTLGW

SEQ ID NO: 1834140 - protein, 19 aa, Staphylococcus epidermidis
EFLDKLIAVSLPRVRDFQG

SEQ ID NO: 1834141 - protein, 26 aa, Staphylococcus epidermidis
EYYKWTQWIFIQLYNKGLAYVDEVAV

SEQ ID NO: 1834142 - protein, 18 aa, Staphylococcus epidermidis
FGIKENVDFIAASFVRRP

SEQ ID NO: 1834143 - protein, 28 aa, Staphylococcus epidermidis
GAHIQVLLLTFFFKYMKPLVQAGRVFIA

SEQ ID NO: 1834144 - protein, 29 aa, Staphylococcus epidermidis
GAHIRTLLLTFFYRFMRPLIEAGYVYIAQ

SEQ ID NO: 1834145 - protein, 25 aa, Staphylococcus epidermidis
GEQKRLYLLRLLVHKPNVLLLDEPT

SEQ ID NO: 1834146 - protein, 21 aa, Staphylococcus epidermidis
GITFAGIPLGHEFNSLVLAIL

SEQ ID NO: 1834147 - protein, 22 aa, Staphylococcus epidermidis
GPQDSYLLIRGIKTLGLRMEQI

SEQ ID NO: 1834148 - protein, 20 aa, Staphylococcus epidermidis
GQLPLFRRLPKRGFTNINRK

SEQ ID NO: 1834149 - protein, 17 aa, Staphylococcus epidermidis
GYVVYFFELACAMSGYQ

SEQ ID NO: 1834150 - protein, 18 aa, Staphylococcus epidermidis
HNRLSLLMAVLEKKENYL

SEQ ID NO: 1834151 - protein, 17 aa, Staphylococcus epidermidis
HYLKVRPGAFFLTGCGN

SEQ ID NO: 1834152 - protein, 25 aa, Staphylococcus epidermidis
IQTKSYDWFLKEGLLEMFRDISPIE

SEQ ID NO: 1834153 - protein, 24 aa, Staphylococcus epidermidis
KGSTYYGIALALLRISKALLNNEN

SEQ ID NO: 1834154 - protein, 24 aa, Staphylococcus epidermidis
KLTFLPYVVKALVSALKKYPALNT

SEQ ID NO: 1834155 - protein, 18 aa, Staphylococcus epidermidis
KVHHPLYYYAAYFTIRAS

SEQ ID NO: 1834156 - protein, 24 aa, Staphylococcus epidermidis
LDATLYMRIAIELHLKRLIVGGLE

SEQ ID NO: 1834157 - protein, 20 aa, Staphylococcus epidermidis
LHIGHLLPFLTLRRFQEHGH

SEQ ID NO: 1834158 - protein, 24 aa, Staphylococcus epidermidis
LIDESKLNFLWVTDWPLLEYDEDA

SEQ ID NO: 1834159 - protein, 18 aa, Staphylococcus epidermidis
LKALKLFYKMPMPQWGGD

SEQ ID NO: 1834160 - protein, 24 aa, Staphylococcus epidermidis
MDDKYPFYLDPMPNLYFTRDPQAS

SEQ ID NO: 1834161 - protein, 17 aa, Staphylococcus epidermidis
NFRVTKIFGYFGLKREE

SEQ ID NO: 1834162 - protein, 20 aa, Staphylococcus epidermidis
NLMFHFLPIAVRYDGQKAPV

SEQ ID NO: 1834163 - protein, 24 aa, Staphylococcus epidermidis
NNFCTFCIIPWARGLMRSRDPEKV

SEQ ID NO: 1834164 - protein, 24 aa, Staphylococcus epidermidis
NRKGYFLYGYRHFSSRIKGGHTNN

SEQ ID NO: 1834165 - protein, 17 aa, Staphylococcus epidermidis
PGFGDRRKAMLEDLAIL

SEQ ID NO: 1834166 - protein, 19 aa, Staphylococcus epidermidis
PRRVGWFDSVVLRHSRRVS

SEQ ID NO: 1834167 - protein, 17 aa, Staphylococcus epidermidis
RDYLPFESLILDLNQPF

SEQ ID NO: 1834168 - protein, 24 aa, Staphylococcus epidermidis
RFHSIIWPILLMALDLPLPKKVFA

SEQ ID NO: 1834169 - protein, 18 aa, Staphylococcus epidermidis
RKAIPNVLFQMLLRASNA

SEQ ID NO: 1834170 - protein, 21 aa, Staphylococcus epidermidis
RQRVWIAMALAQRTDIIFLDE

SEQ ID NO: 1834171 - protein, 22 aa, Staphylococcus epidermidis
RSDLEILLYDRGPRILRNFPEK

SEQ ID NO: 1834172 - protein, 21 aa, Staphylococcus epidermidis
RSDYFWDLFIQMPAALMFPSG

SEQ ID NO: 1834173 - protein, 20 aa, Staphylococcus epidermidis
SFIANKLRLLKLAPNVIKRL

SEQ ID NO: 1834174 - protein, 28 aa, Staphylococcus epidermidis
SVFLETFLFYSGFYYPLYLAGQGKMTTS

SEQ ID NO: 1834175 - protein, 25 aa, Staphylococcus epidermidis
TTLGNSLRRILLSSLPGAAVKYIEI

SEQ ID NO: 1834176 - protein, 19 aa, Staphylococcus epidermidis
VATELLWFIKGDTNIQYLL

SEQ ID NO: 1834177 - protein, 20 aa, Staphylococcus epidermidis
VDMLRMCRYPWKTKQRILSD

SEQ ID NO: 1834178 - protein, 29 aa, Staphylococcus epidermidis
VVTQITPWNYPLLQASWKIAPALATGCSL

SEQ ID NO: 1834179 - protein, 23 aa, Staphylococcus epidermidis
YEDRSFTFITKTPPAPVLLKKAA

SEQ ID NO: 1834180 - protein, 24 aa, Staphylococcus epidermidis
YTKLHNFHWYVKGPNFFSLHTKFE

SEQ ID NO: 1834181 - protein, 17 aa, Staphylococcus epidermidis
AAAFISHFSGDIPHIHF

SEQ ID NO: 1834182 - protein, 27 aa, Staphylococcus epidermidis
AEKDLVETVLPYRPLFIKPNKDELEVM

SEQ ID NO: 1834183 - protein, 25 aa, Staphylococcus epidermidis
AENNITFVPYFPLASGILAGKYDEN

SEQ ID NO: 1834184 - protein, 21 aa, Staphylococcus epidermidis
AFTELFMFELRMQWLNRLEKT

SEQ ID NO: 1834185 - protein, 23 aa, Staphylococcus epidermidis
AGETIYFILRETPFYAVSGGQVA

SEQ ID NO: 1834186 - protein, 24 aa, Staphylococcus epidermidis
AGTNYPYVNYLPKKNIKAIQIDTN

SEQ ID NO: 1834187 - protein, 23 aa, Staphylococcus epidermidis
AIQYPPIPSVLYSLPRLSQIGVT

SEQ ID NO: 1834188 - protein, 24 aa, Staphylococcus epidermidis
ALGGNRLFYLAMAPQFFGVISDYL

SEQ ID NO: 1834189 - protein, 19 aa, Staphylococcus epidermidis
AMIQYLLPKATVVTPNLFE

SEQ ID NO: 1834190 - protein, 22 aa, Staphylococcus epidermidis
AVKYFYPYLKNVKVKKVAVIGD

SEQ ID NO: 1834191 - protein, 23 aa, Staphylococcus epidermidis
AVLHLLYARFWHKVLYDLGVVPT

SEQ ID NO: 1834192 - protein, 22 aa, Staphylococcus epidermidis
DENTWMLFGTLPIYPCLNDEYD

SEQ ID NO: 1834193 - protein, 22 aa, Staphylococcus epidermidis
DFANIFFMIMNYYSIERSMEIA

SEQ ID NO: 1834194 - protein, 17 aa, Staphylococcus epidermidis
DFRKLWITRINAAARQH

SEQ ID NO: 1834195 - protein, 23 aa, Staphylococcus epidermidis
DGNEYIDYVLSWGPLILGHKNQQ

SEQ ID NO: 1834196 - protein, 18 aa, Staphylococcus epidermidis
DHTKVVAPFIRLAGTMEG

SEQ ID NO: 1834197 - protein, 20 aa, Staphylococcus epidermidis
DIKAQLLDWILPYYKNLSRE

SEQ ID NO: 1834198 - protein, 20 aa, Staphylococcus epidermidis
DKLVKLLVPSLKKKAAQGNN

SEQ ID NO: 1834199 - protein, 24 aa, Staphylococcus epidermidis
DLCGNAYLFRFPPKAFKHAAHFPG

SEQ ID NO: 1834200 - protein, 23 aa, Staphylococcus epidermidis
DMYQVLLVLPLWHEGDKFPFKLL

SEQ ID NO: 1834201 - protein, 22 aa, Staphylococcus epidermidis
DVGSHYIWMARKYRSYNPRHLL

SEQ ID NO: 1834202 - protein, 21 aa, Staphylococcus epidermidis
EAQWEAMLLGWKVVSAVKSNA

SEQ ID NO: 1834203 - protein, 18 aa, Staphylococcus epidermidis
EERLFRKYAHKIRNWEDD

SEQ ID NO: 1834204 - protein, 25 aa, Staphylococcus epidermidis
EFRTMPMVWYCPPLSPIMSYFEGEN

SEQ ID NO: 1834205 - protein, 17 aa, Staphylococcus epidermidis
EGDTIPIYLKRNPNFKF

SEQ ID NO: 1834206 - protein, 20 aa, Staphylococcus epidermidis
EIIDHFIMKLRIVKFARTPE

SEQ ID NO: 1834207 - protein, 24 aa, Staphylococcus epidermidis
EIKSPMVGTFFLQDSKELTEPKIK

SEQ ID NO: 1834208 - protein, 24 aa, Staphylococcus epidermidis
EILESLRPLLLRYSKERLDGEHFG

SEQ ID NO: 1834209 - protein, 20 aa, Staphylococcus epidermidis
EIRLRPSYFPFTEPSVEVDV

SEQ ID NO: 1834210 - protein, 30 aa, Staphylococcus epidermidis
ELAAPVSHIWYFKGIPSRMGLLLDMSPRAL

SEQ ID NO: 1834211 - protein, 17 aa, Staphylococcus epidermidis
ELGIPEHLVWRQPFPGP

SEQ ID NO: 1834212 - protein, 20 aa, Staphylococcus epidermidis
EPMVLPARFPNLLINGSTGI

SEQ ID NO: 1834213 - protein, 22 aa, Staphylococcus epidermidis
EPQWMLDFRLKALKLFYKMPMP

SEQ ID NO: 1834214 - protein, 24 aa, Staphylococcus epidermidis
ERPTLKFELFYFDIFRYGTSFVTL

SEQ ID NO: 1834215 - protein, 24 aa, Staphylococcus epidermidis
ESTKQYYFHLFSKKQPDLNWENPD

SEQ ID NO: 1834216 - protein, 19 aa, Staphylococcus epidermidis
EWLSNFKLFKVPKTLITRN

SEQ ID NO: 1834217 - protein, 27 aa, Staphylococcus epidermidis
EYKFFKEELILFTYLHLANEQKLTQAL

SEQ ID NO: 1834218 - protein, 23 aa, Staphylococcus epidermidis
FDRLVNPFILQYASSQTKVINVG

SEQ ID NO: 1834219 - protein, 18 aa, Staphylococcus epidermidis
FEEMKHYFILNFPQRPGA

SEQ ID NO: 1834220 - protein, 17 aa, Staphylococcus epidermidis
FIMKLRIVKFARTPEYN

SEQ ID NO: 1834221 - protein, 21 aa, Staphylococcus epidermidis
FPARIKCATLAWKALEKGTVE

SEQ ID NO: 1834222 - protein, 18 aa, Staphylococcus epidermidis
FTNYRPQFYFRTTDVTGV

SEQ ID NO: 1834223 - protein, 19 aa, Staphylococcus epidermidis
FVYGLFIYNKWRGMGTLNS

SEQ ID NO: 1834224 - protein, 20 aa, Staphylococcus epidermidis
GAKMRYMFGGKAKIPLVVRT

SEQ ID NO: 1834225 - protein, 28 aa, Staphylococcus epidermidis
GAVVAWNFPILLASWKLGPALAAGNTVV

SEQ ID NO: 1834226 - protein, 24 aa, Staphylococcus epidermidis
GFKLYDVFTILYLLDPEAFNVKEA

SEQ ID NO: 1834227 - protein, 19 aa, Staphylococcus epidermidis
GLVHTLWKPMPGRFKDYIA

SEQ ID NO: 1834228 - protein, 24 aa, Staphylococcus epidermidis
GVNAGLFLLKFLASLNLNKSAKDF

SEQ ID NO: 1834229 - protein, 18 aa, Staphylococcus epidermidis
HFDLRPAGIIKMLDLKQP

SEQ ID NO: 1834230 - protein, 21 aa, Staphylococcus epidermidis
HKYLPLLHRYTKLRQELLGLD

SEQ ID NO: 1834231 - protein, 25 aa, Staphylococcus epidermidis
IDEQGYIYFTPIGGWWNQVMLSQKV

SEQ ID NO: 1834232 - protein, 22 aa, Staphylococcus epidermidis
IGPSPVWMQFRLIKAGIRPINN

SEQ ID NO: 1834233 - protein, 26 aa, Staphylococcus epidermidis
IKDKKALFIVYANPLSLGLLTPPGTF

SEQ ID NO: 1834234 - protein, 20 aa, Staphylococcus epidermidis
IKFLKYFTFLEKEEINRLEQ

SEQ ID NO: 1834235 - protein, 24 aa, Staphylococcus epidermidis
IKVQDVMFLLLYALKDLGANLNMD

SEQ ID NO: 1834236 - protein, 18 aa, Staphylococcus epidermidis
ITINQLMKYIKGPDFPTG

SEQ ID NO: 1834237 - protein, 20 aa, Staphylococcus epidermidis
ITTPLNIFYFTGYRSEPHER

SEQ ID NO: 1834238 - protein, 17 aa, Staphylococcus epidermidis
IVRLLDPPLHEFLPSSE

SEQ ID NO: 1834239 - protein, 18 aa, Staphylococcus epidermidis
KAIKPWILPNFESLVNHE

SEQ ID NO: 1834240 - protein, 24 aa, Staphylococcus epidermidis
KDARNYLAFLYSNQLKRTTVSRKI

SEQ ID NO: 1834241 - protein, 23 aa, Staphylococcus epidermidis
KEHQLLYILIMHAFANTYVSKRQ

SEQ ID NO: 1834242 - protein, 22 aa, Staphylococcus epidermidis
KGRYLFIPVHKLADIRWKELGQ

SEQ ID NO: 1834243 - protein, 25 aa, Staphylococcus epidermidis
KNGFGYDPIFFVPELNKTMAEITND

SEQ ID NO: 1834244 - protein, 18 aa, Staphylococcus epidermidis
KRGHDIFLDLKLHDIPNT

SEQ ID NO: 1834245 - protein, 19 aa, Staphylococcus epidermidis
KRPLVCFFSNDLNIHRTKT

SEQ ID NO: 1834246 - protein, 23 aa, Staphylococcus epidermidis
KTDERLWLLNRAGKIPFVVSGQG

SEQ ID NO: 1834247 - protein, 33 aa, Staphylococcus epidermidis
KTKIKSWVRQLLWMSLYQYLYLDKIPNHAIIHE

SEQ ID NO: 1834248 - protein, 22 aa, Staphylococcus epidermidis
KTTDLLIRLYEKVLNKLNYESK

SEQ ID NO: 1834249 - protein, 23 aa, Staphylococcus epidermidis
KVKGLYLYGPFGTGKSFILGAIA

SEQ ID NO: 1834250 - protein, 23 aa, Staphylococcus epidermidis
LHDLAFLLLVYPLSEYEGALDSA

SEQ ID NO: 1834251 - protein, 20 aa, Staphylococcus epidermidis
LIQPTFIYGHPIEISPLAKK

SEQ ID NO: 1834252 - protein, 18 aa, Staphylococcus epidermidis
LLFLYLEHAFLSQNFFNI

SEQ ID NO: 1834253 - protein, 25 aa, Staphylococcus epidermidis
LPNKEFQLLFLLASNPKHIFTRDDI

SEQ ID NO: 1834254 - protein, 19 aa, Staphylococcus epidermidis
LVNFYYPKLTFKSSILQLI

SEQ ID NO: 1834255 - protein, 18 aa, Staphylococcus epidermidis
MEEELKILLIPKDPNDDK

SEQ ID NO: 1834256 - protein, 18 aa, Staphylococcus epidermidis
MIPKFNLFIALGIRDAIQ

SEQ ID NO: 1834257 - protein, 19 aa, Staphylococcus epidermidis
MLRLIQPKYFLPIHGEYRM

SEQ ID NO: 1834258 - protein, 25 aa, Staphylococcus epidermidis
MRASILVMGPLLARLGHAIVALPGG

SEQ ID NO: 1834259 - protein, 25 aa, Staphylococcus epidermidis
MSMVDTWLFHQFLSAVPLEAQIVFV

SEQ ID NO: 1834260 - protein, 25 aa, Staphylococcus epidermidis
MSRQHHRFLFFINKLPGITIKELLI

SEQ ID NO: 1834261 - protein, 25 aa, Staphylococcus epidermidis
NAETFYPMPFLSPETMWYYKSAFNT

SEQ ID NO: 1834262 - protein, 25 aa, Staphylococcus epidermidis
NFKEAVQWLYLAYLAAIKEQNGAAM

SEQ ID NO: 1834263 - protein, 26 aa, Staphylococcus epidermidis
NITEDQMIDFLFTSALFGRVVANNAS

SEQ ID NO: 1834264 - protein, 23 aa, Staphylococcus epidermidis
NNEPLLMDIAKTPHALIAGATGS

SEQ ID NO: 1834265 - protein, 24 aa, Staphylococcus epidermidis
NVRQFIRLTRYFIDILRQSNNGRI

SEQ ID NO: 1834266 - protein, 23 aa, Staphylococcus epidermidis
PDLDTWVIFPWTAGQGKVARLIC

SEQ ID NO: 1834267 - protein, 18 aa, Staphylococcus epidermidis
PERFWPADLVLLSIGFVG

SEQ ID NO: 1834268 - protein, 21 aa, Staphylococcus epidermidis
PGLRYILFTQGCLLRCLYCHN

SEQ ID NO: 1834269 - protein, 22 aa, Staphylococcus epidermidis
PGWQKWVWSPFLSVLGMGATAF

SEQ ID NO: 1834270 - protein, 17 aa, Staphylococcus epidermidis
PMFQFCLGIPWGAENDP

SEQ ID NO: 1834271 - protein, 22 aa, Staphylococcus epidermidis
PVEHQVLIIFALTKGYLDDIPV

SEQ ID NO: 1834272 - protein, 18 aa, Staphylococcus epidermidis
QEARWILIDLANVVVHVF

SEQ ID NO: 1834273 - protein, 24 aa, Staphylococcus epidermidis
QEDRKLIGILTNRDLRFIEDFSIK

SEQ ID NO: 1834274 - protein, 24 aa, Staphylococcus epidermidis
QFRSIIKQLYFFSIANPQPFEWLN

SEQ ID NO: 1834275 - protein, 18 aa, Staphylococcus epidermidis
QFYNLYRKGHLKLPNEDL

SEQ ID NO: 1834276 - protein, 24 aa, Staphylococcus epidermidis
QIKQGHLFLLLAKEGWHEGVLGIV

SEQ ID NO: 1834277 - protein, 20 aa, Staphylococcus epidermidis
QLLDRYLVIAHSYHLKPRIL

SEQ ID NO: 1834278 - protein, 22 aa, Staphylococcus epidermidis
QNHLPVVIYFYGGSFLQGHGTA

SEQ ID NO: 1834279 - protein, 23 aa, Staphylococcus epidermidis
QSKHLNELILYIAPKLIGGSGKH

SEQ ID NO: 1834280 - protein, 21 aa, Staphylococcus epidermidis
QYWQYPPFKLTNKDEWLYGRG

SEQ ID NO: 1834281 - protein, 21 aa, Staphylococcus epidermidis
QYYRMLQRPILYTGLTRAKQS

SEQ ID NO: 1834282 - protein, 24 aa, Staphylococcus epidermidis
RCQDGILLFWPIEGSMHFQQFMKE

SEQ ID NO: 1834283 - protein, 17 aa, Staphylococcus epidermidis
RDQHRLYKLIWERFVAS

SEQ ID NO: 1834284 - protein, 18 aa, Staphylococcus epidermidis
RGALKYIHDIWGYIAPNT

SEQ ID NO: 1834285 - protein, 19 aa, Staphylococcus epidermidis
RIVISLTYVYGIGTSTANK

SEQ ID NO: 1834286 - protein, 19 aa, Staphylococcus epidermidis
RLFEIEGVKSIFYVLDFIS

SEQ ID NO: 1834287 - protein, 24 aa, Staphylococcus epidermidis
RRVSPFFVPMLIPDMATGQVSIDL

SEQ ID NO: 1834288 - protein, 22 aa, Staphylococcus epidermidis
RTSGIFFMIKGDEQYIFGDCAI

SEQ ID NO: 1834289 - protein, 26 aa, Staphylococcus epidermidis
SDNTTMPAFWFDPIINLSAIAQVTSH

SEQ ID NO: 1834290 - protein, 24 aa, Staphylococcus epidermidis
SDRLRQFFDFITNFGIMIKGTGED

SEQ ID NO: 1834291 - protein, 25 aa, Staphylococcus epidermidis
SESIHLLPFNVFFVPARGGLGENVV

SEQ ID NO: 1834292 - protein, 31 aa, Staphylococcus epidermidis
SGGERALSAIALLFAILKVRSAPFVILDEVE

SEQ ID NO: 1834293 - protein, 17 aa, Staphylococcus epidermidis
SGPLYGFGFIKMASAVN

SEQ ID NO: 1834294 - protein, 24 aa, Staphylococcus epidermidis
SHQYKLLIILSPSGAYYGGDTLKS

SEQ ID NO: 1834295 - protein, 21 aa, Staphylococcus epidermidis
SLSFRAFYALPLLSNHAGIHT

SEQ ID NO: 1834296 - protein, 24 aa, Staphylococcus epidermidis
SSKPPILLTPLFPTYFFPTHSDRQ

SEQ ID NO: 1834297 - protein, 24 aa, Staphylococcus epidermidis
STAQLDFLLPERFDLTYIGQDGEQ

SEQ ID NO: 1834298 - protein, 23 aa, Staphylococcus epidermidis
SVTQLLERFLFPSATHGKKVYKL

SEQ ID NO: 1834299 - protein, 24 aa, Staphylococcus epidermidis
TEFEKHMYAIHMLTSLVSSHQSRS

SEQ ID NO: 1834300 - protein, 19 aa, Staphylococcus epidermidis
TFQISLPHFLSHEDYLLFT

SEQ ID NO: 1834301 - protein, 20 aa, Staphylococcus epidermidis
TIDNFRWAGVPFYIRTGKRM

SEQ ID NO: 1834302 - protein, 17 aa, Staphylococcus epidermidis
TLLIGFLKDTEPRMGSM

SEQ ID NO: 1834303 - protein, 18 aa, Staphylococcus epidermidis
TLLTLRLAELFRASTIPA

SEQ ID NO: 1834304 - protein, 23 aa, Staphylococcus epidermidis
TTAGKLALLMRKKYNKKPLLVAG

SEQ ID NO: 1834305 - protein, 23 aa, Staphylococcus epidermidis
TVHLKLPLDWLKGKIIIDSLGLH

SEQ ID NO: 1834306 - protein, 19 aa, Staphylococcus epidermidis
VELGVLYPLSYYDGDWYGK

SEQ ID NO: 1834307 - protein, 24 aa, Staphylococcus epidermidis
VINELAWHNLFARNMFIRPESIDE

SEQ ID NO: 1834308 - protein, 23 aa, Staphylococcus epidermidis
VNYKLRDWLFSRQRYWGEPIPII

SEQ ID NO: 1834309 - protein, 25 aa, Staphylococcus epidermidis
VQAGRVFIALPPLYKLEKGKGKNKK

SEQ ID NO: 1834310 - protein, 24 aa, Staphylococcus epidermidis
VTTPEWMLLPMHKGGTFGKFSTSI

SEQ ID NO: 1834311 - protein, 22 aa, Staphylococcus epidermidis
VVAHPFHPVYILPLVEIVPGKQ

SEQ ID NO: 1834312 - protein, 25 aa, Staphylococcus epidermidis
VYRAKLLRQLPYPTKFIFLDFIQSE

SEQ ID NO: 1834313 - protein, 24 aa, Staphylococcus epidermidis
YAATFFVFSDYLKPALRLSSIMGL

SEQ ID NO: 1834314 - protein, 18 aa, Staphylococcus epidermidis
YLDLRRYGSVPHSGFGLG

SEQ ID NO: 1834315 - protein, 19 aa, Staphylococcus epidermidis
YVGKLTFFRVYSGTLSSGS

SEQ ID NO: 1834316 - protein, 25 aa, Staphylococcus epidermidis
AHHIMTYFWMLERDKGRFMDSLKRI

SEQ ID NO: 1834317 - protein, 27 aa, Staphylococcus epidermidis
ATTYYNNWLFYYIFAHSFLNQHEKKNS

SEQ ID NO: 1834318 - protein, 21 aa, Staphylococcus epidermidis
CNVYLKREDLQWVRSFKLRGA

SEQ ID NO: 1834319 - protein, 19 aa, Staphylococcus epidermidis
DAQFIIWTTTPWTIPSNVA

SEQ ID NO: 1834320 - protein, 26 aa, Staphylococcus epidermidis
DFNNLVLVRFFFKSLTAYLKKHNCLY

SEQ ID NO: 1834321 - protein, 24 aa, Staphylococcus epidermidis
DISTDLVWYLWTGKYSSLFGKRAM

SEQ ID NO: 1834322 - protein, 19 aa, Staphylococcus epidermidis
DLILYVTYFNHSFTDNDKA

SEQ ID NO: 1834323 - protein, 20 aa, Staphylococcus epidermidis
DTYMPLPIFLSHQLAKRLAD

SEQ ID NO: 1834324 - protein, 18 aa, Staphylococcus epidermidis
EAERLVIHGFLDPVVREL

SEQ ID NO: 1834325 - protein, 17 aa, Staphylococcus epidermidis
EEWLKEINLSLNGAFSV

SEQ ID NO: 1834326 - protein, 18 aa, Staphylococcus epidermidis
EHRLPFILFSASGGARMQ

SEQ ID NO: 1834327 - protein, 18 aa, Staphylococcus epidermidis
EKMKLPGIALYPETERFY

SEQ ID NO: 1834328 - protein, 23 aa, Staphylococcus epidermidis
EMHFYRYVFPYYDTLYTLEKLSK

SEQ ID NO: 1834329 - protein, 21 aa, Staphylococcus epidermidis
EMNPFLGYRAIRLCLAQPEIF

SEQ ID NO: 1834330 - protein, 18 aa, Staphylococcus epidermidis
ENIVLVPKLLKWSKEKKD

SEQ ID NO: 1834331 - protein, 24 aa, Staphylococcus epidermidis
EQEDKIYILFYKPTQVITSVSDDR

SEQ ID NO: 1834332 - protein, 26 aa, Staphylococcus epidermidis
ERFENTFFLNLLRKIEIPLIAFDEAH

SEQ ID NO: 1834333 - protein, 25 aa, Staphylococcus epidermidis
FDNGLKLFIIPKPGFQKTYVTYTTQ

SEQ ID NO: 1834334 - protein, 27 aa, Staphylococcus epidermidis
FHDKYEWLLEYFPFLDPQHFVFCGRKN

SEQ ID NO: 1834335 - protein, 18 aa, Staphylococcus epidermidis
FHIQKLFLLIFQLPEHLA

SEQ ID NO: 1834336 - protein, 24 aa, Staphylococcus epidermidis
FLTKDLFIDWIWGESFFKQKLIDY

SEQ ID NO: 1834337 - protein, 18 aa, Staphylococcus epidermidis
GFKHVYPYMLKFIDQLPV

SEQ ID NO: 1834338 - protein, 17 aa, Staphylococcus epidermidis
GIKIHLLHLLKGTPMVK

SEQ ID NO: 1834339 - protein, 22 aa, Staphylococcus epidermidis
GKIEWLLPFLSNSGPTIIYVSS

SEQ ID NO: 1834340 - protein, 24 aa, Staphylococcus epidermidis
GQTFLETFLAPTKLYVKPILELKK

SEQ ID NO: 1834341 - protein, 23 aa, Staphylococcus epidermidis
GYGTKMMMFLPEYVQALFPDFTH

SEQ ID NO: 1834342 - protein, 22 aa, Staphylococcus epidermidis
HILNIYFPFIDVETMLTLLDLA

SEQ ID NO: 1834343 - protein, 17 aa, Staphylococcus epidermidis
HMKKIMTMLDAPNIERL

SEQ ID NO: 1834344 - protein, 20 aa, Staphylococcus epidermidis
IDSLSYYQFYILKLVVGEQR

SEQ ID NO: 1834345 - protein, 20 aa, Staphylococcus epidermidis
IEKSIWYKLLVNLGINTITA

SEQ ID NO: 1834346 - protein, 23 aa, Staphylococcus epidermidis
IHCDQLIILTAIDYVYINYHTDQ

SEQ ID NO: 1834347 - protein, 18 aa, Staphylococcus epidermidis
IMTMLDAPNIERLRQADI

SEQ ID NO: 1834348 - protein, 19 aa, Staphylococcus epidermidis
INNVLAFPGIFRGALDVEA

SEQ ID NO: 1834349 - protein, 23 aa, Staphylococcus epidermidis
INRDLFKYIPFDGSIITISELQE

SEQ ID NO: 1834350 - protein, 21 aa, Staphylococcus epidermidis
ISGYPFVWWFATRPTYDGQGY

SEQ ID NO: 1834351 - protein, 22 aa, Staphylococcus epidermidis
KDGRLFICYLGDFKTTGGIFAT

SEQ ID NO: 1834352 - protein, 18 aa, Staphylococcus epidermidis
KDIIDLFLDSGLGKEAFS

SEQ ID NO: 1834353 - protein, 20 aa, Staphylococcus epidermidis
KTYVLFQLYERFVIDYSLGS

SEQ ID NO: 1834354 - protein, 19 aa, Staphylococcus epidermidis
LEMKPLYEWLGLSVSLGFV

SEQ ID NO: 1834355 - protein, 19 aa, Staphylococcus epidermidis
LFTCLRPVRWFKGVPSPVK

SEQ ID NO: 1834356 - protein, 17 aa, Staphylococcus epidermidis
LIETILLNIINFQTLIA

SEQ ID NO: 1834357 - protein, 24 aa, Staphylococcus epidermidis
LIYYEGYYYISHQWFPLGAVHGLK

SEQ ID NO: 1834358 - protein, 22 aa, Staphylococcus epidermidis
LKGTDVLVCTVIGFPLGATTTA

SEQ ID NO: 1834359 - protein, 18 aa, Staphylococcus epidermidis
LKPLFRDYLLKLAEENQI

SEQ ID NO: 1834360 - protein, 17 aa, Staphylococcus epidermidis
LNALTGKGAYLITTNDY

SEQ ID NO: 1834361 - protein, 21 aa, Staphylococcus epidermidis
LTYPQFLVLTILWDESPVNVK

SEQ ID NO: 1834362 - protein, 17 aa, Staphylococcus epidermidis
MHHYNFPNFSVGETGPV

SEQ ID NO: 1834363 - protein, 17 aa, Staphylococcus epidermidis
MPGFPYLGGLDAKLHTP

SEQ ID NO: 1834364 - protein, 30 aa, Staphylococcus epidermidis
MVHLYDYIPRLFWPIYYFIQAPIQGLLMRG

SEQ ID NO: 1834365 - protein, 17 aa, Staphylococcus epidermidis
NFPFLMFGPGNGPHQIN

SEQ ID NO: 1834366 - protein, 22 aa, Staphylococcus epidermidis
NTPFFIGIMPIASYNNALFLHN

SEQ ID NO: 1834367 - protein, 19 aa, Staphylococcus epidermidis
PLLNRSLLYSAIILHDLGK

SEQ ID NO: 1834368 - protein, 24 aa, Staphylococcus epidermidis
PNEIYNLVIYQLGALSGFCKINHV

SEQ ID NO: 1834369 - protein, 21 aa, Staphylococcus epidermidis
PNGWLLHIPSCYLGIAQAARD

SEQ ID NO: 1834370 - protein, 20 aa, Staphylococcus epidermidis
QIKDLYEFNLFKLRIDHIQA

SEQ ID NO: 1834371 - protein, 20 aa, Staphylococcus epidermidis
QKHALFPKYDFFRADTDYAD

SEQ ID NO: 1834372 - protein, 19 aa, Staphylococcus epidermidis
QLRLYIHDFPIVAIGGINE

SEQ ID NO: 1834373 - protein, 25 aa, Staphylococcus epidermidis
QPDYDRPWHYLNVLAQQALGDTFGS

SEQ ID NO: 1834374 - protein, 17 aa, Staphylococcus epidermidis
REKRIVISLTYVYGIGT

SEQ ID NO: 1834375 - protein, 18 aa, Staphylococcus epidermidis
RIFNFPFYFRGEVYDPFE

SEQ ID NO: 1834376 - protein, 20 aa, Staphylococcus epidermidis
RIRPVILLLTLKMLNKDYQQ

SEQ ID NO: 1834377 - protein, 18 aa, Staphylococcus epidermidis
RKLNIEWVYRVLIDWKRI

SEQ ID NO: 1834378 - protein, 17 aa, Staphylococcus epidermidis
RLLVISPYDKSSVADIE

SEQ ID NO: 1834379 - protein, 17 aa, Staphylococcus epidermidis
RTAPWLERMGFENVKNV

SEQ ID NO: 1834380 - protein, 21 aa, Staphylococcus epidermidis
RYVGRGMLFLDLIQEGNMGLI

SEQ ID NO: 1834381 - protein, 17 aa, Staphylococcus epidermidis
SEDFAFYALERPSTFIY

SEQ ID NO: 1834382 - protein, 23 aa, Staphylococcus epidermidis
SEESYFLFYINRPSIIVGKNQNT

SEQ ID NO: 1834383 - protein, 28 aa, Staphylococcus epidermidis
SINVPMDLLPYLFFQFSSNGKRLYSDNA

SEQ ID NO: 1834384 - protein, 27 aa, Staphylococcus epidermidis
SKEQSLEHLLFGLGIRHLGVKASQVLA

SEQ ID NO: 1834385 - protein, 21 aa, Staphylococcus epidermidis
SVGLDLPFPLKMNRLLGFDST

SEQ ID NO: 1834386 - protein, 22 aa, Staphylococcus epidermidis
TGRYYIQRFLARSFGFEVDDIK

SEQ ID NO: 1834387 - protein, 18 aa, Staphylococcus epidermidis
TIPPWNFPFAIMAGTTLA

SEQ ID NO: 1834388 - protein, 22 aa, Staphylococcus epidermidis
TLMNHAISFLKERGYSVVTIKH

SEQ ID NO: 1834389 - protein, 26 aa, Staphylococcus epidermidis
TQQPYLIYMLGFMPGFPYLGGLDAKL

SEQ ID NO: 1834390 - protein, 24 aa, Staphylococcus epidermidis
VFRSRFRMLVEAQLDLLKSEDWDY

SEQ ID NO: 1834391 - protein, 17 aa, Staphylococcus epidermidis
VGLIPRFSRIFLGDKEF

SEQ ID NO: 1834392 - protein, 18 aa, Staphylococcus epidermidis
VIHGFLDPVVRELPIDDV

SEQ ID NO: 1834393 - protein, 18 aa, Staphylococcus epidermidis
VIISFKHKVILIGGTEYA

SEQ ID NO: 1834394 - protein, 19 aa, Staphylococcus epidermidis
VTDFMFFASAIMVLLHKYT

SEQ ID NO: 1834395 - protein, 19 aa, Staphylococcus epidermidis
YLKDTILKFGFYTNHQHVV

SEQ ID NO: 1834396 - protein, 18 aa, Staphylococcus epidermidis
YMLILGETLIEMKDQLRG

SEQ ID NO: 1834397 - protein, 19 aa, Staphylococcus epidermidis
YNHMLWKGFKPFKITNITQ

SEQ ID NO: 1834398 - protein, 20 aa, Staphylococcus epidermidis
YYLDGPLDLTFLFGLVDHLS

SEQ ID NO: 1834399 - protein, 19 aa, Staphylococcus epidermidis
AEHVKLLIPLLEKNRDEIA

SEQ ID NO: 1834400 - protein, 24 aa, Staphylococcus epidermidis
AELERPYILVTDKKISSFQDILPL

SEQ ID NO: 1834401 - protein, 23 aa, Staphylococcus epidermidis
AQFEEIIFLLWNYRLPNENELSE

SEQ ID NO: 1834402 - protein, 23 aa, Staphylococcus epidermidis
AQSMKFFQLYTPLLKKGGIVVTD

SEQ ID NO: 1834403 - protein, 20 aa, Staphylococcus epidermidis
ATMPLYLNALTGKGAYLITT

SEQ ID NO: 1834404 - protein, 22 aa, Staphylococcus epidermidis
CLYVKLDPYWLYQVYDKDINPL

SEQ ID NO: 1834405 - protein, 18 aa, Staphylococcus epidermidis
DFDFIYWLVTGVKDHQIV

SEQ ID NO: 1834406 - protein, 25 aa, Staphylococcus epidermidis
DSRKAIYLLPPQPLKYASNTWIYKT

SEQ ID NO: 1834407 - protein, 18 aa, Staphylococcus epidermidis
DVLLFIDNIFRFTQAGSE

SEQ ID NO: 1834408 - protein, 18 aa, Staphylococcus epidermidis
DYLLKPFIKTKIKSWVRQ

SEQ ID NO: 1834409 - protein, 17 aa, Staphylococcus epidermidis
EAVLQMNLLGHDFFIFT

SEQ ID NO: 1834410 - protein, 21 aa, Staphylococcus epidermidis
EDRTIYLPNAFHPLLDKDTVV

SEQ ID NO: 1834411 - protein, 24 aa, Staphylococcus epidermidis
EEQDLFIDLIFSPIYFNILIKPET

SEQ ID NO: 1834412 - protein, 17 aa, Staphylococcus epidermidis
EIYFKNEGFYPVAVDAK

SEQ ID NO: 1834413 - protein, 28 aa, Staphylococcus epidermidis
EPKNQGAWLFVYPYLKALVANKYDLTYH

SEQ ID NO: 1834414 - protein, 21 aa, Staphylococcus epidermidis
ESTFFDHQLLRRLVSFMYEKP

SEQ ID NO: 1834415 - protein, 21 aa, Staphylococcus epidermidis
ETAFPLLYTHFVRRGNWSLQQ

SEQ ID NO: 1834416 - protein, 22 aa, Staphylococcus epidermidis
EYFNGLYIITPFQKVDYSLELA

SEQ ID NO: 1834417 - protein, 18 aa, Staphylococcus epidermidis
FELIRLFGKRGRGLYNKA

SEQ ID NO: 1834418 - protein, 20 aa, Staphylococcus epidermidis
FIDKLKFPYFLGKSKYILVD

SEQ ID NO: 1834419 - protein, 22 aa, Staphylococcus epidermidis
FIEHCINLKWIGWFATGVNNLP

SEQ ID NO: 1834420 - protein, 23 aa, Staphylococcus epidermidis
FTPIKLRKRVWRRLAKDLKPQQL

SEQ ID NO: 1834421 - protein, 21 aa, Staphylococcus epidermidis
FTYTFLGFLPRKEKEKIEVLE

SEQ ID NO: 1834422 - protein, 19 aa, Staphylococcus epidermidis
GHQIRWRLLYIANPDYTVK

SEQ ID NO: 1834423 - protein, 24 aa, Staphylococcus epidermidis
GRHELLDSVFLWQSGNKYRVSAHD

SEQ ID NO: 1834424 - protein, 18 aa, Staphylococcus epidermidis
GYVLRRLLRRAVRFSQSL

SEQ ID NO: 1834425 - protein, 24 aa, Staphylococcus epidermidis
HMTNELLQRFKFDKAFISCGSFDT

SEQ ID NO: 1834426 - protein, 18 aa, Staphylococcus epidermidis
IANVVLAFYLTRPSLDVV

SEQ ID NO: 1834427 - protein, 19 aa, Staphylococcus epidermidis
IDEDWRLLDSPYQWTYDRR

SEQ ID NO: 1834428 - protein, 23 aa, Staphylococcus epidermidis
IDRTQLILEIFALRARSREGKLQ

SEQ ID NO: 1834429 - protein, 17 aa, Staphylococcus epidermidis
IEHYIYFLIRSVKYDYL

SEQ ID NO: 1834430 - protein, 18 aa, Staphylococcus epidermidis
IFKKPVITPIKPYKNFYP

SEQ ID NO: 1834431 - protein, 23 aa, Staphylococcus epidermidis
IGPLVKLWKIGFKDALKPKEVDI

SEQ ID NO: 1834432 - protein, 21 aa, Staphylococcus epidermidis
ILKAKRIILLAFGPKKKEAIS

SEQ ID NO: 1834433 - protein, 26 aa, Staphylococcus epidermidis
ILTSIPLWKNQMAIALTLMRQRNAVS

SEQ ID NO: 1834434 - protein, 25 aa, Staphylococcus epidermidis
KDTVYNIPFLWRLSSELNVMQLQRA

SEQ ID NO: 1834435 - protein, 25 aa, Staphylococcus epidermidis
KGIAKLFDFMLPNSPIKMPISKMNM

SEQ ID NO: 1834436 - protein, 29 aa, Staphylococcus epidermidis
KLTLENYVLIYYLEKIIFQANQRLSFMSG

SEQ ID NO: 1834437 - protein, 19 aa, Staphylococcus epidermidis
KMNILIGPLVKLWKIGFKD

SEQ ID NO: 1834438 - protein, 17 aa, Staphylococcus epidermidis
LEKWEIYFKNEGFYPVA

SEQ ID NO: 1834439 - protein, 18 aa, Staphylococcus epidermidis
LGKYPPYYFLINFTISHT

SEQ ID NO: 1834440 - protein, 18 aa, Staphylococcus epidermidis
LRLNTLPQRLAIIGGGVI

SEQ ID NO: 1834441 - protein, 18 aa, Staphylococcus epidermidis
LTEDIAYGLVLWSSLGRV

SEQ ID NO: 1834442 - protein, 22 aa, Staphylococcus epidermidis
MENRLRYQYGKPSKLLAKSFEL

SEQ ID NO: 1834443 - protein, 19 aa, Staphylococcus epidermidis
MLEAIFFGHEEIKRLVAFQ

SEQ ID NO: 1834444 - protein, 20 aa, Staphylococcus epidermidis
NCLPVFNILIKKQTLHFRVY

SEQ ID NO: 1834445 - protein, 17 aa, Staphylococcus epidermidis
NDPIIHFALAELLYYDG

SEQ ID NO: 1834446 - protein, 26 aa, Staphylococcus epidermidis
NEGYNLTFFAFFVKAVAEALKANPLL

SEQ ID NO: 1834447 - protein, 23 aa, Staphylococcus epidermidis
NKLLDLPFGKCHFALAAKPETSC

SEQ ID NO: 1834448 - protein, 17 aa, Staphylococcus epidermidis
NPYLYEVLTIHAQLKDY

SEQ ID NO: 1834449 - protein, 23 aa, Staphylococcus epidermidis
NVIAILEIYFPTSNIYLYAPITG

SEQ ID NO: 1834450 - protein, 17 aa, Staphylococcus epidermidis
NWHINAMLRLFKTNVLT

SEQ ID NO: 1834451 - protein, 23 aa, Staphylococcus epidermidis
PEELRLLLIDPKMVELAPYNDLP

SEQ ID NO: 1834452 - protein, 19 aa, Staphylococcus epidermidis
PIIHFALAELLYYDGQYLR

SEQ ID NO: 1834453 - protein, 21 aa, Staphylococcus epidermidis
PQLFKQLLMISGFDKYYQIVK

SEQ ID NO: 1834454 - protein, 20 aa, Staphylococcus epidermidis
PTLDYVISKIPRFPFDKFEK

SEQ ID NO: 1834455 - protein, 17 aa, Staphylococcus epidermidis
PVFFLKDGKAREVIKRQ

SEQ ID NO: 1834456 - protein, 20 aa, Staphylococcus epidermidis
QPGDFYFIPAGTIHSIGAGI

SEQ ID NO: 1834457 - protein, 22 aa, Staphylococcus epidermidis
QVKTWWRWYRNGESYRFSQQVG

SEQ ID NO: 1834458 - protein, 17 aa, Staphylococcus epidermidis
RAKQIFEWLYQKRVNTI

SEQ ID NO: 1834459 - protein, 28 aa, Staphylococcus epidermidis
RWDHEIFIKYLKFFQLPYKNKIKTFSTG

SEQ ID NO: 1834460 - protein, 22 aa, Staphylococcus epidermidis
SLPSYHLYFIQVSLQHVIEDTY

SEQ ID NO: 1834461 - protein, 24 aa, Staphylococcus epidermidis
TFMTNIFGMMFLSQAAVPYLSEGD

SEQ ID NO: 1834462 - protein, 20 aa, Staphylococcus epidermidis
TPFLAIYHLPTLKKGILFWQ

SEQ ID NO: 1834463 - protein, 23 aa, Staphylococcus epidermidis
TREHILLSRNVGVPALVVFLNKV

SEQ ID NO: 1834464 - protein, 22 aa, Staphylococcus epidermidis
VENTLIPYFRKIEKRALFNQEK

SEQ ID NO: 1834465 - protein, 18 aa, Staphylococcus epidermidis
VFNMIPYKVQVMGGIAIH

SEQ ID NO: 1834466 - protein, 19 aa, Staphylococcus epidermidis
VIDYYYRFIHRFPTIQSLS

SEQ ID NO: 1834467 - protein, 21 aa, Staphylococcus epidermidis
VKRRIFLGTFALSSGYYDAYY

SEQ ID NO: 1834468 - protein, 20 aa, Staphylococcus epidermidis
VLQMNLLGHDFFIFTDRETD

SEQ ID NO: 1834469 - protein, 19 aa, Staphylococcus epidermidis
WFLNPDHMLLILGIEKGWF

SEQ ID NO: 1834470 - protein, 17 aa, Staphylococcus epidermidis
WHDMKIVPYAPFEISPA

SEQ ID NO: 1834471 - protein, 17 aa, Staphylococcus epidermidis
AIKPDIFFFLPSYMAPL

SEQ ID NO: 1834472 - protein, 18 aa, Staphylococcus epidermidis
AMPILLALSHVHQLLIRE

SEQ ID NO: 1834473 - protein, 20 aa, Staphylococcus epidermidis
AQEGHDFFGLLYIGAILTKD

SEQ ID NO: 1834474 - protein, 21 aa, Staphylococcus epidermidis
ATVTHWFINFYNLIMEERFGR

SEQ ID NO: 1834475 - protein, 19 aa, Staphylococcus epidermidis
DEGKYFYYLGKAKYIKGTE

SEQ ID NO: 1834476 - protein, 17 aa, Staphylococcus epidermidis
EIDIAFTSLLTRALETT

SEQ ID NO: 1834477 - protein, 17 aa, Staphylococcus epidermidis
EIQFDVIFLDPPYNKGL

SEQ ID NO: 1834478 - protein, 17 aa, Staphylococcus epidermidis
ELDYLLLDLPPGTGDVA

SEQ ID NO: 1834479 - protein, 22 aa, Staphylococcus epidermidis
ELERPYILVTDKKISSFQDILP

SEQ ID NO: 1834480 - protein, 23 aa, Staphylococcus epidermidis
ENKPYPLYLLLDKEYQLIEPVMK

SEQ ID NO: 1834481 - protein, 21 aa, Staphylococcus epidermidis
EPTLDYVISKIPRFPFDKFEK

SEQ ID NO: 1834482 - protein, 22 aa, Staphylococcus epidermidis
EYDDCLLFFRLGDFYEMFFDDA

SEQ ID NO: 1834483 - protein, 19 aa, Staphylococcus epidermidis
EYFNGLYIITPFQKVDYSL

SEQ ID NO: 1834484 - protein, 18 aa, Staphylococcus epidermidis
FEKALKVLRPIYLEQSPV

SEQ ID NO: 1834485 - protein, 18 aa, Staphylococcus epidermidis
FIYPLIHIPAIDSLIWEN

SEQ ID NO: 1834486 - protein, 17 aa, Staphylococcus epidermidis
GDQQLMLRLIQPKYFLP

SEQ ID NO: 1834487 - protein, 20 aa, Staphylococcus epidermidis
GIIKKLFLLGIMANINQSLD

SEQ ID NO: 1834488 - protein, 22 aa, Staphylococcus epidermidis
GIIKKLFLLGIMANINQSLDEE

SEQ ID NO: 1834489 - protein, 18 aa, Staphylococcus epidermidis
GLYIITPFQKVDYSLELA

SEQ ID NO: 1834490 - protein, 18 aa, Staphylococcus epidermidis
HFYPDLLLGFIHVPLIPE

SEQ ID NO: 1834491 - protein, 17 aa, Staphylococcus epidermidis
HILKKWSGVRPYTEKEM

SEQ ID NO: 1834492 - protein, 23 aa, Staphylococcus epidermidis
IAGPGFINFYLDNQYLTAIIPEA

SEQ ID NO: 1834493 - protein, 22 aa, Staphylococcus epidermidis
IIKRHRLLELFLIEILQYNWEE

SEQ ID NO: 1834494 - protein, 17 aa, Staphylococcus epidermidis
IRDKVIIELLYATGIRV

SEQ ID NO: 1834495 - protein, 18 aa, Staphylococcus epidermidis
ITYILANPFYIGKIQFAK

SEQ ID NO: 1834496 - protein, 21 aa, Staphylococcus epidermidis
KAIQALLLWLNEHHFDYSSIA

SEQ ID NO: 1834497 - protein, 17 aa, Staphylococcus epidermidis
KAKAIQALLLWLNEHHF

SEQ ID NO: 1834498 - protein, 17 aa, Staphylococcus epidermidis
KAKAIQALLLWLNQHHF

SEQ ID NO: 1834499 - protein, 20 aa, Staphylococcus epidermidis
KGLFIVPLNGFKKWLTPVDL

SEQ ID NO: 1834500 - protein, 18 aa, Staphylococcus epidermidis
KIFNYFKPNFLLGMTATP

SEQ ID NO: 1834501 - protein, 21 aa, Staphylococcus epidermidis
KKLYKFFLLIAKYIKRKEAFY

SEQ ID NO: 1834502 - protein, 21 aa, Staphylococcus epidermidis
KLPGIALYPETERFYPNGNFA

SEQ ID NO: 1834503 - protein, 20 aa, Staphylococcus epidermidis
KSAKYVGLIPRFSRIFLGDK

SEQ ID NO: 1834504 - protein, 17 aa, Staphylococcus epidermidis
LFLLGIMANINQSLDEE

SEQ ID NO: 1834505 - protein, 19 aa, Staphylococcus epidermidis
LIQFLLIELSYLKKPKLDV

SEQ ID NO: 1834506 - protein, 19 aa, Staphylococcus epidermidis
LLKWHIELPKVVKLQKDIE

SEQ ID NO: 1834507 - protein, 22 aa, Staphylococcus epidermidis
LPLFNFKIYQFLDDAYLLLDFH

SEQ ID NO: 1834508 - protein, 26 aa, Staphylococcus epidermidis
LVGNNTPVFFFRDPKLFISLNRAVKR

SEQ ID NO: 1834509 - protein, 28 aa, Staphylococcus epidermidis
NAIYEFLTLRIPMLLIPLGLDQSRGDQI

SEQ ID NO: 1834510 - protein, 21 aa, Staphylococcus epidermidis
NDPIIHFALAELLYYDGQYLR

SEQ ID NO: 1834511 - protein, 18 aa, Staphylococcus epidermidis
NHQSLLVKFLKPVQNEWS

SEQ ID NO: 1834512 - protein, 24 aa, Staphylococcus epidermidis
NIRDKFLIQLLYETGLRIGEVLSL

SEQ ID NO: 1834513 - protein, 19 aa, Staphylococcus epidermidis
NIYPIFKQLGLDTYIDVVV

SEQ ID NO: 1834514 - protein, 18 aa, Staphylococcus epidermidis
PEARLLVISPYDKSSVAD

SEQ ID NO: 1834515 - protein, 22 aa, Staphylococcus epidermidis
PEELRLLLIDPKMVELAPYNDL

SEQ ID NO: 1834516 - protein, 17 aa, Staphylococcus epidermidis
PIFVFMNDSFEQLTVWR

SEQ ID NO: 1834517 - protein, 22 aa, Staphylococcus epidermidis
QDISKLQYILFLKELDLTLKQI

SEQ ID NO: 1834518 - protein, 19 aa, Staphylococcus epidermidis
QDVLLFIDNIFRFTQAGSE

SEQ ID NO: 1834519 - protein, 18 aa, Staphylococcus epidermidis
QGEKGLFIVPLNGFKKWL

SEQ ID NO: 1834520 - protein, 23 aa, Staphylococcus epidermidis
QGEKGLFIVPLNGFKKWLTPVDL

SEQ ID NO: 1834521 - protein, 20 aa, Staphylococcus epidermidis
QKRFTLNILYPYIETIHITK

SEQ ID NO: 1834522 - protein, 20 aa, Staphylococcus epidermidis
QLFKQLLMISGFDKYYQIVK

SEQ ID NO: 1834523 - protein, 19 aa, Staphylococcus epidermidis
RGYVLRRLLRRAVRFSQSL

SEQ ID NO: 1834524 - protein, 25 aa, Staphylococcus epidermidis
RKKFPDALFIFLAPPSLDDLKERLV

SEQ ID NO: 1834525 - protein, 17 aa, Staphylococcus epidermidis
RKRYETLKTLPMFDTIE

SEQ ID NO: 1834526 - protein, 17 aa, Staphylococcus epidermidis
RLVIHGFLDPVVRELPI

SEQ ID NO: 1834527 - protein, 20 aa, Staphylococcus epidermidis
RTELKYFYFYHLNNGIWNAK

SEQ ID NO: 1834528 - protein, 22 aa, Staphylococcus epidermidis
SETAFPLLYTHFVRRGNWSLQQ

SEQ ID NO: 1834529 - protein, 24 aa, Staphylococcus epidermidis
SEYDDCLLFFRLGDFYEMFFDDAK

SEQ ID NO: 1834530 - protein, 22 aa, Staphylococcus epidermidis
STIIPMCHPLPLTGIDISFKWD

SEQ ID NO: 1834531 - protein, 20 aa, Staphylococcus epidermidis
TIPIYLKRNPNFKFPQDEST

SEQ ID NO: 1834532 - protein, 24 aa, Staphylococcus epidermidis
TKRDKLILMLMYEGGLRIGEVLSL

SEQ ID NO: 1834533 - protein, 18 aa, Staphylococcus epidermidis
TLPLIKRLSSKQVRLNVT

SEQ ID NO: 1834534 - protein, 24 aa, Staphylococcus epidermidis
TREHILLSRNVGVPALVVFLNKVD

SEQ ID NO: 1834535 - protein, 23 aa, Staphylococcus epidermidis
TSKDYLWTILIHRLREWELNDKT

SEQ ID NO: 1834536 - protein, 18 aa, Staphylococcus epidermidis
TYFLSWTTTPWTLPANVA

SEQ ID NO: 1834537 - protein, 19 aa, Staphylococcus epidermidis
VFNMIPYKVQVMGGIAIHK

SEQ ID NO: 1834538 - protein, 17 aa, Staphylococcus epidermidis
VGIAFIIELKYLNGIDK

SEQ ID NO: 1834539 - protein, 25 aa, Staphylococcus epidermidis
VGNNTPVFFFRDPKLFISLNRAVKR

SEQ ID NO: 1834540 - protein, 19 aa, Staphylococcus epidermidis
VILLRMHYLISNALDLSGY

SEQ ID NO: 1834541 - protein, 19 aa, Staphylococcus epidermidis
VKPFYGNFGIYLRAYTYIR

SEQ ID NO: 1834542 - protein, 22 aa, Staphylococcus epidermidis
VKPFYGNFGIYLRAYTYIRSMG

SEQ ID NO: 1834543 - protein, 22 aa, Staphylococcus epidermidis
VKVKPPFYYPLNKIISIGTMIK

SEQ ID NO: 1834544 - protein, 20 aa, Staphylococcus epidermidis
VLQATLPYLLKQSSGHIINL

SEQ ID NO: 1834545 - protein, 17 aa, Staphylococcus epidermidis
VLRPIYLEQSPVPTFYI

SEQ ID NO: 1834546 - protein, 18 aa, Staphylococcus epidermidis
VLRPIYLEQSPVPTFYIV

SEQ ID NO: 1834547 - protein, 25 aa, Staphylococcus epidermidis
VRKKFPDALFIFLAPPSLDDLRERL

SEQ ID NO: 1834548 - protein, 22 aa, Staphylococcus epidermidis
VSMIFQHFNLLWSRSVLKNVTF

SEQ ID NO: 1834549 - protein, 17 aa, Staphylococcus epidermidis
WMILDVLPIIPPEIRPM

SEQ ID NO: 1834550 - protein, 18 aa, Staphylococcus epidermidis
YGNFGIYLRAYTYIRSMG

SEQ ID NO: 1834551 - protein, 17 aa, Staphylococcus epidermidis
YQRFIRHIQFLIYRLTK

SEQ ID NO: 1834552 - protein, 17 aa, Staphylococcus epidermidis
ADECRLWITVHYLPNES

SEQ ID NO: 1834553 - protein, 27 aa, Staphylococcus epidermidis
AIYEFLSLRIPMLLIPLGLDQSRGDQI

SEQ ID NO: 1834554 - protein, 18 aa, Staphylococcus epidermidis
ALQELLQYIIDFYRLDVK

SEQ ID NO: 1834555 - protein, 19 aa, Staphylococcus epidermidis
AQEGHDFFGLLYIGAILTK

SEQ ID NO: 1834556 - protein, 26 aa, Staphylococcus epidermidis
ATKFLINYLEWLKLSSTIILTSHELN

SEQ ID NO: 1834557 - protein, 21 aa, Staphylococcus epidermidis
CLYVKLDPYWLYQVYDKDINP

SEQ ID NO: 1834558 - protein, 20 aa, Staphylococcus epidermidis
DEFELIRLFGKRGRGLYNKA

SEQ ID NO: 1834559 - protein, 19 aa, Staphylococcus epidermidis
DFDFIYWLVTGVKDHQIVL

SEQ ID NO: 1834560 - protein, 17 aa, Staphylococcus epidermidis
DFYFIPAGTIHSIGAGI

SEQ ID NO: 1834561 - protein, 24 aa, Staphylococcus epidermidis
DLKENRLFYLAMSPKFFGVATNHL

SEQ ID NO: 1834562 - protein, 21 aa, Staphylococcus epidermidis
DTIPIYLKRNPNFKFPQDEST

SEQ ID NO: 1834563 - protein, 20 aa, Staphylococcus epidermidis
DTYMPLPIFLSHQLAKRLSD

SEQ ID NO: 1834564 - protein, 17 aa, Staphylococcus epidermidis
EARLLVISPYDKSSVAD

SEQ ID NO: 1834565 - protein, 22 aa, Staphylococcus epidermidis
EAVLQMNLLGHDFFIFTDRETD

SEQ ID NO: 1834566 - protein, 29 aa, Staphylococcus epidermidis
EEQDLFIDLIFSPIYFNILIKPETLDKNY

SEQ ID NO: 1834567 - protein, 21 aa, Staphylococcus epidermidis
EERTIYLPNAFHPLLDKDTVV

SEQ ID NO: 1834568 - protein, 26 aa, Staphylococcus epidermidis
EGYKRFMFLALLRRAMIRKLPYSRMN

SEQ ID NO: 1834569 - protein, 18 aa, Staphylococcus epidermidis
EIDIAFTSLLTRALETTQ

SEQ ID NO: 1834570 - protein, 30 aa, Staphylococcus epidermidis
EPKNQGAWLFVYPYLKALVANKYDLSYHGR

SEQ ID NO: 1834571 - protein, 17 aa, Staphylococcus epidermidis
EVKDRLNGIIWVFNYFL

SEQ ID NO: 1834572 - protein, 18 aa, Staphylococcus epidermidis
EYMIPRKFEWMERLPLTL

SEQ ID NO: 1834573 - protein, 17 aa, Staphylococcus epidermidis
FDVIFLDPPYNKGLINE

SEQ ID NO: 1834574 - protein, 19 aa, Staphylococcus epidermidis
FFEKALKVLRPIYLEQSPV

SEQ ID NO: 1834575 - protein, 21 aa, Staphylococcus epidermidis
FIEHCINLKWIGWFATGVNNL

SEQ ID NO: 1834576 - protein, 24 aa, Staphylococcus epidermidis
FINRDLFKYIPFDGSIITISELQE

SEQ ID NO: 1834577 - protein, 17 aa, Staphylococcus epidermidis
FKAYHYQAKILLLAWNR

SEQ ID NO: 1834578 - protein, 20 aa, Staphylococcus epidermidis
FKMNILIGPLVKLWKIGFKD

SEQ ID NO: 1834579 - protein, 18 aa, Staphylococcus epidermidis
FMHHYNFPNFSVGETGPV

SEQ ID NO: 1834580 - protein, 24 aa, Staphylococcus epidermidis
FPNQINNVLAFPGLFRGALDVEAT

SEQ ID NO: 1834581 - protein, 24 aa, Staphylococcus epidermidis
FTPIKLRKRVWRRLAKDLKPQQLH

SEQ ID NO: 1834582 - protein, 17 aa, Staphylococcus epidermidis
GAKSRFWLQLQADIFNL

SEQ ID NO: 1834583 - protein, 17 aa, Staphylococcus epidermidis
GYYLVYLFHPEGEGIYL

SEQ ID NO: 1834584 - protein, 19 aa, Staphylococcus epidermidis
HYFKRLFSQYGIRSHIDTV

SEQ ID NO: 1834585 - protein, 22 aa, Staphylococcus epidermidis
IDRTQLILEIFALRARSREGKL

SEQ ID NO: 1834586 - protein, 17 aa, Staphylococcus epidermidis
IHLIYRKLNKNSAYLGT

SEQ ID NO: 1834587 - protein, 23 aa, Staphylococcus epidermidis
IIKRHRLLELFLIEILQYNWEEV

SEQ ID NO: 1834588 - protein, 19 aa, Staphylococcus epidermidis
ILRLNTLPQRLAIIGGGVI

SEQ ID NO: 1834589 - protein, 25 aa, Staphylococcus epidermidis
ILTSIPLWKNQMAIALTLMRQRNAV

SEQ ID NO: 1834590 - protein, 18 aa, Staphylococcus epidermidis
IQALLLWLNQHHFDYSSI

SEQ ID NO: 1834591 - protein, 18 aa, Staphylococcus epidermidis
IQFLLIELSYLKKPKLDV

SEQ ID NO: 1834592 - protein, 19 aa, Staphylococcus epidermidis
IVGKVSLRYWPFSEFKSNF

SEQ ID NO: 1834593 - protein, 17 aa, Staphylococcus epidermidis
IYPLIHIPAIDSLIWEN

SEQ ID NO: 1834594 - protein, 19 aa, Staphylococcus epidermidis
KLGKYPPYYFLINFTISHT

SEQ ID NO: 1834595 - protein, 20 aa, Staphylococcus epidermidis
KLPGIALYPETERFYPNGNF

SEQ ID NO: 1834596 - protein, 28 aa, Staphylococcus epidermidis
KLTLENYVLIYYLEKIIFQANQRLSFMS

SEQ ID NO: 1834597 - protein, 20 aa, Staphylococcus epidermidis
KLYKFFLLIAKYIKRKEAFY

SEQ ID NO: 1834598 - protein, 17 aa, Staphylococcus epidermidis
KRKYTLDYLLKPFIKTK

SEQ ID NO: 1834599 - protein, 18 aa, Staphylococcus epidermidis
KSAKYVGLIPRFSRIFLG

SEQ ID NO: 1834600 - protein, 25 aa, Staphylococcus epidermidis
KVFRSRFRMLVEAQLDLLKSEDWDY

SEQ ID NO: 1834601 - protein, 17 aa, Staphylococcus epidermidis
KWHIELPKVVKLQKDIE

SEQ ID NO: 1834602 - protein, 17 aa, Staphylococcus epidermidis
KYLMNRLVGFTRKILGV

SEQ ID NO: 1834603 - protein, 17 aa, Staphylococcus epidermidis
KYVGLIPRFSRIFLGDK

SEQ ID NO: 1834604 - protein, 20 aa, Staphylococcus epidermidis
LEFKYLFLKLIVKEDWSLSN

SEQ ID NO: 1834605 - protein, 18 aa, Staphylococcus epidermidis
LFKAYHYQAKILLLAWNR

SEQ ID NO: 1834606 - protein, 24 aa, Staphylococcus epidermidis
LFKEYLRFVSILKPKIFIIENVAR

SEQ ID NO: 1834607 - protein, 17 aa, Staphylococcus epidermidis
LHQRLYHDFLRESNARE

SEQ ID NO: 1834608 - protein, 29 aa, Staphylococcus epidermidis
LKENIEIALKLLKILLKELERVLGRNTFA

SEQ ID NO: 1834609 - protein, 17 aa, Staphylococcus epidermidis
LLKWHIELPKVVKLQKD

SEQ ID NO: 1834610 - protein, 18 aa, Staphylococcus epidermidis
LLNRSLLYSAIILHDLGK

SEQ ID NO: 1834611 - protein, 17 aa, Staphylococcus epidermidis
LPLIKRLSSKQVRLNVT

SEQ ID NO: 1834612 - protein, 17 aa, Staphylococcus epidermidis
LPLYYRLVSILKGKGID

SEQ ID NO: 1834613 - protein, 19 aa, Staphylococcus epidermidis
LTEDIAYGLVLWSSLGRVI

SEQ ID NO: 1834614 - protein, 20 aa, Staphylococcus epidermidis
MLEAIFFGHEEIKRLVAFQQ

SEQ ID NO: 1834615 - protein, 17 aa, Staphylococcus epidermidis
MPILLALSHVHQLLIRE

SEQ ID NO: 1834616 - protein, 18 aa, Staphylococcus epidermidis
NFLRKRYETLRTLPMFDT

SEQ ID NO: 1834617 - protein, 26 aa, Staphylococcus epidermidis
NVIAILEIYFPISNIYLYAPITGMHA

SEQ ID NO: 1834618 - protein, 17 aa, Staphylococcus epidermidis
PGDFYFIPAGTIHSIGA

SEQ ID NO: 1834619 - protein, 18 aa, Staphylococcus epidermidis
PIEHYIYFLIRSVKYDYL

SEQ ID NO: 1834620 - protein, 26 aa, Staphylococcus epidermidis
PKDTVYNIPFLWRLSSELNVMQLQRA

SEQ ID NO: 1834621 - protein, 19 aa, Staphylococcus epidermidis
PLPDNQLLTQLFTALEEES

SEQ ID NO: 1834622 - protein, 24 aa, Staphylococcus epidermidis
QDISKLQYILFLKELDLTLKQIQT

SEQ ID NO: 1834623 - protein, 23 aa, Staphylococcus epidermidis
QLPLFNFKIYQFLDDAYLLLDFH

SEQ ID NO: 1834624 - protein, 18 aa, Staphylococcus epidermidis
QMQKPPVFFLKDGKAREV

SEQ ID NO: 1834625 - protein, 20 aa, Staphylococcus epidermidis
QMQKPPVFFLKDGKAREVIK

SEQ ID NO: 1834626 - protein, 18 aa, Staphylococcus epidermidis
QYDYLIKRYLLNIEREND

SEQ ID NO: 1834627 - protein, 23 aa, Staphylococcus epidermidis
RDVTIFCTFWGLNALKKIQSQRI

SEQ ID NO: 1834628 - protein, 19 aa, Staphylococcus epidermidis
REIQFDVIFLDPPYNKGLI

SEQ ID NO: 1834629 - protein, 17 aa, Staphylococcus epidermidis
RILLLNQSLQFLGPTKE

SEQ ID NO: 1834630 - protein, 17 aa, Staphylococcus epidermidis
RKRYETLRTLPMFDTIE

SEQ ID NO: 1834631 - protein, 19 aa, Staphylococcus epidermidis
RNHQSLLVKFLKPVQNEWS

SEQ ID NO: 1834632 - protein, 20 aa, Staphylococcus epidermidis
RYVGRGMLFLDLIQEGNMGL

SEQ ID NO: 1834633 - protein, 21 aa, Staphylococcus epidermidis
SLPSYHLYFIQVSLQHVIEDT

SEQ ID NO: 1834634 - protein, 19 aa, Staphylococcus epidermidis
SLYIRPFVFATEGILGVRS

SEQ ID NO: 1834635 - protein, 24 aa, Staphylococcus epidermidis
SQNLWYFRYFIYYLIKENVIPKDK

SEQ ID NO: 1834636 - protein, 21 aa, Staphylococcus epidermidis
STPFLAIYHLPTLKKGILFWQ

SEQ ID NO: 1834637 - protein, 23 aa, Staphylococcus epidermidis
SVKVKPPFYYPLNKIISIGTMIK

SEQ ID NO: 1834638 - protein, 17 aa, Staphylococcus epidermidis
TLKLFKVCKMRGIPIFT

SEQ ID NO: 1834639 - protein, 22 aa, Staphylococcus epidermidis
TSKDYLWTILIHRLREWELNDK

SEQ ID NO: 1834640 - protein, 23 aa, Staphylococcus epidermidis
TSTIIPMCHPLPLTGIDISFKWD

SEQ ID NO: 1834641 - protein, 25 aa, Staphylococcus epidermidis
TTTATALQWLLFDIGLDGSTKSFTP

SEQ ID NO: 1834642 - protein, 23 aa, Staphylococcus epidermidis
VDKNGDIFFIYTNEKLKSILNIS

SEQ ID NO: 1834643 - protein, 17 aa, Staphylococcus epidermidis
VIIILNYPNNPTGYTPN

SEQ ID NO: 1834644 - protein, 24 aa, Staphylococcus epidermidis
VKNFKQLRLWIWEVKKRDGKHHGT

SEQ ID NO: 1834645 - protein, 20 aa, Staphylococcus epidermidis
VKRRIFLGTFALSSGYYDAY

SEQ ID NO: 1834646 - protein, 19 aa, Staphylococcus epidermidis
VLQATLPYLLKQSSGHIIN

SEQ ID NO: 1834647 - protein, 20 aa, Staphylococcus epidermidis
VSMIFQHFNLLWSRNVLKNV

SEQ ID NO: 1834648 - protein, 19 aa, Staphylococcus epidermidis
VTIPPWNFPFAIMAGTTLA

SEQ ID NO: 1834649 - protein, 18 aa, Staphylococcus epidermidis
WHDMKIVPYAPFEISPAA

SEQ ID NO: 1834650 - protein, 18 aa, Staphylococcus epidermidis
YCFVRPIYLFLNKMNSCD

SEQ ID NO: 1834651 - protein, 18 aa, Staphylococcus epidermidis
YIGQQVIFYLFTEKRIIA

SEQ ID NO: 1834652 - protein, 20 aa, Staphylococcus epidermidis
YLNNILKYYYGTLIIVSHDR

SEQ ID NO: 1834653 - protein, 25 aa, Staphylococcus epidermidis
YMDDRYPFYLDPMPNLYFTRDPQAS

SEQ ID NO: 1834654 - protein, 19 aa, Staphylococcus epidermidis
YTGLFRYIQLFVVSNKMET

SEQ ID NO: 1834655 - protein, 23 aa, Staphylococcus epidermidis
ADIKTYIFYQLFEKYIIDYSMAS

SEQ ID NO: 1834656 - protein, 22 aa, Staphylococcus epidermidis
ADMYYLMQLLYCNNYTYDTLIE

SEQ ID NO: 1834657 - protein, 18 aa, Staphylococcus epidermidis
AEHVKLLIPLLEKNRDEI

SEQ ID NO: 1834658 - protein, 18 aa, Staphylococcus epidermidis
AEHVKLLIPLLEQNRDEI

SEQ ID NO: 1834659 - protein, 18 aa, Staphylococcus epidermidis
AELKEVFQLLKVEMPIVL

SEQ ID NO: 1834660 - protein, 25 aa, Staphylococcus epidermidis
AENNITFVPYFPLASGILAGKYDED

SEQ ID NO: 1834661 - protein, 18 aa, Staphylococcus epidermidis
AFAKFFKLMLHQGINLAP

SEQ ID NO: 1834662 - protein, 17 aa, Staphylococcus epidermidis
AFGMRPYIKKKVKKYSM

SEQ ID NO: 1834663 - protein, 18 aa, Staphylococcus epidermidis
AFTSLLTRALETTQHILA

SEQ ID NO: 1834664 - protein, 24 aa, Staphylococcus epidermidis
AGDDILLRRIYKLPIGFKWENQPN

SEQ ID NO: 1834665 - protein, 17 aa, Staphylococcus epidermidis
AGIRYAKRTYGGRMLSV

SEQ ID NO: 1834666 - protein, 26 aa, Staphylococcus epidermidis
AHHIMTYFWMLERDKGRFMDSLKRID

SEQ ID NO: 1834667 - protein, 25 aa, Staphylococcus epidermidis
AHPIYSKLLIYMKFKSGLDVSSQQV

SEQ ID NO: 1834668 - protein, 22 aa, Staphylococcus epidermidis
AILGLVHTLWKPMPGRFKDYIA

SEQ ID NO: 1834669 - protein, 22 aa, Staphylococcus epidermidis
AIQYPAIPSVLYSLPRLSQIGV

SEQ ID NO: 1834670 - protein, 27 aa, Staphylococcus epidermidis
AKDNSFEHLLFGLGIRHLGVKASQVLA

SEQ ID NO: 1834671 - protein, 18 aa, Staphylococcus epidermidis
AKFIIWTTTPWTIPSNVA

SEQ ID NO: 1834672 - protein, 23 aa, Staphylococcus epidermidis
AKSVYKGFKTWLSNTLSWIRSVG

SEQ ID NO: 1834673 - protein, 24 aa, Staphylococcus epidermidis
ALENQLMKILGSKWKKYIGSVAKD

SEQ ID NO: 1834674 - protein, 23 aa, Staphylococcus epidermidis
ALTNYYLYFLVDSNIEIGIKSII

SEQ ID NO: 1834675 - protein, 19 aa, Staphylococcus epidermidis
ANIPLIRLMNKFELKKASN

SEQ ID NO: 1834676 - protein, 23 aa, Staphylococcus epidermidis
ANTTTHSFIRYYLTRPLETGKTY

SEQ ID NO: 1834677 - protein, 17 aa, Staphylococcus epidermidis
ANVVLAFYLTRPSLDVV

SEQ ID NO: 1834678 - protein, 24 aa, Staphylococcus epidermidis
APGWQKWVWSPFLSILGTGATAFV

SEQ ID NO: 1834679 - protein, 23 aa, Staphylococcus epidermidis
AQFEEIIFLLWNYRLPNEKELSE

SEQ ID NO: 1834680 - protein, 22 aa, Staphylococcus epidermidis
AQFEEIIFLLWNYRLPNENELS

SEQ ID NO: 1834681 - protein, 23 aa, Staphylococcus epidermidis
AQFEEIIFLLWNYRLPNKDELKE

SEQ ID NO: 1834682 - protein, 18 aa, Staphylococcus epidermidis
AQFIIWTTTPWTIPSNVA

SEQ ID NO: 1834683 - protein, 23 aa, Staphylococcus epidermidis
AQSKKFFQLYTPLLKKGGIVVTD

SEQ ID NO: 1834684 - protein, 24 aa, Staphylococcus epidermidis
ASEFRNYILGLIFYRFLSEKTEEE

SEQ ID NO: 1834685 - protein, 21 aa, Staphylococcus epidermidis
ATMPLYLNALTGKGAYLITTN

SEQ ID NO: 1834686 - protein, 18 aa, Staphylococcus epidermidis
AVPVMKFFKYFYSNRGPV

SEQ ID NO: 1834687 - protein, 20 aa, Staphylococcus epidermidis
AYEEWLRVLKPHGHLLNFDA

SEQ ID NO: 1834688 - protein, 23 aa, Staphylococcus epidermidis
CDETFLTTLLKLNPKRIIYISCN

SEQ ID NO: 1834689 - protein, 22 aa, Staphylococcus epidermidis
CFDVANQYWLYLFGHTLKGVGA

SEQ ID NO: 1834690 - protein, 20 aa, Staphylococcus epidermidis
CKVYLKREDLQWVRSFKLRG

SEQ ID NO: 1834691 - protein, 20 aa, Staphylococcus epidermidis
CNVYLKREDLQWVRSFKLRG

SEQ ID NO: 1834692 - protein, 22 aa, Staphylococcus epidermidis
DAYNYGFILTPTEKELGACVID

SEQ ID NO: 1834693 - protein, 20 aa, Staphylococcus epidermidis
DDEEYLFHMLKSGAKGYILK

SEQ ID NO: 1834694 - protein, 23 aa, Staphylococcus epidermidis
DDIENIFFLIKNWKNKEIYLEEK

SEQ ID NO: 1834695 - protein, 26 aa, Staphylococcus epidermidis
DDISTDLVWYLWTGKYSSLFGKRAMT

SEQ ID NO: 1834696 - protein, 18 aa, Staphylococcus epidermidis
DDTSFFDIVAFGKTAQLL

SEQ ID NO: 1834697 - protein, 22 aa, Staphylococcus epidermidis
DDTSFFDIVAFGKTAQLLNDYC

SEQ ID NO: 1834698 - protein, 18 aa, Staphylococcus epidermidis
DEDWRLLDSPYQWTYDRR

SEQ ID NO: 1834699 - protein, 24 aa, Staphylococcus epidermidis
DEIKWDHIFVYKYKLKTPFIDKII

SEQ ID NO: 1834700 - protein, 20 aa, Staphylococcus epidermidis
DENFPFLMFGPGTGPHQVDE

SEQ ID NO: 1834701 - protein, 22 aa, Staphylococcus epidermidis
DENGDIFFIYTNEKLKSILNIS

SEQ ID NO: 1834702 - protein, 24 aa, Staphylococcus epidermidis
DESYAYLFDSIFPLYDIPFNIDTK

SEQ ID NO: 1834703 - protein, 26 aa, Staphylococcus epidermidis
DEYVVLRFGWLYGPGTWYGKDGMIYN

SEQ ID NO: 1834704 - protein, 18 aa, Staphylococcus epidermidis
DFILPGYRDVPQIIWHGL

SEQ ID NO: 1834705 - protein, 24 aa, Staphylococcus epidermidis
DFINRLFEIDGVKSIFYVMDFISV

SEQ ID NO: 1834706 - protein, 24 aa, Staphylococcus epidermidis
DFQKFLSAFLFLYYKEDNDIFYDQ

SEQ ID NO: 1834707 - protein, 23 aa, Staphylococcus epidermidis
DGNEYIDYVLSWGPLILGHKNKQ

SEQ ID NO: 1834708 - protein, 26 aa, Staphylococcus epidermidis
DHEIFIKYLNFFQLPYKNKIKTFSTG

SEQ ID NO: 1834709 - protein, 27 aa, Staphylococcus epidermidis
DHELFINYLQFFQLPYNKKIKTFSTGM

SEQ ID NO: 1834710 - protein, 19 aa, Staphylococcus epidermidis
DHFYPDLLLGFIHVPLIPE

SEQ ID NO: 1834711 - protein, 19 aa, Staphylococcus epidermidis
DHTKVVAPFIRLAGTMEGL

SEQ ID NO: 1834712 - protein, 19 aa, Staphylococcus epidermidis
DIHRMLPHPINLVRVRLTG

SEQ ID NO: 1834713 - protein, 17 aa, Staphylococcus epidermidis
DIIDLFLDSGLGKEAFS

SEQ ID NO: 1834714 - protein, 24 aa, Staphylococcus epidermidis
DIIKRHRLLELFLIEILQYNWEEV

SEQ ID NO: 1834715 - protein, 25 aa, Staphylococcus epidermidis
DISTDLVWYLWTGKYSSLFGKRAMT

SEQ ID NO: 1834716 - protein, 17 aa, Staphylococcus epidermidis
DITSKRWLLKTYSFESN

SEQ ID NO: 1834717 - protein, 20 aa, Staphylococcus epidermidis
DLANQYWYYVTGHALRGLYA

SEQ ID NO: 1834718 - protein, 20 aa, Staphylococcus epidermidis
DLFTCLRPVRWFKGVPSPVK

SEQ ID NO: 1834719 - protein, 18 aa, Staphylococcus epidermidis
DLKENRLFYLAMSPKFFG

SEQ ID NO: 1834720 - protein, 17 aa, Staphylococcus epidermidis
DMDIVISAPFYPAYMTK

SEQ ID NO: 1834721 - protein, 23 aa, Staphylococcus epidermidis
DNGLKLFVIPKPGFQKTYVTYTT

SEQ ID NO: 1834722 - protein, 20 aa, Staphylococcus epidermidis
DQMFIRNELFQRGLVSFVAN

SEQ ID NO: 1834723 - protein, 21 aa, Staphylococcus epidermidis
DQNKFFIEDIKLFPVATISTG

SEQ ID NO: 1834724 - protein, 19 aa, Staphylococcus epidermidis
DSTTFYAHFPKKGMYKIWA

SEQ ID NO: 1834725 - protein, 20 aa, Staphylococcus epidermidis
DSTTFYAHFPKKGMYKIWAE

SEQ ID NO: 1834726 - protein, 24 aa, Staphylococcus epidermidis
DTGYFFNTAYLPDGALNKGNYSNT

SEQ ID NO: 1834727 - protein, 17 aa, Staphylococcus epidermidis
DTYIALLLGYYDATKKY

SEQ ID NO: 1834728 - protein, 23 aa, Staphylococcus epidermidis
DVGSHYIWMARKFRSYNPRHLLF

SEQ ID NO: 1834729 - protein, 17 aa, Staphylococcus epidermidis
DVTIFCTFWGLNALKKI

SEQ ID NO: 1834730 - protein, 22 aa, Staphylococcus epidermidis
DYDRPWNYLNVLAQQALGDTFG

SEQ ID NO: 1834731 - protein, 18 aa, Staphylococcus epidermidis
DYIIAPLPEKTLFTARLV

SEQ ID NO: 1834732 - protein, 25 aa, Staphylococcus epidermidis
DYLKYLGVDYLWLTPIYESPMNDNG

SEQ ID NO: 1834733 - protein, 17 aa, Staphylococcus epidermidis
DYNGYPLVIRKLSTWIN

SEQ ID NO: 1834734 - protein, 17 aa, Staphylococcus epidermidis
DYVFFDYIHLNFQIMMD

SEQ ID NO: 1834735 - protein, 23 aa, Staphylococcus epidermidis
EAERLVIHGFLDPVVRELPIDDV

SEQ ID NO: 1834736 - protein, 23 aa, Staphylococcus epidermidis
EAERLVIHGFLDPVVRELPIEDV

SEQ ID NO: 1834737 - protein, 27 aa, Staphylococcus epidermidis
EAGKFADLVMWEPAFFGVKPELIVKGG

SEQ ID NO: 1834738 - protein, 25 aa, Staphylococcus epidermidis
EAMTKFPVWMGATTLFFGAINGAKE

SEQ ID NO: 1834739 - protein, 20 aa, Staphylococcus epidermidis
EAQWDAMLLGWKVVSSVKSN

SEQ ID NO: 1834740 - protein, 18 aa, Staphylococcus epidermidis
EDDVIHSLILKPLYYFKD

SEQ ID NO: 1834741 - protein, 17 aa, Staphylococcus epidermidis
EDIELFRDIADKVKQTN

SEQ ID NO: 1834742 - protein, 17 aa, Staphylococcus epidermidis
EDILPTFKKLGLDDYID

SEQ ID NO: 1834743 - protein, 24 aa, Staphylococcus epidermidis
EDTVYNIPFLWRLTSELNVAQLKR

SEQ ID NO: 1834744 - protein, 21 aa, Staphylococcus epidermidis
EDVYDFWRPTGHKYPLVAGAL

SEQ ID NO: 1834745 - protein, 22 aa, Staphylococcus epidermidis
EELKFIYFKMQKLSPQYLKLAV

SEQ ID NO: 1834746 - protein, 25 aa, Staphylococcus epidermidis
EEQDLFIDLIFSPIYFNILIKPDSL

SEQ ID NO: 1834747 - protein, 18 aa, Staphylococcus epidermidis
EFKFLFTDIDFLPPVTPP

SEQ ID NO: 1834748 - protein, 22 aa, Staphylococcus epidermidis
EFKNYILGLIFYRFLSEKVEES

SEQ ID NO: 1834749 - protein, 22 aa, Staphylococcus epidermidis
EFKNYILGLIFYRFLSEKVEET

SEQ ID NO: 1834750 - protein, 25 aa, Staphylococcus epidermidis
EFRTMPMVWYCPPLSPIMSYFEGQN

SEQ ID NO: 1834751 - protein, 22 aa, Staphylococcus epidermidis
EGKALFFVKGQYVAGAGGKASL

SEQ ID NO: 1834752 - protein, 25 aa, Staphylococcus epidermidis
EGYNLTFFAFFVKAVADALKAHPLL

SEQ ID NO: 1834753 - protein, 25 aa, Staphylococcus epidermidis
EGYNLTFFAFFVKAVAEALKVNPLL

SEQ ID NO: 1834754 - protein, 25 aa, Staphylococcus epidermidis
EHAVLHLLYARFWHKVLYDLGVVPT

SEQ ID NO: 1834755 - protein, 19 aa, Staphylococcus epidermidis
EHRLPFILFSASGGARMQE

SEQ ID NO: 1834756 - protein, 23 aa, Staphylococcus epidermidis
EIAPLFDKALPYYKQFIQEVAQF

SEQ ID NO: 1834757 - protein, 23 aa, Staphylococcus epidermidis
EIKKILIMPTWRDWLNSTYAFDN

SEQ ID NO: 1834758 - protein, 23 aa, Staphylococcus epidermidis
EIKTQMLEWILPYYKGLSKEGMK

SEQ ID NO: 1834759 - protein, 19 aa, Staphylococcus epidermidis
EKFYQLPKVFFTNPKYVNL

SEQ ID NO: 1834760 - protein, 21 aa, Staphylococcus epidermidis
EKGLYFKCHLPNTSYARDIYE

SEQ ID NO: 1834761 - protein, 24 aa, Staphylococcus epidermidis
EKIEWLIPFLNYSGPTIIYISSKK

SEQ ID NO: 1834762 - protein, 24 aa, Staphylococcus epidermidis
EKMKLPGIALYPETERFYPNGNFA

SEQ ID NO: 1834763 - protein, 22 aa, Staphylococcus epidermidis
EKPKARWLFLTLSTRNAIDGDT

SEQ ID NO: 1834764 - protein, 29 aa, Staphylococcus epidermidis
ELAAPVSHIWYFKGIPSRMGLLLDMSPRA

SEQ ID NO: 1834765 - protein, 19 aa, Staphylococcus epidermidis
ELFEQWFYPEGASVEVYQF

SEQ ID NO: 1834766 - protein, 24 aa, Staphylococcus epidermidis
ELHDLAFLLLVYPLSEYEGALDSA

SEQ ID NO: 1834767 - protein, 23 aa, Staphylococcus epidermidis
ELSFTLYKLFKRLRKLFIENTQE

SEQ ID NO: 1834768 - protein, 18 aa, Staphylococcus epidermidis
ELSRLYVYAHYKGLKSLY

SEQ ID NO: 1834769 - protein, 20 aa, Staphylococcus epidermidis
ELTRPARALKLWITLQVIGE

SEQ ID NO: 1834770 - protein, 22 aa, Staphylococcus epidermidis
EMHFYRYVFPYYDTLYTLEKLS

SEQ ID NO: 1834771 - protein, 18 aa, Staphylococcus epidermidis
EMIKFKIMLLEKGLKDIT

SEQ ID NO: 1834772 - protein, 20 aa, Staphylococcus epidermidis
ENQLLFILILHSFANVHVTR

SEQ ID NO: 1834773 - protein, 21 aa, Staphylococcus epidermidis
ENRLFYLAMSPKFFGVATNHL

SEQ ID NO: 1834774 - protein, 21 aa, Staphylococcus epidermidis
ENTLIPYFRKIEKRALFNQEK

SEQ ID NO: 1834775 - protein, 27 aa, Staphylococcus epidermidis
EPKNQGAWLFVYPYLKALVADRYDLSY

SEQ ID NO: 1834776 - protein, 17 aa, Staphylococcus epidermidis
EPKTQFYNLYRKGHLKL

SEQ ID NO: 1834777 - protein, 18 aa, Staphylococcus epidermidis
EPKTQFYNLYRKGHLKLP

SEQ ID NO: 1834778 - protein, 20 aa, Staphylococcus epidermidis
EPMVLPSRFPNLLVNGSTGI

SEQ ID NO: 1834779 - protein, 18 aa, Staphylococcus epidermidis
EPQIRLWDILQTKFKAKA

SEQ ID NO: 1834780 - protein, 22 aa, Staphylococcus epidermidis
EPQWMLNFRLKALKLFYKMPMP

SEQ ID NO: 1834781 - protein, 24 aa, Staphylococcus epidermidis
EQEQYIKYKLYFKKKIFGEIKDIP

SEQ ID NO: 1834782 - protein, 18 aa, Staphylococcus epidermidis
ERPCFYYYMLTLGTYEWK

SEQ ID NO: 1834783 - protein, 17 aa, Staphylococcus epidermidis
ERPEWNIIGLIGQVFIR

SEQ ID NO: 1834784 - protein, 20 aa, Staphylococcus epidermidis
ESFIDFYHKRLLIADKKPNI

SEQ ID NO: 1834785 - protein, 23 aa, Staphylococcus epidermidis
ESTFFDHQLLRRFVSFMYEKPST

SEQ ID NO: 1834786 - protein, 21 aa, Staphylococcus epidermidis
ESTFFDHQLLRRLVAFMYEKP

SEQ ID NO: 1834787 - protein, 22 aa, Staphylococcus epidermidis
ESTFFDHQLLRRLVAFMYEQPS

SEQ ID NO: 1834788 - protein, 17 aa, Staphylococcus epidermidis
ETGITFAGIPLGHEFNS

SEQ ID NO: 1834789 - protein, 26 aa, Staphylococcus epidermidis
ETSKDYLWTILIHRLQKWELNDKTYF

SEQ ID NO: 1834790 - protein, 17 aa, Staphylococcus epidermidis
EVSQMIKDRLARKKRNL

SEQ ID NO: 1834791 - protein, 17 aa, Staphylococcus epidermidis
EYFTPILNLGETGILGV

SEQ ID NO: 1834792 - protein, 18 aa, Staphylococcus epidermidis
EYLLFHYRFKSRITVWVL

SEQ ID NO: 1834793 - protein, 17 aa, Staphylococcus epidermidis
EYMIPRKFEWMEQLPLT

SEQ ID NO: 1834794 - protein, 28 aa, Staphylococcus epidermidis
EYQFFKEGLILFTYLHLANEEKLTQALV

SEQ ID NO: 1834795 - protein, 20 aa, Staphylococcus epidermidis
FAAAFITHFSGQTPHIHFDI

SEQ ID NO: 1834796 - protein, 24 aa, Staphylococcus epidermidis
FAHHVLTYFWMLERDKGRFEDSLK

SEQ ID NO: 1834797 - protein, 17 aa, Staphylococcus epidermidis
FAWDLNMGGLMNALEAA

SEQ ID NO: 1834798 - protein, 17 aa, Staphylococcus epidermidis
FCTFWGLNALKKIQSQR

SEQ ID NO: 1834799 - protein, 17 aa, Staphylococcus epidermidis
FDIVAFGKTAQLLNDYC

SEQ ID NO: 1834800 - protein, 17 aa, Staphylococcus epidermidis
FDRLFSQYGIRSHIDTV

SEQ ID NO: 1834801 - protein, 17 aa, Staphylococcus epidermidis
FEEMKHYFILNFPQRPG

SEQ ID NO: 1834802 - protein, 17 aa, Staphylococcus epidermidis
FELIRLFGKRGRGLYNK

SEQ ID NO: 1834803 - protein, 24 aa, Staphylococcus epidermidis
FEMHFYRYVFPYYDTLYTLEKLSK

SEQ ID NO: 1834804 - protein, 23 aa, Staphylococcus epidermidis
FENKPLYCLMPFSNTIKNKLEYL

SEQ ID NO: 1834805 - protein, 17 aa, Staphylococcus epidermidis
FERLFSQYGIRSHIDTV

SEQ ID NO: 1834806 - protein, 24 aa, Staphylococcus epidermidis
FERLRNYFFIKKPKRMKYINKFNE

SEQ ID NO: 1834807 - protein, 17 aa, Staphylococcus epidermidis
FGAFVEIAPAVQGLVHI

SEQ ID NO: 1834808 - protein, 17 aa, Staphylococcus epidermidis
FGIMYYKSIKTVDLSNY

SEQ ID NO: 1834809 - protein, 27 aa, Staphylococcus epidermidis
FHDKYEWLLEFFPFLDPQHFVFCGRKN

SEQ ID NO: 1834810 - protein, 27 aa, Staphylococcus epidermidis
FHDKYEWLLEFFPFLNPQHFVFCGRKN

SEQ ID NO: 1834811 - protein, 17 aa, Staphylococcus epidermidis
FIASFYYLKGQNFVVTH

SEQ ID NO: 1834812 - protein, 19 aa, Staphylococcus epidermidis
FIDKLKFPYFLGKSKYILV

SEQ ID NO: 1834813 - protein, 19 aa, Staphylococcus epidermidis
FINERIIPVIPQQGSLGAS

SEQ ID NO: 1834814 - protein, 17 aa, Staphylococcus epidermidis
FIRMTIKPLLNLIVTEL

SEQ ID NO: 1834815 - protein, 18 aa, Staphylococcus epidermidis
FITWDQVLHRLDLFGSGL

SEQ ID NO: 1834816 - protein, 18 aa, Staphylococcus epidermidis
FKDILINEYIYFASKNKK

SEQ ID NO: 1834817 - protein, 17 aa, Staphylococcus epidermidis
FKFMAPLNYKTITSRSI

SEQ ID NO: 1834818 - protein, 17 aa, Staphylococcus epidermidis
FKLMLHQGINLAPSKFE

SEQ ID NO: 1834819 - protein, 17 aa, Staphylococcus epidermidis
FKSYRLLRPLEGNTYKI

SEQ ID NO: 1834820 - protein, 19 aa, Staphylococcus epidermidis
FKYAYDMKLIRIMPSEGIK

SEQ ID NO: 1834821 - protein, 19 aa, Staphylococcus epidermidis
FLFTDIDFLPPVTPPNNVI

SEQ ID NO: 1834822 - protein, 23 aa, Staphylococcus epidermidis
FLGKLTIPLTIATTIFGVSYEKM

SEQ ID NO: 1834823 - protein, 20 aa, Staphylococcus epidermidis
FLNELFYLIELYLKAFKGQK

SEQ ID NO: 1834824 - protein, 17 aa, Staphylococcus epidermidis
FLRKRYETLRTLPMFDT

SEQ ID NO: 1834825 - protein, 17 aa, Staphylococcus epidermidis
FLSLIKVTGIGPKSALA

SEQ ID NO: 1834826 - protein, 23 aa, Staphylococcus epidermidis
FLTKDLFIDWIWGESFFKQKLID

SEQ ID NO: 1834827 - protein, 17 aa, Staphylococcus epidermidis
FLYAVLNYPIYAKGDAS

SEQ ID NO: 1834828 - protein, 17 aa, Staphylococcus epidermidis
FMTLINSKIPFYQTTTS

SEQ ID NO: 1834829 - protein, 23 aa, Staphylococcus epidermidis
FMTNIFGMMFLSQSAVPYLSEGD

SEQ ID NO: 1834830 - protein, 18 aa, Staphylococcus epidermidis
FNIDFEISFYRLLEFIEL

SEQ ID NO: 1834831 - protein, 21 aa, Staphylococcus epidermidis
FNSLAMPFIALYRMDTIGKGI

SEQ ID NO: 1834832 - protein, 17 aa, Staphylococcus epidermidis
FNYFSFLILVSESLSSG

SEQ ID NO: 1834833 - protein, 17 aa, Staphylococcus epidermidis
FPNSNYYILLWKLEVLD

SEQ ID NO: 1834834 - protein, 21 aa, Staphylococcus epidermidis
FPVRIKCATLAWKALEKGTVE

SEQ ID NO: 1834835 - protein, 22 aa, Staphylococcus epidermidis
FQNLILLFLESWYLRASFSQKF

SEQ ID NO: 1834836 - protein, 20 aa, Staphylococcus epidermidis
FRKLNIEWVYRVLIDWKRIG

SEQ ID NO: 1834837 - protein, 18 aa, Staphylococcus epidermidis
FRPQLRALLRASAYGKLN

SEQ ID NO: 1834838 - protein, 18 aa, Staphylococcus epidermidis
FSNPELLFPLLNDTFHLP

SEQ ID NO: 1834839 - protein, 18 aa, Staphylococcus epidermidis
FSNYRPQFYFRTTDVTGV

SEQ ID NO: 1834840 - protein, 18 aa, Staphylococcus epidermidis
FTALPGWVRKSAIALTIL

SEQ ID NO: 1834841 - protein, 22 aa, Staphylococcus epidermidis
FTYTFLGFLPRKEKEKIEVLDD

SEQ ID NO: 1834842 - protein, 22 aa, Staphylococcus epidermidis
FTYTFLGFLPRKEKEKIEVLED

SEQ ID NO: 1834843 - protein, 18 aa, Staphylococcus epidermidis
FVINFYRQVERWLNRKIR

SEQ ID NO: 1834844 - protein, 17 aa, Staphylococcus epidermidis
FVLFYKYEIDISEKYLE

SEQ ID NO: 1834845 - protein, 17 aa, Staphylococcus epidermidis
FYAYLKSVKVKKVAVIG

SEQ ID NO: 1834846 - protein, 17 aa, Staphylococcus epidermidis
FYITYLSRNLKEYRKYY

SEQ ID NO: 1834847 - protein, 25 aa, Staphylococcus epidermidis
GADNLTIDSGFYKTPKYSVGDYVWE

SEQ ID NO: 1834848 - protein, 19 aa, Staphylococcus epidermidis
GAVDFIWNPPYIPGNRLGE

SEQ ID NO: 1834849 - protein, 19 aa, Staphylococcus epidermidis
GDLDYLLLDLPPGTGDVAL

SEQ ID NO: 1834850 - protein, 24 aa, Staphylococcus epidermidis
GDSQIMNWLPYVKTLAERNKLYPN

SEQ ID NO: 1834851 - protein, 23 aa, Staphylococcus epidermidis
GEIDKWVSLLNDLKIASPILENH

SEQ ID NO: 1834852 - protein, 17 aa, Staphylococcus epidermidis
GFKHVYPYMLQFIDQLP

SEQ ID NO: 1834853 - protein, 24 aa, Staphylococcus epidermidis
GGIPDTGFYRFWIQGIFARWPKNP

SEQ ID NO: 1834854 - protein, 24 aa, Staphylococcus epidermidis
GGKRPLICFFSNDLNIHRTKTEKA

SEQ ID NO: 1834855 - protein, 17 aa, Staphylococcus epidermidis
GHQIRWRLLYIANPDYT

SEQ ID NO: 1834856 - protein, 22 aa, Staphylococcus epidermidis
GIFKGLPLYFNVMRYHSLMADP

SEQ ID NO: 1834857 - protein, 26 aa, Staphylococcus epidermidis
GKDVTIFFTFWGLNALKKAQSTRVKK

SEQ ID NO: 1834858 - protein, 22 aa, Staphylococcus epidermidis
GKRIRPVLLLLTLNMLKGDYDK

SEQ ID NO: 1834859 - protein, 19 aa, Staphylococcus epidermidis
GLFGGPLYTFHKIFSIIIL

SEQ ID NO: 1834860 - protein, 18 aa, Staphylococcus epidermidis
GLFGGPLYTFHKIFSIVT

SEQ ID NO: 1834861 - protein, 25 aa, Staphylococcus epidermidis
GLIYFDGRYYISHQWFPLGAVHGLK

SEQ ID NO: 1834862 - protein, 25 aa, Staphylococcus epidermidis
GLIYYKGYYYISHQWFPLGAVHGLK

SEQ ID NO: 1834863 - protein, 24 aa, Staphylococcus epidermidis
GLQGNRLFYLAMAPQFFGVISDFL

SEQ ID NO: 1834864 - protein, 17 aa, Staphylococcus epidermidis
GLRFFTVYGPWGRPDMA

SEQ ID NO: 1834865 - protein, 22 aa, Staphylococcus epidermidis
GLRVYWYYDLIDNEIKIVCIDP

SEQ ID NO: 1834866 - protein, 23 aa, Staphylococcus epidermidis
GMLQRLMIALALALKPKLIIADE

SEQ ID NO: 1834867 - protein, 18 aa, Staphylococcus epidermidis
GNAKQAIDNPLPKGWKII

SEQ ID NO: 1834868 - protein, 24 aa, Staphylococcus epidermidis
GNTDAMIKYLLPKATVVTPNLFEA

SEQ ID NO: 1834869 - protein, 18 aa, Staphylococcus epidermidis
GPIYAGYIPLIETLGGNP

SEQ ID NO: 1834870 - protein, 18 aa, Staphylococcus epidermidis
GPLDLLLHLIQKFEIDIY

SEQ ID NO: 1834871 - protein, 25 aa, Staphylococcus epidermidis
GQTFLETFLAPTKLYVKPILELKKH

SEQ ID NO: 1834872 - protein, 25 aa, Staphylococcus epidermidis
GRDVTIFFTFWGLNALKKAQTVNVK

SEQ ID NO: 1834873 - protein, 20 aa, Staphylococcus epidermidis
GRECKFIAVKLPYGIQKDAD

SEQ ID NO: 1834874 - protein, 23 aa, Staphylococcus epidermidis
GRHELLDSVFLWQSGNKYRVSAH

SEQ ID NO: 1834875 - protein, 20 aa, Staphylococcus epidermidis
GSEEIIYLGGPRSDLRNAIE

SEQ ID NO: 1834876 - protein, 22 aa, Staphylococcus epidermidis
GSLKMLLSYQFPLILGNDFAGE

SEQ ID NO: 1834877 - protein, 23 aa, Staphylococcus epidermidis
GTLYVLQAALPYLLNQSSGHIIN

SEQ ID NO: 1834878 - protein, 23 aa, Staphylococcus epidermidis
GTNYPYVDYLPKKNIKAIQIDTN

SEQ ID NO: 1834879 - protein, 24 aa, Staphylococcus epidermidis
GVKIYDVFTILYLLSPQAFNVIEA

SEQ ID NO: 1834880 - protein, 19 aa, Staphylococcus epidermidis
GYKLKCKCLFPFDANVPFI

SEQ ID NO: 1834881 - protein, 18 aa, Staphylococcus epidermidis
GYYLVYLFHPEGEGIYLS

SEQ ID NO: 1834882 - protein, 23 aa, Staphylococcus epidermidis
HAEDLFHLDLAYAPPFSTTKDPV

SEQ ID NO: 1834883 - protein, 17 aa, Staphylococcus epidermidis
HDNPLIRTIPVGSLNKL

SEQ ID NO: 1834884 - protein, 23 aa, Staphylococcus epidermidis
HEIFIKYLKIFQLPYKNKIKTFS

SEQ ID NO: 1834885 - protein, 17 aa, Staphylococcus epidermidis
HFSKIYLFSPNLDKITD

SEQ ID NO: 1834886 - protein, 19 aa, Staphylococcus epidermidis
HFSKIYLFSPNLDKITDFR

SEQ ID NO: 1834887 - protein, 18 aa, Staphylococcus epidermidis
HGDHIFGLPGLLTSRSFQ

SEQ ID NO: 1834888 - protein, 17 aa, Staphylococcus epidermidis
HHLPFILFSASGGARMQ

SEQ ID NO: 1834889 - protein, 17 aa, Staphylococcus epidermidis
HHYLWRFAKKMPKSGHI

SEQ ID NO: 1834890 - protein, 18 aa, Staphylococcus epidermidis
HIAFLLPTRRDLANFLYH

SEQ ID NO: 1834891 - protein, 21 aa, Staphylococcus epidermidis
HILNIYFPFIDVETMLTLLDL

SEQ ID NO: 1834892 - protein, 22 aa, Staphylococcus epidermidis
HILNLYFPFIDVETMLTLLDLA

SEQ ID NO: 1834893 - protein, 17 aa, Staphylococcus epidermidis
HIQKLFLLIFQLPEHLA

SEQ ID NO: 1834894 - protein, 18 aa, Staphylococcus epidermidis
HIQRILMTILLNIKSQDV

SEQ ID NO: 1834895 - protein, 18 aa, Staphylococcus epidermidis
HLLIQWYSKGIYKFRYNV

SEQ ID NO: 1834896 - protein, 24 aa, Staphylococcus epidermidis
HPDLDTWVIFPWTAGQGKVARLIC

SEQ ID NO: 1834897 - protein, 23 aa, Staphylococcus epidermidis
HSRSHHLLTTDLFLNVFGIENLD

SEQ ID NO: 1834898 - protein, 18 aa, Staphylococcus epidermidis
HTLFPKYDFFRADTDYAD

SEQ ID NO: 1834899 - protein, 19 aa, Staphylococcus epidermidis
HVRQFIRLSRYFVDTLRKS

SEQ ID NO: 1834900 - protein, 18 aa, Staphylococcus epidermidis
HYFKRLFSQYGIRSHIDT

SEQ ID NO: 1834901 - protein, 18 aa, Staphylococcus epidermidis
HYQAKILLLAWNRYLTQT

SEQ ID NO: 1834902 - protein, 19 aa, Staphylococcus epidermidis
IATELLWFIKGDTNIQYLL

SEQ ID NO: 1834903 - protein, 21 aa, Staphylococcus epidermidis
IDALSYYQFYILKLVVGEKRI

SEQ ID NO: 1834904 - protein, 25 aa, Staphylococcus epidermidis
IDKDGYIYFTPIGGWWNQVMLSQKV

SEQ ID NO: 1834905 - protein, 18 aa, Staphylococcus epidermidis
IDKLKFPYFLGKSKYILV

SEQ ID NO: 1834906 - protein, 18 aa, Staphylococcus epidermidis
IDLFLIHWPCEKDGLFIE

SEQ ID NO: 1834907 - protein, 18 aa, Staphylococcus epidermidis
IDLYFKYNLKKYTAMKIT

SEQ ID NO: 1834908 - protein, 23 aa, Staphylococcus epidermidis
IDRTQLILEIFALRARSREGKLH

SEQ ID NO: 1834909 - protein, 21 aa, Staphylococcus epidermidis
IDSLSYYQFYILKLVVGEQRI

SEQ ID NO: 1834910 - protein, 18 aa, Staphylococcus epidermidis
IDYYYRFIHRFPTIQSLS

SEQ ID NO: 1834911 - protein, 18 aa, Staphylococcus epidermidis
IDYYYRFIHRFPTVASLS

SEQ ID NO: 1834912 - protein, 22 aa, Staphylococcus epidermidis
IEECKNLKWIAWYATGVNNLPL

SEQ ID NO: 1834913 - protein, 23 aa, Staphylococcus epidermidis
IEGRDWEFLYYSPELESLPKDES

SEQ ID NO: 1834914 - protein, 20 aa, Staphylococcus epidermidis
IEIDIAFTSLLTRALETTQH

SEQ ID NO: 1834915 - protein, 24 aa, Staphylococcus epidermidis
IEKRDDFLTWFPQKELFVKASKKI

SEQ ID NO: 1834916 - protein, 18 aa, Staphylococcus epidermidis
IELGIPEHLVWRQPFPGP

SEQ ID NO: 1834917 - protein, 17 aa, Staphylococcus epidermidis
IELLSRLGIQLNLPDLT

SEQ ID NO: 1834918 - protein, 18 aa, Staphylococcus epidermidis
IELLSRLGIQLNLPDLTF

SEQ ID NO: 1834919 - protein, 17 aa, Staphylococcus epidermidis
IEMVLSWKLNRISRSMR

SEQ ID NO: 1834920 - protein, 23 aa, Staphylococcus epidermidis
IENRPMMYLALSYDHRIIDGKEA

SEQ ID NO: 1834921 - protein, 26 aa, Staphylococcus epidermidis
IEVPMDLLPYLFFQFAKDGKRLYSDN

SEQ ID NO: 1834922 - protein, 20 aa, Staphylococcus epidermidis
IFKNIRYIGIFNPRLNRIYT

SEQ ID NO: 1834923 - protein, 17 aa, Staphylococcus epidermidis
IFNFPFYFRGEVYDPFE

SEQ ID NO: 1834924 - protein, 17 aa, Staphylococcus epidermidis
IFNYFKPNFLLGMTATP

SEQ ID NO: 1834925 - protein, 17 aa, Staphylococcus epidermidis
IFPLFMYSKGNINLLDF

SEQ ID NO: 1834926 - protein, 25 aa, Staphylococcus epidermidis
IFQKLNIEWVFRLLIDWKRIGRMVS

SEQ ID NO: 1834927 - protein, 21 aa, Staphylococcus epidermidis
IGPLVKLWKIGFKDALKPKEE

SEQ ID NO: 1834928 - protein, 22 aa, Staphylococcus epidermidis
IGPLVKLWKIGFKDALKPKEVD

SEQ ID NO: 1834929 - protein, 24 aa, Staphylococcus epidermidis
IGTAPYWHPVLLKNHLKRMSDEQM

SEQ ID NO: 1834930 - protein, 17 aa, Staphylococcus epidermidis
IGYWLETEINRALSEIG

SEQ ID NO: 1834931 - protein, 23 aa, Staphylococcus epidermidis
IHCDQLIILTAIDYVYINYHTDK

SEQ ID NO: 1834932 - protein, 24 aa, Staphylococcus epidermidis
IIKRHRLLELFLIEILHYNWEEVH

SEQ ID NO: 1834933 - protein, 26 aa, Staphylococcus epidermidis
IIKYVQMKWRCPIIFYTCIRENDENY

SEQ ID NO: 1834934 - protein, 24 aa, Staphylococcus epidermidis
IINNSYFSWLPLLNIDKLINLDKI

SEQ ID NO: 1834935 - protein, 24 aa, Staphylococcus epidermidis
IKASRLNFTIIKPSFFMDNFLRIT

SEQ ID NO: 1834936 - protein, 26 aa, Staphylococcus epidermidis
IKDKKALFIVYANPLALGLLTPPGAF

SEQ ID NO: 1834937 - protein, 20 aa, Staphylococcus epidermidis
IKEIYFWGFSLSDVDKPYIE

SEQ ID NO: 1834938 - protein, 22 aa, Staphylococcus epidermidis
IKEWHRILPLIQELPIAALDMG

SEQ ID NO: 1834939 - protein, 23 aa, Staphylococcus epidermidis
IKSTMVGTFFLQDSKELTDPQIK

SEQ ID NO: 1834940 - protein, 26 aa, Staphylococcus epidermidis
IKVQDVMFLLLYALKDLGARLNMDPV

SEQ ID NO: 1834941 - protein, 18 aa, Staphylococcus epidermidis
ILDVLLNEKLVPGDMLYV

SEQ ID NO: 1834942 - protein, 18 aa, Staphylococcus epidermidis
ILDVLLNEKLVSGDMLYV

SEQ ID NO: 1834943 - protein, 18 aa, Staphylococcus epidermidis
ILENLGVQLLPNTKIKQL

SEQ ID NO: 1834944 - protein, 20 aa, Staphylococcus epidermidis
ILKAKRIILLAFGPKKKEAI

SEQ ID NO: 1834945 - protein, 24 aa, Staphylococcus epidermidis
ILKAKRIILLAFGPKKKEAISKLL

SEQ ID NO: 1834946 - protein, 18 aa, Staphylococcus epidermidis
ILNKSIIKLLPDKISKIT

SEQ ID NO: 1834947 - protein, 20 aa, Staphylococcus epidermidis
ILYDRLVNPLILQYAPPHTE

SEQ ID NO: 1834948 - protein, 23 aa, Staphylococcus epidermidis
INELAWHNLFAHNMFIRPDSKEE

SEQ ID NO: 1834949 - protein, 22 aa, Staphylococcus epidermidis
INKLLDLPFGKCHFALAAKPET

SEQ ID NO: 1834950 - protein, 24 aa, Staphylococcus epidermidis
INKLLDLPFGKCHFALAAKPETSC

SEQ ID NO: 1834951 - protein, 17 aa, Staphylococcus epidermidis
INKYIKMQSAQLAKIPL

SEQ ID NO: 1834952 - protein, 24 aa, Staphylococcus epidermidis
INNEPLLMDIAKTPHALIAGATGS

SEQ ID NO: 1834953 - protein, 23 aa, Staphylococcus epidermidis
INNYVYFDLYYKAAFMVDLYEYN

SEQ ID NO: 1834954 - protein, 19 aa, Staphylococcus epidermidis
INTLFFRRLFEAALKERQY

SEQ ID NO: 1834955 - protein, 17 aa, Staphylococcus epidermidis
IPKYLYYKLSQIDFNYY

SEQ ID NO: 1834956 - protein, 22 aa, Staphylococcus epidermidis
IQCDQLIILTAIDYVYVNYNTE

SEQ ID NO: 1834957 - protein, 17 aa, Staphylococcus epidermidis
IQFLLIELSYLKKPKLD

SEQ ID NO: 1834958 - protein, 17 aa, Staphylococcus epidermidis
IQNVWYYKLVDVYDITQ

SEQ ID NO: 1834959 - protein, 20 aa, Staphylococcus epidermidis
IQRVLYLFSGFHRSILPLKL

SEQ ID NO: 1834960 - protein, 22 aa, Staphylococcus epidermidis
IRALIYGVWLLSWSKIKLSESS

SEQ ID NO: 1834961 - protein, 26 aa, Staphylococcus epidermidis
IREGMLKDVLPIAFPFTPNVDVAGKI

SEQ ID NO: 1834962 - protein, 18 aa, Staphylococcus epidermidis
IRMSLFTSLFILHNINRN

SEQ ID NO: 1834963 - protein, 17 aa, Staphylococcus epidermidis
ISNPFYIGKIQFAKYRH

SEQ ID NO: 1834964 - protein, 20 aa, Staphylococcus epidermidis
ITMEDALFNFQWLAATQGVK

SEQ ID NO: 1834965 - protein, 17 aa, Staphylococcus epidermidis
IVRLLDPPLHEFLPSSD

SEQ ID NO: 1834966 - protein, 25 aa, Staphylococcus epidermidis
IYEFLTLRIPMLLIPLGLDQSRGDQ

SEQ ID NO: 1834967 - protein, 18 aa, Staphylococcus epidermidis
IYIDWSFLLEYMKYVNKF

SEQ ID NO: 1834968 - protein, 23 aa, Staphylococcus epidermidis
IYKLKNIYYLRISTLPLSLGNES

SEQ ID NO: 1834969 - protein, 17 aa, Staphylococcus epidermidis
IYPIFKQLGLDTYIDVV

SEQ ID NO: 1834970 - protein, 17 aa, Staphylococcus epidermidis
IYTFPYLRKNHMTIKYQ

SEQ ID NO: 1834971 - protein, 21 aa, Staphylococcus epidermidis
IYYLDGPLDLTFLFGLVDHLS

SEQ ID NO: 1834972 - protein, 21 aa, Staphylococcus epidermidis
KAIQALLLWLNQHHFDYSSIA

SEQ ID NO: 1834973 - protein, 22 aa, Staphylococcus epidermidis
KAKSLACQFAFYGHTHIAKYEN

SEQ ID NO: 1834974 - protein, 17 aa, Staphylococcus epidermidis
KAYQLLLDLGFSRDIMS

SEQ ID NO: 1834975 - protein, 22 aa, Staphylococcus epidermidis
KCKDFLVHRLVAFAFIPAVVGK

SEQ ID NO: 1834976 - protein, 22 aa, Staphylococcus epidermidis
KCKRAIILPNNKNILMASEQAA

SEQ ID NO: 1834977 - protein, 23 aa, Staphylococcus epidermidis
KDARNYLSYLYSNNLKRTTVSRK

SEQ ID NO: 1834978 - protein, 18 aa, Staphylococcus epidermidis
KDGRLFICYLGDFKTTGG

SEQ ID NO: 1834979 - protein, 23 aa, Staphylococcus epidermidis
KDLVETVLPYQPLFIKPNKDELE

SEQ ID NO: 1834980 - protein, 25 aa, Staphylococcus epidermidis
KEDFINLILLFLETWYFRASFSQKF

SEQ ID NO: 1834981 - protein, 17 aa, Staphylococcus epidermidis
KEEPQWMLNFRLKALKL

SEQ ID NO: 1834982 - protein, 19 aa, Staphylococcus epidermidis
KEFVKNLMFFSISAPRNKN

SEQ ID NO: 1834983 - protein, 21 aa, Staphylococcus epidermidis
KEGNFLFYEQFFITLGRGGGK

SEQ ID NO: 1834984 - protein, 22 aa, Staphylococcus epidermidis
KEINPFLGYRAIRLCLAQPEIF

SEQ ID NO: 1834985 - protein, 18 aa, Staphylococcus epidermidis
KFPFLMFGPGNGPHQINE

SEQ ID NO: 1834986 - protein, 25 aa, Staphylococcus epidermidis
KFTEKWYFPLQSFQKFIVPFVFLFE

SEQ ID NO: 1834987 - protein, 18 aa, Staphylococcus epidermidis
KFVLFYKYEIDISEKYLE

SEQ ID NO: 1834988 - protein, 18 aa, Staphylococcus epidermidis
KFYQLPKVFFTNPKYTKL

SEQ ID NO: 1834989 - protein, 18 aa, Staphylococcus epidermidis
KFYQLPKVFFTNPKYVNL

SEQ ID NO: 1834990 - protein, 25 aa, Staphylococcus epidermidis
KGHQLRWRLLYIANPDYRVKPPFFI

SEQ ID NO: 1834991 - protein, 24 aa, Staphylococcus epidermidis
KGIAKLFDFMLPNSPIKMPISKMN

SEQ ID NO: 1834992 - protein, 25 aa, Staphylococcus epidermidis
KGIAKLFDFMLPNSPIKMTISKMNM

SEQ ID NO: 1834993 - protein, 25 aa, Staphylococcus epidermidis
KGIAKMFDFMLPKTSLKMPLSKMNM

SEQ ID NO: 1834994 - protein, 20 aa, Staphylococcus epidermidis
KGLFIVPLNGFKKWLTPVEM

SEQ ID NO: 1834995 - protein, 19 aa, Staphylococcus epidermidis
KGPLPFLQLTHFLLKFGEF

SEQ ID NO: 1834996 - protein, 22 aa, Staphylococcus epidermidis
KGPNIKLPSFDLLEEPEPHEIN

SEQ ID NO: 1834997 - protein, 20 aa, Staphylococcus epidermidis
KGRGFVKWLAFKTIPEQYQQ

SEQ ID NO: 1834998 - protein, 21 aa, Staphylococcus epidermidis
KIEWLLPFLSNSGPTIIYVSS

SEQ ID NO: 1834999 - protein, 19 aa, Staphylococcus epidermidis
KIKMLNLFNFLLLSECFNN

SEQ ID NO: 1835000 - protein, 17 aa, Staphylococcus epidermidis
KIMLLEKGLKDITLDDI

SEQ ID NO: 1835001 - protein, 18 aa, Staphylococcus epidermidis
KINAPLVEGSFTAAVKLS

SEQ ID NO: 1835002 - protein, 20 aa, Staphylococcus epidermidis
KKFFELYTPLLRKGGLVVTD

SEQ ID NO: 1835003 - protein, 24 aa, Staphylococcus epidermidis
KKNDLYYLYFYIKSMKKYIEDLGS

SEQ ID NO: 1835004 - protein, 22 aa, Staphylococcus epidermidis
KKSLFHYLLLNMRYNRLDVAET

SEQ ID NO: 1835005 - protein, 18 aa, Staphylococcus epidermidis
KLEELKQGVLYPYTTNEE

SEQ ID NO: 1835006 - protein, 20 aa, Staphylococcus epidermidis
KLGKYPPYYFLINFTISHKE

SEQ ID NO: 1835007 - protein, 19 aa, Staphylococcus epidermidis
KLKFLSFLLEDNSLIILDE

SEQ ID NO: 1835008 - protein, 18 aa, Staphylococcus epidermidis
KLKHWLPVDLYIGGVEHA

SEQ ID NO: 1835009 - protein, 22 aa, Staphylococcus epidermidis
KLSKPFYLGFEKGLNAISGIPF

SEQ ID NO: 1835010 - protein, 29 aa, Staphylococcus epidermidis
KLTLENYVLIYYLEKIIFQANQRLLQMSG

SEQ ID NO: 1835011 - protein, 19 aa, Staphylococcus epidermidis
KLYKFFLLIAKYIKRKEAF

SEQ ID NO: 1835012 - protein, 27 aa, Staphylococcus epidermidis
KNERLMEGLLAIPLPGASFLKSTGKSM

SEQ ID NO: 1835013 - protein, 19 aa, Staphylococcus epidermidis
KNFRDIFNKIAWLNKGKME

SEQ ID NO: 1835014 - protein, 20 aa, Staphylococcus epidermidis
KNIYPIFNQLGLDTYIDVVV

SEQ ID NO: 1835015 - protein, 23 aa, Staphylococcus epidermidis
KNTPDSWYFSKRLLYGKLDEIKE

SEQ ID NO: 1835016 - protein, 17 aa, Staphylococcus epidermidis
KNYRIYFEPLIKKNDKE

SEQ ID NO: 1835017 - protein, 17 aa, Staphylococcus epidermidis
KPHVIFIDYLTLMQSDV

SEQ ID NO: 1835018 - protein, 17 aa, Staphylococcus epidermidis
KPPVFFLKDGKAREVIK

SEQ ID NO: 1835019 - protein, 17 aa, Staphylococcus epidermidis
KPSFFMDNFLRITKVEN

SEQ ID NO: 1835020 - protein, 23 aa, Staphylococcus epidermidis
KQLEDWIWTYRRKGLYKTCKHCN

SEQ ID NO: 1835021 - protein, 18 aa, Staphylococcus epidermidis
KQLVARGFTVKVPPEYLG

SEQ ID NO: 1835022 - protein, 24 aa, Staphylococcus epidermidis
KREIQFDIIFLDPPYKKGLIDEAI

SEQ ID NO: 1835023 - protein, 18 aa, Staphylococcus epidermidis
KRFTLNMLYPYIDEILIT

SEQ ID NO: 1835024 - protein, 17 aa, Staphylococcus epidermidis
KRGHDIFLDLKLHDIPN

SEQ ID NO: 1835025 - protein, 21 aa, Staphylococcus epidermidis
KRIRPVILLLTLKMLNKDYQQ

SEQ ID NO: 1835026 - protein, 22 aa, Staphylococcus epidermidis
KRWGLFGYCRYIPYLKKRLNNK

SEQ ID NO: 1835027 - protein, 22 aa, Staphylococcus epidermidis
KSAKYVGLIPRFSRIFLGDKEF

SEQ ID NO: 1835028 - protein, 19 aa, Staphylococcus epidermidis
KTKINIFLFSCSTLIYPQP

SEQ ID NO: 1835029 - protein, 22 aa, Staphylococcus epidermidis
KTSGIFFMIKGDEQYIFGDCAI

SEQ ID NO: 1835030 - protein, 23 aa, Staphylococcus epidermidis
KVDERLWLLNRAGKIPFVVSGQG

SEQ ID NO: 1835031 - protein, 22 aa, Staphylococcus epidermidis
KVNPGDFYFIPAGTIHSIGAGI

SEQ ID NO: 1835032 - protein, 23 aa, Staphylococcus epidermidis
KVSMIFQHFNLLWSRTVLKNITF

SEQ ID NO: 1835033 - protein, 17 aa, Staphylococcus epidermidis
KWIIQIAYDTLIIMAKS

SEQ ID NO: 1835034 - protein, 17 aa, Staphylococcus epidermidis
KYFYAYLKSVKVKKVAV

SEQ ID NO: 1835035 - protein, 18 aa, Staphylococcus epidermidis
KYIIFYIAYHDEDRILVS

SEQ ID NO: 1835036 - protein, 18 aa, Staphylococcus epidermidis
KYLMNRLVGFTRKILGVL

SEQ ID NO: 1835037 - protein, 24 aa, Staphylococcus epidermidis
LAVNGLKLAFRGLLAATGVGLAIT

SEQ ID NO: 1835038 - protein, 22 aa, Staphylococcus epidermidis
LDDGLFYKFFFSYNPPKRKQSW

SEQ ID NO: 1835039 - protein, 23 aa, Staphylococcus epidermidis
LDDGLFYKFFFSYNPPKRKQSWV

SEQ ID NO: 1835040 - protein, 22 aa, Staphylococcus epidermidis
LDKYYYCLLALDTGVRAEALNK

SEQ ID NO: 1835041 - protein, 25 aa, Staphylococcus epidermidis
LDNGLKLFIIPKPGFQKTFVTYTTQ

SEQ ID NO: 1835042 - protein, 21 aa, Staphylococcus epidermidis
LDTEILWKMHFGLYPTPIKRL

SEQ ID NO: 1835043 - protein, 17 aa, Staphylococcus epidermidis
LDVFLKFKFENSDLLNC

SEQ ID NO: 1835044 - protein, 17 aa, Staphylococcus epidermidis
LDYLGLSRFITDSLGVC

SEQ ID NO: 1835045 - protein, 22 aa, Staphylococcus epidermidis
LDYSKIYLFNPNLDKITIFRDE

SEQ ID NO: 1835046 - protein, 17 aa, Staphylococcus epidermidis
LEELKQGVLYPYTTNEE

SEQ ID NO: 1835047 - protein, 19 aa, Staphylococcus epidermidis
LENLWRVTSLNQAITLGID

SEQ ID NO: 1835048 - protein, 17 aa, Staphylococcus epidermidis
LFCGECGHKISRHPQSV

SEQ ID NO: 1835049 - protein, 17 aa, Staphylococcus epidermidis
LFLLLAKENWHEGVLGI

SEQ ID NO: 1835050 - protein, 20 aa, Staphylococcus epidermidis
LFTCLRPVRWFQGVPSPVKR

SEQ ID NO: 1835051 - protein, 20 aa, Staphylococcus epidermidis
LFTTQLLFQFLFSQGRLTDA

SEQ ID NO: 1835052 - protein, 17 aa, Staphylococcus epidermidis
LGTFALSSGYYDAFYKK

SEQ ID NO: 1835053 - protein, 17 aa, Staphylococcus epidermidis
LIDKLAFTPHFNKVYVT

SEQ ID NO: 1835054 - protein, 18 aa, Staphylococcus epidermidis
LIIDLMNPAFFYKNFEEQ

SEQ ID NO: 1835055 - protein, 17 aa, Staphylococcus epidermidis
LILQAMLVSLQTIEEEY

SEQ ID NO: 1835056 - protein, 18 aa, Staphylococcus epidermidis
LILYVTYFNHSFTDNDKA

SEQ ID NO: 1835057 - protein, 19 aa, Staphylococcus epidermidis
LINKYLKMQSAQLAKIPLI

SEQ ID NO: 1835058 - protein, 19 aa, Staphylococcus epidermidis
LIPDSIFPLFMYSKGNINL

SEQ ID NO: 1835059 - protein, 18 aa, Staphylococcus epidermidis
LIPKFNLFIALGIRDAIQ

SEQ ID NO: 1835060 - protein, 18 aa, Staphylococcus epidermidis
LIPYFKKIEKRALFNQEK

SEQ ID NO: 1835061 - protein, 19 aa, Staphylococcus epidermidis
LIQPTFIYGHPIEISPLAK

SEQ ID NO: 1835062 - protein, 18 aa, Staphylococcus epidermidis
LISLFKMTKLFLKEKPLI

SEQ ID NO: 1835063 - protein, 21 aa, Staphylococcus epidermidis
LKELLAKWLFKYENQFPIYAS

SEQ ID NO: 1835064 - protein, 21 aa, Staphylococcus epidermidis
LKGTDVLVCTVIGFPLGATTT

SEQ ID NO: 1835065 - protein, 20 aa, Staphylococcus epidermidis
LKLIHQWINGRMPLIGIGSV

SEQ ID NO: 1835066 - protein, 18 aa, Staphylococcus epidermidis
LKLLNDLAMIFLKAAHEE

SEQ ID NO: 1835067 - protein, 18 aa, Staphylococcus epidermidis
LKPIFRDYLLKLAQENQI

SEQ ID NO: 1835068 - protein, 20 aa, Staphylococcus epidermidis
LKVSIYFYFAPPKSWTKNQK

SEQ ID NO: 1835069 - protein, 20 aa, Staphylococcus epidermidis
LLDRFLVIAHSYHLEPRILI

SEQ ID NO: 1835070 - protein, 18 aa, Staphylococcus epidermidis
LLFRHFYATSLHNQFMYN

SEQ ID NO: 1835071 - protein, 19 aa, Staphylococcus epidermidis
LLKLLIQKLIFRVREKHST

SEQ ID NO: 1835072 - protein, 20 aa, Staphylococcus epidermidis
LLSILKLPHNIMSLMLEYLR

SEQ ID NO: 1835073 - protein, 17 aa, Staphylococcus epidermidis
LNERLLNMIGVHTVSID

SEQ ID NO: 1835074 - protein, 21 aa, Staphylococcus epidermidis
LNQYDYLIKRYLLNIERENDI

SEQ ID NO: 1835075 - protein, 17 aa, Staphylococcus epidermidis
LNSIERLKAAKAKADKF

SEQ ID NO: 1835076 - protein, 20 aa, Staphylococcus epidermidis
LPESLNFISWLQHLQENGIA

SEQ ID NO: 1835077 - protein, 17 aa, Staphylococcus epidermidis
LPGWVRKSAIALTILTA

SEQ ID NO: 1835078 - protein, 18 aa, Staphylococcus epidermidis
LQDGLLFKGIHKLFNGIH

SEQ ID NO: 1835079 - protein, 19 aa, Staphylococcus epidermidis
LQYQIIYILSKILDKHPLP

SEQ ID NO: 1835080 - protein, 25 aa, Staphylococcus epidermidis
LRLQKTLYFLFAYYGASYGQLSKSK

SEQ ID NO: 1835081 - protein, 19 aa, Staphylococcus epidermidis
LRQLHYPIKFVFLDFIQSE

SEQ ID NO: 1835082 - protein, 24 aa, Staphylococcus epidermidis
LSALQLWLLRIHYLDQPHFYPSIE

SEQ ID NO: 1835083 - protein, 21 aa, Staphylococcus epidermidis
LSRQFLYTMLTRTINQCFLFA

SEQ ID NO: 1835084 - protein, 19 aa, Staphylococcus epidermidis
LTCEGILWNKWDDAVEILQ

SEQ ID NO: 1835085 - protein, 17 aa, Staphylococcus epidermidis
LTEAKIKADKFIKQLDA

SEQ ID NO: 1835086 - protein, 19 aa, Staphylococcus epidermidis
LTGYIYTFPYLRKNHMTIK

SEQ ID NO: 1835087 - protein, 20 aa, Staphylococcus epidermidis
LTIKTLMRLIKDIYMQLTRN

SEQ ID NO: 1835088 - protein, 22 aa, Staphylococcus epidermidis
LTNYYLYFLVDSNIEIGIKSII

SEQ ID NO: 1835089 - protein, 19 aa, Staphylococcus epidermidis
LTRDQHRLYKLIWERFVAS

SEQ ID NO: 1835090 - protein, 18 aa, Staphylococcus epidermidis
LVEELVEFLWSSVAGNEH

SEQ ID NO: 1835091 - protein, 18 aa, Staphylococcus epidermidis
LVFYHLKLDSKYASIFGL

SEQ ID NO: 1835092 - protein, 17 aa, Staphylococcus epidermidis
LVKFLKPVQNEWSGMTV

SEQ ID NO: 1835093 - protein, 17 aa, Staphylococcus epidermidis
LVKFLKRKNLLYTYQNF

SEQ ID NO: 1835094 - protein, 19 aa, Staphylococcus epidermidis
LVMGPLLARLGHAIVALPG

SEQ ID NO: 1835095 - protein, 17 aa, Staphylococcus epidermidis
LVPLLTAAQRLLALGIT

SEQ ID NO: 1835096 - protein, 19 aa, Staphylococcus epidermidis
LVSRLIFDFSFYYSKLKHE

SEQ ID NO: 1835097 - protein, 24 aa, Staphylococcus epidermidis
LVTKFLLPLMMKQGGSIINTASFS

SEQ ID NO: 1835098 - protein, 17 aa, Staphylococcus epidermidis
LYDIGAVGMRLLTKYMN

SEQ ID NO: 1835099 - protein, 21 aa, Staphylococcus epidermidis
LYLDTATGVAYRFLKKGTTSP

SEQ ID NO: 1835100 - protein, 17 aa, Staphylococcus epidermidis
LYTDDIYLQTVWGIGFM

SEQ ID NO: 1835101 - protein, 18 aa, Staphylococcus epidermidis
MAETLLAPVPLFHKNHET

SEQ ID NO: 1835102 - protein, 17 aa, Staphylococcus epidermidis
MAKGLQDGLLFKGIHKL

SEQ ID NO: 1835103 - protein, 24 aa, Staphylococcus epidermidis
MAWYRYPRGFKFYRNTRNFVPKPG

SEQ ID NO: 1835104 - protein, 18 aa, Staphylococcus epidermidis
MEEELKILLIPKDPNDEK

SEQ ID NO: 1835105 - protein, 24 aa, Staphylococcus epidermidis
MEMKPLYEWLGLTASLGFIDIPDY

SEQ ID NO: 1835106 - protein, 23 aa, Staphylococcus epidermidis
MENRLRYQYGKPSKLLAKSFELQ

SEQ ID NO: 1835107 - protein, 23 aa, Staphylococcus epidermidis
MENRLRYQYGRPSKLLAKSFELQ

SEQ ID NO: 1835108 - protein, 24 aa, Staphylococcus epidermidis
MFDYSYLYFLLRDDAINTFMKHYR

SEQ ID NO: 1835109 - protein, 21 aa, Staphylococcus epidermidis
MFVYGLFIYNKWRGMGTLNSV

SEQ ID NO: 1835110 - protein, 17 aa, Staphylococcus epidermidis
MIQLPNSIEFIAVLFAC

SEQ ID NO: 1835111 - protein, 22 aa, Staphylococcus epidermidis
MIRMPVVLIISPRYNWLSSDAK

SEQ ID NO: 1835112 - protein, 18 aa, Staphylococcus epidermidis
MLEAIFFGHEEIKRLVAF

SEQ ID NO: 1835113 - protein, 19 aa, Staphylococcus epidermidis
MNPFLGYRAIRLCLAQQDI

SEQ ID NO: 1835114 - protein, 18 aa, Staphylococcus epidermidis
MNPYLYEVLTIHAQLKDY

SEQ ID NO: 1835115 - protein, 26 aa, Staphylococcus epidermidis
MPIVKQYFRMLQRPILYTGLTRAKQS

SEQ ID NO: 1835116 - protein, 25 aa, Staphylococcus epidermidis
MSQEGYHFFGLLYIGAILTKEGPKV

SEQ ID NO: 1835117 - protein, 23 aa, Staphylococcus epidermidis
MTTACLLFFGKYNAISDRFPGFQ

SEQ ID NO: 1835118 - protein, 23 aa, Staphylococcus epidermidis
MVEPFFEWVIEKDAWYGEELNHI

SEQ ID NO: 1835119 - protein, 17 aa, Staphylococcus epidermidis
MVEQIGDYFVWFNEPRG

SEQ ID NO: 1835120 - protein, 18 aa, Staphylococcus epidermidis
MWAAQFYPFKNHGQWVTS

SEQ ID NO: 1835121 - protein, 24 aa, Staphylococcus epidermidis
NAETFYPMPFLSPETMWYYKSAFN

SEQ ID NO: 1835122 - protein, 22 aa, Staphylococcus epidermidis
NAGSYLLKFLSSLNLDKSAKDF

SEQ ID NO: 1835123 - protein, 28 aa, Staphylococcus epidermidis
NAIYEFLSLRIPMLLIPLGLDQSRGDQI

SEQ ID NO: 1835124 - protein, 19 aa, Staphylococcus epidermidis
NCLPVFNILIKKQTLHFRV

SEQ ID NO: 1835125 - protein, 25 aa, Staphylococcus epidermidis
NCPYRNFLFSWYYKKYDKEPDFIEF

SEQ ID NO: 1835126 - protein, 17 aa, Staphylococcus epidermidis
NDDFTHWRKIMGAAPIS

SEQ ID NO: 1835127 - protein, 21 aa, Staphylococcus epidermidis
NDILPNFLFLEAKASFPTSNN

SEQ ID NO: 1835128 - protein, 23 aa, Staphylococcus epidermidis
NDKYDIVLLLTKQVFNKDVLPTV

SEQ ID NO: 1835129 - protein, 25 aa, Staphylococcus epidermidis
NDVYFLNGPLDLTFLFGLVSHLSNK

SEQ ID NO: 1835130 - protein, 26 aa, Staphylococcus epidermidis
NEGYNLTFFAFFVKAVAEALKVNPLL

SEQ ID NO: 1835131 - protein, 22 aa, Staphylococcus epidermidis
NEIYNLVVYQLGALSGFCKINH

SEQ ID NO: 1835132 - protein, 18 aa, Staphylococcus epidermidis
NFINQIGWYLNFEKDIDL

SEQ ID NO: 1835133 - protein, 26 aa, Staphylococcus epidermidis
NFNNLVLVRFFFKSLTAYLKKHNCLY

SEQ ID NO: 1835134 - protein, 18 aa, Staphylococcus epidermidis
NGEPFATARIRPIDNYSG

SEQ ID NO: 1835135 - protein, 24 aa, Staphylococcus epidermidis
NGFGYDPVFFVPDKDRTMAEISNE

SEQ ID NO: 1835136 - protein, 24 aa, Staphylococcus epidermidis
NGIARLDEARPKALDYINSLDKIN

SEQ ID NO: 1835137 - protein, 25 aa, Staphylococcus epidermidis
NGRHELLDSVFLWQSGNKYRVSAHD

SEQ ID NO: 1835138 - protein, 24 aa, Staphylococcus epidermidis
NGRVLDLVMFLRKTAFSDLSRMIE

SEQ ID NO: 1835139 - protein, 20 aa, Staphylococcus epidermidis
NGWFLHIPSCYLGIAQAARD

SEQ ID NO: 1835140 - protein, 20 aa, Staphylococcus epidermidis
NGWILHIPSCYLGIAQAARD

SEQ ID NO: 1835141 - protein, 20 aa, Staphylococcus epidermidis
NHQLFSKIEWIIVSLGANGA

SEQ ID NO: 1835142 - protein, 18 aa, Staphylococcus epidermidis
NIAQITIWDTDQAPLTLH

SEQ ID NO: 1835143 - protein, 19 aa, Staphylococcus epidermidis
NIILPYWLMNSEELESLFI

SEQ ID NO: 1835144 - protein, 17 aa, Staphylococcus epidermidis
NITGIPLNTLWYQKDRG

SEQ ID NO: 1835145 - protein, 18 aa, Staphylococcus epidermidis
NIYPIFKQLGLDTYIDVV

SEQ ID NO: 1835146 - protein, 23 aa, Staphylococcus epidermidis
NKFIRILNFPFYFRGEVYDPFET

SEQ ID NO: 1835147 - protein, 23 aa, Staphylococcus epidermidis
NKGRYLFIPVHKLADIRWKELGQ

SEQ ID NO: 1835148 - protein, 23 aa, Staphylococcus epidermidis
NKNYGIPLYYKKGKHFKLTEAGE

SEQ ID NO: 1835149 - protein, 19 aa, Staphylococcus epidermidis
NKTNQSYHQPAQSTPQQSS

SEQ ID NO: 1835150 - protein, 21 aa, Staphylococcus epidermidis
NLEFKYLFLKLIVKEDWSLSN

SEQ ID NO: 1835151 - protein, 23 aa, Staphylococcus epidermidis
NLERFLKYYLLYSEYNNYSIKTA

SEQ ID NO: 1835152 - protein, 20 aa, Staphylococcus epidermidis
NLSYQQLLKVWGHTFQYIKA

SEQ ID NO: 1835153 - protein, 22 aa, Staphylococcus epidermidis
NLTYPQFLVLTILWDESPVNVK

SEQ ID NO: 1835154 - protein, 21 aa, Staphylococcus epidermidis
NLVNFYYPKLTFKSSILQLIK

SEQ ID NO: 1835155 - protein, 17 aa, Staphylococcus epidermidis
NMLYPYIDEILITKSKT

SEQ ID NO: 1835156 - protein, 17 aa, Staphylococcus epidermidis
NMVRVLVAFLIEVGKGK

SEQ ID NO: 1835157 - protein, 24 aa, Staphylococcus epidermidis
NNIEHKIWYKLLVNLGINSITAIG

SEQ ID NO: 1835158 - protein, 26 aa, Staphylococcus epidermidis
NNNKLYMIELLEPLPFLEKISKLTTV

SEQ ID NO: 1835159 - protein, 20 aa, Staphylococcus epidermidis
NPLIRTIPVGSLNKLIHPEK

SEQ ID NO: 1835160 - protein, 17 aa, Staphylococcus epidermidis
NPYLYEVLTIHAQLKGY

SEQ ID NO: 1835161 - protein, 17 aa, Staphylococcus epidermidis
NQIRALIYGVWLLSWSK

SEQ ID NO: 1835162 - protein, 19 aa, Staphylococcus epidermidis
NQLNLIWHSPNLYLSSIQE

SEQ ID NO: 1835163 - protein, 25 aa, Staphylococcus epidermidis
NQTNLRIYFTSTWPSKLVYIAKPQL

SEQ ID NO: 1835164 - protein, 20 aa, Staphylococcus epidermidis
NQYDYLIKRYLLNIERENDI

SEQ ID NO: 1835165 - protein, 21 aa, Staphylococcus epidermidis
NRGLIPYTVFIDPPLSRVGLT

SEQ ID NO: 1835166 - protein, 23 aa, Staphylococcus epidermidis
NRLKLIHHWINGRMPLVGIGSVF

SEQ ID NO: 1835167 - protein, 20 aa, Staphylococcus epidermidis
NRWHKFKILIAKKYARLYRI

SEQ ID NO: 1835168 - protein, 21 aa, Staphylococcus epidermidis
NTLLDLIRYFVVFQDDGKGHI

SEQ ID NO: 1835169 - protein, 24 aa, Staphylococcus epidermidis
NVFGIVRMMNTFIPLLEQSQQPVV

SEQ ID NO: 1835170 - protein, 17 aa, Staphylococcus epidermidis
NVWYYKLVDVYDITQTN

SEQ ID NO: 1835171 - protein, 24 aa, Staphylococcus epidermidis
NVYIEKYMMSLFLYEVASQTSMNF

SEQ ID NO: 1835172 - protein, 20 aa, Staphylococcus epidermidis
NWVGFYLIEGNGLILGPFQG

SEQ ID NO: 1835173 - protein, 23 aa, Staphylococcus epidermidis
PAQQPNYHQYPNNNQQSGSNKNN

SEQ ID NO: 1835174 - protein, 18 aa, Staphylococcus epidermidis
PCILYGELYTRYGAILNK

SEQ ID NO: 1835175 - protein, 17 aa, Staphylococcus epidermidis
PDNQLLTQLFTALEEES

SEQ ID NO: 1835176 - protein, 23 aa, Staphylococcus epidermidis
PDYDRPWHYLNVLAQQALGDTFG

SEQ ID NO: 1835177 - protein, 22 aa, Staphylococcus epidermidis
PDYMIPIHFKKIDQIPITINGK

SEQ ID NO: 1835178 - protein, 19 aa, Staphylococcus epidermidis
PEERLFRKYAHTIRNWDDE

SEQ ID NO: 1835179 - protein, 28 aa, Staphylococcus epidermidis
PERFENTFFLNLLRKIKIPLIAFDEAHC

SEQ ID NO: 1835180 - protein, 18 aa, Staphylococcus epidermidis
PEYMIPRKFEWMEQLPLT

SEQ ID NO: 1835181 - protein, 19 aa, Staphylococcus epidermidis
PFFIGIMPIASYNNALFLH

SEQ ID NO: 1835182 - protein, 17 aa, Staphylococcus epidermidis
PFHWRLLDKLALNTLNE

SEQ ID NO: 1835183 - protein, 17 aa, Staphylococcus epidermidis
PGVLFKLEKTHDLTEDQ

SEQ ID NO: 1835184 - protein, 22 aa, Staphylococcus epidermidis
PGYILNTLLVPLLTAAQRLLAL

SEQ ID NO: 1835185 - protein, 17 aa, Staphylococcus epidermidis
PHLILDFATLTGAAVVA

SEQ ID NO: 1835186 - protein, 21 aa, Staphylococcus epidermidis
PIDRQLFYQFILRLPDEVLRL

SEQ ID NO: 1835187 - protein, 23 aa, Staphylococcus epidermidis
PIEWQLQYLLLRRDFKSYEACQL

SEQ ID NO: 1835188 - protein, 17 aa, Staphylococcus epidermidis
PIIGLIPSIGLKSLEEY

SEQ ID NO: 1835189 - protein, 20 aa, Staphylococcus epidermidis
PIKDDDLFCGECGHKISRHP

SEQ ID NO: 1835190 - protein, 22 aa, Staphylococcus epidermidis
PISGYPFVWWFATRPTYDGQGY

SEQ ID NO: 1835191 - protein, 18 aa, Staphylococcus epidermidis
PKEFVLFSQWLLMKNIKL

SEQ ID NO: 1835192 - protein, 24 aa, Staphylococcus epidermidis
PKEIYNLVIYQLGALNGFCKVHGV

SEQ ID NO: 1835193 - protein, 21 aa, Staphylococcus epidermidis
PLALGLLTPPGAFGADIVVGD

SEQ ID NO: 1835194 - protein, 17 aa, Staphylococcus epidermidis
PLFAWDLNMGGLMNALE

SEQ ID NO: 1835195 - protein, 20 aa, Staphylococcus epidermidis
PLFNFKIYQFLDEAYLLLDF

SEQ ID NO: 1835196 - protein, 18 aa, Staphylococcus epidermidis
PNIKLPSYQLLEEPEPHE

SEQ ID NO: 1835197 - protein, 24 aa, Staphylococcus epidermidis
PNKEFQLIFLLVSNPKHIFTRDDI

SEQ ID NO: 1835198 - protein, 18 aa, Staphylococcus epidermidis
PPGYAFHWAHPGIDLPYH

SEQ ID NO: 1835199 - protein, 18 aa, Staphylococcus epidermidis
PPQGIILPCYYDGKQWVG

SEQ ID NO: 1835200 - protein, 17 aa, Staphylococcus epidermidis
PQTRLRKLLKKMDYYIK

SEQ ID NO: 1835201 - protein, 20 aa, Staphylococcus epidermidis
PRALVISAYRNVSVNNFTAI

SEQ ID NO: 1835202 - protein, 25 aa, Staphylococcus epidermidis
PSEESYFLFYINRPSIIVGKNQNTI

SEQ ID NO: 1835203 - protein, 18 aa, Staphylococcus epidermidis
PSGEWLYIKLKTGKFNDA

SEQ ID NO: 1835204 - protein, 19 aa, Staphylococcus epidermidis
PSKLFLISPLLDATLSNKD

SEQ ID NO: 1835205 - protein, 22 aa, Staphylococcus epidermidis
PSPIWMQARLMKAGIRPINNVV

SEQ ID NO: 1835206 - protein, 18 aa, Staphylococcus epidermidis
PWNAPILVLMRKVIPAIV

SEQ ID NO: 1835207 - protein, 26 aa, Staphylococcus epidermidis
PYFMYHNYWFLFYHDENYFAVKYKDD

SEQ ID NO: 1835208 - protein, 19 aa, Staphylococcus epidermidis
QAIDNPLPKGWKIIRNERA

SEQ ID NO: 1835209 - protein, 17 aa, Staphylococcus epidermidis
QAMLRGHFYLRELAASE

SEQ ID NO: 1835210 - protein, 19 aa, Staphylococcus epidermidis
QAMLRGHFYLRELATSESE

SEQ ID NO: 1835211 - protein, 23 aa, Staphylococcus epidermidis
QDISKLQYILFLKELDLTLKQIQ

SEQ ID NO: 1835212 - protein, 24 aa, Staphylococcus epidermidis
QDLQAAAQTLYFLYSMKLLDQSNS

SEQ ID NO: 1835213 - protein, 18 aa, Staphylococcus epidermidis
QEGHDFFGLLYIGAILTK

SEQ ID NO: 1835214 - protein, 20 aa, Staphylococcus epidermidis
QEVRAWTFRQGMTAPQCAGI

SEQ ID NO: 1835215 - protein, 20 aa, Staphylococcus epidermidis
QFGTMETMFPRRVDLGLGRA

SEQ ID NO: 1835216 - protein, 20 aa, Staphylococcus epidermidis
QFKELKFYLAFKRIKNFACV

SEQ ID NO: 1835217 - protein, 17 aa, Staphylococcus epidermidis
QGRYFVRLSFVKTWNKG

SEQ ID NO: 1835218 - protein, 18 aa, Staphylococcus epidermidis
QGRYFVRLSFVKTWNKGD

SEQ ID NO: 1835219 - protein, 17 aa, Staphylococcus epidermidis
QGVKGLFIVPLNGFKKW

SEQ ID NO: 1835220 - protein, 23 aa, Staphylococcus epidermidis
QHQMTDFMFFASAIMVLLHKYSR

SEQ ID NO: 1835221 - protein, 21 aa, Staphylococcus epidermidis
QIKDLYEFNLFKLRIDHIQAD

SEQ ID NO: 1835222 - protein, 20 aa, Staphylococcus epidermidis
QIPQSQYFLPSQANFVFVKT

SEQ ID NO: 1835223 - protein, 18 aa, Staphylococcus epidermidis
QKADLLLWFLRPEMKDLN

SEQ ID NO: 1835224 - protein, 24 aa, Staphylococcus epidermidis
QKKLYKFFLLVARYIKRKEAFYKA

SEQ ID NO: 1835225 - protein, 17 aa, Staphylococcus epidermidis
QKLFLLIFQLPEHLARQ

SEQ ID NO: 1835226 - protein, 21 aa, Staphylococcus epidermidis
QKQYDYLLKRYLLNVERENDI

SEQ ID NO: 1835227 - protein, 20 aa, Staphylococcus epidermidis
QLGFIFQDYSVLPTLTVKEN

SEQ ID NO: 1835228 - protein, 18 aa, Staphylococcus epidermidis
QLIETILLNIINFQTLIA

SEQ ID NO: 1835229 - protein, 23 aa, Staphylococcus epidermidis
QLITFKYLLPFRMPIKEIENIDF

SEQ ID NO: 1835230 - protein, 18 aa, Staphylococcus epidermidis
QMMNKILSVYAPLWKLGH

SEQ ID NO: 1835231 - protein, 17 aa, Staphylococcus epidermidis
QMNLLGHDFFIFTDRET

SEQ ID NO: 1835232 - protein, 19 aa, Staphylococcus epidermidis
QNDPALVDLLISTLGWSPD

SEQ ID NO: 1835233 - protein, 17 aa, Staphylococcus epidermidis
QNKYFYITYLSRNLKEY

SEQ ID NO: 1835234 - protein, 22 aa, Staphylococcus epidermidis
QPDKLVLSLAWKYAETLMNTGA

SEQ ID NO: 1835235 - protein, 19 aa, Staphylococcus epidermidis
QRDYLFFKFAIHTGVKLTE

SEQ ID NO: 1835236 - protein, 18 aa, Staphylococcus epidermidis
QRELARLEQLKQAMRSET

SEQ ID NO: 1835237 - protein, 23 aa, Staphylococcus epidermidis
QSDHLNELILYLAPKLIGGSGKH

SEQ ID NO: 1835238 - protein, 26 aa, Staphylococcus epidermidis
QSLKKDWGFFFMPKFNFVINVANENR

SEQ ID NO: 1835239 - protein, 25 aa, Staphylococcus epidermidis
QSRAKWLFLDVFQWSRTDYLIHSQE

SEQ ID NO: 1835240 - protein, 29 aa, Staphylococcus epidermidis
QSSILTSIPLWKNQMAIALTLMRQRNAVS

SEQ ID NO: 1835241 - protein, 18 aa, Staphylococcus epidermidis
QTPQRPTTQTPVRQNPQT

SEQ ID NO: 1835242 - protein, 22 aa, Staphylococcus epidermidis
QTSFHYTPLHKFSYYKSKNLLP

SEQ ID NO: 1835243 - protein, 20 aa, Staphylococcus epidermidis
QVETWWRWYRNGESYRFSQH

SEQ ID NO: 1835244 - protein, 21 aa, Staphylococcus epidermidis
QVKTWWRWYRNGESYRFSQQV

SEQ ID NO: 1835245 - protein, 20 aa, Staphylococcus epidermidis
QVLFILPLWHHDDAFPFELL

SEQ ID NO: 1835246 - protein, 17 aa, Staphylococcus epidermidis
QYLVLLVLWENDEQPLN

SEQ ID NO: 1835247 - protein, 20 aa, Staphylococcus epidermidis
QYWQYPPFQLTEVGGWLYGR

SEQ ID NO: 1835248 - protein, 19 aa, Staphylococcus epidermidis
QYYVYAFIKLFKEKYNNDV

SEQ ID NO: 1835249 - protein, 20 aa, Staphylococcus epidermidis
RAEHVKLLIPLLEKNRDEIA

SEQ ID NO: 1835250 - protein, 20 aa, Staphylococcus epidermidis
RAFIGSFLFGGRYSSSKFKI

SEQ ID NO: 1835251 - protein, 24 aa, Staphylococcus epidermidis
RAKSKRLMVMKQSFKKVVIKNCEN

SEQ ID NO: 1835252 - protein, 20 aa, Staphylococcus epidermidis
RALIYGVWLLSWSKVKLSES

SEQ ID NO: 1835253 - protein, 17 aa, Staphylococcus epidermidis
RALLISAYKNVSVNNFT

SEQ ID NO: 1835254 - protein, 18 aa, Staphylococcus epidermidis
RASILVMGPLLARLGHAI

SEQ ID NO: 1835255 - protein, 24 aa, Staphylococcus epidermidis
RDEETWMLFGTLPIYPCINDENDQ

SEQ ID NO: 1835256 - protein, 21 aa, Staphylococcus epidermidis
RDNLRLIYYALRNPYLSPDRK

SEQ ID NO: 1835257 - protein, 18 aa, Staphylococcus epidermidis
REDLFITSKLWLEDYGRA

SEQ ID NO: 1835258 - protein, 19 aa, Staphylococcus epidermidis
REVQFDVIFLDPPYNKGLI

SEQ ID NO: 1835259 - protein, 17 aa, Staphylococcus epidermidis
RFEAYGWNYILVKDGND

SEQ ID NO: 1835260 - protein, 25 aa, Staphylococcus epidermidis
RFENTFFLNLLRKIDIHLIAFDEAH

SEQ ID NO: 1835261 - protein, 17 aa, Staphylococcus epidermidis
RFWLQLQADIFNLQIKR

SEQ ID NO: 1835262 - protein, 18 aa, Staphylococcus epidermidis
RGAIPYTVFIDPPLSRVG

SEQ ID NO: 1835263 - protein, 18 aa, Staphylococcus epidermidis
RHELMDSVFLWQSGSKYR

SEQ ID NO: 1835264 - protein, 18 aa, Staphylococcus epidermidis
RIIVIPPLNKSHGINIER

SEQ ID NO: 1835265 - protein, 18 aa, Staphylococcus epidermidis
RIVISLTYVYGIGTSTAN

SEQ ID NO: 1835266 - protein, 19 aa, Staphylococcus epidermidis
RLFICYLGDFKTTGGIFAT

SEQ ID NO: 1835267 - protein, 20 aa, Staphylococcus epidermidis
RLKDIIEIFLDSGLGKEAFS

SEQ ID NO: 1835268 - protein, 23 aa, Staphylococcus epidermidis
RLKLGHMLYFIVNYLFVGRGFVV

SEQ ID NO: 1835269 - protein, 17 aa, Staphylococcus epidermidis
RLLVISPYDKTSVADIE

SEQ ID NO: 1835270 - protein, 19 aa, Staphylococcus epidermidis
RLNLYMSLIILNNKEMLFL

SEQ ID NO: 1835271 - protein, 18 aa, Staphylococcus epidermidis
RLPLYYRLVSILKGKGID

SEQ ID NO: 1835272 - protein, 19 aa, Staphylococcus epidermidis
RLQLVLLMLQRDNVLILDE

SEQ ID NO: 1835273 - protein, 22 aa, Staphylococcus epidermidis
RLQLVLLMLQRDNVLILDEPTN

SEQ ID NO: 1835274 - protein, 17 aa, Staphylococcus epidermidis
RLRPSYFPFTEPSVEVD

SEQ ID NO: 1835275 - protein, 19 aa, Staphylococcus epidermidis
RLYVYAHYKGLKSLYYTRN

SEQ ID NO: 1835276 - protein, 20 aa, Staphylococcus epidermidis
RNDQTLLVKFLKPVQNEWSG

SEQ ID NO: 1835277 - protein, 20 aa, Staphylococcus epidermidis
RNELDLLLKKKLVSGDAVYI

SEQ ID NO: 1835278 - protein, 19 aa, Staphylococcus epidermidis
RPNFHLFFHEFGFHATGRK

SEQ ID NO: 1835279 - protein, 24 aa, Staphylococcus epidermidis
RPTLKFELFYFDIFKYGTSFITLQ

SEQ ID NO: 1835280 - protein, 19 aa, Staphylococcus epidermidis
RRKHDLFEFIEETVAPIVN

SEQ ID NO: 1835281 - protein, 17 aa, Staphylococcus epidermidis
RRLLQMFGEVVYGIPML

SEQ ID NO: 1835282 - protein, 25 aa, Staphylococcus epidermidis
RRVSPFFVPMLIPDMATGQVSIDLG

SEQ ID NO: 1835283 - protein, 24 aa, Staphylococcus epidermidis
RTHGYDFPMWFIRPFYAKETTKNK

SEQ ID NO: 1835284 - protein, 24 aa, Staphylococcus epidermidis
RVKPHPFINLLNYILLESSGADIA

SEQ ID NO: 1835285 - protein, 17 aa, Staphylococcus epidermidis
RWRLLYIANPDYTVKPP

SEQ ID NO: 1835286 - protein, 23 aa, Staphylococcus epidermidis
RYLTEDIAFGLVLWSSLGRVIDV

SEQ ID NO: 1835287 - protein, 18 aa, Staphylococcus epidermidis
RYTYLYNKRYLKIQMSAS

SEQ ID NO: 1835288 - protein, 26 aa, Staphylococcus epidermidis
SDDTTLPAFWFDPIINLTAIAQVTSH

SEQ ID NO: 1835289 - protein, 22 aa, Staphylococcus epidermidis
SDEEIILFKGFFARFEFKQINK

SEQ ID NO: 1835290 - protein, 21 aa, Staphylococcus epidermidis
SDFIYVFRMFSLGIADYTLSM

SEQ ID NO: 1835291 - protein, 20 aa, Staphylococcus epidermidis
SDLILYVSYFNHSFTDNDKA

SEQ ID NO: 1835292 - protein, 24 aa, Staphylococcus epidermidis
SEESYFLFYINRPSIIVGKNQNTI

SEQ ID NO: 1835293 - protein, 23 aa, Staphylococcus epidermidis
SEFEKHMYAIHTLTSLYTSNDSQ

SEQ ID NO: 1835294 - protein, 23 aa, Staphylococcus epidermidis
SEFRNYILGLIFYRFLSEKTEEE

SEQ ID NO: 1835295 - protein, 24 aa, Staphylococcus epidermidis
SERLRQFFDFITNFGIMIKGTGED

SEQ ID NO: 1835296 - protein, 26 aa, Staphylococcus epidermidis
SESIHLLPFNVFFVPARGGLGENMVY

SEQ ID NO: 1835297 - protein, 18 aa, Staphylococcus epidermidis
SEVFTPINPITITATDNS

SEQ ID NO: 1835298 - protein, 24 aa, Staphylococcus epidermidis
SEYDDCLLFFRLGDFYEMFFEDAK

SEQ ID NO: 1835299 - protein, 27 aa, Staphylococcus epidermidis
SEYLKQFVKVFLDLGIKVKFYNVVGNH

SEQ ID NO: 1835300 - protein, 25 aa, Staphylococcus epidermidis
SFMTNIFGMMFLSQAAVPYLSEGDT

SEQ ID NO: 1835301 - protein, 23 aa, Staphylococcus epidermidis
SFTYTFLGFLPRKEKEKIDVLQL

SEQ ID NO: 1835302 - protein, 32 aa, Staphylococcus epidermidis
SGGERALSAIALLFAILKVRSAPFVILDEVEA

SEQ ID NO: 1835303 - protein, 26 aa, Staphylococcus epidermidis
SGKSYFLYFLIFQLVIKNADVYVIDR

SEQ ID NO: 1835304 - protein, 18 aa, Staphylococcus epidermidis
SGMALYDLLMGKDPLNER

SEQ ID NO: 1835305 - protein, 18 aa, Staphylococcus epidermidis
SGSPYWYTLPNYADKDKF

SEQ ID NO: 1835306 - protein, 17 aa, Staphylococcus epidermidis
SGTIPGVLFKLEKTHDL

SEQ ID NO: 1835307 - protein, 17 aa, Staphylococcus epidermidis
SHLCIYILIITGSRFKP

SEQ ID NO: 1835308 - protein, 25 aa, Staphylococcus epidermidis
SHTGQYYFHLFSKKQPDLNWNNPDV

SEQ ID NO: 1835309 - protein, 18 aa, Staphylococcus epidermidis
SHYPLLMTYSHKLHLHDG

SEQ ID NO: 1835310 - protein, 24 aa, Staphylococcus epidermidis
SIDDLPLGIYRFLKNKPKIYARTL

SEQ ID NO: 1835311 - protein, 18 aa, Staphylococcus epidermidis
SIIDEIHDFYRNGGYYDE

SEQ ID NO: 1835312 - protein, 18 aa, Staphylococcus epidermidis
SILNSLLVPFISAASYLI

SEQ ID NO: 1835313 - protein, 26 aa, Staphylococcus epidermidis
SINVPMDLLPYLFFQFSRNGKRLYSD

SEQ ID NO: 1835314 - protein, 19 aa, Staphylococcus epidermidis
SIPHNFTFHLLFSNNKLKI

SEQ ID NO: 1835315 - protein, 22 aa, Staphylococcus epidermidis
SISGYPFVWWFATKPAYDGQGY

SEQ ID NO: 1835316 - protein, 22 aa, Staphylococcus epidermidis
SITQLLERFLFPSSTHGKKIYK

SEQ ID NO: 1835317 - protein, 23 aa, Staphylococcus epidermidis
SITSKLIFASWSPRLHFNASLFQ

SEQ ID NO: 1835318 - protein, 28 aa, Staphylococcus epidermidis
SKDDVSLVLFWYFLAVKKFTHFGESMKR

SEQ ID NO: 1835319 - protein, 27 aa, Staphylococcus epidermidis
SKERSLEHLLFGLGIRHLGVKASQVLA

SEQ ID NO: 1835320 - protein, 23 aa, Staphylococcus epidermidis
SKNYILFFIDKYKIKTPFLDQLL

SEQ ID NO: 1835321 - protein, 23 aa, Staphylococcus epidermidis
SKPPILLTPLFPTYFFPTHSDRQ

SEQ ID NO: 1835322 - protein, 24 aa, Staphylococcus epidermidis
SLASYINFYIKQLERQLKLTGKNH

SEQ ID NO: 1835323 - protein, 23 aa, Staphylococcus epidermidis
SLSFRAFYALPLLSNKAGIHTNA

SEQ ID NO: 1835324 - protein, 17 aa, Staphylococcus epidermidis
SLSLLTIIYLRKPWRIE

SEQ ID NO: 1835325 - protein, 19 aa, Staphylococcus epidermidis
SLYIRPFVFATEGILGVRA

SEQ ID NO: 1835326 - protein, 19 aa, Staphylococcus epidermidis
SMIFQHFNLLWSRNVLKNV

SEQ ID NO: 1835327 - protein, 23 aa, Staphylococcus epidermidis
SMSKLLLLIFQLPETLTRLEYSL

SEQ ID NO: 1835328 - protein, 24 aa, Staphylococcus epidermidis
SMVDTWLFHQFLSAVPLDAQIIFV

SEQ ID NO: 1835329 - protein, 23 aa, Staphylococcus epidermidis
SNFKLLLVHYLSQKIYYLELERI

SEQ ID NO: 1835330 - protein, 22 aa, Staphylococcus epidermidis
SNWDMLFIVFSIHLIDIAKQLK

SEQ ID NO: 1835331 - protein, 24 aa, Staphylococcus epidermidis
SQQYKLLIILSPSGAYYGGDTLKA

SEQ ID NO: 1835332 - protein, 22 aa, Staphylococcus epidermidis
SRKVIYILPSQPLKYASNTWIY

SEQ ID NO: 1835333 - protein, 22 aa, Staphylococcus epidermidis
SRLLKWHIDLPKVVKLQKDIEK

SEQ ID NO: 1835334 - protein, 23 aa, Staphylococcus epidermidis
SRQHHRFLFFINKLPGITIKELL

SEQ ID NO: 1835335 - protein, 24 aa, Staphylococcus epidermidis
STAQLDFLLPERFELTYIGSDGEQ

SEQ ID NO: 1835336 - protein, 20 aa, Staphylococcus epidermidis
SVGLDLPFPLKMNRLLGFDS

SEQ ID NO: 1835337 - protein, 25 aa, Staphylococcus epidermidis
SVKAQPPFFYPLDKLISISTMIEEA

SEQ ID NO: 1835338 - protein, 22 aa, Staphylococcus epidermidis
SVKIKPPFYYPLNKIISIGTMI

SEQ ID NO: 1835339 - protein, 22 aa, Staphylococcus epidermidis
SYPYISFIPLNGEVILSLDGFK

SEQ ID NO: 1835340 - protein, 21 aa, Staphylococcus epidermidis
TAPKYDGFLTSLPFVGQHFIG

SEQ ID NO: 1835341 - protein, 18 aa, Staphylococcus epidermidis
TDFMFFASAIMVLLHKYT

SEQ ID NO: 1835342 - protein, 17 aa, Staphylococcus epidermidis
TDKPHVIFIDYLTLMQS

SEQ ID NO: 1835343 - protein, 25 aa, Staphylococcus epidermidis
TDNKLLDFFIIDILNKLYLPSLNKR

SEQ ID NO: 1835344 - protein, 23 aa, Staphylococcus epidermidis
TDNLVLLGIKTRGAFLANRIQDK

SEQ ID NO: 1835345 - protein, 24 aa, Staphylococcus epidermidis
TEDQMVDFLFTSALFGRVVANNAS

SEQ ID NO: 1835346 - protein, 23 aa, Staphylococcus epidermidis
TEKQWDLLRLLESELQTLGLSTD

SEQ ID NO: 1835347 - protein, 17 aa, Staphylococcus epidermidis
TEKWIIQIAYDTLIIMA

SEQ ID NO: 1835348 - protein, 22 aa, Staphylococcus epidermidis
TESTLLIGFLKDTEPRPGSMGK

SEQ ID NO: 1835349 - protein, 17 aa, Staphylococcus epidermidis
TFLPLNVIKPRQIASDI

SEQ ID NO: 1835350 - protein, 23 aa, Staphylococcus epidermidis
TFMTNIFGMMFLSQAAVPHLSEG

SEQ ID NO: 1835351 - protein, 23 aa, Staphylococcus epidermidis
TGRYYIQRFLARSFGFEVDDIKE

SEQ ID NO: 1835352 - protein, 23 aa, Staphylococcus epidermidis
TGRYYIQRFLARSFGFEVDDMKD

SEQ ID NO: 1835353 - protein, 19 aa, Staphylococcus epidermidis
TIDNFRWAGVPFYIRTGKR

SEQ ID NO: 1835354 - protein, 19 aa, Staphylococcus epidermidis
TIFCTFWGLNALKKIQSQR

SEQ ID NO: 1835355 - protein, 17 aa, Staphylococcus epidermidis
TIPGVLFKLEKTHDLTE

SEQ ID NO: 1835356 - protein, 19 aa, Staphylococcus epidermidis
TIPIYLKRNPNFKFPQDES

SEQ ID NO: 1835357 - protein, 22 aa, Staphylococcus epidermidis
TIPKRIRILKKCKLYTDVTFKN

SEQ ID NO: 1835358 - protein, 17 aa, Staphylococcus epidermidis
TIPTLFHKIVPKALSHF

SEQ ID NO: 1835359 - protein, 22 aa, Staphylococcus epidermidis
TLKLAPITHLIPALNTIALKQV

SEQ ID NO: 1835360 - protein, 22 aa, Staphylococcus epidermidis
TLLKIILGLLPLQKGEIFVEGH

SEQ ID NO: 1835361 - protein, 22 aa, Staphylococcus epidermidis
TLMNHAISFLKERGYSVATIKH

SEQ ID NO: 1835362 - protein, 22 aa, Staphylococcus epidermidis
TLQEMAPLFKWLNSSFNDNGFS

SEQ ID NO: 1835363 - protein, 18 aa, Staphylococcus epidermidis
TLQLVIYYLMGKASQKPM

SEQ ID NO: 1835364 - protein, 22 aa, Staphylococcus epidermidis
TNGYIYNVKSYDALLHCIDVTY

SEQ ID NO: 1835365 - protein, 23 aa, Staphylococcus epidermidis
TNGYIYNVKSYDALLHCIDVTYA

SEQ ID NO: 1835366 - protein, 20 aa, Staphylococcus epidermidis
TPFFIGIMPIASYNNALFLH

SEQ ID NO: 1835367 - protein, 19 aa, Staphylococcus epidermidis
TPFLALYDLPTKGKGILFW

SEQ ID NO: 1835368 - protein, 29 aa, Staphylococcus epidermidis
TQQPYLIYMLGFMPGFPYLGGLDAKLHTP

SEQ ID NO: 1835369 - protein, 26 aa, Staphylococcus epidermidis
TQQPYLIYMLGFMPGFPYLGGLDKKL

SEQ ID NO: 1835370 - protein, 25 aa, Staphylococcus epidermidis
TQQQKLFFKLLFYSGARKGEIRALT

SEQ ID NO: 1835371 - protein, 18 aa, Staphylococcus epidermidis
TRIIIVTTFKRPGYFEKA

SEQ ID NO: 1835372 - protein, 23 aa, Staphylococcus epidermidis
TRKVIYLLPSQPLKYASNTWIYK

SEQ ID NO: 1835373 - protein, 22 aa, Staphylococcus epidermidis
TSTIIPMCHPLPLTGIDVSFKW

SEQ ID NO: 1835374 - protein, 23 aa, Staphylococcus epidermidis
TTAGKLALLMRKKYNKKPMLVAG

SEQ ID NO: 1835375 - protein, 18 aa, Staphylococcus epidermidis
TVCYLWLRFEHDKYFNDF

SEQ ID NO: 1835376 - protein, 17 aa, Staphylococcus epidermidis
TVIGPKIHFLRDNTFTI

SEQ ID NO: 1835377 - protein, 17 aa, Staphylococcus epidermidis
TWKMVLGLFPKEDKIKA

SEQ ID NO: 1835378 - protein, 19 aa, Staphylococcus epidermidis
TYFDEIYPKAWYQAGISLE

SEQ ID NO: 1835379 - protein, 19 aa, Staphylococcus epidermidis
TYVLFQLYERFVIDYSLGS

SEQ ID NO: 1835380 - protein, 23 aa, Staphylococcus epidermidis
VDVQYIIRLIPFGSLEHTKDVIT

SEQ ID NO: 1835381 - protein, 26 aa, Staphylococcus epidermidis
VDYLKWTIYKFYWITALNIIIKKKIN

SEQ ID NO: 1835382 - protein, 20 aa, Staphylococcus epidermidis
VFDVRFLPNPYYVKELRPLT

SEQ ID NO: 1835383 - protein, 17 aa, Staphylococcus epidermidis
VGKVSLRYWPFSEFKSN

SEQ ID NO: 1835384 - protein, 24 aa, Staphylococcus epidermidis
VGNNTPVFFFRDPKLFISLNRAVK

SEQ ID NO: 1835385 - protein, 34 aa, Staphylococcus epidermidis
VHDGFLIFMRPKFNLYFMFNWLENFQLKWNKYGQ

SEQ ID NO: 1835386 - protein, 23 aa, Staphylococcus epidermidis
VHKYLPLLHRYTKLRKELLGIED

SEQ ID NO: 1835387 - protein, 21 aa, Staphylococcus epidermidis
VHLNLPLEWLKGKIVVDSLGL

SEQ ID NO: 1835388 - protein, 29 aa, Staphylococcus epidermidis
VHLYDYIPKLFWPIYYFIQAPIQGLFMRG

SEQ ID NO: 1835389 - protein, 28 aa, Staphylococcus epidermidis
VHLYDYIPRLFWPIYYFVQAPIQGLLMR

SEQ ID NO: 1835390 - protein, 20 aa, Staphylococcus epidermidis
VIDYYYRFIHRFPTIQSLSE

SEQ ID NO: 1835391 - protein, 17 aa, Staphylococcus epidermidis
VIFYLFTEKRIIATIKE

SEQ ID NO: 1835392 - protein, 19 aa, Staphylococcus epidermidis
VIHSLILKPLYYFKDKWTQ

SEQ ID NO: 1835393 - protein, 17 aa, Staphylococcus epidermidis
VILLRMHYLISNALDLS

SEQ ID NO: 1835394 - protein, 18 aa, Staphylococcus epidermidis
VILLRMHYLISNALDLSG

SEQ ID NO: 1835395 - protein, 23 aa, Staphylococcus epidermidis
VITNCLPVFKILMKKQSLHFRVY

SEQ ID NO: 1835396 - protein, 18 aa, Staphylococcus epidermidis
VKDHLNGIIWVFNYFLDE

SEQ ID NO: 1835397 - protein, 25 aa, Staphylococcus epidermidis
VKLDPYWMYQLYDKDINPLTEKNDA

SEQ ID NO: 1835398 - protein, 23 aa, Staphylococcus epidermidis
VKPFYGNFGIYLRAYTYIRTMGA

SEQ ID NO: 1835399 - protein, 20 aa, Staphylococcus epidermidis
VKQFSHCELIPQLKLIESTK

SEQ ID NO: 1835400 - protein, 17 aa, Staphylococcus epidermidis
VKRAFIGSFLFGGRYSS

SEQ ID NO: 1835401 - protein, 21 aa, Staphylococcus epidermidis
VKRRIFLGTFALSSGYYDAFY

SEQ ID NO: 1835402 - protein, 21 aa, Staphylococcus epidermidis
VKSVYRWYLQGLGYKKISQHL

SEQ ID NO: 1835403 - protein, 18 aa, Staphylococcus epidermidis
VLLMLQRDNVLILDEPTN

SEQ ID NO: 1835404 - protein, 19 aa, Staphylococcus epidermidis
VLPLYDIFYDGQIKHILAR

SEQ ID NO: 1835405 - protein, 19 aa, Staphylococcus epidermidis
VPEARLLVISPYDKTSVAD

SEQ ID NO: 1835406 - protein, 19 aa, Staphylococcus epidermidis
VPFALIPKFNLFIALGIRD

SEQ ID NO: 1835407 - protein, 25 aa, Staphylococcus epidermidis
VQAGRVFIALPPLYKLEKGKGKSKK

SEQ ID NO: 1835408 - protein, 19 aa, Staphylococcus epidermidis
VQFTAYQIIFDLAKKYVNP

SEQ ID NO: 1835409 - protein, 18 aa, Staphylococcus epidermidis
VQWIVLAGYMRLIGQDLL

SEQ ID NO: 1835410 - protein, 26 aa, Staphylococcus epidermidis
VRKKFPDALFIFLAPPSLDDLKERLV

SEQ ID NO: 1835411 - protein, 20 aa, Staphylococcus epidermidis
VSMEWLFRPLLKMLAEGDPV

SEQ ID NO: 1835412 - protein, 19 aa, Staphylococcus epidermidis
VSRFRIVPLLIFRAMHYIG

SEQ ID NO: 1835413 - protein, 19 aa, Staphylococcus epidermidis
VTLPHLFSDILIYCTERNV

SEQ ID NO: 1835414 - protein, 24 aa, Staphylococcus epidermidis
VTTPEWMLLPMHKGGTFGKFSTAI

SEQ ID NO: 1835415 - protein, 25 aa, Staphylococcus epidermidis
VVAWNFPTLLASWKLGPALAAGNTV

SEQ ID NO: 1835416 - protein, 18 aa, Staphylococcus epidermidis
VVGTVKYDIPFQLKLIFV

SEQ ID NO: 1835417 - protein, 23 aa, Staphylococcus epidermidis
VYIEKYMMSLFLYEVASQTSMNF

SEQ ID NO: 1835418 - protein, 20 aa, Staphylococcus epidermidis
WEALFLCHQLFRAVSGEVAE

SEQ ID NO: 1835419 - protein, 21 aa, Staphylococcus epidermidis
WEQVHVFMLPKDYLRYCLTDQ

SEQ ID NO: 1835420 - protein, 17 aa, Staphylococcus epidermidis
WIVSIYLAHHFISQSSD

SEQ ID NO: 1835421 - protein, 18 aa, Staphylococcus epidermidis
WKDLNTQLDFIWKELNTT

SEQ ID NO: 1835422 - protein, 18 aa, Staphylococcus epidermidis
WLKLFLNEQLTYADGLAM

SEQ ID NO: 1835423 - protein, 18 aa, Staphylococcus epidermidis
WLSVLPIYHISGLSVILR

SEQ ID NO: 1835424 - protein, 20 aa, Staphylococcus epidermidis
YAERYFLMKFFNIPTDEDDA

SEQ ID NO: 1835425 - protein, 22 aa, Staphylococcus epidermidis
YAFTELFMFELRMQWLNRLEKT

SEQ ID NO: 1835426 - protein, 18 aa, Staphylococcus epidermidis
YDDLIIVPLFLFDGRLVN

SEQ ID NO: 1835427 - protein, 23 aa, Staphylococcus epidermidis
YDIKQYLVYLLKFPELHPEDDFL

SEQ ID NO: 1835428 - protein, 17 aa, Staphylococcus epidermidis
YDYLIKRYLLNIEREND

SEQ ID NO: 1835429 - protein, 19 aa, Staphylococcus epidermidis
YEKMDWFRRGFSDMGKLVN

SEQ ID NO: 1835430 - protein, 19 aa, Staphylococcus epidermidis
YFEKALKVLRPIYLEQSPV

SEQ ID NO: 1835431 - protein, 19 aa, Staphylococcus epidermidis
YFHIFHKITFYYESGRLTL

SEQ ID NO: 1835432 - protein, 25 aa, Staphylococcus epidermidis
YGATFFVFSDYLKPALRLSAIMGLN

SEQ ID NO: 1835433 - protein, 20 aa, Staphylococcus epidermidis
YGIPMLAFDTYFDDFKNQHN

SEQ ID NO: 1835434 - protein, 22 aa, Staphylococcus epidermidis
YGTKMMMFLPEYVQALFPDFTH

SEQ ID NO: 1835435 - protein, 17 aa, Staphylococcus epidermidis
YHGIFNEPIACSKINSG

SEQ ID NO: 1835436 - protein, 18 aa, Staphylococcus epidermidis
YHGIFNEPIACSKINSGL

SEQ ID NO: 1835437 - protein, 18 aa, Staphylococcus epidermidis
YHKIGKGPVLILIPGANG

SEQ ID NO: 1835438 - protein, 17 aa, Staphylococcus epidermidis
YIDPLWTRIAKGIILPS

SEQ ID NO: 1835439 - protein, 17 aa, Staphylococcus epidermidis
YILFYKPTQVITSVSDD

SEQ ID NO: 1835440 - protein, 19 aa, Staphylococcus epidermidis
YIVQLISMLDMIGGKKLKI

SEQ ID NO: 1835441 - protein, 17 aa, Staphylococcus epidermidis
YKKDKVIIILNYPNNPT

SEQ ID NO: 1835442 - protein, 19 aa, Staphylococcus epidermidis
YKMLPHFQIGLFRDQLFIM

SEQ ID NO: 1835443 - protein, 24 aa, Staphylococcus epidermidis
YKNHAPITIYYWNNGYISNLYCYI

SEQ ID NO: 1835444 - protein, 17 aa, Staphylococcus epidermidis
YLDLRRYGSVPHSGFGL

SEQ ID NO: 1835445 - protein, 18 aa, Staphylococcus epidermidis
YLDYLGLSRFITDSLGVC

SEQ ID NO: 1835446 - protein, 17 aa, Staphylococcus epidermidis
YLIELYLKAFKGQKKTD

SEQ ID NO: 1835447 - protein, 19 aa, Staphylococcus epidermidis
YLKDAILKFGFYTNHQHVV

SEQ ID NO: 1835448 - protein, 19 aa, Staphylococcus epidermidis
YLKNILKYYYGTLIIVSHD

SEQ ID NO: 1835449 - protein, 20 aa, Staphylococcus epidermidis
YLKNILKYYYGTLIIVSHDR

SEQ ID NO: 1835450 - protein, 17 aa, Staphylococcus epidermidis
YLLKPFIKTKIKSWVRQ

SEQ ID NO: 1835451 - protein, 18 aa, Staphylococcus epidermidis
YLLKPFIKTKIKSWVRQL

SEQ ID NO: 1835452 - protein, 24 aa, Staphylococcus epidermidis
YLPNSNLIRLIFDEGFIAIRPSGT

SEQ ID NO: 1835453 - protein, 21 aa, Staphylococcus epidermidis
YLRKFDYLVFPDNVAIVLGIA

SEQ ID NO: 1835454 - protein, 19 aa, Staphylococcus epidermidis
YLRLYAEFENYKRRIQNEN

SEQ ID NO: 1835455 - protein, 18 aa, Staphylococcus epidermidis
YMLILGETLIEMKDQFKG

SEQ ID NO: 1835456 - protein, 20 aa, Staphylococcus epidermidis
YNVPDFCQLIFITTPDKLET

SEQ ID NO: 1835457 - protein, 19 aa, Staphylococcus epidermidis
YQLLLDLGFSRDIMSLSPF

SEQ ID NO: 1835458 - protein, 17 aa, Staphylococcus epidermidis
YQLLRKLPPREYSISSS

SEQ ID NO: 1835459 - protein, 26 aa, Staphylococcus epidermidis
YRNLTLVRFFFKSLTDYLKKRNCLYV

SEQ ID NO: 1835460 - protein, 18 aa, Staphylococcus epidermidis
YRRMVIIPMLRKFGKGGQ

SEQ ID NO: 1835461 - protein, 23 aa, Staphylococcus epidermidis
YTDLLFLYLERAFLSQNFFDIPT

SEQ ID NO: 1835462 - protein, 23 aa, Staphylococcus epidermidis
YTERLFYELLSEGYVPIIAHPER

SEQ ID NO: 1835463 - protein, 23 aa, Staphylococcus epidermidis
YTKRPDIVLFINGLPIVVIELKN

SEQ ID NO: 1835464 - protein, 20 aa, Staphylococcus epidermidis
YVELFFDLLGIKPDWEKIKY

SEQ ID NO: 1835465 - protein, 24 aa, Staphylococcus epidermidis
YVFVSPMWNLSFPLVLKAYIDAIA

SEQ ID NO: 1835466 - protein, 20 aa, Staphylococcus epidermidis
YVGKLTFFRVYSGTLTSGSY

SEQ ID NO: 1835467 - protein, 18 aa, Staphylococcus epidermidis
YVTKYLYKALKTRGYRVC

SEQ ID NO: 1835468 - protein, 23 aa, Staphylococcus epidermidis
YYPYGPEYFIFGGLYKIKKIEPE

SEQ ID NO: 1835469 - protein, 9 aa, Staphylococcus epidermidis
ESPGASTSV

SEQ ID NO: 1835470 - protein, 4 aa, Staphylococcus epidermidis
GGAI

SEQ ID NO: 1835471 - protein, 8 aa, Staphylococcus epidermidis
KAKEINEQ

SEQ ID NO: 1835472 - protein, 6 aa, Staphylococcus epidermidis
NGKSGW

SEQ ID NO: 1835473 - protein, 8 aa, Staphylococcus epidermidis
TGIPESKH

SEQ ID NO: 1835474 - protein, 10 aa, Staphylococcus epidermidis
VQQPDGSIDI

SEQ ID NO: 1835475 - protein, 13 aa, Staphylococcus epidermidis
KIDEGTDVNYGEL

SEQ ID NO: 1835476 - protein, 4 aa, Staphylococcus epidermidis
KNGK

SEQ ID NO: 1835477 - protein, 7 aa, Staphylococcus epidermidis
AFGSNYD

SEQ ID NO: 1835478 - protein, 7 aa, Staphylococcus epidermidis
PEARDED

SEQ ID NO: 1835479 - protein, 7 aa, Staphylococcus epidermidis
RVDYGAA

SEQ ID NO: 1835480 - protein, 4 aa, Staphylococcus epidermidis
TEDI

SEQ ID NO: 1835481 - protein, 5 aa, Staphylococcus epidermidis
AEGNY

SEQ ID NO: 1835482 - protein, 18 aa, Staphylococcus epidermidis
DRPGIESSNERNNAGTGH

SEQ ID NO: 1835483 - protein, 16 aa, Staphylococcus epidermidis
TSRTISASQAASYNYI

SEQ ID NO: 1835484 - protein, 6 aa, Staphylococcus epidermidis
VNSEDH

SEQ ID NO: 1835485 - protein, 6 aa, Staphylococcus epidermidis
AAEQGA

SEQ ID NO: 1835486 - protein, 7 aa, Staphylococcus epidermidis
AELGKPI

SEQ ID NO: 1835487 - protein, 8 aa, Staphylococcus epidermidis
AFSSNYDR

SEQ ID NO: 1835488 - protein, 7 aa, Staphylococcus epidermidis
AGATTGQ

SEQ ID NO: 1835489 - protein, 4 aa, Staphylococcus epidermidis
AGGF

SEQ ID NO: 1835490 - protein, 6 aa, Staphylococcus epidermidis
AIPGDD

SEQ ID NO: 1835491 - protein, 10 aa, Staphylococcus epidermidis
AKVKPAGETA

SEQ ID NO: 1835492 - protein, 15 aa, Staphylococcus epidermidis
ALSAARPGARKETLE

SEQ ID NO: 1835493 - protein, 4 aa, Staphylococcus epidermidis
APGF

SEQ ID NO: 1835494 - protein, 7 aa, Staphylococcus epidermidis
APPYSHP

SEQ ID NO: 1835495 - protein, 19 aa, Staphylococcus epidermidis
AQAAEQNNDGYNPNDPYSY

SEQ ID NO: 1835496 - protein, 9 aa, Staphylococcus epidermidis
AQRESGGDI

SEQ ID NO: 1835497 - protein, 6 aa, Staphylococcus epidermidis
ASSNAQ

SEQ ID NO: 1835498 - protein, 6 aa, Staphylococcus epidermidis
ATANTI

SEQ ID NO: 1835499 - protein, 15 aa, Staphylococcus epidermidis
DAEASTQHKVQSGES

SEQ ID NO: 1835500 - protein, 7 aa, Staphylococcus epidermidis
DAGEQAT

SEQ ID NO: 1835501 - protein, 8 aa, Staphylococcus epidermidis
DDGAETDL

SEQ ID NO: 1835502 - protein, 26 aa, Staphylococcus epidermidis
DEILEQKESKLEERQQQVDAKESSVQ

SEQ ID NO: 1835503 - protein, 7 aa, Staphylococcus epidermidis
DHEVEGS

SEQ ID NO: 1835504 - protein, 5 aa, Staphylococcus epidermidis
DKGEI

SEQ ID NO: 1835505 - protein, 8 aa, Staphylococcus epidermidis
DPGTMSPY

SEQ ID NO: 1835506 - protein, 4 aa, Staphylococcus epidermidis
DTPE

SEQ ID NO: 1835507 - protein, 8 aa, Staphylococcus epidermidis
DVTSTAGY

SEQ ID NO: 1835508 - protein, 13 aa, Staphylococcus epidermidis
EADPTDDVEGVDA

SEQ ID NO: 1835509 - protein, 7 aa, Staphylococcus epidermidis
EDTQTWS

SEQ ID NO: 1835510 - protein, 16 aa, Staphylococcus epidermidis
EKEKEAKEKVDKTAKE

SEQ ID NO: 1835511 - protein, 8 aa, Staphylococcus epidermidis
EKGNAQEG

SEQ ID NO: 1835512 - protein, 8 aa, Staphylococcus epidermidis
ELTDATPA

SEQ ID NO: 1835513 - protein, 5 aa, Staphylococcus epidermidis
ENPED

SEQ ID NO: 1835514 - protein, 10 aa, Staphylococcus epidermidis
ENRQQIKDTI

SEQ ID NO: 1835515 - protein, 9 aa, Staphylococcus epidermidis
ESARGEGGR

SEQ ID NO: 1835516 - protein, 7 aa, Staphylococcus epidermidis
ESQARGL

SEQ ID NO: 1835517 - protein, 24 aa, Staphylococcus epidermidis
ETDFSDASRPIKDEEKKKLEDKGI

SEQ ID NO: 1835518 - protein, 5 aa, Staphylococcus epidermidis
ETGNG

SEQ ID NO: 1835519 - protein, 21 aa, Staphylococcus epidermidis
FKHGTTKDGVKSFDGTGPFKM

SEQ ID NO: 1835520 - protein, 12 aa, Staphylococcus epidermidis
FSQHGGNRLGAN

SEQ ID NO: 1835521 - protein, 12 aa, Staphylococcus epidermidis
GEMKTKPTQHSV

SEQ ID NO: 1835522 - protein, 7 aa, Staphylococcus epidermidis
GESTNAD

SEQ ID NO: 1835523 - protein, 6 aa, Staphylococcus epidermidis
GGATCA

SEQ ID NO: 1835524 - protein, 4 aa, Staphylococcus epidermidis
GHDQ

SEQ ID NO: 1835525 - protein, 4 aa, Staphylococcus epidermidis
GING

SEQ ID NO: 1835526 - protein, 11 aa, Staphylococcus epidermidis
GKEPPGTPPMT

SEQ ID NO: 1835527 - protein, 8 aa, Staphylococcus epidermidis
GKEQIANT

SEQ ID NO: 1835528 - protein, 8 aa, Staphylococcus epidermidis
GLNGPKAR

SEQ ID NO: 1835529 - protein, 15 aa, Staphylococcus epidermidis
GNPPYGERIGDREEV

SEQ ID NO: 1835530 - protein, 5 aa, Staphylococcus epidermidis
GRMEE

SEQ ID NO: 1835531 - protein, 4 aa, Staphylococcus epidermidis
GSGF

SEQ ID NO: 1835532 - protein, 4 aa, Staphylococcus epidermidis
GSMS

SEQ ID NO: 1835533 - protein, 21 aa, Staphylococcus epidermidis
GSNATESKDNTLISSKAGDVK

SEQ ID NO: 1835534 - protein, 7 aa, Staphylococcus epidermidis
GTSDDNL

SEQ ID NO: 1835535 - protein, 8 aa, Staphylococcus epidermidis
GTVAGPNA

SEQ ID NO: 1835536 - protein, 16 aa, Staphylococcus epidermidis
GVATKAGKDAKKDPIY

SEQ ID NO: 1835537 - protein, 5 aa, Staphylococcus epidermidis
HNPLN

SEQ ID NO: 1835538 - protein, 4 aa, Staphylococcus epidermidis
HRDY

SEQ ID NO: 1835539 - protein, 8 aa, Staphylococcus epidermidis
IGGTTGDI

SEQ ID NO: 1835540 - protein, 7 aa, Staphylococcus epidermidis
INKQNPD

SEQ ID NO: 1835541 - protein, 6 aa, Staphylococcus epidermidis
INPNEV

SEQ ID NO: 1835542 - protein, 10 aa, Staphylococcus epidermidis
INPSSGAAGK

SEQ ID NO: 1835543 - protein, 6 aa, Staphylococcus epidermidis
ISSEEM

SEQ ID NO: 1835544 - protein, 6 aa, Staphylococcus epidermidis
KAGQNT

SEQ ID NO: 1835545 - protein, 6 aa, Staphylococcus epidermidis
KAKQLT

SEQ ID NO: 1835546 - protein, 7 aa, Staphylococcus epidermidis
KARKEVD

SEQ ID NO: 1835547 - protein, 7 aa, Staphylococcus epidermidis
KATKRRK

SEQ ID NO: 1835548 - protein, 9 aa, Staphylococcus epidermidis
KDGNTPRAL

SEQ ID NO: 1835549 - protein, 5 aa, Staphylococcus epidermidis
KDNDF

SEQ ID NO: 1835550 - protein, 5 aa, Staphylococcus epidermidis
KDPHE

SEQ ID NO: 1835551 - protein, 9 aa, Staphylococcus epidermidis
KDTEENGKG

SEQ ID NO: 1835552 - protein, 15 aa, Staphylococcus epidermidis
KEPVYPGPATPEQLN

SEQ ID NO: 1835553 - protein, 8 aa, Staphylococcus epidermidis
KERRGDYL

SEQ ID NO: 1835554 - protein, 7 aa, Staphylococcus epidermidis
KGGQDNM

SEQ ID NO: 1835555 - protein, 17 aa, Staphylococcus epidermidis
KKESMDSSSAKKDGSLG

SEQ ID NO: 1835556 - protein, 21 aa, Staphylococcus epidermidis
KWAKDHKDAKISSGQAGTGAG

SEQ ID NO: 1835557 - protein, 6 aa, Staphylococcus epidermidis
KYETQL

SEQ ID NO: 1835558 - protein, 9 aa, Staphylococcus epidermidis
LEENGYEAY

SEQ ID NO: 1835559 - protein, 12 aa, Staphylococcus epidermidis
LNEPNSDDTGRI

SEQ ID NO: 1835560 - protein, 4 aa, Staphylococcus epidermidis
LTPP

SEQ ID NO: 1835561 - protein, 6 aa, Staphylococcus epidermidis
MGGQTI

SEQ ID NO: 1835562 - protein, 6 aa, Staphylococcus epidermidis
MGPSFN

SEQ ID NO: 1835563 - protein, 4 aa, Staphylococcus epidermidis
MTQD

SEQ ID NO: 1835564 - protein, 12 aa, Staphylococcus epidermidis
NAVSPNSSHGTY

SEQ ID NO: 1835565 - protein, 7 aa, Staphylococcus epidermidis
NGLNANN

SEQ ID NO: 1835566 - protein, 4 aa, Staphylococcus epidermidis
NKLR

SEQ ID NO: 1835567 - protein, 5 aa, Staphylococcus epidermidis
NPVYT

SEQ ID NO: 1835568 - protein, 6 aa, Staphylococcus epidermidis
NQIEEE

SEQ ID NO: 1835569 - protein, 7 aa, Staphylococcus epidermidis
NQPPVKA

SEQ ID NO: 1835570 - protein, 4 aa, Staphylococcus epidermidis
NRTG

SEQ ID NO: 1835571 - protein, 5 aa, Staphylococcus epidermidis
NSDGS

SEQ ID NO: 1835572 - protein, 10 aa, Staphylococcus epidermidis
NWGQSQRADL

SEQ ID NO: 1835573 - protein, 16 aa, Staphylococcus epidermidis
NWSPDRVNTSYNYNNY

SEQ ID NO: 1835574 - protein, 5 aa, Staphylococcus epidermidis
PEEID

SEQ ID NO: 1835575 - protein, 5 aa, Staphylococcus epidermidis
PQSTL

SEQ ID NO: 1835576 - protein, 12 aa, Staphylococcus epidermidis
QAKEQGKSTGLV

SEQ ID NO: 1835577 - protein, 17 aa, Staphylococcus epidermidis
QGGINGAVNTKGEGDSP

SEQ ID NO: 1835578 - protein, 8 aa, Staphylococcus epidermidis
QLGADTQY

SEQ ID NO: 1835579 - protein, 9 aa, Staphylococcus epidermidis
QNKDKLKEV

SEQ ID NO: 1835580 - protein, 7 aa, Staphylococcus epidermidis
RENSDLK

SEQ ID NO: 1835581 - protein, 6 aa, Staphylococcus epidermidis
RGGFDK

SEQ ID NO: 1835582 - protein, 7 aa, Staphylococcus epidermidis
RNAEEVG

SEQ ID NO: 1835583 - protein, 8 aa, Staphylococcus epidermidis
RNGVGRPE

SEQ ID NO: 1835584 - protein, 5 aa, Staphylococcus epidermidis
RNPDQ

SEQ ID NO: 1835585 - protein, 7 aa, Staphylococcus epidermidis
RPNRPQP

SEQ ID NO: 1835586 - protein, 10 aa, Staphylococcus epidermidis
RSSNEIGSDG

SEQ ID NO: 1835587 - protein, 10 aa, Staphylococcus epidermidis
RTANQKNLDE

SEQ ID NO: 1835588 - protein, 6 aa, Staphylococcus epidermidis
RTGNEI

SEQ ID NO: 1835589 - protein, 6 aa, Staphylococcus epidermidis
RTSYGQ

SEQ ID NO: 1835590 - protein, 11 aa, Staphylococcus epidermidis
SAYDKEDGDLT

SEQ ID NO: 1835591 - protein, 6 aa, Staphylococcus epidermidis
SDLGRE

SEQ ID NO: 1835592 - protein, 4 aa, Staphylococcus epidermidis
SESE

SEQ ID NO: 1835593 - protein, 5 aa, Staphylococcus epidermidis
SGAAA

SEQ ID NO: 1835594 - protein, 7 aa, Staphylococcus epidermidis
SGPSHAE

SEQ ID NO: 1835595 - protein, 9 aa, Staphylococcus epidermidis
SGSSTTTIK

SEQ ID NO: 1835596 - protein, 8 aa, Staphylococcus epidermidis
SIKDNEDI

SEQ ID NO: 1835597 - protein, 9 aa, Staphylococcus epidermidis
SLGKGITAA

SEQ ID NO: 1835598 - protein, 5 aa, Staphylococcus epidermidis
SLNGL

SEQ ID NO: 1835599 - protein, 8 aa, Staphylococcus epidermidis
SNNPAEQG

SEQ ID NO: 1835600 - protein, 8 aa, Staphylococcus epidermidis
SNPMPPRT

SEQ ID NO: 1835601 - protein, 5 aa, Staphylococcus epidermidis
SPRYG

SEQ ID NO: 1835602 - protein, 10 aa, Staphylococcus epidermidis
STEGKSKSDY

SEQ ID NO: 1835603 - protein, 10 aa, Staphylococcus epidermidis
SVTKNKEGIG

SEQ ID NO: 1835604 - protein, 5 aa, Staphylococcus epidermidis
TGGPG

SEQ ID NO: 1835605 - protein, 11 aa, Staphylococcus epidermidis
TNSMINTGSAA

SEQ ID NO: 1835606 - protein, 4 aa, Staphylococcus epidermidis
TVGS

SEQ ID NO: 1835607 - protein, 6 aa, Staphylococcus epidermidis
VASAKP

SEQ ID NO: 1835608 - protein, 10 aa, Staphylococcus epidermidis
VDAQQTARAL

SEQ ID NO: 1835609 - protein, 16 aa, Staphylococcus epidermidis
VDDYPKDVKKGKKQFD

SEQ ID NO: 1835610 - protein, 14 aa, Staphylococcus epidermidis
VKGLPKGENNQSLP

SEQ ID NO: 1835611 - protein, 6 aa, Staphylococcus epidermidis
VNDDGS

SEQ ID NO: 1835612 - protein, 5 aa, Staphylococcus epidermidis
VSTNY

SEQ ID NO: 1835613 - protein, 13 aa, Staphylococcus epidermidis
VYGKEPPGTPPMT

SEQ ID NO: 1835614 - protein, 6 aa, Staphylococcus epidermidis
WKPGQK

SEQ ID NO: 1835615 - protein, 13 aa, Staphylococcus epidermidis
YGNSDSKGKNIKG

SEQ ID NO: 1835616 - protein, 8 aa, Staphylococcus epidermidis
YKSSKGPD

SEQ ID NO: 1835617 - protein, 5 aa, Staphylococcus epidermidis
YPDYG

SEQ ID NO: 1835618 - protein, 6 aa, Staphylococcus epidermidis
YPKLEP

SEQ ID NO: 1835619 - protein, 4 aa, Staphylococcus epidermidis
YQPA

SEQ ID NO: 1835620 - protein, 9 aa, Staphylococcus epidermidis
YSDNTANNK

SEQ ID NO: 1835621 - protein, 7 aa, Staphylococcus epidermidis
YSNVTAG

SEQ ID NO: 1835622 - protein, 73 aa, Staphylococcus epidermidis
YSNYNNYSNYNNYNNYQSNNTQSQRTTQPTGGLGASYSTSSSNVHVTTTSAPSSNGVSLSNARSASGNLYTSG

SEQ ID NO: 1835623 - protein, 17 aa, Staphylococcus epidermidis
YSPKSKKDTSTPAAFGK

SEQ ID NO: 1835624 - protein, 10 aa, Staphylococcus epidermidis
YYSPELNQNV

SEQ ID NO: 1835625 - protein, 14 aa, Staphylococcus epidermidis
AAALADKSTRHSLK

SEQ ID NO: 1835626 - protein, 4 aa, Staphylococcus epidermidis
AAKS

SEQ ID NO: 1835627 - protein, 15 aa, Staphylococcus epidermidis
AAKYGHERYGKTYEG

SEQ ID NO: 1835628 - protein, 18 aa, Staphylococcus epidermidis
AALKQDKENTKEASSNKL

SEQ ID NO: 1835629 - protein, 7 aa, Staphylococcus epidermidis
AAPGNMT

SEQ ID NO: 1835630 - protein, 9 aa, Staphylococcus epidermidis
AARTGVSAS

SEQ ID NO: 1835631 - protein, 16 aa, Staphylococcus epidermidis
AATTGTGKGVLGDTKQ

SEQ ID NO: 1835632 - protein, 5 aa, Staphylococcus epidermidis
ADAAP

SEQ ID NO: 1835633 - protein, 8 aa, Staphylococcus epidermidis
ADMSNDTK

SEQ ID NO: 1835634 - protein, 10 aa, Staphylococcus epidermidis
ADNGGSTGKI

SEQ ID NO: 1835635 - protein, 7 aa, Staphylococcus epidermidis
ADPFYSQ

SEQ ID NO: 1835636 - protein, 5 aa, Staphylococcus epidermidis
AEENG

SEQ ID NO: 1835637 - protein, 6 aa, Staphylococcus epidermidis
AGAPYN

SEQ ID NO: 1835638 - protein, 7 aa, Staphylococcus epidermidis
AGPYGNQ

SEQ ID NO: 1835639 - protein, 22 aa, Staphylococcus epidermidis
AGTVSGKGDQTFKATKQQQIDK

SEQ ID NO: 1835640 - protein, 5 aa, Staphylococcus epidermidis
AGYPF

SEQ ID NO: 1835641 - protein, 17 aa, Staphylococcus epidermidis
AHATTPNMGQGASQAME

SEQ ID NO: 1835642 - protein, 5 aa, Staphylococcus epidermidis
AHQEK

SEQ ID NO: 1835643 - protein, 9 aa, Staphylococcus epidermidis
AIAPGTIET

SEQ ID NO: 1835644 - protein, 7 aa, Staphylococcus epidermidis
AIREVSK

SEQ ID NO: 1835645 - protein, 8 aa, Staphylococcus epidermidis
AKDTSPAF

SEQ ID NO: 1835646 - protein, 5 aa, Staphylococcus epidermidis
AKEEN

SEQ ID NO: 1835647 - protein, 8 aa, Staphylococcus epidermidis
AKNAGWTS

SEQ ID NO: 1835648 - protein, 6 aa, Staphylococcus epidermidis
AKTHKD

SEQ ID NO: 1835649 - protein, 9 aa, Staphylococcus epidermidis
AKVTTEEME

SEQ ID NO: 1835650 - protein, 9 aa, Staphylococcus epidermidis
ANEPQSTKA

SEQ ID NO: 1835651 - protein, 6 aa, Staphylococcus epidermidis
ANGPYN

SEQ ID NO: 1835652 - protein, 10 aa, Staphylococcus epidermidis
ANGYNGEDFE

SEQ ID NO: 1835653 - protein, 11 aa, Staphylococcus epidermidis
ANNPFKENEQK

SEQ ID NO: 1835654 - protein, 8 aa, Staphylococcus epidermidis
APADPGAV

SEQ ID NO: 1835655 - protein, 13 aa, Staphylococcus epidermidis
AQLGKPVSNRWGN

SEQ ID NO: 1835656 - protein, 12 aa, Staphylococcus epidermidis
AQQVGQAWDSVG

SEQ ID NO: 1835657 - protein, 9 aa, Staphylococcus epidermidis
AQSIDETYD

SEQ ID NO: 1835658 - protein, 18 aa, Staphylococcus epidermidis
ASNAANDGYQVDNTPSVG

SEQ ID NO: 1835659 - protein, 4 aa, Staphylococcus epidermidis
ATEF

SEQ ID NO: 1835660 - protein, 9 aa, Staphylococcus epidermidis
ATPHNGTHA

SEQ ID NO: 1835661 - protein, 17 aa, Staphylococcus epidermidis
ATRKQTSKDLELNYYES

SEQ ID NO: 1835662 - protein, 9 aa, Staphylococcus epidermidis
AVKGNEDKT

SEQ ID NO: 1835663 - protein, 10 aa, Staphylococcus epidermidis
CGADMAGNKG

SEQ ID NO: 1835664 - protein, 22 aa, Staphylococcus epidermidis
CGGGKDKEKTITVGASPAPHAE

SEQ ID NO: 1835665 - protein, 27 aa, Staphylococcus epidermidis
CGGNDGGSGDGKDLKGSAKGEGSSTVA

SEQ ID NO: 1835666 - protein, 12 aa, Staphylococcus epidermidis
CGGTSSTDKDTL

SEQ ID NO: 1835667 - protein, 7 aa, Staphylococcus epidermidis
DAETGQV

SEQ ID NO: 1835668 - protein, 10 aa, Staphylococcus epidermidis
DAHQIGKDQD

SEQ ID NO: 1835669 - protein, 9 aa, Staphylococcus epidermidis
DAKNSFDDV

SEQ ID NO: 1835670 - protein, 7 aa, Staphylococcus epidermidis
DAPQSNP

SEQ ID NO: 1835671 - protein, 16 aa, Staphylococcus epidermidis
DASKNENTQLLRDNLN

SEQ ID NO: 1835672 - protein, 20 aa, Staphylococcus epidermidis
DDITENKKDIKFNNKQSAEY

SEQ ID NO: 1835673 - protein, 13 aa, Staphylococcus epidermidis
DDLSQKSSKTIQD

SEQ ID NO: 1835674 - protein, 8 aa, Staphylococcus epidermidis
DEEDAARG

SEQ ID NO: 1835675 - protein, 9 aa, Staphylococcus epidermidis
DEHPNKKNQ

SEQ ID NO: 1835676 - protein, 6 aa, Staphylococcus epidermidis
DEKEWR

SEQ ID NO: 1835677 - protein, 4 aa, Staphylococcus epidermidis
DELQ

SEQ ID NO: 1835678 - protein, 10 aa, Staphylococcus epidermidis
DGDSETPNVE

SEQ ID NO: 1835679 - protein, 4 aa, Staphylococcus epidermidis
DGFN

SEQ ID NO: 1835680 - protein, 13 aa, Staphylococcus epidermidis
DGQVDTSKAGKYK

SEQ ID NO: 1835681 - protein, 8 aa, Staphylococcus epidermidis
DGRPELPK

SEQ ID NO: 1835682 - protein, 8 aa, Staphylococcus epidermidis
DGTSNTPL

SEQ ID NO: 1835683 - protein, 22 aa, Staphylococcus epidermidis
DGVPKDYKVADKSGQAITYASR

SEQ ID NO: 1835684 - protein, 21 aa, Staphylococcus epidermidis
DHAQPSSWHNDTHRVKSPEWS

SEQ ID NO: 1835685 - protein, 19 aa, Staphylococcus epidermidis
DIFSSNKKGQKISEKEMKQ

SEQ ID NO: 1835686 - protein, 8 aa, Staphylococcus epidermidis
DKAWREND

SEQ ID NO: 1835687 - protein, 7 aa, Staphylococcus epidermidis
DKEGHLE

SEQ ID NO: 1835688 - protein, 13 aa, Staphylococcus epidermidis
DKESAKDIHPNNR

SEQ ID NO: 1835689 - protein, 15 aa, Staphylococcus epidermidis
DKETDFNSEKSNIKQ

SEQ ID NO: 1835690 - protein, 12 aa, Staphylococcus epidermidis
DKGSSSQKEQAE

SEQ ID NO: 1835691 - protein, 9 aa, Staphylococcus epidermidis
DKPESKENI

SEQ ID NO: 1835692 - protein, 13 aa, Staphylococcus epidermidis
DKQKSKTNVQINN

SEQ ID NO: 1835693 - protein, 19 aa, Staphylococcus epidermidis
DKQSDSNPKITESQADRLS

SEQ ID NO: 1835694 - protein, 9 aa, Staphylococcus epidermidis
DKSKKRPLN

SEQ ID NO: 1835695 - protein, 6 aa, Staphylococcus epidermidis
DLDKDM

SEQ ID NO: 1835696 - protein, 18 aa, Staphylococcus epidermidis
DNEGREKNGQSVEHSRSD

SEQ ID NO: 1835697 - protein, 4 aa, Staphylococcus epidermidis
DNGF

SEQ ID NO: 1835698 - protein, 4 aa, Staphylococcus epidermidis
DNQK

SEQ ID NO: 1835699 - protein, 7 aa, Staphylococcus epidermidis
DNRTTEI

SEQ ID NO: 1835700 - protein, 8 aa, Staphylococcus epidermidis
DNSPYQGY

SEQ ID NO: 1835701 - protein, 8 aa, Staphylococcus epidermidis
DPSKSNTY

SEQ ID NO: 1835702 - protein, 9 aa, Staphylococcus epidermidis
DQLTTNNQG

SEQ ID NO: 1835703 - protein, 5 aa, Staphylococcus epidermidis
DRVDR

SEQ ID NO: 1835704 - protein, 7 aa, Staphylococcus epidermidis
DSAGGQI

SEQ ID NO: 1835705 - protein, 17 aa, Staphylococcus epidermidis
DSDEKRKQQGGGERSDT

SEQ ID NO: 1835706 - protein, 24 aa, Staphylococcus epidermidis
DSKGHKTDQVQKTLSVTKTATLGN

SEQ ID NO: 1835707 - protein, 14 aa, Staphylococcus epidermidis
DSLSAIASKYGTTY

SEQ ID NO: 1835708 - protein, 7 aa, Staphylococcus epidermidis
DSQDTRD

SEQ ID NO: 1835709 - protein, 7 aa, Staphylococcus epidermidis
DTGSTKL

SEQ ID NO: 1835710 - protein, 13 aa, Staphylococcus epidermidis
DTKSGKEVKFNSD

SEQ ID NO: 1835711 - protein, 6 aa, Staphylococcus epidermidis
DTQVEN

SEQ ID NO: 1835712 - protein, 7 aa, Staphylococcus epidermidis
DVKPTEV

SEQ ID NO: 1835713 - protein, 12 aa, Staphylococcus epidermidis
DYADSMRKQGYQ

SEQ ID NO: 1835714 - protein, 6 aa, Staphylococcus epidermidis
DYRDQL

SEQ ID NO: 1835715 - protein, 6 aa, Staphylococcus epidermidis
EADSSN

SEQ ID NO: 1835716 - protein, 8 aa, Staphylococcus epidermidis
EAKKRNSE

SEQ ID NO: 1835717 - protein, 10 aa, Staphylococcus epidermidis
EATDKNQKGV

SEQ ID NO: 1835718 - protein, 13 aa, Staphylococcus epidermidis
EDSRNTKTGGSGL

SEQ ID NO: 1835719 - protein, 5 aa, Staphylococcus epidermidis
EEELS

SEQ ID NO: 1835720 - protein, 5 aa, Staphylococcus epidermidis
EEQGH

SEQ ID NO: 1835721 - protein, 6 aa, Staphylococcus epidermidis
EGEVSK

SEQ ID NO: 1835722 - protein, 7 aa, Staphylococcus epidermidis
EGHQLDT

SEQ ID NO: 1835723 - protein, 14 aa, Staphylococcus epidermidis
EGNFPVQGRSVKST

SEQ ID NO: 1835724 - protein, 19 aa, Staphylococcus epidermidis
EHKKDISAEFNKNNQYWGE

SEQ ID NO: 1835725 - protein, 15 aa, Staphylococcus epidermidis
EHNGVSNEAKAQTAH

SEQ ID NO: 1835726 - protein, 5 aa, Staphylococcus epidermidis
EIGKG

SEQ ID NO: 1835727 - protein, 29 aa, Staphylococcus epidermidis
EIRRNNPELERSIKDAKETFVNRKNQRLG

SEQ ID NO: 1835728 - protein, 33 aa, Staphylococcus epidermidis
EKGSSKKDKNKIKQLEAKNEELESENKKYKKEL

SEQ ID NO: 1835729 - protein, 11 aa, Staphylococcus epidermidis
EKIRDNGELAK

SEQ ID NO: 1835730 - protein, 7 aa, Staphylococcus epidermidis
EKLGADP

SEQ ID NO: 1835731 - protein, 6 aa, Staphylococcus epidermidis
EKPKNT

SEQ ID NO: 1835732 - protein, 13 aa, Staphylococcus epidermidis
EKVKREKQDVDQL

SEQ ID NO: 1835733 - protein, 13 aa, Staphylococcus epidermidis
EKVNIKKGKKSAL

SEQ ID NO: 1835734 - protein, 10 aa, Staphylococcus epidermidis
EKVQKKPKLL

SEQ ID NO: 1835735 - protein, 9 aa, Staphylococcus epidermidis
ELAKKDDID

SEQ ID NO: 1835736 - protein, 8 aa, Staphylococcus epidermidis
ELKGVKSE

SEQ ID NO: 1835737 - protein, 13 aa, Staphylococcus epidermidis
ENKAKKKEVEQLD

SEQ ID NO: 1835738 - protein, 5 aa, Staphylococcus epidermidis
ENKTH

SEQ ID NO: 1835739 - protein, 14 aa, Staphylococcus epidermidis
ENMNAEEPSQKDLT

SEQ ID NO: 1835740 - protein, 4 aa, Staphylococcus epidermidis
ENVD

SEQ ID NO: 1835741 - protein, 9 aa, Staphylococcus epidermidis
EPNKYEDSF

SEQ ID NO: 1835742 - protein, 19 aa, Staphylococcus epidermidis
EQAENELRERRGELQRQET

SEQ ID NO: 1835743 - protein, 10 aa, Staphylococcus epidermidis
EQKDIEDLGG

SEQ ID NO: 1835744 - protein, 7 aa, Staphylococcus epidermidis
EQLSQPG

SEQ ID NO: 1835745 - protein, 6 aa, Staphylococcus epidermidis
EQNSNS

SEQ ID NO: 1835746 - protein, 6 aa, Staphylococcus epidermidis
ERDQDT

SEQ ID NO: 1835747 - protein, 15 aa, Staphylococcus epidermidis
ESDSGKSSLAQSPNH

SEQ ID NO: 1835748 - protein, 16 aa, Staphylococcus epidermidis
ESNGQLHARNASGAAG

SEQ ID NO: 1835749 - protein, 10 aa, Staphylococcus epidermidis
ESQKNSAGKV

SEQ ID NO: 1835750 - protein, 5 aa, Staphylococcus epidermidis
ESSIH

SEQ ID NO: 1835751 - protein, 21 aa, Staphylococcus epidermidis
ESVDSESQSEEDKKKEKEIRQ

SEQ ID NO: 1835752 - protein, 9 aa, Staphylococcus epidermidis
ETFQSPREI

SEQ ID NO: 1835753 - protein, 27 aa, Staphylococcus epidermidis
ETGNGTSQLAKGGDVSKGKFTTKTGHK

SEQ ID NO: 1835754 - protein, 6 aa, Staphylococcus epidermidis
ETQNIE

SEQ ID NO: 1835755 - protein, 6 aa, Staphylococcus epidermidis
ETYSQE

SEQ ID NO: 1835756 - protein, 9 aa, Staphylococcus epidermidis
EVPESDTHR

SEQ ID NO: 1835757 - protein, 12 aa, Staphylococcus epidermidis
FAEGDESLNQQN

SEQ ID NO: 1835758 - protein, 14 aa, Staphylococcus epidermidis
FASTESTATNQTQQ

SEQ ID NO: 1835759 - protein, 11 aa, Staphylococcus epidermidis
FAYASTSKAIN

SEQ ID NO: 1835760 - protein, 8 aa, Staphylococcus epidermidis
FDGDYNEN

SEQ ID NO: 1835761 - protein, 8 aa, Staphylococcus epidermidis
FEASQSMQ

SEQ ID NO: 1835762 - protein, 17 aa, Staphylococcus epidermidis
FGLNGTTKDIESNPKDL

SEQ ID NO: 1835763 - protein, 9 aa, Staphylococcus epidermidis
FGNTKNPKN

SEQ ID NO: 1835764 - protein, 9 aa, Staphylococcus epidermidis
FKEENPEEI

SEQ ID NO: 1835765 - protein, 12 aa, Staphylococcus epidermidis
FKEISKTKKGHK

SEQ ID NO: 1835766 - protein, 16 aa, Staphylococcus epidermidis
FKNSSKVNKDTNDVAD

SEQ ID NO: 1835767 - protein, 4 aa, Staphylococcus epidermidis
FPEY

SEQ ID NO: 1835768 - protein, 11 aa, Staphylococcus epidermidis
FQGQDNRNNAA

SEQ ID NO: 1835769 - protein, 7 aa, Staphylococcus epidermidis
FSNSGSR

SEQ ID NO: 1835770 - protein, 8 aa, Staphylococcus epidermidis
FTSNGSEW

SEQ ID NO: 1835771 - protein, 10 aa, Staphylococcus epidermidis
GAGSLATGSA

SEQ ID NO: 1835772 - protein, 13 aa, Staphylococcus epidermidis
GAHSAELDPSTPY

SEQ ID NO: 1835773 - protein, 5 aa, Staphylococcus epidermidis
GAIST

SEQ ID NO: 1835774 - protein, 39 aa, Staphylococcus epidermidis
GDGHKQTSSDKEQSEHKDNHNKNQVKQIATDKKVQGDNY

SEQ ID NO: 1835775 - protein, 8 aa, Staphylococcus epidermidis
GDKQYKNQ

SEQ ID NO: 1835776 - protein, 17 aa, Staphylococcus epidermidis
GDTADGYSGVKGIGEKT

SEQ ID NO: 1835777 - protein, 8 aa, Staphylococcus epidermidis
GDYKGQSV

SEQ ID NO: 1835778 - protein, 12 aa, Staphylococcus epidermidis
GEEGNKNKQDPH

SEQ ID NO: 1835779 - protein, 9 aa, Staphylococcus epidermidis
GEKTHVDGD

SEQ ID NO: 1835780 - protein, 4 aa, Staphylococcus epidermidis
GESM

SEQ ID NO: 1835781 - protein, 4 aa, Staphylococcus epidermidis
GGHG

SEQ ID NO: 1835782 - protein, 18 aa, Staphylococcus epidermidis
GGKVNLDPNSVSNESLNQ

SEQ ID NO: 1835783 - protein, 4 aa, Staphylococcus epidermidis
GGQT

SEQ ID NO: 1835784 - protein, 8 aa, Staphylococcus epidermidis
GGSERSET

SEQ ID NO: 1835785 - protein, 11 aa, Staphylococcus epidermidis
GIADDNKKNRI

SEQ ID NO: 1835786 - protein, 7 aa, Staphylococcus epidermidis
GIDQPGH

SEQ ID NO: 1835787 - protein, 9 aa, Staphylococcus epidermidis
GIKNAGQNL

SEQ ID NO: 1835788 - protein, 10 aa, Staphylococcus epidermidis
GISESTEKTV

SEQ ID NO: 1835789 - protein, 12 aa, Staphylococcus epidermidis
GKAKEKEWREND

SEQ ID NO: 1835790 - protein, 16 aa, Staphylococcus epidermidis
GKGTEGWQNTSGTYRK

SEQ ID NO: 1835791 - protein, 8 aa, Staphylococcus epidermidis
GKIKSGES

SEQ ID NO: 1835792 - protein, 8 aa, Staphylococcus epidermidis
GKTTGTDA

SEQ ID NO: 1835793 - protein, 21 aa, Staphylococcus epidermidis
GKTYKYNDYSDHYPLSGYASN

SEQ ID NO: 1835794 - protein, 5 aa, Staphylococcus epidermidis
GLPDQ

SEQ ID NO: 1835795 - protein, 40 aa, Staphylococcus epidermidis
GNAGHDAHASETTNVDKAELAQKALTNDQSLNESPVQEGA

SEQ ID NO: 1835796 - protein, 29 aa, Staphylococcus epidermidis
GNNSSNNKDNQSSSKDKDTLRVGTEGTYA

SEQ ID NO: 1835797 - protein, 4 aa, Staphylococcus epidermidis
GNTP

SEQ ID NO: 1835798 - protein, 4 aa, Staphylococcus epidermidis
GNVT

SEQ ID NO: 1835799 - protein, 18 aa, Staphylococcus epidermidis
GQDPHEYEVKPKDIKALT

SEQ ID NO: 1835800 - protein, 13 aa, Staphylococcus epidermidis
GQDSTDTKRTRDE

SEQ ID NO: 1835801 - protein, 4 aa, Staphylococcus epidermidis
GQEY

SEQ ID NO: 1835802 - protein, 8 aa, Staphylococcus epidermidis
GQGNLPKS

SEQ ID NO: 1835803 - protein, 8 aa, Staphylococcus epidermidis
GREGRNIR

SEQ ID NO: 1835804 - protein, 15 aa, Staphylococcus epidermidis
GSNKELTEKKENKVL

SEQ ID NO: 1835805 - protein, 9 aa, Staphylococcus epidermidis
GTDHADPHQ

SEQ ID NO: 1835806 - protein, 5 aa, Staphylococcus epidermidis
GTENA

SEQ ID NO: 1835807 - protein, 8 aa, Staphylococcus epidermidis
GVDEETAL

SEQ ID NO: 1835808 - protein, 9 aa, Staphylococcus epidermidis
GVDNGAGRI

SEQ ID NO: 1835809 - protein, 18 aa, Staphylococcus epidermidis
GVNKDREKKYKFSEPYTY

SEQ ID NO: 1835810 - protein, 9 aa, Staphylococcus epidermidis
GVNSNGSIR

SEQ ID NO: 1835811 - protein, 13 aa, Staphylococcus epidermidis
GYKQNRPAPPDEL

SEQ ID NO: 1835812 - protein, 8 aa, Staphylococcus epidermidis
GYTASGGD

SEQ ID NO: 1835813 - protein, 10 aa, Staphylococcus epidermidis
GYVDTKDSDF

SEQ ID NO: 1835814 - protein, 14 aa, Staphylococcus epidermidis
HAAKYGHKRYGRTY

SEQ ID NO: 1835815 - protein, 22 aa, Staphylococcus epidermidis
HDGTKFDADAVKKNIDAVQQNK

SEQ ID NO: 1835816 - protein, 6 aa, Staphylococcus epidermidis
HDQKAA

SEQ ID NO: 1835817 - protein, 6 aa, Staphylococcus epidermidis
HEQTTF

SEQ ID NO: 1835818 - protein, 7 aa, Staphylococcus epidermidis
HGDVEPT

SEQ ID NO: 1835819 - protein, 14 aa, Staphylococcus epidermidis
HGPGGRIAEFIEGI

SEQ ID NO: 1835820 - protein, 28 aa, Staphylococcus epidermidis
HGSPEEVEYQKQHGGDISPLYKGGQDNM

SEQ ID NO: 1835821 - protein, 5 aa, Staphylococcus epidermidis
HKRAI

SEQ ID NO: 1835822 - protein, 14 aa, Staphylococcus epidermidis
HNPEELNAKPVQAG

SEQ ID NO: 1835823 - protein, 12 aa, Staphylococcus epidermidis
HQTNETKQSHSF

SEQ ID NO: 1835824 - protein, 4 aa, Staphylococcus epidermidis
HSNN

SEQ ID NO: 1835825 - protein, 8 aa, Staphylococcus epidermidis
HSYEPTQK

SEQ ID NO: 1835826 - protein, 5 aa, Staphylococcus epidermidis
HTPEV

SEQ ID NO: 1835827 - protein, 12 aa, Staphylococcus epidermidis
IADGKDPEKVIK

SEQ ID NO: 1835828 - protein, 11 aa, Staphylococcus epidermidis
IEKDPKHQAYY

SEQ ID NO: 1835829 - protein, 5 aa, Staphylococcus epidermidis
IEQTS

SEQ ID NO: 1835830 - protein, 9 aa, Staphylococcus epidermidis
IGKGKAAFI

SEQ ID NO: 1835831 - protein, 8 aa, Staphylococcus epidermidis
IGKQRSEQ

SEQ ID NO: 1835832 - protein, 17 aa, Staphylococcus epidermidis
IGKYTSVGTRKQPNLEE

SEQ ID NO: 1835833 - protein, 5 aa, Staphylococcus epidermidis
IKEDK

SEQ ID NO: 1835834 - protein, 10 aa, Staphylococcus epidermidis
INELEEKKQK

SEQ ID NO: 1835835 - protein, 5 aa, Staphylococcus epidermidis
INGDG

SEQ ID NO: 1835836 - protein, 18 aa, Staphylococcus epidermidis
INGETSDKVAERRSSGDY

SEQ ID NO: 1835837 - protein, 9 aa, Staphylococcus epidermidis
INSNGSVTV

SEQ ID NO: 1835838 - protein, 12 aa, Staphylococcus epidermidis
IPASEVSSYAFI

SEQ ID NO: 1835839 - protein, 18 aa, Staphylococcus epidermidis
IPRDTKAEIAGRGTEEKI

SEQ ID NO: 1835840 - protein, 8 aa, Staphylococcus epidermidis
IPSKPNEK

SEQ ID NO: 1835841 - protein, 10 aa, Staphylococcus epidermidis
IQQDDTNDIE

SEQ ID NO: 1835842 - protein, 8 aa, Staphylococcus epidermidis
IRGKSTIT

SEQ ID NO: 1835843 - protein, 5 aa, Staphylococcus epidermidis
IRVKQ

SEQ ID NO: 1835844 - protein, 12 aa, Staphylococcus epidermidis
ISNIPSKIKNGV

SEQ ID NO: 1835845 - protein, 9 aa, Staphylococcus epidermidis
ITNSMTNNS

SEQ ID NO: 1835846 - protein, 7 aa, Staphylococcus epidermidis
KAATLGD

SEQ ID NO: 1835847 - protein, 17 aa, Staphylococcus epidermidis
KAGDSLSSIAAKYGTTY

SEQ ID NO: 1835848 - protein, 7 aa, Staphylococcus epidermidis
KAKPVYG

SEQ ID NO: 1835849 - protein, 9 aa, Staphylococcus epidermidis
KANNSGIRA

SEQ ID NO: 1835850 - protein, 13 aa, Staphylococcus epidermidis
KASNHKATSYTLG

SEQ ID NO: 1835851 - protein, 16 aa, Staphylococcus epidermidis
KASSNEPSLKELEKDP

SEQ ID NO: 1835852 - protein, 14 aa, Staphylococcus epidermidis
KDGEVTKYDEDGEP

SEQ ID NO: 1835853 - protein, 18 aa, Staphylococcus epidermidis
KDIKEGNRTRKPSKISSI

SEQ ID NO: 1835854 - protein, 14 aa, Staphylococcus epidermidis
KDIYSGKAKTWKDV

SEQ ID NO: 1835855 - protein, 4 aa, Staphylococcus epidermidis
KDKY

SEQ ID NO: 1835856 - protein, 12 aa, Staphylococcus epidermidis
KDMNNEEKNSNV

SEQ ID NO: 1835857 - protein, 8 aa, Staphylococcus epidermidis
KDQETFNR

SEQ ID NO: 1835858 - protein, 7 aa, Staphylococcus epidermidis
KDWKPGQ

SEQ ID NO: 1835859 - protein, 6 aa, Staphylococcus epidermidis
KDWTPK

SEQ ID NO: 1835860 - protein, 34 aa, Staphylococcus epidermidis
KEAQKALKEDTKDGEKPVDLSKKEIEEIENELAK

SEQ ID NO: 1835861 - protein, 15 aa, Staphylococcus epidermidis
KEENLDRKSDLLDKK

SEQ ID NO: 1835862 - protein, 12 aa, Staphylococcus epidermidis
KEGDPKYQSFGK

SEQ ID NO: 1835863 - protein, 8 aa, Staphylococcus epidermidis
KEKMPNMK

SEQ ID NO: 1835864 - protein, 8 aa, Staphylococcus epidermidis
KEKRSYKS

SEQ ID NO: 1835865 - protein, 11 aa, Staphylococcus epidermidis
KEPEKDSDGSW

SEQ ID NO: 1835866 - protein, 7 aa, Staphylococcus epidermidis
KEQKGLG

SEQ ID NO: 1835867 - protein, 40 aa, Staphylococcus epidermidis
KGETNFAYTDDRGTDSLDKDSLKQLKETGSYQVKRSQAMN

SEQ ID NO: 1835868 - protein, 12 aa, Staphylococcus epidermidis
KGFTNKTGLQGW

SEQ ID NO: 1835869 - protein, 11 aa, Staphylococcus epidermidis
KGHAEQNKSAF

SEQ ID NO: 1835870 - protein, 8 aa, Staphylococcus epidermidis
KGIPTNGI

SEQ ID NO: 1835871 - protein, 9 aa, Staphylococcus epidermidis
KGKVGNSDN

SEQ ID NO: 1835872 - protein, 9 aa, Staphylococcus epidermidis
KGSKAGIKN

SEQ ID NO: 1835873 - protein, 35 aa, Staphylococcus epidermidis
KGTNRTYSNDPKENVTDSAAGGTAFSTGHKTYNGA

SEQ ID NO: 1835874 - protein, 25 aa, Staphylococcus epidermidis
KGYETKDNKKIEKGQKKLATINTNL

SEQ ID NO: 1835875 - protein, 7 aa, Staphylococcus epidermidis
KIGGTKA

SEQ ID NO: 1835876 - protein, 6 aa, Staphylococcus epidermidis
KINGKH

SEQ ID NO: 1835877 - protein, 22 aa, Staphylococcus epidermidis
KINVTKNNKRLSIKEKRAVDRG

SEQ ID NO: 1835878 - protein, 7 aa, Staphylococcus epidermidis
KITNKND

SEQ ID NO: 1835879 - protein, 8 aa, Staphylococcus epidermidis
KKAAPKAK

SEQ ID NO: 1835880 - protein, 11 aa, Staphylococcus epidermidis
KKAHKDTNIEA

SEQ ID NO: 1835881 - protein, 8 aa, Staphylococcus epidermidis
KKAYYNKD

SEQ ID NO: 1835882 - protein, 4 aa, Staphylococcus epidermidis
KKEI

SEQ ID NO: 1835883 - protein, 9 aa, Staphylococcus epidermidis
KKESQSSMK

SEQ ID NO: 1835884 - protein, 6 aa, Staphylococcus epidermidis
KKFQDK

SEQ ID NO: 1835885 - protein, 11 aa, Staphylococcus epidermidis
KKNKAHDTYNY

SEQ ID NO: 1835886 - protein, 8 aa, Staphylococcus epidermidis
KKNTENLG

SEQ ID NO: 1835887 - protein, 7 aa, Staphylococcus epidermidis
KKRHANR

SEQ ID NO: 1835888 - protein, 6 aa, Staphylococcus epidermidis
KKYNEN

SEQ ID NO: 1835889 - protein, 7 aa, Staphylococcus epidermidis
KLEEQGA

SEQ ID NO: 1835890 - protein, 8 aa, Staphylococcus epidermidis
KLLETDKK

SEQ ID NO: 1835891 - protein, 6 aa, Staphylococcus epidermidis
KLNKVE

SEQ ID NO: 1835892 - protein, 21 aa, Staphylococcus epidermidis
KLQEKKQQKIAKNDSGDEVKH

SEQ ID NO: 1835893 - protein, 9 aa, Staphylococcus epidermidis
KLWTTKDNG

SEQ ID NO: 1835894 - protein, 25 aa, Staphylococcus epidermidis
KNEANMYGSENKSYNDYSIEQTEDG

SEQ ID NO: 1835895 - protein, 4 aa, Staphylococcus epidermidis
KNIN

SEQ ID NO: 1835896 - protein, 8 aa, Staphylococcus epidermidis
KNIPKNEP

SEQ ID NO: 1835897 - protein, 13 aa, Staphylococcus epidermidis
KNKPGAKKMTPTA

SEQ ID NO: 1835898 - protein, 16 aa, Staphylococcus epidermidis
KNKSYTSVKDLNQNDK

SEQ ID NO: 1835899 - protein, 9 aa, Staphylococcus epidermidis
KNRNSGDVE

SEQ ID NO: 1835900 - protein, 56 aa, Staphylococcus epidermidis
KNRTEVESDINKAQNKEDASQLKSKLEENNQQLKDTAKKYLNSSNNDSDSAKEAIK

SEQ ID NO: 1835901 - protein, 6 aa, Staphylococcus epidermidis
KNSTLS

SEQ ID NO: 1835902 - protein, 7 aa, Staphylococcus epidermidis
KNVKTDL

SEQ ID NO: 1835903 - protein, 17 aa, Staphylococcus epidermidis
KPADKKVSKSPHGQNIN

SEQ ID NO: 1835904 - protein, 12 aa, Staphylococcus epidermidis
KPDSAENDGRGT

SEQ ID NO: 1835905 - protein, 7 aa, Staphylococcus epidermidis
KPIPNDT

SEQ ID NO: 1835906 - protein, 5 aa, Staphylococcus epidermidis
KPSQI

SEQ ID NO: 1835907 - protein, 14 aa, Staphylococcus epidermidis
KQDIKAEKNADTNA

SEQ ID NO: 1835908 - protein, 6 aa, Staphylococcus epidermidis
KQENRT

SEQ ID NO: 1835909 - protein, 8 aa, Staphylococcus epidermidis
KQHSRQYA

SEQ ID NO: 1835910 - protein, 8 aa, Staphylococcus epidermidis
KQKPNAKI

SEQ ID NO: 1835911 - protein, 8 aa, Staphylococcus epidermidis
KQKPNESY

SEQ ID NO: 1835912 - protein, 4 aa, Staphylococcus epidermidis
KQNM

SEQ ID NO: 1835913 - protein, 4 aa, Staphylococcus epidermidis
KRIA

SEQ ID NO: 1835914 - protein, 7 aa, Staphylococcus epidermidis
KRNYEAD

SEQ ID NO: 1835915 - protein, 6 aa, Staphylococcus epidermidis
KSDRVN

SEQ ID NO: 1835916 - protein, 36 aa, Staphylococcus epidermidis
KSKSSDKEGLSDKKAKEKAEKIQKEVEKNPNKFGEI

SEQ ID NO: 1835917 - protein, 5 aa, Staphylococcus epidermidis
KSQSV

SEQ ID NO: 1835918 - protein, 6 aa, Staphylococcus epidermidis
KSSIKS

SEQ ID NO: 1835919 - protein, 5 aa, Staphylococcus epidermidis
KSTQM

SEQ ID NO: 1835920 - protein, 7 aa, Staphylococcus epidermidis
KTEDRVM

SEQ ID NO: 1835921 - protein, 11 aa, Staphylococcus epidermidis
KTEETKEMMDG

SEQ ID NO: 1835922 - protein, 9 aa, Staphylococcus epidermidis
KTGNQTRKY

SEQ ID NO: 1835923 - protein, 7 aa, Staphylococcus epidermidis
KTNTNVS

SEQ ID NO: 1835924 - protein, 8 aa, Staphylococcus epidermidis
KVENDQYG

SEQ ID NO: 1835925 - protein, 7 aa, Staphylococcus epidermidis
KVGPHYP

SEQ ID NO: 1835926 - protein, 8 aa, Staphylococcus epidermidis
KVHTNKEG

SEQ ID NO: 1835927 - protein, 21 aa, Staphylococcus epidermidis
KYFGKENKNLAKKFKKDGYDI

SEQ ID NO: 1835928 - protein, 13 aa, Staphylococcus epidermidis
KYTKESKGSSIEE

SEQ ID NO: 1835929 - protein, 11 aa, Staphylococcus epidermidis
LDNGDLSSDSF

SEQ ID NO: 1835930 - protein, 10 aa, Staphylococcus epidermidis
LEAKEENQIL

SEQ ID NO: 1835931 - protein, 5 aa, Staphylococcus epidermidis
LEEAQ

SEQ ID NO: 1835932 - protein, 19 aa, Staphylococcus epidermidis
LEHHDKKDKSTYEKQGNAY

SEQ ID NO: 1835933 - protein, 7 aa, Staphylococcus epidermidis
LGTPDEV

SEQ ID NO: 1835934 - protein, 18 aa, Staphylococcus epidermidis
LGTPHNGTPAADKLGSTK

SEQ ID NO: 1835935 - protein, 15 aa, Staphylococcus epidermidis
LIPSSTAADYDETLN

SEQ ID NO: 1835936 - protein, 9 aa, Staphylococcus epidermidis
LKASSDYYD

SEQ ID NO: 1835937 - protein, 6 aa, Staphylococcus epidermidis
LKRKNA

SEQ ID NO: 1835938 - protein, 14 aa, Staphylococcus epidermidis
LNAEATTNTEPQLK

SEQ ID NO: 1835939 - protein, 9 aa, Staphylococcus epidermidis
LNKLSKNNK

SEQ ID NO: 1835940 - protein, 4 aa, Staphylococcus epidermidis
LNNG

SEQ ID NO: 1835941 - protein, 9 aa, Staphylococcus epidermidis
LNNSDDAKN

SEQ ID NO: 1835942 - protein, 19 aa, Staphylococcus epidermidis
LNTESKEKGYKIESAGNVE

SEQ ID NO: 1835943 - protein, 4 aa, Staphylococcus epidermidis
LRDK

SEQ ID NO: 1835944 - protein, 10 aa, Staphylococcus epidermidis
LSDDVTKGLS

SEQ ID NO: 1835945 - protein, 7 aa, Staphylococcus epidermidis
LSERTKR

SEQ ID NO: 1835946 - protein, 8 aa, Staphylococcus epidermidis
LSESYDGV

SEQ ID NO: 1835947 - protein, 15 aa, Staphylococcus epidermidis
LSGHEAHASETTNVD

SEQ ID NO: 1835948 - protein, 6 aa, Staphylococcus epidermidis
LSQTGA

SEQ ID NO: 1835949 - protein, 7 aa, Staphylococcus epidermidis
LTGPQSK

SEQ ID NO: 1835950 - protein, 9 aa, Staphylococcus epidermidis
LTQQGTLSA

SEQ ID NO: 1835951 - protein, 32 aa, Staphylococcus epidermidis
LVEDRSPKYLREDNGKPKKTYDGFKEQDNGKL

SEQ ID NO: 1835952 - protein, 4 aa, Staphylococcus epidermidis
MGGQ

SEQ ID NO: 1835953 - protein, 10 aa, Staphylococcus epidermidis
MTTSEIQSFG

SEQ ID NO: 1835954 - protein, 11 aa, Staphylococcus epidermidis
NAKHNLTQKEI

SEQ ID NO: 1835955 - protein, 8 aa, Staphylococcus epidermidis
NAKVNNGQ

SEQ ID NO: 1835956 - protein, 14 aa, Staphylococcus epidermidis
NAMDTKRLANDSSL

SEQ ID NO: 1835957 - protein, 8 aa, Staphylococcus epidermidis
NASESEIN

SEQ ID NO: 1835958 - protein, 15 aa, Staphylococcus epidermidis
NDKDQSTRKKAAEDI

SEQ ID NO: 1835959 - protein, 14 aa, Staphylococcus epidermidis
NDTPSIENVNADEY

SEQ ID NO: 1835960 - protein, 8 aa, Staphylococcus epidermidis
NEQQEKTE

SEQ ID NO: 1835961 - protein, 10 aa, Staphylococcus epidermidis
NGAKGNPRNI

SEQ ID NO: 1835962 - protein, 23 aa, Staphylococcus epidermidis
NGDIKSGKKISTVDYNKSKQTFD

SEQ ID NO: 1835963 - protein, 10 aa, Staphylococcus epidermidis
NGKKERGNVT

SEQ ID NO: 1835964 - protein, 4 aa, Staphylococcus epidermidis
NGKW

SEQ ID NO: 1835965 - protein, 9 aa, Staphylococcus epidermidis
NGNQEEIDY

SEQ ID NO: 1835966 - protein, 18 aa, Staphylococcus epidermidis
NHSELRSGKVNLKNGDPF

SEQ ID NO: 1835967 - protein, 7 aa, Staphylococcus epidermidis
NIESSKA

SEQ ID NO: 1835968 - protein, 13 aa, Staphylococcus epidermidis
NKAKQILKEYQFS

SEQ ID NO: 1835969 - protein, 13 aa, Staphylococcus epidermidis
NKDELNQSQSKQV

SEQ ID NO: 1835970 - protein, 8 aa, Staphylococcus epidermidis
NKESDGNY

SEQ ID NO: 1835971 - protein, 6 aa, Staphylococcus epidermidis
NKNVTN

SEQ ID NO: 1835972 - protein, 28 aa, Staphylococcus epidermidis
NKSIGTDVSGNDFKPFTETSGTSPYPHG

SEQ ID NO: 1835973 - protein, 6 aa, Staphylococcus epidermidis
NLDPVA

SEQ ID NO: 1835974 - protein, 16 aa, Staphylococcus epidermidis
NLSKTDTTDKNKKEFR

SEQ ID NO: 1835975 - protein, 23 aa, Staphylococcus epidermidis
NNKDSVKKGDKVVTSGLADQLPS

SEQ ID NO: 1835976 - protein, 7 aa, Staphylococcus epidermidis
NNPRTKH

SEQ ID NO: 1835977 - protein, 8 aa, Staphylococcus epidermidis
NPKEKKTE

SEQ ID NO: 1835978 - protein, 4 aa, Staphylococcus epidermidis
NPQQ

SEQ ID NO: 1835979 - protein, 7 aa, Staphylococcus epidermidis
NQAFNAS

SEQ ID NO: 1835980 - protein, 4 aa, Staphylococcus epidermidis
NQFS

SEQ ID NO: 1835981 - protein, 14 aa, Staphylococcus epidermidis
NQKYESKTATKKIY

SEQ ID NO: 1835982 - protein, 6 aa, Staphylococcus epidermidis
NRHKGI

SEQ ID NO: 1835983 - protein, 21 aa, Staphylococcus epidermidis
NRNESRGAHYKPEFPERNDEE

SEQ ID NO: 1835984 - protein, 11 aa, Staphylococcus epidermidis
NSKDKDNKTYK

SEQ ID NO: 1835985 - protein, 8 aa, Staphylococcus epidermidis
NSSWPDKK

SEQ ID NO: 1835986 - protein, 6 aa, Staphylococcus epidermidis
NTIGKV

SEQ ID NO: 1835987 - protein, 6 aa, Staphylococcus epidermidis
NTKAQR

SEQ ID NO: 1835988 - protein, 8 aa, Staphylococcus epidermidis
NTKDGIKP

SEQ ID NO: 1835989 - protein, 5 aa, Staphylococcus epidermidis
NTKDI

SEQ ID NO: 1835990 - protein, 30 aa, Staphylococcus epidermidis
NTSSSGVESNESSQNQPTQNTNEVSLYPFD

SEQ ID NO: 1835991 - protein, 16 aa, Staphylococcus epidermidis
NVGDTSIGFSSDDNEL

SEQ ID NO: 1835992 - protein, 12 aa, Staphylococcus epidermidis
NVPNKALSDGDI

SEQ ID NO: 1835993 - protein, 11 aa, Staphylococcus epidermidis
NWAYSANQAGF

SEQ ID NO: 1835994 - protein, 6 aa, Staphylococcus epidermidis
PAPGDI

SEQ ID NO: 1835995 - protein, 5 aa, Staphylococcus epidermidis
PDASF

SEQ ID NO: 1835996 - protein, 33 aa, Staphylococcus epidermidis
PDISSNSLDPKYKISKQSISPETVKVTGGEQQL

SEQ ID NO: 1835997 - protein, 6 aa, Staphylococcus epidermidis
PDKPGM

SEQ ID NO: 1835998 - protein, 11 aa, Staphylococcus epidermidis
PGASANRLNTH

SEQ ID NO: 1835999 - protein, 11 aa, Staphylococcus epidermidis
PGHGNKEIKNR

SEQ ID NO: 1836000 - protein, 6 aa, Staphylococcus epidermidis
PKHHKK

SEQ ID NO: 1836001 - protein, 13 aa, Staphylococcus epidermidis
PKVGNTYAPDKEV

SEQ ID NO: 1836002 - protein, 10 aa, Staphylococcus epidermidis
PLSDDAEARY

SEQ ID NO: 1836003 - protein, 11 aa, Staphylococcus epidermidis
PMAGSHKSGVL

SEQ ID NO: 1836004 - protein, 7 aa, Staphylococcus epidermidis
PNEHNQH

SEQ ID NO: 1836005 - protein, 4 aa, Staphylococcus epidermidis
PNTL

SEQ ID NO: 1836006 - protein, 15 aa, Staphylococcus epidermidis
PPRKRDYTSKSKGGN

SEQ ID NO: 1836007 - protein, 4 aa, Staphylococcus epidermidis
PQYL

SEQ ID NO: 1836008 - protein, 10 aa, Staphylococcus epidermidis
PTASGKTELS

SEQ ID NO: 1836009 - protein, 5 aa, Staphylococcus epidermidis
PTKHD

SEQ ID NO: 1836010 - protein, 10 aa, Staphylococcus epidermidis
PTKPIPNDKL

SEQ ID NO: 1836011 - protein, 7 aa, Staphylococcus epidermidis
PTQFDGN

SEQ ID NO: 1836012 - protein, 13 aa, Staphylococcus epidermidis
PTRTYDKKKAQAL

SEQ ID NO: 1836013 - protein, 13 aa, Staphylococcus epidermidis
PTVGSIAQTDAGY

SEQ ID NO: 1836014 - protein, 15 aa, Staphylococcus epidermidis
PYHPDESAKLPEGTE

SEQ ID NO: 1836015 - protein, 7 aa, Staphylococcus epidermidis
PYPGNSD

SEQ ID NO: 1836016 - protein, 9 aa, Staphylococcus epidermidis
QEIGEHKSK

SEQ ID NO: 1836017 - protein, 7 aa, Staphylococcus epidermidis
QELEQDV

SEQ ID NO: 1836018 - protein, 13 aa, Staphylococcus epidermidis
QGAHAGYYPGNSP

SEQ ID NO: 1836019 - protein, 5 aa, Staphylococcus epidermidis
QHPFN

SEQ ID NO: 1836020 - protein, 10 aa, Staphylococcus epidermidis
QINGNKANNV

SEQ ID NO: 1836021 - protein, 5 aa, Staphylococcus epidermidis
QKANA

SEQ ID NO: 1836022 - protein, 21 aa, Staphylococcus epidermidis
QKLSPKKDSIALESPKDNPYA

SEQ ID NO: 1836023 - protein, 7 aa, Staphylococcus epidermidis
QKQHSVE

SEQ ID NO: 1836024 - protein, 8 aa, Staphylococcus epidermidis
QKTSLNPN

SEQ ID NO: 1836025 - protein, 7 aa, Staphylococcus epidermidis
QLSGNSS

SEQ ID NO: 1836026 - protein, 4 aa, Staphylococcus epidermidis
QNAL

SEQ ID NO: 1836027 - protein, 10 aa, Staphylococcus epidermidis
QNLKNSPNVE

SEQ ID NO: 1836028 - protein, 5 aa, Staphylococcus epidermidis
QNQDA

SEQ ID NO: 1836029 - protein, 17 aa, Staphylococcus epidermidis
QPENSIEPQKEPWTNPI

SEQ ID NO: 1836030 - protein, 15 aa, Staphylococcus epidermidis
QPTTVAASSKDNNVS

SEQ ID NO: 1836031 - protein, 4 aa, Staphylococcus epidermidis
QQIG

SEQ ID NO: 1836032 - protein, 8 aa, Staphylococcus epidermidis
QQKDEHKQ

SEQ ID NO: 1836033 - protein, 13 aa, Staphylococcus epidermidis
QQLNKGDKSLENV

SEQ ID NO: 1836034 - protein, 13 aa, Staphylococcus epidermidis
QSGPGQNGAGAYG

SEQ ID NO: 1836035 - protein, 7 aa, Staphylococcus epidermidis
QSSEGAF

SEQ ID NO: 1836036 - protein, 10 aa, Staphylococcus epidermidis
QSSQDSITPG

SEQ ID NO: 1836037 - protein, 8 aa, Staphylococcus epidermidis
QSTPGPYG

SEQ ID NO: 1836038 - protein, 9 aa, Staphylococcus epidermidis
QTNQTFEES

SEQ ID NO: 1836039 - protein, 18 aa, Staphylococcus epidermidis
QVTDSDGAEKTSIRNIEV

SEQ ID NO: 1836040 - protein, 4 aa, Staphylococcus epidermidis
QYTR

SEQ ID NO: 1836041 - protein, 7 aa, Staphylococcus epidermidis
RASEGKI

SEQ ID NO: 1836042 - protein, 11 aa, Staphylococcus epidermidis
RDEADQLADYD

SEQ ID NO: 1836043 - protein, 7 aa, Staphylococcus epidermidis
REDKGYM

SEQ ID NO: 1836044 - protein, 11 aa, Staphylococcus epidermidis
RGASGYAPEHT

SEQ ID NO: 1836045 - protein, 15 aa, Staphylococcus epidermidis
RKEDGAGGDFGRQER

SEQ ID NO: 1836046 - protein, 13 aa, Staphylococcus epidermidis
RKYPSTKQSLEDY

SEQ ID NO: 1836047 - protein, 17 aa, Staphylococcus epidermidis
RPGIESSNERNNAGTGH

SEQ ID NO: 1836048 - protein, 13 aa, Staphylococcus epidermidis
RQGQPTVVDPNFQ

SEQ ID NO: 1836049 - protein, 7 aa, Staphylococcus epidermidis
RQYGGTV

SEQ ID NO: 1836050 - protein, 9 aa, Staphylococcus epidermidis
RSKKIGKMA

SEQ ID NO: 1836051 - protein, 11 aa, Staphylococcus epidermidis
RSQAGKPISTY

SEQ ID NO: 1836052 - protein, 5 aa, Staphylococcus epidermidis
RTGNH

SEQ ID NO: 1836053 - protein, 12 aa, Staphylococcus epidermidis
RTISNPNSYNYI

SEQ ID NO: 1836054 - protein, 5 aa, Staphylococcus epidermidis
RTKDG

SEQ ID NO: 1836055 - protein, 22 aa, Staphylococcus epidermidis
RTKTTGKLNENKELDSVKLEDK

SEQ ID NO: 1836056 - protein, 25 aa, Staphylococcus epidermidis
RTKYKDANDQVNRHQLEGEGGIQND

SEQ ID NO: 1836057 - protein, 6 aa, Staphylococcus epidermidis
RVDYGA

SEQ ID NO: 1836058 - protein, 9 aa, Staphylococcus epidermidis
RVESSDGIH

SEQ ID NO: 1836059 - protein, 9 aa, Staphylococcus epidermidis
RVKTGADMT

SEQ ID NO: 1836060 - protein, 17 aa, Staphylococcus epidermidis
RYDVNEDGSPSKKLVDD

SEQ ID NO: 1836061 - protein, 13 aa, Staphylococcus epidermidis
RYKGRSEKPEFTY

SEQ ID NO: 1836062 - protein, 6 aa, Staphylococcus epidermidis
SAKIGS

SEQ ID NO: 1836063 - protein, 7 aa, Staphylococcus epidermidis
SDINPNI

SEQ ID NO: 1836064 - protein, 5 aa, Staphylococcus epidermidis
SDITV

SEQ ID NO: 1836065 - protein, 8 aa, Staphylococcus epidermidis
SDNSTPRS

SEQ ID NO: 1836066 - protein, 15 aa, Staphylococcus epidermidis
SFDHRKRESINDKNK

SEQ ID NO: 1836067 - protein, 5 aa, Staphylococcus epidermidis
SGAND

SEQ ID NO: 1836068 - protein, 8 aa, Staphylococcus epidermidis
SGEIQNPK

SEQ ID NO: 1836069 - protein, 14 aa, Staphylococcus epidermidis
SGKKDSAVSDKAVR

SEQ ID NO: 1836070 - protein, 8 aa, Staphylococcus epidermidis
SGNISNPR

SEQ ID NO: 1836071 - protein, 15 aa, Staphylococcus epidermidis
SGPMDSPKHSNNSKP

SEQ ID NO: 1836072 - protein, 8 aa, Staphylococcus epidermidis
SGTSPDGR

SEQ ID NO: 1836073 - protein, 9 aa, Staphylococcus epidermidis
SHAQTAGAA

SEQ ID NO: 1836074 - protein, 8 aa, Staphylococcus epidermidis
SIAPYETD

SEQ ID NO: 1836075 - protein, 11 aa, Staphylococcus epidermidis
SIDKAAHPNDI

SEQ ID NO: 1836076 - protein, 11 aa, Staphylococcus epidermidis
SIEKHPNADVQ

SEQ ID NO: 1836077 - protein, 12 aa, Staphylococcus epidermidis
SIGKEGTKGDSY

SEQ ID NO: 1836078 - protein, 8 aa, Staphylococcus epidermidis
SIVGSRAQ

SEQ ID NO: 1836079 - protein, 11 aa, Staphylococcus epidermidis
SKLGKENHIAT

SEQ ID NO: 1836080 - protein, 9 aa, Staphylococcus epidermidis
SKPDIYTAG

SEQ ID NO: 1836081 - protein, 15 aa, Staphylococcus epidermidis
SKTKDDKEPQVHIYH

SEQ ID NO: 1836082 - protein, 8 aa, Staphylococcus epidermidis
SLHPSDEA

SEQ ID NO: 1836083 - protein, 6 aa, Staphylococcus epidermidis
SLKDKG

SEQ ID NO: 1836084 - protein, 13 aa, Staphylococcus epidermidis
SLTPAQQKKITNN

SEQ ID NO: 1836085 - protein, 8 aa, Staphylococcus epidermidis
SNAVSSYD

SEQ ID NO: 1836086 - protein, 14 aa, Staphylococcus epidermidis
SNGDHYEWYASIYG

SEQ ID NO: 1836087 - protein, 9 aa, Staphylococcus epidermidis
SNRSSGKMG

SEQ ID NO: 1836088 - protein, 5 aa, Staphylococcus epidermidis
SNVKG

SEQ ID NO: 1836089 - protein, 6 aa, Staphylococcus epidermidis
SPMNGD

SEQ ID NO: 1836090 - protein, 17 aa, Staphylococcus epidermidis
SPNPSNSKASKQQNNYS

SEQ ID NO: 1836091 - protein, 9 aa, Staphylococcus epidermidis
SQFTDGTET

SEQ ID NO: 1836092 - protein, 10 aa, Staphylococcus epidermidis
SQIKNESIEF

SEQ ID NO: 1836093 - protein, 16 aa, Staphylococcus epidermidis
SQNADTLEAKAKPLEK

SEQ ID NO: 1836094 - protein, 9 aa, Staphylococcus epidermidis
SQSGALNES

SEQ ID NO: 1836095 - protein, 6 aa, Staphylococcus epidermidis
SSIGEE

SEQ ID NO: 1836096 - protein, 5 aa, Staphylococcus epidermidis
STRGY

SEQ ID NO: 1836097 - protein, 11 aa, Staphylococcus epidermidis
SVDTNKKPIKS

SEQ ID NO: 1836098 - protein, 8 aa, Staphylococcus epidermidis
SVGARTKI

SEQ ID NO: 1836099 - protein, 7 aa, Staphylococcus epidermidis
SVRPDMD

SEQ ID NO: 1836100 - protein, 12 aa, Staphylococcus epidermidis
SVVGGKATTNQV

SEQ ID NO: 1836101 - protein, 12 aa, Staphylococcus epidermidis
SYHFESDGSTWS

SEQ ID NO: 1836102 - protein, 7 aa, Staphylococcus epidermidis
SYSEGLR

SEQ ID NO: 1836103 - protein, 23 aa, Staphylococcus epidermidis
TAGSGLNKRGYRIAQGEAPIKET

SEQ ID NO: 1836104 - protein, 9 aa, Staphylococcus epidermidis
TAKSPVKIN

SEQ ID NO: 1836105 - protein, 10 aa, Staphylococcus epidermidis
TANDNSTIDG

SEQ ID NO: 1836106 - protein, 19 aa, Staphylococcus epidermidis
TDINKTNISDNHVDNARKN

SEQ ID NO: 1836107 - protein, 6 aa, Staphylococcus epidermidis
TDTLEE

SEQ ID NO: 1836108 - protein, 11 aa, Staphylococcus epidermidis
TEKQGTPGQMK

SEQ ID NO: 1836109 - protein, 16 aa, Staphylococcus epidermidis
TEVDAKDKVSATQNID

SEQ ID NO: 1836110 - protein, 14 aa, Staphylococcus epidermidis
TFGRESYDNQGSPI

SEQ ID NO: 1836111 - protein, 5 aa, Staphylococcus epidermidis
TGRSY

SEQ ID NO: 1836112 - protein, 6 aa, Staphylococcus epidermidis
TGTSHW

SEQ ID NO: 1836113 - protein, 9 aa, Staphylococcus epidermidis
TGYPGDKPL

SEQ ID NO: 1836114 - protein, 7 aa, Staphylococcus epidermidis
THTRAGK

SEQ ID NO: 1836115 - protein, 22 aa, Staphylococcus epidermidis
TISMSQDQTNKVITNEENPISQ

SEQ ID NO: 1836116 - protein, 8 aa, Staphylococcus epidermidis
TISNVDED

SEQ ID NO: 1836117 - protein, 7 aa, Staphylococcus epidermidis
TKANRYS

SEQ ID NO: 1836118 - protein, 7 aa, Staphylococcus epidermidis
TKETLYP

SEQ ID NO: 1836119 - protein, 4 aa, Staphylococcus epidermidis
TKNQ

SEQ ID NO: 1836120 - protein, 5 aa, Staphylococcus epidermidis
TKSQL

SEQ ID NO: 1836121 - protein, 13 aa, Staphylococcus epidermidis
TLGTPHNGTHASD

SEQ ID NO: 1836122 - protein, 6 aa, Staphylococcus epidermidis
TNEDLR

SEQ ID NO: 1836123 - protein, 22 aa, Staphylococcus epidermidis
TNSDNGGVHTNSGIPNKAAYNT

SEQ ID NO: 1836124 - protein, 5 aa, Staphylococcus epidermidis
TNYNT

SEQ ID NO: 1836125 - protein, 12 aa, Staphylococcus epidermidis
TPFSATAQPRTV

SEQ ID NO: 1836126 - protein, 18 aa, Staphylococcus epidermidis
TQAQASSSSVSEKGTMGY

SEQ ID NO: 1836127 - protein, 5 aa, Staphylococcus epidermidis
TQGHY

SEQ ID NO: 1836128 - protein, 23 aa, Staphylococcus epidermidis
TQINKRSSNHDCKRKHPRPSTRE

SEQ ID NO: 1836129 - protein, 14 aa, Staphylococcus epidermidis
TRHHDSDLKRGQRQ

SEQ ID NO: 1836130 - protein, 11 aa, Staphylococcus epidermidis
TSHVEKDGQFI

SEQ ID NO: 1836131 - protein, 5 aa, Staphylococcus epidermidis
TSPKI

SEQ ID NO: 1836132 - protein, 7 aa, Staphylococcus epidermidis
TTEGTDI

SEQ ID NO: 1836133 - protein, 5 aa, Staphylococcus epidermidis
TTTPK

SEQ ID NO: 1836134 - protein, 11 aa, Staphylococcus epidermidis
TVEEGKTKINS

SEQ ID NO: 1836135 - protein, 9 aa, Staphylococcus epidermidis
TVENKEKSI

SEQ ID NO: 1836136 - protein, 13 aa, Staphylococcus epidermidis
TVGGNSGSPVFNG

SEQ ID NO: 1836137 - protein, 11 aa, Staphylococcus epidermidis
TVPAGKYAKQY

SEQ ID NO: 1836138 - protein, 13 aa, Staphylococcus epidermidis
VADTVRKETNAKT

SEQ ID NO: 1836139 - protein, 43 aa, Staphylococcus epidermidis
VAPWGTTSTKPSQPSKPSGGTNNKLTVSANRGVAQIKPTNNGL

SEQ ID NO: 1836140 - protein, 8 aa, Staphylococcus epidermidis
VDEKTIEK

SEQ ID NO: 1836141 - protein, 7 aa, Staphylococcus epidermidis
VDGTFND

SEQ ID NO: 1836142 - protein, 17 aa, Staphylococcus epidermidis
VDKKAMQSLSEETKKDI

SEQ ID NO: 1836143 - protein, 8 aa, Staphylococcus epidermidis
VDNKYNSS

SEQ ID NO: 1836144 - protein, 9 aa, Staphylococcus epidermidis
VEIDGEKNK

SEQ ID NO: 1836145 - protein, 8 aa, Staphylococcus epidermidis
VESDTPAI

SEQ ID NO: 1836146 - protein, 9 aa, Staphylococcus epidermidis
VGKQGADKR

SEQ ID NO: 1836147 - protein, 14 aa, Staphylococcus epidermidis
VGTDTSEVRISKEE

SEQ ID NO: 1836148 - protein, 15 aa, Staphylococcus epidermidis
VHPSAKNENDYPNGK

SEQ ID NO: 1836149 - protein, 5 aa, Staphylococcus epidermidis
VKIEN

SEQ ID NO: 1836150 - protein, 9 aa, Staphylococcus epidermidis
VKKDQPNVF

SEQ ID NO: 1836151 - protein, 12 aa, Staphylococcus epidermidis
VKNPTSKLINIY

SEQ ID NO: 1836152 - protein, 4 aa, Staphylococcus epidermidis
VKNQ

SEQ ID NO: 1836153 - protein, 8 aa, Staphylococcus epidermidis
VNNDGSIT

SEQ ID NO: 1836154 - protein, 10 aa, Staphylococcus epidermidis
VNNTPEEGAI

SEQ ID NO: 1836155 - protein, 9 aa, Staphylococcus epidermidis
VQARQTADD

SEQ ID NO: 1836156 - protein, 5 aa, Staphylococcus epidermidis
VSDYT

SEQ ID NO: 1836157 - protein, 17 aa, Staphylococcus epidermidis
VSGSSSRATSTNSGTVY

SEQ ID NO: 1836158 - protein, 21 aa, Staphylococcus epidermidis
VSSQKTSSLPKYTPKVNSSIN

SEQ ID NO: 1836159 - protein, 6 aa, Staphylococcus epidermidis
VTAAGS

SEQ ID NO: 1836160 - protein, 16 aa, Staphylococcus epidermidis
VTKVNPKETKAYINVK

SEQ ID NO: 1836161 - protein, 5 aa, Staphylococcus epidermidis
VTTIQ

SEQ ID NO: 1836162 - protein, 15 aa, Staphylococcus epidermidis
VTTQNIGKQTQSIGK

SEQ ID NO: 1836163 - protein, 11 aa, Staphylococcus epidermidis
WDNASAADGYT

SEQ ID NO: 1836164 - protein, 10 aa, Staphylococcus epidermidis
WLSETGAKYP

SEQ ID NO: 1836165 - protein, 7 aa, Staphylococcus epidermidis
YAKETYD

SEQ ID NO: 1836166 - protein, 10 aa, Staphylococcus epidermidis
YARSKGNKLS

SEQ ID NO: 1836167 - protein, 29 aa, Staphylococcus epidermidis
YDKEDKAKKINKDLDRKISDMKDKTKDFN

SEQ ID NO: 1836168 - protein, 16 aa, Staphylococcus epidermidis
YDLKGTKGYIQTPYPT

SEQ ID NO: 1836169 - protein, 7 aa, Staphylococcus epidermidis
YDNKNEE

SEQ ID NO: 1836170 - protein, 10 aa, Staphylococcus epidermidis
YGDGDGRTFT

SEQ ID NO: 1836171 - protein, 5 aa, Staphylococcus epidermidis
YGGPN

SEQ ID NO: 1836172 - protein, 17 aa, Staphylococcus epidermidis
YGGSGALRQQIEAGAPA

SEQ ID NO: 1836173 - protein, 5 aa, Staphylococcus epidermidis
YGSEY

SEQ ID NO: 1836174 - protein, 13 aa, Staphylococcus epidermidis
YKAYKAQGLSAWG

SEQ ID NO: 1836175 - protein, 12 aa, Staphylococcus epidermidis
YKDKKGKSHIEK

SEQ ID NO: 1836176 - protein, 9 aa, Staphylococcus epidermidis
YKDRDIKKA

SEQ ID NO: 1836177 - protein, 16 aa, Staphylococcus epidermidis
YKNSTQHLTADTNEVK

SEQ ID NO: 1836178 - protein, 7 aa, Staphylococcus epidermidis
YNEETGV

SEQ ID NO: 1836179 - protein, 9 aa, Staphylococcus epidermidis
YNPNSNEKY

SEQ ID NO: 1836180 - protein, 8 aa, Staphylococcus epidermidis
YNSGKKYG

SEQ ID NO: 1836181 - protein, 7 aa, Staphylococcus epidermidis
YNTGTNY

SEQ ID NO: 1836182 - protein, 15 aa, Staphylococcus epidermidis
YNTSVESIKQNNNLS

SEQ ID NO: 1836183 - protein, 16 aa, Staphylococcus epidermidis
YPKGVDPHTYDPSQKQ

SEQ ID NO: 1836184 - protein, 16 aa, Staphylococcus epidermidis
YPLNQAHTSATDQVQK

SEQ ID NO: 1836185 - protein, 18 aa, Staphylococcus epidermidis
YQGESTRPGPNGTQKADV

SEQ ID NO: 1836186 - protein, 13 aa, Staphylococcus epidermidis
YQSHEPDYKEENM

SEQ ID NO: 1836187 - protein, 11 aa, Staphylococcus epidermidis
YRDRYGKGKNE

SEQ ID NO: 1836188 - protein, 9 aa, Staphylococcus epidermidis
YSVKPTNNG

SEQ ID NO: 1836189 - protein, 16 aa, Staphylococcus epidermidis
YTGAATHTGPLGNEVP

SEQ ID NO: 1836190 - protein, 17 aa, Staphylococcus epidermidis
YTGESTHKTLAGKQKAD

SEQ ID NO: 1836191 - protein, 5 aa, Staphylococcus epidermidis
AAGTP

SEQ ID NO: 1836192 - protein, 4 aa, Staphylococcus epidermidis
AAGV

SEQ ID NO: 1836193 - protein, 17 aa, Staphylococcus epidermidis
AAKYGHERYGKTYAGAY

SEQ ID NO: 1836194 - protein, 18 aa, Staphylococcus epidermidis
AANAQESETSQLDTYATG

SEQ ID NO: 1836195 - protein, 8 aa, Staphylococcus epidermidis
ADGHEVGD

SEQ ID NO: 1836196 - protein, 28 aa, Staphylococcus epidermidis
ADSLPQKNGANQKTTKVTVSNKDVPDAV

SEQ ID NO: 1836197 - protein, 33 aa, Staphylococcus epidermidis
AEASEKNSDHQKNVNKTNQQSVRTQASYDFNPQ

SEQ ID NO: 1836198 - protein, 71 aa, Staphylococcus epidermidis
AFAEDSSNKNTNSDKMEQHQSQKETSKQSEKDEFNNDDSKHDSDDKKSTSDSKDKDSNKPLSADSTHRNYK

SEQ ID NO: 1836199 - protein, 5 aa, Staphylococcus epidermidis
AFKQQ

SEQ ID NO: 1836200 - protein, 77 aa, Staphylococcus epidermidis
AGSDADYTESSSNQEVSANTQSSNTNVQAVSAPTSSESRSYSTSTTSYSAPSHNYSSHSSSVRLSNGNTAGSVGSYA

SEQ ID NO: 1836201 - protein, 16 aa, Staphylococcus epidermidis
AGYDVTTTPVTASGPL

SEQ ID NO: 1836202 - protein, 15 aa, Staphylococcus epidermidis
AHATLEKSTPQQQGV

SEQ ID NO: 1836203 - protein, 9 aa, Staphylococcus epidermidis
AITDPNKAK

SEQ ID NO: 1836204 - protein, 26 aa, Staphylococcus epidermidis
AKVTQESQATNALKELPKSENIKKHY

SEQ ID NO: 1836205 - protein, 23 aa, Staphylococcus epidermidis
ALGKEEEGKKRLEEHDKKIEEYK

SEQ ID NO: 1836206 - protein, 13 aa, Staphylococcus epidermidis
ALGNEFKKDHPNV

SEQ ID NO: 1836207 - protein, 27 aa, Staphylococcus epidermidis
APSKVQALSTQSTPAPKQVKPSTQTVN

SEQ ID NO: 1836208 - protein, 8 aa, Staphylococcus epidermidis
AQAQYKNQ

SEQ ID NO: 1836209 - protein, 8 aa, Staphylococcus epidermidis
AQPHPKRK

SEQ ID NO: 1836210 - protein, 4 aa, Staphylococcus epidermidis
ARPM

SEQ ID NO: 1836211 - protein, 13 aa, Staphylococcus epidermidis
ASAQTKFLYKSKE

SEQ ID NO: 1836212 - protein, 6 aa, Staphylococcus epidermidis
ASKAGI

SEQ ID NO: 1836213 - protein, 6 aa, Staphylococcus epidermidis
ASLTEV

SEQ ID NO: 1836214 - protein, 9 aa, Staphylococcus epidermidis
ASSSEANHK

SEQ ID NO: 1836215 - protein, 10 aa, Staphylococcus epidermidis
CGGNNGKKVT

SEQ ID NO: 1836216 - protein, 11 aa, Staphylococcus epidermidis
CGNESKRDIKQ

SEQ ID NO: 1836217 - protein, 52 aa, Staphylococcus epidermidis
CGNSNSESDHANHKDKQQEDSNVKTDTTKKLSGNFESKNGEKVEGKAKIENG

SEQ ID NO: 1836218 - protein, 28 aa, Staphylococcus epidermidis
CSNTNDNNNQEHHSNAHAPKNAKTLKEK

SEQ ID NO: 1836219 - protein, 7 aa, Staphylococcus epidermidis
DADIDQL

SEQ ID NO: 1836220 - protein, 13 aa, Staphylococcus epidermidis
DAEDAQDLDYIKG

SEQ ID NO: 1836221 - protein, 12 aa, Staphylococcus epidermidis
DAKLDSSIKATV

SEQ ID NO: 1836222 - protein, 9 aa, Staphylococcus epidermidis
DASSNTLKQ

SEQ ID NO: 1836223 - protein, 7 aa, Staphylococcus epidermidis
DAYPNER

SEQ ID NO: 1836224 - protein, 17 aa, Staphylococcus epidermidis
DDDRNMGQGVPFQNDSS

SEQ ID NO: 1836225 - protein, 7 aa, Staphylococcus epidermidis
DDENQMR

SEQ ID NO: 1836226 - protein, 7 aa, Staphylococcus epidermidis
DDSSFIT

SEQ ID NO: 1836227 - protein, 14 aa, Staphylococcus epidermidis
DDVEGKAVSKDEVT

SEQ ID NO: 1836228 - protein, 5 aa, Staphylococcus epidermidis
DEMST

SEQ ID NO: 1836229 - protein, 9 aa, Staphylococcus epidermidis
DESISEDKM

SEQ ID NO: 1836230 - protein, 60 aa, Staphylococcus epidermidis
DKDLSTKESPENEKDDSRKGIKALTKNSQATTRNTATTEASKELKDQTNKVASQKEYKNH

SEQ ID NO: 1836231 - protein, 9 aa, Staphylococcus epidermidis
DKGKKIKDL

SEQ ID NO: 1836232 - protein, 8 aa, Staphylococcus epidermidis
DKKAIDDG

SEQ ID NO: 1836233 - protein, 4 aa, Staphylococcus epidermidis
DKKG

SEQ ID NO: 1836234 - protein, 7 aa, Staphylococcus epidermidis
DKKGVEI

SEQ ID NO: 1836235 - protein, 12 aa, Staphylococcus epidermidis
DKKNGQRTSPSK

SEQ ID NO: 1836236 - protein, 16 aa, Staphylococcus epidermidis
DKNFVDDEQRAGVDAN

SEQ ID NO: 1836237 - protein, 8 aa, Staphylococcus epidermidis
DKSHNELG

SEQ ID NO: 1836238 - protein, 29 aa, Staphylococcus epidermidis
DKYKDKVDTKDIDKDIKKEEKQYGGKDQF

SEQ ID NO: 1836239 - protein, 6 aa, Staphylococcus epidermidis
DLEKYK

SEQ ID NO: 1836240 - protein, 12 aa, Staphylococcus epidermidis
DMTQNQLERYFE

SEQ ID NO: 1836241 - protein, 23 aa, Staphylococcus epidermidis
DPDKIKQQQQQQSQGGSGLTNSG

SEQ ID NO: 1836242 - protein, 19 aa, Staphylococcus epidermidis
DQAGKSTKDKNVIAASNNV

SEQ ID NO: 1836243 - protein, 20 aa, Staphylococcus epidermidis
DQLEETVQSINDNGGKATAY

SEQ ID NO: 1836244 - protein, 16 aa, Staphylococcus epidermidis
DRDKEKDFKATKENLK

SEQ ID NO: 1836245 - protein, 10 aa, Staphylococcus epidermidis
DSKKVNKKVR

SEQ ID NO: 1836246 - protein, 10 aa, Staphylococcus epidermidis
DTIKTSEKLA

SEQ ID NO: 1836247 - protein, 11 aa, Staphylococcus epidermidis
DTKGKTTNQIQ

SEQ ID NO: 1836248 - protein, 5 aa, Staphylococcus epidermidis
DTSFP

SEQ ID NO: 1836249 - protein, 6 aa, Staphylococcus epidermidis
DTTQNY

SEQ ID NO: 1836250 - protein, 16 aa, Staphylococcus epidermidis
DVKKSNKANIQSTSGF

SEQ ID NO: 1836251 - protein, 5 aa, Staphylococcus epidermidis
DWEPK

SEQ ID NO: 1836252 - protein, 19 aa, Staphylococcus epidermidis
DYVDDNDNKVDEWLEGIET

SEQ ID NO: 1836253 - protein, 7 aa, Staphylococcus epidermidis
EALSKRG

SEQ ID NO: 1836254 - protein, 19 aa, Staphylococcus epidermidis
EDHNASAAYHKAKKVDNSQ

SEQ ID NO: 1836255 - protein, 23 aa, Staphylococcus epidermidis
EDNATQSEVDGKSKDLSKAYKEM

SEQ ID NO: 1836256 - protein, 6 aa, Staphylococcus epidermidis
EDTETI

SEQ ID NO: 1836257 - protein, 9 aa, Staphylococcus epidermidis
EDYRSNNPL

SEQ ID NO: 1836258 - protein, 8 aa, Staphylococcus epidermidis
EENGDKYS

SEQ ID NO: 1836259 - protein, 17 aa, Staphylococcus epidermidis
EEQTVKSGDDETATQAW

SEQ ID NO: 1836260 - protein, 17 aa, Staphylococcus epidermidis
EGSDESDKYVDTVSTPI

SEQ ID NO: 1836261 - protein, 8 aa, Staphylococcus epidermidis
EIDKEKEK

SEQ ID NO: 1836262 - protein, 19 aa, Staphylococcus epidermidis
ELNKDSKNKFDDIPKNQRA

SEQ ID NO: 1836263 - protein, 11 aa, Staphylococcus epidermidis
ELSTFGPGGRF

SEQ ID NO: 1836264 - protein, 7 aa, Staphylococcus epidermidis
ENNEAAT

SEQ ID NO: 1836265 - protein, 8 aa, Staphylococcus epidermidis
EPVNTKYS

SEQ ID NO: 1836266 - protein, 7 aa, Staphylococcus epidermidis
EQGTPLM

SEQ ID NO: 1836267 - protein, 5 aa, Staphylococcus epidermidis
EQKVY

SEQ ID NO: 1836268 - protein, 6 aa, Staphylococcus epidermidis
ERQSET

SEQ ID NO: 1836269 - protein, 60 aa, Staphylococcus epidermidis
ESTNNATQPVQPSQSQVATQQQPVQVSAPQNEQTAQPQTKSTSTSQTSSSKASSGSSVNV

SEQ ID NO: 1836270 - protein, 6 aa, Staphylococcus epidermidis
ETAKKY

SEQ ID NO: 1836271 - protein, 4 aa, Staphylococcus epidermidis
ETGH

SEQ ID NO: 1836272 - protein, 65 aa, Staphylococcus epidermidis
EYSQDAKKTEKDYNKSKNTSHTKTSQSDNADKNPQLPTDDELKHQSKPAQSFEDDIKRSNTRSTS

SEQ ID NO: 1836273 - protein, 7 aa, Staphylococcus epidermidis
FKTTRSG

SEQ ID NO: 1836274 - protein, 11 aa, Staphylococcus epidermidis
FPTTDKSYYDK

SEQ ID NO: 1836275 - protein, 4 aa, Staphylococcus epidermidis
FQEI

SEQ ID NO: 1836276 - protein, 6 aa, Staphylococcus epidermidis
FQYDSD

SEQ ID NO: 1836277 - protein, 15 aa, Staphylococcus epidermidis
FTSTTDRNDTASSGM

SEQ ID NO: 1836278 - protein, 25 aa, Staphylococcus epidermidis
GAKAQHSQLHENKDVANEIIQFLWE

SEQ ID NO: 1836279 - protein, 10 aa, Staphylococcus epidermidis
GASTGIGQAS

SEQ ID NO: 1836280 - protein, 7 aa, Staphylococcus epidermidis
GDDRHLP

SEQ ID NO: 1836281 - protein, 10 aa, Staphylococcus epidermidis
GDGNKKPYIV

SEQ ID NO: 1836282 - protein, 4 aa, Staphylococcus epidermidis
GDSL

SEQ ID NO: 1836283 - protein, 14 aa, Staphylococcus epidermidis
GDTDAKKVQPTNKV

SEQ ID NO: 1836284 - protein, 18 aa, Staphylococcus epidermidis
GFDPVPLKKDKNSKTTHH

SEQ ID NO: 1836285 - protein, 11 aa, Staphylococcus epidermidis
GGDSAGAQLTS

SEQ ID NO: 1836286 - protein, 12 aa, Staphylococcus epidermidis
GGSIEQGTTELT

SEQ ID NO: 1836287 - protein, 5 aa, Staphylococcus epidermidis
GIQAP

SEQ ID NO: 1836288 - protein, 16 aa, Staphylococcus epidermidis
GKDSHNQSSDHKGKLD

SEQ ID NO: 1836289 - protein, 7 aa, Staphylococcus epidermidis
GKGIPNS

SEQ ID NO: 1836290 - protein, 23 aa, Staphylococcus epidermidis
GKHFSVKSKGNDKNLNVTSKVNN

SEQ ID NO: 1836291 - protein, 17 aa, Staphylococcus epidermidis
GKNDKSKASRRQQVEKN

SEQ ID NO: 1836292 - protein, 121 aa, Staphylococcus epidermidis
GKSNEKASLEKSIDQLKKENKDLKKQKKKLQEQKDKLKHKQDSLQEDVNDLPAKSTSRDKKNKDNHDAKEKSSDNQSTSANHDDQTNKIKSNQDEHDSQSSKPHTQQKPSQNDRKNNHRQE

SEQ ID NO: 1836293 - protein, 7 aa, Staphylococcus epidermidis
GLPQAKD

SEQ ID NO: 1836294 - protein, 21 aa, Staphylococcus epidermidis
GNSGNGSGSSDDSQTSLGNKE

SEQ ID NO: 1836295 - protein, 27 aa, Staphylococcus epidermidis
GNSSSLDNNKSSDSGSDSKSGSYTPKE

SEQ ID NO: 1836296 - protein, 10 aa, Staphylococcus epidermidis
GQGKTAEEAL

SEQ ID NO: 1836297 - protein, 11 aa, Staphylococcus epidermidis
GSDSDEENDIS

SEQ ID NO: 1836298 - protein, 16 aa, Staphylococcus epidermidis
GSTEIKTSQLKGKDDY

SEQ ID NO: 1836299 - protein, 7 aa, Staphylococcus epidermidis
GTHPNSQ

SEQ ID NO: 1836300 - protein, 28 aa, Staphylococcus epidermidis
GTPKQVASKVSGTGNQTFKATKQQQIDK

SEQ ID NO: 1836301 - protein, 11 aa, Staphylococcus epidermidis
GVASNDTKAWE

SEQ ID NO: 1836302 - protein, 12 aa, Staphylococcus epidermidis
GWKGPGKDSMGT

SEQ ID NO: 1836303 - protein, 18 aa, Staphylococcus epidermidis
GYASGTGPVTGKGNYWGG

SEQ ID NO: 1836304 - protein, 9 aa, Staphylococcus epidermidis
GYEPNSTIS

SEQ ID NO: 1836305 - protein, 9 aa, Staphylococcus epidermidis
GYGDNAKAA

SEQ ID NO: 1836306 - protein, 18 aa, Staphylococcus epidermidis
GYSPGQSIKANGAGEASF

SEQ ID NO: 1836307 - protein, 7 aa, Staphylococcus epidermidis
HEDGNTR

SEQ ID NO: 1836308 - protein, 12 aa, Staphylococcus epidermidis
HIPEEYKDPTDR

SEQ ID NO: 1836309 - protein, 11 aa, Staphylococcus epidermidis
HKNKYKAVGRV

SEQ ID NO: 1836310 - protein, 12 aa, Staphylococcus epidermidis
HLEEGQPQYNTE

SEQ ID NO: 1836311 - protein, 12 aa, Staphylococcus epidermidis
HPNAGTKAAQWA

SEQ ID NO: 1836312 - protein, 68 aa, Staphylococcus epidermidis
HQANAAEQPQNQSNHKNVLDDQTALKQAEKAKSEVTQSTTNVSGTQTYQDPTQVQPKQDTQSTTYDAS

SEQ ID NO: 1836313 - protein, 10 aa, Staphylococcus epidermidis
HSKVSKNTPV

SEQ ID NO: 1836314 - protein, 5 aa, Staphylococcus epidermidis
IDEPE

SEQ ID NO: 1836315 - protein, 5 aa, Staphylococcus epidermidis
IDGVN

SEQ ID NO: 1836316 - protein, 8 aa, Staphylococcus epidermidis
IDRSNANE

SEQ ID NO: 1836317 - protein, 4 aa, Staphylococcus epidermidis
IEEI

SEQ ID NO: 1836318 - protein, 13 aa, Staphylococcus epidermidis
IEGPGDKPMTEDF

SEQ ID NO: 1836319 - protein, 14 aa, Staphylococcus epidermidis
IEKDSKHKSYYEKN

SEQ ID NO: 1836320 - protein, 6 aa, Staphylococcus epidermidis
IENDTF

SEQ ID NO: 1836321 - protein, 23 aa, Staphylococcus epidermidis
IKEKYKSHDAYAKAYKKALNKEK

SEQ ID NO: 1836322 - protein, 6 aa, Staphylococcus epidermidis
IKPNEL

SEQ ID NO: 1836323 - protein, 9 aa, Staphylococcus epidermidis
INDYTTPNK

SEQ ID NO: 1836324 - protein, 4 aa, Staphylococcus epidermidis
INKQ

SEQ ID NO: 1836325 - protein, 17 aa, Staphylococcus epidermidis
INTQNIVSSKDSFGITK

SEQ ID NO: 1836326 - protein, 7 aa, Staphylococcus epidermidis
IPVKTGA

SEQ ID NO: 1836327 - protein, 13 aa, Staphylococcus epidermidis
IQNSTDAQSTPYN

SEQ ID NO: 1836328 - protein, 9 aa, Staphylococcus epidermidis
IRPKNNSEL

SEQ ID NO: 1836329 - protein, 7 aa, Staphylococcus epidermidis
ISDPQEV

SEQ ID NO: 1836330 - protein, 11 aa, Staphylococcus epidermidis
ISKESATDKAF

SEQ ID NO: 1836331 - protein, 13 aa, Staphylococcus epidermidis
ISVTSSDNTQFTS

SEQ ID NO: 1836332 - protein, 5 aa, Staphylococcus epidermidis
ITMDK

SEQ ID NO: 1836333 - protein, 5 aa, Staphylococcus epidermidis
ITRRG

SEQ ID NO: 1836334 - protein, 48 aa, Staphylococcus epidermidis
KAINDKDKTLSLESTLDKNKDLLKGEEHEHEHGEGHEHGESHEDEHEH

SEQ ID NO: 1836335 - protein, 8 aa, Staphylococcus epidermidis
KAISNNES

SEQ ID NO: 1836336 - protein, 4 aa, Staphylococcus epidermidis
KDDN

SEQ ID NO: 1836337 - protein, 17 aa, Staphylococcus epidermidis
KDGGKQIGSFSSNRNQF

SEQ ID NO: 1836338 - protein, 10 aa, Staphylococcus epidermidis
KDNKNGNFKE

SEQ ID NO: 1836339 - protein, 23 aa, Staphylococcus epidermidis
KDNKSDKPNDKLISETAKSVMKE

SEQ ID NO: 1836340 - protein, 9 aa, Staphylococcus epidermidis
KDSDEYQQM

SEQ ID NO: 1836341 - protein, 18 aa, Staphylococcus epidermidis
KDYRDIESKVNKNNNKVA

SEQ ID NO: 1836342 - protein, 7 aa, Staphylococcus epidermidis
KEAHPAA

SEQ ID NO: 1836343 - protein, 6 aa, Staphylococcus epidermidis
KEEGRL

SEQ ID NO: 1836344 - protein, 7 aa, Staphylococcus epidermidis
KEFAQGL

SEQ ID NO: 1836345 - protein, 26 aa, Staphylococcus epidermidis
KEKDGETFSKDLSDKEIEKQGKQMAS

SEQ ID NO: 1836346 - protein, 5 aa, Staphylococcus epidermidis
KGAYY

SEQ ID NO: 1836347 - protein, 8 aa, Staphylococcus epidermidis
KGHKDDKN

SEQ ID NO: 1836348 - protein, 6 aa, Staphylococcus epidermidis
KGQSEP

SEQ ID NO: 1836349 - protein, 8 aa, Staphylococcus epidermidis
KGTYENGY

SEQ ID NO: 1836350 - protein, 5 aa, Staphylococcus epidermidis
KHGST

SEQ ID NO: 1836351 - protein, 8 aa, Staphylococcus epidermidis
KHPLTDKQ

SEQ ID NO: 1836352 - protein, 15 aa, Staphylococcus epidermidis
KHQKSDKKDDKKSED

SEQ ID NO: 1836353 - protein, 9 aa, Staphylococcus epidermidis
KHYENSDSE

SEQ ID NO: 1836354 - protein, 17 aa, Staphylococcus epidermidis
KITKREVTYKKSLKSGY

SEQ ID NO: 1836355 - protein, 9 aa, Staphylococcus epidermidis
KKATNQDLK

SEQ ID NO: 1836356 - protein, 25 aa, Staphylococcus epidermidis
KKEIKKYDDQVQKAMDQEKTVNQVS

SEQ ID NO: 1836357 - protein, 33 aa, Staphylococcus epidermidis
KKRSPKYHNSGEEKNKMQENSSSSEQQEVHNSV

SEQ ID NO: 1836358 - protein, 6 aa, Staphylococcus epidermidis
KNGNIN

SEQ ID NO: 1836359 - protein, 23 aa, Staphylococcus epidermidis
KNIKDVKKGAQVAIPNDVSNQAR

SEQ ID NO: 1836360 - protein, 8 aa, Staphylococcus epidermidis
KNTSINEL

SEQ ID NO: 1836361 - protein, 7 aa, Staphylococcus epidermidis
KPITTGW

SEQ ID NO: 1836362 - protein, 16 aa, Staphylococcus epidermidis
KPITYKAGATSDKKLA

SEQ ID NO: 1836363 - protein, 10 aa, Staphylococcus epidermidis
KPKQGTAPSN

SEQ ID NO: 1836364 - protein, 10 aa, Staphylococcus epidermidis
KPLLKKKGYD

SEQ ID NO: 1836365 - protein, 11 aa, Staphylococcus epidermidis
KPQGANIGEQR

SEQ ID NO: 1836366 - protein, 8 aa, Staphylococcus epidermidis
KQEKPATQ

SEQ ID NO: 1836367 - protein, 6 aa, Staphylococcus epidermidis
KQESES

SEQ ID NO: 1836368 - protein, 10 aa, Staphylococcus epidermidis
KQGKPSRMNA

SEQ ID NO: 1836369 - protein, 25 aa, Staphylococcus epidermidis
KQKYGKNYNYQPSLSKNKTSKTDGL

SEQ ID NO: 1836370 - protein, 10 aa, Staphylococcus epidermidis
KQQPNESYAE

SEQ ID NO: 1836371 - protein, 8 aa, Staphylococcus epidermidis
KQREDETL

SEQ ID NO: 1836372 - protein, 14 aa, Staphylococcus epidermidis
KRNGLKDKSKMNED

SEQ ID NO: 1836373 - protein, 7 aa, Staphylococcus epidermidis
KSKEKNI

SEQ ID NO: 1836374 - protein, 19 aa, Staphylococcus epidermidis
KSPEDRENAIKALANFDTY

SEQ ID NO: 1836375 - protein, 6 aa, Staphylococcus epidermidis
KSTGEV

SEQ ID NO: 1836376 - protein, 6 aa, Staphylococcus epidermidis
KTENIP

SEQ ID NO: 1836377 - protein, 24 aa, Staphylococcus epidermidis
KTGGKIGSTWGNANSWATAAQAAG

SEQ ID NO: 1836378 - protein, 9 aa, Staphylococcus epidermidis
KTITPSFTT

SEQ ID NO: 1836379 - protein, 8 aa, Staphylococcus epidermidis
KTQSQSYI

SEQ ID NO: 1836380 - protein, 8 aa, Staphylococcus epidermidis
KVENGNNK

SEQ ID NO: 1836381 - protein, 15 aa, Staphylococcus epidermidis
KVNKSGTVHASNINN

SEQ ID NO: 1836382 - protein, 12 aa, Staphylococcus epidermidis
KVNRTTNGHGRV

SEQ ID NO: 1836383 - protein, 25 aa, Staphylococcus epidermidis
KVPGGSSSSSSSNNTRSNGGYYSPT

SEQ ID NO: 1836384 - protein, 6 aa, Staphylococcus epidermidis
KVSGGV

SEQ ID NO: 1836385 - protein, 25 aa, Staphylococcus epidermidis
KVSGKATSSSRAKASGSSGRTATYT

SEQ ID NO: 1836386 - protein, 6 aa, Staphylococcus epidermidis
KYEPIS

SEQ ID NO: 1836387 - protein, 7 aa, Staphylococcus epidermidis
LAETPFQ

SEQ ID NO: 1836388 - protein, 15 aa, Staphylococcus epidermidis
LAGTSDEEAGQTFRE

SEQ ID NO: 1836389 - protein, 4 aa, Staphylococcus epidermidis
LDKE

SEQ ID NO: 1836390 - protein, 19 aa, Staphylococcus epidermidis
LEDGSHSDGRVSNSSSQSL

SEQ ID NO: 1836391 - protein, 11 aa, Staphylococcus epidermidis
LEGEAGENPTF

SEQ ID NO: 1836392 - protein, 14 aa, Staphylococcus epidermidis
LEKEEIQSQDIKRA

SEQ ID NO: 1836393 - protein, 10 aa, Staphylococcus epidermidis
LEKETTEGVD

SEQ ID NO: 1836394 - protein, 9 aa, Staphylococcus epidermidis
LHNEDGDIH

SEQ ID NO: 1836395 - protein, 10 aa, Staphylococcus epidermidis
LKYSDNSTIN

SEQ ID NO: 1836396 - protein, 24 aa, Staphylococcus epidermidis
LPGLGDGNAKDDVKITTTETSETK

SEQ ID NO: 1836397 - protein, 15 aa, Staphylococcus epidermidis
LQNRGEDISNNLSND

SEQ ID NO: 1836398 - protein, 27 aa, Staphylococcus epidermidis
LRDKSHEDRQNQRPNQKTSNEQHQEGG

SEQ ID NO: 1836399 - protein, 8 aa, Staphylococcus epidermidis
LSEDAANP

SEQ ID NO: 1836400 - protein, 11 aa, Staphylococcus epidermidis
LSTNNDVGQHA

SEQ ID NO: 1836401 - protein, 6 aa, Staphylococcus epidermidis
LTGEKF

SEQ ID NO: 1836402 - protein, 6 aa, Staphylococcus epidermidis
MNEEEM

SEQ ID NO: 1836403 - protein, 26 aa, Staphylococcus epidermidis
NADRNLNRIDSSESMNGYRRGAYENM

SEQ ID NO: 1836404 - protein, 7 aa, Staphylococcus epidermidis
NANYSQI

SEQ ID NO: 1836405 - protein, 5 aa, Staphylococcus epidermidis
NDFSS

SEQ ID NO: 1836406 - protein, 7 aa, Staphylococcus epidermidis
NDIELPT

SEQ ID NO: 1836407 - protein, 5 aa, Staphylococcus epidermidis
NDYAT

SEQ ID NO: 1836408 - protein, 7 aa, Staphylococcus epidermidis
NEEGDIN

SEQ ID NO: 1836409 - protein, 38 aa, Staphylococcus epidermidis
NEKDITSFNDVKGKKLAQTFTSNYGQLAKDKGADVTKV

SEQ ID NO: 1836410 - protein, 18 aa, Staphylococcus epidermidis
NGDTSTKNRTNKENWTPT

SEQ ID NO: 1836411 - protein, 5 aa, Staphylococcus epidermidis
NGTAN

SEQ ID NO: 1836412 - protein, 6 aa, Staphylococcus epidermidis
NHEQTI

SEQ ID NO: 1836413 - protein, 13 aa, Staphylococcus epidermidis
NHSEEKPQQEQVE

SEQ ID NO: 1836414 - protein, 12 aa, Staphylococcus epidermidis
NHSNHEHHSHEG

SEQ ID NO: 1836415 - protein, 9 aa, Staphylococcus epidermidis
NKNPEQVAK

SEQ ID NO: 1836416 - protein, 14 aa, Staphylococcus epidermidis
NKQLDKVKKAADEL

SEQ ID NO: 1836417 - protein, 4 aa, Staphylococcus epidermidis
NKTP

SEQ ID NO: 1836418 - protein, 12 aa, Staphylococcus epidermidis
NKYDNRHYTKTI

SEQ ID NO: 1836419 - protein, 17 aa, Staphylococcus epidermidis
NLAPLEDKTTELRDDNH

SEQ ID NO: 1836420 - protein, 5 aa, Staphylococcus epidermidis
NLKSI

SEQ ID NO: 1836421 - protein, 4 aa, Staphylococcus epidermidis
NNEK

SEQ ID NO: 1836422 - protein, 11 aa, Staphylococcus epidermidis
NPANPGTHQYA

SEQ ID NO: 1836423 - protein, 9 aa, Staphylococcus epidermidis
NRDGKKIPY

SEQ ID NO: 1836424 - protein, 6 aa, Staphylococcus epidermidis
NRYDVG

SEQ ID NO: 1836425 - protein, 13 aa, Staphylococcus epidermidis
NSDFQDAKASLQQ

SEQ ID NO: 1836426 - protein, 22 aa, Staphylococcus epidermidis
NSGTGRFDAESGDIKVQKGRYK

SEQ ID NO: 1836427 - protein, 7 aa, Staphylococcus epidermidis
NTRTTKG

SEQ ID NO: 1836428 - protein, 6 aa, Staphylococcus epidermidis
NVKDSD

SEQ ID NO: 1836429 - protein, 44 aa, Staphylococcus epidermidis
NVSTDTSNTTYDNYDSESTDTYSVSNAYDGLRSVSNSGNLYTTG

SEQ ID NO: 1836430 - protein, 7 aa, Staphylococcus epidermidis
NYQPQNS

SEQ ID NO: 1836431 - protein, 14 aa, Staphylococcus epidermidis
PATISSNTDTRINE

SEQ ID NO: 1836432 - protein, 12 aa, Staphylococcus epidermidis
PHTSNDSQYPED

SEQ ID NO: 1836433 - protein, 5 aa, Staphylococcus epidermidis
PKATS

SEQ ID NO: 1836434 - protein, 5 aa, Staphylococcus epidermidis
PNDEM

SEQ ID NO: 1836435 - protein, 25 aa, Staphylococcus epidermidis
PNGGSGSGSGGTATQTSGNYTSPSF

SEQ ID NO: 1836436 - protein, 4 aa, Staphylococcus epidermidis
PNQF

SEQ ID NO: 1836437 - protein, 11 aa, Staphylococcus epidermidis
PTSTSQSPHPL

SEQ ID NO: 1836438 - protein, 20 aa, Staphylococcus epidermidis
QAEDPTCFKGKDKDIRQSQM

SEQ ID NO: 1836439 - protein, 11 aa, Staphylococcus epidermidis
QEIRATSNHTA

SEQ ID NO: 1836440 - protein, 37 aa, Staphylococcus epidermidis
QGTDARNGVMQETKDELDSDNLDKYSLKESSDQDQFK

SEQ ID NO: 1836441 - protein, 6 aa, Staphylococcus epidermidis
QGTPKL

SEQ ID NO: 1836442 - protein, 21 aa, Staphylococcus epidermidis
QKEGKDDKDEKVVEQTTKLQN

SEQ ID NO: 1836443 - protein, 21 aa, Staphylococcus epidermidis
QKPINDASHTGWTTNGHTGVD

SEQ ID NO: 1836444 - protein, 17 aa, Staphylococcus epidermidis
QNKKLSKDNQYNNQTTN

SEQ ID NO: 1836445 - protein, 7 aa, Staphylococcus epidermidis
QNSAEAK

SEQ ID NO: 1836446 - protein, 8 aa, Staphylococcus epidermidis
QRTQGNNT

SEQ ID NO: 1836447 - protein, 10 aa, Staphylococcus epidermidis
QSEAKKANVD

SEQ ID NO: 1836448 - protein, 33 aa, Staphylococcus epidermidis
QSSESAFESSQNTKDSQRKSTLRDSKVDPEKQP

SEQ ID NO: 1836449 - protein, 4 aa, Staphylococcus epidermidis
QVRG

SEQ ID NO: 1836450 - protein, 5 aa, Staphylococcus epidermidis
QVSDN

SEQ ID NO: 1836451 - protein, 8 aa, Staphylococcus epidermidis
RAGDGYPA

SEQ ID NO: 1836452 - protein, 10 aa, Staphylococcus epidermidis
RKDTKNTGNQ

SEQ ID NO: 1836453 - protein, 16 aa, Staphylococcus epidermidis
RKQTSKDLELGFYNKA

SEQ ID NO: 1836454 - protein, 9 aa, Staphylococcus epidermidis
RNEEGETDI

SEQ ID NO: 1836455 - protein, 12 aa, Staphylococcus epidermidis
RQKAKNLKSDVI

SEQ ID NO: 1836456 - protein, 6 aa, Staphylococcus epidermidis
RQTSPH

SEQ ID NO: 1836457 - protein, 12 aa, Staphylococcus epidermidis
RSQTQSPAEQYV

SEQ ID NO: 1836458 - protein, 5 aa, Staphylococcus epidermidis
RSVQQ

SEQ ID NO: 1836459 - protein, 8 aa, Staphylococcus epidermidis
RVSSEGKV

SEQ ID NO: 1836460 - protein, 11 aa, Staphylococcus epidermidis
RYEEKNSKPVA

SEQ ID NO: 1836461 - protein, 10 aa, Staphylococcus epidermidis
SDDKQVKQFS

SEQ ID NO: 1836462 - protein, 15 aa, Staphylococcus epidermidis
SDGEVTKYDENGEEI

SEQ ID NO: 1836463 - protein, 7 aa, Staphylococcus epidermidis
SDVEPMN

SEQ ID NO: 1836464 - protein, 7 aa, Staphylococcus epidermidis
SDYTQLD

SEQ ID NO: 1836465 - protein, 7 aa, Staphylococcus epidermidis
SESYSKD

SEQ ID NO: 1836466 - protein, 8 aa, Staphylococcus epidermidis
SFANDNKR

SEQ ID NO: 1836467 - protein, 30 aa, Staphylococcus epidermidis
SFEASGKENNGSDKKKISNTVEVPKNPKNA

SEQ ID NO: 1836468 - protein, 7 aa, Staphylococcus epidermidis
SFSGQAA

SEQ ID NO: 1836469 - protein, 4 aa, Staphylococcus epidermidis
SGKV

SEQ ID NO: 1836470 - protein, 14 aa, Staphylococcus epidermidis
SHTKQQDDDNNTYQ

SEQ ID NO: 1836471 - protein, 13 aa, Staphylococcus epidermidis
SISDLKNSDFGKS

SEQ ID NO: 1836472 - protein, 30 aa, Staphylococcus epidermidis
SISGDLGDAHNWNNRAESEGYTVTHTPKNH

SEQ ID NO: 1836473 - protein, 10 aa, Staphylococcus epidermidis
SISSEHNGGI

SEQ ID NO: 1836474 - protein, 7 aa, Staphylococcus epidermidis
SKSSQVI

SEQ ID NO: 1836475 - protein, 61 aa, Staphylococcus epidermidis
SLSSPSIAETSNHSPAPNQSEKSIQQQTNIPSNMNQSSAKTFKRQAESDSVSGKTNDTHNH

SEQ ID NO: 1836476 - protein, 10 aa, Staphylococcus epidermidis
SNPHSTTTGY

SEQ ID NO: 1836477 - protein, 50 aa, Staphylococcus epidermidis
SNSNDSDQSSNEKSSSKSSEKKTDVATEYTKEDEYKELEKEAKDLKQKPV

SEQ ID NO: 1836478 - protein, 11 aa, Staphylococcus epidermidis
SSDAKKGDHVS

SEQ ID NO: 1836479 - protein, 9 aa, Staphylococcus epidermidis
SSEVNDDNV

SEQ ID NO: 1836480 - protein, 7 aa, Staphylococcus epidermidis
STHSRNY

SEQ ID NO: 1836481 - protein, 7 aa, Staphylococcus epidermidis
STKSYQE

SEQ ID NO: 1836482 - protein, 22 aa, Staphylococcus epidermidis
SVAPSQYKGVSPAKAPESVQDR

SEQ ID NO: 1836483 - protein, 21 aa, Staphylococcus epidermidis
SYAKTDTESHNHSSLGTENKN

SEQ ID NO: 1836484 - protein, 9 aa, Staphylococcus epidermidis
SYRGESDLP

SEQ ID NO: 1836485 - protein, 4 aa, Staphylococcus epidermidis
TAKY

SEQ ID NO: 1836486 - protein, 14 aa, Staphylococcus epidermidis
TARNVTKTHTSNIN

SEQ ID NO: 1836487 - protein, 36 aa, Staphylococcus epidermidis
TASKPSNPTKPSTNNQLTVTNNSGVAQINAKNSGLY

SEQ ID NO: 1836488 - protein, 14 aa, Staphylococcus epidermidis
TDPKKSTAKEREKL

SEQ ID NO: 1836489 - protein, 11 aa, Staphylococcus epidermidis
TELDSDDNHKY

SEQ ID NO: 1836490 - protein, 5 aa, Staphylococcus epidermidis
TFEKN

SEQ ID NO: 1836491 - protein, 11 aa, Staphylococcus epidermidis
TFQSPNQGPLG

SEQ ID NO: 1836492 - protein, 8 aa, Staphylococcus epidermidis
TGDDPRKV

SEQ ID NO: 1836493 - protein, 19 aa, Staphylococcus epidermidis
TGQNPQSSEDIGKALANEL

SEQ ID NO: 1836494 - protein, 15 aa, Staphylococcus epidermidis
TISASEASSYNYIHL

SEQ ID NO: 1836495 - protein, 5 aa, Staphylococcus epidermidis
TKAMP

SEQ ID NO: 1836496 - protein, 9 aa, Staphylococcus epidermidis
TKSPDVYPG

SEQ ID NO: 1836497 - protein, 16 aa, Staphylococcus epidermidis
TLSNERNNKTLNSKND

SEQ ID NO: 1836498 - protein, 6 aa, Staphylococcus epidermidis
TLSQVN

SEQ ID NO: 1836499 - protein, 25 aa, Staphylococcus epidermidis
TNEKGQNKEQNEKQPTKGDKQELQV

SEQ ID NO: 1836500 - protein, 10 aa, Staphylococcus epidermidis
TQPGETDNYD

SEQ ID NO: 1836501 - protein, 5 aa, Staphylococcus epidermidis
TQPYE

SEQ ID NO: 1836502 - protein, 11 aa, Staphylococcus epidermidis
TQQEGAGNEIQ

SEQ ID NO: 1836503 - protein, 5 aa, Staphylococcus epidermidis
TSAPK

SEQ ID NO: 1836504 - protein, 10 aa, Staphylococcus epidermidis
TYNTNRYNAE

SEQ ID NO: 1836505 - protein, 4 aa, Staphylococcus epidermidis
TYQD

SEQ ID NO: 1836506 - protein, 8 aa, Staphylococcus epidermidis
VDKNSVSD

SEQ ID NO: 1836507 - protein, 6 aa, Staphylococcus epidermidis
VGGNKV

SEQ ID NO: 1836508 - protein, 4 aa, Staphylococcus epidermidis
VGKG

SEQ ID NO: 1836509 - protein, 7 aa, Staphylococcus epidermidis
VGPEYTD

SEQ ID NO: 1836510 - protein, 6 aa, Staphylococcus epidermidis
VITNQS

SEQ ID NO: 1836511 - protein, 39 aa, Staphylococcus epidermidis
VNATSKQTTSYKYKEPAQRVTTNTVKKETASNQATIDTK

SEQ ID NO: 1836512 - protein, 5 aa, Staphylococcus epidermidis
VNGTN

SEQ ID NO: 1836513 - protein, 7 aa, Staphylococcus epidermidis
VPRGDTG

SEQ ID NO: 1836514 - protein, 9 aa, Staphylococcus epidermidis
VSENSDSFH

SEQ ID NO: 1836515 - protein, 6 aa, Staphylococcus epidermidis
VTAGPT

SEQ ID NO: 1836516 - protein, 7 aa, Staphylococcus epidermidis
VTDEIKD

SEQ ID NO: 1836517 - protein, 18 aa, Staphylococcus epidermidis
WYSNARRSGYATGHKPRK

SEQ ID NO: 1836518 - protein, 19 aa, Staphylococcus epidermidis
YASGSSEQSAQTKQTQNDA

SEQ ID NO: 1836519 - protein, 21 aa, Staphylococcus epidermidis
YAYGPGSNKFKGNMENTQSAK

SEQ ID NO: 1836520 - protein, 13 aa, Staphylococcus epidermidis
YDDEDDDSSTDHL

SEQ ID NO: 1836521 - protein, 6 aa, Staphylococcus epidermidis
YDDNTV

SEQ ID NO: 1836522 - protein, 10 aa, Staphylococcus epidermidis
YDIPTKQAPK

SEQ ID NO: 1836523 - protein, 13 aa, Staphylococcus epidermidis
YDKTAKSGTKYAN

SEQ ID NO: 1836524 - protein, 12 aa, Staphylococcus epidermidis
YEADGKGKEPAV

SEQ ID NO: 1836525 - protein, 11 aa, Staphylococcus epidermidis
YEGGGADLKNN

SEQ ID NO: 1836526 - protein, 13 aa, Staphylococcus epidermidis
YEQDARTWKQKGY

SEQ ID NO: 1836527 - protein, 9 aa, Staphylococcus epidermidis
YGNKDSRVD

SEQ ID NO: 1836528 - protein, 8 aa, Staphylococcus epidermidis
YKGKPYTQ

SEQ ID NO: 1836529 - protein, 5 aa, Staphylococcus epidermidis
YKKGQ

SEQ ID NO: 1836530 - protein, 9 aa, Staphylococcus epidermidis
YKPQVQNEP

SEQ ID NO: 1836531 - protein, 14 aa, Staphylococcus epidermidis
YKVTDTEKDNKGFT

SEQ ID NO: 1836532 - protein, 5 aa, Staphylococcus epidermidis
YNYPY

SEQ ID NO: 1836533 - protein, 12 aa, Staphylococcus epidermidis
YRSGYNAAKGGV

SEQ ID NO: 1836534 - protein, 9 aa, Staphylococcus epidermidis
YSNNKIKTT

SEQ ID NO: 1836535 - protein, 6 aa, Staphylococcus epidermidis
YTGTEL

SEQ ID NO: 1836536 - protein, 23 aa, Staphylococcus epidermidis
YTPGVGGDALRSMSNPERFGQPS

SEQ ID NO: 1836537 - protein, 4 aa, Staphylococcus epidermidis
ADYA

SEQ ID NO: 1836538 - protein, 8 aa, Staphylococcus epidermidis
AEHTTEST

SEQ ID NO: 1836539 - protein, 8 aa, Staphylococcus epidermidis
AKPSKGSF

SEQ ID NO: 1836540 - protein, 9 aa, Staphylococcus epidermidis
AKQRLEEAG

SEQ ID NO: 1836541 - protein, 9 aa, Staphylococcus epidermidis
ALADKGNYD

SEQ ID NO: 1836542 - protein, 10 aa, Staphylococcus epidermidis
AQEGYSKSHP

SEQ ID NO: 1836543 - protein, 8 aa, Staphylococcus epidermidis
ASERDFKD

SEQ ID NO: 1836544 - protein, 14 aa, Staphylococcus epidermidis
ASTERKIDKYQSMT

SEQ ID NO: 1836545 - protein, 14 aa, Staphylococcus epidermidis
AYSWDTSSNSIAKY

SEQ ID NO: 1836546 - protein, 5 aa, Staphylococcus epidermidis
DDINP

SEQ ID NO: 1836547 - protein, 13 aa, Staphylococcus epidermidis
DDYKEQKKLSAYQ

SEQ ID NO: 1836548 - protein, 24 aa, Staphylococcus epidermidis
DEGKAAEDAGYVASPKKTYKSQLD

SEQ ID NO: 1836549 - protein, 8 aa, Staphylococcus epidermidis
DISPDGKT

SEQ ID NO: 1836550 - protein, 10 aa, Staphylococcus epidermidis
DKEKTDRYGR

SEQ ID NO: 1836551 - protein, 4 aa, Staphylococcus epidermidis
DKID

SEQ ID NO: 1836552 - protein, 8 aa, Staphylococcus epidermidis
DKSLKDNK

SEQ ID NO: 1836553 - protein, 25 aa, Staphylococcus epidermidis
DNKADFGETEYGDNTKTKKTTPEKI

SEQ ID NO: 1836554 - protein, 27 aa, Staphylococcus epidermidis
DNLTDEDDTSESEDQSSSSDEATVTRS

SEQ ID NO: 1836555 - protein, 16 aa, Staphylococcus epidermidis
DPEMSQDLKAFIKQLD

SEQ ID NO: 1836556 - protein, 48 aa, Staphylococcus epidermidis
DPKYTKKEIDKMSEKEKKSKNANENLGLNPSHNGETDEEKIAENSPAY

SEQ ID NO: 1836557 - protein, 11 aa, Staphylococcus epidermidis
DPSAKEGSRYE

SEQ ID NO: 1836558 - protein, 7 aa, Staphylococcus epidermidis
DQYKRSQ

SEQ ID NO: 1836559 - protein, 12 aa, Staphylococcus epidermidis
DRADVNKDGTIT

SEQ ID NO: 1836560 - protein, 10 aa, Staphylococcus epidermidis
DRKGDGYPAF

SEQ ID NO: 1836561 - protein, 19 aa, Staphylococcus epidermidis
DRNPKKGSILQSSKGKYGH

SEQ ID NO: 1836562 - protein, 7 aa, Staphylococcus epidermidis
DSGRPEM

SEQ ID NO: 1836563 - protein, 11 aa, Staphylococcus epidermidis
DSRDKKDEIAQ

SEQ ID NO: 1836564 - protein, 8 aa, Staphylococcus epidermidis
DTKGEIKP

SEQ ID NO: 1836565 - protein, 24 aa, Staphylococcus epidermidis
DTPETVKPNTPVQPYGKQASNYTK

SEQ ID NO: 1836566 - protein, 12 aa, Staphylococcus epidermidis
DTTDYKRTGEEL

SEQ ID NO: 1836567 - protein, 9 aa, Staphylococcus epidermidis
EAGIDATKD

SEQ ID NO: 1836568 - protein, 9 aa, Staphylococcus epidermidis
EASNKSELM

SEQ ID NO: 1836569 - protein, 10 aa, Staphylococcus epidermidis
EENKAKEGLV

SEQ ID NO: 1836570 - protein, 36 aa, Staphylococcus epidermidis
EKDNDHKIENYDKKEKEQTKTSKSTPKIPSDKSKMA

SEQ ID NO: 1836571 - protein, 22 aa, Staphylococcus epidermidis
EKPYKSGANGWAVPSTTEHPED

SEQ ID NO: 1836572 - protein, 8 aa, Staphylococcus epidermidis
EKSYTDLD

SEQ ID NO: 1836573 - protein, 5 aa, Staphylococcus epidermidis
EQDGT

SEQ ID NO: 1836574 - protein, 7 aa, Staphylococcus epidermidis
ETAPTDY

SEQ ID NO: 1836575 - protein, 9 aa, Staphylococcus epidermidis
ETDGKIKPT

SEQ ID NO: 1836576 - protein, 10 aa, Staphylococcus epidermidis
ETNIPKTHKK

SEQ ID NO: 1836577 - protein, 4 aa, Staphylococcus epidermidis
EYGE

SEQ ID NO: 1836578 - protein, 5 aa, Staphylococcus epidermidis
FDKKD

SEQ ID NO: 1836579 - protein, 27 aa, Staphylococcus epidermidis
FESIDDAKKALNETKYQTAGKYNGTTY

SEQ ID NO: 1836580 - protein, 25 aa, Staphylococcus epidermidis
FKDDNGKEITPIGPTAWGGDDRTKF

SEQ ID NO: 1836581 - protein, 15 aa, Staphylococcus epidermidis
FKNPEARKYEKEDPM

SEQ ID NO: 1836582 - protein, 12 aa, Staphylococcus epidermidis
FPPYDGSPLANE

SEQ ID NO: 1836583 - protein, 11 aa, Staphylococcus epidermidis
FRAGDSGSPMV

SEQ ID NO: 1836584 - protein, 14 aa, Staphylococcus epidermidis
GDGDLKGSSVGSKN

SEQ ID NO: 1836585 - protein, 7 aa, Staphylococcus epidermidis
GGLGKGI

SEQ ID NO: 1836586 - protein, 68 aa, Staphylococcus epidermidis
GGSAQAAEQQQDKGTVENSTTQSIGDGNEKLSEQQSTQNKNVNEKSNVNSITENESLHNETPKNEDWI

SEQ ID NO: 1836587 - protein, 42 aa, Staphylococcus epidermidis
GKIGSTWGNANNWANAAARSGYTVNNSPAKGAILQTSQGAYG

SEQ ID NO: 1836588 - protein, 8 aa, Staphylococcus epidermidis
GKISTEQM

SEQ ID NO: 1836589 - protein, 9 aa, Staphylococcus epidermidis
GKSDLTTDV

SEQ ID NO: 1836590 - protein, 12 aa, Staphylococcus epidermidis
GLKNSHSDDDVR

SEQ ID NO: 1836591 - protein, 5 aa, Staphylococcus epidermidis
GNNTY

SEQ ID NO: 1836592 - protein, 6 aa, Staphylococcus epidermidis
GRIHPG

SEQ ID NO: 1836593 - protein, 6 aa, Staphylococcus epidermidis
GSSTIQ

SEQ ID NO: 1836594 - protein, 19 aa, Staphylococcus epidermidis
GTQSSGTYQQYAHSEAARE

SEQ ID NO: 1836595 - protein, 6 aa, Staphylococcus epidermidis
GYMSGS

SEQ ID NO: 1836596 - protein, 10 aa, Staphylococcus epidermidis
GYQKLNGDQA

SEQ ID NO: 1836597 - protein, 5 aa, Staphylococcus epidermidis
GYTAH

SEQ ID NO: 1836598 - protein, 4 aa, Staphylococcus epidermidis
HEYP

SEQ ID NO: 1836599 - protein, 18 aa, Staphylococcus epidermidis
HGNPEEVEYQKQHGGEIS

SEQ ID NO: 1836600 - protein, 9 aa, Staphylococcus epidermidis
IETSPEKVL

SEQ ID NO: 1836601 - protein, 22 aa, Staphylococcus epidermidis
IKDDNGKVTEPTKKTIQNGSYA

SEQ ID NO: 1836602 - protein, 16 aa, Staphylococcus epidermidis
ITQNESAKNDKDVYDQ

SEQ ID NO: 1836603 - protein, 9 aa, Staphylococcus epidermidis
KAAKQGRLT

SEQ ID NO: 1836604 - protein, 7 aa, Staphylococcus epidermidis
KDKPEAI

SEQ ID NO: 1836605 - protein, 8 aa, Staphylococcus epidermidis
KDNPEIDK

SEQ ID NO: 1836606 - protein, 16 aa, Staphylococcus epidermidis
KDSGINSLKDLKGKKI

SEQ ID NO: 1836607 - protein, 6 aa, Staphylococcus epidermidis
KEEKER

SEQ ID NO: 1836608 - protein, 11 aa, Staphylococcus epidermidis
KEEQNDDSISY

SEQ ID NO: 1836609 - protein, 7 aa, Staphylococcus epidermidis
KEGNLEG

SEQ ID NO: 1836610 - protein, 8 aa, Staphylococcus epidermidis
KEKPELKP

SEQ ID NO: 1836611 - protein, 12 aa, Staphylococcus epidermidis
KENMAQKANVQP

SEQ ID NO: 1836612 - protein, 7 aa, Staphylococcus epidermidis
KETAKKY

SEQ ID NO: 1836613 - protein, 6 aa, Staphylococcus epidermidis
KGKADL

SEQ ID NO: 1836614 - protein, 5 aa, Staphylococcus epidermidis
KGLAR

SEQ ID NO: 1836615 - protein, 56 aa, Staphylococcus epidermidis
KHASENNQTLHSKAAQSNEDVKTKPSQLDNTAAKQEDSQKENLSKQDTQSSKTTDL

SEQ ID NO: 1836616 - protein, 9 aa, Staphylococcus epidermidis
KKETDTKPL

SEQ ID NO: 1836617 - protein, 7 aa, Staphylococcus epidermidis
KKQEGGL

SEQ ID NO: 1836618 - protein, 5 aa, Staphylococcus epidermidis
KLAGN

SEQ ID NO: 1836619 - protein, 11 aa, Staphylococcus epidermidis
KLEGKISTEEM

SEQ ID NO: 1836620 - protein, 8 aa, Staphylococcus epidermidis
KLTSASSI

SEQ ID NO: 1836621 - protein, 7 aa, Staphylococcus epidermidis
KNDQLTG

SEQ ID NO: 1836622 - protein, 30 aa, Staphylococcus epidermidis
KNQETQQTENKDNKTNHSETIDKTPTIHNN

SEQ ID NO: 1836623 - protein, 8 aa, Staphylococcus epidermidis
KQKSKGKI

SEQ ID NO: 1836624 - protein, 8 aa, Staphylococcus epidermidis
KSSFSGKR

SEQ ID NO: 1836625 - protein, 21 aa, Staphylococcus epidermidis
KTKTGYESATLGIKNKSQLYK

SEQ ID NO: 1836626 - protein, 6 aa, Staphylococcus epidermidis
KTSLKA

SEQ ID NO: 1836627 - protein, 11 aa, Staphylococcus epidermidis
KYFSPNGKYRD

SEQ ID NO: 1836628 - protein, 6 aa, Staphylococcus epidermidis
KYIDTN

SEQ ID NO: 1836629 - protein, 20 aa, Staphylococcus epidermidis
LASTHAQAATTHTVKSGESV

SEQ ID NO: 1836630 - protein, 5 aa, Staphylococcus epidermidis
LEKHA

SEQ ID NO: 1836631 - protein, 50 aa, Staphylococcus epidermidis
LGDSDNNGSSTINDDQQSGYKSNRDSKSSISRNQTEDNQQDTQQDTHSNR

SEQ ID NO: 1836632 - protein, 10 aa, Staphylococcus epidermidis
LKDPKATSYG

SEQ ID NO: 1836633 - protein, 9 aa, Staphylococcus epidermidis
LLAHPSNSY

SEQ ID NO: 1836634 - protein, 14 aa, Staphylococcus epidermidis
LLSSRKKVQQFTEN

SEQ ID NO: 1836635 - protein, 74 aa, Staphylococcus epidermidis
LNSKEEPLKVDKQANPTTDKDKSSKNDKGSQDGLANLESNAVATTNKQSKQQVSEKNEDQTNKSAKQKQYKNND

SEQ ID NO: 1836636 - protein, 6 aa, Staphylococcus epidermidis
LPATDF

SEQ ID NO: 1836637 - protein, 6 aa, Staphylococcus epidermidis
LSGKRY

SEQ ID NO: 1836638 - protein, 45 aa, Staphylococcus epidermidis
MDKEDQEGENVDTNKNQSSSEQQQTQANDDSSERNKKYSSITDSA

SEQ ID NO: 1836639 - protein, 10 aa, Staphylococcus epidermidis
MKAPRIEEDY

SEQ ID NO: 1836640 - protein, 6 aa, Staphylococcus epidermidis
NDPSVS

SEQ ID NO: 1836641 - protein, 7 aa, Staphylococcus epidermidis
NEDGSMQ

SEQ ID NO: 1836642 - protein, 5 aa, Staphylococcus epidermidis
NESAF

SEQ ID NO: 1836643 - protein, 10 aa, Staphylococcus epidermidis
NESKKDIPNS

SEQ ID NO: 1836644 - protein, 10 aa, Staphylococcus epidermidis
NHIKQTPTAF

SEQ ID NO: 1836645 - protein, 7 aa, Staphylococcus epidermidis
NKLHQTK

SEQ ID NO: 1836646 - protein, 8 aa, Staphylococcus epidermidis
NKVEDPYD

SEQ ID NO: 1836647 - protein, 7 aa, Staphylococcus epidermidis
NNKCNSY

SEQ ID NO: 1836648 - protein, 7 aa, Staphylococcus epidermidis
NQVDGHS

SEQ ID NO: 1836649 - protein, 4 aa, Staphylococcus epidermidis
NSDV

SEQ ID NO: 1836650 - protein, 17 aa, Staphylococcus epidermidis
NSSSHNIKPSQNKSYPS

SEQ ID NO: 1836651 - protein, 7 aa, Staphylococcus epidermidis
NYDGGPF

SEQ ID NO: 1836652 - protein, 4 aa, Staphylococcus epidermidis
NYYG

SEQ ID NO: 1836653 - protein, 15 aa, Staphylococcus epidermidis
PDGALNKGNYSNTKV

SEQ ID NO: 1836654 - protein, 14 aa, Staphylococcus epidermidis
PDGKKTGENKQPMS

SEQ ID NO: 1836655 - protein, 7 aa, Staphylococcus epidermidis
PEGKESV

SEQ ID NO: 1836656 - protein, 8 aa, Staphylococcus epidermidis
QAEEPNRE

SEQ ID NO: 1836657 - protein, 11 aa, Staphylococcus epidermidis
QDAKERSKAYQ

SEQ ID NO: 1836658 - protein, 9 aa, Staphylococcus epidermidis
QENDDQRKR

SEQ ID NO: 1836659 - protein, 7 aa, Staphylococcus epidermidis
QHEAKAV

SEQ ID NO: 1836660 - protein, 6 aa, Staphylococcus epidermidis
QKEKVV

SEQ ID NO: 1836661 - protein, 7 aa, Staphylococcus epidermidis
QKNGEEI

SEQ ID NO: 1836662 - protein, 16 aa, Staphylococcus epidermidis
QQGVKGMNDEEPSQKE

SEQ ID NO: 1836663 - protein, 7 aa, Staphylococcus epidermidis
QQIGGKY

SEQ ID NO: 1836664 - protein, 7 aa, Staphylococcus epidermidis
QRGDANM

SEQ ID NO: 1836665 - protein, 8 aa, Staphylococcus epidermidis
QTSQGAYG

SEQ ID NO: 1836666 - protein, 13 aa, Staphylococcus epidermidis
RDADYSKRESQRI

SEQ ID NO: 1836667 - protein, 26 aa, Staphylococcus epidermidis
RDDQSVKNHTIDASQPTGAQSELQRE

SEQ ID NO: 1836668 - protein, 7 aa, Staphylococcus epidermidis
RETQGYN

SEQ ID NO: 1836669 - protein, 31 aa, Staphylococcus epidermidis; identical to SEQ ID NO: 1788389

SEQ ID NO: 1836670 - protein, 15 aa, Staphylococcus epidermidis
RHPGQEERRTVGGPY

SEQ ID NO: 1836671 - protein, 7 aa, Staphylococcus epidermidis
RKDGTWE

SEQ ID NO: 1836672 - protein, 14 aa, Staphylococcus epidermidis
RLPKEGKDISEMDK

SEQ ID NO: 1836673 - protein, 7 aa, Staphylococcus epidermidis
RMNSKQQ

SEQ ID NO: 1836674 - protein, 16 aa, Staphylococcus epidermidis
RSFTQTAAKELADKGI

SEQ ID NO: 1836675 - protein, 8 aa, Staphylococcus epidermidis
RYQEPSDV

SEQ ID NO: 1836676 - protein, 9 aa, Staphylococcus epidermidis
SAALPSVRG

SEQ ID NO: 1836677 - protein, 4 aa, Staphylococcus epidermidis
SADD

SEQ ID NO: 1836678 - protein, 5 aa, Staphylococcus epidermidis
SDSES

SEQ ID NO: 1836679 - protein, 7 aa, Staphylococcus epidermidis
SDVDDTD

SEQ ID NO: 1836680 - protein, 22 aa, Staphylococcus epidermidis
SESGQKQVNDLANQKDSGQISQ

SEQ ID NO: 1836681 - protein, 12 aa, Staphylococcus epidermidis
SFTDSEEKAMGF

SEQ ID NO: 1836682 - protein, 12 aa, Staphylococcus epidermidis
SGKKAGKYQKKY

SEQ ID NO: 1836683 - protein, 22 aa, Staphylococcus epidermidis
SHTKDNHNQTTQHQNDPNLGEQ

SEQ ID NO: 1836684 - protein, 20 aa, Staphylococcus epidermidis
SNDSDYITGQSILTDGGLVY

SEQ ID NO: 1836685 - protein, 22 aa, Staphylococcus epidermidis
SNSSNNNSTSKKKNSDSKETVT

SEQ ID NO: 1836686 - protein, 6 aa, Staphylococcus epidermidis
SPYTQQ

SEQ ID NO: 1836687 - protein, 75 aa, Staphylococcus epidermidis
SQNDTKEDENKKSENTTEKKSDDKKDKKTNEDKKSGEQKKSQEKKNNKSMQESATNEQVQSQQQTNNNQQQYSDE

SEQ ID NO: 1836688 - protein, 5 aa, Staphylococcus epidermidis
SSGKL

SEQ ID NO: 1836689 - protein, 32 aa, Staphylococcus epidermidis
STFKTGSYGSNQRGADDGVDDKSSSHQNQNAK

SEQ ID NO: 1836690 - protein, 197 aa, Staphylococcus epidermidis
SYHETPSTDVKSNEDKQIDSQSNQPQTSMPNNDQQNPKKVAEHTTKSINAKKEETRKNENAKSLVQPQQDDKTTSEQTKMKESREQEITNEQKQLQSKDVKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVD

SEQ ID NO: 1836691 - protein, 37 aa, Staphylococcus epidermidis
TAQNQSKDSQSTEEINKEVNNDTQQVTAKNDDAKVES

SEQ ID NO: 1836692 - protein, 5 aa, Staphylococcus epidermidis
TENQS

SEQ ID NO: 1836693 - protein, 35 aa, Staphylococcus epidermidis
THADAAENNNQQQSTYNYSTTEVSFSNSGNLYTSG

SEQ ID NO: 1836694 - protein, 6 aa, Staphylococcus epidermidis
TIKAKP

SEQ ID NO: 1836695 - protein, 18 aa, Staphylococcus epidermidis
TKAKNKVTDQPVGTGPYK

SEQ ID NO: 1836696 - protein, 5 aa, Staphylococcus epidermidis
TNQKI

SEQ ID NO: 1836697 - protein, 44 aa, Staphylococcus epidermidis
TPRNNEKTYENATESTKPKDLNDFKQTASVTKPTLEYQSTRNEM

SEQ ID NO: 1836698 - protein, 7 aa, Staphylococcus epidermidis
TQPNHQI

SEQ ID NO: 1836699 - protein, 9 aa, Staphylococcus epidermidis
TSLGTSESQ

SEQ ID NO: 1836700 - protein, 12 aa, Staphylococcus epidermidis
TTFGDKQRGQVT

SEQ ID NO: 1836701 - protein, 17 aa, Staphylococcus epidermidis
VENNPDEAKKRGFRGAG

SEQ ID NO: 1836702 - protein, 7 aa, Staphylococcus epidermidis
VETEEYA

SEQ ID NO: 1836703 - protein, 21 aa, Staphylococcus epidermidis
VHAAESNHLENQEQSEVSASH

SEQ ID NO: 1836704 - protein, 9 aa, Staphylococcus epidermidis
VIPSTNASV

SEQ ID NO: 1836705 - protein, 6 aa, Staphylococcus epidermidis
VNSKDH

SEQ ID NO: 1836706 - protein, 14 aa, Staphylococcus epidermidis
VSDKEIKENSKKAS

SEQ ID NO: 1836707 - protein, 19 aa, Staphylococcus epidermidis
VSNEDSTEALTSGLASGDL

SEQ ID NO: 1836708 - protein, 12 aa, Staphylococcus epidermidis
WKSVSKESIIKR

SEQ ID NO: 1836709 - protein, 7 aa, Staphylococcus epidermidis
YAPKKSL

SEQ ID NO: 1836710 - protein, 8 aa, Staphylococcus epidermidis
YDANTGQA

SEQ ID NO: 1836711 - protein, 21 aa, Staphylococcus epidermidis
YESPKDARYEAKTLSQRAPKA

SEQ ID NO: 1836712 - protein, 9 aa, Staphylococcus epidermidis
YGRGISKRD

SEQ ID NO: 1836713 - protein, 12 aa, Staphylococcus epidermidis
YKSLKDLPKGAT

SEQ ID NO: 1836714 - protein, 9 aa, Staphylococcus epidermidis
YKSNGDGTI

SEQ ID NO: 1836715 - protein, 9 aa, Staphylococcus epidermidis
YLPKDTKDN

SEQ ID NO: 1836716 - protein, 11 aa, Staphylococcus epidermidis
YNGGGQRKSIH

SEQ ID NO: 1836717 - protein, 6 aa, Staphylococcus epidermidis
YNVKQE

SEQ ID NO: 1836718 - protein, 5 aa, Staphylococcus epidermidis
YPYQT

SEQ ID NO: 1836719 - protein, 14 aa, Staphylococcus epidermidis
YQADGKGKEPATVA

SEQ ID NO: 1836720 - protein, 7 aa, Staphylococcus epidermidis
YQGGHDN

SEQ ID NO: 1836721 - protein, 10 aa, Staphylococcus epidermidis
YQQKKKANKV

SEQ ID NO: 1836722 - protein, 8 aa, Staphylococcus epidermidis
YSATKHSV

SEQ ID NO: 1836723 - protein, 4 aa, Staphylococcus epidermidis
YSDA

SEQ ID NO: 1836724 - protein, 8 aa, Staphylococcus epidermidis
YSTDGRIS

SEQ ID NO: 1836725 - protein, 5 aa, Staphylococcus epidermidis
AANSL

SEQ ID NO: 1836726 - protein, 21 aa, Staphylococcus epidermidis
ACGGSGKQKEPSKESQKSDKY

SEQ ID NO: 1836727 - protein, 22 aa, Staphylococcus epidermidis
ACGGSGKQKEPSKESQKSDKYD

SEQ ID NO: 1836728 - protein, 18 aa, Staphylococcus epidermidis
ACGKERTKTYEGEVNGKQ

SEQ ID NO: 1836729 - protein, 20 aa, Staphylococcus epidermidis
ADHSTGGLSTAKGKDYKWNP

SEQ ID NO: 1836730 - protein, 21 aa, Staphylococcus epidermidis
ADHSTGGLSTAKGKDYKWNPE

SEQ ID NO: 1836731 - protein, 5 aa, Staphylococcus epidermidis
ADYAA

SEQ ID NO: 1836732 - protein, 12 aa, Staphylococcus epidermidis
AHAQESVKPYYN

SEQ ID NO: 1836733 - protein, 8 aa, Staphylococcus epidermidis
AHTKTIDE

SEQ ID NO: 1836734 - protein, 7 aa, Staphylococcus epidermidis
AKESQHA

SEQ ID NO: 1836735 - protein, 15 aa, Staphylococcus epidermidis
AKPTKDPDKAMSETQ

SEQ ID NO: 1836736 - protein, 17 aa, Staphylococcus epidermidis
AKSIRKDVTETNHSSIE

SEQ ID NO: 1836737 - protein, 6 aa, Staphylococcus epidermidis
AKSKPE

SEQ ID NO: 1836738 - protein, 10 aa, Staphylococcus epidermidis
AKWSNGDSVT

SEQ ID NO: 1836739 - protein, 4 aa, Staphylococcus epidermidis
ANAG

SEQ ID NO: 1836740 - protein, 10 aa, Staphylococcus epidermidis
ANKEADNIKK

SEQ ID NO: 1836741 - protein, 8 aa, Staphylococcus epidermidis
ANKEKMDN

SEQ ID NO: 1836742 - protein, 14 aa, Staphylococcus epidermidis
ATGSKTHLSQLDED

SEQ ID NO: 1836743 - protein, 15 aa, Staphylococcus epidermidis
ATGSKTHLSQLDEDD

SEQ ID NO: 1836744 - protein, 10 aa, Staphylococcus epidermidis
AYASTSKAIN

SEQ ID NO: 1836745 - protein, 24 aa, Staphylococcus epidermidis
AYEGHQLDTDTYTFKEPEQNVDGD

SEQ ID NO: 1836746 - protein, 34 aa, Staphylococcus epidermidis
CGNNSSSNSSKESSKDGVEIKHEEGTTKVPKHPK

SEQ ID NO: 1836747 - protein, 12 aa, Staphylococcus epidermidis
CGNSKEAEIKQN

SEQ ID NO: 1836748 - protein, 7 aa, Staphylococcus epidermidis
CGTGGAA

SEQ ID NO: 1836749 - protein, 4 aa, Staphylococcus epidermidis
DAKH

SEQ ID NO: 1836750 - protein, 6 aa, Staphylococcus epidermidis
DAPLDD

SEQ ID NO: 1836751 - protein, 8 aa, Staphylococcus epidermidis
DASPLASD

SEQ ID NO: 1836752 - protein, 4 aa, Staphylococcus epidermidis
DDIN

SEQ ID NO: 1836753 - protein, 75 aa, Staphylococcus epidermidis
DELNDEPEKKQSKPFETSLPPLNEDWNENEKKKTSHHKEKQNTSQSKRQTTSTHEHQNIPQPDKTTSRDDNYEKL

SEQ ID NO: 1836754 - protein, 6 aa, Staphylococcus epidermidis
DFKDRK

SEQ ID NO: 1836755 - protein, 27 aa, Staphylococcus epidermidis
DGSLPSNNFTGVGTADTPDGKDFARTI

SEQ ID NO: 1836756 - protein, 30 aa, Staphylococcus epidermidis
DHPKKQPHKTQNRSTFSAESNITETNNGER

SEQ ID NO: 1836757 - protein, 30 aa, Staphylococcus epidermidis
DHPKKQTHKTQNRSTFSAESNITETNNGER

SEQ ID NO: 1836758 - protein, 17 aa, Staphylococcus epidermidis
DKEGYRDEEFDKKDKGT

SEQ ID NO: 1836759 - protein, 4 aa, Staphylococcus epidermidis
DKKD

SEQ ID NO: 1836760 - protein, 8 aa, Staphylococcus epidermidis
DKYINTGN

SEQ ID NO: 1836761 - protein, 6 aa, Staphylococcus epidermidis
DLSSAF

SEQ ID NO: 1836762 - protein, 16 aa, Staphylococcus epidermidis
DMKSNNDIKASTQRGN

SEQ ID NO: 1836763 - protein, 11 aa, Staphylococcus epidermidis
DPDNIYGNNNQ

SEQ ID NO: 1836764 - protein, 15 aa, Staphylococcus epidermidis
DPTSIKTSKDVEKLA

SEQ ID NO: 1836765 - protein, 21 aa, Staphylococcus epidermidis
DPYDKAANNAKALKDKIENDY

SEQ ID NO: 1836766 - protein, 25 aa, Staphylococcus epidermidis
DQASYQFSSNSPKDKNVKLYRIDLN

SEQ ID NO: 1836767 - protein, 12 aa, Staphylococcus epidermidis
DRQVRQKEGKDL

SEQ ID NO: 1836768 - protein, 5 aa, Staphylococcus epidermidis
DSQAG

SEQ ID NO: 1836769 - protein, 5 aa, Staphylococcus epidermidis
DSTTV

SEQ ID NO: 1836770 - protein, 7 aa, Staphylococcus epidermidis
DTKEHGK

SEQ ID NO: 1836771 - protein, 8 aa, Staphylococcus epidermidis
DTKEHGKG

SEQ ID NO: 1836772 - protein, 10 aa, Staphylococcus epidermidis
DTKSGKEVKF

SEQ ID NO: 1836773 - protein, 6 aa, Staphylococcus epidermidis
DTPLDD

SEQ ID NO: 1836774 - protein, 5 aa, Staphylococcus epidermidis
DWEPG

SEQ ID NO: 1836775 - protein, 10 aa, Staphylococcus epidermidis
DWSKSDEDKL

SEQ ID NO: 1836776 - protein, 11 aa, Staphylococcus epidermidis
EAITKTQNIGY

SEQ ID NO: 1836777 - protein, 13 aa, Staphylococcus epidermidis
EDDDNKKDKQKGG

SEQ ID NO: 1836778 - protein, 19 aa, Staphylococcus epidermidis
EFKDDKYSNLGNPGRPNFD

SEQ ID NO: 1836779 - protein, 10 aa, Staphylococcus epidermidis
EKEFKEKGYQ

SEQ ID NO: 1836780 - protein, 37 aa, Staphylococcus epidermidis
EKRRKKNSKEQNSNHVDQQQYDYTDKEQQQNKNSNDD

SEQ ID NO: 1836781 - protein, 14 aa, Staphylococcus epidermidis
ELEGESNISDQSLQ

SEQ ID NO: 1836782 - protein, 15 aa, Staphylococcus epidermidis
ELEGESNISDQSLQQ

SEQ ID NO: 1836783 - protein, 12 aa, Staphylococcus epidermidis
ENQRDKKGTQII

SEQ ID NO: 1836784 - protein, 5 aa, Staphylococcus epidermidis
EQAEK

SEQ ID NO: 1836785 - protein, 4 aa, Staphylococcus epidermidis
EQLE

SEQ ID NO: 1836786 - protein, 5 aa, Staphylococcus epidermidis
EQLES

SEQ ID NO: 1836787 - protein, 6 aa, Staphylococcus epidermidis
EQNDHT

SEQ ID NO: 1836788 - protein, 8 aa, Staphylococcus epidermidis
EQQEQQEH

SEQ ID NO: 1836789 - protein, 15 aa, Staphylococcus epidermidis
ESNYTNSLKNTTSIS

SEQ ID NO: 1836790 - protein, 6 aa, Staphylococcus epidermidis
ETAPTD

SEQ ID NO: 1836791 - protein, 4 aa, Staphylococcus epidermidis
EYLE

SEQ ID NO: 1836792 - protein, 9 aa, Staphylococcus epidermidis
FEGDRSQAL

SEQ ID NO: 1836793 - protein, 10 aa, Staphylococcus epidermidis
FEGDRSQALQ

SEQ ID NO: 1836794 - protein, 22 aa, Staphylococcus epidermidis
FKHTSKDEIEKDSAKNLPPKER

SEQ ID NO: 1836795 - protein, 22 aa, Staphylococcus epidermidis
GGSASQNTSSNTSSSSASSHTV

SEQ ID NO: 1836796 - protein, 11 aa, Staphylococcus epidermidis
GIKAFSSNGRF

SEQ ID NO: 1836797 - protein, 8 aa, Staphylococcus epidermidis
GKLSKENK

SEQ ID NO: 1836798 - protein, 8 aa, Staphylococcus epidermidis
GKLSKKNK

SEQ ID NO: 1836799 - protein, 8 aa, Staphylococcus epidermidis
GKSVSEKE

SEQ ID NO: 1836800 - protein, 12 aa, Staphylococcus epidermidis
GLTQEEAVKEQL

SEQ ID NO: 1836801 - protein, 17 aa, Staphylococcus epidermidis
GNDKSGNSYDSKKTVTI

SEQ ID NO: 1836802 - protein, 14 aa, Staphylococcus epidermidis
GNNVEAATGNSMKT

SEQ ID NO: 1836803 - protein, 15 aa, Staphylococcus epidermidis
GNTTSDNFLSKNQKG

SEQ ID NO: 1836804 - protein, 8 aa, Staphylococcus epidermidis
GPRSDLRN

SEQ ID NO: 1836805 - protein, 20 aa, Staphylococcus epidermidis
GQDANHSSNNKDTEKSDKKY

SEQ ID NO: 1836806 - protein, 51 aa, Staphylococcus epidermidis
GQENVKKTESNPKEEQNKTDNMQTNGSVTNSNSNQKQKTAQKQISAQEAEQ

SEQ ID NO: 1836807 - protein, 15 aa, Staphylococcus epidermidis
GRDYTLDKKGNPHVK

SEQ ID NO: 1836808 - protein, 5 aa, Staphylococcus epidermidis
GRIHP

SEQ ID NO: 1836809 - protein, 6 aa, Staphylococcus epidermidis
GTLAEK

SEQ ID NO: 1836810 - protein, 17 aa, Staphylococcus epidermidis
GVLENQGAAFSQAARKY

SEQ ID NO: 1836811 - protein, 18 aa, Staphylococcus epidermidis
GVLENQGAAFSQAARKYG

SEQ ID NO: 1836812 - protein, 6 aa, Staphylococcus epidermidis
GVTQQT

SEQ ID NO: 1836813 - protein, 7 aa, Staphylococcus epidermidis
GVTQQTA

SEQ ID NO: 1836814 - protein, 12 aa, Staphylococcus epidermidis
GWGSTGSVNDQI

SEQ ID NO: 1836815 - protein, 13 aa, Staphylococcus epidermidis
GWGSTGSVNDQIN

SEQ ID NO: 1836816 - protein, 6 aa, Staphylococcus epidermidis
HAKDFG

SEQ ID NO: 1836817 - protein, 33 aa, Staphylococcus epidermidis
HAQAAEMTQSSSDFNEQSQQTEQVEHKEDTTHL

SEQ ID NO: 1836818 - protein, 8 aa, Staphylococcus epidermidis
HESQTEYP

SEQ ID NO: 1836819 - protein, 7 aa, Staphylococcus epidermidis
HSDFSTG

SEQ ID NO: 1836820 - protein, 61 aa, Staphylococcus epidermidis
HYKDSKANTDVASKETQTSNKNTHENTISQDEMQNQVDSQTNEVSNETSTKTLSEKAKRLR

SEQ ID NO: 1836821 - protein, 18 aa, Staphylococcus epidermidis
IAKNVSKNYAEPASGPFN

SEQ ID NO: 1836822 - protein, 4 aa, Staphylococcus epidermidis
IAPT

SEQ ID NO: 1836823 - protein, 12 aa, Staphylococcus epidermidis
IDGNPSIYKPTW

SEQ ID NO: 1836824 - protein, 40 aa, Staphylococcus epidermidis
IDGNPSIYKPTWKSEALSYKDATSHLSRSYATDPNYSKKL

SEQ ID NO: 1836825 - protein, 13 aa, Staphylococcus epidermidis
IEEISESFKQHMN

SEQ ID NO: 1836826 - protein, 11 aa, Staphylococcus epidermidis
IGGDDNKNVRV

SEQ ID NO: 1836827 - protein, 16 aa, Staphylococcus epidermidis
IKDAPKDGFSKGDTVK

SEQ ID NO: 1836828 - protein, 19 aa, Staphylococcus epidermidis
IKDKSIDLKSDQNGGYTFE

SEQ ID NO: 1836829 - protein, 10 aa, Staphylococcus epidermidis
IKKDKGKKKL

SEQ ID NO: 1836830 - protein, 7 aa, Staphylococcus epidermidis
IKTNAGD

SEQ ID NO: 1836831 - protein, 6 aa, Staphylococcus epidermidis
ILSEEN

SEQ ID NO: 1836832 - protein, 6 aa, Staphylococcus epidermidis
INKKGY

SEQ ID NO: 1836833 - protein, 9 aa, Staphylococcus epidermidis
IQNDNGDIQ

SEQ ID NO: 1836834 - protein, 14 aa, Staphylococcus epidermidis
IQSKDGKISKDNMN

SEQ ID NO: 1836835 - protein, 24 aa, Staphylococcus epidermidis
ISKNEKDELRKSSIKQFNPKTGEV

SEQ ID NO: 1836836 - protein, 65 aa, Staphylococcus epidermidis
ITDYEQPQKTSHSSNDEKDQVDQADQAKQPSQHQEQSQSSAKQDQESSNDEKEKTTNHQADSDVS

SEQ ID NO: 1836837 - protein, 8 aa, Staphylococcus epidermidis
KASSDAVK

SEQ ID NO: 1836838 - protein, 9 aa, Staphylococcus epidermidis
KASSDAVKP

SEQ ID NO: 1836839 - protein, 10 aa, Staphylococcus epidermidis
KDDEVLKQST

SEQ ID NO: 1836840 - protein, 20 aa, Staphylococcus epidermidis
KDHDENHEHHSHHEESNQDP

SEQ ID NO: 1836841 - protein, 23 aa, Staphylococcus epidermidis
KDNKSDKPNDKLISETAKNVINK

SEQ ID NO: 1836842 - protein, 18 aa, Staphylococcus epidermidis
KDQQAGASLYDTGSVDDT

SEQ ID NO: 1836843 - protein, 8 aa, Staphylococcus epidermidis
KEKEEQFG

SEQ ID NO: 1836844 - protein, 25 aa, Staphylococcus epidermidis
KENEANDLNKKLEQQVTETKKSINH

SEQ ID NO: 1836845 - protein, 5 aa, Staphylococcus epidermidis
KENND

SEQ ID NO: 1836846 - protein, 6 aa, Staphylococcus epidermidis
KFNPDL

SEQ ID NO: 1836847 - protein, 5 aa, Staphylococcus epidermidis
KGHYY

SEQ ID NO: 1836848 - protein, 7 aa, Staphylococcus epidermidis
KGKNTNV

SEQ ID NO: 1836849 - protein, 26 aa, Staphylococcus epidermidis
KGQASYQFSSNSPKDKNVKLYRIDLN

SEQ ID NO: 1836850 - protein, 11 aa, Staphylococcus epidermidis
KGYQKLNGDQA

SEQ ID NO: 1836851 - protein, 18 aa, Staphylococcus epidermidis
KHPEYAKNKYKNAKVPTL

SEQ ID NO: 1836852 - protein, 7 aa, Staphylococcus epidermidis
KKAAPNA

SEQ ID NO: 1836853 - protein, 11 aa, Staphylococcus epidermidis
KKLGDKVTNPV

SEQ ID NO: 1836854 - protein, 14 aa, Staphylococcus epidermidis
KKNWREAQKELGKN

SEQ ID NO: 1836855 - protein, 20 aa, Staphylococcus epidermidis
KKSNAYKKHANSTSIDSIKD

SEQ ID NO: 1836856 - protein, 12 aa, Staphylococcus epidermidis
KNDGNKINNTWS

SEQ ID NO: 1836857 - protein, 8 aa, Staphylococcus epidermidis
KNDIEERH

SEQ ID NO: 1836858 - protein, 6 aa, Staphylococcus epidermidis
KNGKVK

SEQ ID NO: 1836859 - protein, 6 aa, Staphylococcus epidermidis
KNQSEP

SEQ ID NO: 1836860 - protein, 4 aa, Staphylococcus epidermidis
KPIE

SEQ ID NO: 1836861 - protein, 11 aa, Staphylococcus epidermidis
KPTNGNEKVNN

SEQ ID NO: 1836862 - protein, 6 aa, Staphylococcus epidermidis
KQQLGH

SEQ ID NO: 1836863 - protein, 24 aa, Staphylococcus epidermidis
KQRQKEFEKEEKALDNSEKEFKQA

SEQ ID NO: 1836864 - protein, 6 aa, Staphylococcus epidermidis
KRAEKY

SEQ ID NO: 1836865 - protein, 12 aa, Staphylococcus epidermidis
KRSLEEGMKKSD

SEQ ID NO: 1836866 - protein, 28 aa, Staphylococcus epidermidis
KSEALSYKDATSHLSRSYATDPNYSKKL

SEQ ID NO: 1836867 - protein, 13 aa, Staphylococcus epidermidis
KSFPKKSNGGKTL

SEQ ID NO: 1836868 - protein, 7 aa, Staphylococcus epidermidis
KSHTSTI

SEQ ID NO: 1836869 - protein, 8 aa, Staphylococcus epidermidis
KSKDNGKI

SEQ ID NO: 1836870 - protein, 7 aa, Staphylococcus epidermidis
KSLKDNK

SEQ ID NO: 1836871 - protein, 6 aa, Staphylococcus epidermidis
KTVPEF

SEQ ID NO: 1836872 - protein, 7 aa, Staphylococcus epidermidis
KYINTGN

SEQ ID NO: 1836873 - protein, 13 aa, Staphylococcus epidermidis
KYKSLKDLPKGAT

SEQ ID NO: 1836874 - protein, 4 aa, Staphylococcus epidermidis
LAGN

SEQ ID NO: 1836875 - protein, 7 aa, Staphylococcus epidermidis
LDESTKF

SEQ ID NO: 1836876 - protein, 5 aa, Staphylococcus epidermidis
LITDD

SEQ ID NO: 1836877 - protein, 11 aa, Staphylococcus epidermidis
LKDKEDKYHYT

SEQ ID NO: 1836878 - protein, 13 aa, Staphylococcus epidermidis
LNPNESEPESYDK

SEQ ID NO: 1836879 - protein, 5 aa, Staphylococcus epidermidis
LSSAF

SEQ ID NO: 1836880 - protein, 5 aa, Staphylococcus epidermidis
LTGEA

SEQ ID NO: 1836881 - protein, 11 aa, Staphylococcus epidermidis
LTQEEAVKEQL

SEQ ID NO: 1836882 - protein, 10 aa, Staphylococcus epidermidis
MVKAKDLEKV

SEQ ID NO: 1836883 - protein, 22 aa, Staphylococcus epidermidis
NAANNEVSKPQSNVDSKTKQNI

SEQ ID NO: 1836884 - protein, 15 aa, Staphylococcus epidermidis
NADEVNAGKKSVKDL

SEQ ID NO: 1836885 - protein, 17 aa, Staphylococcus epidermidis
NAHGQKVTITTKEPYPE

SEQ ID NO: 1836886 - protein, 6 aa, Staphylococcus epidermidis
NAKREL

SEQ ID NO: 1836887 - protein, 49 aa, Staphylococcus epidermidis; identical to SEQ ID NO: 1784794

SEQ ID NO: 1836888 - protein, 4 aa, Staphylococcus epidermidis
NDHY

SEQ ID NO: 1836889 - protein, 30 aa, Staphylococcus epidermidis; identical to SEQ ID NO: 1733818

SEQ ID NO: 1836890 - protein, 6 aa, Staphylococcus epidermidis
NEANNE

SEQ ID NO: 1836891 - protein, 126 aa, Staphylococcus epidermidis
NEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYN

SEQ ID NO: 1836892 - protein, 8 aa, Staphylococcus epidermidis
NKNGDTLI

SEQ ID NO: 1836893 - protein, 5 aa, Staphylococcus epidermidis
NKQSW

SEQ ID NO: 1836894 - protein, 8 aa, Staphylococcus epidermidis
NKSGDTLI

SEQ ID NO: 1836895 - protein, 8 aa, Staphylococcus epidermidis
NNKSLEKV

SEQ ID NO: 1836896 - protein, 31 aa, Staphylococcus epidermidis
NNSVSNDDQLSSEEQQKYNENTNENKQNSHV

SEQ ID NO: 1836897 - protein, 7 aa, Staphylococcus epidermidis
NPKTASE

SEQ ID NO: 1836898 - protein, 16 aa, Staphylococcus epidermidis
NSNSSHAKELNDLEKK

SEQ ID NO: 1836899 - protein, 20 aa, Staphylococcus epidermidis
NSTSSHAKELNNLEKKYNAN

SEQ ID NO: 1836900 - protein, 17 aa, Staphylococcus epidermidis
NYEASYSGWSPDYPDPT

SEQ ID NO: 1836901 - protein, 4 aa, Staphylococcus epidermidis
NYKR

SEQ ID NO: 1836902 - protein, 6 aa, Staphylococcus epidermidis
PEARDE

SEQ ID NO: 1836903 - protein, 5 aa, Staphylococcus epidermidis
PESYL

SEQ ID NO: 1836904 - protein, 22 aa, Staphylococcus epidermidis
PEYLGGQNNKNFINKEDNNTGV

SEQ ID NO: 1836905 - protein, 15 aa, Staphylococcus epidermidis
PGMKGAEATVKGAYK

SEQ ID NO: 1836906 - protein, 13 aa, Staphylococcus epidermidis
PNERNVTTRQKEY

SEQ ID NO: 1836907 - protein, 17 aa, Staphylococcus epidermidis
PTKYSGDVNKKQQDKIT

SEQ ID NO: 1836908 - protein, 10 aa, Staphylococcus epidermidis
QDTKHGQSRF

SEQ ID NO: 1836909 - protein, 105 aa, Staphylococcus epidermidis
QKDNDHDEASKNKQEQKKKDNKKEKSKDKTINNESDNSNEVYTENNQNSNTEGFKKNSASHKETQAEANQRMQEESRSEHNGMSNAEYATKINEEANSGKEYQEY

SEQ ID NO: 1836910 - protein, 6 aa, Staphylococcus epidermidis
QLKDSG

SEQ ID NO: 1836911 - protein, 19 aa, Staphylococcus epidermidis
QLTDREKQAKELVDETKHN

SEQ ID NO: 1836912 - protein, 11 aa, Staphylococcus epidermidis
QLYPGAPKGQF

SEQ ID NO: 1836913 - protein, 24 aa, Staphylococcus epidermidis
QQKDSQNDNKSESVVEQNKENEAF

SEQ ID NO: 1836914 - protein, 14 aa, Staphylococcus epidermidis
QRLKELGDKVTNPV

SEQ ID NO: 1836915 - protein, 10 aa, Staphylococcus epidermidis
QTYNVKAGST

SEQ ID NO: 1836916 - protein, 6 aa, Staphylococcus epidermidis
QYKYPT

SEQ ID NO: 1836917 - protein, 49 aa, Staphylococcus epidermidis
QYQSDKQSENSNTQTEQAANNKNSNSNNGHSSNNNESRGRVEDLTQSQK

SEQ ID NO: 1836918 - protein, 5 aa, Staphylococcus epidermidis
RAEKY

SEQ ID NO: 1836919 - protein, 5 aa, Staphylococcus epidermidis
RQKHA

SEQ ID NO: 1836920 - protein, 4 aa, Staphylococcus epidermidis
RQTN

SEQ ID NO: 1836921 - protein, 11 aa, Staphylococcus epidermidis
RQVRQKEGKDL

SEQ ID NO: 1836922 - protein, 8 aa, Staphylococcus epidermidis
RSQGRNTQ

SEQ ID NO: 1836923 - protein, 9 aa, Staphylococcus epidermidis
RSQGRNTQY

SEQ ID NO: 1836924 - protein, 4 aa, Staphylococcus epidermidis
RTAT

SEQ ID NO: 1836925 - protein, 24 aa, Staphylococcus epidermidis
SDNDASPKMNKEVAQELKKKTGIT

SEQ ID NO: 1836926 - protein, 12 aa, Staphylococcus epidermidis
SDVSKKKEQEEL

SEQ ID NO: 1836927 - protein, 23 aa, Staphylococcus epidermidis
SGPFSGSESQHQSEKSNLNGKDK

SEQ ID NO: 1836928 - protein, 5 aa, Staphylococcus epidermidis
SGRSL

SEQ ID NO: 1836929 - protein, 4 aa, Staphylococcus epidermidis
SIGH

SEQ ID NO: 1836930 - protein, 33 aa, Staphylococcus epidermidis
SISDDKKKKIKTDYKTKGSISWKKAKEDQQIAK

SEQ ID NO: 1836931 - protein, 10 aa, Staphylococcus epidermidis
SITKHSKRDK

SEQ ID NO: 1836932 - protein, 22 aa, Staphylococcus epidermidis
SKDKTQDEAKRKADAKGKPDTW

SEQ ID NO: 1836933 - protein, 10 aa, Staphylococcus epidermidis
SKRHKRKNTL

SEQ ID NO: 1836934 - protein, 12 aa, Staphylococcus epidermidis
SLPKKVEGAPND

SEQ ID NO: 1836935 - protein, 107 aa, Staphylococcus epidermidis
SNGGNDESSHKDDSSKTEQKDKSSSQHDSKKDSKRNDTNNKQDNQENNTNKEQTNNQNPNDGEQRTSERPTTNSNGNSSDNQNKQQQSVQDNQNKYVAPYQSENATR

SEQ ID NO: 1836936 - protein, 6 aa, Staphylococcus epidermidis
SNHKAN

SEQ ID NO: 1836937 - protein, 6 aa, Staphylococcus epidermidis
SNSEKL

SEQ ID NO: 1836938 - protein, 20 aa, Staphylococcus epidermidis
SQDANHSSNNKDTEKSDKKY

SEQ ID NO: 1836939 - protein, 11 aa, Staphylococcus epidermidis
SRNVEKNMSRS

SEQ ID NO: 1836940 - protein, 176 aa, Staphylococcus epidermidis
SSKKGNERLSDKTTQQEKKKDDKDKKEKKDKKSVEEKKNNTQQTQQVPQTQQTQQTQQTVQTPQRPTTQTPVRQNPQTGEKRAKEPKTDERKKTRQDSSNSKESPNEKDQSSTQQKPQQNKSNQSSENRQSTQNKSNQTQSTRPQNNGNSGNQNASSGQNTQKQNNNNQNSQSSKK

SEQ ID NO: 1836941 - protein, 7 aa, Staphylococcus epidermidis
SSTKLRD

SEQ ID NO: 1836942 - protein, 7 aa, Staphylococcus epidermidis
SVSGGYA

SEQ ID NO: 1836943 - protein, 7 aa, Staphylococcus epidermidis
SVSGGYT

SEQ ID NO: 1836944 - protein, 9 aa, Staphylococcus epidermidis
TAKAPVKVN

SEQ ID NO: 1836945 - protein, 17 aa, Staphylococcus epidermidis
TDDSNGRPKDDEKRYPV

SEQ ID NO: 1836946 - protein, 6 aa, Staphylococcus epidermidis
TEQAEK

SEQ ID NO: 1836947 - protein, 22 aa, Staphylococcus epidermidis
TGNGSNPINSKTVQQDIKGKKI

SEQ ID NO: 1836948 - protein, 10 aa, Staphylococcus epidermidis
TGQSDEKFLN

SEQ ID NO: 1836949 - protein, 8 aa, Staphylococcus epidermidis
THYDDPTL

SEQ ID NO: 1836950 - protein, 12 aa, Staphylococcus epidermidis
TIEPKGKSMETR

SEQ ID NO: 1836951 - protein, 7 aa, Staphylococcus epidermidis
TNTTGQS

SEQ ID NO: 1836952 - protein, 40 aa, Staphylococcus epidermidis
TPEQKANGAGGGGAGWNYAEEDESFSEWKDRRDREKTEAG

SEQ ID NO: 1836953 - protein, 10 aa, Staphylococcus epidermidis
TQDTPASKIA

SEQ ID NO: 1836954 - protein, 16 aa, Staphylococcus epidermidis
TSKTGLKKEDADPSIR

SEQ ID NO: 1836955 - protein, 15 aa, Staphylococcus epidermidis
TSKTGLKKEVADPSI

SEQ ID NO: 1836956 - protein, 9 aa, Staphylococcus epidermidis
VDKYRGESA

SEQ ID NO: 1836957 - protein, 12 aa, Staphylococcus epidermidis
VDSRDKKDEIAQ

SEQ ID NO: 1836958 - protein, 14 aa, Staphylococcus epidermidis
VEPVKSDTRDKDSI

SEQ ID NO: 1836959 - protein, 15 aa, Staphylococcus epidermidis
VGNNVEAATGNSMKT

SEQ ID NO: 1836960 - protein, 6 aa, Staphylococcus epidermidis
VGPETT

SEQ ID NO: 1836961 - protein, 12 aa, Staphylococcus epidermidis
VIGGDDNKNVRV

SEQ ID NO: 1836962 - protein, 34 aa, Staphylococcus epidermidis
VKNTRIETVDGDEVSRPGPRIDEGLKDLRDDIYK

SEQ ID NO: 1836963 - protein, 7 aa, Staphylococcus epidermidis
VNDEEAQ

SEQ ID NO: 1836964 - protein, 4 aa, Staphylococcus epidermidis
WEPG

SEQ ID NO: 1836965 - protein, 21 aa, Staphylococcus epidermidis
WETEDQAVNDLTTAGAEKLNQ

SEQ ID NO: 1836966 - protein, 22 aa, Staphylococcus epidermidis
WETEDQAVNDLTTAGAEKLNQM

SEQ ID NO: 1836967 - protein, 6 aa, Staphylococcus epidermidis
WKGSHN

SEQ ID NO: 1836968 - protein, 11 aa, Staphylococcus epidermidis
WKSKDSGLHDL

SEQ ID NO: 1836969 - protein, 12 aa, Staphylococcus epidermidis
YANKEADNIKKE

SEQ ID NO: 1836970 - protein, 5 aa, Staphylococcus epidermidis
YDEKY

SEQ ID NO: 1836971 - protein, 15 aa, Staphylococcus epidermidis
YGEPKSTSTSAWGKE

SEQ ID NO: 1836972 - protein, 4 aa, Staphylococcus epidermidis
YGGP

SEQ ID NO: 1836973 - protein, 5 aa, Staphylococcus epidermidis
YGGPL

SEQ ID NO: 1836974 - protein, 6 aa, Staphylococcus epidermidis
YGKNAN

SEQ ID NO: 1836975 - protein, 10 aa, Staphylococcus epidermidis
YGKSSNYKNL

SEQ ID NO: 1836976 - protein, 5 aa, Staphylococcus epidermidis
YKYPT

SEQ ID NO: 1836977 - protein, 5 aa, Staphylococcus epidermidis
YNVKP

SEQ ID NO: 1836978 - protein, 6 aa, Staphylococcus epidermidis
YNVKPG

SEQ ID NO: 1836979 - protein, 5 aa, Staphylococcus epidermidis
YPIPG

SEQ ID NO: 1836980 - protein, 20 aa, Staphylococcus epidermidis
YRRRNNSTNMDKKMIKISFF

SEQ ID NO: 1836981 - protein, 8 aa, Staphylococcus epidermidis
YSTDGRIA

SEQ ID NO: 1836982 - protein, 4 aa, Staphylococcus epidermidis
AAKY

SEQ ID NO: 1836983 - protein, 17 aa, Staphylococcus epidermidis
ACGKERTKTYEGEVNGK

SEQ ID NO: 1836984 - protein, 35 aa, Staphylococcus epidermidis
ACGNNSSSNSSKESSKDGVEIKHEEGTTKVPKHPK

SEQ ID NO: 1836985 - protein, 10 aa, Staphylococcus epidermidis
AEHKQGPPFP

SEQ ID NO: 1836986 - protein, 9 aa, Staphylococcus epidermidis
AEHTTESTV

SEQ ID NO: 1836987 - protein, 5 aa, Staphylococcus epidermidis
AERLA

SEQ ID NO: 1836988 - protein, 6 aa, Staphylococcus epidermidis
AERLAN

SEQ ID NO: 1836989 - protein, 12 aa, Staphylococcus epidermidis
AESKKDNNGYKN

SEQ ID NO: 1836990 - protein, 11 aa, Staphylococcus epidermidis
AHDGGQNGFGY

SEQ ID NO: 1836991 - protein, 7 aa, Staphylococcus epidermidis
AHPSNSY

SEQ ID NO: 1836992 - protein, 19 aa, Staphylococcus epidermidis
AKEASEKARRGELQGLGGS

SEQ ID NO: 1836993 - protein, 9 aa, Staphylococcus epidermidis
AKGQGNSFL

SEQ ID NO: 1836994 - protein, 10 aa, Staphylococcus epidermidis
ALGQSPKEQL

SEQ ID NO: 1836995 - protein, 13 aa, Staphylococcus epidermidis
AQEEAKKRKLNIW

SEQ ID NO: 1836996 - protein, 8 aa, Staphylococcus epidermidis
ASKYNPCS

SEQ ID NO: 1836997 - protein, 43 aa, Staphylococcus epidermidis
ASMTDAHGGSENVDNSHGLKASKTYDNNVSTRSIKQGKKSGGY

SEQ ID NO: 1836998 - protein, 19 aa, Staphylococcus epidermidis
ASTHAQAATTHTVKSGESV

SEQ ID NO: 1836999 - protein, 14 aa, Staphylococcus epidermidis
AYYSQSDKEAKQII

SEQ ID NO: 1837000 - protein, 14 aa, Staphylococcus epidermidis
AYYSQSDKETKQII

SEQ ID NO: 1837001 - protein, 11 aa, Staphylococcus epidermidis
CGNGKETEIKQ

SEQ ID NO: 1837002 - protein, 12 aa, Staphylococcus epidermidis
DADYSKRESQRI

SEQ ID NO: 1837003 - protein, 18 aa, Staphylococcus epidermidis
DAKSIRKDVTETNHSSIE

SEQ ID NO: 1837004 - protein, 10 aa, Staphylococcus epidermidis
DDHTPATDKG

SEQ ID NO: 1837005 - protein, 4 aa, Staphylococcus epidermidis
DDTD

SEQ ID NO: 1837006 - protein, 11 aa, Staphylococcus epidermidis
DDWSKSDEDKL

SEQ ID NO: 1837007 - protein, 12 aa, Staphylococcus epidermidis
DDYKEQKKLSAY

SEQ ID NO: 1837008 - protein, 24 aa, Staphylococcus epidermidis
DEGQAAEDAGYVASPKKTYKSQLD

SEQ ID NO: 1837009 - protein, 76 aa, Staphylococcus epidermidis
DELNDEPEKRQSKPFETSLPPLNEDWNENEKKKTSHHKEKQNTSQSKRQTTSTHEHQNIPQPDKTTSRDDNYEKLK

SEQ ID NO: 1837010 - protein, 4 aa, Staphylococcus epidermidis
DENT

SEQ ID NO: 1837011 - protein, 13 aa, Staphylococcus epidermidis
DEPQVPEELTKLD

SEQ ID NO: 1837012 - protein, 5 aa, Staphylococcus epidermidis
DERQT

SEQ ID NO: 1837013 - protein, 6 aa, Staphylococcus epidermidis
DERQTV

SEQ ID NO: 1837014 - protein, 6 aa, Staphylococcus epidermidis
DESTKF

SEQ ID NO: 1837015 - protein, 13 aa, Staphylococcus epidermidis
DGEKPPKDMRGKK

SEQ ID NO: 1837016 - protein, 22 aa, Staphylococcus epidermidis
DGVSKDCKVADKSGQAITYASR

SEQ ID NO: 1837017 - protein, 8 aa, Staphylococcus epidermidis
DIPTNQAP

SEQ ID NO: 1837018 - protein, 9 aa, Staphylococcus epidermidis
DISPDGKTY

SEQ ID NO: 1837019 - protein, 7 aa, Staphylococcus epidermidis
DKDKTSA

SEQ ID NO: 1837020 - protein, 18 aa, Staphylococcus epidermidis
DKEGYRDEEFDKKDKGTW

SEQ ID NO: 1837021 - protein, 5 aa, Staphylococcus epidermidis
DKMGG

SEQ ID NO: 1837022 - protein, 10 aa, Staphylococcus epidermidis
DPDNIYGNNN

SEQ ID NO: 1837023 - protein, 20 aa, Staphylococcus epidermidis
DPYDKAANNAKALKDKIEND

SEQ ID NO: 1837024 - protein, 13 aa, Staphylococcus epidermidis
DQNGNKIKEQQMS

SEQ ID NO: 1837025 - protein, 18 aa, Staphylococcus epidermidis
DRNPKKGSILQSSKGKYG

SEQ ID NO: 1837026 - protein, 19 aa, Staphylococcus epidermidis
DSGAAQKADDPDKNSANTM

SEQ ID NO: 1837027 - protein, 7 aa, Staphylococcus epidermidis
DSGRGYR

SEQ ID NO: 1837028 - protein, 9 aa, Staphylococcus epidermidis
DSMKNAPKD

SEQ ID NO: 1837029 - protein, 12 aa, Staphylococcus epidermidis
DTDELIKKLKPF

SEQ ID NO: 1837030 - protein, 9 aa, Staphylococcus epidermidis
DTFAESKND

SEQ ID NO: 1837031 - protein, 8 aa, Staphylococcus epidermidis
EAGIDATK

SEQ ID NO: 1837032 - protein, 8 aa, Staphylococcus epidermidis
EDKKNTMD

SEQ ID NO: 1837033 - protein, 8 aa, Staphylococcus epidermidis
EDLPEDTS

SEQ ID NO: 1837034 - protein, 14 aa, Staphylococcus epidermidis
EEGSMRSNDNGDTM

SEQ ID NO: 1837035 - protein, 7 aa, Staphylococcus epidermidis
EGGNQIT

SEQ ID NO: 1837036 - protein, 6 aa, Staphylococcus epidermidis
EGKESV

SEQ ID NO: 1837037 - protein, 8 aa, Staphylococcus epidermidis
EGLPEDTS

SEQ ID NO: 1837038 - protein, 20 aa, Staphylococcus epidermidis
EGMSDDEAATIHESAQESNE

SEQ ID NO: 1837039 - protein, 36 aa, Staphylococcus epidermidis
EKDNDYKIENYDKKEKEQTKTSKSTPKIPSDKSKMA

SEQ ID NO: 1837040 - protein, 22 aa, Staphylococcus epidermidis
EKRRKKNSKEQNSNHVDQQQHD

SEQ ID NO: 1837041 - protein, 7 aa, Staphylococcus epidermidis
EKSYTDL

SEQ ID NO: 1837042 - protein, 18 aa, Staphylococcus epidermidis
EKVPASQYKGQDFQPLAE

SEQ ID NO: 1837043 - protein, 5 aa, Staphylococcus epidermidis
ELASP

SEQ ID NO: 1837044 - protein, 5 aa, Staphylococcus epidermidis
ENASI

SEQ ID NO: 1837045 - protein, 8 aa, Staphylococcus epidermidis
ENQVDGHS

SEQ ID NO: 1837046 - protein, 12 aa, Staphylococcus epidermidis
EQADKFTKEKGY

SEQ ID NO: 1837047 - protein, 4 aa, Staphylococcus epidermidis
EQIT

SEQ ID NO: 1837048 - protein, 7 aa, Staphylococcus epidermidis
EQLKDSG

SEQ ID NO: 1837049 - protein, 5 aa, Staphylococcus epidermidis
ERVSK

SEQ ID NO: 1837050 - protein, 7 aa, Staphylococcus epidermidis
ESDDDFK

SEQ ID NO: 1837051 - protein, 6 aa, Staphylococcus epidermidis
ETQGYN

SEQ ID NO: 1837052 - protein, 4 aa, Staphylococcus epidermidis
EVYT

SEQ ID NO: 1837053 - protein, 195 aa, Staphylococcus epidermidis
FADASTKTQQTHVTKTSPTQKTTSNFKRSVKDTSVKSRATSTKRATSTKRAISPKTSSTKKTTIAKKSTTVNKTRTTTRTQPTIRKSSTTSTRSKTIPTSVKRTTSHKATTVSPTSKAKISTKTQQSTKSHTTSVKKNTTQLSKTKSPSTSTKSKTVQSSTTKAQPTLSTQVSTTTKAKQFSTPTTSKTDSSKSL

SEQ ID NO: 1837054 - protein, 194 aa, Staphylococcus epidermidis
FADASTKTQQTHVTKTSPTQKTTSNFKRSVKDTSVKSRATSTKRATSTKRAISPKTSSTKKTTIAKKSTTVNKTRTTTRTQPTIRKSSTTSTRSKTIPTSVKRTTSHKATTVSPTSKAKISTKTQQSTKSHTTSVKKNTTQLSKTKSPSTSTKSKTVQSSTTKAQPTLSTQVSTTTKAKQLSTPTTSKTDSSKA

SEQ ID NO: 1837055 - protein, 8 aa, Staphylococcus epidermidis
FDGKLDNK

SEQ ID NO: 1837056 - protein, 15 aa, Staphylococcus epidermidis
FKNPESRKYEKEDPM

SEQ ID NO: 1837057 - protein, 28 aa, Staphylococcus epidermidis
FNPQNEKVAKKFGEQYGTTAEKAVYNGP

SEQ ID NO: 1837058 - protein, 7 aa, Staphylococcus epidermidis
FSSNYDR

SEQ ID NO: 1837059 - protein, 9 aa, Staphylococcus epidermidis
FTGDDPRKV

SEQ ID NO: 1837060 - protein, 7 aa, Staphylococcus epidermidis
GASGTEE

SEQ ID NO: 1837061 - protein, 8 aa, Staphylococcus epidermidis
GASGTEES

SEQ ID NO: 1837062 - protein, 10 aa, Staphylococcus epidermidis
GGDSAGAQLT

SEQ ID NO: 1837063 - protein, 6 aa, Staphylococcus epidermidis
GGGGIP

SEQ ID NO: 1837064 - protein, 9 aa, Staphylococcus epidermidis
GGPRSDLRN

SEQ ID NO: 1837065 - protein, 5 aa, Staphylococcus epidermidis
GGQTI

SEQ ID NO: 1837066 - protein, 10 aa, Staphylococcus epidermidis
GIDKDEAKQM

SEQ ID NO: 1837067 - protein, 10 aa, Staphylococcus epidermidis
GIGKDEAKQM

SEQ ID NO: 1837068 - protein, 13 aa, Staphylococcus epidermidis
GIYNGGGINEGPY

SEQ ID NO: 1837069 - protein, 13 aa, Staphylococcus epidermidis
GKDANKEIRPNDG

SEQ ID NO: 1837070 - protein, 9 aa, Staphylococcus epidermidis
GKENQRGLD

SEQ ID NO: 1837071 - protein, 33 aa, Staphylococcus epidermidis
GKIGSTWGNANNWANAAARSGYTVNNSPAKGAI

SEQ ID NO: 1837072 - protein, 34 aa, Staphylococcus epidermidis
GKIGSTWGNANNWANAAARSGYTVNNSPAKGAIL

SEQ ID NO: 1837073 - protein, 9 aa, Staphylococcus epidermidis
GKLSKKNKN

SEQ ID NO: 1837074 - protein, 15 aa, Staphylococcus epidermidis
GKPGDTVVDDHTDEE

SEQ ID NO: 1837075 - protein, 19 aa, Staphylococcus epidermidis
GKVDGGPSQVIKPGKEKTI

SEQ ID NO: 1837076 - protein, 6 aa, Staphylococcus epidermidis
GNESAF

SEQ ID NO: 1837077 - protein, 8 aa, Staphylococcus epidermidis
GNGPQVGS

SEQ ID NO: 1837078 - protein, 8 aa, Staphylococcus epidermidis
GNKFDPNR

SEQ ID NO: 1837079 - protein, 128 aa, Staphylococcus epidermidis
GQEEEKKEKDNKTETTKKDEKKETQKKTENKEDKTKEDTDNNDQQSNEQQDNQVNEQQQAQEQQANQQQEPSYEEQMRANAKVAKQNGYTGIPNGDMGGVPTSDKAYSNDQLDPETGLPKDDAVPQDT

SEQ ID NO: 1837080 - protein, 8 aa, Staphylococcus epidermidis
GRVDYGAA

SEQ ID NO: 1837081 - protein, 7 aa, Staphylococcus epidermidis
GSNARDL

SEQ ID NO: 1837082 - protein, 5 aa, Staphylococcus epidermidis
GTLAE

SEQ ID NO: 1837083 - protein, 32 aa, Staphylococcus epidermidis
HAQAAEMTQSSSDSNEQSQQTEQVEHKEDTTH

SEQ ID NO: 1837084 - protein, 5 aa, Staphylococcus epidermidis
HEYPP

SEQ ID NO: 1837085 - protein, 17 aa, Staphylococcus epidermidis
HGNPEEVEYQKQHGGEI

SEQ ID NO: 1837086 - protein, 7 aa, Staphylococcus epidermidis
HLSGKRY

SEQ ID NO: 1837087 - protein, 17 aa, Staphylococcus epidermidis
HPEYAKNKYKNAKVPTL

SEQ ID NO: 1837088 - protein, 13 aa, Staphylococcus epidermidis
HPSPNTAKQVYNG

SEQ ID NO: 1837089 - protein, 4 aa, Staphylococcus epidermidis
HSGS

SEQ ID NO: 1837090 - protein, 5 aa, Staphylococcus epidermidis
HTGRE

SEQ ID NO: 1837091 - protein, 138 aa, Staphylococcus epidermidis
HTNSNKNDKKIEHNRKNKQNDTSNQNRDTNQHQDQTQPTNNDYNNDNQSGTEQPAQQPNYHQYPNNNQQSGSNKNNSSENNKQKPNQNKTNQSDHQPAQSTPQQSSQHNNQSDSQQNGNSNNNSNNQNHGTNGNQNKN

SEQ ID NO: 1837092 - protein, 14 aa, Staphylococcus epidermidis
IDKEQQQNKNSNDD

SEQ ID NO: 1837093 - protein, 6 aa, Staphylococcus epidermidis
IENGTF

SEQ ID NO: 1837094 - protein, 5 aa, Staphylococcus epidermidis
IESKG

SEQ ID NO: 1837095 - protein, 12 aa, Staphylococcus epidermidis
IETSPEKVLNQS

SEQ ID NO: 1837096 - protein, 17 aa, Staphylococcus epidermidis
IHEEGSMRSNDNGDTMS

SEQ ID NO: 1837097 - protein, 5 aa, Staphylococcus epidermidis
IKAKP

SEQ ID NO: 1837098 - protein, 12 aa, Staphylococcus epidermidis
IRSATNKPTYKV

SEQ ID NO: 1837099 - protein, 10 aa, Staphylococcus epidermidis
ISDGQFAKGS

SEQ ID NO: 1837100 - protein, 28 aa, Staphylococcus epidermidis
IWNTEDQAVNDLTTQGAEKINQQTSLNP

SEQ ID NO: 1837101 - protein, 11 aa, Staphylococcus epidermidis
IYNGGGINEGP

SEQ ID NO: 1837102 - protein, 12 aa, Staphylococcus epidermidis
IYNGGGINEGPY

SEQ ID NO: 1837103 - protein, 6 aa, Staphylococcus epidermidis
IYPDGA

SEQ ID NO: 1837104 - protein, 8 aa, Staphylococcus epidermidis
KDDEVLKQ

SEQ ID NO: 1837105 - protein, 30 aa, Staphylococcus epidermidis
KDYKDGDISYNPNVPSYSAKYQLSNNDYNV

SEQ ID NO: 1837106 - protein, 46 aa, Staphylococcus epidermidis
KEGKFQPSAGGTTNEAHHPKYTAEDARNMSDDEAATIHESAQESNE

SEQ ID NO: 1837107 - protein, 102 aa, Staphylococcus epidermidis
KHNNSDSNESKKSESKTENKNKESKSKEKNQENGHTNSIENNKENEQVNSNENSNNKTNDNSQNKIITDSQKDKRNNENKQNTQSQQTAQNYTQKEHSNRFN

SEQ ID NO: 1837108 - protein, 8 aa, Staphylococcus epidermidis
KHYSHKGH

SEQ ID NO: 1837109 - protein, 23 aa, Staphylococcus epidermidis
KIKDDNGKVTEPTKKTIQNGSYA

SEQ ID NO: 1837110 - protein, 12 aa, Staphylococcus epidermidis
KINDPNISNNQI

SEQ ID NO: 1837111 - protein, 7 aa, Staphylococcus epidermidis
KKASKRL

SEQ ID NO: 1837112 - protein, 9 aa, Staphylococcus epidermidis
KKASKRLST

SEQ ID NO: 1837113 - protein, 8 aa, Staphylococcus epidermidis
KKDQLTGY

SEQ ID NO: 1837114 - protein, 6 aa, Staphylococcus epidermidis
KKGDKV

SEQ ID NO: 1837115 - protein, 9 aa, Staphylococcus epidermidis
KKHREEYEK

SEQ ID NO: 1837116 - protein, 13 aa, Staphylococcus epidermidis
KKMKDNSAGNNIN

SEQ ID NO: 1837117 - protein, 8 aa, Staphylococcus epidermidis
KKQEGGLS

SEQ ID NO: 1837118 - protein, 19 aa, Staphylococcus epidermidis
KLTDREKQAKELVDETKHN

SEQ ID NO: 1837119 - protein, 8 aa, Staphylococcus epidermidis
KMTSASSI

SEQ ID NO: 1837120 - protein, 9 aa, Staphylococcus epidermidis
KNDEQAFKG

SEQ ID NO: 1837121 - protein, 16 aa, Staphylococcus epidermidis
KNDGNKINNTWSDAKH

SEQ ID NO: 1837122 - protein, 5 aa, Staphylococcus epidermidis
KNGSN

SEQ ID NO: 1837123 - protein, 23 aa, Staphylococcus epidermidis
KNIKDIKKGAQVAIPNDVSNQAR

SEQ ID NO: 1837124 - protein, 65 aa, Staphylococcus epidermidis
KNQKESTDSQKESDSSSQNNDEEDQTNEQTDQNSLNGNEQYPNQQDNNQTNGENGMINNDNYPYA

SEQ ID NO: 1837125 - protein, 7 aa, Staphylococcus epidermidis
KNTKGSV

SEQ ID NO: 1837126 - protein, 33 aa, Staphylococcus epidermidis
KNTRIETVDGDEVSRPGPRIDEGLKDLKDEIYK

SEQ ID NO: 1837127 - protein, 8 aa, Staphylococcus epidermidis
KQQPNESY

SEQ ID NO: 1837128 - protein, 28 aa, Staphylococcus epidermidis
KQSDFIDSKGHDEDHEHHSHHEESNQDP

SEQ ID NO: 1837129 - protein, 4 aa, Staphylococcus epidermidis
KQTI

SEQ ID NO: 1837130 - protein, 14 aa, Staphylococcus epidermidis
KRSLEEGMKKSDLL

SEQ ID NO: 1837131 - protein, 6 aa, Staphylococcus epidermidis
KSAIAH

SEQ ID NO: 1837132 - protein, 4 aa, Staphylococcus epidermidis
KSMP

SEQ ID NO: 1837133 - protein, 7 aa, Staphylococcus epidermidis
KSPSNQV

SEQ ID NO: 1837134 - protein, 7 aa, Staphylococcus epidermidis
KSSFSGK

SEQ ID NO: 1837135 - protein, 6 aa, Staphylococcus epidermidis
KSTSKS

SEQ ID NO: 1837136 - protein, 11 aa, Staphylococcus epidermidis
KTKTGYESATL

SEQ ID NO: 1837137 - protein, 6 aa, Staphylococcus epidermidis
KTNAGD

SEQ ID NO: 1837138 - protein, 5 aa, Staphylococcus epidermidis
KYIDT

SEQ ID NO: 1837139 - protein, 8 aa, Staphylococcus epidermidis
KYREEYEK

SEQ ID NO: 1837140 - protein, 7 aa, Staphylococcus epidermidis
LAPSERK

SEQ ID NO: 1837141 - protein, 14 aa, Staphylococcus epidermidis
LGDALDGKIGTLIK

SEQ ID NO: 1837142 - protein, 17 aa, Staphylococcus epidermidis
LGTPHNGTPAADKIGTR

SEQ ID NO: 1837143 - protein, 10 aa, Staphylococcus epidermidis
LKAQEGKTEF

SEQ ID NO: 1837144 - protein, 13 aa, Staphylococcus epidermidis
LLSSRKKVQQFTE

SEQ ID NO: 1837145 - protein, 6 aa, Staphylococcus epidermidis
LTGEAV

SEQ ID NO: 1837146 - protein, 9 aa, Staphylococcus epidermidis
LTSETEDIK

SEQ ID NO: 1837147 - protein, 9 aa, Staphylococcus epidermidis
LTSKTEDIK

SEQ ID NO: 1837148 - protein, 10 aa, Staphylococcus epidermidis
LTSKTEDIKN

SEQ ID NO: 1837149 - protein, 11 aa, Staphylococcus epidermidis
MKDEKEQRIKK

SEQ ID NO: 1837150 - protein, 5 aa, Staphylococcus epidermidis
MKGEK

SEQ ID NO: 1837151 - protein, 15 aa, Staphylococcus epidermidis
MKSNNDIKASTQRGN

SEQ ID NO: 1837152 - protein, 8 aa, Staphylococcus epidermidis
MRKEPSIP

SEQ ID NO: 1837153 - protein, 4 aa, Staphylococcus epidermidis
MTVQ

SEQ ID NO: 1837154 - protein, 5 aa, Staphylococcus epidermidis
NAKRE

SEQ ID NO: 1837155 - protein, 17 aa, Staphylococcus epidermidis
NDANGPSYKAVKQQLGH

SEQ ID NO: 1837156 - protein, 5 aa, Staphylococcus epidermidis
NDDGN

SEQ ID NO: 1837157 - protein, 7 aa, Staphylococcus epidermidis
NDEQAFK

SEQ ID NO: 1837158 - protein, 8 aa, Staphylococcus epidermidis
NDYTTPNK

SEQ ID NO: 1837159 - protein, 7 aa, Staphylococcus epidermidis
NEDGSIQ

SEQ ID NO: 1837160 - protein, 5 aa, Staphylococcus epidermidis
NGKEL

SEQ ID NO: 1837161 - protein, 9 aa, Staphylococcus epidermidis
NGNQEEIEY

SEQ ID NO: 1837162 - protein, 10 aa, Staphylococcus epidermidis
NIQNDNGDIQ

SEQ ID NO: 1837163 - protein, 9 aa, Staphylococcus epidermidis
NITNTYDGT

SEQ ID NO: 1837164 - protein, 11 aa, Staphylococcus epidermidis
NKEDKAEPAIA

SEQ ID NO: 1837165 - protein, 16 aa, Staphylococcus epidermidis
NKEKSSNKGNTPKVSK

SEQ ID NO: 1837166 - protein, 6 aa, Staphylococcus epidermidis
NKLHQT

SEQ ID NO: 1837167 - protein, 9 aa, Staphylococcus epidermidis
NKNDIEERH

SEQ ID NO: 1837168 - protein, 11 aa, Staphylococcus epidermidis
NKQSLYSDQGQ

SEQ ID NO: 1837169 - protein, 11 aa, Staphylococcus epidermidis
NMKAPRIEEDY

SEQ ID NO: 1837170 - protein, 11 aa, Staphylococcus epidermidis
NNANGPSYKAV

SEQ ID NO: 1837171 - protein, 9 aa, Staphylococcus epidermidis
NNKSLEKVE

SEQ ID NO: 1837172 - protein, 5 aa, Staphylococcus epidermidis
NQDSA

SEQ ID NO: 1837173 - protein, 179 aa, Staphylococcus epidermidis
NQEGDTASQSKTNQENQSDGNVQKKSNQIQQDSTQTSPLNDQKQTSMEQQSKDNHVTPNSRQDTYPKGQNQDDKGKQQFKDNQHSQTGHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHI

SEQ ID NO: 1837174 - protein, 179 aa, Staphylococcus epidermidis
NQEGETASQSKTSQENQSDGNVQKKSNQIQQDSTQTSPLNDQKQTSMEQQSKDNHVTPNSRQDTYPKGQNQDDKGKQQFKDNQHSQTEHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHI

SEQ ID NO: 1837175 - protein, 46 aa, Staphylococcus epidermidis
NSGDKTDTKDKKEETKQTSKANKENKEQHHKQENDNKASTQLSEKE

SEQ ID NO: 1837176 - protein, 21 aa, Staphylococcus epidermidis
NSHEAFAKSKKKKHKGNGNKH

SEQ ID NO: 1837177 - protein, 5 aa, Staphylococcus epidermidis
NSKDH

SEQ ID NO: 1837178 - protein, 16 aa, Staphylococcus epidermidis
NSSSHNIKPSQNKSYP

SEQ ID NO: 1837179 - protein, 10 aa, Staphylococcus epidermidis
NVVGSGDGAE

SEQ ID NO: 1837180 - protein, 9 aa, Staphylococcus epidermidis
NVVGSGDGV

SEQ ID NO: 1837181 - protein, 9 aa, Staphylococcus epidermidis
NYDANTGQA

SEQ ID NO: 1837182 - protein, 15 aa, Staphylococcus epidermidis
NYSKTKDEDGTQGDT

SEQ ID NO: 1837183 - protein, 7 aa, Staphylococcus epidermidis
PFTTPEG

SEQ ID NO: 1837184 - protein, 9 aa, Staphylococcus epidermidis
PKLTAKEEK

SEQ ID NO: 1837185 - protein, 6 aa, Staphylococcus epidermidis
PNDEMK

SEQ ID NO: 1837186 - protein, 5 aa, Staphylococcus epidermidis
PSKGQ

SEQ ID NO: 1837187 - protein, 6 aa, Staphylococcus epidermidis
PSPQPI

SEQ ID NO: 1837188 - protein, 8 aa, Staphylococcus epidermidis
QAEEPKRE

SEQ ID NO: 1837189 - protein, 12 aa, Staphylococcus epidermidis
QAEIQNEHIAPD

SEQ ID NO: 1837190 - protein, 5 aa, Staphylococcus epidermidis
QDPSI

SEQ ID NO: 1837191 - protein, 50 aa, Staphylococcus epidermidis
QENVKKTESNPKEEQNKTDNMQTNGSVTNSNSNQKQKTAQKQISAQEAEQ

SEQ ID NO: 1837192 - protein, 11 aa, Staphylococcus epidermidis
QKGNETEKKQM

SEQ ID NO: 1837193 - protein, 11 aa, Staphylococcus epidermidis
QLKSKKDTYIN

SEQ ID NO: 1837194 - protein, 5 aa, Staphylococcus epidermidis
QQIGG

SEQ ID NO: 1837195 - protein, 8 aa, Staphylococcus epidermidis
QRTEGNNT

SEQ ID NO: 1837196 - protein, 7 aa, Staphylococcus epidermidis
QSIYPAG

SEQ ID NO: 1837197 - protein, 4 aa, Staphylococcus epidermidis
QYKN

SEQ ID NO: 1837198 - protein, 7 aa, Staphylococcus epidermidis
QYPYQTP

SEQ ID NO: 1837199 - protein, 26 aa, Staphylococcus epidermidis
RDNQSVKNHTIDASQPTGAQSELQRE

SEQ ID NO: 1837200 - protein, 66 aa, Staphylococcus epidermidis
RKNQKESTDSQKESDSSSQNNDEEDQTNEQTDQNSLNGNEQYPNQQDNNQTNGENGMINNDNYPYA

SEQ ID NO: 1837201 - protein, 13 aa, Staphylococcus epidermidis
RLPKEGKDISEMD

SEQ ID NO: 1837202 - protein, 9 aa, Staphylococcus epidermidis
RLSGGKDVD

SEQ ID NO: 1837203 - protein, 9 aa, Staphylococcus epidermidis
RNLTNEGYN

SEQ ID NO: 1837204 - protein, 7 aa, Staphylococcus epidermidis
RQHGGTI

SEQ ID NO: 1837205 - protein, 12 aa, Staphylococcus epidermidis
RSQTQSPPEQYV

SEQ ID NO: 1837206 - protein, 4 aa, Staphylococcus epidermidis
RYGR

SEQ ID NO: 1837207 - protein, 5 aa, Staphylococcus epidermidis
SAIAH

SEQ ID NO: 1837208 - protein, 6 aa, Staphylococcus epidermidis
SDSESI

SEQ ID NO: 1837209 - protein, 11 aa, Staphylococcus epidermidis
SFTDSEEKAMG

SEQ ID NO: 1837210 - protein, 11 aa, Staphylococcus epidermidis
SGKKAGKYQKK

SEQ ID NO: 1837211 - protein, 5 aa, Staphylococcus epidermidis
SGKVE

SEQ ID NO: 1837212 - protein, 15 aa, Staphylococcus epidermidis
SGMKGATANIDNVKK

SEQ ID NO: 1837213 - protein, 5 aa, Staphylococcus epidermidis
SGSSL

SEQ ID NO: 1837214 - protein, 7 aa, Staphylococcus epidermidis
SHNYYGK

SEQ ID NO: 1837215 - protein, 7 aa, Staphylococcus epidermidis
SIDTDKP

SEQ ID NO: 1837216 - protein, 33 aa, Staphylococcus epidermidis
SISDDTKKKIKTDYKTKGSISWKKAKEDQQIAK

SEQ ID NO: 1837217 - protein, 6 aa, Staphylococcus epidermidis
SIYPAG

SEQ ID NO: 1837218 - protein, 14 aa, Staphylococcus epidermidis
SKKNNYPSNYGKND

SEQ ID NO: 1837219 - protein, 11 aa, Staphylococcus epidermidis
SKNQKDNINKN

SEQ ID NO: 1837220 - protein, 7 aa, Staphylococcus epidermidis
SKYEPIS

SEQ ID NO: 1837221 - protein, 9 aa, Staphylococcus epidermidis
SLEPGQKAK

SEQ ID NO: 1837222 - protein, 5 aa, Staphylococcus epidermidis
SNNQS

SEQ ID NO: 1837223 - protein, 15 aa, Staphylococcus epidermidis
SNRVGGKIQTYRSDG

SEQ ID NO: 1837224 - protein, 6 aa, Staphylococcus epidermidis
SNTLGY

SEQ ID NO: 1837225 - protein, 7 aa, Staphylococcus epidermidis
SPYTQQR

SEQ ID NO: 1837226 - protein, 9 aa, Staphylococcus epidermidis
SQHPSNQAF

SEQ ID NO: 1837227 - protein, 12 aa, Staphylococcus epidermidis
SRNVEKNMSRSA

SEQ ID NO: 1837228 - protein, 11 aa, Staphylococcus epidermidis
SRSAALPSVRG

SEQ ID NO: 1837229 - protein, 6 aa, Staphylococcus epidermidis
TAGPTV

SEQ ID NO: 1837230 - protein, 20 aa, Staphylococcus epidermidis
TAKAPVKVNQTYNVKAGSTL

SEQ ID NO: 1837231 - protein, 6 aa, Staphylococcus epidermidis
TGGKDN

SEQ ID NO: 1837232 - protein, 7 aa, Staphylococcus epidermidis
THYDDPT

SEQ ID NO: 1837233 - protein, 11 aa, Staphylococcus epidermidis
TKNGTDDKIPS

SEQ ID NO: 1837234 - protein, 17 aa, Staphylococcus epidermidis
TKNNAQNNTDWSNKEYD

SEQ ID NO: 1837235 - protein, 16 aa, Staphylococcus epidermidis
TKYSGDVNKKQQDKIT

SEQ ID NO: 1837236 - protein, 5 aa, Staphylococcus epidermidis
TMKDE

SEQ ID NO: 1837237 - protein, 32 aa, Staphylococcus epidermidis
TQGQSSNASEYTSDEGTSNNDASNDDKVTRDN

SEQ ID NO: 1837238 - protein, 16 aa, Staphylococcus epidermidis
TRDGATDLNRKTSLNP

SEQ ID NO: 1837239 - protein, 6 aa, Staphylococcus epidermidis
TSQTDI

SEQ ID NO: 1837240 - protein, 11 aa, Staphylococcus epidermidis
TTDYKRTGEEL

SEQ ID NO: 1837241 - protein, 7 aa, Staphylococcus epidermidis
TTSKIVK

SEQ ID NO: 1837242 - protein, 8 aa, Staphylococcus epidermidis
TYKSEKNK

SEQ ID NO: 1837243 - protein, 14 aa, Staphylococcus epidermidis
VASDDSAFNNPTKP

SEQ ID NO: 1837244 - protein, 10 aa, Staphylococcus epidermidis
VASNDTKAWE

SEQ ID NO: 1837245 - protein, 23 aa, Staphylococcus epidermidis
VGGSASQNTSSNTSSSSASSHTV

SEQ ID NO: 1837246 - protein, 9 aa, Staphylococcus epidermidis
VIPSTNTSV

SEQ ID NO: 1837247 - protein, 7 aa, Staphylococcus epidermidis
VKEEKEK

SEQ ID NO: 1837248 - protein, 8 aa, Staphylococcus epidermidis
VNSNGSIR

SEQ ID NO: 1837249 - protein, 14 aa, Staphylococcus epidermidis
VSDKEIKENSKKTS

SEQ ID NO: 1837250 - protein, 6 aa, Staphylococcus epidermidis
VSGDIA

SEQ ID NO: 1837251 - protein, 12 aa, Staphylococcus epidermidis
VTYKTDYKERKA

SEQ ID NO: 1837252 - protein, 7 aa, Staphylococcus epidermidis
WGVAPKQ

SEQ ID NO: 1837253 - protein, 28 aa, Staphylococcus epidermidis
WKSKDSGLHDLTRDGATDLNRKTSLNPN

SEQ ID NO: 1837254 - protein, 11 aa, Staphylococcus epidermidis
WKSVSKESIIK

SEQ ID NO: 1837255 - protein, 9 aa, Staphylococcus epidermidis
YASASTGFM

SEQ ID NO: 1837256 - protein, 27 aa, Staphylococcus epidermidis
YEFKDKNNTHHRGETKTDTVKVPYNPN

SEQ ID NO: 1837257 - protein, 21 aa, Staphylococcus epidermidis
YESPKDARYEANTLSQRAPKA

SEQ ID NO: 1837258 - protein, 5 aa, Staphylococcus epidermidis
YGKNA

SEQ ID NO: 1837259 - protein, 4 aa, Staphylococcus epidermidis
YKIG

SEQ ID NO: 1837260 - protein, 9 aa, Staphylococcus epidermidis
YKNNGDGTI

SEQ ID NO: 1837261 - protein, 127 aa, Staphylococcus epidermidis
YNEISSNQKQQSLSTDDANQNQTNSVTKNQQEETNDLTQEDKTSTDTNQLQETQSVAKENEKDLGANANNEQQDKKMTASQPSENQAIETQTASNDNESQQKSQQVTSEQNETATPKVSNTNASGYN

SEQ ID NO: 1837262 - protein, 7 aa, Staphylococcus epidermidis
YNTGKKY

SEQ ID NO: 1837263 - protein, 13 aa, Staphylococcus epidermidis
YQKGEAHLTNPQV

SEQ ID NO: 1837264 - protein, 13 aa, Staphylococcus epidermidis
YSWDTSSNSIAKY

SEQ ID NO: 1837265 - protein, 8 aa, Staphylococcus epidermidis
AADARYEA

SEQ ID NO: 1837266 - protein, 296 aa, Staphylococcus epidermidis
AAEETQDQTKNSNVLDDQATLKQAEQAKNEVTQSAQNVSGTQTYQDPTKVQSKQDTTSNNYDASLDELNDSSSKASQQEQSNNSNQPTDSKETNTSSVNTYQDSTKDIKNNEISKDAVTSEDNETSKVDNTNKEVSETEQQESTVENVNKDENSNNNIQASSNQTNNLNDQEKQEATSNQASNNKTSQQATTDSTEKSNNKVSQTNSSGYNFDDDEDDVDTTNAQSKNTKADQPQVASLSAQNNVNTKSESNPTIKNSTNSTNTSKSATQNTKVSNTQANNTTTESNNKVSTFSSV

SEQ ID NO: 1837267 - protein, 4 aa, Staphylococcus epidermidis
AAGL

SEQ ID NO: 1837268 - protein, 70 aa, Staphylococcus epidermidis
AAGSQSSSADYTQSYNQESSNQSVSSNTQSSNTNVEAVSAPTTSHHNYSTSTTSYSAPSSSSASTGGSVK

SEQ ID NO: 1837269 - protein, 16 aa, Staphylococcus epidermidis
AAKYGHDRYGKTYAGA

SEQ ID NO: 1837270 - protein, 8 aa, Staphylococcus epidermidis
AAKYGTTY

SEQ ID NO: 1837271 - protein, 26 aa, Staphylococcus epidermidis
AANAQESETSQLDSYATSDVITNQSN

SEQ ID NO: 1837272 - protein, 27 aa, Staphylococcus epidermidis
AANAQETEASQQDVNSPDVVSTNQSNL

SEQ ID NO: 1837273 - protein, 5 aa, Staphylococcus epidermidis
AAPGY

SEQ ID NO: 1837274 - protein, 15 aa, Staphylococcus epidermidis
AARYGHKRYGKTYEG

SEQ ID NO: 1837275 - protein, 35 aa, Staphylococcus epidermidis
AATLADKSTRNALKQSFKDAKEGNRSRKPSKFNSI

SEQ ID NO: 1837276 - protein, 19 aa, Staphylococcus epidermidis
ADAAENNNNGYNPNDPYSY

SEQ ID NO: 1837277 - protein, 138 aa, Staphylococcus epidermidis
ADAHPEDSQTTQQLKNDKVEETLKASKQGTADSQQVQRIDQSKTNQNNQHSVAESAQLKSDETANQPKVEEESSVKQDIQPSKNVNQQDVATQSNERENNDIKGEDQTSKASNQHTQSSNSHNQSIGTKDSDSEEIDQ

SEQ ID NO: 1837278 - protein, 11 aa, Staphylococcus epidermidis
ADATSHGTVTI

SEQ ID NO: 1837279 - protein, 9 aa, Staphylococcus epidermidis
ADEAKEKYS

SEQ ID NO: 1837280 - protein, 9 aa, Staphylococcus epidermidis
ADHSTGGMT

SEQ ID NO: 1837281 - protein, 9 aa, Staphylococcus epidermidis
ADHTTESTV

SEQ ID NO: 1837282 - protein, 19 aa, Staphylococcus epidermidis
ADPLPTPEQVSQFGDESHQ

SEQ ID NO: 1837283 - protein, 6 aa, Staphylococcus epidermidis
ADQIPS

SEQ ID NO: 1837284 - protein, 28 aa, Staphylococcus epidermidis
ADSLPQKDGANQKTTKVTVSNKDVPDAV

SEQ ID NO: 1837285 - protein, 4 aa, Staphylococcus epidermidis
AEAA

SEQ ID NO: 1837286 - protein, 33 aa, Staphylococcus epidermidis
AEASEKNSDHQKNVNKTNQQSVRTQTSYDFNPQ

SEQ ID NO: 1837287 - protein, 31 aa, Staphylococcus epidermidis
AEEGGTPSYKPNGYSSQINSDDRQRSFTKDG

SEQ ID NO: 1837288 - protein, 7 aa, Staphylococcus epidermidis
AEIKSRD

SEQ ID NO: 1837289 - protein, 9 aa, Staphylococcus epidermidis
AEKPYSETL

SEQ ID NO: 1837290 - protein, 31 aa, Staphylococcus epidermidis
AEKRANKDDKNKDSVKKKAKNRQAQSPIDRN

SEQ ID NO: 1837291 - protein, 5 aa, Staphylococcus epidermidis
AENIP

SEQ ID NO: 1837292 - protein, 71 aa, Staphylococcus epidermidis
AFAEDSSNKNTSSEKMEQHHAQKETSKQSEKDEFNNDDSKHDSDDKKSTSDSKDKDSNKSLSADSTHRNYK

SEQ ID NO: 1837293 - protein, 11 aa, Staphylococcus epidermidis
AGANSSSNHPM

SEQ ID NO: 1837294 - protein, 10 aa, Staphylococcus epidermidis
AGATSDKKLA

SEQ ID NO: 1837295 - protein, 6 aa, Staphylococcus epidermidis
AGDASI

SEQ ID NO: 1837296 - protein, 12 aa, Staphylococcus epidermidis
AGEASGFGGGGL

SEQ ID NO: 1837297 - protein, 7 aa, Staphylococcus epidermidis
AGGTEAA

SEQ ID NO: 1837298 - protein, 14 aa, Staphylococcus epidermidis
AGHHAEAATGNSMK

SEQ ID NO: 1837299 - protein, 16 aa, Staphylococcus epidermidis
AGIAGGATTGATTVGL

SEQ ID NO: 1837300 - protein, 10 aa, Staphylococcus epidermidis
AGLSKGNAGI

SEQ ID NO: 1837301 - protein, 77 aa, Staphylococcus epidermidis
AGSDADYTESSSNQEVSSNAQSSNTNVQAVSAPTSSESRSYSTSTTSYSAPSHNYSSHSSSVRLSNGNTAGSVGSYA

SEQ ID NO: 1837302 - protein, 11 aa, Staphylococcus epidermidis
AGSNPTFEPRT

SEQ ID NO: 1837303 - protein, 6 aa, Staphylococcus epidermidis
AGTELG

SEQ ID NO: 1837304 - protein, 16 aa, Staphylococcus epidermidis
AGYDVTTTPVQASGPL

SEQ ID NO: 1837305 - protein, 18 aa, Staphylococcus epidermidis
AGYHKNSDGIFEKDGKSL

SEQ ID NO: 1837306 - protein, 5 aa, Staphylococcus epidermidis
AGYPL

SEQ ID NO: 1837307 - protein, 11 aa, Staphylococcus epidermidis
AHAQESVKPYY

SEQ ID NO: 1837308 - protein, 17 aa, Staphylococcus epidermidis
AHATTPNMGQGAGQAME

SEQ ID NO: 1837309 - protein, 38 aa, Staphylococcus epidermidis
AHNNPDNLGVAPSSKSESEMPNGEFKGQEIKKYPGNGD

SEQ ID NO: 1837310 - protein, 12 aa, Staphylococcus epidermidis
AHSAELDPSTPY

SEQ ID NO: 1837311 - protein, 8 aa, Staphylococcus epidermidis
AIGEDGVD

SEQ ID NO: 1837312 - protein, 24 aa, Staphylococcus epidermidis
AIKEKYKSHDAYAKAYKKALNKEK

SEQ ID NO: 1837313 - protein, 10 aa, Staphylococcus epidermidis
AITDPDKAKG

SEQ ID NO: 1837314 - protein, 9 aa, Staphylococcus epidermidis
AITNPNKAK

SEQ ID NO: 1837315 - protein, 15 aa, Staphylococcus epidermidis
AKADEDNKKLKYHKN

SEQ ID NO: 1837316 - protein, 14 aa, Staphylococcus epidermidis
AKAINDKDKTLSLE

SEQ ID NO: 1837317 - protein, 6 aa, Staphylococcus epidermidis
AKANPY

SEQ ID NO: 1837318 - protein, 5 aa, Staphylococcus epidermidis
AKDFG

SEQ ID NO: 1837319 - protein, 10 aa, Staphylococcus epidermidis
AKEGYSKSHP

SEQ ID NO: 1837320 - protein, 12 aa, Staphylococcus epidermidis
AKEKDPKYQTFG

SEQ ID NO: 1837321 - protein, 7 aa, Staphylococcus epidermidis
AKEPNRE

SEQ ID NO: 1837322 - protein, 12 aa, Staphylococcus epidermidis
AKERNSEDSLKI

SEQ ID NO: 1837323 - protein, 8 aa, Staphylococcus epidermidis
AKGGLSNQ

SEQ ID NO: 1837324 - protein, 11 aa, Staphylococcus epidermidis
AKGKDYKWDPE

SEQ ID NO: 1837325 - protein, 8 aa, Staphylococcus epidermidis
AKGQGNAF

SEQ ID NO: 1837326 - protein, 19 aa, Staphylococcus epidermidis
AKGYNVSEASVSAFGSNYD

SEQ ID NO: 1837327 - protein, 8 aa, Staphylococcus epidermidis
AKHGQSRF

SEQ ID NO: 1837328 - protein, 12 aa, Staphylococcus epidermidis
AKKQVGNKTFKG

SEQ ID NO: 1837329 - protein, 8 aa, Staphylococcus epidermidis
AKNAGWDS

SEQ ID NO: 1837330 - protein, 6 aa, Staphylococcus epidermidis
AKNGGI

SEQ ID NO: 1837331 - protein, 9 aa, Staphylococcus epidermidis
AKPGKNGAT

SEQ ID NO: 1837332 - protein, 15 aa, Staphylococcus epidermidis
AKPTKDPEKAMSETQ

SEQ ID NO: 1837333 - protein, 15 aa, Staphylococcus epidermidis
AKPTKDPKKAMSETQ

SEQ ID NO: 1837334 - protein, 16 aa, Staphylococcus epidermidis
AKSKVSDKPVGTGPYQ

SEQ ID NO: 1837335 - protein, 11 aa, Staphylococcus epidermidis
AKTKSNIQSTQ

SEQ ID NO: 1837336 - protein, 9 aa, Staphylococcus epidermidis
AKTSEHASR

SEQ ID NO: 1837337 - protein, 9 aa, Staphylococcus epidermidis
AKTSGTKKV

SEQ ID NO: 1837338 - protein, 26 aa, Staphylococcus epidermidis
AKVTQESQATNALKELPKSENIKNHY

SEQ ID NO: 1837339 - protein, 6 aa, Staphylococcus epidermidis
AKYPIG

SEQ ID NO: 1837340 - protein, 7 aa, Staphylococcus epidermidis
ALASSNA

SEQ ID NO: 1837341 - protein, 23 aa, Staphylococcus epidermidis
ALDKEEEGKKRLEEHDKKIEEYK

SEQ ID NO: 1837342 - protein, 14 aa, Staphylococcus epidermidis
ALEKEFKKDHKDAN

SEQ ID NO: 1837343 - protein, 5 aa, Staphylococcus epidermidis
ALKQD

SEQ ID NO: 1837344 - protein, 28 aa, Staphylococcus epidermidis
ANAEENNTTNYQELQKDGTLDKSVTQEQ

SEQ ID NO: 1837345 - protein, 7 aa, Staphylococcus epidermidis
ANETQLD

SEQ ID NO: 1837346 - protein, 56 aa, Staphylococcus epidermidis; identical to SEQ ID NO: 1706606

SEQ ID NO: 1837347 - protein, 7 aa, Staphylococcus epidermidis
ANGTATI

SEQ ID NO: 1837348 - protein, 14 aa, Staphylococcus epidermidis
ANIESKVAKEKKHP

SEQ ID NO: 1837349 - protein, 11 aa, Staphylococcus epidermidis
ANKEADNIKKE

SEQ ID NO: 1837350 - protein, 16 aa, Staphylococcus epidermidis
ANKVTETLRKETDAQP

SEQ ID NO: 1837351 - protein, 11 aa, Staphylococcus epidermidis
ANNPFKEKEQQ

SEQ ID NO: 1837352 - protein, 32 aa, Staphylococcus epidermidis
ANNSVSNDDQLSSEEQQKYNENTNENKQNSHV

SEQ ID NO: 1837353 - protein, 31 aa, Staphylococcus epidermidis
ANNWANAAAAAGYTVNNSPSKGAILQTSQGA

SEQ ID NO: 1837354 - protein, 5 aa, Staphylococcus epidermidis
ANSDV

SEQ ID NO: 1837355 - protein, 4 aa, Staphylococcus epidermidis
ANSK

SEQ ID NO: 1837356 - protein, 10 aa, Staphylococcus epidermidis
ANSYNGEDFE

SEQ ID NO: 1837357 - protein, 6 aa, Staphylococcus epidermidis
ANYSQI

SEQ ID NO: 1837358 - protein, 14 aa, Staphylococcus epidermidis
APAERKTDKYQSMT

SEQ ID NO: 1837359 - protein, 4 aa, Staphylococcus epidermidis
APFS

SEQ ID NO: 1837360 - protein, 15 aa, Staphylococcus epidermidis
APHNGTHAADVGNEP

SEQ ID NO: 1837361 - protein, 15 aa, Staphylococcus epidermidis
APKKYRGKAGNYAKS

SEQ ID NO: 1837362 - protein, 5 aa, Staphylococcus epidermidis
APTGN

SEQ ID NO: 1837363 - protein, 12 aa, Staphylococcus epidermidis
APTKSSKTTTKY

SEQ ID NO: 1837364 - protein, 6 aa, Staphylococcus epidermidis
APYNKL

SEQ ID NO: 1837365 - protein, 19 aa, Staphylococcus epidermidis
AQAAEQNNNGYNPNDPYSY

SEQ ID NO: 1837366 - protein, 17 aa, Staphylococcus epidermidis
AQANEENKKLKYEKNSA

SEQ ID NO: 1837367 - protein, 19 aa, Staphylococcus epidermidis
AQAQETNFENGIKIQQDKV

SEQ ID NO: 1837368 - protein, 18 aa, Staphylococcus epidermidis
AQDEAKKRKFKYLELVAI

SEQ ID NO: 1837369 - protein, 13 aa, Staphylococcus epidermidis
AQDEAKKRKLNIW

SEQ ID NO: 1837370 - protein, 32 aa, Staphylococcus epidermidis
AQENSNGSENQEFTPEEKQQLAKDKKEAQFND

SEQ ID NO: 1837371 - protein, 14 aa, Staphylococcus epidermidis
AQGKPNAGEEFTGK

SEQ ID NO: 1837372 - protein, 13 aa, Staphylococcus epidermidis
AQGKYNAGQEFRG

SEQ ID NO: 1837373 - protein, 8 aa, Staphylococcus epidermidis
AQKEKVVE

SEQ ID NO: 1837374 - protein, 7 aa, Staphylococcus epidermidis
AQKEKYD

SEQ ID NO: 1837375 - protein, 14 aa, Staphylococcus epidermidis
AQNGQSGTLTVSGT

SEQ ID NO: 1837376 - protein, 27 aa, Staphylococcus epidermidis
AQQVKDNGGPASGGSNLANSNPQLKQR

SEQ ID NO: 1837377 - protein, 10 aa, Staphylococcus epidermidis
AQRDGETHAQ

SEQ ID NO: 1837378 - protein, 9 aa, Staphylococcus epidermidis
AQSINETYD

SEQ ID NO: 1837379 - protein, 6 aa, Staphylococcus epidermidis
AQSPDT

SEQ ID NO: 1837380 - protein, 6 aa, Staphylococcus epidermidis
AQYKNQ

SEQ ID NO: 1837381 - protein, 4 aa, Staphylococcus epidermidis
ARDI

SEQ ID NO: 1837382 - protein, 11 aa, Staphylococcus epidermidis
ARDSSSNPETL

SEQ ID NO: 1837383 - protein, 4 aa, Staphylococcus epidermidis
AREN

SEQ ID NO: 1837384 - protein, 11 aa, Staphylococcus epidermidis
ASAKEDSNWNK

SEQ ID NO: 1837385 - protein, 4 aa, Staphylococcus epidermidis
ASEL

SEQ ID NO: 1837386 - protein, 7 aa, Staphylococcus epidermidis
ASEQDLK

SEQ ID NO: 1837387 - protein, 9 aa, Staphylococcus epidermidis
ASERDYKDS

SEQ ID NO: 1837388 - protein, 13 aa, Staphylococcus epidermidis
ASETTIKSMKANT

SEQ ID NO: 1837389 - protein, 11 aa, Staphylococcus epidermidis
ASETVGKELTK

SEQ ID NO: 1837390 - protein, 5 aa, Staphylococcus epidermidis
ASEYK

SEQ ID NO: 1837391 - protein, 8 aa, Staphylococcus epidermidis
ASFSGQAA

SEQ ID NO: 1837392 - protein, 10 aa, Staphylococcus epidermidis
ASGSTKDEKM

SEQ ID NO: 1837393 - protein, 11 aa, Staphylococcus epidermidis
ASKYSDDEKPN

SEQ ID NO: 1837394 - protein, 7 aa, Staphylococcus epidermidis
ASLTDVS

SEQ ID NO: 1837395 - protein, 21 aa, Staphylococcus epidermidis
ASLTEVSKSLGNEFKKDHPNV

SEQ ID NO: 1837396 - protein, 7 aa, Staphylococcus epidermidis
ASPLASD

SEQ ID NO: 1837397 - protein, 31 aa, Staphylococcus epidermidis
ASPSFAVEKPTSLLKNKDNTKISSTYEPQSL

SEQ ID NO: 1837398 - protein, 6 aa, Staphylococcus epidermidis
ASRAGI

SEQ ID NO: 1837399 - protein, 15 aa, Staphylococcus epidermidis
ASTGLNERQLQQDNE

SEQ ID NO: 1837400 - protein, 22 aa, Staphylococcus epidermidis
ASTVSGSGNQTFKATKQQQIDK

SEQ ID NO: 1837401 - protein, 14 aa, Staphylococcus epidermidis
ASVDKTSDSTKTID

SEQ ID NO: 1837402 - protein, 12 aa, Staphylococcus epidermidis
ATADDGQTKING

SEQ ID NO: 1837403 - protein, 16 aa, Staphylococcus epidermidis
ATAPMAKEAKKSKEKI

SEQ ID NO: 1837404 - protein, 17 aa, Staphylococcus epidermidis
ATEHTSTSHSNQDQSLS

SEQ ID NO: 1837405 - protein, 38 aa, Staphylococcus epidermidis
ATGQNQSKDSQSTEEVNKEVKNDTQQVTAKNDDDKVET

SEQ ID NO: 1837406 - protein, 15 aa, Staphylococcus epidermidis
ATGSKTHLEQLDEDD

SEQ ID NO: 1837407 - protein, 6 aa, Staphylococcus epidermidis
ATKEIK

SEQ ID NO: 1837408 - protein, 9 aa, Staphylococcus epidermidis
ATKNGQTRH

SEQ ID NO: 1837409 - protein, 15 aa, Staphylococcus epidermidis
ATTGTGKGVLGDTKE

SEQ ID NO: 1837410 - protein, 28 aa, Staphylococcus epidermidis
AVATPKNKSAQQTDKQVKKQANKSFPQI

SEQ ID NO: 1837411 - protein, 7 aa, Staphylococcus epidermidis
AVKKDRV

SEQ ID NO: 1837412 - protein, 9 aa, Staphylococcus epidermidis
AVQAPTKIN

SEQ ID NO: 1837413 - protein, 5 aa, Staphylococcus epidermidis
AVSSY

SEQ ID NO: 1837414 - protein, 48 aa, Staphylococcus epidermidis; identical to SEQ ID NO: 1774399

SEQ ID NO: 1837415 - protein, 5 aa, Staphylococcus epidermidis
AYQEK

SEQ ID NO: 1837416 - protein, 8 aa, Staphylococcus epidermidis
AYSPNNKH

SEQ ID NO: 1837417 - protein, 17 aa, Staphylococcus epidermidis
CDSSGKDKKKDSAQTKE

SEQ ID NO: 1837418 - protein, 21 aa, Staphylococcus epidermidis
CGGGDKSKTITVGASPAPHAE

SEQ ID NO: 1837419 - protein, 26 aa, Staphylococcus epidermidis
CGKGKQQDASNDESKTDTSEHKGGTL

SEQ ID NO: 1837420 - protein, 10 aa, Staphylococcus epidermidis
CGKSSDGLVG

SEQ ID NO: 1837421 - protein, 15 aa, Staphylococcus epidermidis
CGNETKRDIKQFESQ

SEQ ID NO: 1837422 - protein, 20 aa, Staphylococcus epidermidis
CGNGGSGSSDDGNTSLGKKE

SEQ ID NO: 1837423 - protein, 34 aa, Staphylococcus epidermidis
CGNNNSSNSSKESSKDGVEIKHEEGTTKVPKHPK

SEQ ID NO: 1837424 - protein, 30 aa, Staphylococcus epidermidis
CGNSNSDQEHSQHKDKQQEESKVKTDKTKK

SEQ ID NO: 1837425 - protein, 52 aa, Staphylococcus epidermidis
CGNSNSESDHANHKDKQQEESNVKTDTTKKLSGNFESKNGEKVEGKAKIENG

SEQ ID NO: 1837426 - protein, 11 aa, Staphylococcus epidermidis
CGSKSTKDLKD

SEQ ID NO: 1837427 - protein, 7 aa, Staphylococcus epidermidis
CKKHDSC

SEQ ID NO: 1837428 - protein, 13 aa, Staphylococcus epidermidis
CNSNSSHAQELND

SEQ ID NO: 1837429 - protein, 4 aa, Staphylococcus epidermidis
CNSY

SEQ ID NO: 1837430 - protein, 5 aa, Staphylococcus epidermidis
CPDLR

SEQ ID NO: 1837431 - protein, 14 aa, Staphylococcus epidermidis
CPEKGTPADNAPIE

SEQ ID NO: 1837432 - protein, 21 aa, Staphylococcus epidermidis
CSDQSSDSHKSKHHSDNKHHS

SEQ ID NO: 1837433 - protein, 17 aa, Staphylococcus epidermidis
CSKERTKTYEGDVNGKN

SEQ ID NO: 1837434 - protein, 13 aa, Staphylococcus epidermidis
DAADASDLDYIQG

SEQ ID NO: 1837435 - protein, 8 aa, Staphylococcus epidermidis
DADPFYSQ

SEQ ID NO: 1837436 - protein, 13 aa, Staphylococcus epidermidis
DADYEEENQKVEK

SEQ ID NO: 1837437 - protein, 13 aa, Staphylococcus epidermidis
DAGDAQDLDYIKG

SEQ ID NO: 1837438 - protein, 4 aa, Staphylococcus epidermidis
DAGS

SEQ ID NO: 1837439 - protein, 22 aa, Staphylococcus epidermidis
DAHAAEQNNGGYNPNDPSSYSY

SEQ ID NO: 1837440 - protein, 10 aa, Staphylococcus epidermidis
DAKARSKAYQ

SEQ ID NO: 1837441 - protein, 15 aa, Staphylococcus epidermidis
DAKLDSSIKATADLN

SEQ ID NO: 1837442 - protein, 6 aa, Staphylococcus epidermidis
DAKNEE

SEQ ID NO: 1837443 - protein, 9 aa, Staphylococcus epidermidis
DAKNSFSDI

SEQ ID NO: 1837444 - protein, 9 aa, Staphylococcus epidermidis
DAKTGQDSF

SEQ ID NO: 1837445 - protein, 15 aa, Staphylococcus epidermidis
DAMDPNKLTKDSGAR

SEQ ID NO: 1837446 - protein, 6 aa, Staphylococcus epidermidis
DANNDY

SEQ ID NO: 1837447 - protein, 5 aa, Staphylococcus epidermidis
DANSK

SEQ ID NO: 1837448 - protein, 19 aa, Staphylococcus epidermidis
DANSKLLRKPGERNTSLQK

SEQ ID NO: 1837449 - protein, 7 aa, Staphylococcus epidermidis
DAPSKNP

SEQ ID NO: 1837450 - protein, 4 aa, Staphylococcus epidermidis
DAQT

SEQ ID NO: 1837451 - protein, 7 aa, Staphylococcus epidermidis
DAQTGKV

SEQ ID NO: 1837452 - protein, 10 aa, Staphylococcus epidermidis
DASSNTLKQM

SEQ ID NO: 1837453 - protein, 7 aa, Staphylococcus epidermidis
DAYPSDK

SEQ ID NO: 1837454 - protein, 6 aa, Staphylococcus epidermidis
DDAGNI

SEQ ID NO: 1837455 - protein, 8 aa, Staphylococcus epidermidis
DDEDAARG

SEQ ID NO: 1837456 - protein, 13 aa, Staphylococcus epidermidis
DDISQKSTKTIQD

SEQ ID NO: 1837457 - protein, 6 aa, Staphylococcus epidermidis
DDKEWR

SEQ ID NO: 1837458 - protein, 7 aa, Staphylococcus epidermidis
DDKQTVT

SEQ ID NO: 1837459 - protein, 9 aa, Staphylococcus epidermidis
DDLANASKN

SEQ ID NO: 1837460 - protein, 20 aa, Staphylococcus epidermidis
DDLSNELSSNQYIRTETQTY

SEQ ID NO: 1837461 - protein, 13 aa, Staphylococcus epidermidis
DDNDVSSKQGLWR

SEQ ID NO: 1837462 - protein, 4 aa, Staphylococcus epidermidis
DDSG

SEQ ID NO: 1837463 - protein, 8 aa, Staphylococcus epidermidis
DDSQRTEA

SEQ ID NO: 1837464 - protein, 8 aa, Staphylococcus epidermidis
DDVEDSDR

SEQ ID NO: 1837465 - protein, 14 aa, Staphylococcus epidermidis
DDVEGKAISKDEVT

SEQ ID NO: 1837466 - protein, 14 aa, Staphylococcus epidermidis
DDVEGKAVSKDEVS

SEQ ID NO: 1837467 - protein, 18 aa, Staphylococcus epidermidis
DEEQIKKDVKEAKKHSDA

SEQ ID NO: 1837468 - protein, 16 aa, Staphylococcus epidermidis
DEETANEIEKAWEDVG

SEQ ID NO: 1837469 - protein, 22 aa, Staphylococcus epidermidis
DEFPPIRTGNDYRIDSTRTDNN

SEQ ID NO: 1837470 - protein, 23 aa, Staphylococcus epidermidis
DEGKSAEDAGYVASPKKTYKSEL

SEQ ID NO: 1837471 - protein, 24 aa, Staphylococcus epidermidis
DEKGHSTDQAQKTLSVTKSATLGN

SEQ ID NO: 1837472 - protein, 19 aa, Staphylococcus epidermidis
DELDNTVQEINDAGGQATA

SEQ ID NO: 1837473 - protein, 80 aa, Staphylococcus epidermidis
DELNGETEKKQRKDFEETLPPINKDLDEEEDRPYKETTTSSQTHTHPKPDPTPYNNENNSPQPVATTSRDESAEKLRKEL

SEQ ID NO: 1837474 - protein, 84 aa, Staphylococcus epidermidis
DELPAEDTSKKSSKESKSNSSKENGSDEASSNDSKQSTETSKSDQSKASSKDAKQSSEQNQNVDKKTQDKASTNKNKDSKSTSN

SEQ ID NO: 1837475 - protein, 132 aa, Staphylococcus epidermidis
DEMSTYNEISSNQNQQSSSINDANQNQTNSSTKNQQEETNDLTQEDKTSTDTNQLQETQSVADENEKDLETNASTEQQDKKMTASQPSENQAIETQTASNDNESQQKSQQVTSEQNETVTPKVSNTNASGYN

SEQ ID NO: 1837476 - protein, 6 aa, Staphylococcus epidermidis
DEPKDY

SEQ ID NO: 1837477 - protein, 6 aa, Staphylococcus epidermidis
DEQGTP

SEQ ID NO: 1837478 - protein, 5 aa, Staphylococcus epidermidis
DERQK

SEQ ID NO: 1837479 - protein, 11 aa, Staphylococcus epidermidis
DESAPSDSNHS

SEQ ID NO: 1837480 - protein, 10 aa, Staphylococcus epidermidis
DESISDDKLK

SEQ ID NO: 1837481 - protein, 17 aa, Staphylococcus epidermidis
DESMKDELKRFLKELDN

SEQ ID NO: 1837482 - protein, 11 aa, Staphylococcus epidermidis
DETPPTIGEPV

SEQ ID NO: 1837483 - protein, 4 aa, Staphylococcus epidermidis
DEVE

SEQ ID NO: 1837484 - protein, 15 aa, Staphylococcus epidermidis
DFPTTVSKKEQQRSF

SEQ ID NO: 1837485 - protein, 11 aa, Staphylococcus epidermidis
DFTASKGDGYD

SEQ ID NO: 1837486 - protein, 7 aa, Staphylococcus epidermidis
DGAQKDD

SEQ ID NO: 1837487 - protein, 12 aa, Staphylococcus epidermidis
DGCGADKLSNKG

SEQ ID NO: 1837488 - protein, 23 aa, Staphylococcus epidermidis
DGDIKSGKKISTVDYNKSKQTFN

SEQ ID NO: 1837489 - protein, 13 aa, Staphylococcus epidermidis
DGKAKFDEEADPM

SEQ ID NO: 1837490 - protein, 10 aa, Staphylococcus epidermidis
DGKEETPNVE

SEQ ID NO: 1837491 - protein, 9 aa, Staphylococcus epidermidis
DGKYINTGN

SEQ ID NO: 1837492 - protein, 9 aa, Staphylococcus epidermidis
DGNKKPYIV

SEQ ID NO: 1837493 - protein, 10 aa, Staphylococcus epidermidis
DGNKKPYIVK

SEQ ID NO: 1837494 - protein, 7 aa, Staphylococcus epidermidis
DGNYNEN

SEQ ID NO: 1837495 - protein, 7 aa, Staphylococcus epidermidis
DHAQPSS

SEQ ID NO: 1837496 - protein, 57 aa, Staphylococcus epidermidis
DHQYNKDATQSNEDTVSENVSEQHITAKDEGVTRNNRGDERLNQEKSTTSDKELKVD

SEQ ID NO: 1837497 - protein, 18 aa, Staphylococcus epidermidis
DHSPKEGSIMQTTNGPYG

SEQ ID NO: 1837498 - protein, 7 aa, Staphylococcus epidermidis
DIAGKKA

SEQ ID NO: 1837499 - protein, 6 aa, Staphylococcus epidermidis
DIESEE

SEQ ID NO: 1837500 - protein, 20 aa, Staphylococcus epidermidis
DIFSSNKKGQNISDSEMKSA

SEQ ID NO: 1837501 - protein, 19 aa, Staphylococcus epidermidis
DIKQNQDKQITQQQVEDTV

SEQ ID NO: 1837502 - protein, 6 aa, Staphylococcus epidermidis
DINPNI

SEQ ID NO: 1837503 - protein, 18 aa, Staphylococcus epidermidis
DINQTNISDSHVDNARKN

SEQ ID NO: 1837504 - protein, 7 aa, Staphylococcus epidermidis
DISNNID

SEQ ID NO: 1837505 - protein, 7 aa, Staphylococcus epidermidis
DITGRGK

SEQ ID NO: 1837506 - protein, 7 aa, Staphylococcus epidermidis
DITKDSS

SEQ ID NO: 1837507 - protein, 14 aa, Staphylococcus epidermidis
DKAKTNDGKPLAIG

SEQ ID NO: 1837508 - protein, 13 aa, Staphylococcus epidermidis
DKAVQQVDDSGED

SEQ ID NO: 1837509 - protein, 8 aa, Staphylococcus epidermidis
DKDFDDAH

SEQ ID NO: 1837510 - protein, 10 aa, Staphylococcus epidermidis
DKDKGVKAGL

SEQ ID NO: 1837511 - protein, 61 aa, Staphylococcus epidermidis
DKDLSTKESPENEKDDSRKGIKALTKNSQATTRNTATTEASKELKDQTNKVASQKEYKNQD

SEQ ID NO: 1837512 - protein, 36 aa, Staphylococcus epidermidis
DKDNNNKIEQYDKDEKKDVSTKHKKPTIPKDKSKMA

SEQ ID NO: 1837513 - protein, 18 aa, Staphylococcus epidermidis
DKEGYRDEEFDKDDKGTW

SEQ ID NO: 1837514 - protein, 9 aa, Staphylococcus epidermidis
DKESENKEI

SEQ ID NO: 1837515 - protein, 15 aa, Staphylococcus epidermidis
DKETDFNKEKSNLKE

SEQ ID NO: 1837516 - protein, 8 aa, Staphylococcus epidermidis
DKGNRDQR

SEQ ID NO: 1837517 - protein, 7 aa, Staphylococcus epidermidis
DKGQYTL

SEQ ID NO: 1837518 - protein, 12 aa, Staphylococcus epidermidis
DKGSSEQKEQAE

SEQ ID NO: 1837519 - protein, 26 aa, Staphylococcus epidermidis
DKKEIKKYDDQVQKAMDQEKPVNQVS

SEQ ID NO: 1837520 - protein, 8 aa, Staphylococcus epidermidis
DKKGIKRK

SEQ ID NO: 1837521 - protein, 11 aa, Staphylococcus epidermidis
DKKGKTTDQVQ

SEQ ID NO: 1837522 - protein, 8 aa, Staphylococcus epidermidis
DKKGVEIK

SEQ ID NO: 1837523 - protein, 10 aa, Staphylococcus epidermidis
DKKKNKGFKF

SEQ ID NO: 1837524 - protein, 8 aa, Staphylococcus epidermidis
DKLARKNA

SEQ ID NO: 1837525 - protein, 17 aa, Staphylococcus epidermidis
DKLPNRNTDGGFSWSPD

SEQ ID NO: 1837526 - protein, 43 aa, Staphylococcus epidermidis
DKMERDAQQLANGQSERGKATLGAKAGAKAIKATAKKVGQKAW

SEQ ID NO: 1837527 - protein, 16 aa, Staphylococcus epidermidis
DKNGDGFVSTSEMTPE

SEQ ID NO: 1837528 - protein, 13 aa, Staphylococcus epidermidis
DKNGHVNTKRLYT

SEQ ID NO: 1837529 - protein, 11 aa, Staphylococcus epidermidis
DKNKDGQYITE

SEQ ID NO: 1837530 - protein, 8 aa, Staphylococcus epidermidis
DKNSKKDF

SEQ ID NO: 1837531 - protein, 10 aa, Staphylococcus epidermidis
DKNTKEQWRG

SEQ ID NO: 1837532 - protein, 6 aa, Staphylococcus epidermidis
DKQAEG

SEQ ID NO: 1837533 - protein, 9 aa, Staphylococcus epidermidis
DKQEKPATQ

SEQ ID NO: 1837534 - protein, 21 aa, Staphylococcus epidermidis
DKQSDSSPKITKDQANKLSEL

SEQ ID NO: 1837535 - protein, 7 aa, Staphylococcus epidermidis
DKQSETG

SEQ ID NO: 1837536 - protein, 5 aa, Staphylococcus epidermidis
DKQTI

SEQ ID NO: 1837537 - protein, 6 aa, Staphylococcus epidermidis
DKRQTV

SEQ ID NO: 1837538 - protein, 12 aa, Staphylococcus epidermidis
DKTAKSGTKYAN

SEQ ID NO: 1837539 - protein, 7 aa, Staphylococcus epidermidis
DKVRVPT

SEQ ID NO: 1837540 - protein, 10 aa, Staphylococcus epidermidis
DLAKSDKIRK

SEQ ID NO: 1837541 - protein, 16 aa, Staphylococcus epidermidis
DLDKDMKKVTKDKKNH

SEQ ID NO: 1837542 - protein, 7 aa, Staphylococcus epidermidis
DLDPKID

SEQ ID NO: 1837543 - protein, 6 aa, Staphylococcus epidermidis
DLDPVA

SEQ ID NO: 1837544 - protein, 23 aa, Staphylococcus epidermidis
DLEGQDLQQTEDDLGVDDNYETY

SEQ ID NO: 1837545 - protein, 17 aa, Staphylococcus epidermidis
DLNTKNIVSNKDSFGIT

SEQ ID NO: 1837546 - protein, 7 aa, Staphylococcus epidermidis
DLPEDTS

SEQ ID NO: 1837547 - protein, 14 aa, Staphylococcus epidermidis
DLPNANPKSNVIPK

SEQ ID NO: 1837548 - protein, 18 aa, Staphylococcus epidermidis
DLPSSYNPGENPKAQKAL

SEQ ID NO: 1837549 - protein, 11 aa, Staphylococcus epidermidis
DLQQSINDREI

SEQ ID NO: 1837550 - protein, 9 aa, Staphylococcus epidermidis
DMKEEKKRI

SEQ ID NO: 1837551 - protein, 17 aa, Staphylococcus epidermidis
DMKSSNDIKASTQKGNI

SEQ ID NO: 1837552 - protein, 12 aa, Staphylococcus epidermidis
DMNHQKLKAYFE

SEQ ID NO: 1837553 - protein, 5 aa, Staphylococcus epidermidis
DMTTL

SEQ ID NO: 1837554 - protein, 17 aa, Staphylococcus epidermidis
DNAANDGYQVDNQPSVG

SEQ ID NO: 1837555 - protein, 10 aa, Staphylococcus epidermidis
DNEEKYQYTG

SEQ ID NO: 1837556 - protein, 17 aa, Staphylococcus epidermidis
DNEGREKNGQSIEHSRS

SEQ ID NO: 1837557 - protein, 38 aa, Staphylococcus epidermidis
DNEKDIKSFNDVKGKKLAQTFTSNYGQLAKDKGADITK

SEQ ID NO: 1837558 - protein, 11 aa, Staphylococcus epidermidis
DNGDLVASGSG

SEQ ID NO: 1837559 - protein, 5 aa, Staphylococcus epidermidis
DNKRH

SEQ ID NO: 1837560 - protein, 26 aa, Staphylococcus epidermidis
DNLKDEDDTSESENQSSSSDEVTVTR

SEQ ID NO: 1837561 - protein, 8 aa, Staphylococcus epidermidis
DNNDSQKV

SEQ ID NO: 1837562 - protein, 107 aa, Staphylococcus epidermidis
DNRNTQSSLNKKKQEYQPSNNQINHYPSQNNSVQLSPYNNQVSNLSQNHQSNNQLSETPDPQNNRNDQGDILNETDTPQPVIPPTSDDMKDNYQSDTKKNAYQKDKH

SEQ ID NO: 1837563 - protein, 12 aa, Staphylococcus epidermidis
DNSTKKKEVTQL

SEQ ID NO: 1837564 - protein, 7 aa, Staphylococcus epidermidis
DNVKPTI

SEQ ID NO: 1837565 - protein, 7 aa, Staphylococcus epidermidis
DNWGRGG

SEQ ID NO: 1837566 - protein, 12 aa, Staphylococcus epidermidis
DNWSKDDEEQLA

SEQ ID NO: 1837567 - protein, 5 aa, Staphylococcus epidermidis
DPEMS

SEQ ID NO: 1837568 - protein, 19 aa, Staphylococcus epidermidis
DPKEANESSQSQNEEPDEW

SEQ ID NO: 1837569 - protein, 13 aa, Staphylococcus epidermidis
DPKQPTAQSRDEL

SEQ ID NO: 1837570 - protein, 48 aa, Staphylococcus epidermidis
DPKYTKKEIDKMSEKEKKSKKANENLGLNPSHNGETNQEKIADNSPAY

SEQ ID NO: 1837571 - protein, 48 aa, Staphylococcus epidermidis
DPKYTKKEIDKMSEKEKKSKNANENLGLNPSHNGETDEEKIAKNSPAY

SEQ ID NO: 1837572 - protein, 48 aa, Staphylococcus epidermidis
DPKYTKKEIDKMSEKEKQSKNANENLGLNPSHNGETDEEKIAENSPAY

SEQ ID NO: 1837573 - protein, 6 aa, Staphylococcus epidermidis
DPLNSV

SEQ ID NO: 1837574 - protein, 11 aa, Staphylococcus epidermidis
DPNTDTKESFA

SEQ ID NO: 1837575 - protein, 11 aa, Staphylococcus epidermidis
DPSAKGGSRYE

SEQ ID NO: 1837576 - protein, 9 aa, Staphylococcus epidermidis
DPTDDGGQF

SEQ ID NO: 1837577 - protein, 19 aa, Staphylococcus epidermidis
DQAGKSTKDKSVIAASNNV

SEQ ID NO: 1837578 - protein, 29 aa, Staphylococcus epidermidis
DQEIQQPENKDNKNYHSETIDKNPTIHNN

SEQ ID NO: 1837579 - protein, 13 aa, Staphylococcus epidermidis
DQLEKTYEPASSG

SEQ ID NO: 1837580 - protein, 10 aa, Staphylococcus epidermidis
DQLSKDKSFK

SEQ ID NO: 1837581 - protein, 6 aa, Staphylococcus epidermidis
DQQGNY

SEQ ID NO: 1837582 - protein, 9 aa, Staphylococcus epidermidis
DQSGALNES

SEQ ID NO: 1837583 - protein, 6 aa, Staphylococcus epidermidis
DQSVTL

SEQ ID NO: 1837584 - protein, 4 aa, Staphylococcus epidermidis
DQSY

SEQ ID NO: 1837585 - protein, 16 aa, Staphylococcus epidermidis
DRDKEKDFKGTKQNLK

SEQ ID NO: 1837586 - protein, 26 aa, Staphylococcus epidermidis
DRKLTDALEPYQDKISSEKKLSKKQL

SEQ ID NO: 1837587 - protein, 16 aa, Staphylococcus epidermidis
DRNFVDDEQRAGVDAN

SEQ ID NO: 1837588 - protein, 11 aa, Staphylococcus epidermidis
DRNTRTSKGEY

SEQ ID NO: 1837589 - protein, 18 aa, Staphylococcus epidermidis
DRPGIESSNERHNAGTGH

SEQ ID NO: 1837590 - protein, 4 aa, Staphylococcus epidermidis
DRPM

SEQ ID NO: 1837591 - protein, 6 aa, Staphylococcus epidermidis
DSAGGQ

SEQ ID NO: 1837592 - protein, 16 aa, Staphylococcus epidermidis
DSDAERKQQGGGQRSD

SEQ ID NO: 1837593 - protein, 15 aa, Staphylococcus epidermidis
DSDGDHTTDYADDPL

SEQ ID NO: 1837594 - protein, 6 aa, Staphylococcus epidermidis
DSGEYK

SEQ ID NO: 1837595 - protein, 7 aa, Staphylococcus epidermidis
DSGINSL

SEQ ID NO: 1837596 - protein, 15 aa, Staphylococcus epidermidis
DSGINSLKDLKGKKI

SEQ ID NO: 1837597 - protein, 17 aa, Staphylococcus epidermidis
DSKDLKEYKYDPEKAKK

SEQ ID NO: 1837598 - protein, 6 aa, Staphylococcus epidermidis
DSKEKF

SEQ ID NO: 1837599 - protein, 14 aa, Staphylococcus epidermidis
DSKIKSLKDLKGKK

SEQ ID NO: 1837600 - protein, 7 aa, Staphylococcus epidermidis
DSKRNYD

SEQ ID NO: 1837601 - protein, 9 aa, Staphylococcus epidermidis
DSMNAGRAT

SEQ ID NO: 1837602 - protein, 10 aa, Staphylococcus epidermidis
DSNRTNYQNN

SEQ ID NO: 1837603 - protein, 7 aa, Staphylococcus epidermidis
DSQDTRQ

SEQ ID NO: 1837604 - protein, 10 aa, Staphylococcus epidermidis
DSSEFPDGYK

SEQ ID NO: 1837605 - protein, 6 aa, Staphylococcus epidermidis
DSSFIT

SEQ ID NO: 1837606 - protein, 32 aa, Staphylococcus epidermidis
DSSISGDLGDAHNWNNRAESEGYTVTHTPKNH

SEQ ID NO: 1837607 - protein, 9 aa, Staphylococcus epidermidis
DSSKKDNYS

SEQ ID NO: 1837608 - protein, 174 aa, Staphylococcus epidermidis
DSSKKGNERLSDKTTQQEKKKDDKDKKEKKDKKSVEEKKNNTQQTQQVPQTQQTQQTVQTPQRPTTQTPVRQNPQTGEKRAKEPKTDERKKTRQDSSNSKESPNEKDQSSTQQKPQQNKSNQSSENRQSTQNKSNQTQSTRPQNNGNSGNQNASSGQNTQKQNNNNQNSQSSKK

SEQ ID NO: 1837609 - protein, 177 aa, Staphylococcus epidermidis
DSSKKGNERLSNQTTQQEKKKDDKDKKEKKDKKSEEEKKDNTQQTQQVPQTQQTQQTQQTVQTPQRPTTQTPVKQNPQTGEKRAKEPKTDERKKSRQDSSNSKESPSQKDQSPTQQKPQQNKSNQSSANRQSTQNKSNQTQPTRPQNNGNSGNQNASSGQNTQKQNNNNQNSQSSKK

SEQ ID NO: 1837610 - protein, 12 aa, Staphylococcus epidermidis
DSTGGIQSDEYK

SEQ ID NO: 1837611 - protein, 8 aa, Staphylococcus epidermidis
DSTRNTPL

SEQ ID NO: 1837612 - protein, 11 aa, Staphylococcus epidermidis
DTEENLKSGKQ

SEQ ID NO: 1837613 - protein, 14 aa, Staphylococcus epidermidis
DTGKFEKLDPNKTY

SEQ ID NO: 1837614 - protein, 10 aa, Staphylococcus epidermidis
DTGSTKSTIQ

SEQ ID NO: 1837615 - protein, 6 aa, Staphylococcus epidermidis
DTKEKF

SEQ ID NO: 1837616 - protein, 11 aa, Staphylococcus epidermidis
DTKGKTTDQIQ

SEQ ID NO: 1837617 - protein, 7 aa, Staphylococcus epidermidis
DTKTPVT

SEQ ID NO: 1837618 - protein, 30 aa, Staphylococcus epidermidis
DTKTPVTLEAKDPNHSYNGKVGTKEFKIKE

SEQ ID NO: 1837619 - protein, 7 aa, Staphylococcus epidermidis
DTPEHGK

SEQ ID NO: 1837620 - protein, 8 aa, Staphylococcus epidermidis
DTPEHGKG

SEQ ID NO: 1837621 - protein, 5 aa, Staphylococcus epidermidis
DTQVE

SEQ ID NO: 1837622 - protein, 9 aa, Staphylococcus epidermidis
DTSKVGKYE

SEQ ID NO: 1837623 - protein, 9 aa, Staphylococcus epidermidis
DTTKKRPLN

SEQ ID NO: 1837624 - protein, 7 aa, Staphylococcus epidermidis
DTTQNYE

SEQ ID NO: 1837625 - protein, 7 aa, Staphylococcus epidermidis
DVAKESV

SEQ ID NO: 1837626 - protein, 16 aa, Staphylococcus epidermidis
DVKNSKKAEIQSTSGF

SEQ ID NO: 1837627 - protein, 10 aa, Staphylococcus epidermidis
DVKQKQENVE

SEQ ID NO: 1837628 - protein, 16 aa, Staphylococcus epidermidis
DVLTTRSTSASGLTGH

SEQ ID NO: 1837629 - protein, 12 aa, Staphylococcus epidermidis
DVNTIPDDESGG

SEQ ID NO: 1837630 - protein, 7 aa, Staphylococcus epidermidis
DVQNKGV

SEQ ID NO: 1837631 - protein, 13 aa, Staphylococcus epidermidis
DVSNPTNGTGVST

SEQ ID NO: 1837632 - protein, 17 aa, Staphylococcus epidermidis
DWKKSTLKKRKGSPKHR

SEQ ID NO: 1837633 - protein, 9 aa, Staphylococcus epidermidis
DYAKTNKDT

SEQ ID NO: 1837634 - protein, 10 aa, Staphylococcus epidermidis
DYATKNFKHK

SEQ ID NO: 1837635 - protein, 9 aa, Staphylococcus epidermidis
DYINKGKAE

SEQ ID NO: 1837636 - protein, 5 aa, Staphylococcus epidermidis
DYIQG

SEQ ID NO: 1837637 - protein, 12 aa, Staphylococcus epidermidis
DYKEQKKLSAYQ

SEQ ID NO: 1837638 - protein, 142 aa, Staphylococcus epidermidis
DYTKKQKQNENKEPQTNNNTQNEANSIQSNDRDKTQSTTNERTNQQHNTNEKQKNDQASKQEQQSEEQQENRNEESSQNEEREDPNQQIEQPSSEDKQTPDATQENNNQNNDENTDDKNYENEQTQDVESKGSGNDKETSNA

SEQ ID NO: 1837639 - protein, 19 aa, Staphylococcus epidermidis
EAEGGYTHKGNAGQNASYL

SEQ ID NO: 1837640 - protein, 10 aa, Staphylococcus epidermidis
EAGAATKGNV

SEQ ID NO: 1837641 - protein, 12 aa, Staphylococcus epidermidis
EAINKTQNVGYQ

SEQ ID NO: 1837642 - protein, 4 aa, Staphylococcus epidermidis
EAIQ

SEQ ID NO: 1837643 - protein, 26 aa, Staphylococcus epidermidis
EAKAYEQNQQEIQQASEQLQKMGEGA

SEQ ID NO: 1837644 - protein, 7 aa, Staphylococcus epidermidis
EASLTED

SEQ ID NO: 1837645 - protein, 17 aa, Staphylococcus epidermidis
EASNPAATKDIEDSEDV

SEQ ID NO: 1837646 - protein, 18 aa, Staphylococcus epidermidis
EATNINRDKAKNMKNDVV

SEQ ID NO: 1837647 - protein, 13 aa, Staphylococcus epidermidis
EDDDNKKGKQKGG

SEQ ID NO: 1837648 - protein, 6 aa, Staphylococcus epidermidis
EDESYT

SEQ ID NO: 1837649 - protein, 4 aa, Staphylococcus epidermidis
EDGE

SEQ ID NO: 1837650 - protein, 6 aa, Staphylococcus epidermidis
EDHRSL

SEQ ID NO: 1837651 - protein, 27 aa, Staphylococcus epidermidis
EDKTRKDKKEIQSKVGQATASVFEPDE

SEQ ID NO: 1837652 - protein, 7 aa, Staphylococcus epidermidis
EDLKTAP

SEQ ID NO: 1837653 - protein, 23 aa, Staphylococcus epidermidis
EDNATQSEVDEKSKDLSKAYKEM

SEQ ID NO: 1837654 - protein, 12 aa, Staphylococcus epidermidis
EDNKDNRSLEEM

SEQ ID NO: 1837655 - protein, 4 aa, Staphylococcus epidermidis
EDTE

SEQ ID NO: 1837656 - protein, 5 aa, Staphylococcus epidermidis
EDTEA

SEQ ID NO: 1837657 - protein, 33 aa, Staphylococcus epidermidis
EEGAQDKFKSEPSTSVDNIEHDSTDDLVTASEY

SEQ ID NO: 1837658 - protein, 12 aa, Staphylococcus epidermidis
EEISENFKQHMN

SEQ ID NO: 1837659 - protein, 12 aa, Staphylococcus epidermidis
EEISESFKQHMN

SEQ ID NO: 1837660 - protein, 9 aa, Staphylococcus epidermidis
EELGKSSAA

SEQ ID NO: 1837661 - protein, 4 aa, Staphylococcus epidermidis
EELS

SEQ ID NO: 1837662 - protein, 13 aa, Staphylococcus epidermidis
EENLDRKSDLLDK

SEQ ID NO: 1837663 - protein, 17 aa, Staphylococcus epidermidis
EEQKKAAELKKQQINEQ

SEQ ID NO: 1837664 - protein, 17 aa, Staphylococcus epidermidis
EEQTVTSGDDETATQAW

SEQ ID NO: 1837665 - protein, 14 aa, Staphylococcus epidermidis
EESDVERGAPSSRK

SEQ ID NO: 1837666 - protein, 7 aa, Staphylococcus epidermidis
EETGNSV

SEQ ID NO: 1837667 - protein, 38 aa, Staphylococcus epidermidis
EETIHKEGNYLTNDAVSASGSGLDPDITVTNAKAQVKR

SEQ ID NO: 1837668 - protein, 7 aa, Staphylococcus epidermidis
EFEPDKE

SEQ ID NO: 1837669 - protein, 22 aa, Staphylococcus epidermidis
EFRTSGKKKTVIAEANKNTPLG

SEQ ID NO: 1837670 - protein, 26 aa, Staphylococcus epidermidis
EGASYPSVKADKKSKGILSWLSHLFL

SEQ ID NO: 1837671 - protein, 6 aa, Staphylococcus epidermidis
EGGNQL

SEQ ID NO: 1837672 - protein, 16 aa, Staphylococcus epidermidis
EGIQNMNAEDPSQKEL

SEQ ID NO: 1837673 - protein, 9 aa, Staphylococcus epidermidis
EGKDGNKTL

SEQ ID NO: 1837674 - protein, 28 aa, Staphylococcus epidermidis
EGKLSELTQDLKDSLDKMNTSKTKTHTV

SEQ ID NO: 1837675 - protein, 7 aa, Staphylococcus epidermidis
EGLPEDA

SEQ ID NO: 1837676 - protein, 16 aa, Staphylococcus epidermidis
EGNFPVQGRSVKSTLH

SEQ ID NO: 1837677 - protein, 6 aa, Staphylococcus epidermidis
EGNLEG

SEQ ID NO: 1837678 - protein, 6 aa, Staphylococcus epidermidis
EGQVSK

SEQ ID NO: 1837679 - protein, 8 aa, Staphylococcus epidermidis
EGSKVGRS

SEQ ID NO: 1837680 - protein, 12 aa, Staphylococcus epidermidis
EGWQKTSGSYRK

SEQ ID NO: 1837681 - protein, 4 aa, Staphylococcus epidermidis
EGYT

SEQ ID NO: 1837682 - protein, 8 aa, Staphylococcus epidermidis
EHHPNDSV

SEQ ID NO: 1837683 - protein, 9 aa, Staphylococcus epidermidis
EHKGKKNQL

SEQ ID NO: 1837684 - protein, 4 aa, Staphylococcus epidermidis
EHKH

SEQ ID NO: 1837685 - protein, 8 aa, Staphylococcus epidermidis
EIEKEDNN

SEQ ID NO: 1837686 - protein, 10 aa, Staphylococcus epidermidis
EIRATSNHTA

SEQ ID NO: 1837687 - protein, 29 aa, Staphylococcus epidermidis
EIRRNNPELERSIKDAKDTFVNRKNQRLG

SEQ ID NO: 1837688 - protein, 7 aa, Staphylococcus epidermidis
EITMNKD

SEQ ID NO: 1837689 - protein, 13 aa, Staphylococcus epidermidis
EIYSGKAKTWKDV

SEQ ID NO: 1837690 - protein, 6 aa, Staphylococcus epidermidis
EKAIGT

SEQ ID NO: 1837691 - protein, 27 aa, Staphylococcus epidermidis
EKDGDSYKLEAPKEGKLKNDVRLIGND

SEQ ID NO: 1837692 - protein, 19 aa, Staphylococcus epidermidis
EKDREGRPINNKKKYPVKM

SEQ ID NO: 1837693 - protein, 11 aa, Staphylococcus epidermidis
EKEFKEKGYQA

SEQ ID NO: 1837694 - protein, 8 aa, Staphylococcus epidermidis
EKGKFPKR

SEQ ID NO: 1837695 - protein, 7 aa, Staphylococcus epidermidis
EKGKTEL

SEQ ID NO: 1837696 - protein, 6 aa, Staphylococcus epidermidis
EKGNKY

SEQ ID NO: 1837697 - protein, 14 aa, Staphylococcus epidermidis
EKKDQLKTNLIFDN

SEQ ID NO: 1837698 - protein, 19 aa, Staphylococcus epidermidis
EKNTNLEKSHDGNNNYKKA

SEQ ID NO: 1837699 - protein, 44 aa, Staphylococcus epidermidis
EKNVGDTSKMSKKAFEKKVDKETQKIADKYNTTIYAPQKTFKPH

SEQ ID NO: 1837700 - protein, 11 aa, Staphylococcus epidermidis
EKPKQGTAPSN

SEQ ID NO: 1837701 - protein, 7 aa, Staphylococcus epidermidis
EKQKHAK

SEQ ID NO: 1837702 - protein, 7 aa, Staphylococcus epidermidis
EKQSETG

SEQ ID NO: 1837703 - protein, 22 aa, Staphylococcus epidermidis
EKRRKKNSKEQNSNHVEQQQHD

SEQ ID NO: 1837704 - protein, 7 aa, Staphylococcus epidermidis
EKRSYKS

SEQ ID NO: 1837705 - protein, 10 aa, Staphylococcus epidermidis
EKSKDDIPNS

SEQ ID NO: 1837706 - protein, 7 aa, Staphylococcus epidermidis
EKYSQAT

SEQ ID NO: 1837707 - protein, 8 aa, Staphylococcus epidermidis
ELDESTKF

SEQ ID NO: 1837708 - protein, 14 aa, Staphylococcus epidermidis
ELDGEANINDSTLK

SEQ ID NO: 1837709 - protein, 6 aa, Staphylococcus epidermidis
ELKRKN

SEQ ID NO: 1837710 - protein, 17 aa, Staphylococcus epidermidis
ELNGERNIARKQETNLG

SEQ ID NO: 1837711 - protein, 10 aa, Staphylococcus epidermidis
ELNGVESDNL

SEQ ID NO: 1837712 - protein, 18 aa, Staphylococcus epidermidis
ELNKDSKNKFDDIPQNQR

SEQ ID NO: 1837713 - protein, 7 aa, Staphylococcus epidermidis
ELPQSSI

SEQ ID NO: 1837714 - protein, 10 aa, Staphylococcus epidermidis
ELSTFGPGGR

SEQ ID NO: 1837715 - protein, 11 aa, Staphylococcus epidermidis
ELSTYGPGGRF

SEQ ID NO: 1837716 - protein, 5 aa, Staphylococcus epidermidis
EMPQV

SEQ ID NO: 1837717 - protein, 17 aa, Staphylococcus epidermidis
ENEEPSIRTRTSPWSET

SEQ ID NO: 1837718 - protein, 6 aa, Staphylococcus epidermidis
ENGREL

SEQ ID NO: 1837719 - protein, 27 aa, Staphylococcus epidermidis
ENIKGAKEMHDGKADHISGIKKKDNYT

SEQ ID NO: 1837720 - protein, 8 aa, Staphylococcus epidermidis
ENKPTTKQ

SEQ ID NO: 1837721 - protein, 10 aa, Staphylococcus epidermidis
ENKQASPMAD

SEQ ID NO: 1837722 - protein, 8 aa, Staphylococcus epidermidis
ENNESATY

SEQ ID NO: 1837723 - protein, 12 aa, Staphylococcus epidermidis
ENQRDKKRTQII

SEQ ID NO: 1837724 - protein, 7 aa, Staphylococcus epidermidis
ENTSNGC

SEQ ID NO: 1837725 - protein, 5 aa, Staphylococcus epidermidis
ENVDM

SEQ ID NO: 1837726 - protein, 15 aa, Staphylococcus epidermidis
EPGSSGGAVLNSKNE

SEQ ID NO: 1837727 - protein, 7 aa, Staphylococcus epidermidis
EPIPNDT

SEQ ID NO: 1837728 - protein, 10 aa, Staphylococcus epidermidis
EPKGKNMESR

SEQ ID NO: 1837729 - protein, 4 aa, Staphylococcus epidermidis
EPSQ

SEQ ID NO: 1837730 - protein, 8 aa, Staphylococcus epidermidis
EPVTGEGA

SEQ ID NO: 1837731 - protein, 19 aa, Staphylococcus epidermidis
EQAESELRERRGELQRQET

SEQ ID NO: 1837732 - protein, 15 aa, Staphylococcus epidermidis
EQANGSLVKQDGKVI

SEQ ID NO: 1837733 - protein, 6 aa, Staphylococcus epidermidis
EQESEA

SEQ ID NO: 1837734 - protein, 13 aa, Staphylococcus epidermidis
EQGQEMTPNNKQQ

SEQ ID NO: 1837735 - protein, 4 aa, Staphylococcus epidermidis
EQIE

SEQ ID NO: 1837736 - protein, 6 aa, Staphylococcus epidermidis
EQIGGK

SEQ ID NO: 1837737 - protein, 18 aa, Staphylococcus epidermidis
EQQTVTNGDDETATKAWA

SEQ ID NO: 1837738 - protein, 6 aa, Staphylococcus epidermidis
ERDDQT

SEQ ID NO: 1837739 - protein, 58 aa, Staphylococcus epidermidis
ERDEKNSEKSKQKENTHTDSNNTSSNESDTSKQSSQENTINQTEQNQPTENNSSSQQD

SEQ ID NO: 1837740 - protein, 14 aa, Staphylococcus epidermidis
ERGGSSASGHGNSV

SEQ ID NO: 1837741 - protein, 7 aa, Staphylococcus epidermidis
ERQNGNV

SEQ ID NO: 1837742 - protein, 28 aa, Staphylococcus epidermidis
ERRRSKKAQEQKDQIEKDKNKVYDSEED

SEQ ID NO: 1837743 - protein, 5 aa, Staphylococcus epidermidis
ERYAE

SEQ ID NO: 1837744 - protein, 14 aa, Staphylococcus epidermidis
ESDSGKSTLAQSPN

SEQ ID NO: 1837745 - protein, 5 aa, Staphylococcus epidermidis
ESERF

SEQ ID NO: 1837746 - protein, 4 aa, Staphylococcus epidermidis
ESES

SEQ ID NO: 1837747 - protein, 6 aa, Staphylococcus epidermidis
ESFEEK

SEQ ID NO: 1837748 - protein, 6 aa, Staphylococcus epidermidis
ESGLKC

SEQ ID NO: 1837749 - protein, 14 aa, Staphylococcus epidermidis
ESHSETVDVAEDYD

SEQ ID NO: 1837750 - protein, 23 aa, Staphylococcus epidermidis
ESHTKDNHNHTTQHQNDPNLGEQ

SEQ ID NO: 1837751 - protein, 9 aa, Staphylococcus epidermidis
ESIEPGTTH

SEQ ID NO: 1837752 - protein, 7 aa, Staphylococcus epidermidis
ESNDDFR

SEQ ID NO: 1837753 - protein, 11 aa, Staphylococcus epidermidis
ESSKASPYPQG

SEQ ID NO: 1837754 - protein, 60 aa, Staphylococcus epidermidis
ESTNNATQPVQPSQSQVATQQQPVQVSAPQNEQTAQPQTKSTSASQTSSSKASSGSSVNV

SEQ ID NO: 1837755 - protein, 14 aa, Staphylococcus epidermidis
ESWGTGSVASQTKG

SEQ ID NO: 1837756 - protein, 5 aa, Staphylococcus epidermidis
ETDAK

SEQ ID NO: 1837757 - protein, 16 aa, Staphylococcus epidermidis
ETGNGTSQLAKGGDIV

SEQ ID NO: 1837758 - protein, 9 aa, Staphylococcus epidermidis
ETKGKIKPT

SEQ ID NO: 1837759 - protein, 9 aa, Staphylococcus epidermidis
ETNIPKTHK

SEQ ID NO: 1837760 - protein, 8 aa, Staphylococcus epidermidis
ETQNIEAY

SEQ ID NO: 1837761 - protein, 16 aa, Staphylococcus epidermidis
ETRKQTSKDLELNYYE

SEQ ID NO: 1837762 - protein, 7 aa, Staphylococcus epidermidis
ETSYTEL

SEQ ID NO: 1837763 - protein, 20 aa, Staphylococcus epidermidis
ETTDDSKGRPKDDEKKYPVK

SEQ ID NO: 1837764 - protein, 7 aa, Staphylococcus epidermidis
ETTPIVK

SEQ ID NO: 1837765 - protein, 8 aa, Staphylococcus epidermidis
EVENDQYG

SEQ ID NO: 1837766 - protein, 5 aa, Staphylococcus epidermidis
EVQGA

SEQ ID NO: 1837767 - protein, 5 aa, Staphylococcus epidermidis
EWQPG

SEQ ID NO: 1837768 - protein, 65 aa, Staphylococcus epidermidis
EYSQDAKKTEKDYNKSKNTSHTKTSQSDHADKNPQLPTDDELKHQSKPAQSFEDDIKRSNTRSTS

SEQ ID NO: 1837769 - protein, 4 aa, Staphylococcus epidermidis
EYTR

SEQ ID NO: 1837770 - protein, 11 aa, Staphylococcus epidermidis
FAEGDESLDQQ

SEQ ID NO: 1837771 - protein, 17 aa, Staphylococcus epidermidis
FDPVPLKKEKHSSTEHK

SEQ ID NO: 1837772 - protein, 5 aa, Staphylococcus epidermidis
FEANH

SEQ ID NO: 1837773 - protein, 18 aa, Staphylococcus epidermidis
FEKQTGKKFKFSKVRQVK

SEQ ID NO: 1837774 - protein, 29 aa, Staphylococcus epidermidis
FENEASNLDYDRGDYQNSKLSSGDQRVDT

SEQ ID NO: 1837775 - protein, 27 aa, Staphylococcus epidermidis
FENVEDAKAALEETKHVTAGKYNGTDY

SEQ ID NO: 1837776 - protein, 27 aa, Staphylococcus epidermidis
FESIDDAKKALNETKYQTSGKYNGTTY

SEQ ID NO: 1837777 - protein, 6 aa, Staphylococcus epidermidis
FGDNAK

SEQ ID NO: 1837778 - protein, 13 aa, Staphylococcus epidermidis
FGRESYDDKGSPI

SEQ ID NO: 1837779 - protein, 8 aa, Staphylococcus epidermidis
FGRKNSRV

SEQ ID NO: 1837780 - protein, 9 aa, Staphylococcus epidermidis
FKEETPQEI

SEQ ID NO: 1837781 - protein, 4 aa, Staphylococcus epidermidis
FKEI

SEQ ID NO: 1837782 - protein, 7 aa, Staphylococcus epidermidis
FKKDGYD

SEQ ID NO: 1837783 - protein, 16 aa, Staphylococcus epidermidis
FKNSSKITKDTNDVAE

SEQ ID NO: 1837784 - protein, 29 aa, Staphylococcus epidermidis
FKRQPEADSVSGKTNDKHKKWAKNLTGEK

SEQ ID NO: 1837785 - protein, 29 aa, Staphylococcus epidermidis
FNDDTSKKMQDIKGVKESIKENDEGLVET

SEQ ID NO: 1837786 - protein, 20 aa, Staphylococcus epidermidis
FNGKDRATMSWTEGAPDNMI

SEQ ID NO: 1837787 - protein, 67 aa, Staphylococcus epidermidis
FNNDTKAHSSNKNQVSNKKDNKDKKTKKRTDNSNDNVQQDLNNNQSAESSTQTTTNQTNSEEDPNNV

SEQ ID NO: 1837788 - protein, 27 aa, Staphylococcus epidermidis
FNPQNEKVAKKFGEQYGTTAEKAVYNG

SEQ ID NO: 1837789 - protein, 4 aa, Staphylococcus epidermidis
FNTK

SEQ ID NO: 1837790 - protein, 12 aa, Staphylococcus epidermidis
FPPYDGSPLATE

SEQ ID NO: 1837791 - protein, 8 aa, Staphylococcus epidermidis
FPSTDKSF

SEQ ID NO: 1837792 - protein, 15 aa, Staphylococcus epidermidis
FPSWKDKAEKVQRQL

SEQ ID NO: 1837793 - protein, 24 aa, Staphylococcus epidermidis
FQDGRQLTGQAVKESLEEGMKKSD

SEQ ID NO: 1837794 - protein, 11 aa, Staphylococcus epidermidis
FQGSDNRNNAA

SEQ ID NO: 1837795 - protein, 11 aa, Staphylococcus epidermidis
FSEYESKWTPK

SEQ ID NO: 1837796 - protein, 6 aa, Staphylococcus epidermidis
FSKDPQ

SEQ ID NO: 1837797 - protein, 16 aa, Staphylococcus epidermidis
FSKTDKDKDISKPTMK

SEQ ID NO: 1837798 - protein, 7 aa, Staphylococcus epidermidis
FSNAPKG

SEQ ID NO: 1837799 - protein, 13 aa, Staphylococcus epidermidis
FTENNGIVMNKAL

SEQ ID NO: 1837800 - protein, 9 aa, Staphylococcus epidermidis
FTSKSEDLK

SEQ ID NO: 1837801 - protein, 27 aa, Staphylococcus epidermidis
GAESDTANESKVQDIQGNPVSLPNEKP

SEQ ID NO: 1837802 - protein, 9 aa, Staphylococcus epidermidis
GAGPQGNER

SEQ ID NO: 1837803 - protein, 25 aa, Staphylococcus epidermidis
GAKAQHSQLHENKDVANKIIQFLWG

SEQ ID NO: 1837804 - protein, 7 aa, Staphylococcus epidermidis
GAKGNQP

SEQ ID NO: 1837805 - protein, 15 aa, Staphylococcus epidermidis
GANKLSDKSEKVQIN

SEQ ID NO: 1837806 - protein, 9 aa, Staphylococcus epidermidis
GASTGIGRG

SEQ ID NO: 1837807 - protein, 5 aa, Staphylococcus epidermidis
GASVG

SEQ ID NO: 1837808 - protein, 27 aa, Staphylococcus epidermidis
GATSTPTQAHAATQTHQTTNATTQTAY

SEQ ID NO: 1837809 - protein, 12 aa, Staphylococcus epidermidis
GAYKNDKDDPRI

SEQ ID NO: 1837810 - protein, 7 aa, Staphylococcus epidermidis
GDAFQGL

SEQ ID NO: 1837811 - protein, 14 aa, Staphylococcus epidermidis
GDGDLKGSSIGSKS

SEQ ID NO: 1837812 - protein, 13 aa, Staphylococcus epidermidis
GDGDLKGSSVGHR

SEQ ID NO: 1837813 - protein, 10 aa, Staphylococcus epidermidis
GDGKEAEIKQ

SEQ ID NO: 1837814 - protein, 8 aa, Staphylococcus epidermidis
GDKEEQFE

SEQ ID NO: 1837815 - protein, 43 aa, Staphylococcus epidermidis
GDKNDESKNDSSSNSTDSVSVDKNDNEDKTTAKFKNDKLTTDN

SEQ ID NO: 1837816 - protein, 8 aa, Staphylococcus epidermidis
GDKQYKNP

SEQ ID NO: 1837817 - protein, 8 aa, Staphylococcus epidermidis
GDKVTNPV

SEQ ID NO: 1837818 - protein, 10 aa, Staphylococcus epidermidis
GDKVTNPVRY

SEQ ID NO: 1837819 - protein, 6 aa, Staphylococcus epidermidis
GDNPKR

SEQ ID NO: 1837820 - protein, 4 aa, Staphylococcus epidermidis
GDPD

SEQ ID NO: 1837821 - protein, 10 aa, Staphylococcus epidermidis
GDRPEQGQGL

SEQ ID NO: 1837822 - protein, 23 aa, Staphylococcus epidermidis
GDTDAKKVKPTNKVSINKEQALS

SEQ ID NO: 1837823 - protein, 26 aa, Staphylococcus epidermidis
GDTDAKKVQPTNKVSISKENATDKAF

SEQ ID NO: 1837824 - protein, 16 aa, Staphylococcus epidermidis
GDTDIKTSQLEGKDDY

SEQ ID NO: 1837825 - protein, 5 aa, Staphylococcus epidermidis
GDTPL

SEQ ID NO: 1837826 - protein, 7 aa, Staphylococcus epidermidis
GDVEPME

SEQ ID NO: 1837827 - protein, 6 aa, Staphylococcus epidermidis
GDVEPT

SEQ ID NO: 1837828 - protein, 6 aa, Staphylococcus epidermidis
GEAKED

SEQ ID NO: 1837829 - protein, 10 aa, Staphylococcus epidermidis
GEANDKNEMK

SEQ ID NO: 1837830 - protein, 7 aa, Staphylococcus epidermidis
GEGLPNS

SEQ ID NO: 1837831 - protein, 22 aa, Staphylococcus epidermidis
GEINTKKPFYDDNKPIKYGVYR

SEQ ID NO: 1837832 - protein, 11 aa, Staphylococcus epidermidis
GEKQQLEAGTS

SEQ ID NO: 1837833 - protein, 14 aa, Staphylococcus epidermidis
GENDVEKVAKAKPD

SEQ ID NO: 1837834 - protein, 12 aa, Staphylococcus epidermidis
GENGNKSKQDPH

SEQ ID NO: 1837835 - protein, 18 aa, Staphylococcus epidermidis
GENKETLSVTNEAKENLN

SEQ ID NO: 1837836 - protein, 6 aa, Staphylococcus epidermidis
GERLES

SEQ ID NO: 1837837 - protein, 9 aa, Staphylococcus epidermidis
GERNTSLQK

SEQ ID NO: 1837838 - protein, 5 aa, Staphylococcus epidermidis
GESKV

SEQ ID NO: 1837839 - protein, 17 aa, Staphylococcus epidermidis
GETSNYLKSEWYKTKKM

SEQ ID NO: 1837840 - protein, 18 aa, Staphylococcus epidermidis
GFDPVPLKKNKNSKTTHH

SEQ ID NO: 1837841 - protein, 11 aa, Staphylococcus epidermidis
GFTQGSDYDQR

SEQ ID NO: 1837842 - protein, 4 aa, Staphylococcus epidermidis
GGDK

SEQ ID NO: 1837843 - protein, 7 aa, Staphylococcus epidermidis
GGENVIQ

SEQ ID NO: 1837844 - protein, 45 aa, Staphylococcus epidermidis
GGHKDSSESDSSNKSSDSVSVDKSDDSEKTDSKFKNDKLTTKNYD

SEQ ID NO: 1837845 - protein, 4 aa, Staphylococcus epidermidis
GGIG

SEQ ID NO: 1837846 - protein, 4 aa, Staphylococcus epidermidis
GGIN

SEQ ID NO: 1837847 - protein, 7 aa, Staphylococcus epidermidis
GGINPSV

SEQ ID NO: 1837848 - protein, 41 aa, Staphylococcus epidermidis
GGKIGSTWGNANNWANAAAQDGYTVNNKPKQGAVMQTSQGA

SEQ ID NO: 1837849 - protein, 24 aa, Staphylococcus epidermidis
GGLQGNKNNGGSADQSNAHEGNGI

SEQ ID NO: 1837850 - protein, 10 aa, Staphylococcus epidermidis
GGNIEAGTTE

SEQ ID NO: 1837851 - protein, 17 aa, Staphylococcus epidermidis
GGNKELEEKKEHKTLSY

SEQ ID NO: 1837852 - protein, 9 aa, Staphylococcus epidermidis
GGNNDKKVT

SEQ ID NO: 1837853 - protein, 26 aa, Staphylococcus epidermidis
GGNNGGSGSGSDLKGSAKGEGSSTVA

SEQ ID NO: 1837854 - protein, 9 aa, Staphylococcus epidermidis
GGNNGKKVT

SEQ ID NO: 1837855 - protein, 43 aa, Staphylococcus epidermidis
GGQIGSTWGNANNWASAAEASGYTVNHTPEKGSILQSSNGAYG

SEQ ID NO: 1837856 - protein, 92 aa, Staphylococcus epidermidis
GGSAQAAEQQQDKGTVENSTTQSIGDENEKLSEQQSTQNKNVNEKSNVDSITENESLHNETPKNEDLIQQQKDSQNDNKSESVVEQNKENEA

SEQ ID NO: 1837857 - protein, 93 aa, Staphylococcus epidermidis
GGSAQAAEQQQDKGTVENSTTQSIGDKNEKLSEQQSTQNKNVNEKSNVNSITENENLHNETPKNEDLIQQQKDSQNDNKSESVVEQNKKNEAF

SEQ ID NO: 1837858 - protein, 30 aa, Staphylococcus epidermidis
GGSASQSSNSNTSSNSGSVSTHNVKSGESL

SEQ ID NO: 1837859 - protein, 22 aa, Staphylococcus epidermidis
GGSASQSTSSNTSSSSASSHTV

SEQ ID NO: 1837860 - protein, 21 aa, Staphylococcus epidermidis
GGSGEQKEPSKESQKSDKYEY

SEQ ID NO: 1837861 - protein, 5 aa, Staphylococcus epidermidis
GGTDH

SEQ ID NO: 1837862 - protein, 9 aa, Staphylococcus epidermidis
GGTDHTDPH

SEQ ID NO: 1837863 - protein, 10 aa, Staphylococcus epidermidis
GGTDPDPSDL

SEQ ID NO: 1837864 - protein, 9 aa, Staphylococcus epidermidis
GGVDSDKNL

SEQ ID NO: 1837865 - protein, 6 aa, Staphylococcus epidermidis
GHHPAT

SEQ ID NO: 1837866 - protein, 6 aa, Staphylococcus epidermidis
GHPLDT

SEQ ID NO: 1837867 - protein, 11 aa, Staphylococcus epidermidis
GHSSKDGKQVT

SEQ ID NO: 1837868 - protein, 5 aa, Staphylococcus epidermidis
GHTVR

SEQ ID NO: 1837869 - protein, 9 aa, Staphylococcus epidermidis
GIDKPGRTH

SEQ ID NO: 1837870 - protein, 10 aa, Staphylococcus epidermidis
GIDKSQAKEI

SEQ ID NO: 1837871 - protein, 5 aa, Staphylococcus epidermidis
GIDQS

SEQ ID NO: 1837872 - protein, 13 aa, Staphylococcus epidermidis
GIGGDKLGTKEYD

SEQ ID NO: 1837873 - protein, 14 aa, Staphylococcus epidermidis
GIKPTLADDNEGIG

SEQ ID NO: 1837874 - protein, 6 aa, Staphylococcus epidermidis
GIQTPL

SEQ ID NO: 1837875 - protein, 10 aa, Staphylococcus epidermidis
GISDSTEKTV

SEQ ID NO: 1837876 - protein, 15 aa, Staphylococcus epidermidis
GISFSRQTAKPQHRT

SEQ ID NO: 1837877 - protein, 10 aa, Staphylococcus epidermidis
GITKDEAKQM

SEQ ID NO: 1837878 - protein, 9 aa, Staphylococcus epidermidis
GKAPEKEWR

SEQ ID NO: 1837879 - protein, 25 aa, Staphylococcus epidermidis
GKASYQFSSESPKDKNVKLYRIDIA

SEQ ID NO: 1837880 - protein, 12 aa, Staphylococcus epidermidis
GKATEKEWREND

SEQ ID NO: 1837881 - protein, 16 aa, Staphylococcus epidermidis
GKDGHQQSSDHKGKLD

SEQ ID NO: 1837882 - protein, 9 aa, Staphylococcus epidermidis
GKEDEVKKW

SEQ ID NO: 1837883 - protein, 10 aa, Staphylococcus epidermidis
GKEDNATSDE

SEQ ID NO: 1837884 - protein, 11 aa, Staphylococcus epidermidis
GKFSDKTKTKY

SEQ ID NO: 1837885 - protein, 7 aa, Staphylococcus epidermidis
GKGMPNS

SEQ ID NO: 1837886 - protein, 18 aa, Staphylococcus epidermidis
GKIENDSTIVNGREQSKI

SEQ ID NO: 1837887 - protein, 28 aa, Staphylococcus epidermidis
GKKAHYKENFNSKGYYQSHEPDYKEENM

SEQ ID NO: 1837888 - protein, 14 aa, Staphylococcus epidermidis
GKKIGNTDEPENYS

SEQ ID NO: 1837889 - protein, 9 aa, Staphylococcus epidermidis
GKKQEEPYL

SEQ ID NO: 1837890 - protein, 10 aa, Staphylococcus epidermidis
GKLQPTSDAM

SEQ ID NO: 1837891 - protein, 9 aa, Staphylococcus epidermidis
GKNARYSLK

SEQ ID NO: 1837892 - protein, 9 aa, Staphylococcus epidermidis
GKNDGDEIV

SEQ ID NO: 1837893 - protein, 6 aa, Staphylococcus epidermidis
GKPALD

SEQ ID NO: 1837894 - protein, 27 aa, Staphylococcus epidermidis
GKPTSYKKLPERYKNVPEVGQPMEPSV

SEQ ID NO: 1837895 - protein, 8 aa, Staphylococcus epidermidis
GKREEGIS

SEQ ID NO: 1837896 - protein, 4 aa, Staphylococcus epidermidis
GKRY

SEQ ID NO: 1837897 - protein, 15 aa, Staphylococcus epidermidis
GKSDKSKETRREKVR

SEQ ID NO: 1837898 - protein, 120 aa, Staphylococcus epidermidis
GKSNEKASLEKSIDQLKKENKDLKKQKKKLQEQKDKLKHKQDSLQEDVNELPAKSTSRDKKNKDNHDAKEKSSNNQSTSANHDDQTNKIKSNQDEHDGQSSKPHTQQKPSEDNRKNNHRQ

SEQ ID NO: 1837899 - protein, 47 aa, Staphylococcus epidermidis
GKSNEKASLEKSINQLEKENKDLKKQKKDLQTQKDKLKDKQDRLQKD

SEQ ID NO: 1837900 - protein, 18 aa, Staphylococcus epidermidis
GKSYNGQHDGQKVKKGTH

SEQ ID NO: 1837901 - protein, 20 aa, Staphylococcus epidermidis
GKTYKYNDYSDHYPLSAYAS

SEQ ID NO: 1837902 - protein, 8 aa, Staphylococcus epidermidis
GKVDYGAA

SEQ ID NO: 1837903 - protein, 7 aa, Staphylococcus epidermidis
GKYSMTA

SEQ ID NO: 1837904 - protein, 12 aa, Staphylococcus epidermidis
GLGPTKDDLTKH

SEQ ID NO: 1837905 - protein, 10 aa, Staphylococcus epidermidis
GLKNKENPDL

SEQ ID NO: 1837906 - protein, 16 aa, Staphylococcus epidermidis
GLNGTTKDIESNPKDL

SEQ ID NO: 1837907 - protein, 7 aa, Staphylococcus epidermidis
GLPQATD

SEQ ID NO: 1837908 - protein, 21 aa, Staphylococcus epidermidis
GLQGNKSNGGGIVNLIKKLFH

SEQ ID NO: 1837909 - protein, 5 aa, Staphylococcus epidermidis
GMPDE

SEQ ID NO: 1837910 - protein, 40 aa, Staphylococcus epidermidis
GNAGHDAHASEATNVDKAELAQKAQSNDQSLNESPIQEGA

SEQ ID NO: 1837911 - protein, 9 aa, Staphylococcus epidermidis
GNANEMPDS

SEQ ID NO: 1837912 - protein, 13 aa, Staphylococcus epidermidis
GNDDNKKQDGKVT

SEQ ID NO: 1837913 - protein, 16 aa, Staphylococcus epidermidis
GNDKSGNSYDSKKNSD

SEQ ID NO: 1837914 - protein, 10 aa, Staphylococcus epidermidis
GNDQKEDKNI

SEQ ID NO: 1837915 - protein, 15 aa, Staphylococcus epidermidis
GNEGQHKQNKTQEKY

SEQ ID NO: 1837916 - protein, 12 aa, Staphylococcus epidermidis
GNGSDSDKDVAD

SEQ ID NO: 1837917 - protein, 5 aa, Staphylococcus epidermidis
GNHDL

SEQ ID NO: 1837918 - protein, 11 aa, Staphylococcus epidermidis
GNHSKTDKDTL

SEQ ID NO: 1837919 - protein, 89 aa, Staphylococcus epidermidis
GNKDTSSTKDDKKSESTPKKEKSHNTKKSDKTKTDTKKQNSNDTVKNESQSANKKNNPKSQDAKRNSERVDGKDVNKNKDNSNPSDNGN

SEQ ID NO: 1837920 - protein, 7 aa, Staphylococcus epidermidis
GNLTDAQ

SEQ ID NO: 1837921 - protein, 39 aa, Staphylococcus epidermidis
GNNDSDKNSSSSNNNSSNSSNKKELNEATKKYEKYTDGQ

SEQ ID NO: 1837922 - protein, 30 aa, Staphylococcus epidermidis
GNNDSSSNKDGKSSSKDDNTLRVGTEGTYA

SEQ ID NO: 1837923 - protein, 93 aa, Staphylococcus epidermidis
GNNGTSNNDSDTKSEKKTEKKSENKKDKKSKEDKKSKEEKKSQENKDNSNEEQNTQETATNEQNSSNQDDNYSNTNQNEQSDEENEYPYTAQQ

SEQ ID NO: 1837924 - protein, 36 aa, Staphylococcus epidermidis
GNNSDSGSKDSDKKAETKSYKTDDGKTIKVPKNPKR

SEQ ID NO: 1837925 - protein, 4 aa, Staphylococcus epidermidis
GNPD

SEQ ID NO: 1837926 - protein, 13 aa, Staphylococcus epidermidis
GNQSNHEHHSHEG

SEQ ID NO: 1837927 - protein, 26 aa, Staphylococcus epidermidis
GNSSSLDNNKKSSDSKSSSDGYKPKE

SEQ ID NO: 1837928 - protein, 27 aa, Staphylococcus epidermidis
GNSSSLNNNKSSDSGSDSKSGSYTPKE

SEQ ID NO: 1837929 - protein, 16 aa, Staphylococcus epidermidis
GNTEIKTSQLKGKDDY

SEQ ID NO: 1837930 - protein, 5 aa, Staphylococcus epidermidis
GNTFT

SEQ ID NO: 1837931 - protein, 8 aa, Staphylococcus epidermidis
GNTKNPKN

SEQ ID NO: 1837932 - protein, 8 aa, Staphylococcus epidermidis
GNYNGQSV

SEQ ID NO: 1837933 - protein, 5 aa, Staphylococcus epidermidis
GPDNL

SEQ ID NO: 1837934 - protein, 20 aa, Staphylococcus epidermidis
GPSAPEKYKNQGKTQSTSKD

SEQ ID NO: 1837935 - protein, 11 aa, Staphylococcus epidermidis
GQATGNESNDL

SEQ ID NO: 1837936 - protein, 98 aa, Staphylococcus epidermidis
GQDGDKSNKDDNKKSESKSAKKSNDPKKNKDKKSEDNKKKDSNKDKGQPSEDTQQNEQSNEQQTQQNNTQNNSNQINQQQNNQQAQQSNSKEPTKEEI

SEQ ID NO: 1837937 - protein, 17 aa, Staphylococcus epidermidis
GQDPHEYEVKPKDIKAL

SEQ ID NO: 1837938 - protein, 13 aa, Staphylococcus epidermidis
GQDSSDTVRTREE

SEQ ID NO: 1837939 - protein, 34 aa, Staphylococcus epidermidis
GQEEWANANQSQKEEIRKQDAEKYGYEYDPKNYE

SEQ ID NO: 1837940 - protein, 9 aa, Staphylococcus epidermidis
GQGKTMDDA

SEQ ID NO: 1837941 - protein, 12 aa, Staphylococcus epidermidis
GQHKKDEYAEFN

SEQ ID NO: 1837942 - protein, 7 aa, Staphylococcus epidermidis
GQIENPR

SEQ ID NO: 1837943 - protein, 108 aa, Staphylococcus epidermidis
GQNGDNSNKDDNKKSESKSDKKSNGPKKSDSKNKSNKNTNDDKQQASSDDINNDTTSNKSESTSKNDNGKSQDNNGNNERTQGKQVQTAQSNNQQSEQQDLNSPSYQE

SEQ ID NO: 1837944 - protein, 58 aa, Staphylococcus epidermidis
GQNSNETSHNNNQKTEKKSNTNETSNNQNSNKNKSDNSNETQSSNEQVEHSDKTITVA

SEQ ID NO: 1837945 - protein, 25 aa, Staphylococcus epidermidis
GRSDEDKERHVQHAKESTLYKGPYD

SEQ ID NO: 1837946 - protein, 9 aa, Staphylococcus epidermidis
GSDEFAPNS

SEQ ID NO: 1837947 - protein, 4 aa, Staphylococcus epidermidis
GSHD

SEQ ID NO: 1837948 - protein, 15 aa, Staphylococcus epidermidis
GSKEIKNYSVTDQEF

SEQ ID NO: 1837949 - protein, 14 aa, Staphylococcus epidermidis
GSKYFGKENGHLDK

SEQ ID NO: 1837950 - protein, 11 aa, Staphylococcus epidermidis
GSLIKQDGKVI

SEQ ID NO: 1837951 - protein, 34 aa, Staphylococcus epidermidis
GSNGSNDSNNKSASKDGVEIKHEEGKTKVPKHPK

SEQ ID NO: 1837952 - protein, 17 aa, Staphylococcus epidermidis
GSNNHAIDQGESGVNNN

SEQ ID NO: 1837953 - protein, 13 aa, Staphylococcus epidermidis
GSSAPTSNTPGAF

SEQ ID NO: 1837954 - protein, 7 aa, Staphylococcus epidermidis
GSSFNIG

SEQ ID NO: 1837955 - protein, 8 aa, Staphylococcus epidermidis
GSVIPNTT

SEQ ID NO: 1837956 - protein, 7 aa, Staphylococcus epidermidis
GTDTLEE

SEQ ID NO: 1837957 - protein, 12 aa, Staphylococcus epidermidis
GTGDLKESSVGY

SEQ ID NO: 1837958 - protein, 7 aa, Staphylococcus epidermidis
GTHPNSK

SEQ ID NO: 1837959 - protein, 8 aa, Staphylococcus epidermidis
GTHPNSQF

SEQ ID NO: 1837960 - protein, 4 aa, Staphylococcus epidermidis
GTLA

SEQ ID NO: 1837961 - protein, 7 aa, Staphylococcus epidermidis
GTLAESI

SEQ ID NO: 1837962 - protein, 8 aa, Staphylococcus epidermidis
GTLPTDNI

SEQ ID NO: 1837963 - protein, 10 aa, Staphylococcus epidermidis
GTPGDSVQYK

SEQ ID NO: 1837964 - protein, 20 aa, Staphylococcus epidermidis
GTPKQVASKVSGTGNQTFKA

SEQ ID NO: 1837965 - protein, 16 aa, Staphylococcus epidermidis
GTPSGKYKNDPAGTMY

SEQ ID NO: 1837966 - protein, 27 aa, Staphylococcus epidermidis
GTPSQVASKVSGSGNQTFKATKQQQID

SEQ ID NO: 1837967 - protein, 10 aa, Staphylococcus epidermidis
GTQSSGTYQQ

SEQ ID NO: 1837968 - protein, 7 aa, Staphylococcus epidermidis
GTSPDGR

SEQ ID NO: 1837969 - protein, 4 aa, Staphylococcus epidermidis
GVEK

SEQ ID NO: 1837970 - protein, 18 aa, Staphylococcus epidermidis
GVLEGQGAAFSEAAKKYG

SEQ ID NO: 1837971 - protein, 18 aa, Staphylococcus epidermidis
GVNKDREKKYKFSDPYTY

SEQ ID NO: 1837972 - protein, 9 aa, Staphylococcus epidermidis
GVPFQNDSS

SEQ ID NO: 1837973 - protein, 10 aa, Staphylococcus epidermidis
GVTKTGHSAN

SEQ ID NO: 1837974 - protein, 18 aa, Staphylococcus epidermidis
GVTKVGDDDVEKVAKQKP

SEQ ID NO: 1837975 - protein, 7 aa, Staphylococcus epidermidis
GVTQETA

SEQ ID NO: 1837976 - protein, 8 aa, Staphylococcus epidermidis
GVVDGKTD

SEQ ID NO: 1837977 - protein, 7 aa, Staphylococcus epidermidis
GYAGNNA

SEQ ID NO: 1837978 - protein, 18 aa, Staphylococcus epidermidis
GYASGTGPITGKGNYWGG

SEQ ID NO: 1837979 - protein, 22 aa, Staphylococcus epidermidis
GYDEQGDGKKITYTATKKLKTN

SEQ ID NO: 1837980 - protein, 9 aa, Staphylococcus epidermidis
GYEPNSTIN

SEQ ID NO: 1837981 - protein, 18 aa, Staphylococcus epidermidis
GYKDKDGDGFREDPKGKP

SEQ ID NO: 1837982 - protein, 9 aa, Staphylococcus epidermidis
GYQDSKNVK

SEQ ID NO: 1837983 - protein, 8 aa, Staphylococcus epidermidis
GYQGAPEG

SEQ ID NO: 1837984 - protein, 9 aa, Staphylococcus epidermidis
GYSTDGRIA

SEQ ID NO: 1837985 - protein, 11 aa, Staphylococcus epidermidis
GYTADNGPALA

SEQ ID NO: 1837986 - protein, 5 aa, Staphylococcus epidermidis
HAEDL

SEQ ID NO: 1837987 - protein, 19 aa, Staphylococcus epidermidis
HAKESSNNQSTSEKGTMGY

SEQ ID NO: 1837988 - protein, 18 aa, Staphylococcus epidermidis
HANGPTYKSVKDTFGNKA

SEQ ID NO: 1837989 - protein, 33 aa, Staphylococcus epidermidis
HAQAAEMTQSSSDSNEQSQQTEQVEQKEDTTHL

SEQ ID NO: 1837990 - protein, 10 aa, Staphylococcus epidermidis
HDDEKGRESV

SEQ ID NO: 1837991 - protein, 5 aa, Staphylococcus epidermidis
HDQKA

SEQ ID NO: 1837992 - protein, 23 aa, Staphylococcus epidermidis
HDSNQSSDKDSASTKNDDNKTKY

SEQ ID NO: 1837993 - protein, 13 aa, Staphylococcus epidermidis
HEAHASEATNVDQ

SEQ ID NO: 1837994 - protein, 6 aa, Staphylococcus epidermidis
HEAKAV

SEQ ID NO: 1837995 - protein, 8 aa, Staphylococcus epidermidis
HEDGNTRV

SEQ ID NO: 1837996 - protein, 12 aa, Staphylococcus epidermidis
HEGYTDTKDSNF

SEQ ID NO: 1837997 - protein, 6 aa, Staphylococcus epidermidis
HEKDFG

SEQ ID NO: 1837998 - protein, 9 aa, Staphylococcus epidermidis
HEKKNSVDA

SEQ ID NO: 1837999 - protein, 31 aa, Staphylococcus epidermidis
HEQTKKQNNSGQDSQQNEEEASQENTENVEN

SEQ ID NO: 1838000 - protein, 8 aa, Staphylococcus epidermidis
HGASGTEE

SEQ ID NO: 1838001 - protein, 13 aa, Staphylococcus epidermidis
HGDLKGSSVGSKS

SEQ ID NO: 1838002 - protein, 11 aa, Staphylococcus epidermidis
HGEEHEGHEEH

SEQ ID NO: 1838003 - protein, 7 aa, Staphylococcus epidermidis
HGKTEYA

SEQ ID NO: 1838004 - protein, 18 aa, Staphylococcus epidermidis
HGNPEEVEYQKEHGGTIS

SEQ ID NO: 1838005 - protein, 15 aa, Staphylococcus epidermidis
HHDERKKLNSSQGKN

SEQ ID NO: 1838006 - protein, 12 aa, Staphylococcus epidermidis
HIPEEYKNPTDR

SEQ ID NO: 1838007 - protein, 6 aa, Staphylococcus epidermidis
HIPKNE

SEQ ID NO: 1838008 - protein, 23 aa, Staphylococcus epidermidis
HKANAETMQEVDKETQQRKKLGN

SEQ ID NO: 1838009 - protein, 30 aa, Staphylococcus epidermidis
HKEAKHSSQSIPEEVPASQYKGQGFQPVAE

SEQ ID NO: 1838010 - protein, 18 aa, Staphylococcus epidermidis
HKGQLSAYNYSDGSGQYS

SEQ ID NO: 1838011 - protein, 8 aa, Staphylococcus epidermidis
HKIGQKEN

SEQ ID NO: 1838012 - protein, 147 aa, Staphylococcus epidermidis
HKNNSSQSDKDSQKTEEKHKKKDKSNDNNQQNNENSNMTNSQENAQSEPANSGSYNGDQSTNSSNNTTKQPNNNQYQNNTHQSNTNNNASSNQSGQGSAPSNQNNNHSQQNTTRPSTSEKPNNQQSSPQNSGSQNNNQQNNNAQNKH

SEQ ID NO: 1838013 - protein, 5 aa, Staphylococcus epidermidis
HKSLE

SEQ ID NO: 1838014 - protein, 35 aa, Staphylococcus epidermidis
HKVATKEQSNRSTTRETQKQSANSNRNHQSTHQAQ

SEQ ID NO: 1838015 - protein, 80 aa, Staphylococcus epidermidis
HNENNENDKKDNNSKTEHKDKKSDSNSKDKSKNHQKSQEQNDKNSKSNDNGDNNQASSSNQANNGDHSQTGKDNSNHKDY

SEQ ID NO: 1838016 - protein, 9 aa, Staphylococcus epidermidis
HNNSVEQQE

SEQ ID NO: 1838017 - protein, 8 aa, Staphylococcus epidermidis
HNRAPKAE

SEQ ID NO: 1838018 - protein, 6 aa, Staphylococcus epidermidis
HNSSDI

SEQ ID NO: 1838019 - protein, 17 aa, Staphylococcus epidermidis
HPEYANKKYKNAKVPTL

SEQ ID NO: 1838020 - protein, 4 aa, Staphylococcus epidermidis
HPFN

SEQ ID NO: 1838021 - protein, 68 aa, Staphylococcus epidermidis
HQANAAEQPQDQSNHKNVLDDQTALKQAEKAKSEVTQSTTNVSGTQTYQDPTQVQPEQDTQSTTYDAS

SEQ ID NO: 1838022 - protein, 12 aa, Staphylococcus epidermidis
HQLDGEGGIQDD

SEQ ID NO: 1838023 - protein, 4 aa, Staphylococcus epidermidis
HQPA

SEQ ID NO: 1838024 - protein, 41 aa, Staphylococcus epidermidis
HQSESHNDKNESKTAHTNQAQNNDNNQKKHQKVVKNGRTYA

SEQ ID NO: 1838025 - protein, 7 aa, Staphylococcus epidermidis
HRKDSKD

SEQ ID NO: 1838026 - protein, 5 aa, Staphylococcus epidermidis
HRKTE

SEQ ID NO: 1838027 - protein, 9 aa, Staphylococcus epidermidis
HSKVSKNAP

SEQ ID NO: 1838028 - protein, 10 aa, Staphylococcus epidermidis
HSNKYSQNLE

SEQ ID NO: 1838029 - protein, 10 aa, Staphylococcus epidermidis
HSYEPTQKDI

SEQ ID NO: 1838030 - protein, 8 aa, Staphylococcus epidermidis
HTGTSVNN

SEQ ID NO: 1838031 - protein, 19 aa, Staphylococcus epidermidis
HTHSSSNHVVPNNSQKYRI

SEQ ID NO: 1838032 - protein, 138 aa, Staphylococcus epidermidis
HTNSNKNDKKIEHNRKNKQNDTSNQNRDTNQHQDQTQPTNNDYNNDNQSGTEQPAQQPNYHQYPNNNQQSGSNKNNSSENNKQKPNQNKTNQSDHQPAQSTPQQSSQHNNQSDSQQNGNSNNNSNNQNHGTNDNQNKN

SEQ ID NO: 1838033 - protein, 138 aa, Staphylococcus epidermidis
HTNSNKNDKKIEHNRKNKQNDTSNQNRDTNQHQDQTQPTNNDYNNDNQSGTEQPAQQPNYHQYPNNNQQSGSNKNNSSENNKQKPNQNKTNQSYHQPAQSTPQQSSQHNNQSDSQQNGNSNNNSNNQNHGTNDKQNKN

SEQ ID NO: 1838034 - protein, 139 aa, Staphylococcus epidermidis
HTNSNKNDKKIEHNRKNKQNNTSNQNRDTHQQQDQTQPTNGDYNNDNQSGTEQPAQQPNYHQYPNHNQQSGSNKNNSSVNNKQKPNQNKTNQSDHQPAQSIPQQSSQPNHNQSDSQQNGNSNNNSNNQNHGTNDNQKQN

SEQ ID NO: 1838035 - protein, 19 aa, Staphylococcus epidermidis
HTNSNKNDKKNRTQSQKQT

SEQ ID NO: 1838036 - protein, 14 aa, Staphylococcus epidermidis
HYDKGQEKQQGREH

SEQ ID NO: 1838037 - protein, 61 aa, Staphylococcus epidermidis
HYKDSKANTDVSSKETQTSNKNTHEDTISQDEMQNQVDNQTNEVSNETSTKTLSEKAKRLR

SEQ ID NO: 1838038 - protein, 5 aa, Staphylococcus epidermidis
HYNDP

SEQ ID NO: 1838039 - protein, 5 aa, Staphylococcus epidermidis
IAKDN

SEQ ID NO: 1838040 - protein, 18 aa, Staphylococcus epidermidis
IAKDVSKNYAKPASGPFN

SEQ ID NO: 1838041 - protein, 29 aa, Staphylococcus epidermidis
IAKEGSSVKKASKLADTDKNVNGKEQKQI

SEQ ID NO: 1838042 - protein, 18 aa, Staphylococcus epidermidis
IAKNISKNYAEPASGPFN

SEQ ID NO: 1838043 - protein, 18 aa, Staphylococcus epidermidis
IAKNVSKNYADPASGPFN

SEQ ID NO: 1838044 - protein, 4 aa, Staphylococcus epidermidis
IANV

SEQ ID NO: 1838045 - protein, 12 aa, Staphylococcus epidermidis
IASGKDPEKVIN

SEQ ID NO: 1838046 - protein, 8 aa, Staphylococcus epidermidis
IDAVQQNK

SEQ ID NO: 1838047 - protein, 12 aa, Staphylococcus epidermidis
IDGNPDIYKPTW

SEQ ID NO: 1838048 - protein, 7 aa, Staphylococcus epidermidis
IDGVSNK

SEQ ID NO: 1838049 - protein, 7 aa, Staphylococcus epidermidis
IDKEKEK

SEQ ID NO: 1838050 - protein, 14 aa, Staphylococcus epidermidis
IDKEQQQNINSDDD

SEQ ID NO: 1838051 - protein, 5 aa, Staphylococcus epidermidis
IDKPE

SEQ ID NO: 1838052 - protein, 7 aa, Staphylococcus epidermidis
IDKRTGE

SEQ ID NO: 1838053 - protein, 13 aa, Staphylococcus epidermidis
IDNDDSNMQLVKE

SEQ ID NO: 1838054 - protein, 8 aa, Staphylococcus epidermidis
IDNRLKSE

SEQ ID NO: 1838055 - protein, 6 aa, Staphylococcus epidermidis
IDPGKK

SEQ ID NO: 1838056 - protein, 6 aa, Staphylococcus epidermidis
IDPKTY

SEQ ID NO: 1838057 - protein, 11 aa, Staphylococcus epidermidis
IDQDNDDNVEY

SEQ ID NO: 1838058 - protein, 7 aa, Staphylococcus epidermidis
IDQEGNY

SEQ ID NO: 1838059 - protein, 4 aa, Staphylococcus epidermidis
IDSE

SEQ ID NO: 1838060 - protein, 7 aa, Staphylococcus epidermidis
IDSEGPV

SEQ ID NO: 1838061 - protein, 7 aa, Staphylococcus epidermidis
IDTPDHI

SEQ ID NO: 1838062 - protein, 4 aa, Staphylococcus epidermidis
IDYD

SEQ ID NO: 1838063 - protein, 21 aa, Staphylococcus epidermidis
IEDGDSRDSAVQSGSVDISGG

SEQ ID NO: 1838064 - protein, 21 aa, Staphylococcus epidermidis
IEDGDSRNSAIQSGSVDISGG

SEQ ID NO: 1838065 - protein, 46 aa, Staphylococcus epidermidis
IEETKGDINDPKATAQLKGQVTNYKNGVANRGKATIAAKAGAKALR

SEQ ID NO: 1838066 - protein, 13 aa, Staphylococcus epidermidis
IEGPGDKPLTEDF

SEQ ID NO: 1838067 - protein, 15 aa, Staphylococcus epidermidis
IENGKTLKVPEKPKR

SEQ ID NO: 1838068 - protein, 7 aa, Staphylococcus epidermidis
IENTQRD

SEQ ID NO: 1838069 - protein, 6 aa, Staphylococcus epidermidis
IEPNHP

SEQ ID NO: 1838070 - protein, 4 aa, Staphylococcus epidermidis
IEPT

SEQ ID NO: 1838071 - protein, 13 aa, Staphylococcus epidermidis
IERTGSTMDTTTN

SEQ ID NO: 1838072 - protein, 7 aa, Staphylococcus epidermidis
IETEEYA

SEQ ID NO: 1838073 - protein, 4 aa, Staphylococcus epidermidis
IGER

SEQ ID NO: 1838074 - protein, 8 aa, Staphylococcus epidermidis
IGKDKAQQ

SEQ ID NO: 1838075 - protein, 8 aa, Staphylococcus epidermidis
IGKGKAAF

SEQ ID NO: 1838076 - protein, 10 aa, Staphylococcus epidermidis
IGKGTYENGY

SEQ ID NO: 1838077 - protein, 17 aa, Staphylococcus epidermidis
IGNYTSVGARKQPNLEE

SEQ ID NO: 1838078 - protein, 13 aa, Staphylococcus epidermidis
IGSDKDLYQLTKV

SEQ ID NO: 1838079 - protein, 68 aa, Staphylococcus epidermidis
IGTNQDNKEDDDKNSKHKSENKQTKSNDTKNNDNQQPQTDTQNSQSQQREHQLGQKKNQISGQKAKEI

SEQ ID NO: 1838080 - protein, 10 aa, Staphylococcus epidermidis
IHKTQNVGYQ

SEQ ID NO: 1838081 - protein, 6 aa, Staphylococcus epidermidis
IIGSRA

SEQ ID NO: 1838082 - protein, 9 aa, Staphylococcus epidermidis
IKAMKKNGI

SEQ ID NO: 1838083 - protein, 7 aa, Staphylococcus epidermidis
IKDSKAK

SEQ ID NO: 1838084 - protein, 7 aa, Staphylococcus epidermidis
IKEENSK

SEQ ID NO: 1838085 - protein, 14 aa, Staphylococcus epidermidis
IKEKYKAHDAYAKA

SEQ ID NO: 1838086 - protein, 12 aa, Staphylococcus epidermidis
IKGNAEQNKSAF

SEQ ID NO: 1838087 - protein, 8 aa, Staphylococcus epidermidis
IKNKTQLY

SEQ ID NO: 1838088 - protein, 7 aa, Staphylococcus epidermidis
IKPNELT

SEQ ID NO: 1838089 - protein, 11 aa, Staphylococcus epidermidis
IKSKHKDNSEY

SEQ ID NO: 1838090 - protein, 9 aa, Staphylococcus epidermidis
IKSNTDDLN

SEQ ID NO: 1838091 - protein, 13 aa, Staphylococcus epidermidis
IKTDDGKIDKKAY

SEQ ID NO: 1838092 - protein, 8 aa, Staphylococcus epidermidis
IKTNDGDL

SEQ ID NO: 1838093 - protein, 18 aa, Staphylococcus epidermidis
INGETSDKVAERRTSGDY

SEQ ID NO: 1838094 - protein, 5 aa, Staphylococcus epidermidis
INGQH

SEQ ID NO: 1838095 - protein, 36 aa, Staphylococcus epidermidis
INGSGNGNSGGWKKPGYWSKSSVKKTWSGNKAFYDH

SEQ ID NO: 1838096 - protein, 24 aa, Staphylococcus epidermidis
INRNPDLPQNPQAQERIGATKVAK

SEQ ID NO: 1838097 - protein, 16 aa, Staphylococcus epidermidis
INTQNIVSNKDSFGIT

SEQ ID NO: 1838098 - protein, 12 aa, Staphylococcus epidermidis
IPEGEERPLPTT

SEQ ID NO: 1838099 - protein, 16 aa, Staphylococcus epidermidis
IPHTSSNADQPDDGTY

SEQ ID NO: 1838100 - protein, 6 aa, Staphylococcus epidermidis
IPKDTS

SEQ ID NO: 1838101 - protein, 24 aa, Staphylococcus epidermidis
IQGTDDRNGVMKQTKSELDDGQLD

SEQ ID NO: 1838102 - protein, 22 aa, Staphylococcus epidermidis
IQKPINDASHTGWTTNGHTGVD

SEQ ID NO: 1838103 - protein, 8 aa, Staphylococcus epidermidis
IQNDNGDI

SEQ ID NO: 1838104 - protein, 12 aa, Staphylococcus epidermidis
IQNSTDAQATPY

SEQ ID NO: 1838105 - protein, 12 aa, Staphylococcus epidermidis
IQSNKDVQARPY

SEQ ID NO: 1838106 - protein, 8 aa, Staphylococcus epidermidis
IRKEPSIP

SEQ ID NO: 1838107 - protein, 9 aa, Staphylococcus epidermidis
IRPRNDATV

SEQ ID NO: 1838108 - protein, 8 aa, Staphylococcus epidermidis
ISDDGQTY

SEQ ID NO: 1838109 - protein, 10 aa, Staphylococcus epidermidis
ISDDQQVQQF

SEQ ID NO: 1838110 - protein, 13 aa, Staphylococcus epidermidis
ISDLNSSKSFGKS

SEQ ID NO: 1838111 - protein, 16 aa, Staphylococcus epidermidis
ISKGNIDGDHINSGYY

SEQ ID NO: 1838112 - protein, 12 aa, Staphylococcus epidermidis
ISKNEKDELRKA

SEQ ID NO: 1838113 - protein, 12 aa, Staphylococcus epidermidis
ISKNEKDTLRKA

SEQ ID NO: 1838114 - protein, 7 aa, Staphylococcus epidermidis
ISNPQEV

SEQ ID NO: 1838115 - protein, 79 aa, Staphylococcus epidermidis
ISNYEQPDTQSNHSTTTSQNDSNSNASSTSNDTSAPKQNTTSNGKTEDKSSSQSKTQSQHNSNSASNVESDDSKVSDAL

SEQ ID NO: 1838116 - protein, 33 aa, Staphylococcus epidermidis
ISQHSKDKIKKDYKTKDSESWKAADKDKQIGKE

SEQ ID NO: 1838117 - protein, 9 aa, Staphylococcus epidermidis
ISQSQSKMS

SEQ ID NO: 1838118 - protein, 29 aa, Staphylococcus epidermidis
ISTSDNKGKGFSMKKTEKKMKKDGFKEKE

SEQ ID NO: 1838119 - protein, 12 aa, Staphylococcus epidermidis
ISVTSSDHTQFT

SEQ ID NO: 1838120 - protein, 66 aa, Staphylococcus epidermidis
ITDYEQPQKTNHSSNDEKDQVDQEDQTKQPSQHQNHSQSSAKQDQEPSNDEKEKTTNHQDDSDVSD

SEQ ID NO: 1838121 - protein, 6 aa, Staphylococcus epidermidis
ITGSGP

SEQ ID NO: 1838122 - protein, 12 aa, Staphylococcus epidermidis
ITPNPYSKGTTY

SEQ ID NO: 1838123 - protein, 12 aa, Staphylococcus epidermidis
ITTGSAGTHADG

SEQ ID NO: 1838124 - protein, 10 aa, Staphylococcus epidermidis
ITTNPYSKSV

SEQ ID NO: 1838125 - protein, 10 aa, Staphylococcus epidermidis
IVHESQTDYP

SEQ ID NO: 1838126 - protein, 10 aa, Staphylococcus epidermidis
IYGSRDDLQS

SEQ ID NO: 1838127 - protein, 12 aa, Staphylococcus epidermidis
IYNGGGIKEGPY

SEQ ID NO: 1838128 - protein, 9 aa, Staphylococcus epidermidis
IYPNGERED

SEQ ID NO: 1838129 - protein, 8 aa, Staphylococcus epidermidis
KAAAKAGF

SEQ ID NO: 1838130 - protein, 10 aa, Staphylococcus epidermidis
KAADNKEDWD

SEQ ID NO: 1838131 - protein, 9 aa, Staphylococcus epidermidis
KAAKKGSKV

SEQ ID NO: 1838132 - protein, 4 aa, Staphylococcus epidermidis
KAEN

SEQ ID NO: 1838133 - protein, 9 aa, Staphylococcus epidermidis
KAGDSLSSI

SEQ ID NO: 1838134 - protein, 5 aa, Staphylococcus epidermidis
KAIGT

SEQ ID NO: 1838135 - protein, 7 aa, Staphylococcus epidermidis
KAISSNR

SEQ ID NO: 1838136 - protein, 8 aa, Staphylococcus epidermidis
KAKNNGVY

SEQ ID NO: 1838137 - protein, 20 aa, Staphylococcus epidermidis
KAKSELKPDGFSTYKKKKKK

SEQ ID NO: 1838138 - protein, 10 aa, Staphylococcus epidermidis
KALADKGNYD

SEQ ID NO: 1838139 - protein, 24 aa, Staphylococcus epidermidis
KALGKEDEGKKRLDEHEKKIEKYK

SEQ ID NO: 1838140 - protein, 11 aa, Staphylococcus epidermidis
KAMNKDTTVET

SEQ ID NO: 1838141 - protein, 12 aa, Staphylococcus epidermidis
KAMNKNTTVETL

SEQ ID NO: 1838142 - protein, 4 aa, Staphylococcus epidermidis
KAMP

SEQ ID NO: 1838143 - protein, 9 aa, Staphylococcus epidermidis
KAMSSPTPI

SEQ ID NO: 1838144 - protein, 15 aa, Staphylococcus epidermidis
KAQERKDEAEFEKTA

SEQ ID NO: 1838145 - protein, 9 aa, Staphylococcus epidermidis
KAQKEKYDN

SEQ ID NO: 1838146 - protein, 6 aa, Staphylococcus epidermidis
KARGIN

SEQ ID NO: 1838147 - protein, 6 aa, Staphylococcus epidermidis
KASGTK

SEQ ID NO: 1838148 - protein, 4 aa, Staphylococcus epidermidis
KASH

SEQ ID NO: 1838149 - protein, 8 aa, Staphylococcus epidermidis
KASLSEVS

SEQ ID NO: 1838150 - protein, 13 aa, Staphylococcus epidermidis
KASPNEPSLKELE

SEQ ID NO: 1838151 - protein, 8 aa, Staphylococcus epidermidis
KASSIKVA

SEQ ID NO: 1838152 - protein, 10 aa, Staphylococcus epidermidis
KATDKNQKGV

SEQ ID NO: 1838153 - protein, 10 aa, Staphylococcus epidermidis
KAVTPDADNY

SEQ ID NO: 1838154 - protein, 8 aa, Staphylococcus epidermidis
KAVTPNVN

SEQ ID NO: 1838155 - protein, 18 aa, Staphylococcus epidermidis
KAYGKDLKEKSHCTQKDG

SEQ ID NO: 1838156 - protein, 7 aa, Staphylococcus epidermidis
KAYKQQK

SEQ ID NO: 1838157 - protein, 5 aa, Staphylococcus epidermidis
KCSSL

SEQ ID NO: 1838158 - protein, 8 aa, Staphylococcus epidermidis
KDAYPKER

SEQ ID NO: 1838159 - protein, 22 aa, Staphylococcus epidermidis
KDCSSWKGKPKHKNWPKTAWYR

SEQ ID NO: 1838160 - protein, 5 aa, Staphylococcus epidermidis
KDDEV

SEQ ID NO: 1838161 - protein, 5 aa, Staphylococcus epidermidis
KDDFG

SEQ ID NO: 1838162 - protein, 11 aa, Staphylococcus epidermidis
KDDSQATMNEG

SEQ ID NO: 1838163 - protein, 8 aa, Staphylococcus epidermidis
KDEKTFKG

SEQ ID NO: 1838164 - protein, 38 aa, Staphylococcus epidermidis
KDGGKQIGSFSSNHNQFNTPGYSPSQSIKTNGAGEASI

SEQ ID NO: 1838165 - protein, 37 aa, Staphylococcus epidermidis
KDGGKQIGSFSTNDSEFSSPGYSEKQSVKTDHHGEAT

SEQ ID NO: 1838166 - protein, 6 aa, Staphylococcus epidermidis
KDGIIS

SEQ ID NO: 1838167 - protein, 11 aa, Staphylococcus epidermidis
KDGKEDKFKGV

SEQ ID NO: 1838168 - protein, 4 aa, Staphylococcus epidermidis
KDGN

SEQ ID NO: 1838169 - protein, 20 aa, Staphylococcus epidermidis
KDGRATSYDGSGSGSGKPLP

SEQ ID NO: 1838170 - protein, 33 aa, Staphylococcus epidermidis
KDGSKQDKNKIKQLEAENQKLETENKKYKKELD

SEQ ID NO: 1838171 - protein, 7 aa, Staphylococcus epidermidis
KDGTINQ

SEQ ID NO: 1838172 - protein, 20 aa, Staphylococcus epidermidis
KDHDEDHEHHSHHEESNQDP

SEQ ID NO: 1838173 - protein, 13 aa, Staphylococcus epidermidis
KDILDGQEKPATQ

SEQ ID NO: 1838174 - protein, 6 aa, Staphylococcus epidermidis
KDIQDA

SEQ ID NO: 1838175 - protein, 16 aa, Staphylococcus epidermidis
KDKDGSVWENGKGDSF

SEQ ID NO: 1838176 - protein, 19 aa, Staphylococcus epidermidis
KDKGKLEEYKTYGPYTSDE

SEQ ID NO: 1838177 - protein, 22 aa, Staphylococcus epidermidis
KDKLQEDKKGYASISKENISKY

SEQ ID NO: 1838178 - protein, 18 aa, Staphylococcus epidermidis
KDKNYQSVKDLKGNDKLA

SEQ ID NO: 1838179 - protein, 8 aa, Staphylococcus epidermidis
KDKSNNNE

SEQ ID NO: 1838180 - protein, 26 aa, Staphylococcus epidermidis
KDKVNTKDVDEDIKKEEKQYGGKDQF

SEQ ID NO: 1838181 - protein, 28 aa, Staphylococcus epidermidis
KDLDSDGMTNTHAPGKKDDQSKKGLNTL

SEQ ID NO: 1838182 - protein, 8 aa, Staphylococcus epidermidis
KDLKGKKI

SEQ ID NO: 1838183 - protein, 21 aa, Staphylococcus epidermidis
KDMDNGEKNSKAMQGVKSSDW

SEQ ID NO: 1838184 - protein, 9 aa, Staphylococcus epidermidis
KDNKASAEY

SEQ ID NO: 1838185 - protein, 9 aa, Staphylococcus epidermidis
KDNKNGNFK

SEQ ID NO: 1838186 - protein, 11 aa, Staphylococcus epidermidis
KDNKNPEDVAK

SEQ ID NO: 1838187 - protein, 6 aa, Staphylococcus epidermidis
KDNPEA

SEQ ID NO: 1838188 - protein, 8 aa, Staphylococcus epidermidis
KDNPKIDK

SEQ ID NO: 1838189 - protein, 4 aa, Staphylococcus epidermidis
KDNR

SEQ ID NO: 1838190 - protein, 17 aa, Staphylococcus epidermidis
KDPDGLHKKLGEKEIKL

SEQ ID NO: 1838191 - protein, 14 aa, Staphylococcus epidermidis
KDPRMNNLPKNPYK

SEQ ID NO: 1838192 - protein, 8 aa, Staphylococcus epidermidis
KDQEEFNR

SEQ ID NO: 1838193 - protein, 7 aa, Staphylococcus epidermidis
KDQIAKK

SEQ ID NO: 1838194 - protein, 7 aa, Staphylococcus epidermidis
KDQLTGY

SEQ ID NO: 1838195 - protein, 13 aa, Staphylococcus epidermidis
KDQYTKTFTSSAN

SEQ ID NO: 1838196 - protein, 9 aa, Staphylococcus epidermidis
KDSDEYEQM

SEQ ID NO: 1838197 - protein, 7 aa, Staphylococcus epidermidis
KDSTPFN

SEQ ID NO: 1838198 - protein, 30 aa, Staphylococcus epidermidis
KDTNNVKADPALEKQVNKANDEFKKQTSTV

SEQ ID NO: 1838199 - protein, 19 aa, Staphylococcus epidermidis
KDYRDIESKVNKNNNKVTI

SEQ ID NO: 1838200 - protein, 17 aa, Staphylococcus epidermidis
KEAQKALKEDTKDGEKI

SEQ ID NO: 1838201 - protein, 15 aa, Staphylococcus epidermidis
KEARGYGKSTRTKSF

SEQ ID NO: 1838202 - protein, 18 aa, Staphylococcus epidermidis
KEDDKNDINSILETNDNS

SEQ ID NO: 1838203 - protein, 21 aa, Staphylococcus epidermidis
KEDNSTYTVKTTGGSELGPAV

SEQ ID NO: 1838204 - protein, 6 aa, Staphylococcus epidermidis
KEFAQG

SEQ ID NO: 1838205 - protein, 43 aa, Staphylococcus epidermidis; identical to SEQ ID NO: 1727811

SEQ ID NO: 1838206 - protein, 16 aa, Staphylococcus epidermidis
KEGFRDEEFDKDDKGT

SEQ ID NO: 1838207 - protein, 16 aa, Staphylococcus epidermidis
KEGFRDGEFDKDDKGT

SEQ ID NO: 1838208 - protein, 32 aa, Staphylococcus epidermidis
KEGKFQPSAGGTTNEAHHPKYTAEDARNMSDD

SEQ ID NO: 1838209 - protein, 32 aa, Staphylococcus epidermidis
KEGKFQPSAGGTTNEAHHPKYTAEDVRNMSDD

SEQ ID NO: 1838210 - protein, 11 aa, Staphylococcus epidermidis
KEIAKSKKGHK

SEQ ID NO: 1838211 - protein, 4 aa, Staphylococcus epidermidis
KEIQ

SEQ ID NO: 1838212 - protein, 8 aa, Staphylococcus epidermidis
KEISTDEA

SEQ ID NO: 1838213 - protein, 26 aa, Staphylococcus epidermidis
KEKDGETYSKDLSDKEIEKQGKQMAS

SEQ ID NO: 1838214 - protein, 25 aa, Staphylococcus epidermidis
KEKDGETYSKNLNDKDIEKQGKQMA

SEQ ID NO: 1838215 - protein, 13 aa, Staphylococcus epidermidis
KEKNKDDITLTEK

SEQ ID NO: 1838216 - protein, 7 aa, Staphylococcus epidermidis
KELARTG

SEQ ID NO: 1838217 - protein, 5 aa, Staphylococcus epidermidis
KENDA

SEQ ID NO: 1838218 - protein, 9 aa, Staphylococcus epidermidis
KENMAQKAN

SEQ ID NO: 1838219 - protein, 21 aa, Staphylococcus epidermidis
KENYDRTNEVTTEDLKETNIN

SEQ ID NO: 1838220 - protein, 8 aa, Staphylococcus epidermidis
KERNIDAS

SEQ ID NO: 1838221 - protein, 9 aa, Staphylococcus epidermidis
KETGINATK

SEQ ID NO: 1838222 - protein, 7 aa, Staphylococcus epidermidis
KETLYPD

SEQ ID NO: 1838223 - protein, 56 aa, Staphylococcus epidermidis
KEWSTSREQNKMSQSELDSLSKSEQEGIGYNPNNPRGDVGGPGMSPAHDGIGNDDE

SEQ ID NO: 1838224 - protein, 14 aa, Staphylococcus epidermidis
KEYWGEKSKLNKVE

SEQ ID NO: 1838225 - protein, 7 aa, Staphylococcus epidermidis
KFDAEAV

SEQ ID NO: 1838226 - protein, 9 aa, Staphylococcus epidermidis
KFKKEGLSV

SEQ ID NO: 1838227 - protein, 11 aa, Staphylococcus epidermidis
KFSDGSALDAK

SEQ ID NO: 1838228 - protein, 10 aa, Staphylococcus epidermidis
KFSDGSPLNA

SEQ ID NO: 1838229 - protein, 11 aa, Staphylococcus epidermidis
KGAGSLATGSA

SEQ ID NO: 1838230 - protein, 11 aa, Staphylococcus epidermidis
KGAKTHVNGDE

SEQ ID NO: 1838231 - protein, 12 aa, Staphylococcus epidermidis
KGDIGGKPIDAL

SEQ ID NO: 1838232 - protein, 14 aa, Staphylococcus epidermidis
KGDKVIKQKSVNTL

SEQ ID NO: 1838233 - protein, 5 aa, Staphylococcus epidermidis
KGEDY

SEQ ID NO: 1838234 - protein, 6 aa, Staphylococcus epidermidis
KGEHFS

SEQ ID NO: 1838235 - protein, 7 aa, Staphylococcus epidermidis
KGETNFT

SEQ ID NO: 1838236 - protein, 8 aa, Staphylococcus epidermidis
KGHKDDEN

SEQ ID NO: 1838237 - protein, 9 aa, Staphylococcus epidermidis
KGHKDDKKI

SEQ ID NO: 1838238 - protein, 5 aa, Staphylococcus epidermidis
KGIAI

SEQ ID NO: 1838239 - protein, 8 aa, Staphylococcus epidermidis
KGIKNAGQ

SEQ ID NO: 1838240 - protein, 8 aa, Staphylococcus epidermidis
KGINQKKV

SEQ ID NO: 1838241 - protein, 9 aa, Staphylococcus epidermidis
KGKAGQKPD

SEQ ID NO: 1838242 - protein, 4 aa, Staphylococcus epidermidis
KGKI

SEQ ID NO: 1838243 - protein, 7 aa, Staphylococcus epidermidis
KGKKVEL

SEQ ID NO: 1838244 - protein, 7 aa, Staphylococcus epidermidis
KGKPYTD

SEQ ID NO: 1838245 - protein, 9 aa, Staphylococcus epidermidis
KGLAGAYST

SEQ ID NO: 1838246 - protein, 8 aa, Staphylococcus epidermidis
KGNIDGNK

SEQ ID NO: 1838247 - protein, 16 aa, Staphylococcus epidermidis
KGRDYTLNKKGNPHVK

SEQ ID NO: 1838248 - protein, 11 aa, Staphylococcus epidermidis
KGRTEKPEFTY

SEQ ID NO: 1838249 - protein, 10 aa, Staphylococcus epidermidis
KGSDEYQQMP

SEQ ID NO: 1838250 - protein, 9 aa, Staphylococcus epidermidis
KGSKSGIKN

SEQ ID NO: 1838251 - protein, 35 aa, Staphylococcus epidermidis
KGTNRTYPNDPKENVTDSAAGGTAFATGHKTYNGA

SEQ ID NO: 1838252 - protein, 15 aa, Staphylococcus epidermidis
KGTYENGRVNASVEP

SEQ ID NO: 1838253 - protein, 4 aa, Staphylococcus epidermidis
KGYD

SEQ ID NO: 1838254 - protein, 11 aa, Staphylococcus epidermidis
KGYPSNSTVDD

SEQ ID NO: 1838255 - protein, 56 aa, Staphylococcus epidermidis
KHASENNQTLHSKAAQSNEDVKTKPSQLDNTTAQQEDSQKENLSKQDTQSSKTTDL

SEQ ID NO: 1838256 - protein, 57 aa, Staphylococcus epidermidis
KHASENNQTLHSNAAQSNEDVKTKPSQLDNTTAQQEDSQKENLSKQDTQSSKNTDLL

SEQ ID NO: 1838257 - protein, 4 aa, Staphylococcus epidermidis
KHEL

SEQ ID NO: 1838258 - protein, 8 aa, Staphylococcus epidermidis
KHETDITV

SEQ ID NO: 1838259 - protein, 28 aa, Staphylococcus epidermidis
KHGRTDMGARPYAGIAPRGMTSKQYSEL

SEQ ID NO: 1838260 - protein, 10 aa, Staphylococcus epidermidis
KHKGVKAGLA

SEQ ID NO: 1838261 - protein, 21 aa, Staphylococcus epidermidis
KHKKSDKKSDKKSDDKKSDDK

SEQ ID NO: 1838262 - protein, 16 aa, Staphylococcus epidermidis
KHPDKSEDGRDLALTK

SEQ ID NO: 1838263 - protein, 30 aa, Staphylococcus epidermidis
KHPNQKSNATQNRSTFSTKSRAAVTDNGER

SEQ ID NO: 1838264 - protein, 5 aa, Staphylococcus epidermidis
KHPRA

SEQ ID NO: 1838265 - protein, 15 aa, Staphylococcus epidermidis
KHQKSDKKDDKTSED

SEQ ID NO: 1838266 - protein, 9 aa, Staphylococcus epidermidis
KHRKEYEKL

SEQ ID NO: 1838267 - protein, 13 aa, Staphylococcus epidermidis
KHSEEKPQQEQVE

SEQ ID NO: 1838268 - protein, 5 aa, Staphylococcus epidermidis
KHTGN

SEQ ID NO: 1838269 - protein, 25 aa, Staphylococcus epidermidis
KHTNEKTKQPSAQTTQRDHDQKHMN

SEQ ID NO: 1838270 - protein, 7 aa, Staphylococcus epidermidis
KIAPTVP

SEQ ID NO: 1838271 - protein, 10 aa, Staphylococcus epidermidis
KIDEGTDVNY

SEQ ID NO: 1838272 - protein, 15 aa, Staphylococcus epidermidis
KIDRNAKRVETDKGV

SEQ ID NO: 1838273 - protein, 17 aa, Staphylococcus epidermidis
KIIPTKPISNDKLKKEI

SEQ ID NO: 1838274 - protein, 23 aa, Staphylococcus epidermidis
KIKDDNGKLTEPTKKTIKNGSYA

SEQ ID NO: 1838275 - protein, 17 aa, Staphylococcus epidermidis
KIKKREVTYKKSLKSGY

SEQ ID NO: 1838276 - protein, 12 aa, Staphylococcus epidermidis
KINDPNINNNQI

SEQ ID NO: 1838277 - protein, 8 aa, Staphylococcus epidermidis
KINEGTDV

SEQ ID NO: 1838278 - protein, 18 aa, Staphylococcus epidermidis
KINSYVEKKEKEENSLKN

SEQ ID NO: 1838279 - protein, 27 aa, Staphylococcus epidermidis
KIPSGGSGSGGAATTQTGNGSYNSPTF

SEQ ID NO: 1838280 - protein, 10 aa, Staphylococcus epidermidis
KIRDNGELAK

SEQ ID NO: 1838281 - protein, 4 aa, Staphylococcus epidermidis
KITH

SEQ ID NO: 1838282 - protein, 20 aa, Staphylococcus epidermidis
KITNQQAQLSRKSNLSSVPL

SEQ ID NO: 1838283 - protein, 9 aa, Staphylococcus epidermidis
KKAHKDAKI

SEQ ID NO: 1838284 - protein, 12 aa, Staphylococcus epidermidis
KKAKSGAKYGNR

SEQ ID NO: 1838285 - protein, 7 aa, Staphylococcus epidermidis
KKALSEV

SEQ ID NO: 1838286 - protein, 6 aa, Staphylococcus epidermidis
KKASKR

SEQ ID NO: 1838287 - protein, 7 aa, Staphylococcus epidermidis
KKASNRL

SEQ ID NO: 1838288 - protein, 6 aa, Staphylococcus epidermidis
KKDAGK

SEQ ID NO: 1838289 - protein, 6 aa, Staphylococcus epidermidis
KKDDYV

SEQ ID NO: 1838290 - protein, 8 aa, Staphylococcus epidermidis
KKDNMPQP

SEQ ID NO: 1838291 - protein, 6 aa, Staphylococcus epidermidis
KKDPLN

SEQ ID NO: 1838292 - protein, 8 aa, Staphylococcus epidermidis
KKDQPNVF

SEQ ID NO: 1838293 - protein, 6 aa, Staphylococcus epidermidis
KKFQEK

SEQ ID NO: 1838294 - protein, 14 aa, Staphylococcus epidermidis
KKFRGKAGSYAKSH

SEQ ID NO: 1838295 - protein, 11 aa, Staphylococcus epidermidis
KKGFTKDNSVD

SEQ ID NO: 1838296 - protein, 8 aa, Staphylococcus epidermidis
KKGKFPKR

SEQ ID NO: 1838297 - protein, 26 aa, Staphylococcus epidermidis
KKGNKSKFLDSSQSVASKDIKKSEHY

SEQ ID NO: 1838298 - protein, 4 aa, Staphylococcus epidermidis
KKGQ

SEQ ID NO: 1838299 - protein, 6 aa, Staphylococcus epidermidis
KKGVDW

SEQ ID NO: 1838300 - protein, 12 aa, Staphylococcus epidermidis
KKHGAGSKAARW

SEQ ID NO: 1838301 - protein, 8 aa, Staphylococcus epidermidis
KKHKGKKK

SEQ ID NO: 1838302 - protein, 11 aa, Staphylococcus epidermidis
KKIHKKKVSQI

SEQ ID NO: 1838303 - protein, 9 aa, Staphylococcus epidermidis
KKITENGTF

SEQ ID NO: 1838304 - protein, 20 aa, Staphylococcus epidermidis
KKKATKVYKSGETLEEFVGL

SEQ ID NO: 1838305 - protein, 6 aa, Staphylococcus epidermidis
KKLGGN

SEQ ID NO: 1838306 - protein, 7 aa, Staphylococcus epidermidis
KKLSDKV

SEQ ID NO: 1838307 - protein, 9 aa, Staphylococcus epidermidis
KKNKALPEL

SEQ ID NO: 1838308 - protein, 9 aa, Staphylococcus epidermidis
KKNKGKKKL

SEQ ID NO: 1838309 - protein, 7 aa, Staphylococcus epidermidis
KKQEGEL

SEQ ID NO: 1838310 - protein, 26 aa, Staphylococcus epidermidis
KKQIKQQKSITTNVASSEKINDDILK

SEQ ID NO: 1838311 - protein, 9 aa, Staphylococcus epidermidis
KKQKPNAKI

SEQ ID NO: 1838312 - protein, 25 aa, Staphylococcus epidermidis
KKRQNEFKNEEEALSKSEKEFKKAN

SEQ ID NO: 1838313 - protein, 15 aa, Staphylococcus epidermidis
KKSDQVAPKFNKDKV

SEQ ID NO: 1838314 - protein, 15 aa, Staphylococcus epidermidis
KKTSETQKGQTFKST

SEQ ID NO: 1838315 - protein, 21 aa, Staphylococcus epidermidis
KKTTSSLPKYTPQVKSSINDY

SEQ ID NO: 1838316 - protein, 8 aa, Staphylococcus epidermidis
KKVKPKPF

SEQ ID NO: 1838317 - protein, 11 aa, Staphylococcus epidermidis
KKVSNGKNNMT

SEQ ID NO: 1838318 - protein, 8 aa, Staphylococcus epidermidis
KKYGENET

SEQ ID NO: 1838319 - protein, 9 aa, Staphylococcus epidermidis
KLAKEHPEW

SEQ ID NO: 1838320 - protein, 17 aa, Staphylococcus epidermidis
KLEESIQATTDLKQATQ

SEQ ID NO: 1838321 - protein, 8 aa, Staphylococcus epidermidis
KLKNPKAI

SEQ ID NO: 1838322 - protein, 4 aa, Staphylococcus epidermidis
KLKQ

SEQ ID NO: 1838323 - protein, 27 aa, Staphylococcus epidermidis
KLPKEGKDISNKDKDFNQQYNELKEKV

SEQ ID NO: 1838324 - protein, 23 aa, Staphylococcus epidermidis
KLPNPENKTSSYSADGSAENNTK

SEQ ID NO: 1838325 - protein, 23 aa, Staphylococcus epidermidis
KLQKEGKDEKDPKVAAATTKLQN

SEQ ID NO: 1838326 - protein, 5 aa, Staphylococcus epidermidis
KLQQI

SEQ ID NO: 1838327 - protein, 7 aa, Staphylococcus epidermidis
KLSQQGA

SEQ ID NO: 1838328 - protein, 20 aa, Staphylococcus epidermidis
KLTDREKQAKELVDETKHNV

SEQ ID NO: 1838329 - protein, 49 aa, Staphylococcus epidermidis
KLTENIQNNPDKYQHIGGGPGMALSSPNQSYDSFKQDVTKARNESQALQ

SEQ ID NO: 1838330 - protein, 21 aa, Staphylococcus epidermidis
KLTGREKQAKDLVDETKNNVD

SEQ ID NO: 1838331 - protein, 10 aa, Staphylococcus epidermidis
KLTNNEDKAK

SEQ ID NO: 1838332 - protein, 21 aa, Staphylococcus epidermidis
KMQDKKQEKIAKNDSGDEVKH

SEQ ID NO: 1838333 - protein, 8 aa, Staphylococcus epidermidis
KMSSASSI

SEQ ID NO: 1838334 - protein, 28 aa, Staphylococcus epidermidis
KMYKDKDSKAWKMANDDKKAAKKKDVKK

SEQ ID NO: 1838335 - protein, 10 aa, Staphylococcus epidermidis
KNASDNATEL

SEQ ID NO: 1838336 - protein, 8 aa, Staphylococcus epidermidis
KNDEQAFK

SEQ ID NO: 1838337 - protein, 25 aa, Staphylococcus epidermidis
KNDGNKINNTWSDAKNWDKKAIDDG

SEQ ID NO: 1838338 - protein, 5 aa, Staphylococcus epidermidis
KNDPL

SEQ ID NO: 1838339 - protein, 8 aa, Staphylococcus epidermidis
KNEEGDIN

SEQ ID NO: 1838340 - protein, 10 aa, Staphylococcus epidermidis
KNERKNHKKK

SEQ ID NO: 1838341 - protein, 7 aa, Staphylococcus epidermidis
KNGDTLI

SEQ ID NO: 1838342 - protein, 12 aa, Staphylococcus epidermidis
KNHHPDYEDIKV

SEQ ID NO: 1838343 - protein, 6 aa, Staphylococcus epidermidis
KNIKKY

SEQ ID NO: 1838344 - protein, 14 aa, Staphylococcus epidermidis
KNITSKGGTTQAGL

SEQ ID NO: 1838345 - protein, 9 aa, Staphylococcus epidermidis
KNKESITGY

SEQ ID NO: 1838346 - protein, 12 aa, Staphylococcus epidermidis
KNKKDKDLTASS

SEQ ID NO: 1838347 - protein, 16 aa, Staphylococcus epidermidis
KNKKYSANMRKKAKQA

SEQ ID NO: 1838348 - protein, 17 aa, Staphylococcus epidermidis
KNKMNDDNLNKNQQDNI

SEQ ID NO: 1838349 - protein, 11 aa, Staphylococcus epidermidis
KNKNNKQANVS

SEQ ID NO: 1838350 - protein, 13 aa, Staphylococcus epidermidis
KNKTGKKDITANG

SEQ ID NO: 1838351 - protein, 13 aa, Staphylococcus epidermidis
KNKTNKEEITPSS

SEQ ID NO: 1838352 - protein, 7 aa, Staphylococcus epidermidis
KNKTQLY

SEQ ID NO: 1838353 - protein, 13 aa, Staphylococcus epidermidis
KNMKDNSAGNNIN

SEQ ID NO: 1838354 - protein, 19 aa, Staphylococcus epidermidis
KNNDGKSGVLANDKTLTQQ

SEQ ID NO: 1838355 - protein, 5 aa, Staphylococcus epidermidis
KNNHR

SEQ ID NO: 1838356 - protein, 8 aa, Staphylococcus epidermidis
KNNSINEL

SEQ ID NO: 1838357 - protein, 19 aa, Staphylococcus epidermidis
KNPEDRENAIKALANFDTY

SEQ ID NO: 1838358 - protein, 8 aa, Staphylococcus epidermidis
KNPKGVKV

SEQ ID NO: 1838359 - protein, 30 aa, Staphylococcus epidermidis
KNQETQQPENKDNKTNHSETIDKTPTIHNN

SEQ ID NO: 1838360 - protein, 12 aa, Staphylococcus epidermidis
KNQFSESGITDK

SEQ ID NO: 1838361 - protein, 13 aa, Staphylococcus epidermidis
KNQPGAKKMNPTA

SEQ ID NO: 1838362 - protein, 22 aa, Staphylococcus epidermidis
KNQQLLPSNTIASKTFNASKSL

SEQ ID NO: 1838363 - protein, 56 aa, Staphylococcus epidermidis
KNRSQVESDINKATNKSDADQLTSKLEANNKQLKSTAKKYLDSSTTDSDSAKKAIN

SEQ ID NO: 1838364 - protein, 33 aa, Staphylococcus epidermidis
KNTRIESVNGDEISRPGPRIDEGLKELRDAIYK

SEQ ID NO: 1838365 - protein, 4 aa, Staphylococcus epidermidis
KNVD

SEQ ID NO: 1838366 - protein, 7 aa, Staphylococcus epidermidis
KNVSSLG

SEQ ID NO: 1838367 - protein, 14 aa, Staphylococcus epidermidis
KNYGPGSSQTSNEV

SEQ ID NO: 1838368 - protein, 30 aa, Staphylococcus epidermidis
KNYKDGDISYNPNVPSYSAQYQLSNNEYNV

SEQ ID NO: 1838369 - protein, 9 aa, Staphylococcus epidermidis
KNYPKNERA

SEQ ID NO: 1838370 - protein, 4 aa, Staphylococcus epidermidis
KNYS

SEQ ID NO: 1838371 - protein, 17 aa, Staphylococcus epidermidis
KPADKKVSNSPHGQNIN

SEQ ID NO: 1838372 - protein, 12 aa, Staphylococcus epidermidis
KPDSAENDGQGT

SEQ ID NO: 1838373 - protein, 20 aa, Staphylococcus epidermidis
KPENSTEPQKEPWSQPEKGY

SEQ ID NO: 1838374 - protein, 8 aa, Staphylococcus epidermidis
KPESKENI

SEQ ID NO: 1838375 - protein, 10 aa, Staphylococcus epidermidis
KPFKKEDYEA

SEQ ID NO: 1838376 - protein, 6 aa, Staphylococcus epidermidis
KPGDSL

SEQ ID NO: 1838377 - protein, 16 aa, Staphylococcus epidermidis
KPITYKAGATSDKKIA

SEQ ID NO: 1838378 - protein, 6 aa, Staphylococcus epidermidis
KPLLKK

SEQ ID NO: 1838379 - protein, 11 aa, Staphylococcus epidermidis
KPLLKKKGYDL

SEQ ID NO: 1838380 - protein, 7 aa, Staphylococcus epidermidis
KPSKGNF

SEQ ID NO: 1838381 - protein, 7 aa, Staphylococcus epidermidis
KPYPPTL

SEQ ID NO: 1838382 - protein, 20 aa, Staphylococcus epidermidis
KQAGKSTKDKSVIATSKDVD

SEQ ID NO: 1838383 - protein, 7 aa, Staphylococcus epidermidis
KQAYGKS

SEQ ID NO: 1838384 - protein, 4 aa, Staphylococcus epidermidis
KQDM

SEQ ID NO: 1838385 - protein, 11 aa, Staphylococcus epidermidis
KQGKPSRMNPA

SEQ ID NO: 1838386 - protein, 10 aa, Staphylococcus epidermidis
KQKPNESYAE

SEQ ID NO: 1838387 - protein, 9 aa, Staphylococcus epidermidis
KQKPNESYI

SEQ ID NO: 1838388 - protein, 25 aa, Staphylococcus epidermidis
KQKYGKNYNYQPPLSKNKTSKTDGL

SEQ ID NO: 1838389 - protein, 13 aa, Staphylococcus epidermidis
KQPSSTNDVQNGK

SEQ ID NO: 1838390 - protein, 7 aa, Staphylococcus epidermidis
KQREDET

SEQ ID NO: 1838391 - protein, 6 aa, Staphylococcus epidermidis
KQRGEI

SEQ ID NO: 1838392 - protein, 24 aa, Staphylococcus epidermidis
KQRQKEFEKEEKAIDNSEKEFKQA

SEQ ID NO: 1838393 - protein, 24 aa, Staphylococcus epidermidis
KQRQKEFEKEEKALDNSEKAFKQA

SEQ ID NO: 1838394 - protein, 7 aa, Staphylococcus epidermidis
KQSTIGT

SEQ ID NO: 1838395 - protein, 6 aa, Staphylococcus epidermidis
KQSVSD

SEQ ID NO: 1838396 - protein, 7 aa, Staphylococcus epidermidis
KQVSGGV

SEQ ID NO: 1838397 - protein, 23 aa, Staphylococcus epidermidis
KQWKDQTAKDGKEIKNKIGADST

SEQ ID NO: 1838398 - protein, 19 aa, Staphylococcus epidermidis
KQYDKIEKGKHIKVKNGVV

SEQ ID NO: 1838399 - protein, 19 aa, Staphylococcus epidermidis
KQYDKIKTGKNVKIKNGIV

SEQ ID NO: 1838400 - protein, 8 aa, Staphylococcus epidermidis
KQYISSNT

SEQ ID NO: 1838401 - protein, 7 aa, Staphylococcus epidermidis
KQYPPTY

SEQ ID NO: 1838402 - protein, 14 aa, Staphylococcus epidermidis
KQYRDELPVKQRGA

SEQ ID NO: 1838403 - protein, 23 aa, Staphylococcus epidermidis
KRDGKKAADKYSARPGYSEHQTG

SEQ ID NO: 1838404 - protein, 8 aa, Staphylococcus epidermidis
KRLGNAPQ

SEQ ID NO: 1838405 - protein, 6 aa, Staphylococcus epidermidis
KRMPNL

SEQ ID NO: 1838406 - protein, 14 aa, Staphylococcus epidermidis
KRNGLKEKSKMNDE

SEQ ID NO: 1838407 - protein, 8 aa, Staphylococcus epidermidis
KRNQTKRY

SEQ ID NO: 1838408 - protein, 7 aa, Staphylococcus epidermidis
KRNTENL

SEQ ID NO: 1838409 - protein, 7 aa, Staphylococcus epidermidis
KRSQPMN

SEQ ID NO: 1838410 - protein, 7 aa, Staphylococcus epidermidis
KSATLGN

SEQ ID NO: 1838411 - protein, 16 aa, Staphylococcus epidermidis
KSDADFKEGMKQARKE

SEQ ID NO: 1838412 - protein, 8 aa, Staphylococcus epidermidis
KSDLTTDV

SEQ ID NO: 1838413 - protein, 13 aa, Staphylococcus epidermidis
KSDVSKKKEQEEL

SEQ ID NO: 1838414 - protein, 7 aa, Staphylococcus epidermidis
KSETAHV

SEQ ID NO: 1838415 - protein, 6 aa, Staphylococcus epidermidis
KSGENI

SEQ ID NO: 1838416 - protein, 6 aa, Staphylococcus epidermidis
KSGKLH

SEQ ID NO: 1838417 - protein, 9 aa, Staphylococcus epidermidis
KSIAPYETD

SEQ ID NO: 1838418 - protein, 12 aa, Staphylococcus epidermidis
KSIDTKHLSDKQ

SEQ ID NO: 1838419 - protein, 8 aa, Staphylococcus epidermidis
KSISNPKE

SEQ ID NO: 1838420 - protein, 6 aa, Staphylococcus epidermidis
KSITEL

SEQ ID NO: 1838421 - protein, 7 aa, Staphylococcus epidermidis
KSITEQQ

SEQ ID NO: 1838422 - protein, 13 aa, Staphylococcus epidermidis
KSKEKILSISIIC

SEQ ID NO: 1838423 - protein, 16 aa, Staphylococcus epidermidis
KSKNGEKVEGTAKIEN

SEQ ID NO: 1838424 - protein, 36 aa, Staphylococcus epidermidis
KSKSSDKEGLSDKKAKEKAEKIQKEVEKNPSKFGEI

SEQ ID NO: 1838425 - protein, 7 aa, Staphylococcus epidermidis
KSQDNGF

SEQ ID NO: 1838426 - protein, 9 aa, Staphylococcus epidermidis
KSSDQDQFK

SEQ ID NO: 1838427 - protein, 33 aa, Staphylococcus epidermidis
KSSESAFEKSQDKNDAQRQSNLRDSKVNPEKQP

SEQ ID NO: 1838428 - protein, 8 aa, Staphylococcus epidermidis
KSSITTNN

SEQ ID NO: 1838429 - protein, 14 aa, Staphylococcus epidermidis
KSTGRNNNAKEKNF

SEQ ID NO: 1838430 - protein, 9 aa, Staphylococcus epidermidis
KSTKKMKQI

SEQ ID NO: 1838431 - protein, 7 aa, Staphylococcus epidermidis
KSVSKES

SEQ ID NO: 1838432 - protein, 20 aa, Staphylococcus epidermidis
KTDSHSSMKETGVKLDSKTP

SEQ ID NO: 1838433 - protein, 5 aa, Staphylococcus epidermidis
KTFEK

SEQ ID NO: 1838434 - protein, 10 aa, Staphylococcus epidermidis
KTFVGEKDNV

SEQ ID NO: 1838435 - protein, 7 aa, Staphylococcus epidermidis
KTGDTLI

SEQ ID NO: 1838436 - protein, 6 aa, Staphylococcus epidermidis
KTGEII

SEQ ID NO: 1838437 - protein, 25 aa, Staphylococcus epidermidis
KTGGKIGSTWGNANSWASAAQAAGF

SEQ ID NO: 1838438 - protein, 12 aa, Staphylococcus epidermidis
KTGKEKTTMKPN

SEQ ID NO: 1838439 - protein, 8 aa, Staphylococcus epidermidis
KTITPSFT

SEQ ID NO: 1838440 - protein, 20 aa, Staphylococcus epidermidis
KTKADPTGKIQQQRVAKLLG

SEQ ID NO: 1838441 - protein, 7 aa, Staphylococcus epidermidis
KTKQGKR

SEQ ID NO: 1838442 - protein, 19 aa, Staphylococcus epidermidis
KTKTGYESATSGIKNKADL

SEQ ID NO: 1838443 - protein, 20 aa, Staphylococcus epidermidis
KTPEDRERGIEALKDFDTYI

SEQ ID NO: 1838444 - protein, 8 aa, Staphylococcus epidermidis
KTPYPTYN

SEQ ID NO: 1838445 - protein, 20 aa, Staphylococcus epidermidis
KTQSQSYISTQYSNNKLKTT

SEQ ID NO: 1838446 - protein, 19 aa, Staphylococcus epidermidis
KTTDDSKGRLKDDEKRYPV

SEQ ID NO: 1838447 - protein, 18 aa, Staphylococcus epidermidis
KTTDDSKGRSKADEKRYP

SEQ ID NO: 1838448 - protein, 11 aa, Staphylococcus epidermidis
KVDDKTVQKFN

SEQ ID NO: 1838449 - protein, 9 aa, Staphylococcus epidermidis
KVGGNKAAN

SEQ ID NO: 1838450 - protein, 11 aa, Staphylococcus epidermidis
KVGKDEKKRKE

SEQ ID NO: 1838451 - protein, 6 aa, Staphylococcus epidermidis
KVGPHY

SEQ ID NO: 1838452 - protein, 8 aa, Staphylococcus epidermidis
KVKNPYKY

SEQ ID NO: 1838453 - protein, 15 aa, Staphylococcus epidermidis
KVNKSGTVHASNINY

SEQ ID NO: 1838454 - protein, 13 aa, Staphylococcus epidermidis
KVNNEEDAKRVQS

SEQ ID NO: 1838455 - protein, 32 aa, Staphylococcus epidermidis
KVNPSDGSFTYTYGKSNGNVNNGRNNNDDGQQ

SEQ ID NO: 1838456 - protein, 5 aa, Staphylococcus epidermidis
KVNPT

SEQ ID NO: 1838457 - protein, 25 aa, Staphylococcus epidermidis
KVPGGGSGSSSNSSAGKSTSSGGYY

SEQ ID NO: 1838458 - protein, 10 aa, Staphylococcus epidermidis
KVQKKPKLLT

SEQ ID NO: 1838459 - protein, 6 aa, Staphylococcus epidermidis
KVSGDV

SEQ ID NO: 1838460 - protein, 25 aa, Staphylococcus epidermidis
KVSGKATSSSRTKASGSSGRTATYT

SEQ ID NO: 1838461 - protein, 30 aa, Staphylococcus epidermidis
KVSGSVSNSSSSSKASKSKSTGRTSTYTVQ

SEQ ID NO: 1838462 - protein, 4 aa, Staphylococcus epidermidis
KVSY

SEQ ID NO: 1838463 - protein, 13 aa, Staphylococcus epidermidis
KVTDTEKDNKGFT

SEQ ID NO: 1838464 - protein, 14 aa, Staphylococcus epidermidis
KVYGKEPKGTPPMT

SEQ ID NO: 1838465 - protein, 26 aa, Staphylococcus epidermidis
KYAEGKVKDGKATIVDKKTGKSEKLP

SEQ ID NO: 1838466 - protein, 7 aa, Staphylococcus epidermidis
KYEKNKI

SEQ ID NO: 1838467 - protein, 6 aa, Staphylococcus epidermidis
KYGTTY

SEQ ID NO: 1838468 - protein, 28 aa, Staphylococcus epidermidis
KYKDKVDTKDIDKDIKKEEKQYGGKDQF

SEQ ID NO: 1838469 - protein, 7 aa, Staphylococcus epidermidis
KYKPENK

SEQ ID NO: 1838470 - protein, 7 aa, Staphylococcus epidermidis
KYNESEV

SEQ ID NO: 1838471 - protein, 16 aa, Staphylococcus epidermidis
KYNTSVDSIKQNNNLD

SEQ ID NO: 1838472 - protein, 12 aa, Staphylococcus epidermidis
KYPNLKSSLQDY

SEQ ID NO: 1838473 - protein, 16 aa, Staphylococcus epidermidis
KYPRPIKKQQPNYHTK

SEQ ID NO: 1838474 - protein, 18 aa, Staphylococcus epidermidis
KYRENQDNEINKGGTVKG

SEQ ID NO: 1838475 - protein, 5 aa, Staphylococcus epidermidis
KYYRD

SEQ ID NO: 1838476 - protein, 4 aa, Staphylococcus epidermidis
LAAN

SEQ ID NO: 1838477 - protein, 15 aa, Staphylococcus epidermidis
LAGTSEDEAGRTFRE

SEQ ID NO: 1838478 - protein, 8 aa, Staphylococcus epidermidis
LAKKDGID

SEQ ID NO: 1838479 - protein, 14 aa, Staphylococcus epidermidis
LASAQTKFLYKSKE

SEQ ID NO: 1838480 - protein, 17 aa, Staphylococcus epidermidis
LASPHNGTHASDELGNE

SEQ ID NO: 1838481 - protein, 20 aa, Staphylococcus epidermidis
LATTQAHAATTHTVKSGESV

SEQ ID NO: 1838482 - protein, 4 aa, Staphylococcus epidermidis
LDDD

SEQ ID NO: 1838483 - protein, 4 aa, Staphylococcus epidermidis
LDEM

SEQ ID NO: 1838484 - protein, 5 aa, Staphylococcus epidermidis
LDGKN

SEQ ID NO: 1838485 - protein, 14 aa, Staphylococcus epidermidis
LDKEIKKNKGKKKL

SEQ ID NO: 1838486 - protein, 24 aa, Staphylococcus epidermidis
LDPDKLKQQQQQQSQGASGLTNSG

SEQ ID NO: 1838487 - protein, 6 aa, Staphylococcus epidermidis
LDSQSY

SEQ ID NO: 1838488 - protein, 8 aa, Staphylococcus epidermidis
LEAGTDNQ

SEQ ID NO: 1838489 - protein, 9 aa, Staphylococcus epidermidis
LEAKEENQI

SEQ ID NO: 1838490 - protein, 10 aa, Staphylococcus epidermidis
LEDGQVEEDN

SEQ ID NO: 1838491 - protein, 10 aa, Staphylococcus epidermidis
LEEAARTGKP

SEQ ID NO: 1838492 - protein, 12 aa, Staphylococcus epidermidis
LEGEAGKNPTFL

SEQ ID NO: 1838493 - protein, 4 aa, Staphylococcus epidermidis
LEPG

SEQ ID NO: 1838494 - protein, 12 aa, Staphylococcus epidermidis
LEPSEPAQEDVH

SEQ ID NO: 1838495 - protein, 11 aa, Staphylococcus epidermidis
LEQEGYTKSHP

SEQ ID NO: 1838496 - protein, 6 aa, Staphylococcus epidermidis
LEQQEE

SEQ ID NO: 1838497 - protein, 14 aa, Staphylococcus epidermidis
LEQQQRIGKLDERR

SEQ ID NO: 1838498 - protein, 7 aa, Staphylococcus epidermidis
LEQTNSK

SEQ ID NO: 1838499 - protein, 11 aa, Staphylococcus epidermidis
LERKNKGSIGT

SEQ ID NO: 1838500 - protein, 51 aa, Staphylococcus epidermidis
LGDSDNKGSSTINDDQQSGDKNNRDSKSSTSRNQTGGNQQDTQQDTHSNKY

SEQ ID NO: 1838501 - protein, 50 aa, Staphylococcus epidermidis
LGDSDNNGSSTINDDQQSGYKNNRDSKSSISKNQTEDNQQDTQQDTHSNR

SEQ ID NO: 1838502 - protein, 18 aa, Staphylococcus epidermidis
LGEGKYKEYDAQAISDQV

SEQ ID NO: 1838503 - protein, 21 aa, Staphylococcus epidermidis
LGGIQTDLDGRAMNQQSEPIQ

SEQ ID NO: 1838504 - protein, 11 aa, Staphylococcus epidermidis
LGNDKPKSRPW

SEQ ID NO: 1838505 - protein, 10 aa, Staphylococcus epidermidis
LGSSDKDEDF

SEQ ID NO: 1838506 - protein, 31 aa, Staphylococcus epidermidis
LGTGGSALGGAGGGAASGAGYGAIGATPVSV

SEQ ID NO: 1838507 - protein, 46 aa, Staphylococcus epidermidis
LGTTSNAHAEENTQNIQNNAQYNTSNQQSYSTETTSMSSTSGNLYT

SEQ ID NO: 1838508 - protein, 7 aa, Staphylococcus epidermidis
LHDSPNV

SEQ ID NO: 1838509 - protein, 10 aa, Staphylococcus epidermidis
LHNEDGDIHT

SEQ ID NO: 1838510 - protein, 11 aa, Staphylococcus epidermidis
LKAPDTEPYKT

SEQ ID NO: 1838511 - protein, 5 aa, Staphylococcus epidermidis
LKDNG

SEQ ID NO: 1838512 - protein, 6 aa, Staphylococcus epidermidis
LKEKEG

SEQ ID NO: 1838513 - protein, 10 aa, Staphylococcus epidermidis
LKKGNKSKFL

SEQ ID NO: 1838514 - protein, 4 aa, Staphylococcus epidermidis
LKND

SEQ ID NO: 1838515 - protein, 5 aa, Staphylococcus epidermidis
LKNGY

SEQ ID NO: 1838516 - protein, 10 aa, Staphylococcus epidermidis
LKNPKATSYG

SEQ ID NO: 1838517 - protein, 10 aa, Staphylococcus epidermidis
LKQDSEGNFI

SEQ ID NO: 1838518 - protein, 10 aa, Staphylococcus epidermidis
LKSKKDTYLN

SEQ ID NO: 1838519 - protein, 19 aa, Staphylococcus epidermidis
LKTESKEKGYKIESAGNVE

SEQ ID NO: 1838520 - protein, 16 aa, Staphylococcus epidermidis
LKTGKNRHHHFWYDNN

SEQ ID NO: 1838521 - protein, 26 aa, Staphylococcus epidermidis
LKVPGGSSSSSSSNNTRSNGGYYSPT

SEQ ID NO: 1838522 - protein, 7 aa, Staphylococcus epidermidis
LLETDQK

SEQ ID NO: 1838523 - protein, 14 aa, Staphylococcus epidermidis
LNAQATSNTEPQLR

SEQ ID NO: 1838524 - protein, 4 aa, Staphylococcus epidermidis
LNAS

SEQ ID NO: 1838525 - protein, 7 aa, Staphylococcus epidermidis
LNDSSYA

SEQ ID NO: 1838526 - protein, 10 aa, Staphylococcus epidermidis
LNEKDKAELD

SEQ ID NO: 1838527 - protein, 26 aa, Staphylococcus epidermidis
LNGGAQGNKSNGGDAAQKNDHEGNGF

SEQ ID NO: 1838528 - protein, 19 aa, Staphylococcus epidermidis
LNKNSKNKFDDIPKDQRAM

SEQ ID NO: 1838529 - protein, 4 aa, Staphylococcus epidermidis
LNPN

SEQ ID NO: 1838530 - protein, 4 aa, Staphylococcus epidermidis
LNSS

SEQ ID NO: 1838531 - protein, 10 aa, Staphylococcus epidermidis
LNTEKPSTYV

SEQ ID NO: 1838532 - protein, 6 aa, Staphylococcus epidermidis
LNTNNP

SEQ ID NO: 1838533 - protein, 31 aa, Staphylococcus epidermidis
LNTYASDSHAKQDENYQTTQQQQKNPNLGSE

SEQ ID NO: 1838534 - protein, 9 aa, Staphylococcus epidermidis
LPDQPSFKS

SEQ ID NO: 1838535 - protein, 14 aa, Staphylococcus epidermidis
LPEHSGTAERKTNW

SEQ ID NO: 1838536 - protein, 33 aa, Staphylococcus epidermidis
LPQRSIDSNTLKRSTRGVNSDRAARGSVSYQNA

SEQ ID NO: 1838537 - protein, 4 aa, Staphylococcus epidermidis
LPSG

SEQ ID NO: 1838538 - protein, 16 aa, Staphylococcus epidermidis
LPTEAKADKLDAQGYD

SEQ ID NO: 1838539 - protein, 10 aa, Staphylococcus epidermidis
LPTNAPSHLK

SEQ ID NO: 1838540 - protein, 19 aa, Staphylococcus epidermidis
LQDGSHSDGRVSNSSSQSL

SEQ ID NO: 1838541 - protein, 9 aa, Staphylococcus epidermidis
LQGRITTKE

SEQ ID NO: 1838542 - protein, 22 aa, Staphylococcus epidermidis
LQKEGKDDKDEKVVEQTTKLQN

SEQ ID NO: 1838543 - protein, 15 aa, Staphylococcus epidermidis
LQNRGEDISNNLSKD

SEQ ID NO: 1838544 - protein, 15 aa, Staphylococcus epidermidis
LQNRGEDMSNAFSKD

SEQ ID NO: 1838545 - protein, 21 aa, Staphylococcus epidermidis
LQSKGYKKNKDGYFEKDGKTL

SEQ ID NO: 1838546 - protein, 6 aa, Staphylococcus epidermidis
LRDKGA

SEQ ID NO: 1838547 - protein, 27 aa, Staphylococcus epidermidis
LRDKSHEDRQNQRPNQKPSNEQPQEGG

SEQ ID NO: 1838548 - protein, 11 aa, Staphylococcus epidermidis
LRKHKGGPKQR

SEQ ID NO: 1838549 - protein, 13 aa, Staphylococcus epidermidis
LRKPGERNTSLQK

SEQ ID NO: 1838550 - protein, 4 aa, Staphylococcus epidermidis
LRKY

SEQ ID NO: 1838551 - protein, 19 aa, Staphylococcus epidermidis
LSAPTETKNGKKQLSSNGG

SEQ ID NO: 1838552 - protein, 11 aa, Staphylococcus epidermidis
LSDKKAGSYHK

SEQ ID NO: 1838553 - protein, 5 aa, Staphylococcus epidermidis
LSEEN

SEQ ID NO: 1838554 - protein, 8 aa, Staphylococcus epidermidis
LSERTKRY

SEQ ID NO: 1838555 - protein, 8 aa, Staphylococcus epidermidis
LSIDTDKP

SEQ ID NO: 1838556 - protein, 8 aa, Staphylococcus epidermidis
LSKDAANP

SEQ ID NO: 1838557 - protein, 8 aa, Staphylococcus epidermidis
LSKEGRRY

SEQ ID NO: 1838558 - protein, 12 aa, Staphylococcus epidermidis
LSKLDNKPQQST

SEQ ID NO: 1838559 - protein, 10 aa, Staphylococcus epidermidis
LSPEQTVDQI

SEQ ID NO: 1838560 - protein, 12 aa, Staphylococcus epidermidis
LSPNSRNKRSNW

SEQ ID NO: 1838561 - protein, 13 aa, Staphylococcus epidermidis
LSQEDSSQGHGQM

SEQ ID NO: 1838562 - protein, 16 aa, Staphylococcus epidermidis
LSSNSDFQDAKDALHQ

SEQ ID NO: 1838563 - protein, 9 aa, Staphylococcus epidermidis
LSTGPNDGM

SEQ ID NO: 1838564 - protein, 10 aa, Staphylococcus epidermidis
LTDDVTKGLS

SEQ ID NO: 1838565 - protein, 8 aa, Staphylococcus epidermidis
LTQEEAVN

SEQ ID NO: 1838566 - protein, 10 aa, Staphylococcus epidermidis
LTYKDATSHL

SEQ ID NO: 1838567 - protein, 32 aa, Staphylococcus epidermidis
LVEDSSPKYQREDNGKSKKTYDGFEEQDNGTL

SEQ ID NO: 1838568 - protein, 15 aa, Staphylococcus epidermidis
LVEKDSKHKSYYEKN

SEQ ID NO: 1838569 - protein, 4 aa, Staphylococcus epidermidis
LYDS

SEQ ID NO: 1838570 - protein, 12 aa, Staphylococcus epidermidis
LYNTGGPGHWVT

SEQ ID NO: 1838571 - protein, 45 aa, Staphylococcus epidermidis
MDKEDQEGEDVDTNKNQSSSEQKQTQANDDSSERNKKYSSITDSA

SEQ ID NO: 1838572 - protein, 45 aa, Staphylococcus epidermidis
MDKEDQEGENVDTNKNQSSSEQQQTQANDDSSESNKKYSSITDSA

SEQ ID NO: 1838573 - protein, 11 aa, Staphylococcus epidermidis
MKDEKEQRVKR

SEQ ID NO: 1838574 - protein, 9 aa, Staphylococcus epidermidis
MKDPDKDVK

SEQ ID NO: 1838575 - protein, 39 aa, Staphylococcus epidermidis
MKNQERKDEEKFESTAEAQWQKEQKQEQINRENRSRKKK

SEQ ID NO: 1838576 - protein, 21 aa, Staphylococcus epidermidis
MKNRPGNKSRVNSSVPQSQYN

SEQ ID NO: 1838577 - protein, 4 aa, Staphylococcus epidermidis
MKPH

SEQ ID NO: 1838578 - protein, 5 aa, Staphylococcus epidermidis
MKTEN

SEQ ID NO: 1838579 - protein, 6 aa, Staphylococcus epidermidis
MNQPSL

SEQ ID NO: 1838580 - protein, 11 aa, Staphylococcus epidermidis
MNYNGGPGVVS

SEQ ID NO: 1838581 - protein, 16 aa, Staphylococcus epidermidis
MPKFEEATSDMPAEEY

SEQ ID NO: 1838582 - protein, 23 aa, Staphylococcus epidermidis
MSDDSNKDSQSVPEEMPASKYVG

SEQ ID NO: 1838583 - protein, 11 aa, Staphylococcus epidermidis
MTTSEIKSFGS

SEQ ID NO: 1838584 - protein, 9 aa, Staphylococcus epidermidis
MTVQENASI

SEQ ID NO: 1838585 - protein, 11 aa, Staphylococcus epidermidis
MVKAKDLEEVK

SEQ ID NO: 1838586 - protein, 11 aa, Staphylococcus epidermidis
MVKAKDLEKVK

SEQ ID NO: 1838587 - protein, 89 aa, Staphylococcus epidermidis
NAATSGGSSGSSSSSSSSSSSSASSSASRGSTSSSSSMSRSSAANASRTAQQSSQRAAQQAARSSSMKSSANASKYRQSTQNMRSQSRS

SEQ ID NO: 1838588 - protein, 26 aa, Staphylococcus epidermidis
NADRNLNRIDSSESMNGYRRGAYQDM

SEQ ID NO: 1838589 - protein, 26 aa, Staphylococcus epidermidis
NADRNLNRIDSSESMNGYRRGAYQNM

SEQ ID NO: 1838590 - protein, 8 aa, Staphylococcus epidermidis
NADTQTEC

SEQ ID NO: 1838591 - protein, 29 aa, Staphylococcus epidermidis
NAEADAAQTNDNSGQQKTVQSNENHGNGF

SEQ ID NO: 1838592 - protein, 18 aa, Staphylococcus epidermidis
NAGGKPGVLANDSTLTKQ

SEQ ID NO: 1838593 - protein, 17 aa, Staphylococcus epidermidis
NAHGQKVTINTKEPYPE

SEQ ID NO: 1838594 - protein, 19 aa, Staphylococcus epidermidis
NAHGQKVTINTKEPYPELK

SEQ ID NO: 1838595 - protein, 4 aa, Staphylococcus epidermidis
NAIQ

SEQ ID NO: 1838596 - protein, 11 aa, Staphylococcus epidermidis
NAKHNLTKKEI

SEQ ID NO: 1838597 - protein, 22 aa, Staphylococcus epidermidis
NAKKQEEEEKENQDSSKKDNHK

SEQ ID NO: 1838598 - protein, 9 aa, Staphylococcus epidermidis
NAMPNAQDS

SEQ ID NO: 1838599 - protein, 7 aa, Staphylococcus epidermidis
NAPANSR

SEQ ID NO: 1838600 - protein, 9 aa, Staphylococcus epidermidis
NAPGIGQSF

SEQ ID NO: 1838601 - protein, 8 aa, Staphylococcus epidermidis
NATSSWGL

SEQ ID NO: 1838602 - protein, 34 aa, Staphylococcus epidermidis
NAVATTNKKSKQQTTQQNKDQTNKKAKHSQYKNH

SEQ ID NO: 1838603 - protein, 4 aa, Staphylococcus epidermidis
NAYS

SEQ ID NO: 1838604 - protein, 11 aa, Staphylococcus epidermidis
NDANGPSYKAV

SEQ ID NO: 1838605 - protein, 8 aa, Staphylococcus epidermidis
NDAPHPQG

SEQ ID NO: 1838606 - protein, 6 aa, Staphylococcus epidermidis
NDEEAQ

SEQ ID NO: 1838607 - protein, 6 aa, Staphylococcus epidermidis
NDIELP

SEQ ID NO: 1838608 - protein, 7 aa, Staphylococcus epidermidis
NDKCNSY

SEQ ID NO: 1838609 - protein, 15 aa, Staphylococcus epidermidis
NDKDQNTRKQAAEDI

SEQ ID NO: 1838610 - protein, 10 aa, Staphylococcus epidermidis
NDMQKAKELY

SEQ ID NO: 1838611 - protein, 8 aa, Staphylococcus epidermidis
NDPSVSQY

SEQ ID NO: 1838612 - protein, 17 aa, Staphylococcus epidermidis
NDQRAHKPLTPSQPQNM

SEQ ID NO: 1838613 - protein, 4 aa, Staphylococcus epidermidis
NDTF

SEQ ID NO: 1838614 - protein, 29 aa, Staphylococcus epidermidis
NDYKNGDISYNPNVPSYSAEYDLENNNYN

SEQ ID NO: 1838615 - protein, 4 aa, Staphylococcus epidermidis
NDYT

SEQ ID NO: 1838616 - protein, 37 aa, Staphylococcus epidermidis
NDYTNGPNYHPKKEKIKDKGEKKHKHKDSKEDKQNQS

SEQ ID NO: 1838617 - protein, 7 aa, Staphylococcus epidermidis
NEDDLKE

SEQ ID NO: 1838618 - protein, 26 aa, Staphylococcus epidermidis
NEELSEASEYYEDKIDSEESLSQNEI

SEQ ID NO: 1838619 - protein, 12 aa, Staphylococcus epidermidis
NEGELKTNGRLK

SEQ ID NO: 1838620 - protein, 16 aa, Staphylococcus epidermidis
NEGTSIDTYTESRKVG

SEQ ID NO: 1838621 - protein, 37 aa, Staphylococcus epidermidis
NEKGITSFNDVKGKKLAQTFTSNYGQLAKDKGADITK

SEQ ID NO: 1838622 - protein, 8 aa, Staphylococcus epidermidis
NEKISAKR

SEQ ID NO: 1838623 - protein, 7 aa, Staphylococcus epidermidis
NEKRKQI

SEQ ID NO: 1838624 - protein, 9 aa, Staphylococcus epidermidis
NENDIEERH

SEQ ID NO: 1838625 - protein, 6 aa, Staphylococcus epidermidis
NEQRLN

SEQ ID NO: 1838626 - protein, 11 aa, Staphylococcus epidermidis
NESKKDVPNSY

SEQ ID NO: 1838627 - protein, 8 aa, Staphylococcus epidermidis
NETGAKYP

SEQ ID NO: 1838628 - protein, 9 aa, Staphylococcus epidermidis
NEVYSGETF

SEQ ID NO: 1838629 - protein, 30 aa, Staphylococcus epidermidis
NFEASGKERDGSDAKKISNTVKVPKNPKNA

SEQ ID NO: 1838630 - protein, 11 aa, Staphylococcus epidermidis
NFPQDNGAAPR

SEQ ID NO: 1838631 - protein, 14 aa, Staphylococcus epidermidis
NFPTQTSKAAQQRA

SEQ ID NO: 1838632 - protein, 6 aa, Staphylococcus epidermidis
NFQNRT

SEQ ID NO: 1838633 - protein, 14 aa, Staphylococcus epidermidis
NFSSNSYKLKRVKT

SEQ ID NO: 1838634 - protein, 51 aa, Staphylococcus epidermidis
NGEVQYKSGNYGEYSTLNNKDCYTGQGITTKTYKETHHATNADTSVDSARE

SEQ ID NO: 1838635 - protein, 128 aa, Staphylococcus epidermidis
NGGAQGNKNNGGSANQSNAHEGNGIKNGGLQGNKSNGGDATQKNEDQGNGFKNGGAQGNKNNGGKTDQSNAHEGNGIKNGGLQGNKSNGGDATQKNEDQGNGFKNGGAQGNKNNGGSVAQSNAHEGKG

SEQ ID NO: 1838636 - protein, 9 aa, Staphylococcus epidermidis
NGIKPPHPY

SEQ ID NO: 1838637 - protein, 6 aa, Staphylococcus epidermidis
NGKDSY

SEQ ID NO: 1838638 - protein, 34 aa, Staphylococcus epidermidis
NGKPSSAKKSTSDSNQHTHSKNSTSKTAQPHKKS

SEQ ID NO: 1838639 - protein, 4 aa, Staphylococcus epidermidis
NGKY

SEQ ID NO: 1838640 - protein, 4 aa, Staphylococcus epidermidis
NGME

SEQ ID NO: 1838641 - protein, 7 aa, Staphylococcus epidermidis
NGNAGYN

SEQ ID NO: 1838642 - protein, 18 aa, Staphylococcus epidermidis
NGNPEEVDYQKQHGGSIS

SEQ ID NO: 1838643 - protein, 7 aa, Staphylococcus epidermidis
NGQDIPN

SEQ ID NO: 1838644 - protein, 10 aa, Staphylococcus epidermidis
NGSVSKKDMD

SEQ ID NO: 1838645 - protein, 4 aa, Staphylococcus epidermidis
NGTA

SEQ ID NO: 1838646 - protein, 7 aa, Staphylococcus epidermidis
NGTAPLE

SEQ ID NO: 1838647 - protein, 9 aa, Staphylococcus epidermidis
NGTKSDHRY

SEQ ID NO: 1838648 - protein, 5 aa, Staphylococcus epidermidis
NGYGQ

SEQ ID NO: 1838649 - protein, 9 aa, Staphylococcus epidermidis
NHAGYYPNA

SEQ ID NO: 1838650 - protein, 7 aa, Staphylococcus epidermidis
NHGDQSL

SEQ ID NO: 1838651 - protein, 6 aa, Staphylococcus epidermidis
NHIGGK

SEQ ID NO: 1838652 - protein, 9 aa, Staphylococcus epidermidis
NHIKQTPTA

SEQ ID NO: 1838653 - protein, 9 aa, Staphylococcus epidermidis
NHYEDSDSE

SEQ ID NO: 1838654 - protein, 6 aa, Staphylococcus epidermidis
NHYGNV

SEQ ID NO: 1838655 - protein, 5 aa, Staphylococcus epidermidis
NIAPR

SEQ ID NO: 1838656 - protein, 26 aa, Staphylococcus epidermidis
NIEKNSDDLLNKAKNKAKDLNTEENR

SEQ ID NO: 1838657 - protein, 9 aa, Staphylococcus epidermidis
NIENTYDGT

SEQ ID NO: 1838658 - protein, 10 aa, Staphylococcus epidermidis
NIEQHPNANV

SEQ ID NO: 1838659 - protein, 7 aa, Staphylococcus epidermidis
NIKGKGV

SEQ ID NO: 1838660 - protein, 15 aa, Staphylococcus epidermidis
NITHAKESHDSTPQN

SEQ ID NO: 1838661 - protein, 15 aa, Staphylococcus epidermidis
NKDDSKEKEIKKSFN

SEQ ID NO: 1838662 - protein, 7 aa, Staphylococcus epidermidis
NKDGNIN

SEQ ID NO: 1838663 - protein, 9 aa, Staphylococcus epidermidis
NKDKYQYTG

SEQ ID NO: 1838664 - protein, 18 aa, Staphylococcus epidermidis
NKDNQQAHDYDVKDAEKL

SEQ ID NO: 1838665 - protein, 12 aa, Staphylococcus epidermidis
NKDQQNDKDLSY

SEQ ID NO: 1838666 - protein, 12 aa, Staphylococcus epidermidis
NKDYSGSYYPSV

SEQ ID NO: 1838667 - protein, 8 aa, Staphylococcus epidermidis
NKEAFQKA

SEQ ID NO: 1838668 - protein, 14 aa, Staphylococcus epidermidis
NKEAKSKSSFSGKK

SEQ ID NO: 1838669 - protein, 11 aa, Staphylococcus epidermidis
NKGDKAEPAIA

SEQ ID NO: 1838670 - protein, 10 aa, Staphylococcus epidermidis
NKGHYNNKEV

SEQ ID NO: 1838671 - protein, 7 aa, Staphylococcus epidermidis
NKGKADL

SEQ ID NO: 1838672 - protein, 4 aa, Staphylococcus epidermidis
NKGY

SEQ ID NO: 1838673 - protein, 5 aa, Staphylococcus epidermidis
NKHEL

SEQ ID NO: 1838674 - protein, 23 aa, Staphylococcus epidermidis
NKHPQTKAPQKQTTQKLTNQKDL

SEQ ID NO: 1838675 - protein, 9 aa, Staphylococcus epidermidis
NKKVDPASL

SEQ ID NO: 1838676 - protein, 4 aa, Staphylococcus epidermidis
NKQD

SEQ ID NO: 1838677 - protein, 5 aa, Staphylococcus epidermidis
NKQGW

SEQ ID NO: 1838678 - protein, 14 aa, Staphylococcus epidermidis
NKQLDKVKKAADDL

SEQ ID NO: 1838679 - protein, 10 aa, Staphylococcus epidermidis
NKQSLYSDQE

SEQ ID NO: 1838680 - protein, 9 aa, Staphylococcus epidermidis
NKQTSPMTE

SEQ ID NO: 1838681 - protein, 9 aa, Staphylococcus epidermidis
NKSNEQALK

SEQ ID NO: 1838682 - protein, 12 aa, Staphylococcus epidermidis
NKTDLQQAPDEF

SEQ ID NO: 1838683 - protein, 14 aa, Staphylococcus epidermidis
NKTSQSVPEEMPAS

SEQ ID NO: 1838684 - protein, 12 aa, Staphylococcus epidermidis
NKVEIDGKTNKY

SEQ ID NO: 1838685 - protein, 14 aa, Staphylococcus epidermidis
NKYDNRHYNKTINS

SEQ ID NO: 1838686 - protein, 14 aa, Staphylococcus epidermidis
NLGFESAKAVKDDH

SEQ ID NO: 1838687 - protein, 5 aa, Staphylococcus epidermidis
NLNSI

SEQ ID NO: 1838688 - protein, 8 aa, Staphylococcus epidermidis
NLSGPQSK

SEQ ID NO: 1838689 - protein, 14 aa, Staphylococcus epidermidis
NLSKTDTTDKNKKE

SEQ ID NO: 1838690 - protein, 27 aa, Staphylococcus epidermidis
NLSLKGQPKYYKGTDGLKTGTSDSGYS

SEQ ID NO: 1838691 - protein, 8 aa, Staphylococcus epidermidis
NLSNNQKW

SEQ ID NO: 1838692 - protein, 5 aa, Staphylococcus epidermidis
NLYTA

SEQ ID NO: 1838693 - protein, 13 aa, Staphylococcus epidermidis
NMDGKDDGKIPDG

SEQ ID NO: 1838694 - protein, 21 aa, Staphylococcus epidermidis
NMFGNSTKKYNDYSIEATEDG

SEQ ID NO: 1838695 - protein, 4 aa, Staphylococcus epidermidis
NMGQ

SEQ ID NO: 1838696 - protein, 8 aa, Staphylococcus epidermidis
NMTKERLQ

SEQ ID NO: 1838697 - protein, 17 aa, Staphylococcus epidermidis
NNANGPSYKAVKQQLGH

SEQ ID NO: 1838698 - protein, 10 aa, Staphylococcus epidermidis
NNAPNINSNQ

SEQ ID NO: 1838699 - protein, 5 aa, Staphylococcus epidermidis
NNDME

SEQ ID NO: 1838700 - protein, 7 aa, Staphylococcus epidermidis
NNDSVEE

SEQ ID NO: 1838701 - protein, 4 aa, Staphylococcus epidermidis
NNDV

SEQ ID NO: 1838702 - protein, 5 aa, Staphylococcus epidermidis
NNDYD

SEQ ID NO: 1838703 - protein, 5 aa, Staphylococcus epidermidis
NNEAT

SEQ ID NO: 1838704 - protein, 12 aa, Staphylococcus epidermidis
NNFDPKSKNEVD

SEQ ID NO: 1838705 - protein, 10 aa, Staphylococcus epidermidis
NNGEKYKKDI

SEQ ID NO: 1838706 - protein, 39 aa, Staphylococcus epidermidis
NNGQKDNQSNKDQSESKDSKNSNQVKQIATDKNVQGDNY

SEQ ID NO: 1838707 - protein, 7 aa, Staphylococcus epidermidis
NNITGNE

SEQ ID NO: 1838708 - protein, 17 aa, Staphylococcus epidermidis
NNKDSVKKGDKVVTSGL

SEQ ID NO: 1838709 - protein, 14 aa, Staphylococcus epidermidis
NNKIPKEYKDPTQR

SEQ ID NO: 1838710 - protein, 5 aa, Staphylococcus epidermidis
NNLNA

SEQ ID NO: 1838711 - protein, 13 aa, Staphylococcus epidermidis
NNLNQKNDENFKS

SEQ ID NO: 1838712 - protein, 4 aa, Staphylococcus epidermidis
NNQV

SEQ ID NO: 1838713 - protein, 15 aa, Staphylococcus epidermidis
NNRHQISNTQEGHYA

SEQ ID NO: 1838714 - protein, 7 aa, Staphylococcus epidermidis
NNSLPNH

SEQ ID NO: 1838715 - protein, 22 aa, Staphylococcus epidermidis
NNSSNNNSTSKKNNSDSKETVT

SEQ ID NO: 1838716 - protein, 7 aa, Staphylococcus epidermidis
NNVKTDL

SEQ ID NO: 1838717 - protein, 11 aa, Staphylococcus epidermidis
NPASPGTHQYA

SEQ ID NO: 1838718 - protein, 7 aa, Staphylococcus epidermidis
NPRTQNN

SEQ ID NO: 1838719 - protein, 10 aa, Staphylococcus epidermidis
NPSNPGTHQY

SEQ ID NO: 1838720 - protein, 5 aa, Staphylococcus epidermidis
NPYLT

SEQ ID NO: 1838721 - protein, 179 aa, Staphylococcus epidermidis
NQEGDTASQSKTNQENQSDENVQKKNNQTQQDSTQTSPLNDQEQTLKGQQSKDNHVTPNSRQDTYPKGQNQDDKGKQQFKDNQHSQTEHQPNTQNQNNDQDSSDKKQHPSDQTQAPSSKGTQPKQSQSIGDRDKTVKQPSSKVHKIGNTKTDKTVKTNQKKQTSLTSPRVVKSKQTKHI

SEQ ID NO: 1838722 - protein, 179 aa, Staphylococcus epidermidis
NQEGETASQSKTNQENQSDGNVQKKDNQIQQGSTQTSPLNDQKQTSMEQQSKDNHVSPNSRQDTYPKGQNQDDKGKQQFKDNQHSQTEHQPNTQNQNNDQDSSDKKQHPSDQTQASSSKGTQPKQSQSIEDRDKTVKQPSSKVHKIGNTKTDKTVKTNQNKQTSLTSPRVVKSKQTKHI

SEQ ID NO: 1838723 - protein, 7 aa, Staphylococcus epidermidis
NQEQIEK

SEQ ID NO: 1838724 - protein, 12 aa, Staphylococcus epidermidis
NQHNEHSSHGGK

SEQ ID NO: 1838725 - protein, 4 aa, Staphylococcus epidermidis
NQLA

SEQ ID NO: 1838726 - protein, 11 aa, Staphylococcus epidermidis
NQPVNKEKLDK

SEQ ID NO: 1838727 - protein, 7 aa, Staphylococcus epidermidis
NQQGTEH

SEQ ID NO: 1838728 - protein, 9 aa, Staphylococcus epidermidis
NQSNPTIAP

SEQ ID NO: 1838729 - protein, 20 aa, Staphylococcus epidermidis
NQSNSQVVNGEVPAANGAAA

SEQ ID NO: 1838730 - protein, 8 aa, Staphylococcus epidermidis
NQVDQSSI

SEQ ID NO: 1838731 - protein, 27 aa, Staphylococcus epidermidis
NRDDHSVKHNTIDASQPTGAQSELERE

SEQ ID NO: 1838732 - protein, 11 aa, Staphylococcus epidermidis
NREVSKDSRSF

SEQ ID NO: 1838733 - protein, 6 aa, Staphylococcus epidermidis
NRIGGR

SEQ ID NO: 1838734 - protein, 4 aa, Staphylococcus epidermidis
NRIK

SEQ ID NO: 1838735 - protein, 6 aa, Staphylococcus epidermidis
NRLDES

SEQ ID NO: 1838736 - protein, 21 aa, Staphylococcus epidermidis
NRNESRGAHYKPEFPDRNDDE

SEQ ID NO: 1838737 - protein, 15 aa, Staphylococcus epidermidis
NRNGASSTAKYYGDE

SEQ ID NO: 1838738 - protein, 7 aa, Staphylococcus epidermidis
NRNTGDV

SEQ ID NO: 1838739 - protein, 6 aa, Staphylococcus epidermidis
NSAEAK

SEQ ID NO: 1838740 - protein, 8 aa, Staphylococcus epidermidis
NSANSQSF

SEQ ID NO: 1838741 - protein, 299 aa, Staphylococcus epidermidis
NSAQAAEENHNQGTSDNEISQSIGTNNENVNEHQTTKNEETQSTSEQPNVKNDTNDKTNQQNSLHNENNQKDVHQNTDNEESATSQNQAQEQSTGNQGHQQSDSKEDVKQPSTTDDARKTDQTSTENTKEKAQNQNAKTEAEDAAPMEKAEHHESADNQTQIPSKTENKSDNQGNQVSESETQDKQQTKENAQNSKDEDAQTLTKENTDETKSSKDTDDTTATVKSPKATSQKDNQPEADNHQKVTAQDDATSEATLATTKDSDESKSLTVGDNANPTSNKDDSSDKDKDSKDGLGTLK

SEQ ID NO: 1838742 - protein, 13 aa, Staphylococcus epidermidis
NSDFQDAKAALQQ

SEQ ID NO: 1838743 - protein, 16 aa, Staphylococcus epidermidis
NSGKKDSAVSDKTVRQ

SEQ ID NO: 1838744 - protein, 16 aa, Staphylococcus epidermidis
NSIDNNNSKENSEDKI

SEQ ID NO: 1838745 - protein, 5 aa, Staphylococcus epidermidis
NSIYT

SEQ ID NO: 1838746 - protein, 4 aa, Staphylococcus epidermidis
NSKD

SEQ ID NO: 1838747 - protein, 73 aa, Staphylococcus epidermidis
NSKEEPLKVDKQANPTTDKDKSSKNDKGSHDGLANLESNAVATTNKQSKQQVSEKNEDQTNKSAKQKQYKNND

SEQ ID NO: 1838748 - protein, 73 aa, Staphylococcus epidermidis
NSKEEPLKVDKQANPTTDKDKSSKNDKGSQDGLANLESNAVATTNKHSKQQVSEKNEDQTNKSAKQKQYKNND

SEQ ID NO: 1838749 - protein, 9 aa, Staphylococcus epidermidis
NSKWPDKKI

SEQ ID NO: 1838750 - protein, 9 aa, Staphylococcus epidermidis
NSLTDGETM

SEQ ID NO: 1838751 - protein, 12 aa, Staphylococcus epidermidis
NSNDNPGNAGSY

SEQ ID NO: 1838752 - protein, 16 aa, Staphylococcus epidermidis
NSNSSHTKELNDLEKK

SEQ ID NO: 1838753 - protein, 11 aa, Staphylococcus epidermidis
NSNSSHTQELN

SEQ ID NO: 1838754 - protein, 16 aa, Staphylococcus epidermidis
NSNYRTPKTQPTSTQY

SEQ ID NO: 1838755 - protein, 6 aa, Staphylococcus epidermidis
NSSIYT

SEQ ID NO: 1838756 - protein, 19 aa, Staphylococcus epidermidis
NSSQAKQQIENKSDVSTRS

SEQ ID NO: 1838757 - protein, 8 aa, Staphylococcus epidermidis
NSWDNDSE

SEQ ID NO: 1838758 - protein, 4 aa, Staphylococcus epidermidis
NSWP

SEQ ID NO: 1838759 - protein, 16 aa, Staphylococcus epidermidis
NSYASAQTKFLYKSKE

SEQ ID NO: 1838760 - protein, 4 aa, Staphylococcus epidermidis
NSYY

SEQ ID NO: 1838761 - protein, 10 aa, Staphylococcus epidermidis
NTAKSPVKVN

SEQ ID NO: 1838762 - protein, 20 aa, Staphylococcus epidermidis
NTKDVDALKDKKKAHDTYNY

SEQ ID NO: 1838763 - protein, 8 aa, Staphylococcus epidermidis
NTKEGIKP

SEQ ID NO: 1838764 - protein, 15 aa, Staphylococcus epidermidis
NTKIDRDKSNTHVYK

SEQ ID NO: 1838765 - protein, 16 aa, Staphylococcus epidermidis
NTLSNERNNKTFNSKN

SEQ ID NO: 1838766 - protein, 9 aa, Staphylococcus epidermidis
NTNAQVGHS

SEQ ID NO: 1838767 - protein, 6 aa, Staphylococcus epidermidis
NTNGQY

SEQ ID NO: 1838768 - protein, 7 aa, Staphylococcus epidermidis
NTPSSIA

SEQ ID NO: 1838769 - protein, 4 aa, Staphylococcus epidermidis
NTRH

SEQ ID NO: 1838770 - protein, 7 aa, Staphylococcus epidermidis
NTRTSKG

SEQ ID NO: 1838771 - protein, 8 aa, Staphylococcus epidermidis
NTRTTKGS

SEQ ID NO: 1838772 - protein, 6 aa, Staphylococcus epidermidis
NTSLDD

SEQ ID NO: 1838773 - protein, 30 aa, Staphylococcus epidermidis
NTSSSGVESGESTDVNSGNQTNNSVSLYPY

SEQ ID NO: 1838774 - protein, 13 aa, Staphylococcus epidermidis
NTTFGDKQRAQVT

SEQ ID NO: 1838775 - protein, 5 aa, Staphylococcus epidermidis
NTYKV

SEQ ID NO: 1838776 - protein, 16 aa, Staphylococcus epidermidis
NVGDQSIGFSSDDNEL

SEQ ID NO: 1838777 - protein, 6 aa, Staphylococcus epidermidis
NVKDSG

SEQ ID NO: 1838778 - protein, 40 aa, Staphylococcus epidermidis
NVNATSKQTTSYKYKEPAQRVTTNTAKKETASNQATIDTK

SEQ ID NO: 1838779 - protein, 10 aa, Staphylococcus epidermidis
NVSSDGSVTV

SEQ ID NO: 1838780 - protein, 44 aa, Staphylococcus epidermidis
NVSTDTSNTTYDNYNSESTDTYSVPNAYNGLRSVSNSGNLYTTG

SEQ ID NO: 1838781 - protein, 8 aa, Staphylococcus epidermidis
NVVGSGDG

SEQ ID NO: 1838782 - protein, 12 aa, Staphylococcus epidermidis
NWAGQASSAGFK

SEQ ID NO: 1838783 - protein, 5 aa, Staphylococcus epidermidis
NWEPK

SEQ ID NO: 1838784 - protein, 21 aa, Staphylococcus epidermidis
NWNNRAESEGYSVTHSPKNHT

SEQ ID NO: 1838785 - protein, 99 aa, Staphylococcus epidermidis
  misc_feature (72)..(72): Xaa can be any naturally occurring amino acid
NWSPDRVNTSYNYNSYNNYNNYGYNNYSNYNNYSNYNNYNNYQSNNTQSQRTTQPTGGLGASYSTSSSNVHXTTTSAPSSNGVSLSNARSASGNLYTSG

SEQ ID NO: 1838786 - protein, 30 aa, Staphylococcus epidermidis
NWSPNQAQQGNNANYSNANQGTQNYNSNNY

SEQ ID NO: 1838787 - protein, 12 aa, Staphylococcus epidermidis
NYAASKEKDDKD

SEQ ID NO: 1838788 - protein, 4 aa, Staphylococcus epidermidis
NYEI

SEQ ID NO: 1838789 - protein, 30 aa, Staphylococcus epidermidis
NYGNTNQSYSNAYNQTGGLGSSYSSTSRNV

SEQ ID NO: 1838790 - protein, 16 aa, Staphylococcus epidermidis
NYGTIEEAKKEHPNAD

SEQ ID NO: 1838791 - protein, 5 aa, Staphylococcus epidermidis
NYIDK

SEQ ID NO: 1838792 - protein, 7 aa, Staphylococcus epidermidis
NYIPNSN

SEQ ID NO: 1838793 - protein, 11 aa, Staphylococcus epidermidis
NYKAPQIEENY

SEQ ID NO: 1838794 - protein, 10 aa, Staphylococcus epidermidis
NYKKSSKSGY

SEQ ID NO: 1838795 - protein, 9 aa, Staphylococcus epidermidis
NYKRSQKLE

SEQ ID NO: 1838796 - protein, 67 aa, Staphylococcus epidermidis
NYNGSNNNQTQSYQSNNNGGGLGASYSTSDRNVKVTTQSAPTQQSSNHSSAAFSGQTSSGSNLYTSG

SEQ ID NO: 1838797 - protein, 7 aa, Staphylococcus epidermidis
NYQPQNT

SEQ ID NO: 1838798 - protein, 7 aa, Staphylococcus epidermidis
PAAPTGV

SEQ ID NO: 1838799 - protein, 5 aa, Staphylococcus epidermidis
PAIKS

SEQ ID NO: 1838800 - protein, 16 aa, Staphylococcus epidermidis
PAKISSNSNTQTDQDI

SEQ ID NO: 1838801 - protein, 14 aa, Staphylococcus epidermidis
PASIKTSKDVEKLA

SEQ ID NO: 1838802 - protein, 14 aa, Staphylococcus epidermidis
PDGKKAGKDKQPMS

SEQ ID NO: 1838803 - protein, 4 aa, Staphylococcus epidermidis
PDQF

SEQ ID NO: 1838804 - protein, 7 aa, Staphylococcus epidermidis
PDTIAKH

SEQ ID NO: 1838805 - protein, 58 aa, Staphylococcus epidermidis
PDTNAKGLSHEKSEFSANVQKPTSSQSSTQANALKKVNEKNLTSNPDDPSLPKDSKVN

SEQ ID NO: 1838806 - protein, 32 aa, Staphylococcus epidermidis
PDVSQSDIDNNYKVSKQKISPETVKVTGGEQQ

SEQ ID NO: 1838807 - protein, 50 aa, Staphylococcus epidermidis
PEEINKFDDDDTDSDDSNKDKKEDKEHKEKSDDKENDNQEKKKTDLTLSE

SEQ ID NO: 1838808 - protein, 16 aa, Staphylococcus epidermidis
PEGALNKGNYSNPKVT

SEQ ID NO: 1838809 - protein, 5 aa, Staphylococcus epidermidis
PEHNG

SEQ ID NO: 1838810 - protein, 10 aa, Staphylococcus epidermidis
PEKIYGKDDE

SEQ ID NO: 1838811 - protein, 9 aa, Staphylococcus epidermidis
PERINPGDK

SEQ ID NO: 1838812 - protein, 19 aa, Staphylococcus epidermidis
PESGGNPNAVNPAGYRGLG

SEQ ID NO: 1838813 - protein, 4 aa, Staphylococcus epidermidis
PETF

SEQ ID NO: 1838814 - protein, 22 aa, Staphylococcus epidermidis
PEYIGGQNNKNFINKEDNNTGV

SEQ ID NO: 1838815 - protein, 22 aa, Staphylococcus epidermidis
PEYLGGQNNKNFINREDNNTGV

SEQ ID NO: 1838816 - protein, 9 aa, Staphylococcus epidermidis
PEYTSDWEP

SEQ ID NO: 1838817 - protein, 10 aa, Staphylococcus epidermidis
PFNRDEKVEN

SEQ ID NO: 1838818 - protein, 10 aa, Staphylococcus epidermidis
PGADANSLGF

SEQ ID NO: 1838819 - protein, 8 aa, Staphylococcus epidermidis
PGGIQSEF

SEQ ID NO: 1838820 - protein, 10 aa, Staphylococcus epidermidis
PGPPKEMKPM

SEQ ID NO: 1838821 - protein, 35 aa, Staphylococcus epidermidis
PGQAHANEVSQNQKVIEQQEDSQIDEDNSNSKAHQ

SEQ ID NO: 1838822 - protein, 4 aa, Staphylococcus epidermidis
PHDF

SEQ ID NO: 1838823 - protein, 10 aa, Staphylococcus epidermidis
PHPAKTDDKV

SEQ ID NO: 1838824 - protein, 12 aa, Staphylococcus epidermidis
PHTSSDSQYPED

SEQ ID NO: 1838825 - protein, 37 aa, Staphylococcus epidermidis
PIASSNISHAATETTSTTQNNNAAGQISKVGENDAQF

SEQ ID NO: 1838826 - protein, 4 aa, Staphylococcus epidermidis
PKDQ

SEQ ID NO: 1838827 - protein, 7 aa, Staphylococcus epidermidis
PKEKKTE

SEQ ID NO: 1838828 - protein, 6 aa, Staphylococcus epidermidis
PKIDQN

SEQ ID NO: 1838829 - protein, 4 aa, Staphylococcus epidermidis
PKIS

SEQ ID NO: 1838830 - protein, 10 aa, Staphylococcus epidermidis
PKKVEGAPND

SEQ ID NO: 1838831 - protein, 6 aa, Staphylococcus epidermidis
PKSDKL

SEQ ID NO: 1838832 - protein, 6 aa, Staphylococcus epidermidis
PLSDDA

SEQ ID NO: 1838833 - protein, 5 aa, Staphylococcus epidermidis
PLTNG

SEQ ID NO: 1838834 - protein, 10 aa, Staphylococcus epidermidis
PLYKGNNDNM

SEQ ID NO: 1838835 - protein, 12 aa, Staphylococcus epidermidis
PMAGSHKSGVLN

SEQ ID NO: 1838836 - protein, 6 aa, Staphylococcus epidermidis
PNAQYD

SEQ ID NO: 1838837 - protein, 5 aa, Staphylococcus epidermidis
PNGAL

SEQ ID NO: 1838838 - protein, 5 aa, Staphylococcus epidermidis
PNNPV

SEQ ID NO: 1838839 - protein, 12 aa, Staphylococcus epidermidis
PNWKDQAEKVQR

SEQ ID NO: 1838840 - protein, 6 aa, Staphylococcus epidermidis
PNYKTK

SEQ ID NO: 1838841 - protein, 4 aa, Staphylococcus epidermidis
PPDI

SEQ ID NO: 1838842 - protein, 12 aa, Staphylococcus epidermidis
PPFGSAKDPVNM

SEQ ID NO: 1838843 - protein, 15 aa, Staphylococcus epidermidis
PPRKRDYTSKSKGGK

SEQ ID NO: 1838844 - protein, 4 aa, Staphylococcus epidermidis
PQDP

SEQ ID NO: 1838845 - protein, 4 aa, Staphylococcus epidermidis
PQSE

SEQ ID NO: 1838846 - protein, 7 aa, Staphylococcus epidermidis
PRDTQAK

SEQ ID NO: 1838847 - protein, 6 aa, Staphylococcus epidermidis
PRGDTG

SEQ ID NO: 1838848 - protein, 14 aa, Staphylococcus epidermidis
PRRPYSSGAPYTSQ

SEQ ID NO: 1838849 - protein, 8 aa, Staphylococcus epidermidis
PSKPQIDA

SEQ ID NO: 1838850 - protein, 16 aa, Staphylococcus epidermidis
PSKQMDKVKQAAKDLR

SEQ ID NO: 1838851 - protein, 17 aa, Staphylococcus epidermidis
PSQNADKLEAKAKPLEK

SEQ ID NO: 1838852 - protein, 7 aa, Staphylococcus epidermidis
PSSFTDA

SEQ ID NO: 1838853 - protein, 7 aa, Staphylococcus epidermidis
PSYAGGI

SEQ ID NO: 1838854 - protein, 4 aa, Staphylococcus epidermidis
PSYG

SEQ ID NO: 1838855 - protein, 6 aa, Staphylococcus epidermidis
PSYGKF

SEQ ID NO: 1838856 - protein, 14 aa, Staphylococcus epidermidis
PTAKQLTYGTGTAI

SEQ ID NO: 1838857 - protein, 5 aa, Staphylococcus epidermidis
PTKKS

SEQ ID NO: 1838858 - protein, 10 aa, Staphylococcus epidermidis
PTKVEGAPSD

SEQ ID NO: 1838859 - protein, 9 aa, Staphylococcus epidermidis
PTQLSDPSG

SEQ ID NO: 1838860 - protein, 14 aa, Staphylococcus epidermidis
PYKVTPNPKNIKKT

SEQ ID NO: 1838861 - protein, 36 aa, Staphylococcus epidermidis
PYTTGKTSVNKYKGTVKKYDQSFSGVNTKKTRAGKV

SEQ ID NO: 1838862 - protein, 7 aa, Staphylococcus epidermidis
QAAYGKN

SEQ ID NO: 1838863 - protein, 20 aa, Staphylococcus epidermidis
QAEDPTCMKGKDQSIRQSQM

SEQ ID NO: 1838864 - protein, 20 aa, Staphylococcus epidermidis
QAEDSTCFKGKDKDIRQSQM

SEQ ID NO: 1838865 - protein, 39 aa, Staphylococcus epidermidis
QASEKSTPQADSMHQASHKKVTNENGKANKKVKPLGSRK

SEQ ID NO: 1838866 - protein, 102 aa, Staphylococcus epidermidis
QATKTRKVSSSSKVSKSKTSRTSKTATKSKATTSKTSKSKVTKAKPVKPSVKTSVRTATKTTHSQPKKNYYNKPPKRWPSNIPGGDNVRDFGQTTKESGLDD

SEQ ID NO: 1838867 - protein, 11 aa, Staphylococcus epidermidis
QDAKARSKAYQ

SEQ ID NO: 1838868 - protein, 15 aa, Staphylococcus epidermidis
QDDGKINYEYNGKKH

SEQ ID NO: 1838869 - protein, 22 aa, Staphylococcus epidermidis
QDGATQSEVDSKSKDLSRAYKD

SEQ ID NO: 1838870 - protein, 13 aa, Staphylococcus epidermidis
QDIKAEKNADTNA

SEQ ID NO: 1838871 - protein, 8 aa, Staphylococcus epidermidis
QDNQNKGI

SEQ ID NO: 1838872 - protein, 6 aa, Staphylococcus epidermidis
QDPSVE

SEQ ID NO: 1838873 - protein, 14 aa, Staphylococcus epidermidis
QDVKHNGFKFVDNK

SEQ ID NO: 1838874 - protein, 16 aa, Staphylococcus epidermidis
QDYGGDWPHVLKIGVE

SEQ ID NO: 1838875 - protein, 9 aa, Staphylococcus epidermidis
QEKSSERGW

SEQ ID NO: 1838876 - protein, 9 aa, Staphylococcus epidermidis
QEPRQAIGG

SEQ ID NO: 1838877 - protein, 7 aa, Staphylococcus epidermidis
QEQAGRV

SEQ ID NO: 1838878 - protein, 9 aa, Staphylococcus epidermidis
QESDDQRKR

SEQ ID NO: 1838879 - protein, 13 aa, Staphylococcus epidermidis
QESPLGGDDRPYH

SEQ ID NO: 1838880 - protein, 7 aa, Staphylococcus epidermidis
QETHKEM

SEQ ID NO: 1838881 - protein, 5 aa, Staphylococcus epidermidis
QEVGH

SEQ ID NO: 1838882 - protein, 12 aa, Staphylococcus epidermidis
QEVRATSDDTAV

SEQ ID NO: 1838883 - protein, 10 aa, Staphylococcus epidermidis
QFNREKKAKE

SEQ ID NO: 1838884 - protein, 13 aa, Staphylococcus epidermidis
QGAHAGYYPGNTP

SEQ ID NO: 1838885 - protein, 10 aa, Staphylococcus epidermidis
QGKEYSTQEV

SEQ ID NO: 1838886 - protein, 7 aa, Staphylococcus epidermidis
QGKPKLK

SEQ ID NO: 1838887 - protein, 8 aa, Staphylococcus epidermidis
QGLPRSGE

SEQ ID NO: 1838888 - protein, 5 aa, Staphylococcus epidermidis
QGNLP

SEQ ID NO: 1838889 - protein, 49 aa, Staphylococcus epidermidis
QHQSGKKSENSNTQTEQASNNKNSNSNNGHSSNNNESRGRVEDLTQSQK

SEQ ID NO: 1838890 - protein, 12 aa, Staphylococcus epidermidis
QHQSTFKKHGKA

SEQ ID NO: 1838891 - protein, 49 aa, Staphylococcus epidermidis
QHQTEKQSENSNTQTEQASNNKNSNSNNGHSSNNNESRDRVEDLTQSQK

SEQ ID NO: 1838892 - protein, 11 aa, Staphylococcus epidermidis
QIGGYKGTGID

SEQ ID NO: 1838893 - protein, 6 aa, Staphylococcus epidermidis
QINGKD

SEQ ID NO: 1838894 - protein, 9 aa, Staphylococcus epidermidis
QKDIEDLGG

SEQ ID NO: 1838895 - protein, 9 aa, Staphylococcus epidermidis
QKDQLRKQS

SEQ ID NO: 1838896 - protein, 13 aa, Staphylococcus epidermidis
QKEIKDIEDELAK

SEQ ID NO: 1838897 - protein, 21 aa, Staphylococcus epidermidis
QKLSPKKDSIALENAKDNPYA

SEQ ID NO: 1838898 - protein, 7 aa, Staphylococcus epidermidis
QKNHPAA

SEQ ID NO: 1838899 - protein, 5 aa, Staphylococcus epidermidis
QKNIN

SEQ ID NO: 1838900 - protein, 23 aa, Staphylococcus epidermidis
QKPINDASHTGWTTNGHTGEDVN

SEQ ID NO: 1838901 - protein, 72 aa, Staphylococcus epidermidis
QKPSNDSTYQTQSKAKQDSSKQLPQEKTAKHQIQTTENEQTTNVNSKKANDTQDARQHTQEPKNDTSRLQKN

SEQ ID NO: 1838902 - protein, 108 aa, Staphylococcus epidermidis; identical to SEQ ID NO: 1734643

SEQ ID NO: 1838903 - protein, 19 aa, Staphylococcus epidermidis
QKQQKQDRIDRENRSRKKK

SEQ ID NO: 1838904 - protein, 8 aa, Staphylococcus epidermidis
QKSGSRVK

SEQ ID NO: 1838905 - protein, 6 aa, Staphylococcus epidermidis
QKVNNK

SEQ ID NO: 1838906 - protein, 11 aa, Staphylococcus epidermidis
QLGKENNIPAP

SEQ ID NO: 1838907 - protein, 10 aa, Staphylococcus epidermidis
QLLNSQSDKV

SEQ ID NO: 1838908 - protein, 8 aa, Staphylococcus epidermidis
QLNTPAKV

SEQ ID NO: 1838909 - protein, 7 aa, Staphylococcus epidermidis
QMKSNEK

SEQ ID NO: 1838910 - protein, 10 aa, Staphylococcus epidermidis
QNAKERSKAY

SEQ ID NO: 1838911 - protein, 14 aa, Staphylococcus epidermidis
QNGATLSPAERQSV

SEQ ID NO: 1838912 - protein, 10 aa, Staphylococcus epidermidis
QNGYKAKNLD

SEQ ID NO: 1838913 - protein, 15 aa, Staphylococcus epidermidis
QNHPDQLNAKPVQAG

SEQ ID NO: 1838914 - protein, 17 aa, Staphylococcus epidermidis
QNKKLSKDKQYNDQTTN

SEQ ID NO: 1838915 - protein, 25 aa, Staphylococcus epidermidis
QNKPENGDKGSKDSKSSSNDGNNKD

SEQ ID NO: 1838916 - protein, 18 aa, Staphylococcus epidermidis
QNLSPLEDKTTELRDDNH

SEQ ID NO: 1838917 - protein, 5 aa, Staphylococcus epidermidis
QNQKA

SEQ ID NO: 1838918 - protein, 38 aa, Staphylococcus epidermidis
QNSKDVKRSLEIGGGHDTDLKEKYEENMGNKINKDGKV

SEQ ID NO: 1838919 - protein, 9 aa, Staphylococcus epidermidis
QNVKGGTDY

SEQ ID NO: 1838920 - protein, 7 aa, Staphylococcus epidermidis
QNYSIKP

SEQ ID NO: 1838921 - protein, 8 aa, Staphylococcus epidermidis
QPKNSHQT

SEQ ID NO: 1838922 - protein, 12 aa, Staphylococcus epidermidis
QPNEDNKKIGDV

SEQ ID NO: 1838923 - protein, 5 aa, Staphylococcus epidermidis
QPQSL

SEQ ID NO: 1838924 - protein, 29 aa, Staphylococcus epidermidis
QPSDLPEQSKQTLPESGNHDSIRGTEVAA

SEQ ID NO: 1838925 - protein, 14 aa, Staphylococcus epidermidis
QPSRVNVNEVTIRP

SEQ ID NO: 1838926 - protein, 5 aa, Staphylococcus epidermidis
QPSSI

SEQ ID NO: 1838927 - protein, 16 aa, Staphylococcus epidermidis
QPSTHQPKNVTLSTTH

SEQ ID NO: 1838928 - protein, 15 aa, Staphylococcus epidermidis
QPTTVAASSKDKKIS

SEQ ID NO: 1838929 - protein, 8 aa, Staphylococcus epidermidis
QQAQAAEI

SEQ ID NO: 1838930 - protein, 150 aa, Staphylococcus epidermidis; identical to SEQ ID NO: 1734725

SEQ ID NO: 1838931 - protein, 13 aa, Staphylococcus epidermidis
QQGKNAVDEILEE

SEQ ID NO: 1838932 - protein, 13 aa, Staphylococcus epidermidis
QQGKNAVEEILEE

SEQ ID NO: 1838933 - protein, 21 aa, Staphylococcus epidermidis
QQIKQDKKNKKLTVEDKPSTV

SEQ ID NO: 1838934 - protein, 21 aa, Staphylococcus epidermidis
QQIQQDKKNKNLKVEEASSTV

SEQ ID NO: 1838935 - protein, 23 aa, Staphylococcus epidermidis
QQKDSQNDNKSESVVEQNKENEA

SEQ ID NO: 1838936 - protein, 8 aa, Staphylococcus epidermidis
QQQDEDKQ

SEQ ID NO: 1838937 - protein, 5 aa, Staphylococcus epidermidis
QRGDV

SEQ ID NO: 1838938 - protein, 6 aa, Staphylococcus epidermidis
QRRYGV

SEQ ID NO: 1838939 - protein, 9 aa, Staphylococcus epidermidis
QSEAKKANI

SEQ ID NO: 1838940 - protein, 11 aa, Staphylococcus epidermidis
QSGQDSISPGE

SEQ ID NO: 1838941 - protein, 13 aa, Staphylococcus epidermidis
QSGSGQNGAGAYG

SEQ ID NO: 1838942 - protein, 11 aa, Staphylococcus epidermidis
QSITKNSKRDK

SEQ ID NO: 1838943 - protein, 6 aa, Staphylococcus epidermidis
QSLDSI

SEQ ID NO: 1838944 - protein, 6 aa, Staphylococcus epidermidis
QSNDKF

SEQ ID NO: 1838945 - protein, 6 aa, Staphylococcus epidermidis
QSPENV

SEQ ID NO: 1838946 - protein, 33 aa, Staphylococcus epidermidis
QSSESAFESSQNTKDSQRKSTLRDTKVDPEKQP

SEQ ID NO: 1838947 - protein, 11 aa, Staphylococcus epidermidis
QSYDKSHNELG

SEQ ID NO: 1838948 - protein, 84 aa, Staphylococcus epidermidis
QTAIAKDDSDATRSKSNVTQHHTQSNEDKTTDTAKTQQDDKRNTSSSKKQDKKDNSKNDKPSTSSQSHQTTTAVTDKNKRDHTN

SEQ ID NO: 1838949 - protein, 80 aa, Staphylococcus epidermidis
QTGQATPQQDVSEQASASNNQTSAEQVSAQQQSNQAQPEQTAAPQTEQTQQPQAKATTSYSAPSNNTSSSKASSGSSVNV

SEQ ID NO: 1838950 - protein, 8 aa, Staphylococcus epidermidis
QTGTALEN

SEQ ID NO: 1838951 - protein, 6 aa, Staphylococcus epidermidis
QTKKGK

SEQ ID NO: 1838952 - protein, 8 aa, Staphylococcus epidermidis
QTKSGQDV

SEQ ID NO: 1838953 - protein, 25 aa, Staphylococcus epidermidis
QTSKGGGGYGTRTLTKKQAVQYNYI

SEQ ID NO: 1838954 - protein, 8 aa, Staphylococcus epidermidis
QVKGIDSG

SEQ ID NO: 1838955 - protein, 10 aa, Staphylococcus epidermidis
QVQSRQTAED

SEQ ID NO: 1838956 - protein, 56 aa, Staphylococcus epidermidis
QWEKEDGKKDTSSQQRHSNKDTSQESPTQSQHQNSKQTQPSHSEGQNKGSSMSDSA

SEQ ID NO: 1838957 - protein, 6 aa, Staphylococcus epidermidis
QYDEQY

SEQ ID NO: 1838958 - protein, 9 aa, Staphylococcus epidermidis
QYETSQKDI

SEQ ID NO: 1838959 - protein, 6 aa, Staphylococcus epidermidis
QYKRSQ

SEQ ID NO: 1838960 - protein, 4 aa, Staphylococcus epidermidis
QYWD

SEQ ID NO: 1838961 - protein, 14 aa, Staphylococcus epidermidis
RAGFATGKKPIAGS

SEQ ID NO: 1838962 - protein, 16 aa, Staphylococcus epidermidis
RAIQQAKSEGYNGDEY

SEQ ID NO: 1838963 - protein, 11 aa, Staphylococcus epidermidis
RAQAGKSISTY

SEQ ID NO: 1838964 - protein, 7 aa, Staphylococcus epidermidis
RAQDGHT

SEQ ID NO: 1838965 - protein, 8 aa, Staphylococcus epidermidis
RASEGKIS

SEQ ID NO: 1838966 - protein, 10 aa, Staphylococcus epidermidis
RDEADQMADY

SEQ ID NO: 1838967 - protein, 15 aa, Staphylococcus epidermidis
RDGATDLNRKTSLNP

SEQ ID NO: 1838968 - protein, 9 aa, Staphylococcus epidermidis
RDKANATEF

SEQ ID NO: 1838969 - protein, 18 aa, Staphylococcus epidermidis
RDKNFTDDNQRAGVDANY

SEQ ID NO: 1838970 - protein, 28 aa, Staphylococcus epidermidis
RDKSHEDRQNQRPPQKSQGEQQPKKGGF

SEQ ID NO: 1838971 - protein, 9 aa, Staphylococcus epidermidis
RDQTPAGPV

SEQ ID NO: 1838972 - protein, 6 aa, Staphylococcus epidermidis
RDVKRS

SEQ ID NO: 1838973 - protein, 6 aa, Staphylococcus epidermidis
REGRNI

SEQ ID NO: 1838974 - protein, 8 aa, Staphylococcus epidermidis
RENNSGVM

SEQ ID NO: 1838975 - protein, 10 aa, Staphylococcus epidermidis
REYQTNGNSF

SEQ ID NO: 1838976 - protein, 5 aa, Staphylococcus epidermidis
RGESY

SEQ ID NO: 1838977 - protein, 6 aa, Staphylococcus epidermidis
RGTENA

SEQ ID NO: 1838978 - protein, 12 aa, Staphylococcus epidermidis
RGVTKKEYSQLQ

SEQ ID NO: 1838979 - protein, 5 aa, Staphylococcus epidermidis
RINDD

SEQ ID NO: 1838980 - protein, 7 aa, Staphylococcus epidermidis
RKAAPDA

SEQ ID NO: 1838981 - protein, 6 aa, Staphylococcus epidermidis
RKDGKW

SEQ ID NO: 1838982 - protein, 15 aa, Staphylococcus epidermidis
RKEEGAGGDFGRQER

SEQ ID NO: 1838983 - protein, 10 aa, Staphylococcus epidermidis
RKGNDLETRG

SEQ ID NO: 1838984 - protein, 11 aa, Staphylococcus epidermidis
RKLPSANNGTK

SEQ ID NO: 1838985 - protein, 56 aa, Staphylococcus epidermidis
RKNQKDTTSDDNDSNNNNDENTNNNDNEQNNVQNNQTTDNQNTYENNNQDQYQQNN

SEQ ID NO: 1838986 - protein, 13 aa, Staphylococcus epidermidis
RKNQKESTDSQKE

SEQ ID NO: 1838987 - protein, 66 aa, Staphylococcus epidermidis
RKNQKESTDSQKESSSSSQNNDEEDQTNEQTDQNTLNGNEQYPNQQYNNQDNGENGMINNDNYPYA

SEQ ID NO: 1838988 - protein, 9 aa, Staphylococcus epidermidis
RKPDGSIDI

SEQ ID NO: 1838989 - protein, 12 aa, Staphylococcus epidermidis
RKPQGANIGEQR

SEQ ID NO: 1838990 - protein, 16 aa, Staphylococcus epidermidis
RKQTSKDLELGFYDKA

SEQ ID NO: 1838991 - protein, 16 aa, Staphylococcus epidermidis
RKQTSKDLELGYYDKA

SEQ ID NO: 1838992 - protein, 15 aa, Staphylococcus epidermidis
RKQTSKDLELNYYEN

SEQ ID NO: 1838993 - protein, 11 aa, Staphylococcus epidermidis
RKSEDDNDHEL

SEQ ID NO: 1838994 - protein, 13 aa, Staphylococcus epidermidis
RKVTQEKQDVDQL

SEQ ID NO: 1838995 - protein, 8 aa, Staphylococcus epidermidis
RLASQGNR

SEQ ID NO: 1838996 - protein, 5 aa, Staphylococcus epidermidis
RLDGE

SEQ ID NO: 1838997 - protein, 10 aa, Staphylococcus epidermidis
RMKAPDYPGF

SEQ ID NO: 1838998 - protein, 7 aa, Staphylococcus epidermidis
RMNSKQK

SEQ ID NO: 1838999 - protein, 9 aa, Staphylococcus epidermidis
RNEEGQTDI

SEQ ID NO: 1839000 - protein, 7 aa, Staphylococcus epidermidis
RNKDGEI

SEQ ID NO: 1839001 - protein, 7 aa, Staphylococcus epidermidis
RNQVEES

SEQ ID NO: 1839002 - protein, 11 aa, Staphylococcus epidermidis
RNRNNGSEETV

SEQ ID NO: 1839003 - protein, 6 aa, Staphylococcus epidermidis
RNRSQN

SEQ ID NO: 1839004 - protein, 7 aa, Staphylococcus epidermidis
RNTNKTV

SEQ ID NO: 1839005 - protein, 16 aa, Staphylococcus epidermidis
RPNSEAISIDSDNKEV

SEQ ID NO: 1839006 - protein, 13 aa, Staphylococcus epidermidis
RQGEPTLIDPNYQ

SEQ ID NO: 1839007 - protein, 4 aa, Staphylococcus epidermidis
RQKA

SEQ ID NO: 1839008 - protein, 13 aa, Staphylococcus epidermidis
RQKAKNLKSDVIK

SEQ ID NO: 1839009 - protein, 11 aa, Staphylococcus epidermidis
RQRNSGDVQTE

SEQ ID NO: 1839010 - protein, 10 aa, Staphylococcus epidermidis
RQSGETFEES

SEQ ID NO: 1839011 - protein, 5 aa, Staphylococcus epidermidis
RQTRP

SEQ ID NO: 1839012 - protein, 5 aa, Staphylococcus epidermidis
RQVGE

SEQ ID NO: 1839013 - protein, 7 aa, Staphylococcus epidermidis
RRQDGTW

SEQ ID NO: 1839014 - protein, 6 aa, Staphylococcus epidermidis
RSEPVA

SEQ ID NO: 1839015 - protein, 19 aa, Staphylococcus epidermidis
RSHSELRSGKVNLKNGDPF

SEQ ID NO: 1839016 - protein, 12 aa, Staphylococcus epidermidis
RSLFPEGEEFKE

SEQ ID NO: 1839017 - protein, 13 aa, Staphylococcus epidermidis
RSRKIGKVAQKRN

SEQ ID NO: 1839018 - protein, 17 aa, Staphylococcus epidermidis
RSYITEPANEVQSKEVS

SEQ ID NO: 1839019 - protein, 16 aa, Staphylococcus epidermidis
RTAKPQPFLSNKSGKL

SEQ ID NO: 1839020 - protein, 16 aa, Staphylococcus epidermidis
RTISSSEASSYNYIHL

SEQ ID NO: 1839021 - protein, 15 aa, Staphylococcus epidermidis
RTRHQDSDLKRGQRQ

SEQ ID NO: 1839022 - protein, 39 aa, Staphylococcus epidermidis
RTTGQNQSKDSQSTEEVNKEVNNDTQQVTAKKDDDKVET

SEQ ID NO: 1839023 - protein, 52 aa, Staphylococcus epidermidis
RVDKETQKIANKYGNTIYAPQKTYKPKSTQTHQGNRPYAGIPPKGMTEAQYA

SEQ ID NO: 1839024 - protein, 5 aa, Staphylococcus epidermidis
RVDYG

SEQ ID NO: 1839025 - protein, 25 aa, Staphylococcus epidermidis
RVDYGAAHTAKYGHERYGKTYAGAY

SEQ ID NO: 1839026 - protein, 8 aa, Staphylococcus epidermidis
RVKEEQER

SEQ ID NO: 1839027 - protein, 8 aa, Staphylococcus epidermidis
RVKTGADL

SEQ ID NO: 1839028 - protein, 5 aa, Staphylococcus epidermidis
RVQNS

SEQ ID NO: 1839029 - protein, 7 aa, Staphylococcus epidermidis
RVSREGK

SEQ ID NO: 1839030 - protein, 20 aa, Staphylococcus epidermidis
RYEEQNSKPVKVNKEELKKN

SEQ ID NO: 1839031 - protein, 7 aa, Staphylococcus epidermidis
RYGKNAN

SEQ ID NO: 1839032 - protein, 4 aa, Staphylococcus epidermidis
SAED

SEQ ID NO: 1839033 - protein, 29 aa, Staphylococcus epidermidis
SAGNNLNDEDDTSESEDQSSSSDEVTVTR

SEQ ID NO: 1839034 - protein, 13 aa, Staphylococcus epidermidis
SAGQSLSSKITDY

SEQ ID NO: 1839035 - protein, 6 aa, Staphylococcus epidermidis
SAGTIN

SEQ ID NO: 1839036 - protein, 7 aa, Staphylococcus epidermidis
SAKSYQE

SEQ ID NO: 1839037 - protein, 5 aa, Staphylococcus epidermidis
SAKVQ

SEQ ID NO: 1839038 - protein, 35 aa, Staphylococcus epidermidis
SALDKNKDLLKGEEHEHEHGEGHEHGEAHEDEHEH

SEQ ID NO: 1839039 - protein, 17 aa, Staphylococcus epidermidis
SALLPSSTAEDYNETLN

SEQ ID NO: 1839040 - protein, 11 aa, Staphylococcus epidermidis
SALSKLDKNKK

SEQ ID NO: 1839041 - protein, 52 aa, Staphylococcus epidermidis
SAPTFANETGLKGNQNTSIHSKSTSTQTQQSATHQTSNITTQSSKNQNSHNH

SEQ ID NO: 1839042 - protein, 17 aa, Staphylococcus epidermidis
SAQAKSQLNQFKQGGSL

SEQ ID NO: 1839043 - protein, 19 aa, Staphylococcus epidermidis
SAQATTQSSSSTSNQSNQN

SEQ ID NO: 1839044 - protein, 36 aa, Staphylococcus epidermidis
SASKPSNPTKPSTNNQLTVTNNSGVAQINAKNSGLY

SEQ ID NO: 1839045 - protein, 8 aa, Staphylococcus epidermidis
SASSDAVK

SEQ ID NO: 1839046 - protein, 4 aa, Staphylococcus epidermidis
SAVE

SEQ ID NO: 1839047 - protein, 14 aa, Staphylococcus epidermidis
SCSHDQKENRYQSQ

SEQ ID NO: 1839048 - protein, 11 aa, Staphylococcus epidermidis
SDALKKEDARH

SEQ ID NO: 1839049 - protein, 6 aa, Staphylococcus epidermidis
SDARKV

SEQ ID NO: 1839050 - protein, 7 aa, Staphylococcus epidermidis
SDEEVQA

SEQ ID NO: 1839051 - protein, 77 aa, Staphylococcus epidermidis
SDELNDEPEKKQSKPYETSLPPLNKDWNEKEKKKTSHPKEKQNTSQSKRQTTSTHEHQNIPQPDKTTSRNDNYEKLK

SEQ ID NO: 1839052 - protein, 12 aa, Staphylococcus epidermidis
SDGGQLKNAKKL

SEQ ID NO: 1839053 - protein, 13 aa, Staphylococcus epidermidis
SDGGQLKNAKKLK

SEQ ID NO: 1839054 - protein, 6 aa, Staphylococcus epidermidis
SDGNNW

SEQ ID NO: 1839055 - protein, 20 aa, Staphylococcus epidermidis
SDITENKKDIKFNDKQSAEY

SEQ ID NO: 1839056 - protein, 14 aa, Staphylococcus epidermidis
SDKAKKILKEYQFS

SEQ ID NO: 1839057 - protein, 7 aa, Staphylococcus epidermidis
SDKKMSD

SEQ ID NO: 1839058 - protein, 8 aa, Staphylococcus epidermidis
SDKYDQSF

SEQ ID NO: 1839059 - protein, 14 aa, Staphylococcus epidermidis
SDMDNNVTKGDQIK

SEQ ID NO: 1839060 - protein, 23 aa, Staphylococcus epidermidis
SDNDASPKMNKEVAQELKKRTGI

SEQ ID NO: 1839061 - protein, 11 aa, Staphylococcus epidermidis
SDNQDGSGVNQ

SEQ ID NO: 1839062 - protein, 50 aa, Staphylococcus epidermidis
SDNSSEQKKNQNKTETKSKKEKSSNKTNSEDNTQTNLKAKDKVENLPDKT

SEQ ID NO: 1839063 - protein, 60 aa, Staphylococcus epidermidis
SDNSSEQKKNQNKTETKSTKEKDEKTSSKPHSENKVKDDNQSHTTIEKKTDVRNLSDKTK

SEQ ID NO: 1839064 - protein, 5 aa, Staphylococcus epidermidis
SDNVK

SEQ ID NO: 1839065 - protein, 17 aa, Staphylococcus epidermidis
SDSSKNENTQLLKNNLD

SEQ ID NO: 1839066 - protein, 7 aa, Staphylococcus epidermidis
SDVDDTK

SEQ ID NO: 1839067 - protein, 13 aa, Staphylococcus epidermidis
SDYADSMKQQGYN

SEQ ID NO: 1839068 - protein, 6 aa, Staphylococcus epidermidis
SDYTQL

SEQ ID NO: 1839069 - protein, 30 aa, Staphylococcus epidermidis
SEAKADEVTANNAKHVAQQAMKNSGGNPYL

SEQ ID NO: 1839070 - protein, 5 aa, Staphylococcus epidermidis
SEAPK

SEQ ID NO: 1839071 - protein, 6 aa, Staphylococcus epidermidis
SEIGKG

SEQ ID NO: 1839072 - protein, 6 aa, Staphylococcus epidermidis
SEKEIK

SEQ ID NO: 1839073 - protein, 8 aa, Staphylococcus epidermidis
SENAATAQ

SEQ ID NO: 1839074 - protein, 5 aa, Staphylococcus epidermidis
SENEE

SEQ ID NO: 1839075 - protein, 5 aa, Staphylococcus epidermidis
SENVP

SEQ ID NO: 1839076 - protein, 7 aa, Staphylococcus epidermidis
SESYDGV

SEQ ID NO: 1839077 - protein, 7 aa, Staphylococcus epidermidis
SEVNDHN

SEQ ID NO: 1839078 - protein, 12 aa, Staphylococcus epidermidis
SFANDNKSFQLK

SEQ ID NO: 1839079 - protein, 30 aa, Staphylococcus epidermidis
SFETSGKENNGSDKKKISNTVKVPKNPKNA

SEQ ID NO: 1839080 - protein, 9 aa, Staphylococcus epidermidis
SFGKTEEGR

SEQ ID NO: 1839081 - protein, 9 aa, Staphylococcus epidermidis
SGDAYDSEL

SEQ ID NO: 1839082 - protein, 5 aa, Staphylococcus epidermidis
SGDSL

SEQ ID NO: 1839083 - protein, 15 aa, Staphylococcus epidermidis
SGFEPTKTNAVYGAT

SEQ ID NO: 1839084 - protein, 6 aa, Staphylococcus epidermidis
SGIASV

SEQ ID NO: 1839085 - protein, 15 aa, Staphylococcus epidermidis
SGKEKTTLKPNQHFD

SEQ ID NO: 1839086 - protein, 10 aa, Staphylococcus epidermidis
SGKSDLTTDV

SEQ ID NO: 1839087 - protein, 15 aa, Staphylococcus epidermidis
SGMKGTTANIDNVKK

SEQ ID NO: 1839088 - protein, 8 aa, Staphylococcus epidermidis
SGNIDNPR

SEQ ID NO: 1839089 - protein, 23 aa, Staphylococcus epidermidis
SGPFSGSESQHQSDNSNLNGKDK

SEQ ID NO: 1839090 - protein, 5 aa, Staphylococcus epidermidis
SGPVE

SEQ ID NO: 1839091 - protein, 4 aa, Staphylococcus epidermidis
SGQL

SEQ ID NO: 1839092 - protein, 12 aa, Staphylococcus epidermidis
SGSEQNPDLTNK

SEQ ID NO: 1839093 - protein, 13 aa, Staphylococcus epidermidis
SGYSGGHVENPTY

SEQ ID NO: 1839094 - protein, 23 aa, Staphylococcus epidermidis
SHASGSGAGPGENAQGQQGQDDA

SEQ ID NO: 1839095 - protein, 103 aa, Staphylococcus epidermidis
SHATTSGGTSSSSSASSSSSSSAASASRGSTSSSTSMSRSSAINASRNAQQSSQRAAQQATKSSRVTATKNKGQQSVSSQKAQSRSLMPSQRPYDSSAPYSSQ

SEQ ID NO: 1839096 - protein, 40 aa, Staphylococcus epidermidis
SHDEGQDNKTNDEDKGDKQSTKQSSKKQSDNAVQYPKDGV

SEQ ID NO: 1839097 - protein, 43 aa, Staphylococcus epidermidis
SHDSDSNKSSSKKSENKTDVATKYSEEDSKKDQYKKLEKEVKG

SEQ ID NO: 1839098 - protein, 9 aa, Staphylococcus epidermidis
SHEQTAGAA

SEQ ID NO: 1839099 - protein, 13 aa, Staphylococcus epidermidis
SHPNAGSKAAQWA

SEQ ID NO: 1839100 - protein, 163 aa, Staphylococcus epidermidis
SHTDSSDKKETDSSKKSDSKKDNKKDSKGDKKINNAKDKIKDSKLAKKNKNKDSKNKDDKSKSKQQNNKQNHPTNNNASQANNTTKQSQYNNNNANQNAANNNQANTANQQQNQTNGKAQNKVQYPQGAANKNPQQSNTQQYSNNGSNVNNNQGQANTNNRNG

SEQ ID NO: 1839101 - protein, 19 aa, Staphylococcus epidermidis
SHTKDNHNQTTQHQNDPNL

SEQ ID NO: 1839102 - protein, 15 aa, Staphylococcus epidermidis
SHTKQQDDDKNTYQS

SEQ ID NO: 1839103 - protein, 21 aa, Staphylococcus epidermidis
SIDADGQKVTITTKEPYPELK

SEQ ID NO: 1839104 - protein, 12 aa, Staphylococcus epidermidis
SIDKAAHPNDVT

SEQ ID NO: 1839105 - protein, 10 aa, Staphylococcus epidermidis
SIEQHPNAEV

SEQ ID NO: 1839106 - protein, 210 aa, Staphylococcus epidermidis
SIGAENDKNSEKQSNVENDNKSSLETKNNAPSSIHNEDAQQQAQTNTENNDKVTETKENATQDKQNQDNVKTNKSETQQPQIQQSQSSQTKNDHVSSQAQENQQNPNEQSQQTKQASAEKVSERKAEPQSEDTQKPSTSNTNVTKSSEKGNNDATKPLEKQDNDSVTQAQPQKKSHPASTQNNDSNHTQSPKQQVTAKDTQNAKKEAPVE

SEQ ID NO: 1839107 - protein, 12 aa, Staphylococcus epidermidis
SIGKKGTKGDSY

SEQ ID NO: 1839108 - protein, 18 aa, Staphylococcus epidermidis
SIHEKGSMRSHDNGDDMS

SEQ ID NO: 1839109 - protein, 9 aa, Staphylococcus epidermidis
SINNNDDQE

SEQ ID NO: 1839110 - protein, 8 aa, Staphylococcus epidermidis
SIPNDSGI

SEQ ID NO: 1839111 - protein, 8 aa, Staphylococcus epidermidis
SISPEHNA

SEQ ID NO: 1839112 - protein, 5 aa, Staphylococcus epidermidis
SISPG

SEQ ID NO: 1839113 - protein, 9 aa, Staphylococcus epidermidis
SITTSDATQ

SEQ ID NO: 1839114 - protein, 7 aa, Staphylococcus epidermidis
SKASTLI

SEQ ID NO: 1839115 - protein, 7 aa, Staphylococcus epidermidis
SKDGKVK

SEQ ID NO: 1839116 - protein, 22 aa, Staphylococcus epidermidis
SKDKTQDEEKRKADAKGKPDTW

SEQ ID NO: 1839117 - protein, 9 aa, Staphylococcus epidermidis
SKDMDNKTY

SEQ ID NO: 1839118 - protein, 14 aa, Staphylococcus epidermidis
SKDNNVRQKDGKAL

SEQ ID NO: 1839119 - protein, 8 aa, Staphylococcus epidermidis
SKDQLPEA

SEQ ID NO: 1839120 - protein, 16 aa, Staphylococcus epidermidis
SKEIKNYSVTDKEFES

SEQ ID NO: 1839121 - protein, 8 aa, Staphylococcus epidermidis
SKFGKNQH

SEQ ID NO: 1839122 - protein, 14 aa, Staphylococcus epidermidis
SKGEHKIDGTTYDV

SEQ ID NO: 1839123 - protein, 6 aa, Staphylococcus epidermidis
SKGNAY

SEQ ID NO: 1839124 - protein, 16 aa, Staphylococcus epidermidis
SKGQHDLTKKAGWAEV

SEQ ID NO: 1839125 - protein, 11 aa, Staphylococcus epidermidis
SKIQASKDAGM

SEQ ID NO: 1839126 - protein, 8 aa, Staphylococcus epidermidis
SKITDKDE

SEQ ID NO: 1839127 - protein, 8 aa, Staphylococcus epidermidis
SKKDKTAS

SEQ ID NO: 1839128 - protein, 8 aa, Staphylococcus epidermidis
SKKMNKNV

SEQ ID NO: 1839129 - protein, 11 aa, Staphylococcus epidermidis
SKKQKDNINKN

SEQ ID NO: 1839130 - protein, 14 aa, Staphylococcus epidermidis
SKLRRAEKNTKQFR

SEQ ID NO: 1839131 - protein, 8 aa, Staphylococcus epidermidis
SKLTQSGY

SEQ ID NO: 1839132 - protein, 7 aa, Staphylococcus epidermidis
SKNGKVK

SEQ ID NO: 1839133 - protein, 8 aa, Staphylococcus epidermidis
SKNGKVKP

SEQ ID NO: 1839134 - protein, 6 aa, Staphylococcus epidermidis
SKNGTK

SEQ ID NO: 1839135 - protein, 11 aa, Staphylococcus epidermidis
SKNSTLSEENL

SEQ ID NO: 1839136 - protein, 12 aa, Staphylococcus epidermidis
SKPDIYTAGKGT

SEQ ID NO: 1839137 - protein, 9 aa, Staphylococcus epidermidis
SKQATSPVN

SEQ ID NO: 1839138 - protein, 7 aa, Staphylococcus epidermidis
SKRNPTY

SEQ ID NO: 1839139 - protein, 15 aa, Staphylococcus epidermidis
SKSIDTKDIAGKSVN

SEQ ID NO: 1839140 - protein, 15 aa, Staphylococcus epidermidis
SKSKDDKEPQVHIYH

SEQ ID NO: 1839141 - protein, 9 aa, Staphylococcus epidermidis
SKVNNGNNK

SEQ ID NO: 1839142 - protein, 8 aa, Staphylococcus epidermidis
SKYNTTHP

SEQ ID NO: 1839143 - protein, 7 aa, Staphylococcus epidermidis
SLEHNSN

SEQ ID NO: 1839144 - protein, 6 aa, Staphylococcus epidermidis
SLKKDG

SEQ ID NO: 1839145 - protein, 8 aa, Staphylococcus epidermidis
SLNSVTTS

SEQ ID NO: 1839146 - protein, 17 aa, Staphylococcus epidermidis
SLPTEAKADQLDAQGYD

SEQ ID NO: 1839147 - protein, 17 aa, Staphylococcus epidermidis
SMTKEDKKEEKIKKSFE

SEQ ID NO: 1839148 - protein, 17 aa, Staphylococcus epidermidis
SNALTSDPKAFKQNAKD

SEQ ID NO: 1839149 - protein, 21 aa, Staphylococcus epidermidis
SNDEKAIAKDRLARQNASRNN

SEQ ID NO: 1839150 - protein, 7 aa, Staphylococcus epidermidis
SNEPIKD

SEQ ID NO: 1839151 - protein, 108 aa, Staphylococcus epidermidis
SNGGNDEASHKDDSSKTEQKDKSSSQHDSKKDSKRNDTNNKQDNQENNNNKEQTSNQNPNDGEQRTSERPTTNSNRNSSDNQNKQQQSVQDNQNKYVAPYQSENATRV

SEQ ID NO: 1839152 - protein, 108 aa, Staphylococcus epidermidis
SNGGNDESSHKDDSSKTEQKDKSSSQHDSKKDSKRNDTINKQDNQENNNNKERTSNQNPNVGEQRTSERPTTNSNGNSSDNQNKQQQSVQDNQNKYVAPYQSENATRV

SEQ ID NO: 1839153 - protein, 108 aa, Staphylococcus epidermidis
SNGGNDESSHKDDSSKTEQKDKSSSQHDSKKDSKRNDTNNKQDNQENKSNKEQTSNQNSNAGEQRTSERPTTNSNGISSDNQNKQQQSVQDNQNKYVAPYQSENATRV

SEQ ID NO: 1839154 - protein, 23 aa, Staphylococcus epidermidis
SNGSNNNDSDSKNKNSDSKETVT

SEQ ID NO: 1839155 - protein, 13 aa, Staphylococcus epidermidis
SNHKANGVFFSLG

SEQ ID NO: 1839156 - protein, 4 aa, Staphylococcus epidermidis
SNHS

SEQ ID NO: 1839157 - protein, 11 aa, Staphylococcus epidermidis
SNHSKGEEMAE

SEQ ID NO: 1839158 - protein, 8 aa, Staphylococcus epidermidis
SNKGAPYY

SEQ ID NO: 1839159 - protein, 15 aa, Staphylococcus epidermidis
SNKLPKSYRKDTERI

SEQ ID NO: 1839160 - protein, 10 aa, Staphylococcus epidermidis
SNKSGAGVGT

SEQ ID NO: 1839161 - protein, 4 aa, Staphylococcus epidermidis
SNKV

SEQ ID NO: 1839162 - protein, 46 aa, Staphylococcus epidermidis
SNNDEKDKDTKDQKSETHMKHNDESKVPEDMKSTNEGEFKAGDKVT

SEQ ID NO: 1839163 - protein, 41 aa, Staphylococcus epidermidis
SNNDEKDKDTNDQKSESHMKHNDESKVPEDMKSTNKGEFKV

SEQ ID NO: 1839164 - protein, 47 aa, Staphylococcus epidermidis
SNNDEKDKDTSDQKSESHMKHNDESKVPENMKSINEGEFKAGDKVTI

SEQ ID NO: 1839165 - protein, 22 aa, Staphylococcus epidermidis
SNNNTQVSGTAPNVTSVTNKSV

SEQ ID NO: 1839166 - protein, 28 aa, Staphylococcus epidermidis
SNNSEDDNNQNDHSSAHAPKSAKNIKEK

SEQ ID NO: 1839167 - protein, 7 aa, Staphylococcus epidermidis
SNRHKGI

SEQ ID NO: 1839168 - protein, 15 aa, Staphylococcus epidermidis
SNRPGGKIQTYREDG

SEQ ID NO: 1839169 - protein, 8 aa, Staphylococcus epidermidis
SNRSSGKM

SEQ ID NO: 1839170 - protein, 19 aa, Staphylococcus epidermidis
SNSGNKSTTVSENKPQFKN

SEQ ID NO: 1839171 - protein, 51 aa, Staphylococcus epidermidis
SNSNDSDQSSNEKSSSKSSENKTDVATEYTKEDEYKELEKEAKDHKQKPVL

SEQ ID NO: 1839172 - protein, 23 aa, Staphylococcus epidermidis
SNSSNNNSTSKKKNSDSKETVTI

SEQ ID NO: 1839173 - protein, 28 aa, Staphylococcus epidermidis
SNSSNSNKDGDKKESSSPDSGKKQELQI

SEQ ID NO: 1839174 - protein, 27 aa, Staphylococcus epidermidis
SNTNDNNNQEHHSNAHAPKNAKTLKEK

SEQ ID NO: 1839175 - protein, 4 aa, Staphylococcus epidermidis
SNVK

SEQ ID NO: 1839176 - protein, 13 aa, Staphylococcus epidermidis
SNWAASASQAGFN

SEQ ID NO: 1839177 - protein, 10 aa, Staphylococcus epidermidis
SPANRQGRQV

SEQ ID NO: 1839178 - protein, 11 aa, Staphylococcus epidermidis
SPFKGNEGQAL

SEQ ID NO: 1839179 - protein, 17 aa, Staphylococcus epidermidis
SPGAKPFIPPANGLEEA

SEQ ID NO: 1839180 - protein, 4 aa, Staphylococcus epidermidis
SPGD

SEQ ID NO: 1839181 - protein, 6 aa, Staphylococcus epidermidis
SPHMTT

SEQ ID NO: 1839182 - protein, 7 aa, Staphylococcus epidermidis
SPINGDL

SEQ ID NO: 1839183 - protein, 5 aa, Staphylococcus epidermidis
SPISS

SEQ ID NO: 1839184 - protein, 21 aa, Staphylococcus epidermidis
SPLANANEVQESSQKVNQPQY

SEQ ID NO: 1839185 - protein, 15 aa, Staphylococcus epidermidis
SPYPSETAKLTRNEI

SEQ ID NO: 1839186 - protein, 9 aa, Staphylococcus epidermidis
SQDAEGYPM

SEQ ID NO: 1839187 - protein, 14 aa, Staphylococcus epidermidis
SQEAHDNIPTKTVN

SEQ ID NO: 1839188 - protein, 17 aa, Staphylococcus epidermidis
SQIKNESVEYGSSIGDE

SEQ ID NO: 1839189 - protein, 9 aa, Staphylococcus epidermidis
SQKHSSGKV

SEQ ID NO: 1839190 - protein, 8 aa, Staphylococcus epidermidis
SQNVERSM

SEQ ID NO: 1839191 - protein, 8 aa, Staphylococcus epidermidis
SQSPTSEY

SEQ ID NO: 1839192 - protein, 21 aa, Staphylococcus epidermidis
SQTSYDGLKGISNAGNLYTDG

SEQ ID NO: 1839193 - protein, 4 aa, Staphylococcus epidermidis
SQVN

SEQ ID NO: 1839194 - protein, 7 aa, Staphylococcus epidermidis
SQYPYQT

SEQ ID NO: 1839195 - protein, 4 aa, Staphylococcus epidermidis
SREG

SEQ ID NO: 1839196 - protein, 15 aa, Staphylococcus epidermidis
SREGTSKLNQHTSLN

SEQ ID NO: 1839197 - protein, 6 aa, Staphylococcus epidermidis
SRKGKL

SEQ ID NO: 1839198 - protein, 9 aa, Staphylococcus epidermidis
SRNVEKNMS

SEQ ID NO: 1839199 - protein, 10 aa, Staphylococcus epidermidis
SRSASLPSVR

SEQ ID NO: 1839200 - protein, 15 aa, Staphylococcus epidermidis
SRTISASQAASYNYI

SEQ ID NO: 1839201 - protein, 6 aa, Staphylococcus epidermidis
SRYGSL

SEQ ID NO: 1839202 - protein, 7 aa, Staphylococcus epidermidis
SSDAALG

SEQ ID NO: 1839203 - protein, 13 aa, Staphylococcus epidermidis
SSDDDGSGYPPGT

SEQ ID NO: 1839204 - protein, 10 aa, Staphylococcus epidermidis
SSDHTDATVE

SEQ ID NO: 1839205 - protein, 12 aa, Staphylococcus epidermidis
SSEVTDDNVESY

SEQ ID NO: 1839206 - protein, 12 aa, Staphylococcus epidermidis
SSGMVGAAASCF

SEQ ID NO: 1839207 - protein, 13 aa, Staphylococcus epidermidis
SSHDQQAKKDSVR

SEQ ID NO: 1839208 - protein, 7 aa, Staphylococcus epidermidis
SSKGFTG

SEQ ID NO: 1839209 - protein, 7 aa, Staphylococcus epidermidis
SSKGLTG

SEQ ID NO: 1839210 - protein, 10 aa, Staphylococcus epidermidis
SSSKYTDKID

SEQ ID NO: 1839211 - protein, 7 aa, Staphylococcus epidermidis
SSSYDAP

SEQ ID NO: 1839212 - protein, 11 aa, Staphylococcus epidermidis
SSTLNQDDSWS

SEQ ID NO: 1839213 - protein, 5 aa, Staphylococcus epidermidis
SSYPG

SEQ ID NO: 1839214 - protein, 8 aa, Staphylococcus epidermidis
STAGGNSE

SEQ ID NO: 1839215 - protein, 33 aa, Staphylococcus epidermidis
STFKKGSYGSDQQGADDGVDDKSSSHQKQNGKV

SEQ ID NO: 1839216 - protein, 32 aa, Staphylococcus epidermidis
STFKTGSYGSNQQGADDGVDDKSSSHQNQNAK

SEQ ID NO: 1839217 - protein, 6 aa, Staphylococcus epidermidis
STGLGY

SEQ ID NO: 1839218 - protein, 6 aa, Staphylococcus epidermidis
STHSRN

SEQ ID NO: 1839219 - protein, 12 aa, Staphylococcus epidermidis
STKNKKVDDVEA

SEQ ID NO: 1839220 - protein, 9 aa, Staphylococcus epidermidis
STNTRAGKL

SEQ ID NO: 1839221 - protein, 7 aa, Staphylococcus epidermidis
STPGPYG

SEQ ID NO: 1839222 - protein, 5 aa, Staphylococcus epidermidis
STPSL

SEQ ID NO: 1839223 - protein, 7 aa, Staphylococcus epidermidis
STQPNYR

SEQ ID NO: 1839224 - protein, 14 aa, Staphylococcus epidermidis
STSAGKSTPGYEKT

SEQ ID NO: 1839225 - protein, 22 aa, Staphylococcus epidermidis
SVAPSQYKGQSPANAPESVQDA

SEQ ID NO: 1839226 - protein, 23 aa, Staphylococcus epidermidis
SVAPSQYKGVSPAKAPESVQDKA

SEQ ID NO: 1839227 - protein, 11 aa, Staphylococcus epidermidis
SVDNNKKPLKS

SEQ ID NO: 1839228 - protein, 10 aa, Staphylococcus epidermidis
SVEGNKVTGK

SEQ ID NO: 1839229 - protein, 5 aa, Staphylococcus epidermidis
SVENE

SEQ ID NO: 1839230 - protein, 11 aa, Staphylococcus epidermidis
SVENGKVNGKF

SEQ ID NO: 1839231 - protein, 5 aa, Staphylococcus epidermidis
SVNNQ

SEQ ID NO: 1839232 - protein, 8 aa, Staphylococcus epidermidis
SVNPGGGM

SEQ ID NO: 1839233 - protein, 9 aa, Staphylococcus epidermidis
SVNPNGTLT

SEQ ID NO: 1839234 - protein, 6 aa, Staphylococcus epidermidis
SVRPDM

SEQ ID NO: 1839235 - protein, 10 aa, Staphylococcus epidermidis
SVSQDSDSFH

SEQ ID NO: 1839236 - protein, 18 aa, Staphylococcus epidermidis
SVSTDSPVNGSAHAATSH

SEQ ID NO: 1839237 - protein, 12 aa, Staphylococcus epidermidis
SVVGGKSTTNQV

SEQ ID NO: 1839238 - protein, 21 aa, Staphylococcus epidermidis
SYAKTDTQSHNHSSLGTENKN

SEQ ID NO: 1839239 - protein, 197 aa, Staphylococcus epidermidis
SYHETPSTDVKSNEDKQIDSQSNQPQTSMPNNDQQNPKKVAEHTTKSINAKKEETRKNENAKSLVQPQQDDKTTSEQTKIKESREQEITNEQKQLQSKDIKNAQQENQNIDQEKSQEKIKVQQSNIEKAQKSSRIDGKLDNQYNKDATQSDEGTASENVSEQHITAKDGGVTRNNRGDKHLNQEKPTTSSDKELKVD

SEQ ID NO: 1839240 - protein, 138 aa, Staphylococcus epidermidis
SYHETPSTDVKSNEGKQIDSQSNQPQTSMTKNDQQNPKKIGEHATNGINAKKEETRKNENAKSLVKPQQDDKTTSEQTKMKESREQEITNEQKQLQSKDVKNAQQENQNIEQEKSQEKINLQQSSIEKVQKSSRIDGK

SEQ ID NO: 1839241 - protein, 5 aa, Staphylococcus epidermidis
SYLGG

SEQ ID NO: 1839242 - protein, 24 aa, Staphylococcus epidermidis
SYPKTKVTRPKNSSLGNKAANNAV

SEQ ID NO: 1839243 - protein, 4 aa, Staphylococcus epidermidis
SYPQ

SEQ ID NO: 1839244 - protein, 9 aa, Staphylococcus epidermidis
SYRGDSDLP

SEQ ID NO: 1839245 - protein, 17 aa, Staphylococcus epidermidis
TAHAAEQDAQGNSENHI

SEQ ID NO: 1839246 - protein, 10 aa, Staphylococcus epidermidis
TAIDKSNNQI

SEQ ID NO: 1839247 - protein, 19 aa, Staphylococcus epidermidis
TAKAPVKVNQTYNVKAGST

SEQ ID NO: 1839248 - protein, 9 aa, Staphylococcus epidermidis
TAKPSKGSF

SEQ ID NO: 1839249 - protein, 19 aa, Staphylococcus epidermidis
TAKSPVKVNQTYNVKAGST

SEQ ID NO: 1839250 - protein, 11 aa, Staphylococcus epidermidis
TANDNSTIDGE

SEQ ID NO: 1839251 - protein, 17 aa, Staphylococcus epidermidis
TAPTKKPIIKPKVETKY

SEQ ID NO: 1839252 - protein, 22 aa, Staphylococcus epidermidis
TAQRAENNQKNNKKEIYILYIY

SEQ ID NO: 1839253 - protein, 24 aa, Staphylococcus epidermidis
TARNVTKTHTSNINTFQSPNHGPL

SEQ ID NO: 1839254 - protein, 25 aa, Staphylococcus epidermidis
TARNVTKTHTSNINTFQSPNQGPLG

SEQ ID NO: 1839255 - protein, 13 aa, Staphylococcus epidermidis
TDAPIDYKALKVN

SEQ ID NO: 1839256 - protein, 13 aa, Staphylococcus epidermidis
TDAPIDYKTLKVN

SEQ ID NO: 1839257 - protein, 25 aa, Staphylococcus epidermidis
TDDRGTDSLDKDGLNQLKETGQYQV

SEQ ID NO: 1839258 - protein, 6 aa, Staphylococcus epidermidis
TDEIKD

SEQ ID NO: 1839259 - protein, 6 aa, Staphylococcus epidermidis
TDESSL

SEQ ID NO: 1839260 - protein, 15 aa, Staphylococcus epidermidis
TDETREMMDGEEPVA

SEQ ID NO: 1839261 - protein, 4 aa, Staphylococcus epidermidis
TDLD

SEQ ID NO: 1839262 - protein, 7 aa, Staphylococcus epidermidis
TDQETYA

SEQ ID NO: 1839263 - protein, 64 aa, Staphylococcus epidermidis
TDYEQPQKTSHSSNDEKDQVDQADQAKQPSQHQEPSQSSAKQDQEPSNDEKEKTTNHQADSDVS

SEQ ID NO: 1839264 - protein, 64 aa, Staphylococcus epidermidis
TDYEQPQKTSHSSNDEKDQVDQADQAKQPSQHQEQSQSSAKQDQESSNDEKEKTTNHQADSDVS

SEQ ID NO: 1839265 - protein, 10 aa, Staphylococcus epidermidis
TEKQGTPGQM

SEQ ID NO: 1839266 - protein, 5 aa, Staphylococcus epidermidis
TEQAE

SEQ ID NO: 1839267 - protein, 5 aa, Staphylococcus epidermidis
TETPK

SEQ ID NO: 1839268 - protein, 13 aa, Staphylococcus epidermidis
TEYTYDSTLGKYA

SEQ ID NO: 1839269 - protein, 29 aa, Staphylococcus epidermidis
TFESVDDAKKALNETKYQTAGKYSGTTYD

SEQ ID NO: 1839270 - protein, 33 aa, Staphylococcus epidermidis
TFKPGSYGSTQSGSDNNDNGNNHHGSDNEKVGD

SEQ ID NO: 1839271 - protein, 9 aa, Staphylococcus epidermidis
TFQPQDNGN

SEQ ID NO: 1839272 - protein, 15 aa, Staphylococcus epidermidis
TFSNPEAQKYEKEDP

SEQ ID NO: 1839273 - protein, 11 aa, Staphylococcus epidermidis
TFTNKTGMQGW

SEQ ID NO: 1839274 - protein, 10 aa, Staphylococcus epidermidis
TGASSGIGEA

SEQ ID NO: 1839275 - protein, 13 aa, Staphylococcus epidermidis
TGIPESKNLGGFP

SEQ ID NO: 1839276 - protein, 9 aa, Staphylococcus epidermidis
TGIQTPKQS

SEQ ID NO: 1839277 - protein, 17 aa, Staphylococcus epidermidis
TGISGTTLSDINAANDL

SEQ ID NO: 1839278 - protein, 4 aa, Staphylococcus epidermidis
TGKI

SEQ ID NO: 1839279 - protein, 4 aa, Staphylococcus epidermidis
TGNH

SEQ ID NO: 1839280 - protein, 5 aa, Staphylococcus epidermidis
TGPGL

SEQ ID NO: 1839281 - protein, 19 aa, Staphylococcus epidermidis
TGQNPQSSEEIGKALANEL

SEQ ID NO: 1839282 - protein, 11 aa, Staphylococcus epidermidis
TGQSDEKFLNK

SEQ ID NO: 1839283 - protein, 35 aa, Staphylococcus epidermidis
TGSVNAQDNSSTNSESLKELQDEGAVSKSITENQW

SEQ ID NO: 1839284 - protein, 24 aa, Staphylococcus epidermidis
TGSVNAQGNSSTNSESLKELQNEG

SEQ ID NO: 1839285 - protein, 6 aa, Staphylococcus epidermidis
TGTGFG

SEQ ID NO: 1839286 - protein, 26 aa, Staphylococcus epidermidis
TGVANASEYHHGNTATYKEKVESLTK

SEQ ID NO: 1839287 - protein, 35 aa, Staphylococcus epidermidis
THADAAENNNQQQSTHNYSTTEVSFSNSGNLYTSG

SEQ ID NO: 1839288 - protein, 35 aa, Staphylococcus epidermidis
THADAAENNNQQQSTYNYSTTDVSFSKSGNLYTSG

SEQ ID NO: 1839289 - protein, 14 aa, Staphylococcus epidermidis
THTNDNSRFKGKTG

SEQ ID NO: 1839290 - protein, 4 aa, Staphylococcus epidermidis
TIAS

SEQ ID NO: 1839291 - protein, 4 aa, Staphylococcus epidermidis
TIEG

SEQ ID NO: 1839292 - protein, 12 aa, Staphylococcus epidermidis
TIEPKGKNMETK

SEQ ID NO: 1839293 - protein, 10 aa, Staphylococcus epidermidis
TIEPKGKYME

SEQ ID NO: 1839294 - protein, 11 aa, Staphylococcus epidermidis
TIEPKGKYMES

SEQ ID NO: 1839295 - protein, 13 aa, Staphylococcus epidermidis
TIKKGKKAKGLAT

SEQ ID NO: 1839296 - protein, 9 aa, Staphylococcus epidermidis
TIKTSEKLA

SEQ ID NO: 1839297 - protein, 27 aa, Staphylococcus epidermidis
TIPNGGSGSGSGGTATQTSGNYTSPSF

SEQ ID NO: 1839298 - protein, 13 aa, Staphylococcus epidermidis
TISASEVDSYTFI

SEQ ID NO: 1839299 - protein, 18 aa, Staphylococcus epidermidis
TISEENKGKDGYSDEALN

SEQ ID NO: 1839300 - protein, 22 aa, Staphylococcus epidermidis
TISMSQDATNKVVTNEENPISQ

SEQ ID NO: 1839301 - protein, 12 aa, Staphylococcus epidermidis
TISSNTDTRINE

SEQ ID NO: 1839302 - protein, 18 aa, Staphylococcus epidermidis
TKAKNKVTDQPVGTGPYQ

SEQ ID NO: 1839303 - protein, 7 aa, Staphylococcus epidermidis
TKAPEWS

SEQ ID NO: 1839304 - protein, 17 aa, Staphylococcus epidermidis
TKDNAQNNTDWSNKEYD

SEQ ID NO: 1839305 - protein, 8 aa, Staphylococcus epidermidis
TKKDENNI

SEQ ID NO: 1839306 - protein, 13 aa, Staphylococcus epidermidis
TKNGTDNKEPSIL

SEQ ID NO: 1839307 - protein, 14 aa, Staphylococcus epidermidis
TKNNKVTHITIGTL

SEQ ID NO: 1839308 - protein, 6 aa, Staphylococcus epidermidis
TKPYEI

SEQ ID NO: 1839309 - protein, 14 aa, Staphylococcus epidermidis
TKSIGTDTSGSDFK

SEQ ID NO: 1839310 - protein, 9 aa, Staphylococcus epidermidis
TKSPNVYPG

SEQ ID NO: 1839311 - protein, 4 aa, Staphylococcus epidermidis
TKSQ

SEQ ID NO: 1839312 - protein, 8 aa, Staphylococcus epidermidis
TKVEDPYD

SEQ ID NO: 1839313 - protein, 16 aa, Staphylococcus epidermidis
TKYAGDVNKKQQDKIK

SEQ ID NO: 1839314 - protein, 7 aa, Staphylococcus epidermidis
TLSKVNP

SEQ ID NO: 1839315 - protein, 7 aa, Staphylococcus epidermidis
TLSQVNP

SEQ ID NO: 1839316 - protein, 7 aa, Staphylococcus epidermidis
TLSTEQG

SEQ ID NO: 1839317 - protein, 4 aa, Staphylococcus epidermidis
TLTR

SEQ ID NO: 1839318 - protein, 28 aa, Staphylococcus epidermidis
TMNEEENYASQSIPASQYKGQGFQPVAE

SEQ ID NO: 1839319 - protein, 8 aa, Staphylococcus epidermidis
TNANEHDY

SEQ ID NO: 1839320 - protein, 25 aa, Staphylococcus epidermidis
TNERGLNKEQNEKQSPKGDKQELQV

SEQ ID NO: 1839321 - protein, 17 aa, Staphylococcus epidermidis
TNGGGIRASISKGKVTK

SEQ ID NO: 1839322 - protein, 11 aa, Staphylococcus epidermidis
TNGKKDKGHVT

SEQ ID NO: 1839323 - protein, 4 aa, Staphylococcus epidermidis
TNIN

SEQ ID NO: 1839324 - protein, 8 aa, Staphylococcus epidermidis
TNIPNTHK

SEQ ID NO: 1839325 - protein, 6 aa, Staphylococcus epidermidis
TNKDLR

SEQ ID NO: 1839326 - protein, 13 aa, Staphylococcus epidermidis
TNKQETNHSTAHH

SEQ ID NO: 1839327 - protein, 6 aa, Staphylococcus epidermidis
TNQTGH

SEQ ID NO: 1839328 - protein, 16 aa, Staphylococcus epidermidis
TNREQVKLPEGTEEYK

SEQ ID NO: 1839329 - protein, 5 aa, Staphylococcus epidermidis
TPATV

SEQ ID NO: 1839330 - protein, 4 aa, Staphylococcus epidermidis
TPEA

SEQ ID NO: 1839331 - protein, 13 aa, Staphylococcus epidermidis
TPIDKNNKPDLTP

SEQ ID NO: 1839332 - protein, 5 aa, Staphylococcus epidermidis
TPLKE

SEQ ID NO: 1839333 - protein, 20 aa, Staphylococcus epidermidis
TPMTEGTDFGERKKLEAQNI

SEQ ID NO: 1839334 - protein, 44 aa, Staphylococcus epidermidis
TPRNNEKTYENSTESTKSKDLNDFKQTASVTKPTLEYQSTRNEI

SEQ ID NO: 1839335 - protein, 44 aa, Staphylococcus epidermidis
TPRNYEKTYENATESTKPKDLNDFKQTASVTKPTLEYQSTRNEM

SEQ ID NO: 1839336 - protein, 10 aa, Staphylococcus epidermidis
TPSDMSKDTK

SEQ ID NO: 1839337 - protein, 20 aa, Staphylococcus epidermidis
TQFEGNPYSWDTQSNSIAKY

SEQ ID NO: 1839338 - protein, 6 aa, Staphylococcus epidermidis
TQGGIE

SEQ ID NO: 1839339 - protein, 32 aa, Staphylococcus epidermidis
TQGQSSNASEYTSDEGTSNNDVSNDDKVTRDN

SEQ ID NO: 1839340 - protein, 11 aa, Staphylococcus epidermidis
TQKKGAGNEIQ

SEQ ID NO: 1839341 - protein, 19 aa, Staphylococcus epidermidis
TQMSSTPLPIKGSGSIKNG

SEQ ID NO: 1839342 - protein, 11 aa, Staphylococcus epidermidis
TQPGETDNYDV

SEQ ID NO: 1839343 - protein, 6 aa, Staphylococcus epidermidis
TQPNYQ

SEQ ID NO: 1839344 - protein, 35 aa, Staphylococcus epidermidis
TQSQSSNSSESNTSDEGTSNSDSDTSNDDKVTRSN

SEQ ID NO: 1839345 - protein, 32 aa, Staphylococcus epidermidis
TQSQSSNSSESTSDEGTSNNDASNDDKVTRDN

SEQ ID NO: 1839346 - protein, 17 aa, Staphylococcus epidermidis
TRDGATDLNRKTSLNPN

SEQ ID NO: 1839347 - protein, 10 aa, Staphylococcus epidermidis
TREQTSFEEA

SEQ ID NO: 1839348 - protein, 13 aa, Staphylococcus epidermidis
TREYDTKKAEKLL

SEQ ID NO: 1839349 - protein, 17 aa, Staphylococcus epidermidis
TRTISASEASSYNYIHL

SEQ ID NO: 1839350 - protein, 15 aa, Staphylococcus epidermidis
TRTISASQASAYNYI

SEQ ID NO: 1839351 - protein, 13 aa, Staphylococcus epidermidis
TSDGKKLDDSEAQ

SEQ ID NO: 1839352 - protein, 7 aa, Staphylococcus epidermidis
TSGLPTE

SEQ ID NO: 1839353 - protein, 23 aa, Staphylococcus epidermidis
TSGSGLNKRGYRMAQGEAPIKET

SEQ ID NO: 1839354 - protein, 6 aa, Staphylococcus epidermidis
TSKTDI

SEQ ID NO: 1839355 - protein, 7 aa, Staphylococcus epidermidis
TSNGTNW

SEQ ID NO: 1839356 - protein, 40 aa, Staphylococcus epidermidis
TTDKKEIKKYDDQVQKAFDQEKTVNSTSKKINKLEEDKQK

SEQ ID NO: 1839357 - protein, 8 aa, Staphylococcus epidermidis
TTEHASDD

SEQ ID NO: 1839358 - protein, 13 aa, Staphylococcus epidermidis
TTFGEKQRASVTN

SEQ ID NO: 1839359 - protein, 23 aa, Staphylococcus epidermidis
TTNTYAANYSNIDEARKEHPNAD

SEQ ID NO: 1839360 - protein, 15 aa, Staphylococcus epidermidis
TTPETKIKTSPDAVK

SEQ ID NO: 1839361 - protein, 29 aa, Staphylococcus epidermidis
TTPSKVQTLSTQSTPAPKQVQSSTQTVNQ

SEQ ID NO: 1839362 - protein, 35 aa, Staphylococcus epidermidis
TTPSSSNTKPSKPSTDNSSSNNKLTVSANSGVAQI

SEQ ID NO: 1839363 - protein, 50 aa, Staphylococcus epidermidis
TTPTQSKVAVSKPKTSTKAVSTNSKATTADRAAITQTSAKASNTNSTQTI

SEQ ID NO: 1839364 - protein, 6 aa, Staphylococcus epidermidis
TTVDGK

SEQ ID NO: 1839365 - protein, 6 aa, Staphylococcus epidermidis
TTVPGL

SEQ ID NO: 1839366 - protein, 15 aa, Staphylococcus epidermidis
TVDKLNKSNSSVASY

SEQ ID NO: 1839367 - protein, 6 aa, Staphylococcus epidermidis
TVDKQI

SEQ ID NO: 1839368 - protein, 12 aa, Staphylococcus epidermidis
TVDRTTNGHGRV

SEQ ID NO: 1839369 - protein, 100 aa, Staphylococcus epidermidis
TVDYSSNEDLENTYQESSANENNTDNNQSSEVANNTESKDTNTNVQSNTQKQGNTNKEQTQQSAPREHSGGHPSAFGGGDVPVGTEKVDDQGESYIDATG

SEQ ID NO: 1839370 - protein, 15 aa, Staphylococcus epidermidis
TVKASKYDDDKKPSI

SEQ ID NO: 1839371 - protein, 12 aa, Staphylococcus epidermidis
TVPAGKYAKQYL

SEQ ID NO: 1839372 - protein, 12 aa, Staphylococcus epidermidis
TYDTSQVDSKTM

SEQ ID NO: 1839373 - protein, 35 aa, Staphylococcus epidermidis
TYDVDENGIATLTDKNNGKTEQLPYSAKDKDGKDV

SEQ ID NO: 1839374 - protein, 13 aa, Staphylococcus epidermidis
TYGGNSGSPVFNE

SEQ ID NO: 1839375 - protein, 4 aa, Staphylococcus epidermidis
TYQN

SEQ ID NO: 1839376 - protein, 10 aa, Staphylococcus epidermidis
TYSDNTANNK

SEQ ID NO: 1839377 - protein, 10 aa, Staphylococcus epidermidis
TYSTNRYNAE

SEQ ID NO: 1839378 - protein, 45 aa, Staphylococcus epidermidis
VAPWGTSSTSPSKPSKPSDSSNNNKLTVSANSGVAQIKPSNSGLY

SEQ ID NO: 1839379 - protein, 14 aa, Staphylococcus epidermidis
VAPYQSKDATQVAR

SEQ ID NO: 1839380 - protein, 23 aa, Staphylococcus epidermidis
VASTIKDKNKKLSLQDKLDKSSL

SEQ ID NO: 1839381 - protein, 16 aa, Staphylococcus epidermidis
VDADDAMTQLYNLFYK

SEQ ID NO: 1839382 - protein, 16 aa, Staphylococcus epidermidis
VDDHETKVDKWLKGID

SEQ ID NO: 1839383 - protein, 7 aa, Staphylococcus epidermidis
VDDPNQM

SEQ ID NO: 1839384 - protein, 6 aa, Staphylococcus epidermidis
VDGTFN

SEQ ID NO: 1839385 - protein, 4 aa, Staphylococcus epidermidis
VDHS

SEQ ID NO: 1839386 - protein, 17 aa, Staphylococcus epidermidis
VDKKAMQSLSEETNKDI

SEQ ID NO: 1839387 - protein, 9 aa, Staphylococcus epidermidis
VDKNSVSDH

SEQ ID NO: 1839388 - protein, 10 aa, Staphylococcus epidermidis
VDNAKQQVKR

SEQ ID NO: 1839389 - protein, 52 aa, Staphylococcus epidermidis
VDNNQSRSSENNQPNALDKTTLTNNDENQNAIQSLESEQASTNSDENNINNQ

SEQ ID NO: 1839390 - protein, 5 aa, Staphylococcus epidermidis
VDPTE

SEQ ID NO: 1839391 - protein, 5 aa, Staphylococcus epidermidis
VDTDN

SEQ ID NO: 1839392 - protein, 10 aa, Staphylococcus epidermidis
VEADKDEAKK

SEQ ID NO: 1839393 - protein, 6 aa, Staphylococcus epidermidis
VEASQG

SEQ ID NO: 1839394 - protein, 8 aa, Staphylococcus epidermidis
VEKEQESK

SEQ ID NO: 1839395 - protein, 8 aa, Staphylococcus epidermidis
VEKNLPGV

SEQ ID NO: 1839396 - protein, 6 aa, Staphylococcus epidermidis
VEKPLP

SEQ ID NO: 1839397 - protein, 14 aa, Staphylococcus epidermidis
VENGKVQNQDIKKA

SEQ ID NO: 1839398 - protein, 25 aa, Staphylococcus epidermidis
VEQRQKEFEKEEKALDNSEKEFKQA

SEQ ID NO: 1839399 - protein, 5 aa, Staphylococcus epidermidis
VETGL

SEQ ID NO: 1839400 - protein, 17 aa, Staphylococcus epidermidis
VGGGVGGGLTGGATFCG

SEQ ID NO: 1839401 - protein, 7 aa, Staphylococcus epidermidis
VGGNKVD

SEQ ID NO: 1839402 - protein, 11 aa, Staphylococcus epidermidis
VGHTYAPDKEV

SEQ ID NO: 1839403 - protein, 6 aa, Staphylococcus epidermidis
VGPEYT

SEQ ID NO: 1839404 - protein, 7 aa, Staphylococcus epidermidis
VGQEGVD

SEQ ID NO: 1839405 - protein, 16 aa, Staphylococcus epidermidis
VGQGFQPKAEKSAIEY

SEQ ID NO: 1839406 - protein, 9 aa, Staphylococcus epidermidis
VGRGTTEKI

SEQ ID NO: 1839407 - protein, 9 aa, Staphylococcus epidermidis
VGSDSSEVR

SEQ ID NO: 1839408 - protein, 12 aa, Staphylococcus epidermidis
VGVADDKKKERI

SEQ ID NO: 1839409 - protein, 22 aa, Staphylococcus epidermidis
VHAAESNHLENQEQSEVSASHS

SEQ ID NO: 1839410 - protein, 19 aa, Staphylococcus epidermidis
VHAAESNHLENQEQSEVSV

SEQ ID NO: 1839411 - protein, 7 aa, Staphylococcus epidermidis
VHANSKG

SEQ ID NO: 1839412 - protein, 18 aa, Staphylococcus epidermidis
VHDDPLANKKYKVEDTDY

SEQ ID NO: 1839413 - protein, 18 aa, Staphylococcus epidermidis
VHTKTTGKLDNDKELDNV

SEQ ID NO: 1839414 - protein, 37 aa, Staphylococcus epidermidis
VINGSGNGNSGGWKKPGYWSKSSVKKTWSGNKAFYDH

SEQ ID NO: 1839415 - protein, 9 aa, Staphylococcus epidermidis
VKANNSGIR

SEQ ID NO: 1839416 - protein, 8 aa, Staphylococcus epidermidis
VKDKGDYY

SEQ ID NO: 1839417 - protein, 8 aa, Staphylococcus epidermidis
VKDKSGRT

SEQ ID NO: 1839418 - protein, 5 aa, Staphylococcus epidermidis
VKDPY

SEQ ID NO: 1839419 - protein, 9 aa, Staphylococcus epidermidis
VKGENNETH

SEQ ID NO: 1839420 - protein, 9 aa, Staphylococcus epidermidis
VKGIGNDVS

SEQ ID NO: 1839421 - protein, 9 aa, Staphylococcus epidermidis
VKGSDVKKA

SEQ ID NO: 1839422 - protein, 10 aa, Staphylococcus epidermidis
VKGTPKQQVG

SEQ ID NO: 1839423 - protein, 5 aa, Staphylococcus epidermidis
VKIED

SEQ ID NO: 1839424 - protein, 15 aa, Staphylococcus epidermidis
VKKDPKHKKEYENNY

SEQ ID NO: 1839425 - protein, 34 aa, Staphylococcus epidermidis
VKNTRIETVDGDEVSRPGPRIDEGLKDLKDEIYK

SEQ ID NO: 1839426 - protein, 7 aa, Staphylococcus epidermidis
VKPETTV

SEQ ID NO: 1839427 - protein, 15 aa, Staphylococcus epidermidis
VKQDEGSTESELDTG

SEQ ID NO: 1839428 - protein, 8 aa, Staphylococcus epidermidis
VKSEPKKV

SEQ ID NO: 1839429 - protein, 10 aa, Staphylococcus epidermidis
VKSKESSIKD

SEQ ID NO: 1839430 - protein, 17 aa, Staphylococcus epidermidis
VKSKGNDKNLNVTSKVN

SEQ ID NO: 1839431 - protein, 5 aa, Staphylococcus epidermidis
VKSNI

SEQ ID NO: 1839432 - protein, 16 aa, Staphylococcus epidermidis
VKSPSSKMAKAYNSQR

SEQ ID NO: 1839433 - protein, 154 aa, Staphylococcus epidermidis
VKSRATSTKRAISPKTSSTKKTTIAKKSTTLNKTRTTTKTQPTIRKSSTTSTRSKTMPTSVKRTTSHKATTVSPTSKAKISTKTQQSTKSHTTSVKKNTTQLSKTKSPSVSTKSKTVQSSTTKAQPTLTTQVSKTTKAKQLSTSPTSKISSSKE

SEQ ID NO: 1839434 - protein, 14 aa, Staphylococcus epidermidis
VKTNDIPKNANKNL

SEQ ID NO: 1839435 - protein, 19 aa, Staphylococcus epidermidis
VLPAVASKSGLLAHPSNSY

SEQ ID NO: 1839436 - protein, 9 aa, Staphylococcus epidermidis
VLPNKTGMA

SEQ ID NO: 1839437 - protein, 12 aa, Staphylococcus epidermidis
VNAQEEKSTNAQ

SEQ ID NO: 1839438 - protein, 6 aa, Staphylococcus epidermidis
VNGDGS

SEQ ID NO: 1839439 - protein, 18 aa, Staphylococcus epidermidis
VNGRTDAFSDPYTKPEGY

SEQ ID NO: 1839440 - protein, 6 aa, Staphylococcus epidermidis
VNKDGS

SEQ ID NO: 1839441 - protein, 9 aa, Staphylococcus epidermidis
VNKDNQEDH

SEQ ID NO: 1839442 - protein, 10 aa, Staphylococcus epidermidis
VNKKDGTFSY

SEQ ID NO: 1839443 - protein, 14 aa, Staphylococcus epidermidis
VNNDGSPNKKLVDD

SEQ ID NO: 1839444 - protein, 9 aa, Staphylococcus epidermidis
VNNDGSVKV

SEQ ID NO: 1839445 - protein, 7 aa, Staphylococcus epidermidis
VNNTPEV

SEQ ID NO: 1839446 - protein, 7 aa, Staphylococcus epidermidis
VNNTSKI

SEQ ID NO: 1839447 - protein, 22 aa, Staphylococcus epidermidis
VNSDTGRFDTESGDIKVQNGRY

SEQ ID NO: 1839448 - protein, 8 aa, Staphylococcus epidermidis
VNSNGTIT

SEQ ID NO: 1839449 - protein, 43 aa, Staphylococcus epidermidis
VNTDANAKKGSATQKINAEVTQQTDAPKALKALPDSQNVKNHY

SEQ ID NO: 1839450 - protein, 23 aa, Staphylococcus epidermidis
VNTSSDNGGVHTNSGIPNKAAYN

SEQ ID NO: 1839451 - protein, 14 aa, Staphylococcus epidermidis
VPAQAVGDAAYRGA

SEQ ID NO: 1839452 - protein, 8 aa, Staphylococcus epidermidis
VPDSTDGR

SEQ ID NO: 1839453 - protein, 8 aa, Staphylococcus epidermidis
VPEGKDNV

SEQ ID NO: 1839454 - protein, 12 aa, Staphylococcus epidermidis
VPGQWTNANYNE

SEQ ID NO: 1839455 - protein, 7 aa, Staphylococcus epidermidis
VPNHHQK

SEQ ID NO: 1839456 - protein, 7 aa, Staphylococcus epidermidis
VPPQTNA

SEQ ID NO: 1839457 - protein, 5 aa, Staphylococcus epidermidis
VPYNP

SEQ ID NO: 1839458 - protein, 11 aa, Staphylococcus epidermidis
VQAATNQPDQY

SEQ ID NO: 1839459 - protein, 6 aa, Staphylococcus epidermidis
VQHGSK

SEQ ID NO: 1839460 - protein, 6 aa, Staphylococcus epidermidis
VQSNFS

SEQ ID NO: 1839461 - protein, 5 aa, Staphylococcus epidermidis
VRKVG

SEQ ID NO: 1839462 - protein, 13 aa, Staphylococcus epidermidis
VRSEIDREKEKQL

SEQ ID NO: 1839463 - protein, 14 aa, Staphylococcus epidermidis
VSDKEIKDDSKKAS

SEQ ID NO: 1839464 - protein, 4 aa, Staphylococcus epidermidis
VSDL

SEQ ID NO: 1839465 - protein, 7 aa, Staphylococcus epidermidis
VSDNYGV

SEQ ID NO: 1839466 - protein, 8 aa, Staphylococcus epidermidis
VSDYTPTD

SEQ ID NO: 1839467 - protein, 6 aa, Staphylococcus epidermidis
VSEDIK

SEQ ID NO: 1839468 - protein, 9 aa, Staphylococcus epidermidis
VSEKDKQKL

SEQ ID NO: 1839469 - protein, 5 aa, Staphylococcus epidermidis
VSGDI

SEQ ID NO: 1839470 - protein, 7 aa, Staphylococcus epidermidis
VSGQTSE

SEQ ID NO: 1839471 - protein, 21 aa, Staphylococcus epidermidis
VSGSSSSTTKSRATSNSGSVY

SEQ ID NO: 1839472 - protein, 16 aa, Staphylococcus epidermidis
VSKSTSTFTDQMNQQA

SEQ ID NO: 1839473 - protein, 6 aa, Staphylococcus epidermidis
VSLGQR

SEQ ID NO: 1839474 - protein, 6 aa, Staphylococcus epidermidis
VSPING

SEQ ID NO: 1839475 - protein, 19 aa, Staphylococcus epidermidis
VSTPQQKAQYQKKNEEMRK

SEQ ID NO: 1839476 - protein, 17 aa, Staphylococcus epidermidis
VTDSDGAEQTSTRYIEV

SEQ ID NO: 1839477 - protein, 11 aa, Staphylococcus epidermidis
VTDTQKDNKGF

SEQ ID NO: 1839478 - protein, 10 aa, Staphylococcus epidermidis
VTGYPGDKPL

SEQ ID NO: 1839479 - protein, 9 aa, Staphylococcus epidermidis
VTKAPDSVD

SEQ ID NO: 1839480 - protein, 15 aa, Staphylococcus epidermidis
VTKVDPKETKAYINV

SEQ ID NO: 1839481 - protein, 9 aa, Staphylococcus epidermidis
VTSEQYQNA

SEQ ID NO: 1839482 - protein, 6 aa, Staphylococcus epidermidis
VTSIQQ

SEQ ID NO: 1839483 - protein, 24 aa, Staphylococcus epidermidis
VTSQNIGNQTKATGQYKVSQTNNG

SEQ ID NO: 1839484 - protein, 36 aa, Staphylococcus epidermidis
VTSTESNETPVSQASFESTATDESGVTYENYETPIN

SEQ ID NO: 1839485 - protein, 28 aa, Staphylococcus epidermidis
VTSTSAPSSNGVSLSNASSAGGNLYTSG

SEQ ID NO: 1839486 - protein, 9 aa, Staphylococcus epidermidis
VYPGATEED

SEQ ID NO: 1839487 - protein, 11 aa, Staphylococcus epidermidis
WDNAAAADGYT

SEQ ID NO: 1839488 - protein, 4 aa, Staphylococcus epidermidis
WGKG

SEQ ID NO: 1839489 - protein, 5 aa, Staphylococcus epidermidis
WGTKG

SEQ ID NO: 1839490 - protein, 28 aa, Staphylococcus epidermidis
WKSEDSGLHDLTRDGATDLNRKTSLNPN

SEQ ID NO: 1839491 - protein, 28 aa, Staphylococcus epidermidis
WSPDRLDNNYNNYNYNNYSNYSNSNNYY

SEQ ID NO: 1839492 - protein, 18 aa, Staphylococcus epidermidis
WYSNARQSGYATGHKPRK

SEQ ID NO: 1839493 - protein, 34 aa, Staphylococcus epidermidis
YADASTKTQQTHVTKTSPTQKTTSNFKRSVKDTV

SEQ ID NO: 1839494 - protein, 5 aa, Staphylococcus epidermidis
YAKKG

SEQ ID NO: 1839495 - protein, 27 aa, Staphylococcus epidermidis
YAKRTNNDVSDTTENVTVTSENSDQVN

SEQ ID NO: 1839496 - protein, 7 aa, Staphylococcus epidermidis
YAPEKSL

SEQ ID NO: 1839497 - protein, 7 aa, Staphylococcus epidermidis
YAPKTSL

SEQ ID NO: 1839498 - protein, 13 aa, Staphylococcus epidermidis
YASERDSKDSLKI

SEQ ID NO: 1839499 - protein, 19 aa, Staphylococcus epidermidis
YASGSSEQGAQTKQTQNEA

SEQ ID NO: 1839500 - protein, 10 aa, Staphylococcus epidermidis
YATDPDYAKK

SEQ ID NO: 1839501 - protein, 21 aa, Staphylococcus epidermidis
YAYGPGSNKFKGNMENTQNAK

SEQ ID NO: 1839502 - protein, 21 aa, Staphylococcus epidermidis
YAYGPGSSKFKGNMENTQSAK

SEQ ID NO: 1839503 - protein, 13 aa, Staphylococcus epidermidis
YDASLDGNLGDAH

SEQ ID NO: 1839504 - protein, 14 aa, Staphylococcus epidermidis
YDDEDDDSSTDHLE

SEQ ID NO: 1839505 - protein, 18 aa, Staphylococcus epidermidis
YDDEKNMGQGVPFQNDSS

SEQ ID NO: 1839506 - protein, 7 aa, Staphylococcus epidermidis
YDDNTVK

SEQ ID NO: 1839507 - protein, 6 aa, Staphylococcus epidermidis
YDGGPF

SEQ ID NO: 1839508 - protein, 9 aa, Staphylococcus epidermidis
YDGGPFSIS

SEQ ID NO: 1839509 - protein, 10 aa, Staphylococcus epidermidis
YDIPTKKAPK

SEQ ID NO: 1839510 - protein, 20 aa, Staphylococcus epidermidis
YDKAKNKTGEVRPKYESKEL

SEQ ID NO: 1839511 - protein, 29 aa, Staphylococcus epidermidis
YDKEDKAKNINKDLDKKISGMKDKTKGFN

SEQ ID NO: 1839512 - protein, 11 aa, Staphylococcus epidermidis
YDKKGRPHHHD

SEQ ID NO: 1839513 - protein, 6 aa, Staphylococcus epidermidis
YDQKYY

SEQ ID NO: 1839514 - protein, 6 aa, Staphylococcus epidermidis
YDSSPL

SEQ ID NO: 1839515 - protein, 6 aa, Staphylococcus epidermidis
YDTPQI

SEQ ID NO: 1839516 - protein, 20 aa, Staphylococcus epidermidis
YEATENGQDKKEKEDKDIDH

SEQ ID NO: 1839517 - protein, 13 aa, Staphylococcus epidermidis
YEDNKDNRSLEEM

SEQ ID NO: 1839518 - protein, 22 aa, Staphylococcus epidermidis
YEEKGNDLNTEDIQNSNQEMND

SEQ ID NO: 1839519 - protein, 21 aa, Staphylococcus epidermidis
YEFKDKNNTHHRGETKTDTVK

SEQ ID NO: 1839520 - protein, 10 aa, Staphylococcus epidermidis
YEGGGADLKN

SEQ ID NO: 1839521 - protein, 24 aa, Staphylococcus epidermidis
YEGHPLDTDTYTFKEPEQNEDGDW

SEQ ID NO: 1839522 - protein, 24 aa, Staphylococcus epidermidis
YEGHQLDTDTYTFKEPEQNEDGDW

SEQ ID NO: 1839523 - protein, 4 aa, Staphylococcus epidermidis
YEKE

SEQ ID NO: 1839524 - protein, 7 aa, Staphylococcus epidermidis
YENEWKP

SEQ ID NO: 1839525 - protein, 5 aa, Staphylococcus epidermidis
YERNI

SEQ ID NO: 1839526 - protein, 8 aa, Staphylococcus epidermidis
YGDGDGRT

SEQ ID NO: 1839527 - protein, 10 aa, Staphylococcus epidermidis
YGESSNYKNL

SEQ ID NO: 1839528 - protein, 6 aa, Staphylococcus epidermidis
YGGPIA

SEQ ID NO: 1839529 - protein, 6 aa, Staphylococcus epidermidis
YGGPNM

SEQ ID NO: 1839530 - protein, 16 aa, Staphylococcus epidermidis
YGGSGALRQQIETGAP

SEQ ID NO: 1839531 - protein, 10 aa, Staphylococcus epidermidis
YGKSSNYKDI

SEQ ID NO: 1839532 - protein, 8 aa, Staphylococcus epidermidis
YGNKDTRV

SEQ ID NO: 1839533 - protein, 17 aa, Staphylococcus epidermidis
YGNKGVSIEPTKAKDAN

SEQ ID NO: 1839534 - protein, 11 aa, Staphylococcus epidermidis
YGNTKKPQDHT

SEQ ID NO: 1839535 - protein, 9 aa, Staphylococcus epidermidis
YGRGISQRD

SEQ ID NO: 1839536 - protein, 6 aa, Staphylococcus epidermidis
YGSEYV

SEQ ID NO: 1839537 - protein, 4 aa, Staphylococcus epidermidis
YGYS

SEQ ID NO: 1839538 - protein, 15 aa, Staphylococcus epidermidis
YHDERKKLNSSQGKN

SEQ ID NO: 1839539 - protein, 7 aa, Staphylococcus epidermidis
YHSTSEG

SEQ ID NO: 1839540 - protein, 12 aa, Staphylococcus epidermidis
YIDSNVDASWFT

SEQ ID NO: 1839541 - protein, 10 aa, Staphylococcus epidermidis
YKDANQTVNR

SEQ ID NO: 1839542 - protein, 12 aa, Staphylococcus epidermidis
YKDKNGNSHLER

SEQ ID NO: 1839543 - protein, 6 aa, Staphylococcus epidermidis
YKDQKA

SEQ ID NO: 1839544 - protein, 44 aa, Staphylococcus epidermidis
YKDRDIKKAVEDSILDPDKIKQQQQQQQSSQGGASGSSGLTSSA

SEQ ID NO: 1839545 - protein, 8 aa, Staphylococcus epidermidis
YKEQEKLN

SEQ ID NO: 1839546 - protein, 5 aa, Staphylococcus epidermidis
YKIGN

SEQ ID NO: 1839547 - protein, 9 aa, Staphylococcus epidermidis
YKKALNKEK

SEQ ID NO: 1839548 - protein, 16 aa, Staphylococcus epidermidis
YKKSTQQLPAKTNDVK

SEQ ID NO: 1839549 - protein, 5 aa, Staphylococcus epidermidis
YKNGK

SEQ ID NO: 1839550 - protein, 8 aa, Staphylococcus epidermidis
YKPQVQNE

SEQ ID NO: 1839551 - protein, 10 aa, Staphylococcus epidermidis
YKQKSDSTLE

SEQ ID NO: 1839552 - protein, 7 aa, Staphylococcus epidermidis
YKSNAEL

SEQ ID NO: 1839553 - protein, 9 aa, Staphylococcus epidermidis
YKYPTPLEQ

SEQ ID NO: 1839554 - protein, 5 aa, Staphylococcus epidermidis
YKYPY

SEQ ID NO: 1839555 - protein, 5 aa, Staphylococcus epidermidis
YMSGS

SEQ ID NO: 1839556 - protein, 7 aa, Staphylococcus epidermidis
YNEQTGV

SEQ ID NO: 1839557 - protein, 11 aa, Staphylococcus epidermidis
YNGGGERKSIH

SEQ ID NO: 1839558 - protein, 6 aa, Staphylococcus epidermidis
YNGGPY

SEQ ID NO: 1839559 - protein, 7 aa, Staphylococcus epidermidis
YNNNRIQ

SEQ ID NO: 1839560 - protein, 21 aa, Staphylococcus epidermidis
YNPNVPSYSAKYQLSNNDYNV

SEQ ID NO: 1839561 - protein, 8 aa, Staphylococcus epidermidis
YNPPNAQA

SEQ ID NO: 1839562 - protein, 15 aa, Staphylococcus epidermidis
YNPTVGSIAQTDAGY

SEQ ID NO: 1839563 - protein, 12 aa, Staphylococcus epidermidis
YNQKKKTDKVKE

SEQ ID NO: 1839564 - protein, 9 aa, Staphylococcus epidermidis
YNRARQAAI

SEQ ID NO: 1839565 - protein, 13 aa, Staphylococcus epidermidis
YNVPNKALSDGDI

SEQ ID NO: 1839566 - protein, 5 aa, Staphylococcus epidermidis
YPAGT

SEQ ID NO: 1839567 - protein, 7 aa, Staphylococcus epidermidis
YPDEMGT

SEQ ID NO: 1839568 - protein, 5 aa, Staphylococcus epidermidis
YPIKM

SEQ ID NO: 1839569 - protein, 5 aa, Staphylococcus epidermidis
YPISN

SEQ ID NO: 1839570 - protein, 14 aa, Staphylococcus epidermidis
YQKGEAHLTNPQVK

SEQ ID NO: 1839571 - protein, 11 aa, Staphylococcus epidermidis
YQQKKKANKVK

SEQ ID NO: 1839572 - protein, 9 aa, Staphylococcus epidermidis
YQQKKKVNK

SEQ ID NO: 1839573 - protein, 8 aa, Staphylococcus epidermidis
YQRGSGRK

SEQ ID NO: 1839574 - protein, 13 aa, Staphylococcus epidermidis
YRDSNGKIREFIN

SEQ ID NO: 1839575 - protein, 12 aa, Staphylococcus epidermidis
YRLTTSSTNQHP

SEQ ID NO: 1839576 - protein, 5 aa, Staphylococcus epidermidis
YRQTS

SEQ ID NO: 1839577 - protein, 10 aa, Staphylococcus epidermidis
YRSGYNAAKG

SEQ ID NO: 1839578 - protein, 7 aa, Staphylococcus epidermidis
YRSYPTQ

SEQ ID NO: 1839579 - protein, 16 aa, Staphylococcus epidermidis
YSDNTANNKIIKEIGG

SEQ ID NO: 1839580 - protein, 65 aa, Staphylococcus epidermidis
YSEDAKKTQSNYKQNKDASHKASTNSKSSHNENPQLPTNDELKHKSKPVQSFEDNVKQNNTRSTS

SEQ ID NO: 1839581 - protein, 10 aa, Staphylococcus epidermidis
YSENDIEERH

SEQ ID NO: 1839582 - protein, 7 aa, Staphylococcus epidermidis
YSTDGRI

SEQ ID NO: 1839583 - protein, 11 aa, Staphylococcus epidermidis
YSVKPKTANVN

SEQ ID NO: 1839584 - protein, 5 aa, Staphylococcus epidermidis
YSYDD

SEQ ID NO: 1839585 - protein, 38 aa, Staphylococcus epidermidis
YTAKASEKDENDKSKQINNKNYNKKVDNGQTSYDFTPQ

SEQ ID NO: 1839586 - protein, 12 aa, Staphylococcus epidermidis
YTEESEGSSLEE

SEQ ID NO: 1839587 - protein, 7 aa, Staphylococcus epidermidis
YTGESTH

SEQ ID NO: 1839588 - protein, 17 aa, Staphylococcus epidermidis
YTGESTRPTLDGRQKAD

SEQ ID NO: 1839589 - protein, 17 aa, Staphylococcus epidermidis
YTGKGKVKEAPGYGQPV

SEQ ID NO: 1839590 - protein, 19 aa, Staphylococcus epidermidis
YTGSATHTEPLGNELPNSS

SEQ ID NO: 1839591 - protein, 19 aa, Staphylococcus epidermidis
YTGSATHTGPLGNELPNSS

SEQ ID NO: 1839592 - protein, 16 aa, Staphylococcus epidermidis
YTIKGDSMDPTLKDGE

SEQ ID NO: 1839593 - protein, 24 aa, Staphylococcus epidermidis
YTNGPYNTDYRTIPASEVSLYAYI

SEQ ID NO: 1839594 - protein, 24 aa, Staphylococcus epidermidis
YTPDRDGDALRSMSDPEEYGQPSH

SEQ ID NO: 1839595 - protein, 23 aa, Staphylococcus epidermidis
YTPGVGGDALRSLSNPERFGQPS

SEQ ID NO: 1839596 - protein, 9 aa, Staphylococcus epidermidis
YTSPTGADT

SEQ ID NO: 1839597 - protein, 6 aa, Staphylococcus epidermidis
YVQNKK

SEQ ID NO: 1839598 - protein, 5 aa, Staphylococcus epidermidis
YWGGT

SEQ ID NO: 1839599 - protein, 6 aa, Staphylococcus epidermidis
YWGGTK

SEQ ID NO: 1839600 - protein, 11 aa, Staphylococcus epidermidis
YYEQAKSGEIV

SEQ ID NO: 1839601 - protein, 18 aa, Staphylococcus epidermidis
YYSPKSKKDTSTPAAFGK

SEQ ID NO: 1839602 - protein, 33 aa, Staphylococcus epidermidis
SNYDRAVELYYYIKGGRVDYGAAHAAKYGHERY

SEQ ID NO: 1839603 - protein, 19 aa, Staphylococcus epidermidis
AGIATFAFAHHDAQAAEQN

SEQ ID NO: 1839604 - protein, 22 aa, Staphylococcus epidermidis
EMNYGHGAGVVTSRTISASQAA

SEQ ID NO: 1839605 - protein, 20 aa, Staphylococcus epidermidis
WANAAARSGYTVNNSPAKGA

SEQ ID NO: 1839606 - protein, 34 aa, Staphylococcus epidermidis
YTSGQCTYYVFDRVGGKIGSTWGNANNWANAAAR

SEQ ID NO: 1839607 - protein, 19 aa, Staphylococcus epidermidis
DGRIHPGRIEDMVEKARKE

SEQ ID NO: 1839608 - protein, 18 aa, Staphylococcus epidermidis
DLKSYRLARDIKNQIEEE

SEQ ID NO: 1839609 - protein, 20 aa, Staphylococcus epidermidis
DTPEAVILSGFDPIRREIAR

SEQ ID NO: 1839610 - protein, 36 aa, Staphylococcus epidermidis; identical to SEQ ID NO: 1713109

SEQ ID NO: 1839611 - protein, 29 aa, Staphylococcus epidermidis
EGNYHYTWKGNWSPDRVNTSYNYNNYNNY

SEQ ID NO: 1839612 - protein, 21 aa, Staphylococcus epidermidis
ELAMPRPYVFVSPKDFKHGTT

SEQ ID NO: 1839613 - protein, 17 aa, Staphylococcus epidermidis
GKITIGLVGKYVSLQDA

SEQ ID NO: 1839614 - protein, 20 aa, Staphylococcus epidermidis
GVEKAFAIQAGREIRVVVSP

SEQ ID NO: 1839615 - protein, 28 aa, Staphylococcus epidermidis
HPDLVKILGRLNYRTSYGQNVLKHSIEV

SEQ ID NO: 1839616 - protein, 18 aa, Staphylococcus epidermidis
IESLPFLEAIRQIRSDLG

SEQ ID NO: 1839617 - protein, 20 aa, Staphylococcus epidermidis
IFDVCINQKLGINGENMVYL

SEQ ID NO: 1839618 - protein, 20 aa, Staphylococcus epidermidis
KEAYQPALAELAMPRPYVFV

SEQ ID NO: 1839619 - protein, 21 aa, Staphylococcus epidermidis
KKDGSLGYVIKGQMVDSFEKA

SEQ ID NO: 1839620 - protein, 25 aa, Staphylococcus epidermidis
LIDPFCGSGTIAIEACLIAQNIAPG

SEQ ID NO: 1839621 - protein, 20 aa, Staphylococcus epidermidis
MYVHCTLLPYIKAAGEMKTK

SEQ ID NO: 1839622 - protein, 24 aa, Staphylococcus epidermidis
PNDEMKGRIIGREGRNIRTLETLT

SEQ ID NO: 1839623 - protein, 23 aa, Staphylococcus epidermidis
TKNKEGIGYFGYNFYEQNKDKLK

SEQ ID NO: 1839624 - protein, 18 aa, Staphylococcus epidermidis
VDAARKVVITSYLSFNQV

SEQ ID NO: 1839625 - protein, 18 aa, Staphylococcus epidermidis
VKTDYGYHIIKADKETDF

SEQ ID NO: 1839626 - protein, 22 aa, Staphylococcus epidermidis
VPVTASALLLGACGSNATESKD

SEQ ID NO: 1839627 - protein, 25 aa, Staphylococcus epidermidis
VQGDNYRTILPFKESQARGLLQDNM

SEQ ID NO: 1839628 - protein, 21 aa, Staphylococcus epidermidis
AALTLAFPFSHVAQAHTYLEK

SEQ ID NO: 1839629 - protein, 27 aa, Staphylococcus epidermidis
AAQMAARTGVSASTWEHIIARESNGQL

SEQ ID NO: 1839630 - protein, 18 aa, Staphylococcus epidermidis
AFYQYRPPIERILTNLLD

SEQ ID NO: 1839631 - protein, 27 aa, Staphylococcus epidermidis
AGAYKDWKPGQKIHLIGHSMGGQTIRY

SEQ ID NO: 1839632 - protein, 24 aa, Staphylococcus epidermidis
AISKIGKGKAAFIGDSSLVEDRSP

SEQ ID NO: 1839633 - protein, 19 aa, Staphylococcus epidermidis
AKEKEWRENDGLVSVISSQ

SEQ ID NO: 1839634 - protein, 17 aa, Staphylococcus epidermidis
AKIGSKVYFKTGNQTRK

SEQ ID NO: 1839635 - protein, 18 aa, Staphylococcus epidermidis
AKKFKKDGYDIVSNKDEL

SEQ ID NO: 1839636 - protein, 17 aa, Staphylococcus epidermidis
ALMTRGLAEISRLGEKL

SEQ ID NO: 1839637 - protein, 26 aa, Staphylococcus epidermidis
APIKETLAASLIRLANWNGNTPLIDP

SEQ ID NO: 1839638 - protein, 18 aa, Staphylococcus epidermidis
ARENNIPFFGICLGMQLA

SEQ ID NO: 1839639 - protein, 21 aa, Staphylococcus epidermidis
ARGLREFPIDITAIVTVADNG

SEQ ID NO: 1839640 - protein, 20 aa, Staphylococcus epidermidis
ASAKPDVIFISGRTANQKNL

SEQ ID NO: 1839641 - protein, 25 aa, Staphylococcus epidermidis
ATSYTLGEPFKIYKFNKESDGNYYY

SEQ ID NO: 1839642 - protein, 19 aa, Staphylococcus epidermidis
DAIYLPGGHGTVYDFANNE

SEQ ID NO: 1839643 - protein, 17 aa, Staphylococcus epidermidis
DDYKEQKKLSAYQKQLL

SEQ ID NO: 1839644 - protein, 17 aa, Staphylococcus epidermidis
DHAQEFVTPLAFQAISR

SEQ ID NO: 1839645 - protein, 23 aa, Staphylococcus epidermidis
DIEEMRKWMPLMMTGRTGNEIMA

SEQ ID NO: 1839646 - protein, 20 aa, Staphylococcus epidermidis
DIYDLKPLKTFVYGRTILMG

SEQ ID NO: 1839647 - protein, 26 aa, Staphylococcus epidermidis
DSSNHMFSIQAGFRKYPSTKQSLEDY

SEQ ID NO: 1839648 - protein, 22 aa, Staphylococcus epidermidis
DTDLKYHVCTCDDEKEWREYDY

SEQ ID NO: 1839649 - protein, 26 aa, Staphylococcus epidermidis
DVDGILVPGGFGFRASEGKIAAIRYA

SEQ ID NO: 1839650 - protein, 24 aa, Staphylococcus epidermidis
DVKDKIIFAKDVKQVLNYVEKGNA

SEQ ID NO: 1839651 - protein, 36 aa, Staphylococcus epidermidis
EEDYTSYFPKYGYRNGVGRPEGIVVHDTANDNSTID

SEQ ID NO: 1839652 - protein, 25 aa, Staphylococcus epidermidis
EIIPYPGNSDLAILRVSPNEHNQHI

SEQ ID NO: 1839653 - protein, 23 aa, Staphylococcus epidermidis
EKELLKHDIHLISGHPMAGSHKS

SEQ ID NO: 1839654 - protein, 23 aa, Staphylococcus epidermidis
EKYYEFRTDKGVLLVTANGKKER

SEQ ID NO: 1839655 - protein, 26 aa, Staphylococcus epidermidis
ENSDLKDIPIHFAIYKQSSQDSITPG

SEQ ID NO: 1839656 - protein, 34 aa, Staphylococcus epidermidis
EPEKDSDGSWGFSFTDKEGHLEGSYIIDKDGEVT

SEQ ID NO: 1839657 - protein, 19 aa, Staphylococcus epidermidis
EQNKSAFAFSKKVDEKTIE

SEQ ID NO: 1839658 - protein, 26 aa, Staphylococcus epidermidis
EQTEDGFRYVFSFKDPSKSNTYSIVT

SEQ ID NO: 1839659 - protein, 19 aa, Staphylococcus epidermidis
ESLHSVYVFSSENKLHQTK

SEQ ID NO: 1839660 - protein, 24 aa, Staphylococcus epidermidis
ESVIECRDADSLYEIPLQLSKQNM

SEQ ID NO: 1839661 - protein, 21 aa, Staphylococcus epidermidis
EWREYDYLFLTFGTFSYHDPY

SEQ ID NO: 1839662 - protein, 25 aa, Staphylococcus epidermidis
FAQQFDVKPGYIWEINTEKQGTPGQ

SEQ ID NO: 1839663 - protein, 18 aa, Staphylococcus epidermidis
FCTDIDAFYQYRPPIERI

SEQ ID NO: 1839664 - protein, 17 aa, Staphylococcus epidermidis
FENKVPFLTQSKLEEQG

SEQ ID NO: 1839665 - protein, 20 aa, Staphylococcus epidermidis
FGIKGDYKGQSVTFNTLEAD

SEQ ID NO: 1839666 - protein, 18 aa, Staphylococcus epidermidis
FIGNSYVKAGQNTLYKMR

SEQ ID NO: 1839667 - protein, 18 aa, Staphylococcus epidermidis
FKKDGYDIVSNKDELNQS

SEQ ID NO: 1839668 - protein, 18 aa, Staphylococcus epidermidis
FLEAEFKKLGVQLDINGE

SEQ ID NO: 1839669 - protein, 21 aa, Staphylococcus epidermidis
FNPQECKVIALNYAENHLSKK

SEQ ID NO: 1839670 - protein, 18 aa, Staphylococcus epidermidis
FPAVHYSMGGLYVDYDQM

SEQ ID NO: 1839671 - protein, 17 aa, Staphylococcus epidermidis
GAAHAAKYGHKRYGRTY

SEQ ID NO: 1839672 - protein, 19 aa, Staphylococcus epidermidis
GDAAMDFIRSRKEDGAGGD

SEQ ID NO: 1839673 - protein, 17 aa, Staphylococcus epidermidis
GGAKYFGKENKNLAKKF

SEQ ID NO: 1839674 - protein, 17 aa, Staphylococcus epidermidis
GGTLHHRTAFAGATTGQ

SEQ ID NO: 1839675 - protein, 18 aa, Staphylococcus epidermidis
GKESVDIIVNLLQNAELK

SEQ ID NO: 1839676 - protein, 19 aa, Staphylococcus epidermidis
GKSDLFLYTGDNLDPVAKK

SEQ ID NO: 1839677 - protein, 19 aa, Staphylococcus epidermidis
GKSNEKASLEKSIDQLKKE

SEQ ID NO: 1839678 - protein, 24 aa, Staphylococcus epidermidis
GKVNLKNGDPFTIALFGVDSDEKR

SEQ ID NO: 1839679 - protein, 17 aa, Staphylococcus epidermidis
GKYKVKYQVTDSDGAEK

SEQ ID NO: 1839680 - protein, 19 aa, Staphylococcus epidermidis
GLLDFRRFGGTLHHRTAFA

SEQ ID NO: 1839681 - protein, 19 aa, Staphylococcus epidermidis
GNNKFYLVEDYNSGKKYGW

SEQ ID NO: 1839682 - protein, 26 aa, Staphylococcus epidermidis
GVYKDWKPGQKIHLVGHSMGGQTIRQ

SEQ ID NO: 1839683 - protein, 23 aa, Staphylococcus epidermidis
GYLACGYVAKGRMEEPMQILSVI

SEQ ID NO: 1839684 - protein, 18 aa, Staphylococcus epidermidis
GYPFKKDVVVKWIDSSEV

SEQ ID NO: 1839685 - protein, 17 aa, Staphylococcus epidermidis
GYTFPLVTLKKEAGIDA

SEQ ID NO: 1839686 - protein, 18 aa, Staphylococcus epidermidis
HAYAYGGPNMAVKTIEKL

SEQ ID NO: 1839687 - protein, 23 aa, Staphylococcus epidermidis
HKVDVMLGGGAKYFGKENKNLAK

SEQ ID NO: 1839688 - protein, 18 aa, Staphylococcus epidermidis
HNLFGIKGDYKGQSVTFN

SEQ ID NO: 1839689 - protein, 29 aa, Staphylococcus epidermidis
HQFIPGYNLFHIYPLFPIPERQRFLEQLK

SEQ ID NO: 1839690 - protein, 17 aa, Staphylococcus epidermidis
IDIQEPIVITGAMRSSN

SEQ ID NO: 1839691 - protein, 19 aa, Staphylococcus epidermidis
IDLLIDIQEPIVITGAMRS

SEQ ID NO: 1839692 - protein, 20 aa, Staphylococcus epidermidis
IEEIKLSKPITYKAGATSDK

SEQ ID NO: 1839693 - protein, 24 aa, Staphylococcus epidermidis
IIEHLKENLNWIWNSLSVKDQETF

SEQ ID NO: 1839694 - protein, 26 aa, Staphylococcus epidermidis
IIHLLDRMGVMFNRTKEGLLDFRRFG

SEQ ID NO: 1839695 - protein, 19 aa, Staphylococcus epidermidis
IITGVSALRDKSHEDRQNQ

SEQ ID NO: 1839696 - protein, 21 aa, Staphylococcus epidermidis
IKRSNTRSTSLFQQLPELDNG

SEQ ID NO: 1839697 - protein, 22 aa, Staphylococcus epidermidis
IKTSEKLAQIDVDRLPKEGKDI

SEQ ID NO: 1839698 - protein, 18 aa, Staphylococcus epidermidis
INNYLIPEFKKYKNSTQH

SEQ ID NO: 1839699 - protein, 20 aa, Staphylococcus epidermidis
IPFFGICLGMQLATVEFARH

SEQ ID NO: 1839700 - protein, 25 aa, Staphylococcus epidermidis
IPSNTEILYRLGIGEDIVGVSTVDD

SEQ ID NO: 1839701 - protein, 18 aa, Staphylococcus epidermidis
ITLIGVLLIILAIYLFSK

SEQ ID NO: 1839702 - protein, 22 aa, Staphylococcus epidermidis
ITNEIKERLLLAGESTNADVVI

SEQ ID NO: 1839703 - protein, 22 aa, Staphylococcus epidermidis
IVEKLNEKWAKDHKDAKISSGQ

SEQ ID NO: 1839704 - protein, 25 aa, Staphylococcus epidermidis
IVIEKGQEYNLLKGISAYDKEDGDL

SEQ ID NO: 1839705 - protein, 21 aa, Staphylococcus epidermidis
KDWTPKLQKMIPSYGKSLIDD

SEQ ID NO: 1839706 - protein, 25 aa, Staphylococcus epidermidis
KEIEPTHVAVCWDMGQETFRNEMYD

SEQ ID NO: 1839707 - protein, 22 aa, Staphylococcus epidermidis
KELEKDPVWKKLNAVKNQRVDI

SEQ ID NO: 1839708 - protein, 17 aa, Staphylococcus epidermidis
KESIIKRNPDILISTEG

SEQ ID NO: 1839709 - protein, 20 aa, Staphylococcus epidermidis
KITRVMHVQPDISSNSLDPK

SEQ ID NO: 1839710 - protein, 24 aa, Staphylococcus epidermidis
KKAQALLDKAGWVLSKDRQVRQKE

SEQ ID NO: 1839711 - protein, 25 aa, Staphylococcus epidermidis
KLIVVLCAMIIFIALIGLSIRSQTQ

SEQ ID NO: 1839712 - protein, 17 aa, Staphylococcus epidermidis
KLLESAGLIKLKKNFGL

SEQ ID NO: 1839713 - protein, 17 aa, Staphylococcus epidermidis
KMPNMKKYNKSIGTDVS

SEQ ID NO: 1839714 - protein, 19 aa, Staphylococcus epidermidis
KNMKAPRIEEDYTSYFPKY

SEQ ID NO: 1839715 - protein, 20 aa, Staphylococcus epidermidis
KPVQAGAYDIHFVDNGYQYN

SEQ ID NO: 1839716 - protein, 32 aa, Staphylococcus epidermidis
KQKADLNMFLPFTITGNLIGKAKEKEWRENDG

SEQ ID NO: 1839717 - protein, 21 aa, Staphylococcus epidermidis
KSFDGTGPFKMGEHKKDISAE

SEQ ID NO: 1839718 - protein, 25 aa, Staphylococcus epidermidis
KSTDLVKEKIKYAYTGMTLNNAINI

SEQ ID NO: 1839719 - protein, 18 aa, Staphylococcus epidermidis
KTTMARYKGRSEKPEFTY

SEQ ID NO: 1839720 - protein, 17 aa, Staphylococcus epidermidis
KTVSFNLPKDVTKVNPK

SEQ ID NO: 1839721 - protein, 21 aa, Staphylococcus epidermidis
KVQSGESLWTIAQQYNTSVES

SEQ ID NO: 1839722 - protein, 24 aa, Staphylococcus epidermidis
KYDPHIWLDPVVSQKFAKAIKDEL

SEQ ID NO: 1839723 - protein, 17 aa, Staphylococcus epidermidis
LAAGGFRDITRIASSNA

SEQ ID NO: 1839724 - protein, 20 aa, Staphylococcus epidermidis
LANDSSLKYQFLRLDQPQYL

SEQ ID NO: 1839725 - protein, 24 aa, Staphylococcus epidermidis
LEKIPLRININGIRGKSTITRMAY

SEQ ID NO: 1839726 - protein, 23 aa, Staphylococcus epidermidis
LESAGLIKLKKNFGLNGTTKDIE

SEQ ID NO: 1839727 - protein, 19 aa, Staphylococcus epidermidis
LFQTMPGWGSTGSVNDQIN

SEQ ID NO: 1839728 - protein, 22 aa, Staphylococcus epidermidis
LGADPMTFLGLGGIGDLIVTCT

SEQ ID NO: 1839729 - protein, 20 aa, Staphylococcus epidermidis
LGDKKFYLVGDYNTGTNYGW

SEQ ID NO: 1839730 - protein, 19 aa, Staphylococcus epidermidis
LGIAGYGLSGHEAHASETT

SEQ ID NO: 1839731 - protein, 17 aa, Staphylococcus epidermidis
LGMQLATVEFARHVLGY

SEQ ID NO: 1839732 - protein, 18 aa, Staphylococcus epidermidis
LHSQYPYQTPIVGKGTEG

SEQ ID NO: 1839733 - protein, 26 aa, Staphylococcus epidermidis
LIGHSMGGQTIRYLEELLRHGSPEEV

SEQ ID NO: 1839734 - protein, 28 aa, Staphylococcus epidermidis
LIPQFDYVKEISHQFGFVNVGKRNYEAD

SEQ ID NO: 1839735 - protein, 19 aa, Staphylococcus epidermidis
LKDKIALFCDIKKESVIEC

SEQ ID NO: 1839736 - protein, 17 aa, Staphylococcus epidermidis
LKETGSYQVKRSQAMNT

SEQ ID NO: 1839737 - protein, 19 aa, Staphylococcus epidermidis
LKGDAFTIIGGNESAFDAA

SEQ ID NO: 1839738 - protein, 17 aa, Staphylococcus epidermidis
LKKNFGLNGTTKDIESN

SEQ ID NO: 1839739 - protein, 20 aa, Staphylococcus epidermidis
LKYQFLRLDQPQYLSAQALN

SEQ ID NO: 1839740 - protein, 17 aa, Staphylococcus epidermidis
LMMKGREDKGYMAASKI

SEQ ID NO: 1839741 - protein, 20 aa, Staphylococcus epidermidis
LPSMVALTLFGTAFTAHQAN

SEQ ID NO: 1839742 - protein, 26 aa, Staphylococcus epidermidis
LQQLPNFETALSIAKNEANMYGSENK

SEQ ID NO: 1839743 - protein, 19 aa, Staphylococcus epidermidis
LRDEMHFEQQFKPSQIKAA

SEQ ID NO: 1839744 - protein, 20 aa, Staphylococcus epidermidis
LRLGLYPCHIKEGTLAEKIY

SEQ ID NO: 1839745 - protein, 18 aa, Staphylococcus epidermidis
LSAGIGIGDNVLKKLGHH

SEQ ID NO: 1839746 - protein, 29 aa, Staphylococcus epidermidis
LSGNSSIHFKGYLGNNIVKFFDYTLASVG

SEQ ID NO: 1839747 - protein, 20 aa, Staphylococcus epidermidis
LSLALGLFFNSAHADSLPQK

SEQ ID NO: 1839748 - protein, 19 aa, Staphylococcus epidermidis
LSSIAAFIAINTAANAQES

SEQ ID NO: 1839749 - protein, 18 aa, Staphylococcus epidermidis
LTSFDKEKMPNMKKYNKS

SEQ ID NO: 1839750 - protein, 17 aa, Staphylococcus epidermidis
LTTLLVLSSLFLVFSTI

SEQ ID NO: 1839751 - protein, 21 aa, Staphylococcus epidermidis
LVLTACGKSNEKASLEKSIDQ

SEQ ID NO: 1839752 - protein, 24 aa, Staphylococcus epidermidis
LYTWGQCTWHVFNRRAEIGKGIST

SEQ ID NO: 1839753 - protein, 17 aa, Staphylococcus epidermidis
MDTKRLANDSSLKYQFL

SEQ ID NO: 1839754 - protein, 21 aa, Staphylococcus epidermidis
MGPSFNTAYRYYKNKPGAKKM

SEQ ID NO: 1839755 - protein, 17 aa, Staphylococcus epidermidis
MRYLHPNLRGHDFQFTG

SEQ ID NO: 1839756 - protein, 30 aa, Staphylococcus epidermidis
MSLPMKILLWVVGILFLLAIIAVIYVSAKI

SEQ ID NO: 1839757 - protein, 20 aa, Staphylococcus epidermidis
MTSEGAFKYFAQQFDVKPGY

SEQ ID NO: 1839758 - protein, 22 aa, Staphylococcus epidermidis
MTSRSAALPSVRGKMTKIQFTH

SEQ ID NO: 1839759 - protein, 17 aa, Staphylococcus epidermidis
MVEGASIDKAAHPNDIT

SEQ ID NO: 1839760 - protein, 21 aa, Staphylococcus epidermidis
NDFFIACQFHPEFLSRPNRPQ

SEQ ID NO: 1839761 - protein, 19 aa, Staphylococcus epidermidis
NFTKSIAIEYGRENIRANA

SEQ ID NO: 1839762 - protein, 20 aa, Staphylococcus epidermidis
NGHDVLMWGKNVENVDELNT

SEQ ID NO: 1839763 - protein, 18 aa, Staphylococcus epidermidis
NGKHKVDVMLGGGAKYFG

SEQ ID NO: 1839764 - protein, 23 aa, Staphylococcus epidermidis
NKLRNGVKMIVNQVVDTVSQLYI

SEQ ID NO: 1839765 - protein, 30 aa, Staphylococcus epidermidis
NNPAEQGRFLKFFVDEGLIKLKKGVKIENA

SEQ ID NO: 1839766 - protein, 26 aa, Staphylococcus epidermidis
NNVKFLKDRYEAMKQFPMFDNIEYTE

SEQ ID NO: 1839767 - protein, 26 aa, Staphylococcus epidermidis
NNVKFLKNRYEAMRNFPMFDNIEYTE

SEQ ID NO: 1839768 - protein, 24 aa, Staphylococcus epidermidis
NPEDLKVVVDLSGKKAGKYQKKYQ

SEQ ID NO: 1839769 - protein, 23 aa, Staphylococcus epidermidis
NPMPPRTARLLIKLIQNNELVIK

SEQ ID NO: 1839770 - protein, 23 aa, Staphylococcus epidermidis
NQSMDLLLSKRVDGTFNDSLSYL

SEQ ID NO: 1839771 - protein, 18 aa, Staphylococcus epidermidis
NYDTLLIGIEMSRETLYL

SEQ ID NO: 1839772 - protein, 19 aa, Staphylococcus epidermidis
PESYLRKFDYLVFPDNVAI

SEQ ID NO: 1839773 - protein, 19 aa, Staphylococcus epidermidis
PGPYGHVAYVERINGDGSI

SEQ ID NO: 1839774 - protein, 17 aa, Staphylococcus epidermidis
PKFLRNGSNLDLFKSVK

SEQ ID NO: 1839775 - protein, 23 aa, Staphylococcus epidermidis
PNIRQFPLFDLTSRVIGGDDNKN

SEQ ID NO: 1839776 - protein, 22 aa, Staphylococcus epidermidis
PSDEAFKKVGMMNLATDKGIWQ

SEQ ID NO: 1839777 - protein, 23 aa, Staphylococcus epidermidis
PTDYLSWGAGPYGNQRFINVEIV

SEQ ID NO: 1839778 - protein, 26 aa, Staphylococcus epidermidis
QCINHNVEVWLIKKGFTIYQRYTLDR

SEQ ID NO: 1839779 - protein, 20 aa, Staphylococcus epidermidis
QFEISKQFWGHLVKSGEIQN

SEQ ID NO: 1839780 - protein, 17 aa, Staphylococcus epidermidis
QKKLSAYQKQLLLDKVN

SEQ ID NO: 1839781 - protein, 25 aa, Staphylococcus epidermidis
QNLYTEGQCTWYVFDKRSQAGKPIS

SEQ ID NO: 1839782 - protein, 23 aa, Staphylococcus epidermidis
RAEIGKGISTYWWNANNWDNASA

SEQ ID NO: 1839783 - protein, 23 aa, Staphylococcus epidermidis
RFVALILAVFFFLSVNNVFGNIF

SEQ ID NO: 1839784 - protein, 18 aa, Staphylococcus epidermidis
RGAHYKPEFPERNDEEWL

SEQ ID NO: 1839785 - protein, 25 aa, Staphylococcus epidermidis
RGTVWTHAAISNFLGGTDHADPHQY

SEQ ID NO: 1839786 - protein, 18 aa, Staphylococcus epidermidis
RNDEEWLKTTMARYKGRS

SEQ ID NO: 1839787 - protein, 25 aa, Staphylococcus epidermidis
RQLTWFKNKMNVHWLNKERMSLQMM

SEQ ID NO: 1839788 - protein, 18 aa, Staphylococcus epidermidis
RTKEGLLDFRRFGGTLHH

SEQ ID NO: 1839789 - protein, 19 aa, Staphylococcus epidermidis
SGAAGLFQTMPGWGSTGSV

SEQ ID NO: 1839790 - protein, 18 aa, Staphylococcus epidermidis
SGDYDLMFNQTWGLLYDP

SEQ ID NO: 1839791 - protein, 24 aa, Staphylococcus epidermidis
SIYDLKEFVDLCNRSIKDNEDILD

SEQ ID NO: 1839792 - protein, 25 aa, Staphylococcus epidermidis
SKENIKKVLLFLSRNTSSSGVESNE

SEQ ID NO: 1839793 - protein, 17 aa, Staphylococcus epidermidis
SKLKPDLIIADNNRHKG

SEQ ID NO: 1839794 - protein, 20 aa, Staphylococcus epidermidis
SLAIGLGVVAGNAGHDAHAS

SEQ ID NO: 1839795 - protein, 18 aa, Staphylococcus epidermidis
SMKSVLKKYSHPIYSYNP

SEQ ID NO: 1839796 - protein, 26 aa, Staphylococcus epidermidis
SNDTKLPVIFWMHGGGFIAGDKQYKN

SEQ ID NO: 1839797 - protein, 25 aa, Staphylococcus epidermidis
SNPQYLPRFVFGHYMKSYLSYYNDQ

SEQ ID NO: 1839798 - protein, 26 aa, Staphylococcus epidermidis
SVSKAIIGGAKFIGNSYVKAGQNTLY

SEQ ID NO: 1839799 - protein, 25 aa, Staphylococcus epidermidis
SYHFESDGSTWSWSYESTNNATQPV

SEQ ID NO: 1839800 - protein, 24 aa, Staphylococcus epidermidis
TAGAADWVIDGAFSDYADSMRKQG

SEQ ID NO: 1839801 - protein, 17 aa, Staphylococcus epidermidis
TCFRGMVEDVQFNDQHV

SEQ ID NO: 1839802 - protein, 21 aa, Staphylococcus epidermidis
TDARMLYWFTEKEYPVIRKPQ

SEQ ID NO: 1839803 - protein, 25 aa, Staphylococcus epidermidis
TDYKRTGEELGQFYMSMINNMLKVE

SEQ ID NO: 1839804 - protein, 20 aa, Staphylococcus epidermidis
TEFEVAYAPPYSHPKDLINL

SEQ ID NO: 1839805 - protein, 28 aa, Staphylococcus epidermidis
TGIPESKHLGGFPISGQFIACTNPQVIE

SEQ ID NO: 1839806 - protein, 30 aa, Staphylococcus epidermidis
TGIPESKHLGGFPISGQFLICTNPDVINEH

SEQ ID NO: 1839807 - protein, 21 aa, Staphylococcus epidermidis
TKDGIKPLLAKKWDISPDGKT

SEQ ID NO: 1839808 - protein, 17 aa, Staphylococcus epidermidis
TKDILKYLGENKTHQYL

SEQ ID NO: 1839809 - protein, 20 aa, Staphylococcus epidermidis
TLAVSLGIAGYGLSGHEAHA

SEQ ID NO: 1839810 - protein, 19 aa, Staphylococcus epidermidis
TLVAGLGIAFLGHTTHADA

SEQ ID NO: 1839811 - protein, 20 aa, Staphylococcus epidermidis
TLYTVPWGTPKQVASKVSGT

SEQ ID NO: 1839812 - protein, 21 aa, Staphylococcus epidermidis
TPKNHTAVVFEAGQLGADTQY

SEQ ID NO: 1839813 - protein, 24 aa, Staphylococcus epidermidis
TSNEMLRFGRSQGRNTQYLNRMTS

SEQ ID NO: 1839814 - protein, 26 aa, Staphylococcus epidermidis
TTKTGHKYHNVFGIGAFDNNALVDGI

SEQ ID NO: 1839815 - protein, 17 aa, Staphylococcus epidermidis
TYYAFDRRAELGKPIGS

SEQ ID NO: 1839816 - protein, 17 aa, Staphylococcus epidermidis
VALVFVLAACGNNSSNN

SEQ ID NO: 1839817 - protein, 22 aa, Staphylococcus epidermidis
VAVILSICLVLLLFLATNQNAL

SEQ ID NO: 1839818 - protein, 17 aa, Staphylococcus epidermidis
VDAAAVFNDARTVVKKD

SEQ ID NO: 1839819 - protein, 24 aa, Staphylococcus epidermidis
VEDYNSGKKYGWVKQGDVVYNTAK

SEQ ID NO: 1839820 - protein, 24 aa, Staphylococcus epidermidis
VEYDIKKKLPFHKSLQLVERDQDT

SEQ ID NO: 1839821 - protein, 24 aa, Staphylococcus epidermidis
VGDYNTGTNYGWVKQDEVIYNTAK

SEQ ID NO: 1839822 - protein, 18 aa, Staphylococcus epidermidis
VKAGSTLYTVPWGTPKQV

SEQ ID NO: 1839823 - protein, 20 aa, Staphylococcus epidermidis
VKIGESMKSVLKKYSHPIYS

SEQ ID NO: 1839824 - protein, 23 aa, Staphylococcus epidermidis
VKSPEWSVKSWGKTYKYNDYSDH

SEQ ID NO: 1839825 - protein, 17 aa, Staphylococcus epidermidis
VLTLLLAGCMSHEYADK

SEQ ID NO: 1839826 - protein, 23 aa, Staphylococcus epidermidis
VQYDWDHLDLVGLDTTDYKRTGE

SEQ ID NO: 1839827 - protein, 24 aa, Staphylococcus epidermidis
VSHVPHIIASILVHLSANHVKDHS

SEQ ID NO: 1839828 - protein, 23 aa, Staphylococcus epidermidis
VTKYEGWEFLGIVKDEEDAARGI

SEQ ID NO: 1839829 - protein, 31 aa, Staphylococcus epidermidis
WANEMRKLAGNKKILFYSYENFMLNHASNAV

SEQ ID NO: 1839830 - protein, 25 aa, Staphylococcus epidermidis
YAEYAKRIANSKVWETEDQAVNDLT

SEQ ID NO: 1839831 - protein, 17 aa, Staphylococcus epidermidis
YERLDRPGIESSNERNN

SEQ ID NO: 1839832 - protein, 17 aa, Staphylococcus epidermidis
YFLPTAIYPNWGQSQRA

SEQ ID NO: 1839833 - protein, 18 aa, Staphylococcus epidermidis
YGKTYAGAYKDWKPGQKI

SEQ ID NO: 1839834 - protein, 19 aa, Staphylococcus epidermidis
YLEELLRHGSPEEVEYQKQ

SEQ ID NO: 1839835 - protein, 20 aa, Staphylococcus epidermidis
YLIPEFKKYKNSTQHLTADT

SEQ ID NO: 1839836 - protein, 24 aa, Staphylococcus epidermidis
YLVFPDNVAIVLGIAQAVGVDEET

SEQ ID NO: 1839837 - protein, 22 aa, Staphylococcus epidermidis
YNSSVYINDFVQQFLRNNIPDI

SEQ ID NO: 1839838 - protein, 19 aa, Staphylococcus epidermidis
YNYNVPLGYGTRIISKSSA

SEQ ID NO: 1839839 - protein, 28 aa, Staphylococcus epidermidis
YRHVNLPAQVPLAWGAHRGASIIAEQLS

SEQ ID NO: 1839840 - protein, 25 aa, Staphylococcus epidermidis
YSKKLNSIIKHYHLTSFDKEKMPNM

SEQ ID NO: 1839841 - protein, 18 aa, Staphylococcus epidermidis
YTSGQCTWYVYDKTGGKI

SEQ ID NO: 1839842 - protein, 20 aa, Staphylococcus epidermidis
YWGVKGRVGIVPLINQRAYW

SEQ ID NO: 1839843 - protein, 18 aa, Staphylococcus epidermidis
AEAKALYLQGYNTAKYQL

SEQ ID NO: 1839844 - protein, 23 aa, Staphylococcus epidermidis
AGKYQFLQSTWDSVAPSQYKGVS

SEQ ID NO: 1839845 - protein, 21 aa, Staphylococcus epidermidis
AIQAGREIRVVVSPEEIDDLK

SEQ ID NO: 1839846 - protein, 17 aa, Staphylococcus epidermidis
AKRELRKILNRFKEEGR

SEQ ID NO: 1839847 - protein, 19 aa, Staphylococcus epidermidis
AKSFLKYADKKGIDIYYIS

SEQ ID NO: 1839848 - protein, 25 aa, Staphylococcus epidermidis
AKVNNGQKVILIWNPWDNGLMTQDA

SEQ ID NO: 1839849 - protein, 24 aa, Staphylococcus epidermidis
ALAKVHKTICTFTKVKTVSHNDIF

SEQ ID NO: 1839850 - protein, 19 aa, Staphylococcus epidermidis
ALDSYRGESDLPFDDLEIV

SEQ ID NO: 1839851 - protein, 20 aa, Staphylococcus epidermidis
ALSYKDATSHLSRSYATDPN

SEQ ID NO: 1839852 - protein, 26 aa, Staphylococcus epidermidis
ANNEKLADILLQFKNSNKIISSVCHG

SEQ ID NO: 1839853 - protein, 19 aa, Staphylococcus epidermidis
AQTAHSYWYKYNGYTASGG

SEQ ID NO: 1839854 - protein, 18 aa, Staphylococcus epidermidis
CPYCKKTEDRVMPKLKKK

SEQ ID NO: 1839855 - protein, 26 aa, Staphylococcus epidermidis
DESTKFPNVFLIGATVRHQNAILCYI

SEQ ID NO: 1839856 - protein, 21 aa, Staphylococcus epidermidis
DISSAILAYYLFSPTELDSDD

SEQ ID NO: 1839857 - protein, 24 aa, Staphylococcus epidermidis
DITRIASSNAQMWKDITLNNQNHI

SEQ ID NO: 1839858 - protein, 26 aa, Staphylococcus epidermidis
DLKNIKSYAIGVGPEYTDLNIKNTRH

SEQ ID NO: 1839859 - protein, 20 aa, Staphylococcus epidermidis
DNAKVGLAVPKYVQDVDSIS

SEQ ID NO: 1839860 - protein, 19 aa, Staphylococcus epidermidis
DRRAELGKPIGSLWGNASN

SEQ ID NO: 1839861 - protein, 18 aa, Staphylococcus epidermidis
DVKMLKDPDNIYGNNNQH

SEQ ID NO: 1839862 - protein, 24 aa, Staphylococcus epidermidis
DVNLRVPLVKAYMGMEDDVLSFYS

SEQ ID NO: 1839863 - protein, 26 aa, Staphylococcus epidermidis
EDIEEMRKWIPLMMKGREDKGYMAAS

SEQ ID NO: 1839864 - protein, 21 aa, Staphylococcus epidermidis
EIAFMKRNYTNAFVHAFVDGN

SEQ ID NO: 1839865 - protein, 20 aa, Staphylococcus epidermidis
EKLKWIWITTLIILVVSLIL

SEQ ID NO: 1839866 - protein, 19 aa, Staphylococcus epidermidis
EKQPISILFLGIDDNEGRE

SEQ ID NO: 1839867 - protein, 19 aa, Staphylococcus epidermidis
ELKQLDAGSWFNRKHPEYA

SEQ ID NO: 1839868 - protein, 24 aa, Staphylococcus epidermidis
ENSDSFHASGIFPTTDKSYYDKFK

SEQ ID NO: 1839869 - protein, 17 aa, Staphylococcus epidermidis
EPKIKKMIPSYGESLID

SEQ ID NO: 1839870 - protein, 17 aa, Staphylococcus epidermidis
EQLKDSGIRVLTASNLV

SEQ ID NO: 1839871 - protein, 17 aa, Staphylococcus epidermidis
EQTSCKVTLHFTKQESE

SEQ ID NO: 1839872 - protein, 19 aa, Staphylococcus epidermidis
EVDYDVLICTGKSTQMVTQ

SEQ ID NO: 1839873 - protein, 20 aa, Staphylococcus epidermidis
EVHEAYEILIKQANRLSILF

SEQ ID NO: 1839874 - protein, 25 aa, Staphylococcus epidermidis
EVMGGIEPTVDWLRTALKNKKHVIT

SEQ ID NO: 1839875 - protein, 40 aa, Staphylococcus epidermidis
FGNVPLEKVVSLFLKECEDYGIDFKKLIYRRTGNHVKDLE

SEQ ID NO: 1839876 - protein, 20 aa, Staphylococcus epidermidis
FHAKKIYKIPSYDMVVVETK

SEQ ID NO: 1839877 - protein, 20 aa, Staphylococcus epidermidis
FKSQSVDFSKYWEPNKYEDS

SEQ ID NO: 1839878 - protein, 28 aa, Staphylococcus epidermidis
FLIGLSLIIICSVGVYAQNKKLSKDNQY

SEQ ID NO: 1839879 - protein, 17 aa, Staphylococcus epidermidis
FNEEISHVNGHEVTFTS

SEQ ID NO: 1839880 - protein, 29 aa, Staphylococcus epidermidis
FTHLTKSRFNGIMKNHFGNVPLEKVVSLF

SEQ ID NO: 1839881 - protein, 19 aa, Staphylococcus epidermidis
FVGLVGEDAFSMYPNYWGG

SEQ ID NO: 1839882 - protein, 19 aa, Staphylococcus epidermidis
FVKEVRLSKHFYEDKEIEE

SEQ ID NO: 1839883 - protein, 17 aa, Staphylococcus epidermidis
FYMSMINNMLKVEELDG

SEQ ID NO: 1839884 - protein, 24 aa, Staphylococcus epidermidis
GDALRSMSNPERFGQPSHMNDFVY

SEQ ID NO: 1839885 - protein, 30 aa, Staphylococcus epidermidis
GLQQCLKKNIPLVLVSRSFNGIVSPVYAYE

SEQ ID NO: 1839886 - protein, 25 aa, Staphylococcus epidermidis
GNKDSRVDFGLEHWGLKQKPNESYI

SEQ ID NO: 1839887 - protein, 26 aa, Staphylococcus epidermidis
GNPSIYKPTWKSEALSYKDATSHLSR

SEQ ID NO: 1839888 - protein, 19 aa, Staphylococcus epidermidis
GQGPVEIGCLVPEGKESVD

SEQ ID NO: 1839889 - protein, 20 aa, Staphylococcus epidermidis
GSPIISIAHVNNFQGQDNRN

SEQ ID NO: 1839890 - protein, 23 aa, Staphylococcus epidermidis
GYNSWCAGYTMSALLNATYNTNR

SEQ ID NO: 1839891 - protein, 38 aa, Staphylococcus epidermidis
HHFRLPMYRLTEIPKATSYDIVFLFPKSMQLEEVLSHI

SEQ ID NO: 1839892 - protein, 17 aa, Staphylococcus epidermidis
HKMKHSGMYMTKQIADG

SEQ ID NO: 1839893 - protein, 22 aa, Staphylococcus epidermidis
HKYGISIAKLKSLNGLTSNLIF

SEQ ID NO: 1839894 - protein, 18 aa, Staphylococcus epidermidis
HLKNLGFLVHPYTVDDEN

SEQ ID NO: 1839895 - protein, 22 aa, Staphylococcus epidermidis
HQSIWKKICVNGTANSLCTILE

SEQ ID NO: 1839896 - protein, 28 aa, Staphylococcus epidermidis
IGGTKALDLELGFSQWGFKQQPNESYAE

SEQ ID NO: 1839897 - protein, 26 aa, Staphylococcus epidermidis
IIFIIFFASGAMTWFTIDKNKYDNRH

SEQ ID NO: 1839898 - protein, 23 aa, Staphylococcus epidermidis
INPSVLTHYWGGDKMNIRQDLEE

SEQ ID NO: 1839899 - protein, 17 aa, Staphylococcus epidermidis
INVSPFLSKILNQYKNQ

SEQ ID NO: 1839900 - protein, 21 aa, Staphylococcus epidermidis
IPAAGLGTRFLPATKAMPKEM

SEQ ID NO: 1839901 - protein, 17 aa, Staphylococcus epidermidis
IPRDTKAEIAGRGTEEK

SEQ ID NO: 1839902 - protein, 17 aa, Staphylococcus epidermidis
IQDLFMNDYLRVYTNND

SEQ ID NO: 1839903 - protein, 17 aa, Staphylococcus epidermidis
IQEPIVITGAMRSSNEI

SEQ ID NO: 1839904 - protein, 32 aa, Staphylococcus epidermidis
IQYVKRVQNSKLWKSKDSGLHDLTRDGATDLN

SEQ ID NO: 1839905 - protein, 19 aa, Staphylococcus epidermidis
ITHAHAYGGPLAAMDSVEA

SEQ ID NO: 1839906 - protein, 17 aa, Staphylococcus epidermidis
ITVPKYIKNIDIKTNAG

SEQ ID NO: 1839907 - protein, 25 aa, Staphylococcus epidermidis
IVKPGDSLYKIALEHNLSLEELYAL

SEQ ID NO: 1839908 - protein, 22 aa, Staphylococcus epidermidis
IVLTSAVLLAGCTIDKKEIKKY

SEQ ID NO: 1839909 - protein, 21 aa, Staphylococcus epidermidis
KATEFPRIQLFMKSYTGTSHW

SEQ ID NO: 1839910 - protein, 18 aa, Staphylococcus epidermidis
KATSYGILQTKYKGKPYT

SEQ ID NO: 1839911 - protein, 17 aa, Staphylococcus epidermidis
KDAYPNERLNHIPHTSN

SEQ ID NO: 1839912 - protein, 24 aa, Staphylococcus epidermidis
KDYGFKFDSARPMQIGLVYDALKN

SEQ ID NO: 1839913 - protein, 19 aa, Staphylococcus epidermidis
KEAHPAAYTVATRMADDWS

SEQ ID NO: 1839914 - protein, 18 aa, Staphylococcus epidermidis
KEAIKNHISPLIDKQITD

SEQ ID NO: 1839915 - protein, 22 aa, Staphylococcus epidermidis
KGNYDYYSFEGIRPKNNSELHV

SEQ ID NO: 1839916 - protein, 21 aa, Staphylococcus epidermidis
KHPLFEYARSFDFIIITDVGL

SEQ ID NO: 1839917 - protein, 23 aa, Staphylococcus epidermidis
KKIHVYRPPYMIYGDDDVEGKAV

SEQ ID NO: 1839918 - protein, 19 aa, Staphylococcus epidermidis
KKKLAIALDLDETVLDNSP

SEQ ID NO: 1839919 - protein, 17 aa, Staphylococcus epidermidis
KNIKGMTIGLAMNSVYY

SEQ ID NO: 1839920 - protein, 24 aa, Staphylococcus epidermidis
KNNDPIILVHGFNGFTDDINPSVL

SEQ ID NO: 1839921 - protein, 22 aa, Staphylococcus epidermidis
KNSDFGKSVDWAIQGTDARNGV

SEQ ID NO: 1839922 - protein, 22 aa, Staphylococcus epidermidis
KRAVDRGYGLNFNPFHSNNRKL

SEQ ID NO: 1839923 - protein, 24 aa, Staphylococcus epidermidis
KTDYKTKGSISWKKAKEDQQIAKK

SEQ ID NO: 1839924 - protein, 21 aa, Staphylococcus epidermidis
KVAKGAYYAGLSYEQDARTWK

SEQ ID NO: 1839925 - protein, 22 aa, Staphylococcus epidermidis
KVLPAVAAKSGLLAHPSNSYVG

SEQ ID NO: 1839926 - protein, 21 aa, Staphylococcus epidermidis
KVPMKIFPAVHYSMGGLYVDY

SEQ ID NO: 1839927 - protein, 21 aa, Staphylococcus epidermidis
KVSNHITITVPKYIKNIDIKT

SEQ ID NO: 1839928 - protein, 19 aa, Staphylococcus epidermidis
KYKAVGRVSNMDGWKGPGK

SEQ ID NO: 1839929 - protein, 21 aa, Staphylococcus epidermidis
LEVREDIYGALQISFKSPEDR

SEQ ID NO: 1839930 - protein, 17 aa, Staphylococcus epidermidis
LGDLNTIRTKYKDANDQ

SEQ ID NO: 1839931 - protein, 18 aa, Staphylococcus epidermidis
LILLSFGLLVVPIIFATQ

SEQ ID NO: 1839932 - protein, 26 aa, Staphylococcus epidermidis
LKVFGTRNELGLAIGKSDRVNIGITD

SEQ ID NO: 1839933 - protein, 25 aa, Staphylococcus epidermidis
LNGPKARLKLLVGLSQDMTQNQLER

SEQ ID NO: 1839934 - protein, 20 aa, Staphylococcus epidermidis
LNPGVEPLIFPGDEIVVSET

SEQ ID NO: 1839935 - protein, 17 aa, Staphylococcus epidermidis
LNQYAKFVSHLNDTPSI

SEQ ID NO: 1839936 - protein, 19 aa, Staphylococcus epidermidis
LSERTKRYRIKQLLNSRNV

SEQ ID NO: 1839937 - protein, 27 aa, Staphylococcus epidermidis
LSNLAVKNDLHFKKFIKNNHIPEEYKD

SEQ ID NO: 1839938 - protein, 17 aa, Staphylococcus epidermidis
LVPEGKESVDIIVNLLQ

SEQ ID NO: 1839939 - protein, 22 aa, Staphylococcus epidermidis
LYDMVKRVGGNKVDVHSIVPVG

SEQ ID NO: 1839940 - protein, 17 aa, Staphylococcus epidermidis
LYSIAWGTKNQQLLAPN

SEQ ID NO: 1839941 - protein, 17 aa, Staphylococcus epidermidis
LYVSNVMTQPGETDNYD

SEQ ID NO: 1839942 - protein, 22 aa, Staphylococcus epidermidis
MILCMVLLYSCSGPMDSPKHSN

SEQ ID NO: 1839943 - protein, 26 aa, Staphylococcus epidermidis
MNANIPLIRLMNKFELKKATNQDLKN

SEQ ID NO: 1839944 - protein, 17 aa, Staphylococcus epidermidis
MNGYRRGAYENMTKDMN

SEQ ID NO: 1839945 - protein, 20 aa, Staphylococcus epidermidis
MRGTFLVTKFLLPLMMKQGG

SEQ ID NO: 1839946 - protein, 23 aa, Staphylococcus epidermidis
NDNKRFQLKPGDIIVTKGPVLNG

SEQ ID NO: 1839947 - protein, 34 aa, Staphylococcus epidermidis
NEYYVEHLVRDAAGTPIKFCAVVNKSTGEVINRF

SEQ ID NO: 1839948 - protein, 17 aa, Staphylococcus epidermidis
NHISPLIDKQITDINKT

SEQ ID NO: 1839949 - protein, 17 aa, Staphylococcus epidermidis
NHLKHLLVETSVDKKAM

SEQ ID NO: 1839950 - protein, 23 aa, Staphylococcus epidermidis
NKKLHSWLKLSTLIDDVKVKDKY

SEQ ID NO: 1839951 - protein, 20 aa, Staphylococcus epidermidis
NMVFPGQVINVGGSASQNTS

SEQ ID NO: 1839952 - protein, 20 aa, Staphylococcus epidermidis
NQKKHQIRMLSIPRDTISYI

SEQ ID NO: 1839953 - protein, 22 aa, Staphylococcus epidermidis
NRAGDGYPAFVKDYGFKFDSAR

SEQ ID NO: 1839954 - protein, 17 aa, Staphylococcus epidermidis
NRSSGKMGYAIAEALRD

SEQ ID NO: 1839955 - protein, 17 aa, Staphylococcus epidermidis
PEAIHKMKHSGMYMTKQ

SEQ ID NO: 1839956 - protein, 20 aa, Staphylococcus epidermidis
PGQMKQAIKFVKDNHLKHLL

SEQ ID NO: 1839957 - protein, 19 aa, Staphylococcus epidermidis
PIGSLWGNASNWAYSANQA

SEQ ID NO: 1839958 - protein, 17 aa, Staphylococcus epidermidis
PKNAVVLDYGALDVLKE

SEQ ID NO: 1839959 - protein, 21 aa, Staphylococcus epidermidis
PRDTISYIPKVGYYDKITHAH

SEQ ID NO: 1839960 - protein, 20 aa, Staphylococcus epidermidis
PSKIKNGVSYYDILLSTQPN

SEQ ID NO: 1839961 - protein, 21 aa, Staphylococcus epidermidis
QDPHAWLSLENGIKYVKTIQK

SEQ ID NO: 1839962 - protein, 28 aa, Staphylococcus epidermidis
QKVYTDVKWCRMMIRQVLSNSLKYSDNS

SEQ ID NO: 1839963 - protein, 21 aa, Staphylococcus epidermidis
QNTLYKMRWNPANPGTHQYAT

SEQ ID NO: 1839964 - protein, 29 aa, Staphylococcus epidermidis
QQFKPSQIKAAVFFGGFYNMKTVKATEFP

SEQ ID NO: 1839965 - protein, 19 aa, Staphylococcus epidermidis
REVTYKKSLKSGYINITKG

SEQ ID NO: 1839966 - protein, 22 aa, Staphylococcus epidermidis
RGESDLPFDDLEIVHQNISNKV

SEQ ID NO: 1839967 - protein, 19 aa, Staphylococcus epidermidis
RQLAYDVGKMYGNKDSRVD

SEQ ID NO: 1839968 - protein, 20 aa, Staphylococcus epidermidis
RVKQSKLWTTKDNGFYDLTT

SEQ ID NO: 1839969 - protein, 32 aa, Staphylococcus epidermidis
RYGRTYEGIMPDWEPGKKIHLVGHSMGGQTIR

SEQ ID NO: 1839970 - protein, 18 aa, Staphylococcus epidermidis
RYRIKQLLNSRNVEKNMS

SEQ ID NO: 1839971 - protein, 20 aa, Staphylococcus epidermidis
RYYAQVWLTALDSYRGESDL

SEQ ID NO: 1839972 - protein, 31 aa, Staphylococcus epidermidis
SAIVVLLLLIGLAFGIYSFVDSSKKGNERLS

SEQ ID NO: 1839973 - protein, 19 aa, Staphylococcus epidermidis
SDGLYNFISAIRVASSSEA

SEQ ID NO: 1839974 - protein, 21 aa, Staphylococcus epidermidis
SDITVKKGKHFSVKSKGNDKN

SEQ ID NO: 1839975 - protein, 25 aa, Staphylococcus epidermidis
SESNVKGLGVISFRTIDAEDAQDLD

SEQ ID NO: 1839976 - protein, 25 aa, Staphylococcus epidermidis
SFANCALPYYIGNVIEDRRKVLAYT

SEQ ID NO: 1839977 - protein, 30 aa, Staphylococcus epidermidis
SHNYSYAELYDLIYEKYLIKTKQVAPWGTT

SEQ ID NO: 1839978 - protein, 18 aa, Staphylococcus epidermidis
SIKDEGIGIVPELQSRIF

SEQ ID NO: 1839979 - protein, 27 aa, Staphylococcus epidermidis
SKANFYITDCLIREGRMKLDKGITHVK

SEQ ID NO: 1839980 - protein, 28 aa, Staphylococcus epidermidis
SMGGQTIRLMEHFLRNGNQEEIDYQRQY

SEQ ID NO: 1839981 - protein, 25 aa, Staphylococcus epidermidis
SNGSEWSWSYAVAGSDADYTESSSN

SEQ ID NO: 1839982 - protein, 18 aa, Staphylococcus epidermidis
SNMDGWKGPGKDSMGTGF

SEQ ID NO: 1839983 - protein, 32 aa, Staphylococcus epidermidis
SNYDRAVELYYYIKGGRVDYGAAHAAKYGHKR

SEQ ID NO: 1839984 - protein, 20 aa, Staphylococcus epidermidis
SPDVYPGMEKQLLDTLDKHD

SEQ ID NO: 1839985 - protein, 24 aa, Staphylococcus epidermidis
SPHPLRTLIVYSPYPSHLIRPILN

SEQ ID NO: 1839986 - protein, 18 aa, Staphylococcus epidermidis
SQAKGIGFELDFKDEQKV

SEQ ID NO: 1839987 - protein, 17 aa, Staphylococcus epidermidis
SRNDVAFVYPKGQSEPI

SEQ ID NO: 1839988 - protein, 19 aa, Staphylococcus epidermidis
SSGKMGYAIAEALRDKGAI

SEQ ID NO: 1839989 - protein, 27 aa, Staphylococcus epidermidis
STFGPGGRFGGLVFDTLGFKPADKKVS

SEQ ID NO: 1839990 - protein, 20 aa, Staphylococcus epidermidis
SYLSVPRGDTGYFFNTAYLP

SEQ ID NO: 1839991 - protein, 18 aa, Staphylococcus epidermidis
TATIPYNGKLVVMKDNYT

SEQ ID NO: 1839992 - protein, 18 aa, Staphylococcus epidermidis
TETGLWLEEAGAPYNILT

SEQ ID NO: 1839993 - protein, 17 aa, Staphylococcus epidermidis
TILSLMLVGCSNGGNDE

SEQ ID NO: 1839994 - protein, 24 aa, Staphylococcus epidermidis
TISNVVRLRDEIITYSKENIYDGF

SEQ ID NO: 1839995 - protein, 21 aa, Staphylococcus epidermidis
TKAQRALVVGAGYISLEVLEN

SEQ ID NO: 1839996 - protein, 21 aa, Staphylococcus epidermidis
TKFLLPLMMKQGGSIINTASF

SEQ ID NO: 1839997 - protein, 22 aa, Staphylococcus epidermidis
TPVKHNWDHGDFVGTDTSEVRI

SEQ ID NO: 1839998 - protein, 23 aa, Staphylococcus epidermidis
TSDKKLAKEWINFLKSNKAKQIL

SEQ ID NO: 1839999 - protein, 22 aa, Staphylococcus epidermidis
TSFPEGWHEWVAAAKAKPVYGA

SEQ ID NO: 1840000 - protein, 20 aa, Staphylococcus epidermidis
TSPHINFRIQGKVSNHITIT

SEQ ID NO: 1840001 - protein, 21 aa, Staphylococcus epidermidis
TTLWSRSLFDIQLIDEEYEIK

SEQ ID NO: 1840002 - protein, 24 aa, Staphylococcus epidermidis
TVNGKSGWISKYYLTAPSKVQALS

SEQ ID NO: 1840003 - protein, 24 aa, Staphylococcus epidermidis
TVNGKSGWISKYYLTTASKPSNPT

SEQ ID NO: 1840004 - protein, 23 aa, Staphylococcus epidermidis
TYLKKLLKPTLAKFIVTHANEHD

SEQ ID NO: 1840005 - protein, 18 aa, Staphylococcus epidermidis
VAPIVEKLNEKWAKDHKD

SEQ ID NO: 1840006 - protein, 23 aa, Staphylococcus epidermidis
VGHSMGNMSFAFYMKNYGDDRHL

SEQ ID NO: 1840007 - protein, 31 aa, Staphylococcus epidermidis
VIKQKNINGVKWYYGQLLDGKYVWIKSTDLV

SEQ ID NO: 1840008 - protein, 20 aa, Staphylococcus epidermidis
VKFIKENKHELPIDFDQVVI

SEQ ID NO: 1840009 - protein, 22 aa, Staphylococcus epidermidis
VKGISEALLRTSAPKLYVSNVM

SEQ ID NO: 1840010 - protein, 21 aa, Staphylococcus epidermidis
VKTDLKLGDLNTIRTKYKDAN

SEQ ID NO: 1840011 - protein, 18 aa, Staphylococcus epidermidis
VKVEIKHGSTQVLLSNIH

SEQ ID NO: 1840012 - protein, 24 aa, Staphylococcus epidermidis
VLSQLKSQFGIQQFNFVGHSMGNM

SEQ ID NO: 1840013 - protein, 17 aa, Staphylococcus epidermidis
VMISFVLASCGGTSSTD

SEQ ID NO: 1840014 - protein, 21 aa, Staphylococcus epidermidis
VPVDYYVRINMKAFVEAVDEL

SEQ ID NO: 1840015 - protein, 20 aa, Staphylococcus epidermidis
VRYEIELNYYSPKSKKDTST

SEQ ID NO: 1840016 - protein, 17 aa, Staphylococcus epidermidis
VSGGVGIVSKWPIVQQE

SEQ ID NO: 1840017 - protein, 17 aa, Staphylococcus epidermidis
YALSRPLFIYAKDKSLK

SEQ ID NO: 1840018 - protein, 27 aa, Staphylococcus epidermidis
YHGKMIKLQYKVTHGFVTSVTIGEGVD

SEQ ID NO: 1840019 - protein, 23 aa, Staphylococcus epidermidis
YKFSEPYTYSSAVLVVRENEKDI

SEQ ID NO: 1840020 - protein, 27 aa, Staphylococcus epidermidis
YKNHDPIILVHGFNGYASGTGPVTGKG

SEQ ID NO: 1840021 - protein, 25 aa, Staphylococcus epidermidis
YQRQYGGTVSDLFKGGQDNMVSTIT

SEQ ID NO: 1840022 - protein, 20 aa, Staphylococcus epidermidis
YSTDLANIFYVRQKEQKGLG

SEQ ID NO: 1840023 - protein, 27 aa, Staphylococcus epidermidis
YVYDKTGGKIGSTWGNANSWATAAQAA

SEQ ID NO: 1840024 - protein, 19 aa, Staphylococcus epidermidis
AFTILILAGCGLGDSDNNG

SEQ ID NO: 1840025 - protein, 22 aa, Staphylococcus epidermidis
AKKRGFRGAGSYWADHLGYTDI

SEQ ID NO: 1840026 - protein, 19 aa, Staphylococcus epidermidis
AKPVYGAKSFLKYADKKGI

SEQ ID NO: 1840027 - protein, 17 aa, Staphylococcus epidermidis
ALILWLGIKEKKRHANR

SEQ ID NO: 1840028 - protein, 26 aa, Staphylococcus epidermidis
ALNESFSDVFGYFIDDEDFLMGEDVY

SEQ ID NO: 1840029 - protein, 17 aa, Staphylococcus epidermidis
ANNISKFMGIFNGTSNF

SEQ ID NO: 1840030 - protein, 28 aa, Staphylococcus epidermidis
APSNLAIMGRYVLTPEIFDYLETQQEGA

SEQ ID NO: 1840031 - protein, 21 aa, Staphylococcus epidermidis
ASGDLPDFIVYYLDDSGRPEM

SEQ ID NO: 1840032 - protein, 23 aa, Staphylococcus epidermidis
AYTVATRMADDWSKSDEDKLAKK

SEQ ID NO: 1840033 - protein, 28 aa, Staphylococcus epidermidis
DESAIVRCNLWLRTADRIKIVMGRFNAT

SEQ ID NO: 1840034 - protein, 19 aa, Staphylococcus epidermidis
EIIRQVAYDYARSKGNKLS

SEQ ID NO: 1840035 - protein, 20 aa, Staphylococcus epidermidis
EKAKPLLKKKGYDLKIKPIN

SEQ ID NO: 1840036 - protein, 30 aa, Staphylococcus epidermidis
EPWTNPIEGYKWYDRSTFKTGSYGSNQRGA

SEQ ID NO: 1840037 - protein, 17 aa, Staphylococcus epidermidis
FDDLEIVHQNISNKVLD

SEQ ID NO: 1840038 - protein, 24 aa, Staphylococcus epidermidis
FFSMKKVTLSFVTLFIGVGTIGSY

SEQ ID NO: 1840039 - protein, 23 aa, Staphylococcus epidermidis
FKKAAPKAKVVYVGTSDDNLIKD

SEQ ID NO: 1840040 - protein, 20 aa, Staphylococcus epidermidis
FKNSNKIISSVCHGPSAFVG

SEQ ID NO: 1840041 - protein, 23 aa, Staphylococcus epidermidis
FLDQRVIKRYGSLVPLTELDEDL

SEQ ID NO: 1840042 - protein, 19 aa, Staphylococcus epidermidis
FVLEDEGKAAEDAGYVASP

SEQ ID NO: 1840043 - protein, 17 aa, Staphylococcus epidermidis
GDTGYFFNTAYLPDGAL

SEQ ID NO: 1840044 - protein, 30 aa, Staphylococcus epidermidis
GKGNYWGGNRLKIIQDYRAKGYNVMEASVS

SEQ ID NO: 1840045 - protein, 24 aa, Staphylococcus epidermidis
GNNTYAYWNKLRFLQEASNKSELM

SEQ ID NO: 1840046 - protein, 24 aa, Staphylococcus epidermidis
GNRYDVGEKLGFVKTTIEYALKDP

SEQ ID NO: 1840047 - protein, 20 aa, Staphylococcus epidermidis
HFQGSWRDADYSKRESQRII

SEQ ID NO: 1840048 - protein, 22 aa, Staphylococcus epidermidis
HGGEISPLYQGGHDNMVSSITT

SEQ ID NO: 1840049 - protein, 19 aa, Staphylococcus epidermidis
IAATLVLSACSQNDTKEDE

SEQ ID NO: 1840050 - protein, 17 aa, Staphylococcus epidermidis
IDEAFKIQDAKERSKAY

SEQ ID NO: 1840051 - protein, 18 aa, Staphylococcus epidermidis
ILFFLIVMLGFAGGLGYS

SEQ ID NO: 1840052 - protein, 19 aa, Staphylococcus epidermidis
ILTTCSFSYITFSKLTSKT

SEQ ID NO: 1840053 - protein, 24 aa, Staphylococcus epidermidis
INTYKKGQCTYYVFERVKNDGNKI

SEQ ID NO: 1840054 - protein, 20 aa, Staphylococcus epidermidis
IQPHHPFQFTIKLTGYEPNS

SEQ ID NO: 1840055 - protein, 25 aa, Staphylococcus epidermidis
IRIDGGVMAYTWPGEMLSDESWKNS

SEQ ID NO: 1840056 - protein, 27 aa, Staphylococcus epidermidis
ITVNAYCPGVAKTEMWDRIDEEMVKLD

SEQ ID NO: 1840057 - protein, 24 aa, Staphylococcus epidermidis
IVLSGCSLPGLGDGNAKDDVKITT

SEQ ID NO: 1840058 - protein, 21 aa, Staphylococcus epidermidis
IYGDGDGRTFTALSGANDVVA

SEQ ID NO: 1840059 - protein, 20 aa, Staphylococcus epidermidis
KIAAIRYARENNIPFFGICL

SEQ ID NO: 1840060 - protein, 21 aa, Staphylococcus epidermidis
KKVREALDMIINRKDIAKNVS

SEQ ID NO: 1840061 - protein, 18 aa, Staphylococcus epidermidis
KNNSELHVTSTHYDDPTL

SEQ ID NO: 1840062 - protein, 20 aa, Staphylococcus epidermidis
KPEAIKLEFNEPVNTKYSSV

SEQ ID NO: 1840063 - protein, 18 aa, Staphylococcus epidermidis
KPEFPERNDEEWLKTTMA

SEQ ID NO: 1840064 - protein, 18 aa, Staphylococcus epidermidis
KQPMSYAQILATFKEGKL

SEQ ID NO: 1840065 - protein, 23 aa, Staphylococcus epidermidis
KRAKEPKTDERKKTRQDSSNSKE

SEQ ID NO: 1840066 - protein, 26 aa, Staphylococcus epidermidis
KRGQRQMELIKILFQKAQNLKSIDKL

SEQ ID NO: 1840067 - protein, 18 aa, Staphylococcus epidermidis
KRYAEYLSLVATHYNLNV

SEQ ID NO: 1840068 - protein, 26 aa, Staphylococcus epidermidis
KTDRYGRTLAYVWLKNGDMFNESLVK

SEQ ID NO: 1840069 - protein, 18 aa, Staphylococcus epidermidis
KYNQTFFNSYGFENTYAL

SEQ ID NO: 1840070 - protein, 17 aa, Staphylococcus epidermidis
LATMWESVGKVVYIGGE

SEQ ID NO: 1840071 - protein, 17 aa, Staphylococcus epidermidis
LEDKGIKYHEFKIAQDG

SEQ ID NO: 1840072 - protein, 24 aa, Staphylococcus epidermidis
LELTTALRKAFFKNGDTSTKNRTN

SEQ ID NO: 1840073 - protein, 20 aa, Staphylococcus epidermidis
LKFNKKLYSLGYPVMNGNNT

SEQ ID NO: 1840074 - protein, 18 aa, Staphylococcus epidermidis
LKIKNLKASSDYYDSIAK

SEQ ID NO: 1840075 - protein, 21 aa, Staphylococcus epidermidis
LKVTVEPFSKMVKVRTKTTGK

SEQ ID NO: 1840076 - protein, 25 aa, Staphylococcus epidermidis
LSEKAKRLREAFNVNDEEAQILADE

SEQ ID NO: 1840077 - protein, 28 aa, Staphylococcus epidermidis
LYLRINKRVDIMLGHGLFNEVQHLVEQG

SEQ ID NO: 1840078 - protein, 19 aa, Staphylococcus epidermidis
MTIGLAMNSVYYYKKEKDG

SEQ ID NO: 1840079 - protein, 19 aa, Staphylococcus epidermidis
NGEEIKVRLIGVDTPETVK

SEQ ID NO: 1840080 - protein, 18 aa, Staphylococcus epidermidis
NKMKYGVYSYSMYESPKD

SEQ ID NO: 1840081 - protein, 31 aa, Staphylococcus epidermidis
NQDPHVWLDPVLNQKFAFMIKEKLIEKDPKH

SEQ ID NO: 1840082 - protein, 25 aa, Staphylococcus epidermidis
NVKQELTKLGYRVHEANVGAFSSNY

SEQ ID NO: 1840083 - protein, 26 aa, Staphylococcus epidermidis
NYYGKKQCTWWAFKRRAQLGKPVSNR

SEQ ID NO: 1840084 - protein, 19 aa, Staphylococcus epidermidis
PTNNGLYSIAWGTKNQQLL

SEQ ID NO: 1840085 - protein, 22 aa, Staphylococcus epidermidis
PYPELMSELASPFAAIYDTKAK

SEQ ID NO: 1840086 - protein, 18 aa, Staphylococcus epidermidis
QCTWYVYDKTGGKIGSTW

SEQ ID NO: 1840087 - protein, 17 aa, Staphylococcus epidermidis
QKEIKSLAKMYLGGSTE

SEQ ID NO: 1840088 - protein, 18 aa, Staphylococcus epidermidis
QNDFSSYQLGVFKKIIES

SEQ ID NO: 1840089 - protein, 20 aa, Staphylococcus epidermidis
RALLFEWSRINEMLDKQLYL

SEQ ID NO: 1840090 - protein, 26 aa, Staphylococcus epidermidis
RQLLSLHKIYCGKEIEVLNIYGDLED

SEQ ID NO: 1840091 - protein, 18 aa, Staphylococcus epidermidis
RQLWNMLVLARVITIGAY

SEQ ID NO: 1840092 - protein, 18 aa, Staphylococcus epidermidis
RSAFQYDSDEVINGIIWS

SEQ ID NO: 1840093 - protein, 27 aa, Staphylococcus epidermidis
RVGIVPLINQRAYWFITVHAKEGDPKY

SEQ ID NO: 1840094 - protein, 18 aa, Staphylococcus epidermidis
SDWLSQNFGVRFRYNALG

SEQ ID NO: 1840095 - protein, 23 aa, Staphylococcus epidermidis
SFGQRVISYPIQFVTGSIGDLFE

SEQ ID NO: 1840096 - protein, 19 aa, Staphylococcus epidermidis
SLGYLAHRYGFKQQGVKGM

SEQ ID NO: 1840097 - protein, 24 aa, Staphylococcus epidermidis
TASGGDFVLSNSFYQGLKAGNVTF

SEQ ID NO: 1840098 - protein, 18 aa, Staphylococcus epidermidis
TLSQRAPKAAFYINDYEE

SEQ ID NO: 1840099 - protein, 25 aa, Staphylococcus epidermidis
TRQVGEPFIDFVICSSESYSKDVLQ

SEQ ID NO: 1840100 - protein, 27 aa, Staphylococcus epidermidis
VDLNSLPATDFRTDWMSESGQKQVNDL

SEQ ID NO: 1840101 - protein, 27 aa, Staphylococcus epidermidis
VGASSILIAALLFMGGGSAQAAEQQQD

SEQ ID NO: 1840102 - protein, 21 aa, Staphylococcus epidermidis
VMSEFMKFVLEDEGKAAEDAG

SEQ ID NO: 1840103 - protein, 25 aa, Staphylococcus epidermidis
VPKHPKRVVVLEYSFVDALVALDVK

SEQ ID NO: 1840104 - protein, 19 aa, Staphylococcus epidermidis
VTLFIGVGTIGSYNQFADA

SEQ ID NO: 1840105 - protein, 30 aa, Staphylococcus epidermidis
VVIILICALGFSLYAAINHHTNSNKNDKKI

SEQ ID NO: 1840106 - protein, 23 aa, Staphylococcus epidermidis
WIADRKLKGLVFQSDNDASPKMN

SEQ ID NO: 1840107 - protein, 20 aa, Staphylococcus epidermidis
WRDADYSKRESQRIIDDART

SEQ ID NO: 1840108 - protein, 18 aa, Staphylococcus epidermidis
YAQILATFKEGKLVATNI

SEQ ID NO: 1840109 - protein, 24 aa, Staphylococcus epidermidis
YKDELRLGMDTQWMNRAGDGYPAF

SEQ ID NO: 1840110 - protein, 25 aa, Staphylococcus epidermidis
YPVEVFDKIMAVDMRGTFLVTKFLL

SEQ ID NO: 1840111 - protein, 17 aa, Staphylococcus epidermidis
AAAKAKPVYGAKSFLKY

SEQ ID NO: 1840112 - protein, 18 aa, Staphylococcus epidermidis
ADKRFAYASTSKAINSAI

SEQ ID NO: 1840113 - protein, 19 aa, Staphylococcus epidermidis
AIGKYKLQVDLERPVPYIN

SEQ ID NO: 1840114 - protein, 17 aa, Staphylococcus epidermidis
AKASLQQAAFDLYGDGI

SEQ ID NO: 1840115 - protein, 21 aa, Staphylococcus epidermidis
AKDLRVGMDSSWMDRKGDGYP

SEQ ID NO: 1840116 - protein, 18 aa, Staphylococcus epidermidis
AKSDLFVYSSHQLDPVAA

SEQ ID NO: 1840117 - protein, 23 aa, Staphylococcus epidermidis
ANSGKEYQEYLGAKESQHAITHL

SEQ ID NO: 1840118 - protein, 18 aa, Staphylococcus epidermidis
AQHAVNHYAPKKSLEFQK

SEQ ID NO: 1840119 - protein, 19 aa, Staphylococcus epidermidis
ARFKVLMSLIQSLYNSKKF

SEQ ID NO: 1840120 - protein, 20 aa, Staphylococcus epidermidis
AVSSYDGYWLAAYQAEEPNR

SEQ ID NO: 1840121 - protein, 19 aa, Staphylococcus epidermidis
AYKILKMIQREFSVYVYEA

SEQ ID NO: 1840122 - protein, 21 aa, Staphylococcus epidermidis
DELQQFWHGLAEDLVQSEQLT

SEQ ID NO: 1840123 - protein, 20 aa, Staphylococcus epidermidis
DGYPAFKKEYGYSFGTVRPM

SEQ ID NO: 1840124 - protein, 21 aa, Staphylococcus epidermidis
DLMKKGLMTKEFYTMEENKAK

SEQ ID NO: 1840125 - protein, 17 aa, Staphylococcus epidermidis
DSIGYLAERYHFEQEGI

SEQ ID NO: 1840126 - protein, 18 aa, Staphylococcus epidermidis
DSIGYLAERYHFEQEGIE

SEQ ID NO: 1840127 - protein, 19 aa, Staphylococcus epidermidis
DYGALDVMKQLGLQNKIVS

SEQ ID NO: 1840128 - protein, 18 aa, Staphylococcus epidermidis
EHLHQSIWKKICVNGTAN

SEQ ID NO: 1840129 - protein, 18 aa, Staphylococcus epidermidis
ENNDYVVVNVDWGIPNER

SEQ ID NO: 1840130 - protein, 25 aa, Staphylococcus epidermidis
ESQTEYPLKRVHYVKDLMKKGLMTK

SEQ ID NO: 1840131 - protein, 19 aa, Staphylococcus epidermidis
ETFTYCTKIIYQAYKYGVD

SEQ ID NO: 1840132 - protein, 22 aa, Staphylococcus epidermidis
EVSRPGPRIDEGLKDLKDEIYK

SEQ ID NO: 1840133 - protein, 21 aa, Staphylococcus epidermidis
EVSRPGPRIDEGLKDLRDDIY

SEQ ID NO: 1840134 - protein, 19 aa, Staphylococcus epidermidis
FEISKQFWGHLVKSGNISN

SEQ ID NO: 1840135 - protein, 22 aa, Staphylococcus epidermidis
FKKEYGYSFGTVRPMQIGLVYD

SEQ ID NO: 1840136 - protein, 22 aa, Staphylococcus epidermidis
FKQQEPIVFTAMEPSWFSKELD

SEQ ID NO: 1840137 - protein, 23 aa, Staphylococcus epidermidis
FLSKNQKGMIVQQDWKGSHNQFH

SEQ ID NO: 1840138 - protein, 19 aa, Staphylococcus epidermidis
FPYHPFSYRLHYSEIQTFT

SEQ ID NO: 1840139 - protein, 27 aa, Staphylococcus epidermidis
GEDAFSMYPNYWGGTKYNVKQELTKLG

SEQ ID NO: 1840140 - protein, 19 aa, Staphylococcus epidermidis
GGAAGCWATATALGITTGW

SEQ ID NO: 1840141 - protein, 18 aa, Staphylococcus epidermidis
GQASYQFSSNSPKDKNVK

SEQ ID NO: 1840142 - protein, 18 aa, Staphylococcus epidermidis
GVGGDALRSMSNPERFGQ

SEQ ID NO: 1840143 - protein, 28 aa, Staphylococcus epidermidis
HGQSRFTSHHPMKINTYKKGQCTYYVFE

SEQ ID NO: 1840144 - protein, 19 aa, Staphylococcus epidermidis
ICALIVVLAACGQDANHSS

SEQ ID NO: 1840145 - protein, 19 aa, Staphylococcus epidermidis
ICALIVVLAACSQDANHSS

SEQ ID NO: 1840146 - protein, 20 aa, Staphylococcus epidermidis
IENFKFFVQYANFKDINDYK

SEQ ID NO: 1840147 - protein, 17 aa, Staphylococcus epidermidis
IERKAQDIINDKYLSER

SEQ ID NO: 1840148 - protein, 18 aa, Staphylococcus epidermidis
IKNLENFYDKEGYRDEEF

SEQ ID NO: 1840149 - protein, 24 aa, Staphylococcus epidermidis
IKSPLKFNPDLAKKNWREAQKELG

SEQ ID NO: 1840150 - protein, 21 aa, Staphylococcus epidermidis
IKTMYPRSFNTAYKILKMIQR

SEQ ID NO: 1840151 - protein, 18 aa, Staphylococcus epidermidis
ILGSLLILSACSNNDEKD

SEQ ID NO: 1840152 - protein, 17 aa, Staphylococcus epidermidis
INLRKNAKWSNGDSVTA

SEQ ID NO: 1840153 - protein, 19 aa, Staphylococcus epidermidis
IRHIQFLIYRLTKGEYLEA

SEQ ID NO: 1840154 - protein, 27 aa, Staphylococcus epidermidis
ITITTLLAGCDFGDFVGQYQSDKQSEN

SEQ ID NO: 1840155 - protein, 19 aa, Staphylococcus epidermidis
ITLKELIEASMKYSDNTAN

SEQ ID NO: 1840156 - protein, 18 aa, Staphylococcus epidermidis
IYISLLILVSGCGNSKEA

SEQ ID NO: 1840157 - protein, 23 aa, Staphylococcus epidermidis
KAFSSNGRFGGFLNKDLGIKHVD

SEQ ID NO: 1840158 - protein, 20 aa, Staphylococcus epidermidis
KEFKEKGYQAVAFKSDVSKK

SEQ ID NO: 1840159 - protein, 19 aa, Staphylococcus epidermidis
KGQSEPIVLVIFTNKDNKS

SEQ ID NO: 1840160 - protein, 18 aa, Staphylococcus epidermidis
KKGNERLSDKTTQQEKKK

SEQ ID NO: 1840161 - protein, 18 aa, Staphylococcus epidermidis
KSGANGWAVPSTTEHPED

SEQ ID NO: 1840162 - protein, 21 aa, Staphylococcus epidermidis
LDPDIFYPLIKKLKENNDYVV

SEQ ID NO: 1840163 - protein, 21 aa, Staphylococcus epidermidis
LGEQFFKDNFSLNVKATNVVG

SEQ ID NO: 1840164 - protein, 18 aa, Staphylococcus epidermidis
LKHGHVMIQSFSGRSLEK

SEQ ID NO: 1840165 - protein, 22 aa, Staphylococcus epidermidis
LMLSGCSSFDHRKRESINDKNK

SEQ ID NO: 1840166 - protein, 17 aa, Staphylococcus epidermidis
LNNLTTWLGKKESQSSM

SEQ ID NO: 1840167 - protein, 19 aa, Staphylococcus epidermidis
LRKNAKWSNGDSVTAYDFV

SEQ ID NO: 1840168 - protein, 18 aa, Staphylococcus epidermidis
LSMYPIKNLENFYDKEGY

SEQ ID NO: 1840169 - protein, 22 aa, Staphylococcus epidermidis
MMRKIDSQAGYNFLTGNGSNPI

SEQ ID NO: 1840170 - protein, 19 aa, Staphylococcus epidermidis
MNWNGGVNVKSYRTISNPN

SEQ ID NO: 1840171 - protein, 27 aa, Staphylococcus epidermidis
NESIEFGSSIGEEFKGLIGNFKSDINP

SEQ ID NO: 1840172 - protein, 27 aa, Staphylococcus epidermidis
NGDSVTAYDFVYAWRKVVNPKTASEFA

SEQ ID NO: 1840173 - protein, 24 aa, Staphylococcus epidermidis
NGGGQRKSIHTYKLESLPKKVEGA

SEQ ID NO: 1840174 - protein, 19 aa, Staphylococcus epidermidis
NGKVKPLLVKNYHQVSDNQ

SEQ ID NO: 1840175 - protein, 18 aa, Staphylococcus epidermidis
NQSEPIILVIFTNKDNKS

SEQ ID NO: 1840176 - protein, 18 aa, Staphylococcus epidermidis
NWNGGVNVKSYRTISNPN

SEQ ID NO: 1840177 - protein, 18 aa, Staphylococcus epidermidis
PKERGWCEWAVGALCGTG

SEQ ID NO: 1840178 - protein, 17 aa, Staphylococcus epidermidis
QDAKASLQQAAFDLYGD

SEQ ID NO: 1840179 - protein, 20 aa, Staphylococcus epidermidis
QFEISKQFWGHLVKSGNISN

SEQ ID NO: 1840180 - protein, 28 aa, Staphylococcus epidermidis
QYKNQYPVVFVHGFVGLVGEDAFSMYPN

SEQ ID NO: 1840181 - protein, 18 aa, Staphylococcus epidermidis
REFSVYVYEAEIVYLTLH

SEQ ID NO: 1840182 - protein, 17 aa, Staphylococcus epidermidis
RKILNRFKEEGRLRSYT

SEQ ID NO: 1840183 - protein, 19 aa, Staphylococcus epidermidis
RSFNTAYKILKMIQREFSV

SEQ ID NO: 1840184 - protein, 19 aa, Staphylococcus epidermidis
RSLVIAEVLKKAGYDVTTT

SEQ ID NO: 1840185 - protein, 20 aa, Staphylococcus epidermidis
SCSLKSLAKILYKNKALSYN

SEQ ID NO: 1840186 - protein, 26 aa, Staphylococcus epidermidis
SENATRVARCLSPFEGDRSQALQQLP

SEQ ID NO: 1840187 - protein, 18 aa, Staphylococcus epidermidis
SIIIISSFCVATGFQNVN

SEQ ID NO: 1840188 - protein, 26 aa, Staphylococcus epidermidis
SKKFQNRFLFNLGIKHYNFNNDIRKV

SEQ ID NO: 1840189 - protein, 20 aa, Staphylococcus epidermidis
SLATICGLISSLGCTGATNY

SEQ ID NO: 1840190 - protein, 17 aa, Staphylococcus epidermidis
SLSCSLKSLAKILYKNK

SEQ ID NO: 1840191 - protein, 20 aa, Staphylococcus epidermidis
SMETRGMVLYINRNTRTTKG

SEQ ID NO: 1840192 - protein, 17 aa, Staphylococcus epidermidis
SMIKTMYPRSFNTAYKI

SEQ ID NO: 1840193 - protein, 20 aa, Staphylococcus epidermidis
TELTKALADKGNYDYYSFEG

SEQ ID NO: 1840194 - protein, 20 aa, Staphylococcus epidermidis
TFIVFWGIGFFKYADAHVTL

SEQ ID NO: 1840195 - protein, 29 aa, Staphylococcus epidermidis
TSPYPHGQCTWYVYHRMNQFDASISGDLG

SEQ ID NO: 1840196 - protein, 19 aa, Staphylococcus epidermidis
TVLSGCNLPGLKNSHSDDD

SEQ ID NO: 1840197 - protein, 26 aa, Staphylococcus epidermidis
VDKYRGESALNYRLTAATFFIKMNQK

SEQ ID NO: 1840198 - protein, 20 aa, Staphylococcus epidermidis
VEEMYRYIGTLLKQHPHLSA

SEQ ID NO: 1840199 - protein, 21 aa, Staphylococcus epidermidis
VEEMYRYIGTLLKQHPHLSAY

SEQ ID NO: 1840200 - protein, 23 aa, Staphylococcus epidermidis
VENYKRTPIFYSLGNTTSDNFLS

SEQ ID NO: 1840201 - protein, 21 aa, Staphylococcus epidermidis
VKGAYKTYAYVVSYKPTNGNE

SEQ ID NO: 1840202 - protein, 29 aa, Staphylococcus epidermidis
VPEFKNKHLRLAISQAINKKGYVNSVLND

SEQ ID NO: 1840203 - protein, 18 aa, Staphylococcus epidermidis
VQQDWKGSHNQFHITPIQ

SEQ ID NO: 1840204 - protein, 17 aa, Staphylococcus epidermidis
VSMYSYLSVPRGDTGYF

SEQ ID NO: 1840205 - protein, 19 aa, Staphylococcus epidermidis
WATATALGITTGWGGFSLA

SEQ ID NO: 1840206 - protein, 26 aa, Staphylococcus epidermidis
WCEWAVGALCGTGGAAGCWATATALG

SEQ ID NO: 1840207 - protein, 17 aa, Staphylococcus epidermidis
YQLGVFKKIIESSMSFD

SEQ ID NO: 1840208 - protein, 18 aa, Staphylococcus epidermidis
YVRKDIMDKLHIDPTSIK

SEQ ID NO: 1840209 - protein, 23 aa, Staphylococcus epidermidis
YYHSLGFANTYAFMVTKETAKKY

SEQ ID NO: 1840210 - protein, 18 aa, Staphylococcus epidermidis
AGAESLYGNPRDFILKHN

SEQ ID NO: 1840211 - protein, 21 aa, Staphylococcus epidermidis
AHALANAGADVIIGHNTVIQK

SEQ ID NO: 1840212 - protein, 17 aa, Staphylococcus epidermidis
AIEKQLVGCGFTVKVPP

SEQ ID NO: 1840213 - protein, 20 aa, Staphylococcus epidermidis
AIQAGREIRVVVSPEEIDDL

SEQ ID NO: 1840214 - protein, 19 aa, Staphylococcus epidermidis
AKASLQQAAFDLYGDGIAQ

SEQ ID NO: 1840215 - protein, 17 aa, Staphylococcus epidermidis
ALAEGLKQSDFIHSKDH

SEQ ID NO: 1840216 - protein, 18 aa, Staphylococcus epidermidis
APSNLAIMGRYVLTPEIF

SEQ ID NO: 1840217 - protein, 20 aa, Staphylococcus epidermidis
AVSSYDGYWLAAYQAEEPKR

SEQ ID NO: 1840218 - protein, 18 aa, Staphylococcus epidermidis
AYSVLREDQYRVVGKTTG

SEQ ID NO: 1840219 - protein, 17 aa, Staphylococcus epidermidis
CTWYVYDKTGGKIGSTW

SEQ ID NO: 1840220 - protein, 29 aa, Staphylococcus epidermidis
DESAIVRCNLWLRTADRIKIVMGRFNATT

SEQ ID NO: 1840221 - protein, 18 aa, Staphylococcus epidermidis
DKAEPAIAKSFPKKSNGG

SEQ ID NO: 1840222 - protein, 21 aa, Staphylococcus epidermidis
DRFAKEGKFQPSAGGTTNEAH

SEQ ID NO: 1840223 - protein, 18 aa, Staphylococcus epidermidis
DVSMYSYLSVPRGDTGYF

SEQ ID NO: 1840224 - protein, 33 aa, Staphylococcus epidermidis
DVVKLADFLASRRGKLLGQYGIKGRDYTLDKKG

SEQ ID NO: 1840225 - protein, 20 aa, Staphylococcus epidermidis
EDGDWGFSILDKEGNLEGSY

SEQ ID NO: 1840226 - protein, 27 aa, Staphylococcus epidermidis
EEQMRANAKVAKQNGYTGIPNGDMGGV

SEQ ID NO: 1840227 - protein, 17 aa, Staphylococcus epidermidis
EHLHQSIWKKICVNGTA

SEQ ID NO: 1840228 - protein, 18 aa, Staphylococcus epidermidis
EIIRQVAYDYARSKGNKL

SEQ ID NO: 1840229 - protein, 17 aa, Staphylococcus epidermidis
EPGQKAKIEVVFKNTGT

SEQ ID NO: 1840230 - protein, 18 aa, Staphylococcus epidermidis
ETFTYCTKIIYQAYKYGV

SEQ ID NO: 1840231 - protein, 22 aa, Staphylococcus epidermidis
FASLLVLTACGQEEEKKEKDNK

SEQ ID NO: 1840232 - protein, 18 aa, Staphylococcus epidermidis
FDDLEIVHQNISNKVLDP

SEQ ID NO: 1840233 - protein, 20 aa, Staphylococcus epidermidis
FHWHGLEINGKVDGGPSQVI

SEQ ID NO: 1840234 - protein, 22 aa, Staphylococcus epidermidis
FKKAAPKAKVVYVGTSDDNLIK

SEQ ID NO: 1840235 - protein, 23 aa, Staphylococcus epidermidis
FKQQEPIVFTAMEPSWFSKELDV

SEQ ID NO: 1840236 - protein, 17 aa, Staphylococcus epidermidis
FLEKNTKGSVLITSLAG

SEQ ID NO: 1840237 - protein, 26 aa, Staphylococcus epidermidis
FLIVMLGFAGGLGYSHYKDSKANTDV

SEQ ID NO: 1840238 - protein, 17 aa, Staphylococcus epidermidis
FNRRAEIGKGISTYWWN

SEQ ID NO: 1840239 - protein, 18 aa, Staphylococcus epidermidis
FSTGSLIVNDFSKNQKDN

SEQ ID NO: 1840240 - protein, 18 aa, Staphylococcus epidermidis
FVLEDEGQAAEDAGYVAS

SEQ ID NO: 1840241 - protein, 28 aa, Staphylococcus epidermidis
GEDAFSMYPNYWGGIKYNVKQELTKLGY

SEQ ID NO: 1840242 - protein, 17 aa, Staphylococcus epidermidis
GIDGVTYKADFKDRKAI

SEQ ID NO: 1840243 - protein, 30 aa, Staphylococcus epidermidis; identical to SEQ ID NO: 1738805

SEQ ID NO: 1840244 - protein, 30 aa, Staphylococcus epidermidis
GKGNYWGGDRLKIIQDYRAKGYNVMEASVS

SEQ ID NO: 1840245 - protein, 27 aa, Staphylococcus epidermidis
GNGNSGGWKKPGYWSKSSVKKTWSGNK

SEQ ID NO: 1840246 - protein, 28 aa, Staphylococcus epidermidis
GTEESIYLGGPRSDLRNAIEKQLVGRGF

SEQ ID NO: 1840247 - protein, 17 aa, Staphylococcus epidermidis
IGNEPFAVLLGDDIVES

SEQ ID NO: 1840248 - protein, 18 aa, Staphylococcus epidermidis
IGNEPFAVLLGDDIVESD

SEQ ID NO: 1840249 - protein, 19 aa, Staphylococcus epidermidis
IKNRTATISIHGASGTEEI

SEQ ID NO: 1840250 - protein, 19 aa, Staphylococcus epidermidis
IKNRTATISIHGASGTEES

SEQ ID NO: 1840251 - protein, 17 aa, Staphylococcus epidermidis
ILSLIIIGLIKTFNEYD

SEQ ID NO: 1840252 - protein, 21 aa, Staphylococcus epidermidis
IQPHHPFQFTIKLTGYEPNST

SEQ ID NO: 1840253 - protein, 19 aa, Staphylococcus epidermidis
ITLKELIEASMTYSDNTAN

SEQ ID NO: 1840254 - protein, 23 aa, Staphylococcus epidermidis
IVNRLPKSMPQYHVGHIKMIKEI

SEQ ID NO: 1840255 - protein, 34 aa, Staphylococcus epidermidis
KARRGELQGLGGSWGVAPKQDFNLWRNQQAEIQN

SEQ ID NO: 1840256 - protein, 17 aa, Staphylococcus epidermidis
KEIEVLNIYGDLEDGSH

SEQ ID NO: 1840257 - protein, 25 aa, Staphylococcus epidermidis
KGQFKQFRHGLSSFIEALVKDIESK

SEQ ID NO: 1840258 - protein, 26 aa, Staphylococcus epidermidis
KGSMLPKVEAALQFLEKNTKGSVLIT

SEQ ID NO: 1840259 - protein, 19 aa, Staphylococcus epidermidis
KIAAIRYARENNIPFFGIC

SEQ ID NO: 1840260 - protein, 23 aa, Staphylococcus epidermidis
KLKEINLAPSERKEIVIDLSKMK

SEQ ID NO: 1840261 - protein, 29 aa, Staphylococcus epidermidis
KNESIEFGSSIGEEFKGLIGNFKSDINPN

SEQ ID NO: 1840262 - protein, 20 aa, Staphylococcus epidermidis
KNTGTYMFHCHILEHEENGM

SEQ ID NO: 1840263 - protein, 19 aa, Staphylococcus epidermidis
KPEFPERNDEEWLKTTMAR

SEQ ID NO: 1840264 - protein, 26 aa, Staphylococcus epidermidis
KQGPPFPFPECGAMSQAYIGYQMQES

SEQ ID NO: 1840265 - protein, 23 aa, Staphylococcus epidermidis
KSKPELILASFRQAHTKTIDEMK

SEQ ID NO: 1840266 - protein, 18 aa, Staphylococcus epidermidis
KYGHHRYGRTYKGIMRDW

SEQ ID NO: 1840267 - protein, 19 aa, Staphylococcus epidermidis
LALAEGLKQSDFIDSKGHD

SEQ ID NO: 1840268 - protein, 19 aa, Staphylococcus epidermidis
LALAEGLKQSDFIHSKDHD

SEQ ID NO: 1840269 - protein, 19 aa, Staphylococcus epidermidis
LASSLILGFSVTPELFNVT

SEQ ID NO: 1840270 - protein, 25 aa, Staphylococcus epidermidis
LDNKTYLWDNIRINDDGNWTVHYRN

SEQ ID NO: 1840271 - protein, 17 aa, Staphylococcus epidermidis
LILGFSVTPELFNVTQA

SEQ ID NO: 1840272 - protein, 25 aa, Staphylococcus epidermidis
LIVMLGFAGGLGYSHYKDSKANTDV

SEQ ID NO: 1840273 - protein, 18 aa, Staphylococcus epidermidis
LKHGHVMIQSFSGSSLEK

SEQ ID NO: 1840274 - protein, 17 aa, Staphylococcus epidermidis
LKIFSNFMAVIGNASKY

SEQ ID NO: 1840275 - protein, 17 aa, Staphylococcus epidermidis
LKIKNLKASSDYYDSIA

SEQ ID NO: 1840276 - protein, 20 aa, Staphylococcus epidermidis
LKLKIRWPFWLSQIGLILLG

SEQ ID NO: 1840277 - protein, 20 aa, Staphylococcus epidermidis
LKLSNNQSFEYIASDGGQLK

SEQ ID NO: 1840278 - protein, 22 aa, Staphylococcus epidermidis
LRNAIEKQLVGRGFTVKVPPEY

SEQ ID NO: 1840279 - protein, 22 aa, Staphylococcus epidermidis
LSSLLILGSCGVKHNNSDSNES

SEQ ID NO: 1840280 - protein, 26 aa, Staphylococcus epidermidis
LVGCGFTVKVPPEYLGGQNNKNFINK

SEQ ID NO: 1840281 - protein, 17 aa, Staphylococcus epidermidis
LVLLLFLATNQNALAKV

SEQ ID NO: 1840282 - protein, 19 aa, Staphylococcus epidermidis
MKHPFHIHGTQFKVLSVDG

SEQ ID NO: 1840283 - protein, 21 aa, Staphylococcus epidermidis
MLSGCSSFDHRKRESINDKNK

SEQ ID NO: 1840284 - protein, 19 aa, Staphylococcus epidermidis
MSDDEFLDAYTEGMSDDEA

SEQ ID NO: 1840285 - protein, 17 aa, Staphylococcus epidermidis
NELTQVRPLRIMSPHSV

SEQ ID NO: 1840286 - protein, 25 aa, Staphylococcus epidermidis
NGYTGIPNGDMGGVPTSDKAYSNDQ

SEQ ID NO: 1840287 - protein, 19 aa, Staphylococcus epidermidis
NKMKYGVYSYSMYESPKDA

SEQ ID NO: 1840288 - protein, 22 aa, Staphylococcus epidermidis
NLKVTVEPFSKMVKVRTKTTGK

SEQ ID NO: 1840289 - protein, 23 aa, Staphylococcus epidermidis
NTYKKGQCTYYVFERVKNDGNKI

SEQ ID NO: 1840290 - protein, 24 aa, Staphylococcus epidermidis
NYDRAVELYYYVKGGRVDYGAAHA

SEQ ID NO: 1840291 - protein, 25 aa, Staphylococcus epidermidis
NYYGKKQCTWWAFKRRAQLGKPVSN

SEQ ID NO: 1840292 - protein, 24 aa, Staphylococcus epidermidis
PEQNVDGDWGFSILDKEGNLEGSY

SEQ ID NO: 1840293 - protein, 24 aa, Staphylococcus epidermidis
PKHPKRVVVLEYSFVDALVALDVK

SEQ ID NO: 1840294 - protein, 21 aa, Staphylococcus epidermidis
PRSLVIAEVLKKAGYDVTTTP

SEQ ID NO: 1840295 - protein, 22 aa, Staphylococcus epidermidis
PSIAMTLLLTGCVQKDNDHDEA

SEQ ID NO: 1840296 - protein, 18 aa, Staphylococcus epidermidis
PTNNGLYSIAWGTKNQQL

SEQ ID NO: 1840297 - protein, 44 aa, Staphylococcus epidermidis; identical to SEQ ID NO: 1739021

SEQ ID NO: 1840298 - protein, 29 aa, Staphylococcus epidermidis
QDPHVWLDPVLNQKFAFMIKEKLIEKDPK

SEQ ID NO: 1840299 - protein, 25 aa, Staphylococcus epidermidis
QHDWDHLDLVGMDAFDLTHTGRELG

SEQ ID NO: 1840300 - protein, 26 aa, Staphylococcus epidermidis
QKQHGGEISPLFQGGHDNMVSSITTL

SEQ ID NO: 1840301 - protein, 29 aa, Staphylococcus epidermidis
QNAILCYIYKFRARFAVLAHLVSLREDLP

SEQ ID NO: 1840302 - protein, 29 aa, Staphylococcus epidermidis
QNAILCYIYKFRARFAVLARIVSLREGLP

SEQ ID NO: 1840303 - protein, 20 aa, Staphylococcus epidermidis
QNGFGYGDYLAAKEASEKAR

SEQ ID NO: 1840304 - protein, 17 aa, Staphylococcus epidermidis
QSAKNLFDFFGNNVTSN

SEQ ID NO: 1840305 - protein, 22 aa, Staphylococcus epidermidis
QVYPSKGQFASIVGVNKNKIFI

SEQ ID NO: 1840306 - protein, 22 aa, Staphylococcus epidermidis
RQHGGTISDLFTGGKDNMVASI

SEQ ID NO: 1840307 - protein, 17 aa, Staphylococcus epidermidis
RSVKDTSVKSRATSTKR

SEQ ID NO: 1840308 - protein, 19 aa, Staphylococcus epidermidis
RVGIVPLINQRAYWFITVH

SEQ ID NO: 1840309 - protein, 25 aa, Staphylococcus epidermidis
SENATRVARYLSPFEGDRSQALQQL

SEQ ID NO: 1840310 - protein, 20 aa, Staphylococcus epidermidis
SGKRYAEYLSLVATHYNLNV

SEQ ID NO: 1840311 - protein, 17 aa, Staphylococcus epidermidis
SIILFAIVLTACGNDKS

SEQ ID NO: 1840312 - protein, 24 aa, Staphylococcus epidermidis
SIKQGKKSGGYWVRGTTSKIVKSN

SEQ ID NO: 1840313 - protein, 19 aa, Staphylococcus epidermidis
SKALVSLASTERKIDKYQS

SEQ ID NO: 1840314 - protein, 31 aa, Staphylococcus epidermidis; identical to SEQ ID NO: 1812899

SEQ ID NO: 1840315 - protein, 17 aa, Staphylococcus epidermidis
SRNDVAFVYPKNQSEPI

SEQ ID NO: 1840316 - protein, 23 aa, Staphylococcus epidermidis
TASGGDFVLSNSFYQGLKAGNVT

SEQ ID NO: 1840317 - protein, 21 aa, Staphylococcus epidermidis
TELTKALADKGNYDYYSFEGI

SEQ ID NO: 1840318 - protein, 25 aa, Staphylococcus epidermidis
THTGRELGQFYLGIMDNIMRIEEAD

SEQ ID NO: 1840319 - protein, 21 aa, Staphylococcus epidermidis
TLKELIEASMAYSDNTANNKI

SEQ ID NO: 1840320 - protein, 20 aa, Staphylococcus epidermidis
TNTYDGTGFVIARTSQTDIT

SEQ ID NO: 1840321 - protein, 22 aa, Staphylococcus epidermidis
TQLSEKERLALAFYADGVEKYM

SEQ ID NO: 1840322 - protein, 22 aa, Staphylococcus epidermidis
TRKLVKETINRIGRLSGGKDVD

SEQ ID NO: 1840323 - protein, 28 aa, Staphylococcus epidermidis
TSPYPHGQCTWYVYHRMNQFDASISGDL

SEQ ID NO: 1840324 - protein, 20 aa, Staphylococcus epidermidis
TTSNFKRSVKDTSVKSRATS

SEQ ID NO: 1840325 - protein, 21 aa, Staphylococcus epidermidis
TTSNFKRSVKDTSVKSRATST

SEQ ID NO: 1840326 - protein, 23 aa, Staphylococcus epidermidis
TTYPRLRVTGAPFEAVGLPDCIQ

SEQ ID NO: 1840327 - protein, 17 aa, Staphylococcus epidermidis
TYKADFKDRKAIEHIDI

SEQ ID NO: 1840328 - protein, 19 aa, Staphylococcus epidermidis
VAGAESLYGNPRDFILKHN

SEQ ID NO: 1840329 - protein, 17 aa, Staphylococcus epidermidis
VGGDALRSMSNPERFGQ

SEQ ID NO: 1840330 - protein, 21 aa, Staphylococcus epidermidis
VMSEFMKFVLEDEGQAAEDAG

SEQ ID NO: 1840331 - protein, 23 aa, Staphylococcus epidermidis
VPLINQRAYWFITVHAKEGDPKY

SEQ ID NO: 1840332 - protein, 19 aa, Staphylococcus epidermidis
VRYEIELNYYSPKSKKDTS

SEQ ID NO: 1840333 - protein, 17 aa, Staphylococcus epidermidis
YASRNDVAFVYPKNQSE

SEQ ID NO: 1840334 - protein, 19 aa, Staphylococcus epidermidis
YGDGDGRTFTALSGANDVV

SEQ ID NO: 1840335 - protein, 18 aa, Staphylococcus epidermidis
YKLQVDLERPVPYINELL

SEQ ID NO: 1840336 - protein, 27 aa, Staphylococcus epidermidis
YKNQYPVVFVHGFVGLVGEDAFSMYPN

SEQ ID NO: 1840337 - protein, 18 aa, Staphylococcus epidermidis
YLGGPRSDLRNAIEKQLV

SEQ ID NO: 1840338 - protein, 17 aa, Staphylococcus epidermidis
YNPNRVAVLDYGALDVM

SEQ ID NO: 1840339 - protein, 26 aa, Staphylococcus epidermidis
YNVKQELTKLGYRVHEANVGAFSSNY

SEQ ID NO: 1840340 - protein, 17 aa, Staphylococcus epidermidis
YTLDRFIDEYGLNPQQL

SEQ ID NO: 1840341 - protein, 24 aa, Staphylococcus epidermidis
YTYKIGNKDVRFYVNRNGYVIKGQ

SEQ ID NO: 1840342 - protein, 19 aa, Staphylococcus epidermidis
AAGLGTRFLPATKAMPKEM

SEQ ID NO: 1840343 - protein, 23 aa, Staphylococcus epidermidis
ADFKVNKKDGTFSYTYDNRNTQS

SEQ ID NO: 1840344 - protein, 24 aa, Staphylococcus epidermidis
ADNKEDWDEPVFIKGADLEGQDLQ

SEQ ID NO: 1840345 - protein, 20 aa, Staphylococcus epidermidis
AEQNKSAFAFSKKVDDKTVQ

SEQ ID NO: 1840346 - protein, 23 aa, Staphylococcus epidermidis
AFNMNDFNFISSYFKKNSSIYTS

SEQ ID NO: 1840347 - protein, 18 aa, Staphylococcus epidermidis
AFQKAGVYDKMERDAQQL

SEQ ID NO: 1840348 - protein, 19 aa, Staphylococcus epidermidis
AFTVLILAGCGLGDSDNKG

SEQ ID NO: 1840349 - protein, 19 aa, Staphylococcus epidermidis
AFTVLILAGCGLGDSDNNG

SEQ ID NO: 1840350 - protein, 23 aa, Staphylococcus epidermidis
AGAADWVIDGAFSDYADSMKQQG

SEQ ID NO: 1840351 - protein, 20 aa, Staphylococcus epidermidis
AGAKALRATVHRIGEKAWNK

SEQ ID NO: 1840352 - protein, 18 aa, Staphylococcus epidermidis
AGGRALEFNQLYNYNQLY

SEQ ID NO: 1840353 - protein, 21 aa, Staphylococcus epidermidis
AGIATFAFASHDAHAAEQNNG

SEQ ID NO: 1840354 - protein, 25 aa, Staphylococcus epidermidis
AGKYQFLQSTWDSVAPSQYKGQSPA

SEQ ID NO: 1840355 - protein, 24 aa, Staphylococcus epidermidis
AGKYQFLQSTWDSVAPSQYKGVSP

SEQ ID NO: 1840356 - protein, 30 aa, Staphylococcus epidermidis
AGLMIVMFVLCGLLFPLTVTAIGQITFPHQ

SEQ ID NO: 1840357 - protein, 23 aa, Staphylococcus epidermidis
AGQNTLYKMRWNPSNPGTHQYAT

SEQ ID NO: 1840358 - protein, 23 aa, Staphylococcus epidermidis
AGSKAARWARKHYVGKKYRYGIN

SEQ ID NO: 1840359 - protein, 26 aa, Staphylococcus epidermidis
AGYNAKFVLDKQFRTALNKGKVTFNG

SEQ ID NO: 1840360 - protein, 20 aa, Staphylococcus epidermidis
AHALANAGADVIIGHNTVIQ

SEQ ID NO: 1840361 - protein, 19 aa, Staphylococcus epidermidis
AIELARTLPQRSIDSNTLK

SEQ ID NO: 1840362 - protein, 26 aa, Staphylococcus epidermidis
AIGTFSTVIATLVFVGFNPGQAHANE

SEQ ID NO: 1840363 - protein, 25 aa, Staphylococcus epidermidis
AILSSALLLTACGQDGDKSNKDDNK

SEQ ID NO: 1840364 - protein, 21 aa, Staphylococcus epidermidis
AIQGYIYKCAKKHHLETPYLD

SEQ ID NO: 1840365 - protein, 24 aa, Staphylococcus epidermidis
AISKIGKGKAAFIGDTSLVEDSSP

SEQ ID NO: 1840366 - protein, 26 aa, Staphylococcus epidermidis
AIVNFVKRGGSVIFISDHYNADRNLN

SEQ ID NO: 1840367 - protein, 22 aa, Staphylococcus epidermidis
AIVVGCSVILGACQGVHDDPLA

SEQ ID NO: 1840368 - protein, 22 aa, Staphylococcus epidermidis
AKAVKFSIERAKAMNKDTTVET

SEQ ID NO: 1840369 - protein, 20 aa, Staphylococcus epidermidis
AKDLRVGMDSSWMDRKGDGY

SEQ ID NO: 1840370 - protein, 18 aa, Staphylococcus epidermidis
AKEIVKKQIGGYKGTGID

SEQ ID NO: 1840371 - protein, 18 aa, Staphylococcus epidermidis
AKFVSHLNDTPSIENVNA

SEQ ID NO: 1840372 - protein, 18 aa, Staphylococcus epidermidis
AKPDLILAHESQKHSSGK

SEQ ID NO: 1840373 - protein, 18 aa, Staphylococcus epidermidis
AKPEVIFISGRTANQKNL

SEQ ID NO: 1840374 - protein, 17 aa, Staphylococcus epidermidis
AKSDLFVYSSHQLDPVA

SEQ ID NO: 1840375 - protein, 19 aa, Staphylococcus epidermidis
AKTAIKFIINHKSDARKVI

SEQ ID NO: 1840376 - protein, 24 aa, Staphylococcus epidermidis
ALAKVHKTICTFTKVKTVSHNNIF

SEQ ID NO: 1840377 - protein, 23 aa, Staphylococcus epidermidis
ALAKVHQTICTFSKANKVSYIED

SEQ ID NO: 1840378 - protein, 19 aa, Staphylococcus epidermidis
ALIDIREAQRLKKQIKQQK

SEQ ID NO: 1840379 - protein, 26 aa, Staphylococcus epidermidis
ALKDNGINEFLIWNAANDYTNGPNYH

SEQ ID NO: 1840380 - protein, 18 aa, Staphylococcus epidermidis
ALLLSACSHQSESHNDKN

SEQ ID NO: 1840381 - protein, 25 aa, Staphylococcus epidermidis
ALNESFSDVFGYFIDDEDFLMGEDV

SEQ ID NO: 1840382 - protein, 25 aa, Staphylococcus epidermidis
ALNESFSDVFGYFVDDEDFLMGEDV

SEQ ID NO: 1840383 - protein, 25 aa, Staphylococcus epidermidis
ALNESFSDVFGYFVDNDDFLMGEDV

SEQ ID NO: 1840384 - protein, 22 aa, Staphylococcus epidermidis
ALNPGIEPLIFPGDEIVVSETA

SEQ ID NO: 1840385 - protein, 22 aa, Staphylococcus epidermidis
ANAVSSYDGYWMASYQAEEPNR

SEQ ID NO: 1840386 - protein, 17 aa, Staphylococcus epidermidis
ANDLGYKIKLIGKGTYE

SEQ ID NO: 1840387 - protein, 19 aa, Staphylococcus epidermidis
ANENLGLNPSHNGETNQEK

SEQ ID NO: 1840388 - protein, 31 aa, Staphylococcus epidermidis
ANKKVKPLGSRKFPSVILPNNNRHQISNTQE

SEQ ID NO: 1840389 - protein, 18 aa, Staphylococcus epidermidis
ANKSFPQIQYKNHDPIIL

SEQ ID NO: 1840390 - protein, 19 aa, Staphylococcus epidermidis
ANLTLCYFKASFTENNGIV

SEQ ID NO: 1840391 - protein, 25 aa, Staphylococcus epidermidis
ANNEKLADILLQFKNSNKVISSVCH

SEQ ID NO: 1840392 - protein, 20 aa, Staphylococcus epidermidis
ANSKGKVVLINGDTDAKKVK

SEQ ID NO: 1840393 - protein, 25 aa, Staphylococcus epidermidis
APIKETLAASLIRLANWKGDTPLID

SEQ ID NO: 1840394 - protein, 23 aa, Staphylococcus epidermidis
APTDYLSWGAGPQGNERFINVEI

SEQ ID NO: 1840395 - protein, 32 aa, Staphylococcus epidermidis
AQDGHTISTFWGDARNWAGQASSAGFKVDHSP

SEQ ID NO: 1840396 - protein, 18 aa, Staphylococcus epidermidis
AQDSLKILKAHAEKPYSE

SEQ ID NO: 1840397 - protein, 22 aa, Staphylococcus epidermidis
AQELKKRTGITLELQTVSNEDS

SEQ ID NO: 1840398 - protein, 17 aa, Staphylococcus epidermidis
AQHAVNHYAPKKSLEFQ

SEQ ID NO: 1840399 - protein, 17 aa, Staphylococcus epidermidis
AQHAVNHYAPKTSLEFQ

SEQ ID NO: 1840400 - protein, 18 aa, Staphylococcus epidermidis
AQHAVNHYAPKYSLQFQK

SEQ ID NO: 1840401 - protein, 25 aa, Staphylococcus epidermidis
AQSNAHEGKGFFNGGLQGNKSNGGG

SEQ ID NO: 1840402 - protein, 17 aa, Staphylococcus epidermidis
ASATFLLAGCGNDQKED

SEQ ID NO: 1840403 - protein, 25 aa, Staphylococcus epidermidis
ASDDEIMWQLNLNLMGVIRMTKAVL

SEQ ID NO: 1840404 - protein, 21 aa, Staphylococcus epidermidis
ASISFKGYLGSNIVKFFDYTL

SEQ ID NO: 1840405 - protein, 19 aa, Staphylococcus epidermidis
ASITLTARVTDEIKDANIR

SEQ ID NO: 1840406 - protein, 17 aa, Staphylococcus epidermidis
ASSIIVASMLFIGGQTA

SEQ ID NO: 1840407 - protein, 20 aa, Staphylococcus epidermidis
ATEKEWRENDGLVSVISAQH

SEQ ID NO: 1840408 - protein, 21 aa, Staphylococcus epidermidis
ATIEHKKWGKGVDVKIDTPDH

SEQ ID NO: 1840409 - protein, 18 aa, Staphylococcus epidermidis
ATLTLTAKVSEDIKDAHI

SEQ ID NO: 1840410 - protein, 17 aa, Staphylococcus epidermidis
AVASGIVAGMGFGDNAK

SEQ ID NO: 1840411 - protein, 26 aa, Staphylococcus epidermidis
AVILSICLVGLIFLATNQNALAKVHQ

SEQ ID NO: 1840412 - protein, 27 aa, Staphylococcus epidermidis
AVTISSLALVVPLAFGNAEADAAQTND

SEQ ID NO: 1840413 - protein, 24 aa, Staphylococcus epidermidis
AYTIATRISDNWSKDDEEQLAKKI

SEQ ID NO: 1840414 - protein, 24 aa, Staphylococcus epidermidis
AYTVATRMADDWSKSDEDKLAKKI

SEQ ID NO: 1840415 - protein, 20 aa, Staphylococcus epidermidis
CISDNRIKQSMLHCLITKEQ

SEQ ID NO: 1840416 - protein, 17 aa, Staphylococcus epidermidis
DAAYRGALNAGLSKGNA

SEQ ID NO: 1840417 - protein, 17 aa, Staphylococcus epidermidis
DCLGAAVNRSMELSHKE

SEQ ID NO: 1840418 - protein, 19 aa, Staphylococcus epidermidis
DCMAELPKDQPIIVSCHSG

SEQ ID NO: 1840419 - protein, 22 aa, Staphylococcus epidermidis
DDMLKAVIDHFGHIDIVVNSAG

SEQ ID NO: 1840420 - protein, 24 aa, Staphylococcus epidermidis
DEFPPIRTGNDYRIDSTRTDNNVY

SEQ ID NO: 1840421 - protein, 21 aa, Staphylococcus epidermidis
DELKHKSKPVQSFEDNVKQNN

SEQ ID NO: 1840422 - protein, 22 aa, Staphylococcus epidermidis
DELQQFWHGLAEDLVQSEQLTS

SEQ ID NO: 1840423 - protein, 23 aa, Staphylococcus epidermidis
DELTEFEVAYAPPYSHPKDLINM

SEQ ID NO: 1840424 - protein, 26 aa, Staphylococcus epidermidis
DESTKFPNVFLIGATVRHQNVILCYI

SEQ ID NO: 1840425 - protein, 18 aa, Staphylococcus epidermidis
DFESGLLELSKEVFPTNK

SEQ ID NO: 1840426 - protein, 20 aa, Staphylococcus epidermidis
DFFIACQFHPEFLSRPNRPQ

SEQ ID NO: 1840427 - protein, 18 aa, Staphylococcus epidermidis
DGERVMVNIIGYKIGGVE

SEQ ID NO: 1840428 - protein, 19 aa, Staphylococcus epidermidis
DGKVIIIGIQLFKKENKLH

SEQ ID NO: 1840429 - protein, 19 aa, Staphylococcus epidermidis
DGKVKPLLVKSYKQKSDST

SEQ ID NO: 1840430 - protein, 17 aa, Staphylococcus epidermidis
DGLYNFISAIRVASSDA

SEQ ID NO: 1840431 - protein, 17 aa, Staphylococcus epidermidis
DGTHLVHMGINRHPGQE

SEQ ID NO: 1840432 - protein, 24 aa, Staphylococcus epidermidis
DGYLACGYVAKGRMEEPLQIVSVI

SEQ ID NO: 1840433 - protein, 19 aa, Staphylococcus epidermidis
DGYPAFKKEYGYSFGTVRP

SEQ ID NO: 1840434 - protein, 24 aa, Staphylococcus epidermidis
DIEEMKKWIPLMMKGRENNSGVMA

SEQ ID NO: 1840435 - protein, 25 aa, Staphylococcus epidermidis
DIEEMRKWIPLMMKGREDKGYMAAS

SEQ ID NO: 1840436 - protein, 21 aa, Staphylococcus epidermidis
DIIKDKYLSERTKRYRLKQLL

SEQ ID NO: 1840437 - protein, 19 aa, Staphylococcus epidermidis
DIKMLKDPEKIYGKDDEHI

SEQ ID NO: 1840438 - protein, 36 aa, Staphylococcus epidermidis; identical to SEQ ID NO: 1738737

SEQ ID NO: 1840439 - protein, 36 aa, Staphylococcus epidermidis
DIKPFIKTRLISPIGKLRAGLDLFKKPIEIENDISV

SEQ ID NO: 1840440 - protein, 24 aa, Staphylococcus epidermidis
DINPSVLTHYWGGDKMNIRQDLEE

SEQ ID NO: 1840441 - protein, 24 aa, Staphylococcus epidermidis
DITRIASSNAQMWKDITLNNPNHI

SEQ ID NO: 1840442 - protein, 19 aa, Staphylococcus epidermidis
DKNKKEFIALQKDINNYLI

SEQ ID NO: 1840443 - protein, 23 aa, Staphylococcus epidermidis
DKNKRDHTNLVDAFYNNISQSQS

SEQ ID NO: 1840444 - protein, 18 aa, Staphylococcus epidermidis
DKQMKGIFQNSVQYVNKD

SEQ ID NO: 1840445 - protein, 17 aa, Staphylococcus epidermidis
DLEIKHFSDYNVPNKAL

SEQ ID NO: 1840446 - protein, 22 aa, Staphylococcus epidermidis
DLMKKGLMTKEFYTMEENKAKE

SEQ ID NO: 1840447 - protein, 22 aa, Staphylococcus epidermidis
DLPELEFTYAPPFGSAKDPVNM

SEQ ID NO: 1840448 - protein, 26 aa, Staphylococcus epidermidis
DMKEEKKRINGLVIIKSKNNYIKIIK

SEQ ID NO: 1840449 - protein, 28 aa, Staphylococcus epidermidis
DNGPALAGNYWGGDRIKLTQELRAKGYN

SEQ ID NO: 1840450 - protein, 25 aa, Staphylococcus epidermidis
DNGTLLKNLTTWMGKTDSHSSMKET

SEQ ID NO: 1840451 - protein, 20 aa, Staphylococcus epidermidis
DPEAIHKMKHSGMYMTKEIA

SEQ ID NO: 1840452 - protein, 28 aa, Staphylococcus epidermidis
DPIEYYARWGYDMHQLFELVKYHYDNIP

SEQ ID NO: 1840453 - protein, 28 aa, Staphylococcus epidermidis
DQAVALFLKECEDYGIDFQKLIHRRTGN

SEQ ID NO: 1840454 - protein, 24 aa, Staphylococcus epidermidis
DQAVLYIKDAFVIKDKESENKEIA

SEQ ID NO: 1840455 - protein, 24 aa, Staphylococcus epidermidis
DQLPEADAVVFAVAHKDYVQNKKE

SEQ ID NO: 1840456 - protein, 18 aa, Staphylococcus epidermidis
DQTPAGPVTLTIINKDGR

SEQ ID NO: 1840457 - protein, 20 aa, Staphylococcus epidermidis
DRFAKEGKFQPSAGGTTNEA

SEQ ID NO: 1840458 - protein, 26 aa, Staphylococcus epidermidis
DRGVEFKIATPIVACNDKGFVVEVNG

SEQ ID NO: 1840459 - protein, 24 aa, Staphylococcus epidermidis
DSDSFHASGIFPSTDKSFYNKFKS

SEQ ID NO: 1840460 - protein, 20 aa, Staphylococcus epidermidis
DSEMKSALKKYLQVNNDVLD

SEQ ID NO: 1840461 - protein, 17 aa, Staphylococcus epidermidis
DSSESMNGYRRGAYQDM

SEQ ID NO: 1840462 - protein, 17 aa, Staphylococcus epidermidis
DSSESMNGYRRGAYQNM

SEQ ID NO: 1840463 - protein, 33 aa, Staphylococcus epidermidis
DSVSKAIIGGAKFIGQSYIKAGQNTLYKMRWNP

SEQ ID NO: 1840464 - protein, 24 aa, Staphylococcus epidermidis
DTDKYLWDVVNWQKDGNWKVNCRN

SEQ ID NO: 1840465 - protein, 22 aa, Staphylococcus epidermidis
DTKLKYYVCTCEDDKEWREYDY

SEQ ID NO: 1840466 - protein, 26 aa, Staphylococcus epidermidis
DVDGILVPGGFGFRASEGKISAIKYA

SEQ ID NO: 1840467 - protein, 21 aa, Staphylococcus epidermidis
DVKDAEKLLKEAGYHKNSDGI

SEQ ID NO: 1840468 - protein, 23 aa, Staphylococcus epidermidis
DVNLRVPLVKAYMGMEDDVLSFY

SEQ ID NO: 1840469 - protein, 17 aa, Staphylococcus epidermidis
DVQARPYNYTFVISNSN

SEQ ID NO: 1840470 - protein, 18 aa, Staphylococcus epidermidis
DVSMYSYLTVPRGDTGYF

SEQ ID NO: 1840471 - protein, 21 aa, Staphylococcus epidermidis
DVVPKHQKWYIAINSKGNAYV

SEQ ID NO: 1840472 - protein, 17 aa, Staphylococcus epidermidis
DWDHVDFVGQDSSDTVR

SEQ ID NO: 1840473 - protein, 28 aa, Staphylococcus epidermidis
DYLHRMGIKLTPILGWAERGGSSASGHG

SEQ ID NO: 1840474 - protein, 23 aa, Staphylococcus epidermidis
EAARTGKPIKLMIGFNARDSSSN

SEQ ID NO: 1840475 - protein, 23 aa, Staphylococcus epidermidis
EAKEKYSRIDVIFNNAGVDNGAG

SEQ ID NO: 1840476 - protein, 23 aa, Staphylococcus epidermidis
EAKNGGIKLVKGIDFNFNNFNNF

SEQ ID NO: 1840477 - protein, 25 aa, Staphylococcus epidermidis
EATEDGFRYVFSFKDSSKKDNYSIV

SEQ ID NO: 1840478 - protein, 31 aa, Staphylococcus epidermidis
EATSDMPAEEYKKLSQLVGDYTKKQKQNENK

SEQ ID NO: 1840479 - protein, 24 aa, Staphylococcus epidermidis
EDAKRVQSAIVKKLDQLGIHEKKD

SEQ ID NO: 1840480 - protein, 25 aa, Staphylococcus epidermidis
EDIEEMRKWIPLMMKGHNSSDIMAA

SEQ ID NO: 1840481 - protein, 26 aa, Staphylococcus epidermidis
EDSFSMYPNYWGGTKYNVKQELTKLG

SEQ ID NO: 1840482 - protein, 17 aa, Staphylococcus epidermidis
EEELSQDIAILVKEKEK

SEQ ID NO: 1840483 - protein, 21 aa, Staphylococcus epidermidis
EEMKKWMPLMMKGRTGNEIMA

SEQ ID NO: 1840484 - protein, 29 aa, Staphylococcus epidermidis
EENRNLLQRIWDGIVEIIQSIIQFFSNLL

SEQ ID NO: 1840485 - protein, 36 aa, Staphylococcus epidermidis
EENYTSYFPKYGYRNGVGRPEGIVVHDTANDNSTID

SEQ ID NO: 1840486 - protein, 18 aa, Staphylococcus epidermidis
EFKEKGYQAVAYKSDVSK

SEQ ID NO: 1840487 - protein, 24 aa, Staphylococcus epidermidis
EFLDHRVIKHYGSLVPLTELDDSL

SEQ ID NO: 1840488 - protein, 29 aa, Staphylococcus epidermidis
EGNYHYTWKGNWSPDRVNTSYNYNSYNNY

SEQ ID NO: 1840489 - protein, 24 aa, Staphylococcus epidermidis
EGNYHYTWQGNWSPDRLDNNYNNY

SEQ ID NO: 1840490 - protein, 25 aa, Staphylococcus epidermidis
EHLHQSIWKKICVNGTANSLCTILE

SEQ ID NO: 1840491 - protein, 23 aa, Staphylococcus epidermidis
EHYYEFRTHKGVLLVTTNGKKDK

SEQ ID NO: 1840492 - protein, 22 aa, Staphylococcus epidermidis
EIAFMKRNYNSAFVHAFVDGNR

SEQ ID NO: 1840493 - protein, 21 aa, Staphylococcus epidermidis
EIENFKFFVQYGDFKNLKDYK

SEQ ID NO: 1840494 - protein, 21 aa, Staphylococcus epidermidis
EIENFKFFVQYGNFKDIKDYK

SEQ ID NO: 1840495 - protein, 21 aa, Staphylococcus epidermidis
EIENFKFFVQYGNFKDIKNYK

SEQ ID NO: 1840496 - protein, 18 aa, Staphylococcus epidermidis
EILSRYGKNANYYIETKS

SEQ ID NO: 1840497 - protein, 20 aa, Staphylococcus epidermidis
EIQSTSGFRTHLLLYNHESK

SEQ ID NO: 1840498 - protein, 20 aa, Staphylococcus epidermidis
EKAKPLLKKKGYDLKIKSIN

SEQ ID NO: 1840499 - protein, 20 aa, Staphylococcus epidermidis
EKAKPLLKKKGYDLQIKTIN

SEQ ID NO: 1840500 - protein, 22 aa, Staphylococcus epidermidis
EKIAHAYAYGGPNMAVNSLEKL

SEQ ID NO: 1840501 - protein, 25 aa, Staphylococcus epidermidis
EKRAKEPKTDERKKSRQDSSNSKES

SEQ ID NO: 1840502 - protein, 20 aa, Staphylococcus epidermidis
EKRFMIKADNTYKVKDIRLF

SEQ ID NO: 1840503 - protein, 18 aa, Staphylococcus epidermidis
ELADYVFIGAGGGAIPLL

SEQ ID NO: 1840504 - protein, 20 aa, Staphylococcus epidermidis
ELEKDAVWKKLDAVKKDRVD

SEQ ID NO: 1840505 - protein, 26 aa, Staphylococcus epidermidis
ELPVKQRGALSIAYDLYVDIPDKAGM

SEQ ID NO: 1840506 - protein, 22 aa, Staphylococcus epidermidis
ELQYKKRYPISNHDVSRAIQQA

SEQ ID NO: 1840507 - protein, 17 aa, Staphylococcus epidermidis
ENIFTLRSVPDVDAISN

SEQ ID NO: 1840508 - protein, 25 aa, Staphylococcus epidermidis
ENLYIRIKAIDIVAPTGNHRVFRVN

SEQ ID NO: 1840509 - protein, 26 aa, Staphylococcus epidermidis
ENSDLKDIPIHFAIYKQSGQDSISPG

SEQ ID NO: 1840510 - protein, 25 aa, Staphylococcus epidermidis
ENSLKNKLTEFFTGYATAMNSAFNM

SEQ ID NO: 1840511 - protein, 20 aa, Staphylococcus epidermidis
ENTYDGTGFVIARTSKTDIT

SEQ ID NO: 1840512 - protein, 25 aa, Staphylococcus epidermidis
EPEQNVDGDWGFSILDKEGNLEGSY

SEQ ID NO: 1840513 - protein, 20 aa, Staphylococcus epidermidis
EPLQIVSVIHQFFDNKEAKS

SEQ ID NO: 1840514 - protein, 17 aa, Staphylococcus epidermidis
EPNWNIKLYERLDRPGI

SEQ ID NO: 1840515 - protein, 22 aa, Staphylococcus epidermidis
EPQLRGVNDIVIEKGEDYNLLN

SEQ ID NO: 1840516 - protein, 25 aa, Staphylococcus epidermidis
EPSQIKAAIFFGGFYDMKTVKATEF

SEQ ID NO: 1840517 - protein, 30 aa, Staphylococcus epidermidis
EPWTNPIEGYKWYDRSTFKKGSYGSDQQGA

SEQ ID NO: 1840518 - protein, 30 aa, Staphylococcus epidermidis
EPWTNPIEGYKWYDRSTFKTGSYGSNQQGA

SEQ ID NO: 1840519 - protein, 17 aa, Staphylococcus epidermidis
EQTSCKVTLHFIKQESE

SEQ ID NO: 1840520 - protein, 18 aa, Staphylococcus epidermidis
ERLKKAYQEKGWLNETGA

SEQ ID NO: 1840521 - protein, 20 aa, Staphylococcus epidermidis
ERTDLKHVYEHILSDGNKKP

SEQ ID NO: 1840522 - protein, 17 aa, Staphylococcus epidermidis
ESITGYQYEPWHLRYLG

SEQ ID NO: 1840523 - protein, 18 aa, Staphylococcus epidermidis
ESQARGLLQDNMANSYNG

SEQ ID NO: 1840524 - protein, 18 aa, Staphylococcus epidermidis
ESQIKWLKEHDAKFLTLK

SEQ ID NO: 1840525 - protein, 25 aa, Staphylococcus epidermidis
ESQTDYPLKRVHYVKDLMKKGLMTK

SEQ ID NO: 1840526 - protein, 33 aa, Staphylococcus epidermidis
ESSKASPYPQGQCTWYVYNRMEQYDASLDGNLG

SEQ ID NO: 1840527 - protein, 26 aa, Staphylococcus epidermidis
ESVEYGSSIGDEFKDLIGNFKSDINP

SEQ ID NO: 1840528 - protein, 24 aa, Staphylococcus epidermidis
ESVIECRDADSLYEIPLQLSKQDM

SEQ ID NO: 1840529 - protein, 20 aa, Staphylococcus epidermidis
ESYLGRKTIMTDLAKDIGLE

SEQ ID NO: 1840530 - protein, 28 aa, Staphylococcus epidermidis
ETAIVKCNLWLRTADRIKIVMGRFDAKT

SEQ ID NO: 1840531 - protein, 25 aa, Staphylococcus epidermidis
ETIMKTGYDYSWFILTEDIIKKEFV

SEQ ID NO: 1840532 - protein, 20 aa, Staphylococcus epidermidis
ETLVPVKLYVKPQLQQKISY

SEQ ID NO: 1840533 - protein, 20 aa, Staphylococcus epidermidis
EVDYDVLICTGKSTQMVTQF

SEQ ID NO: 1840534 - protein, 25 aa, Staphylococcus epidermidis
EVLSQLKSQFGIQQFNFVGHSMGNM

SEQ ID NO: 1840535 - protein, 24 aa, Staphylococcus epidermidis
EVMGGIEPTVDWLITALKNKKHVI

SEQ ID NO: 1840536 - protein, 26 aa, Staphylococcus epidermidis
EVMGGIEPTVDWLRTALKRKKHVITA

SEQ ID NO: 1840537 - protein, 18 aa, Staphylococcus epidermidis
EVRISVDDLRDFWDSMMK

SEQ ID NO: 1840538 - protein, 17 aa, Staphylococcus epidermidis
EVYDYYKDTFGRESYDD

SEQ ID NO: 1840539 - protein, 20 aa, Staphylococcus epidermidis
FANCGLPYYVAGEIGERTDL

SEQ ID NO: 1840540 - protein, 17 aa, Staphylococcus epidermidis
FANTYAFMVTKETAKKY

SEQ ID NO: 1840541 - protein, 22 aa, Staphylococcus epidermidis
FASLLVLGACGQNGDNSNKDDN

SEQ ID NO: 1840542 - protein, 20 aa, Staphylococcus epidermidis
FDKIMAVDMRGTFLVTKFLL

SEQ ID NO: 1840543 - protein, 20 aa, Staphylococcus epidermidis
FDLFEKGVIFSNGLNGPKAR

SEQ ID NO: 1840544 - protein, 20 aa, Staphylococcus epidermidis
FDRRAELGKPIGSLWGNASN

SEQ ID NO: 1840545 - protein, 17 aa, Staphylococcus epidermidis
FEPRTAAIKDFWEKVGL

SEQ ID NO: 1840546 - protein, 17 aa, Staphylococcus epidermidis
FFEKLEKTFKEISDELN

SEQ ID NO: 1840547 - protein, 20 aa, Staphylococcus epidermidis
FFRQRLGDEVLENLIEPLMG

SEQ ID NO: 1840548 - protein, 24 aa, Staphylococcus epidermidis
FFSMKKVTLSFVTVFIGVGTIGSF

SEQ ID NO: 1840549 - protein, 17 aa, Staphylococcus epidermidis
FFVQYGNFKDIKDYKNV

SEQ ID NO: 1840550 - protein, 33 aa, Staphylococcus epidermidis
FGGINESVKLYAIVNRHTGEIITTGSAGTHADG

SEQ ID NO: 1840551 - protein, 17 aa, Staphylococcus epidermidis
FISAIRVATSFEANHKG

SEQ ID NO: 1840552 - protein, 25 aa, Staphylococcus epidermidis
FKEGMKQARKELHYEANSNVVTTLF

SEQ ID NO: 1840553 - protein, 17 aa, Staphylococcus epidermidis
FKGANKLSDKSEKVQIN

SEQ ID NO: 1840554 - protein, 18 aa, Staphylococcus epidermidis
FKGLKGVTYKVDYKDQKA

SEQ ID NO: 1840555 - protein, 18 aa, Staphylococcus epidermidis
FKKDGYDLVNNKTQLLNS

SEQ ID NO: 1840556 - protein, 20 aa, Staphylococcus epidermidis
FKNSNKIISSVCHGPSVFVG

SEQ ID NO: 1840557 - protein, 20 aa, Staphylococcus epidermidis
FKNSNKVISSVCHGPSAFVG

SEQ ID NO: 1840558 - protein, 20 aa, Staphylococcus epidermidis
FKSQIQWLKAHDAKFLTLKE

SEQ ID NO: 1840559 - protein, 19 aa, Staphylococcus epidermidis
FKSQSVDFSKYWEPNKYED

SEQ ID NO: 1840560 - protein, 24 aa, Staphylococcus epidermidis
FLDQRVIKRYGSLVPLTELDEDLL

SEQ ID NO: 1840561 - protein, 18 aa, Staphylococcus epidermidis
FLGGCIFSGIRVAEGIDK

SEQ ID NO: 1840562 - protein, 18 aa, Staphylococcus epidermidis
FLKNEGKLSELTQDLKDS

SEQ ID NO: 1840563 - protein, 24 aa, Staphylococcus epidermidis
FNIGKDMRNYFSLSNGQDIPNVPF

SEQ ID NO: 1840564 - protein, 19 aa, Staphylococcus epidermidis
FNIPHGKIVNIAKIKTLNF

SEQ ID NO: 1840565 - protein, 18 aa, Staphylococcus epidermidis
FNKKVMYLLVNEGELSTY

SEQ ID NO: 1840566 - protein, 24 aa, Staphylococcus epidermidis
FNQSMDLLLSKRVDGTFNDSLSYL

SEQ ID NO: 1840567 - protein, 17 aa, Staphylococcus epidermidis
FNTAYRYYKNQPGAKKM

SEQ ID NO: 1840568 - protein, 19 aa, Staphylococcus epidermidis
FNTKMGYLKEFDKHGRTDM

SEQ ID NO: 1840569 - protein, 17 aa, Staphylococcus epidermidis
FPNQVLKVSGSSSSTTK

SEQ ID NO: 1840570 - protein, 20 aa, Staphylococcus epidermidis
FPQIQYKNHDPIILVHGFNG

SEQ ID NO: 1840571 - protein, 23 aa, Staphylococcus epidermidis
FQDAKAALQQAAFDLYGDGIAQQ

SEQ ID NO: 1840572 - protein, 26 aa, Staphylococcus epidermidis
FQNPQYLPRFVFGHYMKSYLSQYDEQ

SEQ ID NO: 1840573 - protein, 19 aa, Staphylococcus epidermidis
FRKAAPDAKVVYVGTSDDN

SEQ ID NO: 1840574 - protein, 27 aa, Staphylococcus epidermidis
FRLQNGNTFTARVNWVGNNAPNINSNQ

SEQ ID NO: 1840575 - protein, 19 aa, Staphylococcus epidermidis
FSDISGWKSVSKESIIKHN

SEQ ID NO: 1840576 - protein, 20 aa, Staphylococcus epidermidis
FSDPYTYSSAVLVVRDNEKD

SEQ ID NO: 1840577 - protein, 21 aa, Staphylococcus epidermidis
FSEPYTYSSAVLVVRENEKGI

SEQ ID NO: 1840578 - protein, 22 aa, Staphylococcus epidermidis
FSSALILGACGNNGTSNNDSDT

SEQ ID NO: 1840579 - protein, 20 aa, Staphylococcus epidermidis
FSSIAAFFAINTAANAQETE

SEQ ID NO: 1840580 - protein, 18 aa, Staphylococcus epidermidis
FSTGSLIVNDFSKKQKDN

SEQ ID NO: 1840581 - protein, 29 aa, Staphylococcus epidermidis
FTHLTKSRFNGIMKKHFGNVPLEKVVSLF

SEQ ID NO: 1840582 - protein, 20 aa, Staphylococcus epidermidis
FTLLFTLAFTSMNFFNSANA

SEQ ID NO: 1840583 - protein, 18 aa, Staphylococcus epidermidis
FTSHHPMQINTYKKGQCT

SEQ ID NO: 1840584 - protein, 17 aa, Staphylococcus epidermidis
FVLSSLLLVFSSITYAK

SEQ ID NO: 1840585 - protein, 18 aa, Staphylococcus epidermidis
FYQIELVRQYTFEDFAKS

SEQ ID NO: 1840586 - protein, 19 aa, Staphylococcus epidermidis
GAPEGMQFYAVKPSKGNFQ

SEQ ID NO: 1840587 - protein, 24 aa, Staphylococcus epidermidis
GAYREWQPGQKIHLIGHSMGGQTV

SEQ ID NO: 1840588 - protein, 17 aa, Staphylococcus epidermidis
GCLYAYSIDFIHGIAIT

SEQ ID NO: 1840589 - protein, 20 aa, Staphylococcus epidermidis
GDEAMKFIRSRKEEGAGGDF

SEQ ID NO: 1840590 - protein, 19 aa, Staphylococcus epidermidis
GDGYHFIEPGDGYLACGYV

SEQ ID NO: 1840591 - protein, 23 aa, Staphylococcus epidermidis
GDIDMNAFQHFAFLDQYKKAHKD

SEQ ID NO: 1840592 - protein, 32 aa, Staphylococcus epidermidis
GDSFVNPFVKDVWKYNVAISKAAAKAGFRDIQ

SEQ ID NO: 1840593 - protein, 17 aa, Staphylococcus epidermidis
GDTGYFFNTAYLPEGAL

SEQ ID NO: 1840594 - protein, 17 aa, Staphylococcus epidermidis
GDTGYFFNTAYLPNGAL

SEQ ID NO: 1840595 - protein, 26 aa, Staphylococcus epidermidis
GDYKCAYCKQIEASIVPKLKKDYINK

SEQ ID NO: 1840596 - protein, 19 aa, Staphylococcus epidermidis
GEQFFKDNFSLNVKATNVV

SEQ ID NO: 1840597 - protein, 17 aa, Staphylococcus epidermidis
GETNFTFTDDRGTDSLD

SEQ ID NO: 1840598 - protein, 24 aa, Staphylococcus epidermidis
GGCFWCMVKPFSSYPGIKSVVSGY

SEQ ID NO: 1840599 - protein, 25 aa, Staphylococcus epidermidis
GGDDRPYHGFKRFNTPSSIAKDLVD

SEQ ID NO: 1840600 - protein, 17 aa, Staphylococcus epidermidis
GGGERKSIHTYQLEALP

SEQ ID NO: 1840601 - protein, 24 aa, Staphylococcus epidermidis
GGKDVDIDLGFSQWGLKQQPNESY

SEQ ID NO: 1840602 - protein, 24 aa, Staphylococcus epidermidis
GGQAYWSFGGLFLVNSKVQRRYGV

SEQ ID NO: 1840603 - protein, 18 aa, Staphylococcus epidermidis
GGQTIRQLEELLRHGNPE

SEQ ID NO: 1840604 - protein, 22 aa, Staphylococcus epidermidis
GGRFGDLVFDTLGFKPADKKVS

SEQ ID NO: 1840605 - protein, 18 aa, Staphylococcus epidermidis
GGRVDYGAAHAAKYGHKR

SEQ ID NO: 1840606 - protein, 22 aa, Staphylococcus epidermidis
GGTLKVGMPAAPTGVYSSILSS

SEQ ID NO: 1840607 - protein, 18 aa, Staphylococcus epidermidis
GGVEHKHNSAVFINEDVQ

SEQ ID NO: 1840608 - protein, 25 aa, Staphylococcus epidermidis
GHSHTAIKHGMKFHNDILAQTGTAL

SEQ ID NO: 1840609 - protein, 19 aa, Staphylococcus epidermidis
GIDFQKLIHRRTGNHIQDL

SEQ ID NO: 1840610 - protein, 17 aa, Staphylococcus epidermidis
GIPESKNLGGFPITGQF

SEQ ID NO: 1840611 - protein, 18 aa, Staphylococcus epidermidis
GKFPKRSVWINFDDMDQT

SEQ ID NO: 1840612 - protein, 21 aa, Staphylococcus epidermidis
GKKKLAIALDLDETVLDNSPY

SEQ ID NO: 1840613 - protein, 17 aa, Staphylococcus epidermidis
GKTYAGAYREWQPGQKI

SEQ ID NO: 1840614 - protein, 18 aa, Staphylococcus epidermidis
GKVKPLLVKNYHQVSDNQ

SEQ ID NO: 1840615 - protein, 24 aa, Staphylococcus epidermidis
GKVNLKNGDPFTIALFGVDSDAER

SEQ ID NO: 1840616 - protein, 22 aa, Staphylococcus epidermidis
GKVYEFHLKKNVKFSDGSALDA

SEQ ID NO: 1840617 - protein, 19 aa, Staphylococcus epidermidis
GLASLDVVRYVTAHHPNLP

SEQ ID NO: 1840618 - protein, 30 aa, Staphylococcus epidermidis
GLQQCLKNKIPLVLVSRSFNGIVSPVYAYE

SEQ ID NO: 1840619 - protein, 28 aa, Staphylococcus epidermidis
GLVLIMFVLCGFIFPLTVTALGQVLFPE

SEQ ID NO: 1840620 - protein, 18 aa, Staphylococcus epidermidis
GLYSIAWGTKNQQLLPSN

SEQ ID NO: 1840621 - protein, 24 aa, Staphylococcus epidermidis
GMHPHVIEPVKWVEGKDGNKTLVA

SEQ ID NO: 1840622 - protein, 24 aa, Staphylococcus epidermidis
GNKTFKGNLTILMTPARSIVKENF

SEQ ID NO: 1840623 - protein, 17 aa, Staphylococcus epidermidis
GNLPATCLSGLQHCLDK

SEQ ID NO: 1840624 - protein, 23 aa, Staphylococcus epidermidis
GNRYDVGEKLGFVKTTIEYALKD

SEQ ID NO: 1840625 - protein, 39 aa, Staphylococcus epidermidis
GNVPLEKVVSLFLKECEDYGIDFKKLIYRRTGNHVKDLE

SEQ ID NO: 1840626 - protein, 22 aa, Staphylococcus epidermidis
GPLKALHGFDYFSTMQQAIHRY

SEQ ID NO: 1840627 - protein, 19 aa, Staphylococcus epidermidis
GPRSDLRNAIEKQLVGCGF

SEQ ID NO: 1840628 - protein, 19 aa, Staphylococcus epidermidis
GQGAAFSEAAKKYGINEIY

SEQ ID NO: 1840629 - protein, 28 aa, Staphylococcus epidermidis
GQGTVWTHYAISRYLGGTDHTDPHQYFR

SEQ ID NO: 1840630 - protein, 17 aa, Staphylococcus epidermidis
GQKAWDGYIKQVEKEQE

SEQ ID NO: 1840631 - protein, 20 aa, Staphylococcus epidermidis
GQMKQAIRFVKDNHLKHLLV

SEQ ID NO: 1840632 - protein, 24 aa, Staphylococcus epidermidis
GQPFNEIYCATKFGVEGYTEALSS

SEQ ID NO: 1840633 - protein, 19 aa, Staphylococcus epidermidis
GQTKINGWDTIKEKSALLP

SEQ ID NO: 1840634 - protein, 27 aa, Staphylococcus epidermidis
GRFVEEKGRVIGMPKLKGLKNKENPDL

SEQ ID NO: 1840635 - protein, 28 aa, Staphylococcus epidermidis
GRQKADINIKFSYLVTANVIGKAPEKEW

SEQ ID NO: 1840636 - protein, 29 aa, Staphylococcus epidermidis
GRQKADYNLFFPFTITANVIGKATEKEWR

SEQ ID NO: 1840637 - protein, 22 aa, Staphylococcus epidermidis
GRSLEVFGVQMLQYGDVALVYT

SEQ ID NO: 1840638 - protein, 17 aa, Staphylococcus epidermidis
GRTHLMGSGPVEIGSLV

SEQ ID NO: 1840639 - protein, 21 aa, Staphylococcus epidermidis
GSFFRQRLGDEVLENLIEPLM

SEQ ID NO: 1840640 - protein, 21 aa, Staphylococcus epidermidis
GSFFRQRLGNEVLENLIEPLM

SEQ ID NO: 1840641 - protein, 17 aa, Staphylococcus epidermidis
GSVNPGGGMPMVTLSGL

SEQ ID NO: 1840642 - protein, 19 aa, Staphylococcus epidermidis
GTETGLWLEEAGAPYNILT

SEQ ID NO: 1840643 - protein, 17 aa, Staphylococcus epidermidis
GTLRLGLYPCHIKEGTL

SEQ ID NO: 1840644 - protein, 17 aa, Staphylococcus epidermidis
GTMGYGYQQYIKKHPNQ

SEQ ID NO: 1840645 - protein, 18 aa, Staphylococcus epidermidis
GTVFGIGVSAEMPQVKEA

SEQ ID NO: 1840646 - protein, 17 aa, Staphylococcus epidermidis
GTVLSGFEYRANKEKMD

SEQ ID NO: 1840647 - protein, 25 aa, Staphylococcus epidermidis
GTVNGKSGWISKYYLTTPSSSNTKP

SEQ ID NO: 1840648 - protein, 25 aa, Staphylococcus epidermidis
GTVNGKSGWVSKYYLTTPTQSKVAV

SEQ ID NO: 1840649 - protein, 25 aa, Staphylococcus epidermidis
GVTKKEYSQLQGRINTLYEEGAQDK

SEQ ID NO: 1840650 - protein, 18 aa, Staphylococcus epidermidis
GVVSIITGVTIFIGGQQA

SEQ ID NO: 1840651 - protein, 26 aa, Staphylococcus epidermidis
GVYKDWKPGQKVHLVGHSMGGQTIRQ

SEQ ID NO: 1840652 - protein, 17 aa, Staphylococcus epidermidis
GYDVSLIDGWEPQVTSI

SEQ ID NO: 1840653 - protein, 19 aa, Staphylococcus epidermidis
GYKPKELTVQFVPSQNADK

SEQ ID NO: 1840654 - protein, 23 aa, Staphylococcus epidermidis
GYNSWCAGYTMSALLNATYSTNR

SEQ ID NO: 1840655 - protein, 17 aa, Staphylococcus epidermidis
GYTVIARADATSHGTVT

SEQ ID NO: 1840656 - protein, 19 aa, Staphylococcus epidermidis
HAQVVAKARHDWIQEVRNL

SEQ ID NO: 1840657 - protein, 17 aa, Staphylococcus epidermidis
HEGNGILNGGAQGNKSN

SEQ ID NO: 1840658 - protein, 26 aa, Staphylococcus epidermidis
HFQGSWRDADYSKRESQRIIDDARTV

SEQ ID NO: 1840659 - protein, 26 aa, Staphylococcus epidermidis
HGEYDPHIWLEPKMDQTFAKEIKDTL

SEQ ID NO: 1840660 - protein, 17 aa, Staphylococcus epidermidis
HGNGFLNGGLQGNKNNG

SEQ ID NO: 1840661 - protein, 24 aa, Staphylococcus epidermidis
HGNSVPRFHITWGTGPGLVEPFTN

SEQ ID NO: 1840662 - protein, 25 aa, Staphylococcus epidermidis
HHFKLPMYRLTEIPKDTSYDIVFLF

SEQ ID NO: 1840663 - protein, 17 aa, Staphylococcus epidermidis
HHLKHLLVETSVDKKAM

SEQ ID NO: 1840664 - protein, 22 aa, Staphylococcus epidermidis
HITAPSEYYVWGAGAKANPYFY

SEQ ID NO: 1840665 - protein, 17 aa, Staphylococcus epidermidis
HKMKHSGMYMTKEIASG

SEQ ID NO: 1840666 - protein, 19 aa, Staphylococcus epidermidis
HKNSALALNYHRVRKNDPL

SEQ ID NO: 1840667 - protein, 30 aa, Staphylococcus epidermidis
HQNVILCYIYKFRARFAVLARIVSLREGLP

SEQ ID NO: 1840668 - protein, 19 aa, Staphylococcus epidermidis
HQPAQSIPQQSSQPNHNQS

SEQ ID NO: 1840669 - protein, 19 aa, Staphylococcus epidermidis
HQVFLNWFSHNPAFDYFKN

SEQ ID NO: 1840670 - protein, 18 aa, Staphylococcus epidermidis
HQYRVMAFNAYNKSIENL

SEQ ID NO: 1840671 - protein, 21 aa, Staphylococcus epidermidis
HRYGRTYKGIMRDWEPGKKIH

SEQ ID NO: 1840672 - protein, 27 aa, Staphylococcus epidermidis
HSNHENMIYWFAIPRDQTPAGPVTLTI

SEQ ID NO: 1840673 - protein, 18 aa, Staphylococcus epidermidis
HSQKWPHAVDQGIYNGGG

SEQ ID NO: 1840674 - protein, 19 aa, Staphylococcus epidermidis
HTIHLKKSETAHVGTFPLG

SEQ ID NO: 1840675 - protein, 21 aa, Staphylococcus epidermidis
HYAPKTSLEFQKLMFNQQKDE

SEQ ID NO: 1840676 - protein, 19 aa, Staphylococcus epidermidis
IAIKDEGIGIVPELQSRIF

SEQ ID NO: 1840677 - protein, 28 aa, Staphylococcus epidermidis
IAILSIVFIGLVLFVVSFAKDTLFNNDT

SEQ ID NO: 1840678 - protein, 17 aa, Staphylococcus epidermidis
IALVFVLAACGNNDSSS

SEQ ID NO: 1840679 - protein, 20 aa, Staphylococcus epidermidis
IASSNAQMWKDITLNNQNHI

SEQ ID NO: 1840680 - protein, 18 aa, Staphylococcus epidermidis
IDDEGVFIPVSYGRMTVV

SEQ ID NO: 1840681 - protein, 17 aa, Staphylococcus epidermidis
IDEAFKIQDAKARSKAY

SEQ ID NO: 1840682 - protein, 17 aa, Staphylococcus epidermidis
IDEAFKIQNAKERSKAY

SEQ ID NO: 1840683 - protein, 22 aa, Staphylococcus epidermidis
IDELTIYYSHYVSVLENKPTTK

SEQ ID NO: 1840684 - protein, 18 aa, Staphylococcus epidermidis
IDKVEAYEGHPLDTDTYT

SEQ ID NO: 1840685 - protein, 27 aa, Staphylococcus epidermidis
IDYAKRVQNSKLWKSQDNGFYDLTRDG

SEQ ID NO: 1840686 - protein, 20 aa, Staphylococcus epidermidis
IENFKFFVQYGDFKNLKDYK

SEQ ID NO: 1840687 - protein, 19 aa, Staphylococcus epidermidis
IEPNHPFQVKIKLKGYPSN

SEQ ID NO: 1840688 - protein, 17 aa, Staphylococcus epidermidis
IERLPLQWRNFFSNGET

SEQ ID NO: 1840689 - protein, 28 aa, Staphylococcus epidermidis
IGGTKALDLELGFSQWGFKQKPNESYAE

SEQ ID NO: 1840690 - protein, 17 aa, Staphylococcus epidermidis
IGTHFKIKLASNDIELP

SEQ ID NO: 1840691 - protein, 22 aa, Staphylococcus epidermidis
IHKNKIEAIMKFGVNHELTVIS

SEQ ID NO: 1840692 - protein, 24 aa, Staphylococcus epidermidis
IHTWKKFKDKVLFTGIFNSQEAHD

SEQ ID NO: 1840693 - protein, 19 aa, Staphylococcus epidermidis
IIEYLKENLNWIWNSLSVK

SEQ ID NO: 1840694 - protein, 23 aa, Staphylococcus epidermidis
IIFFASGTMTWFTIDKNKYDNRH

SEQ ID NO: 1840695 - protein, 18 aa, Staphylococcus epidermidis
IIFFLAFLFVSGLALATD

SEQ ID NO: 1840696 - protein, 26 aa, Staphylococcus epidermidis
IIHLLDRMGVMFSRTNEGLLDFRRFG

SEQ ID NO: 1840697 - protein, 22 aa, Staphylococcus epidermidis
IILICALGFSLYAAINHHTNSN

SEQ ID NO: 1840698 - protein, 17 aa, Staphylococcus epidermidis
IISLGLVGCSDQSSDSH

SEQ ID NO: 1840699 - protein, 19 aa, Staphylococcus epidermidis
IIYAKDVKQVLNYVEKGNA

SEQ ID NO: 1840700 - protein, 19 aa, Staphylococcus epidermidis
IKEKLNYYIVLQRNNLAID

SEQ ID NO: 1840701 - protein, 17 aa, Staphylococcus epidermidis
IKGGRVDYGAAHAAKYG

SEQ ID NO: 1840702 - protein, 23 aa, Staphylococcus epidermidis
IKGSGSIKNGFSINNNDDQELFK

SEQ ID NO: 1840703 - protein, 18 aa, Staphylococcus epidermidis
IKKREVTYKKSLKSGYIN

SEQ ID NO: 1840704 - protein, 17 aa, Staphylococcus epidermidis
IKKTYCSEIVWYSYYKA

SEQ ID NO: 1840705 - protein, 30 aa, Staphylococcus epidermidis
IKQKNINGVKWYYGQLLDGKYVWIKSTDLV

SEQ ID NO: 1840706 - protein, 19 aa, Staphylococcus epidermidis
IKQRGEIRVGLSADYAPLE

SEQ ID NO: 1840707 - protein, 17 aa, Staphylococcus epidermidis
IKVRLIGVDTPETVKPN

SEQ ID NO: 1840708 - protein, 27 aa, Staphylococcus epidermidis
ILEKESGLKCGDDFFVGYSPERINPGD

SEQ ID NO: 1840709 - protein, 18 aa, Staphylococcus epidermidis
ILILIIVLFFLLRNYNPP

SEQ ID NO: 1840710 - protein, 20 aa, Staphylococcus epidermidis
ILLNNNIHLIGGHPMAGSHK

SEQ ID NO: 1840711 - protein, 18 aa, Staphylococcus epidermidis
ILLSCGITKNVQAATNQP

SEQ ID NO: 1840712 - protein, 19 aa, Staphylococcus epidermidis
ILTTCSFSYITFSKLTSET

SEQ ID NO: 1840713 - protein, 19 aa, Staphylococcus epidermidis
INIKFKGANKLSDKSEKVQ

SEQ ID NO: 1840714 - protein, 25 aa, Staphylococcus epidermidis
INNSWPNGMYFDWAQGSSAPTSNTP

SEQ ID NO: 1840715 - protein, 17 aa, Staphylococcus epidermidis
INNYLIPEFKKYKKSTQ

SEQ ID NO: 1840716 - protein, 18 aa, Staphylococcus epidermidis
INVSPFLSKILNQYKNQK

SEQ ID NO: 1840717 - protein, 17 aa, Staphylococcus epidermidis
IPAAGLGTRFLPATKAM

SEQ ID NO: 1840718 - protein, 25 aa, Staphylococcus epidermidis
IPQSEVYDIVFLFPKSMQLKHVLED

SEQ ID NO: 1840719 - protein, 22 aa, Staphylococcus epidermidis
IPRDTISYIPKVGYYDKITHAH

SEQ ID NO: 1840720 - protein, 17 aa, Staphylococcus epidermidis
IPSKIKNGVSYYDISLS

SEQ ID NO: 1840721 - protein, 25 aa, Staphylococcus epidermidis
IQGYNLFHIYPIFPIPERQRFLEQL

SEQ ID NO: 1840722 - protein, 25 aa, Staphylococcus epidermidis
IQLFMKSYTGMNNWETNFKNLSQMS

SEQ ID NO: 1840723 - protein, 32 aa, Staphylococcus epidermidis
IQYVKRVQNSKLWKSEDSGLHDLTRDGATDLN

SEQ ID NO: 1840724 - protein, 17 aa, Staphylococcus epidermidis
IRFVKDNHLKHLLVETS

SEQ ID NO: 1840725 - protein, 24 aa, Staphylococcus epidermidis
IRIDGGVMAYTWPGEMLSDESWKN

SEQ ID NO: 1840726 - protein, 26 aa, Staphylococcus epidermidis
IRKEPSIPHNFTFHLLFSNNKLKIND

SEQ ID NO: 1840727 - protein, 17 aa, Staphylococcus epidermidis
ISKQFWSHLVKNKSISN

SEQ ID NO: 1840728 - protein, 24 aa, Staphylococcus epidermidis
ISLSSMFLFSACGQNSNETSHNNN

SEQ ID NO: 1840729 - protein, 18 aa, Staphylococcus epidermidis
ISPGEFIAGATADDGQTK

SEQ ID NO: 1840730 - protein, 21 aa, Staphylococcus epidermidis
ISTIFLLAACNNGQKDNQSNK

SEQ ID NO: 1840731 - protein, 18 aa, Staphylococcus epidermidis
ITANVIGKATEKEWREND

SEQ ID NO: 1840732 - protein, 21 aa, Staphylococcus epidermidis
ITCVEAAPKMLPMFSDELVSY

SEQ ID NO: 1840733 - protein, 26 aa, Staphylococcus epidermidis
ITENEIRKSIKLYLDKNEELSEASEY

SEQ ID NO: 1840734 - protein, 21 aa, Staphylococcus epidermidis
ITGYQYEPWHLRYLGKKKATK

SEQ ID NO: 1840735 - protein, 20 aa, Staphylococcus epidermidis
ITHAHAYGGPIASMDSVEAT

SEQ ID NO: 1840736 - protein, 23 aa, Staphylococcus epidermidis
ITIGCLYAYSIDFIHGVAITALI

SEQ ID NO: 1840737 - protein, 23 aa, Staphylococcus epidermidis
ITITTLLAGCDFGDLVGQHQSGK

SEQ ID NO: 1840738 - protein, 20 aa, Staphylococcus epidermidis
ITLKALIEASMTYSDNTANN

SEQ ID NO: 1840739 - protein, 23 aa, Staphylococcus epidermidis
ITNEIKERLLLAGESTNADVVIT

SEQ ID NO: 1840740 - protein, 17 aa, Staphylococcus epidermidis
ITPSSVWTAGVTVKQDE

SEQ ID NO: 1840741 - protein, 17 aa, Staphylococcus epidermidis
ITRIASSNAQMWKDITL

SEQ ID NO: 1840742 - protein, 21 aa, Staphylococcus epidermidis
ITTSPKIAHWNVKVDAQTGKV

SEQ ID NO: 1840743 - protein, 17 aa, Staphylococcus epidermidis
ITVPKYIKNIDIKTNDG

SEQ ID NO: 1840744 - protein, 24 aa, Staphylococcus epidermidis
IVAIAVALALIFAIKTFVAKPYTI

SEQ ID NO: 1840745 - protein, 27 aa, Staphylococcus epidermidis
IVIGAICGAVDYLARNGFLNKYKHTGN

SEQ ID NO: 1840746 - protein, 18 aa, Staphylococcus epidermidis
IVKENFKEKRFMIKADNT

SEQ ID NO: 1840747 - protein, 22 aa, Staphylococcus epidermidis
IVLTSSVLLAGCTVDKKEIKKY

SEQ ID NO: 1840748 - protein, 21 aa, Staphylococcus epidermidis
IVLTSTVLLAGCTTDKKEIKK

SEQ ID NO: 1840749 - protein, 19 aa, Staphylococcus epidermidis
IVLVSRSFNGIVSPVYAYE

SEQ ID NO: 1840750 - protein, 22 aa, Staphylococcus epidermidis
IVRQLVYDVGKMYGNKDTRVDF

SEQ ID NO: 1840751 - protein, 17 aa, Staphylococcus epidermidis
IVSGPVYFTLESHKANA

SEQ ID NO: 1840752 - protein, 26 aa, Staphylococcus epidermidis
IYGDGDGRTFIPLSGANDIVAHEITH

SEQ ID NO: 1840753 - protein, 18 aa, Staphylococcus epidermidis
IYISLLFLIILVIGCGDG

SEQ ID NO: 1840754 - protein, 17 aa, Staphylococcus epidermidis
IYISLLILVSGCGNGKE

SEQ ID NO: 1840755 - protein, 18 aa, Staphylococcus epidermidis
IYISLLILVSGCGNGKET

SEQ ID NO: 1840756 - protein, 25 aa, Staphylococcus epidermidis
KADNTYKVKDIRLFINDKDKGKLEE

SEQ ID NO: 1840757 - protein, 19 aa, Staphylococcus epidermidis
KALSEVCPEKGTPADNAPI

SEQ ID NO: 1840758 - protein, 24 aa, Staphylococcus epidermidis
KAPEKEWRVNDGLVSVISAQHPFN

SEQ ID NO: 1840759 - protein, 18 aa, Staphylococcus epidermidis
KAQNKVQYPQGAANKNPQ

SEQ ID NO: 1840760 - protein, 20 aa, Staphylococcus epidermidis
KAQTAHSYWYKYNGYTASGG

SEQ ID NO: 1840761 - protein, 19 aa, Staphylococcus epidermidis
KARHDWIQEVRNLMSEYLS

SEQ ID NO: 1840762 - protein, 21 aa, Staphylococcus epidermidis
KATEFPRIQLFMKSYTGMNNW

SEQ ID NO: 1840763 - protein, 21 aa, Staphylococcus epidermidis
KAVKFSIDRAKAMNKNTTVET

SEQ ID NO: 1840764 - protein, 19 aa, Staphylococcus epidermidis
KCIVTTIFVLSSLLLVFSS

SEQ ID NO: 1840765 - protein, 19 aa, Staphylococcus epidermidis
KDANIGMVFNWNPTAKQLT

SEQ ID NO: 1840766 - protein, 18 aa, Staphylococcus epidermidis
KDAYPKERLNHIPHTSSD

SEQ ID NO: 1840767 - protein, 23 aa, Staphylococcus epidermidis
KDDPRIINQFVLVNYPKFSNAPK

SEQ ID NO: 1840768 - protein, 17 aa, Staphylococcus epidermidis
KDEFLDHRVIKHYGSLV

SEQ ID NO: 1840769 - protein, 19 aa, Staphylococcus epidermidis
KDHISPLIDKQITDINKTN

SEQ ID NO: 1840770 - protein, 17 aa, Staphylococcus epidermidis
KDKEDKYHYTGFTDEAI

SEQ ID NO: 1840771 - protein, 23 aa, Staphylococcus epidermidis
KDKGTWIVGSTMTIEPKGKYMES

SEQ ID NO: 1840772 - protein, 18 aa, Staphylococcus epidermidis
KDSRKLLRAAAVGKQGAD

SEQ ID NO: 1840773 - protein, 21 aa, Staphylococcus epidermidis
KDSVRYQMNMLKQQMKSNEKL

SEQ ID NO: 1840774 - protein, 24 aa, Staphylococcus epidermidis
KDTSYDIVFLFPKSMQLEEVLSHI

SEQ ID NO: 1840775 - protein, 18 aa, Staphylococcus epidermidis
KEAIKDHISPLIDKQITD

SEQ ID NO: 1840776 - protein, 18 aa, Staphylococcus epidermidis
KEEGRLRSFTIVPTSNLA

SEQ ID NO: 1840777 - protein, 17 aa, Staphylococcus epidermidis
KEEGRLRSYTIVPTSNL

SEQ ID NO: 1840778 - protein, 21 aa, Staphylococcus epidermidis
KEFRIVPTTVALTMTLDKLDL

SEQ ID NO: 1840779 - protein, 17 aa, Staphylococcus epidermidis
KEHGGTISPLYKGNNDN

SEQ ID NO: 1840780 - protein, 17 aa, Staphylococcus epidermidis
KEINEQFEISKQFWGHL

SEQ ID NO: 1840781 - protein, 21 aa, Staphylococcus epidermidis
KEKEQQAIVNFVKRGGSVIFI

SEQ ID NO: 1840782 - protein, 25 aa, Staphylococcus epidermidis
KEKKHPKVLILMGIPGSYLVATDQS

SEQ ID NO: 1840783 - protein, 20 aa, Staphylococcus epidermidis
KEKYKAHDAYAKAYKKALNK

SEQ ID NO: 1840784 - protein, 24 aa, Staphylococcus epidermidis
KENCPDLRNTKVIHIIEELIDYGL

SEQ ID NO: 1840785 - protein, 17 aa, Staphylococcus epidermidis
KESILSVILPQYVESLI

SEQ ID NO: 1840786 - protein, 20 aa, Staphylococcus epidermidis
KESTLYKGPYDAFRKDFSHK

SEQ ID NO: 1840787 - protein, 19 aa, Staphylococcus epidermidis
KEVRKVGSNVLVIAPHGGN

SEQ ID NO: 1840788 - protein, 23 aa, Staphylococcus epidermidis
KEWREYDYLFLTFGTFSYHDPYH

SEQ ID NO: 1840789 - protein, 24 aa, Staphylococcus epidermidis
KGHHPATHSLSWFKKRYAKKGKWM

SEQ ID NO: 1840790 - protein, 20 aa, Staphylococcus epidermidis
KGISEALLRSEAPKLYVSNV

SEQ ID NO: 1840791 - protein, 23 aa, Staphylococcus epidermidis
KGQFKQFRHGLSSFIEALAKDVQ

SEQ ID NO: 1840792 - protein, 22 aa, Staphylococcus epidermidis
KGQGVLEGQGAAFSEAAKKYGI

SEQ ID NO: 1840793 - protein, 20 aa, Staphylococcus epidermidis
KGQSEPIVLVIFTNKDNKSD

SEQ ID NO: 1840794 - protein, 24 aa, Staphylococcus epidermidis
KGSIGTAIVRVFKMAAASTGLNER

SEQ ID NO: 1840795 - protein, 28 aa, Staphylococcus epidermidis
KHDSCYAKHGWGACACDAPFIRATNKII

SEQ ID NO: 1840796 - protein, 27 aa, Staphylococcus epidermidis
KHGQSRFTSHHPMKINTYKKGQCTYYV

SEQ ID NO: 1840797 - protein, 30 aa, Staphylococcus epidermidis
KHGRTDMGARPYAGIAPRGMTSKQYSELEY

SEQ ID NO: 1840798 - protein, 39 aa, Staphylococcus epidermidis
KIDKKAYNITLEFYNTYVYKKGMPKFEEATSDMPAEEYK

SEQ ID NO: 1840799 - protein, 24 aa, Staphylococcus epidermidis
KIEFKIKKGIKWHDGNELTIDDWI

SEQ ID NO: 1840800 - protein, 20 aa, Staphylococcus epidermidis
KILFITSFAMILAIVSNHNQ

SEQ ID NO: 1840801 - protein, 19 aa, Staphylococcus epidermidis
KIPATGFVITGHIGQQNFH

SEQ ID NO: 1840802 - protein, 19 aa, Staphylococcus epidermidis
KKDEKTFKGLKGVTYKVDY

SEQ ID NO: 1840803 - protein, 24 aa, Staphylococcus epidermidis
KKDKGTWIVGSTMTIEPKGKYMES

SEQ ID NO: 1840804 - protein, 20 aa, Staphylococcus epidermidis
KKEILNRIGEYYFGSDDITI

SEQ ID NO: 1840805 - protein, 20 aa, Staphylococcus epidermidis
KKEYGYSFGTVRPMQIGLVY

SEQ ID NO: 1840806 - protein, 18 aa, Staphylococcus epidermidis
KKGFFLMVEGASIDKAAH

SEQ ID NO: 1840807 - protein, 23 aa, Staphylococcus epidermidis
KKGKKAKGLATYQLKNDNKVVLH

SEQ ID NO: 1840808 - protein, 31 aa, Staphylococcus epidermidis
KKGVWQVMPVKHGWDHGDFVGSDSSEVRISV

SEQ ID NO: 1840809 - protein, 20 aa, Staphylococcus epidermidis
KKHGKAYLAELEKLNKNSKN

SEQ ID NO: 1840810 - protein, 24 aa, Staphylococcus epidermidis
KKHSDAVIVSAHWGNEGQHKQNKT

SEQ ID NO: 1840811 - protein, 23 aa, Staphylococcus epidermidis
KKIHVYRPPYMIYGDDDVEGKAI

SEQ ID NO: 1840812 - protein, 19 aa, Staphylococcus epidermidis
KKILYYSYENFMINHVANA

SEQ ID NO: 1840813 - protein, 18 aa, Staphylococcus epidermidis
KKIVKREINYKKSSKSGY

SEQ ID NO: 1840814 - protein, 23 aa, Staphylococcus epidermidis
KKKKMWYGHYCGKGDIGGKPIDA

SEQ ID NO: 1840815 - protein, 21 aa, Staphylococcus epidermidis
KKLHSWLKISTLIDNVKVKDK

SEQ ID NO: 1840816 - protein, 20 aa, Staphylococcus epidermidis
KKLKWIWITTLIILVVALIL

SEQ ID NO: 1840817 - protein, 17 aa, Staphylococcus epidermidis
KKNGIQYGFTLQEKAVT

SEQ ID NO: 1840818 - protein, 20 aa, Staphylococcus epidermidis
KKRKELYVQWQKYMNEELPA

SEQ ID NO: 1840819 - protein, 21 aa, Staphylococcus epidermidis
KKVREALDMIINRKDIAKNIS

SEQ ID NO: 1840820 - protein, 19 aa, Staphylococcus epidermidis
KKYPGNGDLSILKVQPNED

SEQ ID NO: 1840821 - protein, 17 aa, Staphylococcus epidermidis
KKYRYGINTHLSKRNPT

SEQ ID NO: 1840822 - protein, 19 aa, Staphylococcus epidermidis
KLILLIGIILLSGISLYGC

SEQ ID NO: 1840823 - protein, 24 aa, Staphylococcus epidermidis
KLKYEKNSALALNYHRVRKKDPLN

SEQ ID NO: 1840824 - protein, 26 aa, Staphylococcus epidermidis
KLVVVLCAIIVFIALIGLSIRSQTQS

SEQ ID NO: 1840825 - protein, 26 aa, Staphylococcus epidermidis
KNARYSLKPYYDKTFVVSKQKNINGV

SEQ ID NO: 1840826 - protein, 23 aa, Staphylococcus epidermidis
KNDNKVVLHFSKGIGGDKLGTKE

SEQ ID NO: 1840827 - protein, 18 aa, Staphylococcus epidermidis
KNGDGFVSTSEMTPEAWK

SEQ ID NO: 1840828 - protein, 33 aa, Staphylococcus epidermidis
KNGKRVFKPSTVIKRNGVRYGIIGVTTPETKIK

SEQ ID NO: 1840829 - protein, 21 aa, Staphylococcus epidermidis
KNGKVKPLLVKKYHQVSDNQL

SEQ ID NO: 1840830 - protein, 25 aa, Staphylococcus epidermidis
KNHDPIILVHGFNGFTDDINPTVLS

SEQ ID NO: 1840831 - protein, 25 aa, Staphylococcus epidermidis
KNHDPIILVHGFNGYTADNGPALAG

SEQ ID NO: 1840832 - protein, 25 aa, Staphylococcus epidermidis
KNIKGMSIGLAMNSVYYYKKEKDGE

SEQ ID NO: 1840833 - protein, 23 aa, Staphylococcus epidermidis
KNIKGMTIGLAMNSVYYYQKEKD

SEQ ID NO: 1840834 - protein, 17 aa, Staphylococcus epidermidis
KNLEDFYDKEGFRDEEF

SEQ ID NO: 1840835 - protein, 20 aa, Staphylococcus epidermidis
KNNMKFGVYSYSMYENAADA

SEQ ID NO: 1840836 - protein, 27 aa, Staphylococcus epidermidis
KNNVKFLKDRYEAMKNFPMFDNIEYTE

SEQ ID NO: 1840837 - protein, 20 aa, Staphylococcus epidermidis
KNPKRIAVVAPSYAGGIKKL

SEQ ID NO: 1840838 - protein, 25 aa, Staphylococcus epidermidis
KNPYKFKSYIGIVIHEVGEDHRSLQ

SEQ ID NO: 1840839 - protein, 18 aa, Staphylococcus epidermidis
KPEFPDRNDDEWLKTTMA

SEQ ID NO: 1840840 - protein, 18 aa, Staphylococcus epidermidis
KPNESYAEYAKRIANSKV

SEQ ID NO: 1840841 - protein, 19 aa, Staphylococcus epidermidis
KPSNSGLYTTVYDEKGHST

SEQ ID NO: 1840842 - protein, 24 aa, Staphylococcus epidermidis
KPVQAGAYDIHFVNNGFEYNFTSN

SEQ ID NO: 1840843 - protein, 18 aa, Staphylococcus epidermidis
KPVYGAKSFLKYADKKGI

SEQ ID NO: 1840844 - protein, 24 aa, Staphylococcus epidermidis
KQGLERFDTLVLTGGLGPTKDDLT

SEQ ID NO: 1840845 - protein, 24 aa, Staphylococcus epidermidis
KQNDIWKHFKAVKNNQVYDLEEIP

SEQ ID NO: 1840846 - protein, 18 aa, Staphylococcus epidermidis
KQNYDFIIIRGQYGSEYV

SEQ ID NO: 1840847 - protein, 23 aa, Staphylococcus epidermidis
KQRTEGNNTYVLLQDGTSNTPLG

SEQ ID NO: 1840848 - protein, 23 aa, Staphylococcus epidermidis
KQRTEGNNTYVLLQDSTRNTPLG

SEQ ID NO: 1840849 - protein, 18 aa, Staphylococcus epidermidis
KQYEYKKVLSKGEHKIDG

SEQ ID NO: 1840850 - protein, 21 aa, Staphylococcus epidermidis
KRALLFEWSRINEMLDKQLYL

SEQ ID NO: 1840851 - protein, 18 aa, Staphylococcus epidermidis
KRAVDRGYGLNFNPFHSN

SEQ ID NO: 1840852 - protein, 24 aa, Staphylococcus epidermidis
KRGQRQMELIKILFQKAQNLNSID

SEQ ID NO: 1840853 - protein, 21 aa, Staphylococcus epidermidis
KRYAKKGKWMKIYRSKKHGAG

SEQ ID NO: 1840854 - protein, 21 aa, Staphylococcus epidermidis
KSEIENFKFFAQYANFKDLND

SEQ ID NO: 1840855 - protein, 20 aa, Staphylococcus epidermidis
KSFDGTGPFKMGQHKKDEYA

SEQ ID NO: 1840856 - protein, 22 aa, Staphylococcus epidermidis
KSIIYRYDATKGIAINTNQVLN

SEQ ID NO: 1840857 - protein, 24 aa, Staphylococcus epidermidis
KSKPELILASFRQAHTKTIDEMKK

SEQ ID NO: 1840858 - protein, 18 aa, Staphylococcus epidermidis
KSLNGLKSNLIFPNQVLK

SEQ ID NO: 1840859 - protein, 25 aa, Staphylococcus epidermidis
KSLPILKNKISLHFGQTKTYRTWWF

SEQ ID NO: 1840860 - protein, 17 aa, Staphylococcus epidermidis
KSLVSLASTERKIDKYQ

SEQ ID NO: 1840861 - protein, 24 aa, Staphylococcus epidermidis
KSNNNEIFIETPFGGINESVKLYA

SEQ ID NO: 1840862 - protein, 24 aa, Staphylococcus epidermidis
KSSERGWKKCAAGIAGGATTGATT

SEQ ID NO: 1840863 - protein, 23 aa, Staphylococcus epidermidis
KSVNNQAWLAAYMLKQNGIKPTL

SEQ ID NO: 1840864 - protein, 18 aa, Staphylococcus epidermidis
KTIMTDLAKDIGLENDLI

SEQ ID NO: 1840865 - protein, 24 aa, Staphylococcus epidermidis
KTKTKYHNVFGIGAYDSSPLIEGI

SEQ ID NO: 1840866 - protein, 20 aa, Staphylococcus epidermidis
KTNWKKCALGTGGSALGGAG

SEQ ID NO: 1840867 - protein, 21 aa, Staphylococcus epidermidis
KVGALESLFKMSKDGKVKPLL

SEQ ID NO: 1840868 - protein, 26 aa, Staphylococcus epidermidis
KVMSEFMKFVLKDEGKSAEDAGYVAS

SEQ ID NO: 1840869 - protein, 26 aa, Staphylococcus epidermidis
KVNNGQEVILIWNPWDNGFMTQDAHS

SEQ ID NO: 1840870 - protein, 17 aa, Staphylococcus epidermidis
KVPIIVGGTGLYIQSLL

SEQ ID NO: 1840871 - protein, 20 aa, Staphylococcus epidermidis
KVPMKIFPAVHYSMGGLYVD

SEQ ID NO: 1840872 - protein, 24 aa, Staphylococcus epidermidis
KVPMKIFPAVHYSMGGLYVDYDQM

SEQ ID NO: 1840873 - protein, 23 aa, Staphylococcus epidermidis
KVQIKDYYGSLVYIINDKGNRDQ

SEQ ID NO: 1840874 - protein, 23 aa, Staphylococcus epidermidis
KVQSGESLWSIAQKYNTSVDSIK

SEQ ID NO: 1840875 - protein, 26 aa, Staphylococcus epidermidis
KVTKYDIISVLPFGNLISQIKVKGSD

SEQ ID NO: 1840876 - protein, 17 aa, Staphylococcus epidermidis
KWTPKIKKMIPSYGQSL

SEQ ID NO: 1840877 - protein, 28 aa, Staphylococcus epidermidis
KYDEKFYHSLGFANTYAFMVTKETAKKY

SEQ ID NO: 1840878 - protein, 19 aa, Staphylococcus epidermidis
KYKEWLEHYNDTIKKGKKA

SEQ ID NO: 1840879 - protein, 24 aa, Staphylococcus epidermidis
KYKKIAATVPFNYQKHKYLEQQEE

SEQ ID NO: 1840880 - protein, 22 aa, Staphylococcus epidermidis
KYMESRGMFLYINRNTRTTKGF

SEQ ID NO: 1840881 - protein, 22 aa, Staphylococcus epidermidis
KYMESRGMFLYINRNTRTTKGY

SEQ ID NO: 1840882 - protein, 20 aa, Staphylococcus epidermidis
KYNHKEILKEIGKLTNNEDK

SEQ ID NO: 1840883 - protein, 19 aa, Staphylococcus epidermidis
KYQVKGIGNDVSYSVKPKT

SEQ ID NO: 1840884 - protein, 21 aa, Staphylococcus epidermidis
KYWPKRLGNAPQHMIQGVPDS

SEQ ID NO: 1840885 - protein, 17 aa, Staphylococcus epidermidis
KYYEELGKSSAAFYSHV

SEQ ID NO: 1840886 - protein, 18 aa, Staphylococcus epidermidis
KYYRDNQVHFTIPVSDNQ

SEQ ID NO: 1840887 - protein, 17 aa, Staphylococcus epidermidis
LADFLASREGKLLGQYG

SEQ ID NO: 1840888 - protein, 18 aa, Staphylococcus epidermidis
LADFLASRKGKLLGQYGI

SEQ ID NO: 1840889 - protein, 17 aa, Staphylococcus epidermidis
LAFIMILAACGNQHNEH

SEQ ID NO: 1840890 - protein, 17 aa, Staphylococcus epidermidis
LAGCGLGDSDNKGSSTI

SEQ ID NO: 1840891 - protein, 17 aa, Staphylococcus epidermidis
LAGNKKILYYSYENFMI

SEQ ID NO: 1840892 - protein, 21 aa, Staphylococcus epidermidis
LASSLILGFSVTPELFNVTQA

SEQ ID NO: 1840893 - protein, 30 aa, Staphylococcus epidermidis
LASTLMLTACGKSNEKASLEKSINQLEKEN

SEQ ID NO: 1840894 - protein, 22 aa, Staphylococcus epidermidis
LCCAICSTVLTTGSVNAQDNSS

SEQ ID NO: 1840895 - protein, 22 aa, Staphylococcus epidermidis
LCCTICGTVLTTGSVNAQGNSS

SEQ ID NO: 1840896 - protein, 22 aa, Staphylococcus epidermidis
LCISFLLITFFIGGCGFINKDD

SEQ ID NO: 1840897 - protein, 18 aa, Staphylococcus epidermidis
LCSLFILTACSASVDKTS

SEQ ID NO: 1840898 - protein, 21 aa, Staphylococcus epidermidis
LDAKNSFSDISGWKSVSKESI

SEQ ID NO: 1840899 - protein, 17 aa, Staphylococcus epidermidis
LDGRQKADINIKFSYLV

SEQ ID NO: 1840900 - protein, 17 aa, Staphylococcus epidermidis
LDKALSIGIIDEKITNY

SEQ ID NO: 1840901 - protein, 19 aa, Staphylococcus epidermidis
LDQPQSLSVAALNELLKGQ

SEQ ID NO: 1840902 - protein, 21 aa, Staphylococcus epidermidis
LDQRVIKRYGSLVPLTELDED

SEQ ID NO: 1840903 - protein, 18 aa, Staphylococcus epidermidis
LDRYFKYTERIYRFTEKG

SEQ ID NO: 1840904 - protein, 23 aa, Staphylococcus epidermidis
LDSNMVFPGQVINVGGSASQSSN

SEQ ID NO: 1840905 - protein, 18 aa, Staphylococcus epidermidis
LEALPTKVEGAPSDMKFY

SEQ ID NO: 1840906 - protein, 18 aa, Staphylococcus epidermidis
LEELLRHGNPEEVEYQKE

SEQ ID NO: 1840907 - protein, 17 aa, Staphylococcus epidermidis
LEFNQLYNYNQLYVEPM

SEQ ID NO: 1840908 - protein, 21 aa, Staphylococcus epidermidis
LEKAKPLLKKKGYDLKIKPIN

SEQ ID NO: 1840909 - protein, 23 aa, Staphylococcus epidermidis
LELTTALRKVFFKNGDTSTKNRT

SEQ ID NO: 1840910 - protein, 24 aa, Staphylococcus epidermidis
LENEIKAQLPFHKSLQMVERDDQT

SEQ ID NO: 1840911 - protein, 26 aa, Staphylococcus epidermidis
LEPNWNIKLFERLDRPGIESSNERNN

SEQ ID NO: 1840912 - protein, 25 aa, Staphylococcus epidermidis
LESAGLIKLKKNFGLNGTTKDIESN

SEQ ID NO: 1840913 - protein, 21 aa, Staphylococcus epidermidis
LEVREDIYGALQISFKNPEDR

SEQ ID NO: 1840914 - protein, 21 aa, Staphylococcus epidermidis
LEVREDIYGALQISFKTPEDR

SEQ ID NO: 1840915 - protein, 18 aa, Staphylococcus epidermidis
LEYNRARQAAITQQITEI

SEQ ID NO: 1840916 - protein, 26 aa, Staphylococcus epidermidis
LFIFIVTTCSFGYITFSKLTSETEDI

SEQ ID NO: 1840917 - protein, 17 aa, Staphylococcus epidermidis
LFMKSYTGTSHWETDFK

SEQ ID NO: 1840918 - protein, 18 aa, Staphylococcus epidermidis
LFSLVPVKRSHSVCAQGG

SEQ ID NO: 1840919 - protein, 30 aa, Staphylococcus epidermidis
LGAYIVKAGDCLYNIALDHGITLDQLYALN

SEQ ID NO: 1840920 - protein, 20 aa, Staphylococcus epidermidis
LGDWADAIIIAPATANTIAK

SEQ ID NO: 1840921 - protein, 20 aa, Staphylococcus epidermidis
LGEQFFKDNFSLNVKATNVV

SEQ ID NO: 1840922 - protein, 20 aa, Staphylococcus epidermidis
LGFESDIAFTLRNFEDTEAI

SEQ ID NO: 1840923 - protein, 20 aa, Staphylococcus epidermidis
LGNDKFYLVEDYNTGKKYGW

SEQ ID NO: 1840924 - protein, 17 aa, Staphylococcus epidermidis
LGNLVIAGMTNITNDFG

SEQ ID NO: 1840925 - protein, 20 aa, Staphylococcus epidermidis
LGNNKFYLVEDYNTGKKYGW

SEQ ID NO: 1840926 - protein, 19 aa, Staphylococcus epidermidis
LGSHDGVGIVYGRDIAGKK

SEQ ID NO: 1840927 - protein, 20 aa, Staphylococcus epidermidis
LGVAGFALTGHEAHASEATN

SEQ ID NO: 1840928 - protein, 17 aa, Staphylococcus epidermidis
LIAVTISSLALVVPLAF

SEQ ID NO: 1840929 - protein, 18 aa, Staphylococcus epidermidis
LIDDLSLEYNRARQAAIT

SEQ ID NO: 1840930 - protein, 30 aa, Staphylococcus epidermidis
LIGHSMGGQTVRLLEEMLRNGNPEEVDYQK

SEQ ID NO: 1840931 - protein, 27 aa, Staphylococcus epidermidis
LIGLSLIIICSVGVYAQNKKLSKDKQY

SEQ ID NO: 1840932 - protein, 17 aa, Staphylococcus epidermidis
LIIAVCLVLAGCSNSSN

SEQ ID NO: 1840933 - protein, 21 aa, Staphylococcus epidermidis
LIKDNFLPYFKEFEKKGIEVF

SEQ ID NO: 1840934 - protein, 17 aa, Staphylococcus epidermidis
LIMPTFTTQTAIAKDDS

SEQ ID NO: 1840935 - protein, 18 aa, Staphylococcus epidermidis
LIPEFKKYKKSTQQLPAK

SEQ ID NO: 1840936 - protein, 17 aa, Staphylococcus epidermidis
LIPFIYFFYTRLTDVRN

SEQ ID NO: 1840937 - protein, 18 aa, Staphylococcus epidermidis
LIQDLFMNDYLRVYTNND

SEQ ID NO: 1840938 - protein, 17 aa, Staphylococcus epidermidis
LISVFLLGIVFSIPVHA

SEQ ID NO: 1840939 - protein, 17 aa, Staphylococcus epidermidis
LITCDDYNEETGVWETR

SEQ ID NO: 1840940 - protein, 18 aa, Staphylococcus epidermidis
LITCDDYNEETGVWETRK

SEQ ID NO: 1840941 - protein, 17 aa, Staphylococcus epidermidis
LITPTFATQTAFAEDSS

SEQ ID NO: 1840942 - protein, 19 aa, Staphylococcus epidermidis
LKAADFIIVAVPTPIDKNN

SEQ ID NO: 1840943 - protein, 20 aa, Staphylococcus epidermidis
LKANPYLTAPQLYSQLLQEQ

SEQ ID NO: 1840944 - protein, 19 aa, Staphylococcus epidermidis
LKDKIALFCDINKESVIEC

SEQ ID NO: 1840945 - protein, 19 aa, Staphylococcus epidermidis
LKDPEKIYGKDDEHINLVF

SEQ ID NO: 1840946 - protein, 17 aa, Staphylococcus epidermidis
LKELIEASMAYSDNTAN

SEQ ID NO: 1840947 - protein, 20 aa, Staphylococcus epidermidis
LKENLNWIWNSLSVKDQEEF

SEQ ID NO: 1840948 - protein, 23 aa, Staphylococcus epidermidis
LKKLFKTTLAKFITTNANEHDYV

SEQ ID NO: 1840949 - protein, 23 aa, Staphylococcus epidermidis
LKKNNIYPIARIVTFKDTKLAKE

SEQ ID NO: 1840950 - protein, 22 aa, Staphylococcus epidermidis
LKNKKLDVAVGYSTDGRIAAYD

SEQ ID NO: 1840951 - protein, 19 aa, Staphylococcus epidermidis
LKPDLIIADSNRHKGIYKD

SEQ ID NO: 1840952 - protein, 18 aa, Staphylococcus epidermidis
LKPLLKLSDVPAQAVGDA

SEQ ID NO: 1840953 - protein, 18 aa, Staphylococcus epidermidis
LKPYLKGVDYIGENDVEK

SEQ ID NO: 1840954 - protein, 24 aa, Staphylococcus epidermidis
LKQLKKLDAGSWFNKAHPEYANKK

SEQ ID NO: 1840955 - protein, 21 aa, Staphylococcus epidermidis
LKSNLIFPNQVLKVSGSSSST

SEQ ID NO: 1840956 - protein, 32 aa, Staphylococcus epidermidis
LKSPHIESICRRILVDGLKVARAEQINFEDHI

SEQ ID NO: 1840957 - protein, 25 aa, Staphylococcus epidermidis
LKTNGRLKGAINIPLDSLRDCMAEL

SEQ ID NO: 1840958 - protein, 17 aa, Staphylococcus epidermidis
LLARLHSQYPYQTPIVG

SEQ ID NO: 1840959 - protein, 21 aa, Staphylococcus epidermidis
LLLCGCSTFKYGNTKKPQDHT

SEQ ID NO: 1840960 - protein, 20 aa, Staphylococcus epidermidis
LLLFGCSTINHHLNKTSQSV

SEQ ID NO: 1840961 - protein, 18 aa, Staphylococcus epidermidis
LLTGCGKSSDGLVGKELK

SEQ ID NO: 1840962 - protein, 23 aa, Staphylococcus epidermidis
LMLSGCSSFDHRKRESINDKNKM

SEQ ID NO: 1840963 - protein, 18 aa, Staphylococcus epidermidis
LMMKGRTGNEIMAASKID

SEQ ID NO: 1840964 - protein, 26 aa, Staphylococcus epidermidis
LNGPKARLKLLVGLSQDMNHQKLKAY

SEQ ID NO: 1840965 - protein, 26 aa, Staphylococcus epidermidis
LNGPKARLKLLVGLSQDMTHNQLERY

SEQ ID NO: 1840966 - protein, 19 aa, Staphylococcus epidermidis
LNKEKELFTYLNQDGATQS

SEQ ID NO: 1840967 - protein, 28 aa, Staphylococcus epidermidis
LNLMGVIRMTKAVLPSMRARREGHIINI

SEQ ID NO: 1840968 - protein, 18 aa, Staphylococcus epidermidis
LNNKDCYTGQGITTKTYK

SEQ ID NO: 1840969 - protein, 18 aa, Staphylococcus epidermidis
LNQYAKFVSHLNDTPSIE

SEQ ID NO: 1840970 - protein, 18 aa, Staphylococcus epidermidis
LNSAVQFSDIYLMALPTK

SEQ ID NO: 1840971 - protein, 20 aa, Staphylococcus epidermidis
LPATCLSGLQHCLDKGIPIV

SEQ ID NO: 1840972 - protein, 25 aa, Staphylococcus epidermidis
LPNRNTDGGFSWSPDHKSIIYRYDA

SEQ ID NO: 1840973 - protein, 21 aa, Staphylococcus epidermidis
LPSMVALTLFGTAFTAHHAHA

SEQ ID NO: 1840974 - protein, 19 aa, Staphylococcus epidermidis
LPVAVTFGKKHEVIGFDIN

SEQ ID NO: 1840975 - protein, 21 aa, Staphylococcus epidermidis
LPYQHVFQAVVYISGQKVNNK

SEQ ID NO: 1840976 - protein, 27 aa, Staphylococcus epidermidis
LQQLPNFKTALDIARKEANMFGNSTKK

SEQ ID NO: 1840977 - protein, 17 aa, Staphylococcus epidermidis
LRAAAVGKQGADKRIDV

SEQ ID NO: 1840978 - protein, 21 aa, Staphylococcus epidermidis
LRLGLYPCHIKEGTLAESIYS

SEQ ID NO: 1840979 - protein, 21 aa, Staphylococcus epidermidis
LSCLLVLGACSNSGNKSTTVS

SEQ ID NO: 1840980 - protein, 21 aa, Staphylococcus epidermidis
LSERTKRYRLKQLLNSRNVEK

SEQ ID NO: 1840981 - protein, 28 aa, Staphylococcus epidermidis
LSGLQHCLDKGIPIVLVSRSFNGIVSPV

SEQ ID NO: 1840982 - protein, 24 aa, Staphylococcus epidermidis
LSNHSLKNGHVMLQSFSGDSLQKL

SEQ ID NO: 1840983 - protein, 27 aa, Staphylococcus epidermidis
LSNLAVKNDLHFKKFIKNNHIPEEYKN

SEQ ID NO: 1840984 - protein, 23 aa, Staphylococcus epidermidis
LSSFLILTACGNKDTSSTKDDKK

SEQ ID NO: 1840985 - protein, 23 aa, Staphylococcus epidermidis
LSSFLVLGACSHTDSSDKKETDS

SEQ ID NO: 1840986 - protein, 17 aa, Staphylococcus epidermidis
LSSLFLVFSTITYASER

SEQ ID NO: 1840987 - protein, 19 aa, Staphylococcus epidermidis
LSSTLILGACSIGTNQDNK

SEQ ID NO: 1840988 - protein, 24 aa, Staphylococcus epidermidis
LSTLRKKKILILISTIILVLGLTY

SEQ ID NO: 1840989 - protein, 18 aa, Staphylococcus epidermidis
LSVILPQYVESLIYGTIL

SEQ ID NO: 1840990 - protein, 24 aa, Staphylococcus epidermidis
LSVTFKRTEDILKYLGDNKRHQYL

SEQ ID NO: 1840991 - protein, 19 aa, Staphylococcus epidermidis
LSYKDATSHLSRSYATDPN

SEQ ID NO: 1840992 - protein, 17 aa, Staphylococcus epidermidis
LTACGSKSTKDLKDFEH

SEQ ID NO: 1840993 - protein, 17 aa, Staphylococcus epidermidis
LTAFLVLAGCNSGDKTD

SEQ ID NO: 1840994 - protein, 18 aa, Staphylococcus epidermidis
LTASSAFIESFDIYQNSK

SEQ ID NO: 1840995 - protein, 17 aa, Staphylococcus epidermidis
LTFNLVIQTAEFPSWKD

SEQ ID NO: 1840996 - protein, 17 aa, Staphylococcus epidermidis
LTGEKFTTIAHRGASGY

SEQ ID NO: 1840997 - protein, 19 aa, Staphylococcus epidermidis
LTGHAAIYIGKGYIKEARG

SEQ ID NO: 1840998 - protein, 17 aa, Staphylococcus epidermidis
LTLSLLLFGCSTINHHL

SEQ ID NO: 1840999 - protein, 19 aa, Staphylococcus epidermidis
LTQVRPLRIMSPHSVEGNK

SEQ ID NO: 1841000 - protein, 19 aa, Staphylococcus epidermidis
LTVDLPIDYYGQAETIGIT

SEQ ID NO: 1841001 - protein, 25 aa, Staphylococcus epidermidis
LVEDYNTGKKYGWVKQDDVVYNTAK

SEQ ID NO: 1841002 - protein, 25 aa, Staphylococcus epidermidis
LVEDYNTGKKYGWVKQGDVVYNTAK

SEQ ID NO: 1841003 - protein, 24 aa, Staphylococcus epidermidis
LVLSGCSLPGLGDGNAKDDVKITT

SEQ ID NO: 1841004 - protein, 19 aa, Staphylococcus epidermidis
LVPEGKESVDIIVNLLQNA

SEQ ID NO: 1841005 - protein, 25 aa, Staphylococcus epidermidis
LVSEMNWSAAPGYMTYRTIPAYQVR

SEQ ID NO: 1841006 - protein, 21 aa, Staphylococcus epidermidis
LVSSLILGFSVTPELFNVTQA

SEQ ID NO: 1841007 - protein, 22 aa, Staphylococcus epidermidis
LYDMVKRVGGNKVDAHSIVPVG

SEQ ID NO: 1841008 - protein, 17 aa, Staphylococcus epidermidis
LYKDIDEAFKIQNAKER

SEQ ID NO: 1841009 - protein, 27 aa, Staphylococcus epidermidis
LYLRINKRVDIMLGHGLFNEVKHLVEQ

SEQ ID NO: 1841010 - protein, 27 aa, Staphylococcus epidermidis
LYLRINKRVDIMLGHGLFNEVQHLVEQ

SEQ ID NO: 1841011 - protein, 18 aa, Staphylococcus epidermidis
LYQAFGLKMSKGQHDLTK

SEQ ID NO: 1841012 - protein, 23 aa, Staphylococcus epidermidis
LYTVPWGTPSQVASKVSGSGNQT

SEQ ID NO: 1841013 - protein, 28 aa, Staphylococcus epidermidis
LYTWGQCTWHVFNRRSEIGKGISTYWWN

SEQ ID NO: 1841014 - protein, 17 aa, Staphylococcus epidermidis
MALNLCLFGKYKELKRK

SEQ ID NO: 1841015 - protein, 20 aa, Staphylococcus epidermidis
MATFKKDKLIALSNQPGLFH

SEQ ID NO: 1841016 - protein, 18 aa, Staphylococcus epidermidis
MESRGMVLFINRNTRTSK

SEQ ID NO: 1841017 - protein, 19 aa, Staphylococcus epidermidis
MGPSFNTAYRYYKNQPGAK

SEQ ID NO: 1841018 - protein, 20 aa, Staphylococcus epidermidis
MGQGPVEIGCLVPEGKESVD

SEQ ID NO: 1841019 - protein, 17 aa, Staphylococcus epidermidis
MGYLAHRYGFKQEGIQN

SEQ ID NO: 1841020 - protein, 21 aa, Staphylococcus epidermidis
MILCMVLLYSCSGPMDSPKHS

SEQ ID NO: 1841021 - protein, 24 aa, Staphylococcus epidermidis
MKEDLKTAPFNHAIDYNTSIKPFK

SEQ ID NO: 1841022 - protein, 17 aa, Staphylococcus epidermidis
MLKQQMKPHEKLYTVTV

SEQ ID NO: 1841023 - protein, 17 aa, Staphylococcus epidermidis
MMRTEFSAGNNLNDEDD

SEQ ID NO: 1841024 - protein, 18 aa, Staphylococcus epidermidis
MNGYRRGAYQDMTKDMDN

SEQ ID NO: 1841025 - protein, 17 aa, Staphylococcus epidermidis
MNGYRRGAYQNMTKDMN

SEQ ID NO: 1841026 - protein, 27 aa, Staphylococcus epidermidis
MNSHVPLIRLMNKFELLNASEQDLKAI

SEQ ID NO: 1841027 - protein, 21 aa, Staphylococcus epidermidis
MNYGHGAGVVTSRTISASQAA

SEQ ID NO: 1841028 - protein, 26 aa, Staphylococcus epidermidis
MPSNTEILYRLGLGKNIVGVSTVDDY

SEQ ID NO: 1841029 - protein, 20 aa, Staphylococcus epidermidis
MRGTFLVTKFLLPLMMDHGG

SEQ ID NO: 1841030 - protein, 27 aa, Staphylococcus epidermidis
MSKDTKLPVIFWMHGGGFIAGDKQYKN

SEQ ID NO: 1841031 - protein, 29 aa, Staphylococcus epidermidis
MSLPTKILLWVVGILFLLTVIAVIYVGAK

SEQ ID NO: 1841032 - protein, 19 aa, Staphylococcus epidermidis
MTFIGILLIILAIYLFAKP

SEQ ID NO: 1841033 - protein, 18 aa, Staphylococcus epidermidis
MTIGLAMNSVYYYKKEKD

SEQ ID NO: 1841034 - protein, 22 aa, Staphylococcus epidermidis
MTSEGAFKYFAKQFNVKPGYIW

SEQ ID NO: 1841035 - protein, 17 aa, Staphylococcus epidermidis
MVEGASIDKAAHPNDVT

SEQ ID NO: 1841036 - protein, 20 aa, Staphylococcus epidermidis
NAPKGMKFYSVYPSNHSFQS

SEQ ID NO: 1841037 - protein, 17 aa, Staphylococcus epidermidis
NAVKNTRIESVNGDEIS

SEQ ID NO: 1841038 - protein, 23 aa, Staphylococcus epidermidis
NAVSSYDGYWLAAYQAKEPNREK

SEQ ID NO: 1841039 - protein, 25 aa, Staphylococcus epidermidis
NDAPHPQGWHEWVAAAKAKPVYGAK

SEQ ID NO: 1841040 - protein, 19 aa, Staphylococcus epidermidis
NDDMSKFIASNVVKGLLKQ

SEQ ID NO: 1841041 - protein, 28 aa, Staphylococcus epidermidis
NDMNFLRWPNIREDYSITWSSDKLPNRN

SEQ ID NO: 1841042 - protein, 17 aa, Staphylococcus epidermidis
NEAKAQTAHSYWYKYNG

SEQ ID NO: 1841043 - protein, 41 aa, Staphylococcus epidermidis
NEALVRQVVFDVGKAFGRKNSRVDFGLAQWGLKQKPNESYI

SEQ ID NO: 1841044 - protein, 22 aa, Staphylococcus epidermidis
NEELPALPMLQMKSIGIVNDKV

SEQ ID NO: 1841045 - protein, 18 aa, Staphylococcus epidermidis
NEGEFKAGDKVTITAGHM

SEQ ID NO: 1841046 - protein, 17 aa, Staphylococcus epidermidis
NENLGLNPSHNGETDEE

SEQ ID NO: 1841047 - protein, 40 aa, Staphylococcus epidermidis
NEPFIRQLAYDYARFQGHKLSRVDLGLKQWGLAQRDGETH

SEQ ID NO: 1841048 - protein, 28 aa, Staphylococcus epidermidis
NESIEFGSSIGEEFKGLIGNFKSDINPN

SEQ ID NO: 1841049 - protein, 17 aa, Staphylococcus epidermidis
NFTSNGTNWSWSYQAAG

SEQ ID NO: 1841050 - protein, 25 aa, Staphylococcus epidermidis
NGGGQRKSIHTYKLEALPKKVEGAP

SEQ ID NO: 1841051 - protein, 24 aa, Staphylococcus epidermidis
NHQLKVPLIKAYMGMESDLLDFYA

SEQ ID NO: 1841052 - protein, 18 aa, Staphylococcus epidermidis
NHSYVLHPYMKWGDSVID

SEQ ID NO: 1841053 - protein, 27 aa, Staphylococcus epidermidis
NIEKSIWYKLLVNLGINTITAIGHQPA

SEQ ID NO: 1841054 - protein, 23 aa, Staphylococcus epidermidis
NKDGKVKGVMFFKLKDTKTPVTL

SEQ ID NO: 1841055 - protein, 30 aa, Staphylococcus epidermidis
NKDGSIFISEMNWIAPYIVSTRTISASEVD

SEQ ID NO: 1841056 - protein, 23 aa, Staphylococcus epidermidis
NKDLRKEMHFEQQFEPSQIKAAI

SEQ ID NO: 1841057 - protein, 24 aa, Staphylococcus epidermidis
NKKLHSWLRLSTLIDDVKVKDKYT

SEQ ID NO: 1841058 - protein, 23 aa, Staphylococcus epidermidis
NKLRNGVKMIVDQVVNTVSQLYL

SEQ ID NO: 1841059 - protein, 22 aa, Staphylococcus epidermidis
NKNVRKAFDMIINRKEIAKDVS

SEQ ID NO: 1841060 - protein, 25 aa, Staphylococcus epidermidis
NLAIMGRYVLTPEIFDYLETQQEGA

SEQ ID NO: 1841061 - protein, 26 aa, Staphylococcus epidermidis
NLAIMGRYVLTPEIFDYLKTQKKGAG

SEQ ID NO: 1841062 - protein, 17 aa, Staphylococcus epidermidis
NLKEYRKYYEPLINKSD

SEQ ID NO: 1841063 - protein, 22 aa, Staphylococcus epidermidis
NLKSGKQKILFERTHTNDNSRF

SEQ ID NO: 1841064 - protein, 24 aa, Staphylococcus epidermidis
NLKVLPAVAAKSGLLAHPSNSYVG

SEQ ID NO: 1841065 - protein, 24 aa, Staphylococcus epidermidis
NLSDKTKISLAFFADEKGEYLLTK

SEQ ID NO: 1841066 - protein, 24 aa, Staphylococcus epidermidis
NLTKKEIKALAKMYLSGDTDIKTS

SEQ ID NO: 1841067 - protein, 23 aa, Staphylococcus epidermidis
NNLYTAGQCTWYVFDKRAQDGHT

SEQ ID NO: 1841068 - protein, 21 aa, Staphylococcus epidermidis
NNMVFPGQVINVGGSASQSTS

SEQ ID NO: 1841069 - protein, 30 aa, Staphylococcus epidermidis
NNPAEQGRFLKFFVDEGLIKLKKGVKIEDA

SEQ ID NO: 1841070 - protein, 17 aa, Staphylococcus epidermidis
NNSELHVTSTHYDDPTL

SEQ ID NO: 1841071 - protein, 18 aa, Staphylococcus epidermidis
NNSGIRASVFDKKAKSGA

SEQ ID NO: 1841072 - protein, 26 aa, Staphylococcus epidermidis
NNVQFLKNRYEAMRNFPMFDNIEYTE

SEQ ID NO: 1841073 - protein, 25 aa, Staphylococcus epidermidis
NPDIILRLPHGMPDEVKKMFQKEFK

SEQ ID NO: 1841074 - protein, 24 aa, Staphylococcus epidermidis
NPDIYKPTWKDEALTYKDATSHLS

SEQ ID NO: 1841075 - protein, 28 aa, Staphylococcus epidermidis
NPDKYQHIGGGPGMALSSPNQSYDSFKQ

SEQ ID NO: 1841076 - protein, 19 aa, Staphylococcus epidermidis
NPEAIKLEFNEPVNTKYSS

SEQ ID NO: 1841077 - protein, 21 aa, Staphylococcus epidermidis
NPEKQPISILFLGIDDNEGRE

SEQ ID NO: 1841078 - protein, 18 aa, Staphylococcus epidermidis
NPKNAVVLDYGALDVLKE

SEQ ID NO: 1841079 - protein, 17 aa, Staphylococcus epidermidis
NPMIPKETYFVKTNQPV

SEQ ID NO: 1841080 - protein, 18 aa, Staphylococcus epidermidis
NPSDGSFTYTYGKSNGNV

SEQ ID NO: 1841081 - protein, 25 aa, Staphylococcus epidermidis
NPSIYKPTWKSEALSYKDATSHLSR

SEQ ID NO: 1841082 - protein, 21 aa, Staphylococcus epidermidis
NQKKHQIRMLSIPRDTISYIP

SEQ ID NO: 1841083 - protein, 19 aa, Staphylococcus epidermidis
NQNYSIKPGVKLYTVPWGT

SEQ ID NO: 1841084 - protein, 21 aa, Staphylococcus epidermidis
NQPSLIGPVHFERHKGNIDGN

SEQ ID NO: 1841085 - protein, 23 aa, Staphylococcus epidermidis
NQTYNVKPGVKFHTVPWGTYNQV

SEQ ID NO: 1841086 - protein, 24 aa, Staphylococcus epidermidis
NRSLEEMKNKIEIVDSGAAQKADD

SEQ ID NO: 1841087 - protein, 25 aa, Staphylococcus epidermidis
NRSLEEMKNKIGIVDSGAAQKADDP

SEQ ID NO: 1841088 - protein, 21 aa, Staphylococcus epidermidis
NRSSGKMGYAIAEALRDKGAI

SEQ ID NO: 1841089 - protein, 17 aa, Staphylococcus epidermidis
NRTMHLGNTEYTYDSTL

SEQ ID NO: 1841090 - protein, 22 aa, Staphylococcus epidermidis
NRYDVGEKLGFVKTTIEYALKD

SEQ ID NO: 1841091 - protein, 24 aa, Staphylococcus epidermidis
NSKDVKRSLEIGGGHDTDLKEKYE

SEQ ID NO: 1841092 - protein, 38 aa, Staphylococcus epidermidis
NSKEPTKEEIAEWDRQNVKGGTDYGLIDPKEANESSQS

SEQ ID NO: 1841093 - protein, 23 aa, Staphylococcus epidermidis
NSSKSFGKSVDWTIQGTDDRNGV

SEQ ID NO: 1841094 - protein, 23 aa, Staphylococcus epidermidis
NTKEGIKPLLAKKWDISDDGQTY

SEQ ID NO: 1841095 - protein, 18 aa, Staphylococcus epidermidis
NTRIESVNGDEISRPGPR

SEQ ID NO: 1841096 - protein, 24 aa, Staphylococcus epidermidis
NTSKIWKTKDNAFYDLSREGTSKL

SEQ ID NO: 1841097 - protein, 17 aa, Staphylococcus epidermidis
NVKRHLYSGDAYDSELY

SEQ ID NO: 1841098 - protein, 22 aa, Staphylococcus epidermidis
NVPFFGICLGMQLATVEYARNV

SEQ ID NO: 1841099 - protein, 18 aa, Staphylococcus epidermidis
NWNGGVNVKSYRTIYNPG

SEQ ID NO: 1841100 - protein, 18 aa, Staphylococcus epidermidis
NYANSRYGSLSNAIDFRA

SEQ ID NO: 1841101 - protein, 18 aa, Staphylococcus epidermidis
NYNGGPGVVSTRTISASQ

SEQ ID NO: 1841102 - protein, 31 aa, Staphylococcus epidermidis
PANSRFAWAQSPDTWKCISDNRIKQSMLHCL

SEQ ID NO: 1841103 - protein, 22 aa, Staphylococcus epidermidis
PCIFSLLQGFFVIYSVCSNKKI

SEQ ID NO: 1841104 - protein, 27 aa, Staphylococcus epidermidis
PESKNLGGFPITGQFLICTNPDTIAKH

SEQ ID NO: 1841105 - protein, 21 aa, Staphylococcus epidermidis
PFKYHGKYFAGLAKITYHSTS

SEQ ID NO: 1841106 - protein, 17 aa, Staphylococcus epidermidis
PGPYGHVAYVERVNGDG

SEQ ID NO: 1841107 - protein, 21 aa, Staphylococcus epidermidis
PGQMKQAIKFVKDHHLKHLLV

SEQ ID NO: 1841108 - protein, 19 aa, Staphylococcus epidermidis
PHRVAVLDYGALDVMKQLG

SEQ ID NO: 1841109 - protein, 17 aa, Staphylococcus epidermidis
PHTLRLEKSTGRNNNAK

SEQ ID NO: 1841110 - protein, 20 aa, Staphylococcus epidermidis
PIGSLWGNASNWAYSANQAG

SEQ ID NO: 1841111 - protein, 19 aa, Staphylococcus epidermidis
PIVKELKPLLKLSDVPAQA

SEQ ID NO: 1841112 - protein, 21 aa, Staphylococcus epidermidis
PKGQSEPIVLVIFTNKDNKSD

SEQ ID NO: 1841113 - protein, 24 aa, Staphylococcus epidermidis
PKHPKRVVVLEYSFVDALAALDVK

SEQ ID NO: 1841114 - protein, 17 aa, Staphylococcus epidermidis
PKNAVVLDYGALDVLNE

SEQ ID NO: 1841115 - protein, 21 aa, Staphylococcus epidermidis
PLATMWESKGKILSINGNQMT

SEQ ID NO: 1841116 - protein, 26 aa, Staphylococcus epidermidis
PLIEGIKYAKNAGWDSVSKAIIGGAK

SEQ ID NO: 1841117 - protein, 17 aa, Staphylococcus epidermidis
PMQINTYKKGQCTYYVF

SEQ ID NO: 1841118 - protein, 18 aa, Staphylococcus epidermidis
PQECNVIALNYANNHLNT

SEQ ID NO: 1841119 - protein, 24 aa, Staphylococcus epidermidis
PQGNERFINVEIVHTHDYDSFARS

SEQ ID NO: 1841120 - protein, 18 aa, Staphylococcus epidermidis
PRDVKRSGYLIITSDKGL

SEQ ID NO: 1841121 - protein, 18 aa, Staphylococcus epidermidis
PRSDLRNAIEKQLVGCGF

SEQ ID NO: 1841122 - protein, 18 aa, Staphylococcus epidermidis
PRSDLRNAIEKQLVGRGF

SEQ ID NO: 1841123 - protein, 20 aa, Staphylococcus epidermidis
PRSLVIAEVLKKAGYDVTTT

SEQ ID NO: 1841124 - protein, 26 aa, Staphylococcus epidermidis
PRTAAIKDFWEKVGLKTKVKLVEFGK

SEQ ID NO: 1841125 - protein, 17 aa, Staphylococcus epidermidis
PSSMWFDAEGHRMKAPD

SEQ ID NO: 1841126 - protein, 17 aa, Staphylococcus epidermidis
PSVANYFRHGAAHGYQF

SEQ ID NO: 1841127 - protein, 17 aa, Staphylococcus epidermidis
PTLDRFAKEGKFQPSAG

SEQ ID NO: 1841128 - protein, 18 aa, Staphylococcus epidermidis
PTLDRFAKEGKFQPSAGG

SEQ ID NO: 1841129 - protein, 22 aa, Staphylococcus epidermidis
PTTAIIQKRYVLILKNGKIKKR

SEQ ID NO: 1841130 - protein, 21 aa, Staphylococcus epidermidis
PTVLSHYWGGDKMNIRQDLEE

SEQ ID NO: 1841131 - protein, 24 aa, Staphylococcus epidermidis
PVFNENNEVIGIHYGGVEHKHNSA

SEQ ID NO: 1841132 - protein, 21 aa, Staphylococcus epidermidis
PVKHNWDHGDFVGTDTSEVRI

SEQ ID NO: 1841133 - protein, 19 aa, Staphylococcus epidermidis
PYLDMAYTFLYAYHLENTQ

SEQ ID NO: 1841134 - protein, 20 aa, Staphylococcus epidermidis
PYYQLNKFWDFARGSDEFAP

SEQ ID NO: 1841135 - protein, 23 aa, Staphylococcus epidermidis
QADFSTYQLEVFKKVAEEEEKYM

SEQ ID NO: 1841136 - protein, 17 aa, Staphylococcus epidermidis
QAYLRFLKNEGKLSELT

SEQ ID NO: 1841137 - protein, 20 aa, Staphylococcus epidermidis
QCTYYAFNRRAELGKPIGSL

SEQ ID NO: 1841138 - protein, 25 aa, Staphylococcus epidermidis
QDAEGYPMKAAVTIDKRTGEFIDYI

SEQ ID NO: 1841139 - protein, 18 aa, Staphylococcus epidermidis
QDKFKSEPSTSVDNIEHD

SEQ ID NO: 1841140 - protein, 27 aa, Staphylococcus epidermidis
QDLKAIKSYAIGVGPEYTDLNIKNTRH

SEQ ID NO: 1841141 - protein, 24 aa, Staphylococcus epidermidis
QDPHAWLSLDNGIKYVKTIQKSLE

SEQ ID NO: 1841142 - protein, 17 aa, Staphylococcus epidermidis
QEFKSQIQWLKAHDAKF

SEQ ID NO: 1841143 - protein, 20 aa, Staphylococcus epidermidis
QFEISKQFWGHLVKSGNIDN

SEQ ID NO: 1841144 - protein, 20 aa, Staphylococcus epidermidis
QFEISKQFWGHLVKSGQIEN

SEQ ID NO: 1841145 - protein, 18 aa, Staphylococcus epidermidis
QFYMSMINNMLKVEELDG

SEQ ID NO: 1841146 - protein, 17 aa, Staphylococcus epidermidis
QGAFGHVAYVENVNNDG

SEQ ID NO: 1841147 - protein, 23 aa, Staphylococcus epidermidis
QGLPRSGEIKAITYFDDNVQSNF

SEQ ID NO: 1841148 - protein, 24 aa, Staphylococcus epidermidis
QIGGYKGTGIDGVIKEDNSTYTVK

SEQ ID NO: 1841149 - protein, 17 aa, Staphylococcus epidermidis
QIGSTWGNANNWASAAE

SEQ ID NO: 1841150 - protein, 17 aa, Staphylococcus epidermidis
QKEIKSLAKMYLGGNTE

SEQ ID NO: 1841151 - protein, 18 aa, Staphylococcus epidermidis
QKILKRIDDEGVFIPVSY

SEQ ID NO: 1841152 - protein, 17 aa, Staphylococcus epidermidis
QKKLSAYQKQLLLDKVK

SEQ ID NO: 1841153 - protein, 21 aa, Staphylococcus epidermidis
QKNINGVTWYYGKLTNGKYVW

SEQ ID NO: 1841154 - protein, 20 aa, Staphylococcus epidermidis
QKPIVFTAMEPSWFSKELDI

SEQ ID NO: 1841155 - protein, 25 aa, Staphylococcus epidermidis
QKQHGGSISPLFKGGQDNMISSITT

SEQ ID NO: 1841156 - protein, 26 aa, Staphylococcus epidermidis
QKYRIAKRKGISFSRQTAKPQHRTIV

SEQ ID NO: 1841157 - protein, 18 aa, Staphylococcus epidermidis
QLKQAYGKSLRKLPSANN

SEQ ID NO: 1841158 - protein, 25 aa, Staphylococcus epidermidis
QLLSLYKIYCGKEIEVLNIYGDLED

SEQ ID NO: 1841159 - protein, 27 aa, Staphylococcus epidermidis
QLVGRGFTVKVPPEYIGGQNNKNFINK

SEQ ID NO: 1841160 - protein, 27 aa, Staphylococcus epidermidis
QLVGRGFTVKVPPEYLGGQNNKNFINK

SEQ ID NO: 1841161 - protein, 27 aa, Staphylococcus epidermidis
QLVGRGFTVKVPPEYLGGQNNKNFINR

SEQ ID NO: 1841162 - protein, 23 aa, Staphylococcus epidermidis
QMKQLPPDIPLRIKNEEGDINLN

SEQ ID NO: 1841163 - protein, 28 aa, Staphylococcus epidermidis
QNAILCYIYKFRARFAVLAHLVSLREDL

SEQ ID NO: 1841164 - protein, 21 aa, Staphylococcus epidermidis
QNGKPLIVMYGDFKCPYCKKV

SEQ ID NO: 1841165 - protein, 25 aa, Staphylococcus epidermidis
QNLYTEGQCTWYVFDKRAQAGKSIS

SEQ ID NO: 1841166 - protein, 22 aa, Staphylococcus epidermidis
QNTLYKMRWNPASPGTHQYATD

SEQ ID NO: 1841167 - protein, 23 aa, Staphylococcus epidermidis
QPKKGGFFEEFEKTFKELNDELN

SEQ ID NO: 1841168 - protein, 28 aa, Staphylococcus epidermidis
QQFKPSQIKAAVFFGGFYNMKTVRATEF

SEQ ID NO: 1841169 - protein, 24 aa, Staphylococcus epidermidis
QQGNYHYNWQGNWSPNQAQQGNNA

SEQ ID NO: 1841170 - protein, 18 aa, Staphylococcus epidermidis
QQGVDFFNNRGYEIESSL

SEQ ID NO: 1841171 - protein, 17 aa, Staphylococcus epidermidis
QQIYYRALTDYLSSNSD

SEQ ID NO: 1841172 - protein, 24 aa, Staphylococcus epidermidis
QQLKKIAYLKATFKNSSKITKDTN

SEQ ID NO: 1841173 - protein, 24 aa, Staphylococcus epidermidis
QRQYGGTVSDLFKGGQDNMVSTIT

SEQ ID NO: 1841174 - protein, 18 aa, Staphylococcus epidermidis
QRTILYIHGGAWFQDPLD

SEQ ID NO: 1841175 - protein, 19 aa, Staphylococcus epidermidis
QSFKAFVQNKDELIFNKDK

SEQ ID NO: 1841176 - protein, 21 aa, Staphylococcus epidermidis
QSIWKKICVNGTANALCSILE

SEQ ID NO: 1841177 - protein, 22 aa, Staphylococcus epidermidis
QTKKGKRVIVVPKKQYDKIKTG

SEQ ID NO: 1841178 - protein, 21 aa, Staphylococcus epidermidis
QVKGIDSGINYQIKPEVAHIN

SEQ ID NO: 1841179 - protein, 32 aa, Staphylococcus epidermidis
QYIATTYYNNWLFYYIFAYSFLNQHEKKNSVD

SEQ ID NO: 1841180 - protein, 28 aa, Staphylococcus epidermidis
QYMATSYYNNWLYFYIIASSSHDQQAKK

SEQ ID NO: 1841181 - protein, 17 aa, Staphylococcus epidermidis
QYVESLIYGTILDAKTS

SEQ ID NO: 1841182 - protein, 19 aa, Staphylococcus epidermidis
RAGIEDIIIVTGKHKRAIE

SEQ ID NO: 1841183 - protein, 19 aa, Staphylococcus epidermidis
RAQHAVNHYAPEKSLEFQK

SEQ ID NO: 1841184 - protein, 31 aa, Staphylococcus epidermidis
RASVFDKKAKSGAKYGNRTYIITKQRTEGNN

SEQ ID NO: 1841185 - protein, 20 aa, Staphylococcus epidermidis
RATEFPRIQLFMKSYTGTSH

SEQ ID NO: 1841186 - protein, 19 aa, Staphylococcus epidermidis
RDTISYIPKVGYYDKITHA

SEQ ID NO: 1841187 - protein, 21 aa, Staphylococcus epidermidis
RDYRKHFEPLIKESNDDFRKH

SEQ ID NO: 1841188 - protein, 21 aa, Staphylococcus epidermidis
REHSGGHPSAFGGGDVPVGTE

SEQ ID NO: 1841189 - protein, 17 aa, Staphylococcus epidermidis
RELRKILNRFKEEGRLR

SEQ ID NO: 1841190 - protein, 17 aa, Staphylococcus epidermidis
RENDGLVSVISAQHPFN

SEQ ID NO: 1841191 - protein, 17 aa, Staphylococcus epidermidis
RENQKWVTPLGRLGTPD

SEQ ID NO: 1841192 - protein, 20 aa, Staphylococcus epidermidis
REVTYKKSLKSGYINITKGL

SEQ ID NO: 1841193 - protein, 19 aa, Staphylococcus epidermidis
RFAKEGKFQPSAGGTTNEA

SEQ ID NO: 1841194 - protein, 21 aa, Staphylococcus epidermidis
RFISIMAGLSIDYIRQQLNTN

SEQ ID NO: 1841195 - protein, 21 aa, Staphylococcus epidermidis
RFSIRKYAVGVVSIITGATIF

SEQ ID NO: 1841196 - protein, 18 aa, Staphylococcus epidermidis
RFSIRKYAVGVVSIITGV

SEQ ID NO: 1841197 - protein, 23 aa, Staphylococcus epidermidis
RFTSHHPMKINTYKKGQCTYYVF

SEQ ID NO: 1841198 - protein, 24 aa, Staphylococcus epidermidis
RFVALILAVFFFLSVNNVFGNVFN

SEQ ID NO: 1841199 - protein, 18 aa, Staphylococcus epidermidis
RGAHYKPEFPDRNDDEWL

SEQ ID NO: 1841200 - protein, 22 aa, Staphylococcus epidermidis
RGDSDLPFDDLEIVHQNISNKV

SEQ ID NO: 1841201 - protein, 21 aa, Staphylococcus epidermidis
RGDVGGPGMSPAHDGIGNDDE

SEQ ID NO: 1841202 - protein, 19 aa, Staphylococcus epidermidis
RGGEVLYQAFGLKMSKGQH

SEQ ID NO: 1841203 - protein, 17 aa, Staphylococcus epidermidis
RGSGRKAFIESHWGSQN

SEQ ID NO: 1841204 - protein, 19 aa, Staphylococcus epidermidis
RHLKDLGFLVHPYTVNDVN

SEQ ID NO: 1841205 - protein, 18 aa, Staphylococcus epidermidis
RKADAKGKPDTWIADRKL

SEQ ID NO: 1841206 - protein, 22 aa, Staphylococcus epidermidis
RKGKLLGQYGIKGRDYTLNKKG

SEQ ID NO: 1841207 - protein, 17 aa, Staphylococcus epidermidis
RKILNRFKEEGRLRSFT

SEQ ID NO: 1841208 - protein, 18 aa, Staphylococcus epidermidis
RKQDAEKYGYEYDPKNYE

SEQ ID NO: 1841209 - protein, 21 aa, Staphylococcus epidermidis
RKSIHTYQLEALPTKVEGAPS

SEQ ID NO: 1841210 - protein, 20 aa, Staphylococcus epidermidis
RKVGHPVYQVMAGDMHNNSV

SEQ ID NO: 1841211 - protein, 17 aa, Staphylococcus epidermidis
RKYAVGVVSIITGVTIF

SEQ ID NO: 1841212 - protein, 17 aa, Staphylococcus epidermidis
RLKSEIENFKFFAQYAN

SEQ ID NO: 1841213 - protein, 31 aa, Staphylococcus epidermidis
RLKYKPQVQNEAWKWSNANYSQIKNAMDTKR

SEQ ID NO: 1841214 - protein, 20 aa, Staphylococcus epidermidis
RLPLQWRNFFSNGETIDLYE

SEQ ID NO: 1841215 - protein, 17 aa, Staphylococcus epidermidis
RMNPAYRQLLSLHKIYS

SEQ ID NO: 1841216 - protein, 21 aa, Staphylococcus epidermidis
RNAIEKQLVGRGFTVKVPPEY

SEQ ID NO: 1841217 - protein, 24 aa, Staphylococcus epidermidis
RNPKKAVVIGAGFIGLEMAESLVQ

SEQ ID NO: 1841218 - protein, 18 aa, Staphylococcus epidermidis
RNRFVAKLRNAMMKVMPN

SEQ ID NO: 1841219 - protein, 18 aa, Staphylococcus epidermidis
RNTPLGWVNVKDVTSQNI

SEQ ID NO: 1841220 - protein, 18 aa, Staphylococcus epidermidis
RNYLEGASYPSVKADKKS

SEQ ID NO: 1841221 - protein, 51 aa, Staphylococcus epidermidis
RPEQGQGLDSIYCFIGKGDVSYRISFKTSGLPTERLYYAAGGRALEFNQLY

SEQ ID NO: 1841222 - protein, 17 aa, Staphylococcus epidermidis
RQLWNMLVLARVITIGA

SEQ ID NO: 1841223 - protein, 19 aa, Staphylococcus epidermidis
RQMELIKILFQKAQNLKSI

SEQ ID NO: 1841224 - protein, 24 aa, Staphylococcus epidermidis
RQTRPHINFRIQGHVSNHITITVP

SEQ ID NO: 1841225 - protein, 17 aa, Staphylococcus epidermidis
RRAELGKPIGSLWGNAS

SEQ ID NO: 1841226 - protein, 18 aa, Staphylococcus epidermidis
RRLERLEALSESYDGVEK

SEQ ID NO: 1841227 - protein, 22 aa, Staphylococcus epidermidis
RRTSGDYDLMFNQTWGLLYDPQ

SEQ ID NO: 1841228 - protein, 17 aa, Staphylococcus epidermidis
RSAFQYDSDEVINGIIW

SEQ ID NO: 1841229 - protein, 21 aa, Staphylococcus epidermidis
RSASLPSVRGKMIDIQFTHLT

SEQ ID NO: 1841230 - protein, 23 aa, Staphylococcus epidermidis
RSEAPKLYVSNVMTQPGETDNYD

SEQ ID NO: 1841231 - protein, 18 aa, Staphylococcus epidermidis
RSQNYAMIRLLKWFEQQE

SEQ ID NO: 1841232 - protein, 25 aa, Staphylococcus epidermidis
RVFGTRNELGLAIGKSDRVNIGITD

SEQ ID NO: 1841233 - protein, 24 aa, Staphylococcus epidermidis
RVIFSELLRFAGIGESKVETILMD

SEQ ID NO: 1841234 - protein, 19 aa, Staphylococcus epidermidis
RYETELNYYSPKSKKDTST

SEQ ID NO: 1841235 - protein, 33 aa, Staphylococcus epidermidis
RYGRTYEGIMPDWEPGKKIHLVGHSMGGQTIRL

SEQ ID NO: 1841236 - protein, 20 aa, Staphylococcus epidermidis
RYGRTYKGIMRDWEPGKKIH

SEQ ID NO: 1841237 - protein, 19 aa, Staphylococcus epidermidis
RYQFLRLDQPQSLSVAALN

SEQ ID NO: 1841238 - protein, 17 aa, Staphylococcus epidermidis
SADVFGYSALVKNAPGI

SEQ ID NO: 1841239 - protein, 21 aa, Staphylococcus epidermidis
SAEAKALYLQGYNSAKVQLDK

SEQ ID NO: 1841240 - protein, 20 aa, Staphylococcus epidermidis
SCVMMVFLTSSLSIVSTYSH

SEQ ID NO: 1841241 - protein, 19 aa, Staphylococcus epidermidis
SDARKVIKKVGGNKAANLF

SEQ ID NO: 1841242 - protein, 19 aa, Staphylococcus epidermidis
SDGLYNFISAIRVATSFEA

SEQ ID NO: 1841243 - protein, 19 aa, Staphylococcus epidermidis
SDWLSQNFGVRFRYNALGD

SEQ ID NO: 1841244 - protein, 25 aa, Staphylococcus epidermidis
SDYIKMIKKRGGFDKINAVKNTRIE

SEQ ID NO: 1841245 - protein, 21 aa, Staphylococcus epidermidis
SEAAKKYGINEIYLVAHALVE

SEQ ID NO: 1841246 - protein, 25 aa, Staphylococcus epidermidis
SEGIMGVVYKTHLFLTPYGAKQYIE

SEQ ID NO: 1841247 - protein, 22 aa, Staphylococcus epidermidis
SEIGKGISTYWWNANNWDNAAA

SEQ ID NO: 1841248 - protein, 19 aa, Staphylococcus epidermidis
SELKPDGFSTYKKKKKKMW

SEQ ID NO: 1841249 - protein, 26 aa, Staphylococcus epidermidis
SENATRVARYLSPFEGDRSQALQQLP

SEQ ID NO: 1841250 - protein, 24 aa, Staphylococcus epidermidis
SESNVKGLGVISFRTIDAGDAQDL

SEQ ID NO: 1841251 - protein, 24 aa, Staphylococcus epidermidis
SESNVKGLGVISYRTIDAADASDL

SEQ ID NO: 1841252 - protein, 23 aa, Staphylococcus epidermidis
SETFGIDGMKDYAFQIENVLTSR

SEQ ID NO: 1841253 - protein, 23 aa, Staphylococcus epidermidis
SFANCALPYYIGEIVNERDNVLA

SEQ ID NO: 1841254 - protein, 26 aa, Staphylococcus epidermidis
SFANCALPYYIGNVIEDRRKVLAYTP

SEQ ID NO: 1841255 - protein, 20 aa, Staphylococcus epidermidis
SFEGVKRGRIINKQDLTIEG

SEQ ID NO: 1841256 - protein, 24 aa, Staphylococcus epidermidis
SFGQRVISYPIQFVTGSIGDLFEK

SEQ ID NO: 1841257 - protein, 25 aa, Staphylococcus epidermidis
SGGKDVDIDLGFSQWGLKQQPNESY

SEQ ID NO: 1841258 - protein, 19 aa, Staphylococcus epidermidis
SGHIINLASVSGFEPTKTN

SEQ ID NO: 1841259 - protein, 17 aa, Staphylococcus epidermidis
SGKRYAEYLSLVATHYN

SEQ ID NO: 1841260 - protein, 25 aa, Staphylococcus epidermidis
SGKVYEFHLKKNIKFSDGSPLNAKA

SEQ ID NO: 1841261 - protein, 25 aa, Staphylococcus epidermidis
SGSGKPLPKFWETAGGINPSVANYF

SEQ ID NO: 1841262 - protein, 27 aa, Staphylococcus epidermidis
SHFQGSWRDADYSKRESQRIIDDARTV

SEQ ID NO: 1841263 - protein, 23 aa, Staphylococcus epidermidis
SHKYGISIAKLKSLNGLKSNLIF

SEQ ID NO: 1841264 - protein, 23 aa, Staphylococcus epidermidis
SHKYGISIAKLKSLNGLTSNLIF

SEQ ID NO: 1841265 - protein, 17 aa, Staphylococcus epidermidis
SHLKANPYLTAPQLYSQ

SEQ ID NO: 1841266 - protein, 31 aa, Staphylococcus epidermidis
SHNYSYAELYDLIYEKYLIKTGQVAPWGTSS

SEQ ID NO: 1841267 - protein, 30 aa, Staphylococcus epidermidis
SHNYSYAELYDLIYEKYLIKTGQVAPWGTT

SEQ ID NO: 1841268 - protein, 20 aa, Staphylococcus epidermidis
SIAKHAHKIGQKENIYASVM

SEQ ID NO: 1841269 - protein, 25 aa, Staphylococcus epidermidis
SIKDLKSFVDLCNRSIKDNEDILDY

SEQ ID NO: 1841270 - protein, 20 aa, Staphylococcus epidermidis
SILKDKFKGVTKVGDDDVEK

SEQ ID NO: 1841271 - protein, 18 aa, Staphylococcus epidermidis
SIPRDTKAEIAGRGTEEK

SEQ ID NO: 1841272 - protein, 25 aa, Staphylococcus epidermidis
SIYRKGVKDCSSWKGKPKHKNWPKT

SEQ ID NO: 1841273 - protein, 27 aa, Staphylococcus epidermidis
SKANFYITDCLIREGRMKLDKGLTHVK

SEQ ID NO: 1841274 - protein, 25 aa, Staphylococcus epidermidis
SKENIKKVLLFLSRNTSSSGVESGE

SEQ ID NO: 1841275 - protein, 17 aa, Staphylococcus epidermidis
SKIKNGVSYYDISLSTQ

SEQ ID NO: 1841276 - protein, 17 aa, Staphylococcus epidermidis
SKLKPDLIIADSNRHKG

SEQ ID NO: 1841277 - protein, 22 aa, Staphylococcus epidermidis
SKNEIVGVHAFRVDSGEYKTYH

SEQ ID NO: 1841278 - protein, 23 aa, Staphylococcus epidermidis
SKNGTKYLIFDNMSFTAPTKKPI

SEQ ID NO: 1841279 - protein, 25 aa, Staphylococcus epidermidis
SKQDPHAWLSLDNGIKYVKTIQQTL

SEQ ID NO: 1841280 - protein, 26 aa, Staphylococcus epidermidis
SKSLYVGKDLYLYGTVNNRTGWIAAK

SEQ ID NO: 1841281 - protein, 18 aa, Staphylococcus epidermidis
SKVGKYEVKYKVTDSDGA

SEQ ID NO: 1841282 - protein, 24 aa, Staphylococcus epidermidis
SKVHVYRPPYMMYGDDDVEGKAVS

SEQ ID NO: 1841283 - protein, 26 aa, Staphylococcus epidermidis
SKVKFPMLSSNIYKNGKRVFKPSTVI

SEQ ID NO: 1841284 - protein, 20 aa, Staphylococcus epidermidis
SLAVGLGVVAGNAGHDAHAS

SEQ ID NO: 1841285 - protein, 18 aa, Staphylococcus epidermidis
SLGNLVIAGMTSITNDFG

SEQ ID NO: 1841286 - protein, 30 aa, Staphylococcus epidermidis
SLGQRAVSYPIHFVTGAIGNIFNKDGSKQD

SEQ ID NO: 1841287 - protein, 21 aa, Staphylococcus epidermidis
SLNGLSNFFIYPGQQLKVPGG

SEQ ID NO: 1841288 - protein, 18 aa, Staphylococcus epidermidis
SMAKEIRKEPSIPHNFTF

SEQ ID NO: 1841289 - protein, 27 aa, Staphylococcus epidermidis
SMGGQTIRLMEHFLRNGNQEEIDYQRQ

SEQ ID NO: 1841290 - protein, 18 aa, Staphylococcus epidermidis
SNAAALILGEKVSKSTST

SEQ ID NO: 1841291 - protein, 17 aa, Staphylococcus epidermidis
SNDQLDPETGLPKDDAV

SEQ ID NO: 1841292 - protein, 18 aa, Staphylococcus epidermidis
SNDQLDPETGLPKDDAVP

SEQ ID NO: 1841293 - protein, 23 aa, Staphylococcus epidermidis
SNLAVKNDLHFKKFVKNNKIPKE

SEQ ID NO: 1841294 - protein, 24 aa, Staphylococcus epidermidis
SNLSSVPLKAGQIYTVKEILSQTA

SEQ ID NO: 1841295 - protein, 25 aa, Staphylococcus epidermidis
SNPMPPRTAKLLIQLIQKGELEIKK

SEQ ID NO: 1841296 - protein, 25 aa, Staphylococcus epidermidis
SNYDRAVELYYYIKGGKVDYGAAHA

SEQ ID NO: 1841297 - protein, 27 aa, Staphylococcus epidermidis
SNYDRAVELYYYIKGGRVDYGAAHAAK

SEQ ID NO: 1841298 - protein, 46 aa, Staphylococcus epidermidis
SNYDRAVELYYYIKGGRVDYGAAHAARYGHKRYGKTYEGVYKDWKP

SEQ ID NO: 1841299 - protein, 32 aa, Staphylococcus epidermidis
SNYDRAVELYYYIKGGRVDYGAAHTAKYGHER

SEQ ID NO: 1841300 - protein, 23 aa, Staphylococcus epidermidis
SNYKDIANQIAFTQSQSSNSSES

SEQ ID NO: 1841301 - protein, 25 aa, Staphylococcus epidermidis
SPLGKLRAGLDLFKKPIEIEDDISV

SEQ ID NO: 1841302 - protein, 20 aa, Staphylococcus epidermidis
SPNVYPGMEKQLLNTLNQHG

SEQ ID NO: 1841303 - protein, 18 aa, Staphylococcus epidermidis
SPSYQEYLNAKKLTENIQ

SEQ ID NO: 1841304 - protein, 21 aa, Staphylococcus epidermidis
SQATLRRYEEQNSKPVKVNKE

SEQ ID NO: 1841305 - protein, 18 aa, Staphylococcus epidermidis
SQDNGFYDLTRDGATDLN

SEQ ID NO: 1841306 - protein, 28 aa, Staphylococcus epidermidis
SQPEKGYKWYDRSTFKPGSYGSTQSGSD

SEQ ID NO: 1841307 - protein, 23 aa, Staphylococcus epidermidis
SREGKLLGQYGIKGRDYTLDKKG

SEQ ID NO: 1841308 - protein, 23 aa, Staphylococcus epidermidis
SRFKGKTGLGLYIVKRLVERQNG

SEQ ID NO: 1841309 - protein, 26 aa, Staphylococcus epidermidis
SRNKRSNWSPVMYRFSDAIDKAVQQV

SEQ ID NO: 1841310 - protein, 25 aa, Staphylococcus epidermidis
SRQVGEPFIDFVICSSESYSKDVLQ

SEQ ID NO: 1841311 - protein, 20 aa, Staphylococcus epidermidis
SSDWLSQNFGVRFRYNALGD

SEQ ID NO: 1841312 - protein, 17 aa, Staphylococcus epidermidis
SSIHTGFKVTKIEQTSC

SEQ ID NO: 1841313 - protein, 17 aa, Staphylococcus epidermidis
SSLEEVDKFFKDKKGIK

SEQ ID NO: 1841314 - protein, 21 aa, Staphylococcus epidermidis
SSSLMAVGIMAPTILFTTNEA

SEQ ID NO: 1841315 - protein, 30 aa, Staphylococcus epidermidis
SSYVQPKFNVKFSVIEPGGIQSEFTNNVMA

SEQ ID NO: 1841316 - protein, 20 aa, Staphylococcus epidermidis
STHASLFGRQKADYNLFFPF

SEQ ID NO: 1841317 - protein, 17 aa, Staphylococcus epidermidis
STIRLRLSASDMDNNVT

SEQ ID NO: 1841318 - protein, 27 aa, Staphylococcus epidermidis
STQPNYRIGTHFKIKLASNDIELPTTA

SEQ ID NO: 1841319 - protein, 34 aa, Staphylococcus epidermidis
STSGNLYTAGQCTWYVFDKVGGQIGSTWGNANNW

SEQ ID NO: 1841320 - protein, 22 aa, Staphylococcus epidermidis
STYWSDAKFWADNAANDGYQVD

SEQ ID NO: 1841321 - protein, 24 aa, Staphylococcus epidermidis
SVDSARELNAFYVGNVQPSDLPEQ

SEQ ID NO: 1841322 - protein, 29 aa, Staphylococcus epidermidis
SVGASSILIAALLFMGGGSAQAAEQQQDK

SEQ ID NO: 1841323 - protein, 28 aa, Staphylococcus epidermidis
SVGTSSILIAALLFIGGNSAQAAEENHN

SEQ ID NO: 1841324 - protein, 23 aa, Staphylococcus epidermidis
SVITIILLFGCSKQPSSTNDVQN

SEQ ID NO: 1841325 - protein, 28 aa, Staphylococcus epidermidis
SVPVKHVLPEVVSVPRYTVQGHNFPQDN

SEQ ID NO: 1841326 - protein, 17 aa, Staphylococcus epidermidis
SVTGISFSNNFDPKSKN

SEQ ID NO: 1841327 - protein, 18 aa, Staphylococcus epidermidis
SWFKKRYAKKGKWMKIYR

SEQ ID NO: 1841328 - protein, 17 aa, Staphylococcus epidermidis
SYALSRPLFIYVKDKSL

SEQ ID NO: 1841329 - protein, 20 aa, Staphylococcus epidermidis
SYDSFKQDVTKARNESQALQ

SEQ ID NO: 1841330 - protein, 19 aa, Staphylococcus epidermidis
SYIIFRFHHDGVLSTGPND

SEQ ID NO: 1841331 - protein, 20 aa, Staphylococcus epidermidis
SYLTVPRGDTGYFFNTAYLP

SEQ ID NO: 1841332 - protein, 18 aa, Staphylococcus epidermidis
SYQLGVFKKIIESSMSFD

SEQ ID NO: 1841333 - protein, 20 aa, Staphylococcus epidermidis
TALDSYRGDSDLPFDDLEIV

SEQ ID NO: 1841334 - protein, 18 aa, Staphylococcus epidermidis
TATIPYNGKLVVMKDDYT

SEQ ID NO: 1841335 - protein, 22 aa, Staphylococcus epidermidis
TCISLLLAGCSFNKHTNEKTKQ

SEQ ID NO: 1841336 - protein, 21 aa, Staphylococcus epidermidis
TDAKHALVVGAGYISLEVLEN

SEQ ID NO: 1841337 - protein, 19 aa, Staphylococcus epidermidis
TDITACTWTSKKMAIYHSR

SEQ ID NO: 1841338 - protein, 34 aa, Staphylococcus epidermidis
TDNQMFNINAGFRKYPNLKSSLQDYADLIKHGID

SEQ ID NO: 1841339 - protein, 18 aa, Staphylococcus epidermidis
TEEGRWIAKNAHNYGFII

SEQ ID NO: 1841340 - protein, 24 aa, Staphylococcus epidermidis
TEFDKKRMPNLKKYTKSIGTDTSG

SEQ ID NO: 1841341 - protein, 23 aa, Staphylococcus epidermidis
TEINSYVPSTEWIAADSKDLKEY

SEQ ID NO: 1841342 - protein, 21 aa, Staphylococcus epidermidis
TEKTVKFDLPKNVTKVDPKET

SEQ ID NO: 1841343 - protein, 19 aa, Staphylococcus epidermidis
TFGPGGRFGDLVFDTLGFK

SEQ ID NO: 1841344 - protein, 25 aa, Staphylococcus epidermidis
TFSSVAKPRMMYAVNKKTTSSLPKY

SEQ ID NO: 1841345 - protein, 18 aa, Staphylococcus epidermidis
TGADLADLNHVYVAKRDV

SEQ ID NO: 1841346 - protein, 25 aa, Staphylococcus epidermidis
TGGSVKAQFLAAGGTEAAWNAIVMP

SEQ ID NO: 1841347 - protein, 30 aa, Staphylococcus epidermidis
TGIPESKHLGGFPISGQFIACTNPQVIEQH

SEQ ID NO: 1841348 - protein, 31 aa, Staphylococcus epidermidis
TGIPESKHLGGFPISGQFLICTNPAVINEHD

SEQ ID NO: 1841349 - protein, 23 aa, Staphylococcus epidermidis
TGVLCVVTLLSASPSFAVEKPTS

SEQ ID NO: 1841350 - protein, 17 aa, Staphylococcus epidermidis
THAHAYGGPLAAMDSVE

SEQ ID NO: 1841351 - protein, 23 aa, Staphylococcus epidermidis
THSPKNHTAVVFEAGQLGADTQY

SEQ ID NO: 1841352 - protein, 23 aa, Staphylococcus epidermidis
TIDKRTGEFIDYIDGRSDEDKER

SEQ ID NO: 1841353 - protein, 25 aa, Staphylococcus epidermidis
TIEGLPSGWTHSFVKAQNGQSGTLT

SEQ ID NO: 1841354 - protein, 17 aa, Staphylococcus epidermidis
TIGHSFKHWPLSTKTIT

SEQ ID NO: 1841355 - protein, 18 aa, Staphylococcus epidermidis
TILSLMLVGCSNGGNDEA

SEQ ID NO: 1841356 - protein, 25 aa, Staphylococcus epidermidis
TIRIDGGVMAYTWPGEMLSDDSWKK

SEQ ID NO: 1841357 - protein, 24 aa, Staphylococcus epidermidis
TISNVVRLRDEIITYSKENIYNGF

SEQ ID NO: 1841358 - protein, 23 aa, Staphylococcus epidermidis
TKAPEWSVKSWGKTYKYNDYSDH

SEQ ID NO: 1841359 - protein, 21 aa, Staphylococcus epidermidis
TKAQRALVVGAGYISLEILEN

SEQ ID NO: 1841360 - protein, 21 aa, Staphylococcus epidermidis
TKFLLPLMMDHGGSIINTASF

SEQ ID NO: 1841361 - protein, 18 aa, Staphylococcus epidermidis
TKNFKHKPDFAITNGGGI

SEQ ID NO: 1841362 - protein, 18 aa, Staphylococcus epidermidis
TKNLEDFYDKEGFRDGEF

SEQ ID NO: 1841363 - protein, 19 aa, Staphylococcus epidermidis
TKQGKRVVVVPKKQYDKIE

SEQ ID NO: 1841364 - protein, 27 aa, Staphylococcus epidermidis
TKWNFLNFKPGLVGGHCIGVDPYYLTH

SEQ ID NO: 1841365 - protein, 20 aa, Staphylococcus epidermidis
TKYHRIVSLMPSNTEILYRL

SEQ ID NO: 1841366 - protein, 20 aa, Staphylococcus epidermidis
TLLEGCDFGDLVGQHQTEKQ

SEQ ID NO: 1841367 - protein, 17 aa, Staphylococcus epidermidis
TLLLTGCVQKDNDHDEA

SEQ ID NO: 1841368 - protein, 18 aa, Staphylococcus epidermidis
TMNVPVDYYVRVNMKAFV

SEQ ID NO: 1841369 - protein, 17 aa, Staphylococcus epidermidis
TMSWTEGAPDNMIKDST

SEQ ID NO: 1841370 - protein, 20 aa, Staphylococcus epidermidis
TNAKVLLVVGGVNGRTDAFS

SEQ ID NO: 1841371 - protein, 30 aa, Staphylococcus epidermidis
TQVARGLSPFKGNEGQALQQLPNFKTALDI

SEQ ID NO: 1841372 - protein, 18 aa, Staphylococcus epidermidis
TQVRPLRIMSPHSVENGK

SEQ ID NO: 1841373 - protein, 19 aa, Staphylococcus epidermidis
TRAVFKIGGIGLAFKKGKF

SEQ ID NO: 1841374 - protein, 25 aa, Staphylococcus epidermidis
TRTKSFEKWKHSTLRKHKGGPKQRY

SEQ ID NO: 1841375 - protein, 19 aa, Staphylococcus epidermidis
TSALYRVLFEDIPVKDSVK

SEQ ID NO: 1841376 - protein, 23 aa, Staphylococcus epidermidis
TSDKKIAKEWINFLKSNKAKQIL

SEQ ID NO: 1841377 - protein, 23 aa, Staphylococcus epidermidis
TSDKKLAKEWMKFLKSDKAKKIL

SEQ ID NO: 1841378 - protein, 17 aa, Staphylococcus epidermidis
TSMLAIILLLCGCSTFK

SEQ ID NO: 1841379 - protein, 26 aa, Staphylococcus epidermidis
TSNGSEWSWSYTVAGSDADYTESSSN

SEQ ID NO: 1841380 - protein, 21 aa, Staphylococcus epidermidis
TSNGTNWSWSYQAAGSQSSSA

SEQ ID NO: 1841381 - protein, 28 aa, Staphylococcus epidermidis
TSPYPHGQCTWYVYHRMNQFDSSISGDL

SEQ ID NO: 1841382 - protein, 28 aa, Staphylococcus epidermidis
TTGGSELGPAVSTAWVVDKKTGEIIKTY

SEQ ID NO: 1841383 - protein, 21 aa, Staphylococcus epidermidis
TTLWSRSLINLQIVNEEYEIK

SEQ ID NO: 1841384 - protein, 20 aa, Staphylococcus epidermidis
TTQAKYPIGTHFKISLISND

SEQ ID NO: 1841385 - protein, 24 aa, Staphylococcus epidermidis
TTSNFKRSVKDTVVKSRATSTKRA

SEQ ID NO: 1841386 - protein, 17 aa, Staphylococcus epidermidis
TVFIGVGTIGSFNQYAD

SEQ ID NO: 1841387 - protein, 24 aa, Staphylococcus epidermidis
TVNGKSGWISKYYLTSASKPSNPT

SEQ ID NO: 1841388 - protein, 24 aa, Staphylococcus epidermidis
TVNGKSGWISKYYLTTPSKVQTLS

SEQ ID NO: 1841389 - protein, 26 aa, Staphylococcus epidermidis
TYGPGGRFGGLVFDTLGFKPADKKVS

SEQ ID NO: 1841390 - protein, 24 aa, Staphylococcus epidermidis
TYSDALMPYNFMNSVFKNAGGKPG

SEQ ID NO: 1841391 - protein, 26 aa, Staphylococcus epidermidis
TYSDALMPYNFMSSVFKNNDGKSGVL

SEQ ID NO: 1841392 - protein, 22 aa, Staphylococcus epidermidis
VADAVLAYYLFSPVELDGKNHK

SEQ ID NO: 1841393 - protein, 18 aa, Staphylococcus epidermidis
VAEAKSIVYNSANSQSFK

SEQ ID NO: 1841394 - protein, 18 aa, Staphylococcus epidermidis
VALLMIIGLSALFQINEA

SEQ ID NO: 1841395 - protein, 25 aa, Staphylococcus epidermidis
VANYFRHGAAHGYQFYNTPYYQLNK

SEQ ID NO: 1841396 - protein, 25 aa, Staphylococcus epidermidis
VAPIVEKLNEKWAKDHKDAKISSGQ

SEQ ID NO: 1841397 - protein, 20 aa, Staphylococcus epidermidis
VDKKTGEIIKTYDVSTPQQK

SEQ ID NO: 1841398 - protein, 17 aa, Staphylococcus epidermidis
VDLPIDYYGQAETIGIT

SEQ ID NO: 1841399 - protein, 19 aa, Staphylococcus epidermidis
VDRGYGLNFNPFHSNNRKL

SEQ ID NO: 1841400 - protein, 19 aa, Staphylococcus epidermidis
VDVMLGGGSKYFGKENGHL

SEQ ID NO: 1841401 - protein, 17 aa, Staphylococcus epidermidis
VDYYVRINMKAFVEAVD

SEQ ID NO: 1841402 - protein, 17 aa, Staphylococcus epidermidis
VEEELSQDIAILVKEKE

SEQ ID NO: 1841403 - protein, 25 aa, Staphylococcus epidermidis
VENLPDKTKLALIFCADDKGQYTLT

SEQ ID NO: 1841404 - protein, 17 aa, Staphylococcus epidermidis
VETKYEFRTSGKKKTVI

SEQ ID NO: 1841405 - protein, 18 aa, Staphylococcus epidermidis
VFASFLILMIFIVGCGSM

SEQ ID NO: 1841406 - protein, 28 aa, Staphylococcus epidermidis
VGASSILIAALLFMGGGSAQAAEQQQDK

SEQ ID NO: 1841407 - protein, 17 aa, Staphylococcus epidermidis
VGGDALRSLSNPERFGQ

SEQ ID NO: 1841408 - protein, 24 aa, Staphylococcus epidermidis
VGHSMGNMSFAFYMKNYGDDLHLP

SEQ ID NO: 1841409 - protein, 18 aa, Staphylococcus epidermidis
VGIVYGRDIAGKKAAFMK

SEQ ID NO: 1841410 - protein, 19 aa, Staphylococcus epidermidis
VGTVLSGFEYRANKEKMDN

SEQ ID NO: 1841411 - protein, 23 aa, Staphylococcus epidermidis
VHHYPRVMSVKKWIKSYPKTKVT

SEQ ID NO: 1841412 - protein, 19 aa, Staphylococcus epidermidis
VIPTYKYLLHFSQQKIDQL

SEQ ID NO: 1841413 - protein, 19 aa, Staphylococcus epidermidis
VISFSVLATSLGIVNAHAK

SEQ ID NO: 1841414 - protein, 19 aa, Staphylococcus epidermidis
VKAGSTLYTVPWGTPSQVA

SEQ ID NO: 1841415 - protein, 17 aa, Staphylococcus epidermidis
VKDKIIYAKDVKQVLNY

SEQ ID NO: 1841416 - protein, 20 aa, Staphylococcus epidermidis
VKDNHLKHLLVETSVDKKAM

SEQ ID NO: 1841417 - protein, 20 aa, Staphylococcus epidermidis
VKFVKENKHELPIDFDQVVI

SEQ ID NO: 1841418 - protein, 17 aa, Staphylococcus epidermidis
VKNTRIESVNGDEISRP

SEQ ID NO: 1841419 - protein, 24 aa, Staphylococcus epidermidis
VKPGDSLYKIALEHHLTLEELYAL

SEQ ID NO: 1841420 - protein, 20 aa, Staphylococcus epidermidis
VKPKPFIASWKDIDPGKKIE

SEQ ID NO: 1841421 - protein, 19 aa, Staphylococcus epidermidis
VKQSKLWTTKDNGFYDLTT

SEQ ID NO: 1841422 - protein, 23 aa, Staphylococcus epidermidis
VKTDLKLGDLNTIRTKYKDANDQ

SEQ ID NO: 1841423 - protein, 19 aa, Staphylococcus epidermidis
VLGLLATLALAIVLSACGN

SEQ ID NO: 1841424 - protein, 21 aa, Staphylococcus epidermidis
VLHPYMKWGDSVIDVKDKSGR

SEQ ID NO: 1841425 - protein, 26 aa, Staphylococcus epidermidis
VLLSISICILMILLTGCGKSSDGLVG

SEQ ID NO: 1841426 - protein, 25 aa, Staphylococcus epidermidis
VLLTSFLLSACTINIERDEKNSEKS

SEQ ID NO: 1841427 - protein, 18 aa, Staphylococcus epidermidis
VLSGCNLPGLKNSHSDDD

SEQ ID NO: 1841428 - protein, 18 aa, Staphylococcus epidermidis
VLSSLFLVFSTITYASER

SEQ ID NO: 1841429 - protein, 18 aa, Staphylococcus epidermidis
VMTSEGLVGRVTKVNQFS

SEQ ID NO: 1841430 - protein, 18 aa, Staphylococcus epidermidis
VMVSFILASCGNHSKTDK

SEQ ID NO: 1841431 - protein, 25 aa, Staphylococcus epidermidis
VMYGDFKCPYCKKVEDNVMPKLKNN

SEQ ID NO: 1841432 - protein, 17 aa, Staphylococcus epidermidis
VNNRTGWIAAKDLIQSN

SEQ ID NO: 1841433 - protein, 18 aa, Staphylococcus epidermidis
VNPAGYRGLGQTMESWGT

SEQ ID NO: 1841434 - protein, 18 aa, Staphylococcus epidermidis
VNSFKGVLNQIKLPTNAP

SEQ ID NO: 1841435 - protein, 23 aa, Staphylococcus epidermidis
VPAANGAAAFQLEKVIKSNYVSE

SEQ ID NO: 1841436 - protein, 34 aa, Staphylococcus epidermidis; identical to SEQ ID NO: 1714358

SEQ ID NO: 1841437 - protein, 21 aa, Staphylococcus epidermidis
VPVDYYVRVNMKAFVEAVDEL

SEQ ID NO: 1841438 - protein, 19 aa, Staphylococcus epidermidis
VPYNPHRVAVLDYGALDVM

SEQ ID NO: 1841439 - protein, 17 aa, Staphylococcus epidermidis
VPYNPNRVAVLDYGALD

SEQ ID NO: 1841440 - protein, 24 aa, Staphylococcus epidermidis
VQFLKDRYYAMKDFPMFDNIEYTE

SEQ ID NO: 1841441 - protein, 20 aa, Staphylococcus epidermidis
VQRHPMGGIQIIPETNQVIS

SEQ ID NO: 1841442 - protein, 26 aa, Staphylococcus epidermidis
VQRKGLRKYNNKLIAVTISSLALVVP

SEQ ID NO: 1841443 - protein, 23 aa, Staphylococcus epidermidis
VRAKPYPPTLVTTALQLKGKAGQ

SEQ ID NO: 1841444 - protein, 18 aa, Staphylococcus epidermidis
VSAGIGIGDNVLKKLGNH

SEQ ID NO: 1841445 - protein, 18 aa, Staphylococcus epidermidis
VSASHSIELQHKDQEIQQ

SEQ ID NO: 1841446 - protein, 25 aa, Staphylococcus epidermidis
VSFGQRVISYPIQFVTGSIGNLFEK

SEQ ID NO: 1841447 - protein, 24 aa, Staphylococcus epidermidis
VSHVPHIIASSLVHLSANHVSHHT

SEQ ID NO: 1841448 - protein, 19 aa, Staphylococcus epidermidis
VSNHITITVPKYIKNIDIK

SEQ ID NO: 1841449 - protein, 24 aa, Staphylococcus epidermidis
VSNRSSGKMGFAIAEALRDKGADV

SEQ ID NO: 1841450 - protein, 20 aa, Staphylococcus epidermidis
VSTRSRFHLKAGDVLISNAT

SEQ ID NO: 1841451 - protein, 29 aa, Staphylococcus epidermidis
VSTSEMTPEAWKLVNEGKLQPTSDAMAKE

SEQ ID NO: 1841452 - protein, 18 aa, Staphylococcus epidermidis
VSYLPRHQVTAIDIEDNQ

SEQ ID NO: 1841453 - protein, 23 aa, Staphylococcus epidermidis
VTKYEGWEFLGIVKDDEDAARGI

SEQ ID NO: 1841454 - protein, 23 aa, Staphylococcus epidermidis
VTTPHQVFLNWFSHDPAFDYFKN

SEQ ID NO: 1841455 - protein, 28 aa, Staphylococcus epidermidis
VVIILICALGFSVYAAINHHTNSNKNDK

SEQ ID NO: 1841456 - protein, 30 aa, Staphylococcus epidermidis
VVILLVIALSFSIYAAVNHKNNSSQSDKDS

SEQ ID NO: 1841457 - protein, 26 aa, Staphylococcus epidermidis
VVKKGKRYGLFNHYEFNIPKYSIDMY

SEQ ID NO: 1841458 - protein, 17 aa, Staphylococcus epidermidis
VVSGITLGAVLGLNVTE

SEQ ID NO: 1841459 - protein, 23 aa, Staphylococcus epidermidis
VWLPPSIVAPYAFVNKQDVKHNG

SEQ ID NO: 1841460 - protein, 26 aa, Staphylococcus epidermidis
VYDKTGGKIGSTWGNANSWASAAQAA

SEQ ID NO: 1841461 - protein, 18 aa, Staphylococcus epidermidis
VYFLPTAIYPNWGQSQRA

SEQ ID NO: 1841462 - protein, 23 aa, Staphylococcus epidermidis
VYYEENDKLFVHAQEKSSERGWK

SEQ ID NO: 1841463 - protein, 22 aa, Staphylococcus epidermidis
WADEMRKLAGNKKILYYSYENF

SEQ ID NO: 1841464 - protein, 18 aa, Staphylococcus epidermidis
WGNANSWASAAQAAGFTV

SEQ ID NO: 1841465 - protein, 17 aa, Staphylococcus epidermidis
WKYNGLSYREMKEKGVI

SEQ ID NO: 1841466 - protein, 22 aa, Staphylococcus epidermidis
WLRTALKRKKHVITANKDLLAV

SEQ ID NO: 1841467 - protein, 17 aa, Staphylococcus epidermidis
WSFKDKDGSVWENGKGD

SEQ ID NO: 1841468 - protein, 35 aa, Staphylococcus epidermidis
WSKKHPRAYVDFYKSDCWYHAKAYKCSSLGKMTKC

SEQ ID NO: 1841469 - protein, 27 aa, Staphylococcus epidermidis
WVAAAKAKPVYGAKSFLNYANKKGIDI

SEQ ID NO: 1841470 - protein, 25 aa, Staphylococcus epidermidis
YAKKLNSIIKHYNLTEFDKKRMPNL

SEQ ID NO: 1841471 - protein, 24 aa, Staphylococcus epidermidis
YAKVFADAGVDVVLGMHPHVIEPV

SEQ ID NO: 1841472 - protein, 18 aa, Staphylococcus epidermidis
YALSRPLFIYAKDKSLKD

SEQ ID NO: 1841473 - protein, 17 aa, Staphylococcus epidermidis
YASRNDVAFVYPKGQSE

SEQ ID NO: 1841474 - protein, 18 aa, Staphylococcus epidermidis
YCSKLVWQSYYYGAGRLS

SEQ ID NO: 1841475 - protein, 19 aa, Staphylococcus epidermidis
YDAVSFIYIPIHGGYMSGS

SEQ ID NO: 1841476 - protein, 24 aa, Staphylococcus epidermidis
YDDDKKPSIAIIYGVKNKKDKDLT

SEQ ID NO: 1841477 - protein, 19 aa, Staphylococcus epidermidis
YDKEGFRDGEFDKDDKGTW

SEQ ID NO: 1841478 - protein, 17 aa, Staphylococcus epidermidis
YDMKPLKTFVYGRTLLL

SEQ ID NO: 1841479 - protein, 19 aa, Staphylococcus epidermidis
YDMVKHVGGDKVDVHSIVP

SEQ ID NO: 1841480 - protein, 17 aa, Staphylococcus epidermidis
YDSTLGKYANRAILDSD

SEQ ID NO: 1841481 - protein, 17 aa, Staphylococcus epidermidis
YEEQNSKPVKVNKEELK

SEQ ID NO: 1841482 - protein, 24 aa, Staphylococcus epidermidis
YENEWKPKIQKMIPSYGQSLINDI

SEQ ID NO: 1841483 - protein, 18 aa, Staphylococcus epidermidis
YERLDRPGIESSNERHNA

SEQ ID NO: 1841484 - protein, 35 aa, Staphylococcus epidermidis
YESKELRQALLYAIDRKKWINAFFNGYGTEINSYV

SEQ ID NO: 1841485 - protein, 26 aa, Staphylococcus epidermidis
YFAKQFNVKPGYIWEINTEKQGTPGQ

SEQ ID NO: 1841486 - protein, 24 aa, Staphylococcus epidermidis
YGKLTNGKYVWIKSTDVAKESVKY

SEQ ID NO: 1841487 - protein, 18 aa, Staphylococcus epidermidis
YGKSLRKLPSANNGTKMY

SEQ ID NO: 1841488 - protein, 26 aa, Staphylococcus epidermidis
YGNKDTRVDFGLEHWGLKQKPNESYI

SEQ ID NO: 1841489 - protein, 19 aa, Staphylococcus epidermidis
YGVKDSYDLALNDWMGSAQ

SEQ ID NO: 1841490 - protein, 24 aa, Staphylococcus epidermidis
YHFESDGNNWSWNYAQTGQATPQQ

SEQ ID NO: 1841491 - protein, 24 aa, Staphylococcus epidermidis
YHGDQIKLQFKVEDGYVTSVTIGQ

SEQ ID NO: 1841492 - protein, 23 aa, Staphylococcus epidermidis
YHGKMIKLQYKVTQGFVTSVTIG

SEQ ID NO: 1841493 - protein, 18 aa, Staphylococcus epidermidis
YIHGGAWFQDPLDSHFEY

SEQ ID NO: 1841494 - protein, 28 aa, Staphylococcus epidermidis
YISNPRLREILGYFIKYVGSSSYDAPAV

SEQ ID NO: 1841495 - protein, 31 aa, Staphylococcus epidermidis
YITTKRLKNGYQWDVLFNLGHSNHENMIYWF

SEQ ID NO: 1841496 - protein, 19 aa, Staphylococcus epidermidis
YKAEDYWFTDPITLEHLRS

SEQ ID NO: 1841497 - protein, 24 aa, Staphylococcus epidermidis
YKDKLRLGMDTQWMNRAGDGYPAF

SEQ ID NO: 1841498 - protein, 22 aa, Staphylococcus epidermidis
YKEKGKFPKRSVWINFDDMDQT

SEQ ID NO: 1841499 - protein, 19 aa, Staphylococcus epidermidis
YKLQVDLERPVPYINELLA

SEQ ID NO: 1841500 - protein, 25 aa, Staphylococcus epidermidis
YKNNDPIILVHGFNGFTDDINPSVL

SEQ ID NO: 1841501 - protein, 26 aa, Staphylococcus epidermidis
YKNQDPIILVHGFNGYASGTGPITGK

SEQ ID NO: 1841502 - protein, 27 aa, Staphylococcus epidermidis
YKNQYPVVFVHGFVGLVGEDSFSMYPN

SEQ ID NO: 1841503 - protein, 20 aa, Staphylococcus epidermidis
YKPTKKSLEVWFVVDNNHVV

SEQ ID NO: 1841504 - protein, 19 aa, Staphylococcus epidermidis
YKSGANGWAVPSTTEHPED

SEQ ID NO: 1841505 - protein, 22 aa, Staphylococcus epidermidis
YLKKLLKPTLAKFIVTHANEHD

SEQ ID NO: 1841506 - protein, 20 aa, Staphylococcus epidermidis
YLSERTKRYRLKQLLNSQNV

SEQ ID NO: 1841507 - protein, 20 aa, Staphylococcus epidermidis
YNAGQEFRGKYQLKEKEGKL

SEQ ID NO: 1841508 - protein, 23 aa, Staphylococcus epidermidis
YNGLSYREMKEKGVIMAHGSSQV

SEQ ID NO: 1841509 - protein, 17 aa, Staphylococcus epidermidis
YNSAFVHAFVDGNRIIE

SEQ ID NO: 1841510 - protein, 18 aa, Staphylococcus epidermidis
YNVTFDYNGFTYHFESDG

SEQ ID NO: 1841511 - protein, 25 aa, Staphylococcus epidermidis
YPELKSELASPFAAIYDTKAKNKVT

SEQ ID NO: 1841512 - protein, 25 aa, Staphylococcus epidermidis
YPELKSELASPFAAIYDVKAKSKVS

SEQ ID NO: 1841513 - protein, 25 aa, Staphylococcus epidermidis
YPNAKTIVLKLLFHPTTGKIYGAQA

SEQ ID NO: 1841514 - protein, 17 aa, Staphylococcus epidermidis
YPQLAHHNFFFSNDSKR

SEQ ID NO: 1841515 - protein, 17 aa, Staphylococcus epidermidis
YPSHWSPGDFGLKAPDT

SEQ ID NO: 1841516 - protein, 18 aa, Staphylococcus epidermidis
YPSVENIKGAKEMHDGKA

SEQ ID NO: 1841517 - protein, 20 aa, Staphylococcus epidermidis
YPVEVFDKIMAVDMRGTFLV

SEQ ID NO: 1841518 - protein, 26 aa, Staphylococcus epidermidis
YPVEVFDKIMAVDMRGTFLVTKFLLP

SEQ ID NO: 1841519 - protein, 17 aa, Staphylococcus epidermidis
YQELVQAIELARTLPQR

SEQ ID NO: 1841520 - protein, 28 aa, Staphylococcus epidermidis
YRHVDLQAQVPLAWGAHRGASIIAEQLA

SEQ ID NO: 1841521 - protein, 19 aa, Staphylococcus epidermidis
YRTSKKFRGKAGSYAKSHF

SEQ ID NO: 1841522 - protein, 20 aa, Staphylococcus epidermidis
YSTELANIFYVRQKEQKGLG

SEQ ID NO: 1841523 - protein, 17 aa, Staphylococcus epidermidis
YSVLREDKYRVIGKTTG

SEQ ID NO: 1841524 - protein, 23 aa, Staphylococcus epidermidis
YSYKIGNKDVRFYVNKKGYVIKG

SEQ ID NO: 1841525 - protein, 19 aa, Staphylococcus epidermidis
YTDGQCTYYAFNRRAELGK

SEQ ID NO: 1841526 - protein, 19 aa, Staphylococcus epidermidis
YTKPEGYTVIARADATSHG

SEQ ID NO: 1841527 - protein, 17 aa, Staphylococcus epidermidis
YTLQPKVGHTYAPDKEV

SEQ ID NO: 1841528 - protein, 22 aa, Staphylococcus epidermidis
YTSGQCTYYVFDKVGGKIGSTW

SEQ ID NO: 1841529 - protein, 35 aa, Staphylococcus epidermidis
YTSGQCTYYVFDRVGGKICSTWGNANNWANAAAAA

SEQ ID NO: 1841530 - protein, 27 aa, Staphylococcus epidermidis
YVFDKVGGKIGSTWGNANNWANAAAQD

SEQ ID NO: 1841531 - protein, 18 aa, Staphylococcus epidermidis
YVHYKRNYLEGASYPSVK

SEQ ID NO: 1841532 - protein, 22 aa, Staphylococcus epidermidis
YVKPQLQQKISYWHNNEGTSID

SEQ ID NO: 1841533 - protein, 19 aa, Staphylococcus epidermidis
YVRKDIMDKLHINPASIKT

SEQ ID NO: 1841534 - protein, 19 aa, Staphylococcus epidermidis
YWAEQWAKAYVKFATYEKE

SEQ ID NO: 1841535 - protein, 17 aa, Staphylococcus epidermidis
YWGGDKMNIRQDLEENG

SEQ ID NO: 1841536 - protein, 19 aa, Staphylococcus epidermidis
YYAQVWLTALDSYRGDSDL

SEQ ID NO: 1841537 - protein, 18 aa, Staphylococcus epidermidis
YYERSEPVAEAFGDLDPK

SEQ ID NO: 1841538 - protein, 21 aa, Staphylococcus epidermidis
YYNSLGFANTYAFMVTKETAK

SEQ ID NO: 1841539 - protein, 18 aa, Staphylococcus epidermidis
YYRKQYEYKKVLSKGEHK

SEQ ID NO: 1841540 - protein, 19 aa, Staphylococcus epidermidis
VELYYYIKGGRVDYGAAHA

SEQ ID NO: 1841541 - protein, 19 aa, Staphylococcus epidermidis
YDRAVELYYYIKGGRVDYG

SEQ ID NO: 1841542 - protein, 24 aa, Staphylococcus epidermidis
NPAEQGRFLKFFVDEGLIKLKKGV

SEQ ID NO: 1841543 - protein, 20 aa, Staphylococcus epidermidis
RFVALILAVFFFLSVNNVFG

SEQ ID NO: 1841544 - protein, 19 aa, Staphylococcus epidermidis
VKILGRLNYRTSYGQNVLK

SEQ ID NO: 1841545 - protein, 17 aa, Staphylococcus epidermidis
WTYKDGKPWYFLEEKYP

SEQ ID NO: 1841546 - protein, 19 aa, Staphylococcus epidermidis
YHYTWKGNWSPDRVNTSYN

SEQ ID NO: 1841547 - protein, 18 aa, Staphylococcus epidermidis
YKDGKPWYFLEEKYPDYG

SEQ ID NO: 1841548 - protein, 19 aa, Staphylococcus epidermidis
AEYAKRIANSKVWETEDQA

SEQ ID NO: 1841549 - protein, 20 aa, Staphylococcus epidermidis
ANCALPYYIGNVIEDRRKVL

SEQ ID NO: 1841550 - protein, 23 aa, Staphylococcus epidermidis
AQQFDVKPGYIWEINTEKQGTPG

SEQ ID NO: 1841551 - protein, 19 aa, Staphylococcus epidermidis
AYKDWKPGQKIHLIGHSMG

SEQ ID NO: 1841552 - protein, 24 aa, Staphylococcus epidermidis
DYTSYFPKYGYRNGVGRPEGIVVH

SEQ ID NO: 1841553 - protein, 18 aa, Staphylococcus epidermidis
DYVKEISHQFGFVNVGKR

SEQ ID NO: 1841554 - protein, 20 aa, Staphylococcus epidermidis
EEMRKWIPLMMKGREDKGYM

SEQ ID NO: 1841555 - protein, 17 aa, Staphylococcus epidermidis
EKDPVWKKLNAVKNQRV

SEQ ID NO: 1841556 - protein, 25 aa, Staphylococcus epidermidis
ESIEFGSSIGEEFKGLIGNFKSDIN

SEQ ID NO: 1841557 - protein, 20 aa, Staphylococcus epidermidis
ESKHLGGFPISGQFIACTNP

SEQ ID NO: 1841558 - protein, 19 aa, Staphylococcus epidermidis
GGQTIRLMEHFLRNGNQEE

SEQ ID NO: 1841559 - protein, 24 aa, Staphylococcus epidermidis
KADLNMFLPFTITGNLIGKAKEKE

SEQ ID NO: 1841560 - protein, 23 aa, Staphylococcus epidermidis
KLIVVLCAMIIFIALIGLSIRSQ

SEQ ID NO: 1841561 - protein, 19 aa, Staphylococcus epidermidis
KNINGVKWYYGQLLDGKYV

SEQ ID NO: 1841562 - protein, 19 aa, Staphylococcus epidermidis
KRIANSKVWETEDQAVNDL

SEQ ID NO: 1841563 - protein, 18 aa, Staphylococcus epidermidis
KVVSLFLKECEDYGIDFK

SEQ ID NO: 1841564 - protein, 18 aa, Staphylococcus epidermidis
KYQFLQSTWDSVAPSQYK

SEQ ID NO: 1841565 - protein, 17 aa, Staphylococcus epidermidis
LAIGLGVVAGNAGHDAH

SEQ ID NO: 1841566 - protein, 18 aa, Staphylococcus epidermidis
LPSMVALTLFGTAFTAHQ

SEQ ID NO: 1841567 - protein, 20 aa, Staphylococcus epidermidis
LYTEGQCTWYVFDKRSQAGK

SEQ ID NO: 1841568 - protein, 23 aa, Staphylococcus epidermidis
MKILLWVVGILFLLAIIAVIYVS

SEQ ID NO: 1841569 - protein, 19 aa, Staphylococcus epidermidis
NNDPIILVHGFNGFTDDIN

SEQ ID NO: 1841570 - protein, 24 aa, Staphylococcus epidermidis
NSDLKDIPIHFAIYKQSSQDSITP

SEQ ID NO: 1841571 - protein, 24 aa, Staphylococcus epidermidis
NVKFLKDRYEAMKQFPMFDNIEYT

SEQ ID NO: 1841572 - protein, 17 aa, Staphylococcus epidermidis
PGQKIHLIGHSMGGQTI

SEQ ID NO: 1841573 - protein, 24 aa, Staphylococcus epidermidis
QTEDGFRYVFSFKDPSKSNTYSIV

SEQ ID NO: 1841574 - protein, 24 aa, Staphylococcus epidermidis
RHVNLPAQVPLAWGAHRGASIIAE

SEQ ID NO: 1841575 - protein, 19 aa, Staphylococcus epidermidis
SIYKPTWKSEALSYKDATS

SEQ ID NO: 1841576 - protein, 18 aa, Staphylococcus epidermidis
YDKTGGKIGSTWGNANSW

SEQ ID NO: 1841577 - protein, 17 aa, Staphylococcus epidermidis
YNLFHIYPLFPIPERQR

SEQ ID NO: 1841578 - protein, 20 aa, Staphylococcus epidermidis
AELYDLIYEKYLIKTKQVAP

SEQ ID NO: 1841579 - protein, 18 aa, Staphylococcus epidermidis
AIMGRYVLTPEIFDYLET

SEQ ID NO: 1841580 - protein, 18 aa, Staphylococcus epidermidis
ANIPLIRLMNKFELKKAT

SEQ ID NO: 1841581 - protein, 19 aa, Staphylococcus epidermidis
EKLKWIWITTLIILVVSLI

SEQ ID NO: 1841582 - protein, 21 aa, Staphylococcus epidermidis
ESKHLGGFPISGQFLICTNPD

SEQ ID NO: 1841583 - protein, 19 aa, Staphylococcus epidermidis
FFASGAMTWFTIDKNKYDN

SEQ ID NO: 1841584 - protein, 24 aa, Staphylococcus epidermidis
FGPGGRFGGLVFDTLGFKPADKKV

SEQ ID NO: 1841585 - protein, 17 aa, Staphylococcus epidermidis
FYDKIGEVGKYFEIPTY

SEQ ID NO: 1841586 - protein, 24 aa, Staphylococcus epidermidis
GTKALDLELGFSQWGFKQQPNESY

SEQ ID NO: 1841587 - protein, 17 aa, Staphylococcus epidermidis
IILVHGFNGYASGTGPV

SEQ ID NO: 1841588 - protein, 17 aa, Staphylococcus epidermidis
IKKKLPFHKSLQLVERD

SEQ ID NO: 1841589 - protein, 19 aa, Staphylococcus epidermidis
INKRVDIMLGHGLFNEVQH

SEQ ID NO: 1841590 - protein, 17 aa, Staphylococcus epidermidis
ITDCLIREGRMKLDKGI

SEQ ID NO: 1841591 - protein, 18 aa, Staphylococcus epidermidis
KATSYDIVFLFPKSMQLE

SEQ ID NO: 1841592 - protein, 22 aa, Staphylococcus epidermidis
KNIKSYAIGVGPEYTDLNIKNT

SEQ ID NO: 1841593 - protein, 24 aa, Staphylococcus epidermidis
KPSQIKAAVFFGGFYNMKTVKATE

SEQ ID NO: 1841594 - protein, 22 aa, Staphylococcus epidermidis
KQELTKLGYRVHEANVGAFSSN

SEQ ID NO: 1841595 - protein, 20 aa, Staphylococcus epidermidis
LKKNIPLVLVSRSFNGIVSP

SEQ ID NO: 1841596 - protein, 22 aa, Staphylococcus epidermidis
LSLIIICSVGVYAQNKKLSKDN

SEQ ID NO: 1841597 - protein, 17 aa, Staphylococcus epidermidis
LTWFKNKMNVHWLNKER

SEQ ID NO: 1841598 - protein, 24 aa, Staphylococcus epidermidis
NNEKLADILLQFKNSNKIISSVCH

SEQ ID NO: 1841599 - protein, 17 aa, Staphylococcus epidermidis
NQYPVVFVHGFVGLVGE

SEQ ID NO: 1841600 - protein, 17 aa, Staphylococcus epidermidis
PGQKIHLVGHSMGGQTI

SEQ ID NO: 1841601 - protein, 25 aa, Staphylococcus epidermidis
PYPHGQCTWYVYHRMNQFDASISGD

SEQ ID NO: 1841602 - protein, 17 aa, Staphylococcus epidermidis
QRVIKRYGSLVPLTELD

SEQ ID NO: 1841603 - protein, 17 aa, Staphylococcus epidermidis
RVDFGLEHWGLKQKPNE

SEQ ID NO: 1841604 - protein, 20 aa, Staphylococcus epidermidis
SAIVVLLLLIGLAFGIYSFV

SEQ ID NO: 1841605 - protein, 22 aa, Staphylococcus epidermidis
SNTEILYRLGIGEDIVGVSTVD

SEQ ID NO: 1841606 - protein, 21 aa, Staphylococcus epidermidis
SNVKGLGVISFRTIDAEDAQD

SEQ ID NO: 1841607 - protein, 21 aa, Staphylococcus epidermidis
TGHKYHNVFGIGAFDNNALVD

SEQ ID NO: 1841608 - protein, 21 aa, Staphylococcus epidermidis
TKFPNVFLIGATVRHQNAILC

SEQ ID NO: 1841609 - protein, 23 aa, Staphylococcus epidermidis
TKSRFNGIMKNHFGNVPLEKVVS

SEQ ID NO: 1841610 - protein, 20 aa, Staphylococcus epidermidis
VQNSKLWKSKDSGLHDLTRD

SEQ ID NO: 1841611 - protein, 23 aa, Staphylococcus epidermidis
YYVFDRVGGKIGSTWGNANNWAN

SEQ ID NO: 1841612 - protein, 19 aa, Staphylococcus epidermidis
AYCPGVAKTEMWDRIDEEM

SEQ ID NO: 1841613 - protein, 18 aa, Staphylococcus epidermidis
ENIKKVLLFLSRNTSSSG

SEQ ID NO: 1841614 - protein, 17 aa, Staphylococcus epidermidis
ENLNWIWNSLSVKDQET

SEQ ID NO: 1841615 - protein, 18 aa, Staphylococcus epidermidis
ESDLPFDDLEIVHQNISN

SEQ ID NO: 1841616 - protein, 19 aa, Staphylococcus epidermidis
FSDVFGYFIDDEDFLMGED

SEQ ID NO: 1841617 - protein, 17 aa, Staphylococcus epidermidis
ILFFLIVMLGFAGGLGY

SEQ ID NO: 1841618 - protein, 17 aa, Staphylococcus epidermidis
INQRAYWFITVHAKEGD

SEQ ID NO: 1841619 - protein, 18 aa, Staphylococcus epidermidis
IRLMEHFLRNGNQEEIDY

SEQ ID NO: 1841620 - protein, 22 aa, Staphylococcus epidermidis
KDELRLGMDTQWMNRAGDGYPA

SEQ ID NO: 1841621 - protein, 19 aa, Staphylococcus epidermidis
LGFAGGLGYSHYKDSKANT

SEQ ID NO: 1841622 - protein, 17 aa, Staphylococcus epidermidis
LKLLVGLSQDMTQNQLE

SEQ ID NO: 1841623 - protein, 23 aa, Staphylococcus epidermidis
LNSLPATDFRTDWMSESGQKQVN

SEQ ID NO: 1841624 - protein, 17 aa, Staphylococcus epidermidis
MAARTGVSASTWEHIIA

SEQ ID NO: 1841625 - protein, 17 aa, Staphylococcus epidermidis
NSIIKHYHLTSFDKEKM

SEQ ID NO: 1841626 - protein, 17 aa, Staphylococcus epidermidis
PNFETALSIAKNEANMY

SEQ ID NO: 1841627 - protein, 17 aa, Staphylococcus epidermidis
RIWTYKDGKPWYFLEEK

SEQ ID NO: 1841628 - protein, 17 aa, Staphylococcus epidermidis
SGCSSFDHRKRESINDK

SEQ ID NO: 1841629 - protein, 23 aa, Staphylococcus epidermidis
VKFLKNRYEAMRNFPMFDNIEYT

SEQ ID NO: 1841630 - protein, 28 aa, Staphylococcus epidermidis
VVIILICALGFSLYAAINHHTNSNKNDK

SEQ ID NO: 1841631 - protein, 21 aa, Staphylococcus epidermidis
YPVVFVHGFVGLVGEDAFSMY

SEQ ID NO: 1841632 - protein, 18 aa, Staphylococcus epidermidis
AFTILILAGCGLGDSDNN

SEQ ID NO: 1841633 - protein, 19 aa, Staphylococcus epidermidis
ATRVARCLSPFEGDRSQAL

SEQ ID NO: 1841634 - protein, 19 aa, Staphylococcus epidermidis
CYIYKFRARFAVLAHLVSL

SEQ ID NO: 1841635 - protein, 18 aa, Staphylococcus epidermidis
DPVLNQKFAFMIKEKLIE

SEQ ID NO: 1841636 - protein, 24 aa, Staphylococcus epidermidis
DSVTAYDFVYAWRKVVNPKTASEF

SEQ ID NO: 1841637 - protein, 19 aa, Staphylococcus epidermidis
ENIKKVLLFLSRNTSSSGV

SEQ ID NO: 1841638 - protein, 17 aa, Staphylococcus epidermidis
FIVFWGIGFFKYADAHV

SEQ ID NO: 1841639 - protein, 19 aa, Staphylococcus epidermidis
FSSNGRFGGFLNKDLGIKH

SEQ ID NO: 1841640 - protein, 17 aa, Staphylococcus epidermidis
HKTICTFTKVKTVSHND

SEQ ID NO: 1841641 - protein, 17 aa, Staphylococcus epidermidis
IYISLLILVSGCGNSKE

SEQ ID NO: 1841642 - protein, 23 aa, Staphylococcus epidermidis
KFQNRFLFNLGIKHYNFNNDIRK

SEQ ID NO: 1841643 - protein, 22 aa, Staphylococcus epidermidis
KNKHLRLAISQAINKKGYVNSV

SEQ ID NO: 1841644 - protein, 22 aa, Staphylococcus epidermidis
LLLIGLAFGIYSFVDSSKKGNE

SEQ ID NO: 1841645 - protein, 19 aa, Staphylococcus epidermidis
LQQCLKKNIPLVLVSRSFN

SEQ ID NO: 1841646 - protein, 19 aa, Staphylococcus epidermidis
MSEFMKFVLEDEGKAAEDA

SEQ ID NO: 1841647 - protein, 17 aa, Staphylococcus epidermidis
NGVKMIVNQVVDTVSQL

SEQ ID NO: 1841648 - protein, 19 aa, Staphylococcus epidermidis
PIEGYKWYDRSTFKTGSYG

SEQ ID NO: 1841649 - protein, 20 aa, Staphylococcus epidermidis
RTGVSASTWEHIIARESNGQ

SEQ ID NO: 1841650 - protein, 20 aa, Staphylococcus epidermidis
SKNQKGMIVQQDWKGSHNQF

SEQ ID NO: 1841651 - protein, 24 aa, Staphylococcus epidermidis
TDRYGRTLAYVWLKNGDMFNESLV

SEQ ID NO: 1841652 - protein, 19 aa, Staphylococcus epidermidis
TGVSASTWEHIIARESNGQ

SEQ ID NO: 1841653 - protein, 22 aa, Staphylococcus epidermidis
VFGTRNELGLAIGKSDRVNIGI

SEQ ID NO: 1841654 - protein, 17 aa, Staphylococcus epidermidis
WYDRSTFKTGSYGSNQR

SEQ ID NO: 1841655 - protein, 23 aa, Staphylococcus epidermidis
YTDVKWCRMMIRQVLSNSLKYSD

SEQ ID NO: 1841656 - protein, 22 aa, Staphylococcus epidermidis
YVFDRVGGKIGSTWGNANNWAN

SEQ ID NO: 1841657 - protein, 17 aa, Staphylococcus epidermidis
AFTVLILAGCGLGDSDN

SEQ ID NO: 1841658 - protein, 26 aa, Staphylococcus epidermidis
ARRGELQGLGGSWGVAPKQDFNLWRN

SEQ ID NO: 1841659 - protein, 17 aa, Staphylococcus epidermidis
FASLLVLTACGQEEEKK

SEQ ID NO: 1841660 - protein, 23 aa, Staphylococcus epidermidis
GCGFTVKVPPEYLGGQNNKNFIN

SEQ ID NO: 1841661 - protein, 17 aa, Staphylococcus epidermidis
GDLPDFIVYYLDDSGRP

SEQ ID NO: 1841662 - protein, 18 aa, Staphylococcus epidermidis
GEISPLFQGGHDNMVSSI

SEQ ID NO: 1841663 - protein, 17 aa, Staphylococcus epidermidis
GNSGGWKKPGYWSKSSV

SEQ ID NO: 1841664 - protein, 17 aa, Staphylococcus epidermidis
GTNYGWVKQDEVIYNTA

SEQ ID NO: 1841665 - protein, 18 aa, Staphylococcus epidermidis
IAMTLLLTGCVQKDNDHD

SEQ ID NO: 1841666 - protein, 18 aa, Staphylococcus epidermidis
INQRAYWFITVHAKEGDP

SEQ ID NO: 1841667 - protein, 17 aa, Staphylococcus epidermidis
IRLMEHFLRNGNQEEID

SEQ ID NO: 1841668 - protein, 18 aa, Staphylococcus epidermidis
KENLNWIWNSLSVKDQET

SEQ ID NO: 1841669 - protein, 17 aa, Staphylococcus epidermidis
KEPSIPHNFTFHLLFSN

SEQ ID NO: 1841670 - protein, 28 aa, Staphylococcus epidermidis
KNQYPVVFVHGFLGFAGDNQFSLAPKYW

SEQ ID NO: 1841671 - protein, 18 aa, Staphylococcus epidermidis
KVEAALQFLEKNTKGSVL

SEQ ID NO: 1841672 - protein, 23 aa, Staphylococcus epidermidis
KVFGTRNELGLAIGKSDRVNIGI

SEQ ID NO: 1841673 - protein, 19 aa, Staphylococcus epidermidis
KWCRMMIRQVLSNSLKYSD

SEQ ID NO: 1841674 - protein, 19 aa, Staphylococcus epidermidis
MSEFMKFVLEDEGQAAEDA

SEQ ID NO: 1841675 - protein, 20 aa, Staphylococcus epidermidis
NPIEGYKWYDRSTFKTGSYG

SEQ ID NO: 1841676 - protein, 24 aa, Staphylococcus epidermidis
NVKFLKNRYEAMRNFPMFDNIEYT

SEQ ID NO: 1841677 - protein, 24 aa, Staphylococcus epidermidis
NYWGGNRLKIIQDYRAKGYNVMEA

SEQ ID NO: 1841678 - protein, 25 aa, Staphylococcus epidermidis
NYWGGNRLKIIQDYRAKGYNVMEAS

SEQ ID NO: 1841679 - protein, 19 aa, Staphylococcus epidermidis
QGKKSGGYWVRGTTSKIVK

SEQ ID NO: 1841680 - protein, 17 aa, Staphylococcus epidermidis
QQCLKKNIPLVLVSRSF

SEQ ID NO: 1841681 - protein, 17 aa, Staphylococcus epidermidis
RNGVGRPEGIVVHDTAN

SEQ ID NO: 1841682 - protein, 18 aa, Staphylococcus epidermidis
SLLILGSCGVKHNNSDSN

SEQ ID NO: 1841683 - protein, 18 aa, Staphylococcus epidermidis
SMLPKVEAALQFLEKNTK

SEQ ID NO: 1841684 - protein, 22 aa, Staphylococcus epidermidis
TGRELGQFYLGIMDNIMRIEEA

SEQ ID NO: 1841685 - protein, 18 aa, Staphylococcus epidermidis
VDIDLGFSQWGLKQQPNE

SEQ ID NO: 1841686 - protein, 17 aa, Staphylococcus epidermidis
WKKPGYWSKSSVKKTWS

SEQ ID NO: 1841687 - protein, 17 aa, Staphylococcus epidermidis
YDRAVELYYYIKGGRVD

SEQ ID NO: 1841688 - protein, 18 aa, Staphylococcus epidermidis
AANGAAAFQLEKVIKSNY

SEQ ID NO: 1841689 - protein, 20 aa, Staphylococcus epidermidis
AEEYKKLSQLVGDYTKKQKQ

SEQ ID NO: 1841690 - protein, 20 aa, Staphylococcus epidermidis
AELYDLIYEKYLIKTGQVAP

SEQ ID NO: 1841691 - protein, 17 aa, Staphylococcus epidermidis
AFTILILAGCGLGDSDN

SEQ ID NO: 1841692 - protein, 20 aa, Staphylococcus epidermidis
AIKSYAIGVGPEYTDLNIKN

SEQ ID NO: 1841693 - protein, 23 aa, Staphylococcus epidermidis
AKQFNVKPGYIWEINTEKQGTPG

SEQ ID NO: 1841694 - protein, 18 aa, Staphylococcus epidermidis
ALMPYNFMNSVFKNAGGK

SEQ ID NO: 1841695 - protein, 19 aa, Staphylococcus epidermidis
ALMPYNFMSSVFKNNDGKS

SEQ ID NO: 1841696 - protein, 19 aa, Staphylococcus epidermidis
ANCALPYYIGEIVNERDNV

SEQ ID NO: 1841697 - protein, 23 aa, Staphylococcus epidermidis
ATEDGFRYVFSFKDSSKKDNYSI

SEQ ID NO: 1841698 - protein, 20 aa, Staphylococcus epidermidis
ATSYYNNWLYFYIIASSSHD

SEQ ID NO: 1841699 - protein, 21 aa, Staphylococcus epidermidis
ATTYYNNWLFYYIFAYSFLNQ

SEQ ID NO: 1841700 - protein, 26 aa, Staphylococcus epidermidis
AYIVKAGDCLYNIALDHGITLDQLYA

SEQ ID NO: 1841701 - protein, 20 aa, Staphylococcus epidermidis
CYAKHGWGACACDAPFIRAT

SEQ ID NO: 1841702 - protein, 21 aa, Staphylococcus epidermidis
CYIYKFRARFAVLARIVSLRE

SEQ ID NO: 1841703 - protein, 22 aa, Staphylococcus epidermidis
CYIYKFRARFAVLARIVSLREG

SEQ ID NO: 1841704 - protein, 18 aa, Staphylococcus epidermidis
DAVLAYYLFSPVELDGKN

SEQ ID NO: 1841705 - protein, 18 aa, Staphylococcus epidermidis
DDEIMWQLNLNLMGVIRM

SEQ ID NO: 1841706 - protein, 18 aa, Staphylococcus epidermidis
DHRVIKHYGSLVPLTELD

SEQ ID NO: 1841707 - protein, 19 aa, Staphylococcus epidermidis
DIISVLPFGNLISQIKVKG

SEQ ID NO: 1841708 - protein, 18 aa, Staphylococcus epidermidis
DKGIPIVLVSRSFNGIVS

SEQ ID NO: 1841709 - protein, 24 aa, Staphylococcus epidermidis
DKYQHIGGGPGMALSSPNQSYDSF

SEQ ID NO: 1841710 - protein, 21 aa, Staphylococcus epidermidis
DMGARPYAGIAPRGMTSKQYS

SEQ ID NO: 1841711 - protein, 17 aa, Staphylococcus epidermidis
DNKEDWDEPVFIKGADL

SEQ ID NO: 1841712 - protein, 17 aa, Staphylococcus epidermidis
DPIILVHGFNGYASGTG

SEQ ID NO: 1841713 - protein, 23 aa, Staphylococcus epidermidis
DRYGRTLAYVWLKNGDMFNESLV

SEQ ID NO: 1841714 - protein, 30 aa, Staphylococcus epidermidis
DVGKAFGRKNSRVDFGLAQWGLKQKPNESY

SEQ ID NO: 1841715 - protein, 21 aa, Staphylococcus epidermidis
EEKKRINGLVIIKSKNNYIKI

SEQ ID NO: 1841716 - protein, 20 aa, Staphylococcus epidermidis
EEMRKWIPLMMKGHNSSDIM

SEQ ID NO: 1841717 - protein, 19 aa, Staphylococcus epidermidis
EGLPSGWTHSFVKAQNGQS

SEQ ID NO: 1841718 - protein, 23 aa, Staphylococcus epidermidis
EKSIWYKLLVNLGINTITAIGHQ

SEQ ID NO: 1841719 - protein, 20 aa, Staphylococcus epidermidis
EMKKWIPLMMKGRENNSGVM

SEQ ID NO: 1841720 - protein, 17 aa, Staphylococcus epidermidis
ESICRRILVDGLKVARA

SEQ ID NO: 1841721 - protein, 24 aa, Staphylococcus epidermidis
ESKELRQALLYAIDRKKWINAFFN

SEQ ID NO: 1841722 - protein, 21 aa, Staphylococcus epidermidis
EYYARWGYDMHQLFELVKYHY

SEQ ID NO: 1841723 - protein, 21 aa, Staphylococcus epidermidis
FASLLVLGACGQNGDNSNKDD

SEQ ID NO: 1841724 - protein, 19 aa, Staphylococcus epidermidis
FDKVGGKIGSTWGNANNWA

SEQ ID NO: 1841725 - protein, 19 aa, Staphylococcus epidermidis
FDNDEVINGLIWSEILSKP

SEQ ID NO: 1841726 - protein, 17 aa, Staphylococcus epidermidis
FGTRNELGLAIGKSDRV

SEQ ID NO: 1841727 - protein, 20 aa, Staphylococcus epidermidis
FISEMNWIAPYIVSTRTISA

SEQ ID NO: 1841728 - protein, 18 aa, Staphylococcus epidermidis
FNVKFSVIEPGGIQSEFT

SEQ ID NO: 1841729 - protein, 17 aa, Staphylococcus epidermidis
FPSVILPNNNRHQISNT

SEQ ID NO: 1841730 - protein, 18 aa, Staphylococcus epidermidis
FSDVFGYFIDDEDFLMGE

SEQ ID NO: 1841731 - protein, 17 aa, Staphylococcus epidermidis
FSDVFGYFVDDEDFLMG

SEQ ID NO: 1841732 - protein, 17 aa, Staphylococcus epidermidis
FSMYPNYWGGIKYNVKQ

SEQ ID NO: 1841733 - protein, 21 aa, Staphylococcus epidermidis
FSSALILGACGNNGTSNNDSD

SEQ ID NO: 1841734 - protein, 23 aa, Staphylococcus epidermidis
FVEEKGRVIGMPKLKGLKNKENP

SEQ ID NO: 1841735 - protein, 17 aa, Staphylococcus epidermidis
FYDKIGEVGKYFEIPIY

SEQ ID NO: 1841736 - protein, 21 aa, Staphylococcus epidermidis
FYKSDCWYHAKAYKCSSLGKM

SEQ ID NO: 1841737 - protein, 19 aa, Staphylococcus epidermidis
GDSDLPFDDLEIVHQNISN

SEQ ID NO: 1841738 - protein, 19 aa, Staphylococcus epidermidis
GESDLPFDDLEIVHQNISN

SEQ ID NO: 1841739 - protein, 21 aa, Staphylococcus epidermidis
GGCFWCMVKPFSSYPGIKSVV

SEQ ID NO: 1841740 - protein, 19 aa, Staphylococcus epidermidis
GGQTVRLLEEMLRNGNPEE

SEQ ID NO: 1841741 - protein, 24 aa, Staphylococcus epidermidis
GGSELGPAVSTAWVVDKKTGEIIK

SEQ ID NO: 1841742 - protein, 19 aa, Staphylococcus epidermidis
GGSVKAQFLAAGGTEAAWN

SEQ ID NO: 1841743 - protein, 18 aa, Staphylococcus epidermidis
GGTDYGLIDPKEANESSQ

SEQ ID NO: 1841744 - protein, 19 aa, Staphylococcus epidermidis
GKGDVSYRISFKTSGLPTE

SEQ ID NO: 1841745 - protein, 17 aa, Staphylococcus epidermidis
GLPTERLYYAAGGRALE

SEQ ID NO: 1841746 - protein, 26 aa, Staphylococcus epidermidis
GLVLIMFVLCGFIFPLTVTALGQVLF

SEQ ID NO: 1841747 - protein, 21 aa, Staphylococcus epidermidis
GNSVPRFHITWGTGPGLVEPF

SEQ ID NO: 1841748 - protein, 23 aa, Staphylococcus epidermidis
GPGGRFGGLVFDTLGFKPADKKV

SEQ ID NO: 1841749 - protein, 23 aa, Staphylococcus epidermidis
GRGFTVKVPPEYLGGQNNKNFIN

SEQ ID NO: 1841750 - protein, 17 aa, Staphylococcus epidermidis
GSWGFSFTDKEGHLEGS

SEQ ID NO: 1841751 - protein, 24 aa, Staphylococcus epidermidis
GTKALDLELGFSQWGFKQKPNESY

SEQ ID NO: 1841752 - protein, 18 aa, Staphylococcus epidermidis
GTLLKNLTTWMGKTDSHS

SEQ ID NO: 1841753 - protein, 20 aa, Staphylococcus epidermidis
HDPIILVHGFNGFTDDINPT

SEQ ID NO: 1841754 - protein, 18 aa, Staphylococcus epidermidis
HEGKGFFNGGLQGNKSNG

SEQ ID NO: 1841755 - protein, 18 aa, Staphylococcus epidermidis
HENMIYWFAIPRDQTPAG

SEQ ID NO: 1841756 - protein, 17 aa, Staphylococcus epidermidis
HKTICTFTKVKTVSHNN

SEQ ID NO: 1841757 - protein, 24 aa, Staphylococcus epidermidis
HRMGIKLTPILGWAERGGSSASGH

SEQ ID NO: 1841758 - protein, 17 aa, Staphylococcus epidermidis
HSDAVIVSAHWGNEGQH

SEQ ID NO: 1841759 - protein, 22 aa, Staphylococcus epidermidis
HSHTAIKHGMKFHNDILAQTGT

SEQ ID NO: 1841760 - protein, 20 aa, Staphylococcus epidermidis
HTISTFWGDARNWAGQASSA

SEQ ID NO: 1841761 - protein, 18 aa, Staphylococcus epidermidis
HVDLQAQVPLAWGAHRGA

SEQ ID NO: 1841762 - protein, 18 aa, Staphylococcus epidermidis
HYTWKGNWSPDRVNTSYN

SEQ ID NO: 1841763 - protein, 17 aa, Staphylococcus epidermidis
IAKRKGISFSRQTAKPQ

SEQ ID NO: 1841764 - protein, 20 aa, Staphylococcus epidermidis
IGAICGAVDYLARNGFLNKY

SEQ ID NO: 1841765 - protein, 17 aa, Staphylococcus epidermidis
IHFVTGAIGNIFNKDGS

SEQ ID NO: 1841766 - protein, 21 aa, Staphylococcus epidermidis
IHLLDRMGVMFSRTNEGLLDF

SEQ ID NO: 1841767 - protein, 18 aa, Staphylococcus epidermidis
IKAQLPFHKSLQMVERDD

SEQ ID NO: 1841768 - protein, 24 aa, Staphylococcus epidermidis
ILCYIYKFRARFAVLARIVSLREG

SEQ ID NO: 1841769 - protein, 17 aa, Staphylococcus epidermidis
ILLWVVGILFLLTVIAV

SEQ ID NO: 1841770 - protein, 19 aa, Staphylococcus epidermidis
ILVPGGFGFRASEGKISAI

SEQ ID NO: 1841771 - protein, 17 aa, Staphylococcus epidermidis
IMGRYVLTPEIFDYLKT

SEQ ID NO: 1841772 - protein, 20 aa, Staphylococcus epidermidis
INESVKLYAIVNRHTGEIIT

SEQ ID NO: 1841773 - protein, 19 aa, Staphylococcus epidermidis
INKRVDIMLGHGLFNEVKH

SEQ ID NO: 1841774 - protein, 22 aa, Staphylococcus epidermidis
ISLSSMFLFSACGQNSNETSHN

SEQ ID NO: 1841775 - protein, 24 aa, Staphylococcus epidermidis
ISNPRLREILGYFIKYVGSSSYDA

SEQ ID NO: 1841776 - protein, 26 aa, Staphylococcus epidermidis
ITTKRLKNGYQWDVLFNLGHSNHENM

SEQ ID NO: 1841777 - protein, 24 aa, Staphylococcus epidermidis
IVMFVLCGLLFPLTVTAIGQITFP

SEQ ID NO: 1841778 - protein, 20 aa, Staphylococcus epidermidis
IVTTCSFGYITFSKLTSETE

SEQ ID NO: 1841779 - protein, 22 aa, Staphylococcus epidermidis
KADINIKFSYLVTANVIGKAPE

SEQ ID NO: 1841780 - protein, 19 aa, Staphylococcus epidermidis
KAKNLDGAFALYSTVKPEK

SEQ ID NO: 1841781 - protein, 21 aa, Staphylococcus epidermidis
KDGKVKGVMFFKLKDTKTPVT

SEQ ID NO: 1841782 - protein, 20 aa, Staphylococcus epidermidis
KDKLRLGMDTQWMNRAGDGY

SEQ ID NO: 1841783 - protein, 22 aa, Staphylococcus epidermidis
KDLKSFVDLCNRSIKDNEDILD

SEQ ID NO: 1841784 - protein, 22 aa, Staphylococcus epidermidis
KDNGINEFLIWNAANDYTNGPN

SEQ ID NO: 1841785 - protein, 31 aa, Staphylococcus epidermidis
KEPTKEEIAEWDRQNVKGGTDYGLIDPKEAN

SEQ ID NO: 1841786 - protein, 17 aa, Staphylococcus epidermidis
KIGSTWGNANNWANAAA

SEQ ID NO: 1841787 - protein, 22 aa, Staphylococcus epidermidis
KKHPKVLILMGIPGSYLVATDQ

SEQ ID NO: 1841788 - protein, 18 aa, Staphylococcus epidermidis
KKLKWIWITTLIILVVAL

SEQ ID NO: 1841789 - protein, 18 aa, Staphylococcus epidermidis
KKPSIAIIYGVKNKKDKD

SEQ ID NO: 1841790 - protein, 20 aa, Staphylococcus epidermidis
KLHSWLRLSTLIDDVKVKDK

SEQ ID NO: 1841791 - protein, 22 aa, Staphylococcus epidermidis
KLVVVLCAIIVFIALIGLSIRS

SEQ ID NO: 1841792 - protein, 18 aa, Staphylococcus epidermidis
KNLGGFPITGQFLICTNP

SEQ ID NO: 1841793 - protein, 20 aa, Staphylococcus epidermidis
KNQDPIILVHGFNGYASGTG

SEQ ID NO: 1841794 - protein, 24 aa, Staphylococcus epidermidis
KPSQIKAAVFFGGFYNMKTVRATE

SEQ ID NO: 1841795 - protein, 21 aa, Staphylococcus epidermidis
KQELTKLGYRVHEANVGAFSS

SEQ ID NO: 1841796 - protein, 21 aa, Staphylococcus epidermidis
KTKYHNVFGIGAYDSSPLIEG

SEQ ID NO: 1841797 - protein, 17 aa, Staphylococcus epidermidis
KYQFLQSTWDSVAPSQY

SEQ ID NO: 1841798 - protein, 21 aa, Staphylococcus epidermidis
LCCAICSTVLTTGSVNAQDNS

SEQ ID NO: 1841799 - protein, 19 aa, Staphylococcus epidermidis
LCCTICGTVLTTGSVNAQG

SEQ ID NO: 1841800 - protein, 17 aa, Staphylococcus epidermidis
LIRLMNKFELLNASEQD

SEQ ID NO: 1841801 - protein, 17 aa, Staphylococcus epidermidis
LKLLVGLSQDMTHNQLE

SEQ ID NO: 1841802 - protein, 20 aa, Staphylococcus epidermidis
LKNKLTEFFTGYATAMNSAF

SEQ ID NO: 1841803 - protein, 17 aa, Staphylococcus epidermidis
LKNLTTWMGKTDSHSSM

SEQ ID NO: 1841804 - protein, 20 aa, Staphylococcus epidermidis
LLIGLAFGIYSFVDSSKKGN

SEQ ID NO: 1841805 - protein, 21 aa, Staphylococcus epidermidis
LLLIGLAFGIYSFVDSSKKGN

SEQ ID NO: 1841806 - protein, 22 aa, Staphylococcus epidermidis
LPNFKTALDIARKEANMFGNST

SEQ ID NO: 1841807 - protein, 18 aa, Staphylococcus epidermidis
LPSMVALTLFGTAFTAHH

SEQ ID NO: 1841808 - protein, 17 aa, Staphylococcus epidermidis
LPVIFWMHGGGFIAGDK

SEQ ID NO: 1841809 - protein, 17 aa, Staphylococcus epidermidis
LQHCLDKGIPIVLVSRS

SEQ ID NO: 1841810 - protein, 19 aa, Staphylococcus epidermidis
LRNGVKMIVDQVVNTVSQL

SEQ ID NO: 1841811 - protein, 19 aa, Staphylococcus epidermidis
LRWPNIREDYSITWSSDKL

SEQ ID NO: 1841812 - protein, 17 aa, Staphylococcus epidermidis
LSCLLVLGACSNSGNKS

SEQ ID NO: 1841813 - protein, 22 aa, Staphylococcus epidermidis
LSLIIICSVGVYAQNKKLSKDK

SEQ ID NO: 1841814 - protein, 17 aa, Staphylococcus epidermidis
LSPFKGNEGQALQQLPN

SEQ ID NO: 1841815 - protein, 17 aa, Staphylococcus epidermidis
LSSALLLTACGQDGDKS

SEQ ID NO: 1841816 - protein, 21 aa, Staphylococcus epidermidis
LSSFLVLGACSHTDSSDKKET

SEQ ID NO: 1841817 - protein, 20 aa, Staphylococcus epidermidis
LYTEGQCTWYVFDKRAQAGK

SEQ ID NO: 1841818 - protein, 19 aa, Staphylococcus epidermidis
MSEFMKFVLKDEGKSAEDA

SEQ ID NO: 1841819 - protein, 20 aa, Staphylococcus epidermidis
MTPEAWKLVNEGKLQPTSDA

SEQ ID NO: 1841820 - protein, 19 aa, Staphylococcus epidermidis
NGSEWSWSYTVAGSDADYT

SEQ ID NO: 1841821 - protein, 17 aa, Staphylococcus epidermidis
NHDPIILVHGFNGYASG

SEQ ID NO: 1841822 - protein, 17 aa, Staphylococcus epidermidis
NHTAVVFEAGQLGADTQ

SEQ ID NO: 1841823 - protein, 18 aa, Staphylococcus epidermidis
NIGKDMRNYFSLSNGQDI

SEQ ID NO: 1841824 - protein, 22 aa, Staphylococcus epidermidis
NKRSNWSPVMYRFSDAIDKAVQ

SEQ ID NO: 1841825 - protein, 22 aa, Staphylococcus epidermidis
NLPDKTKLALIFCADDKGQYTL

SEQ ID NO: 1841826 - protein, 23 aa, Staphylococcus epidermidis
NNEKLADILLQFKNSNKVISSVC

SEQ ID NO: 1841827 - protein, 17 aa, Staphylococcus epidermidis
NNNEIFIETPFGGINES

SEQ ID NO: 1841828 - protein, 23 aa, Staphylococcus epidermidis
NNSWPNGMYFDWAQGSSAPTSNT

SEQ ID NO: 1841829 - protein, 20 aa, Staphylococcus epidermidis
NPIEGYKWYDRSTFKKGSYG

SEQ ID NO: 1841830 - protein, 18 aa, Staphylococcus epidermidis
NPQYLPRFVFGHYMKSYL

SEQ ID NO: 1841831 - protein, 23 aa, Staphylococcus epidermidis
NQYPVVFVHGFVGLVGEDAFSMY

SEQ ID NO: 1841832 - protein, 23 aa, Staphylococcus epidermidis
NRNLLQRIWDGIVEIIQSIIQFF

SEQ ID NO: 1841833 - protein, 24 aa, Staphylococcus epidermidis
NSDLKDIPIHFAIYKQSGQDSISP

SEQ ID NO: 1841834 - protein, 24 aa, Staphylococcus epidermidis
NVKFLKDRYEAMKNFPMFDNIEYT

SEQ ID NO: 1841835 - protein, 24 aa, Staphylococcus epidermidis
NYDRAVELYYYIKGGRVDYGAAHA

SEQ ID NO: 1841836 - protein, 20 aa, Staphylococcus epidermidis
NYFRHGAAHGYQFYNTPYYQ

SEQ ID NO: 1841837 - protein, 25 aa, Staphylococcus epidermidis
NYTSYFPKYGYRNGVGRPEGIVVHD

SEQ ID NO: 1841838 - protein, 21 aa, Staphylococcus epidermidis
PALAGNYWGGDRIKLTQELRA

SEQ ID NO: 1841839 - protein, 17 aa, Staphylococcus epidermidis
PCIFSLLQGFFVIYSVC

SEQ ID NO: 1841840 - protein, 17 aa, Staphylococcus epidermidis
PEKEWRVNDGLVSVISA

SEQ ID NO: 1841841 - protein, 26 aa, Staphylococcus epidermidis
PEKPKRVAVLTGFYVGDFIKLGIKPI

SEQ ID NO: 1841842 - protein, 21 aa, Staphylococcus epidermidis
PESKHLGGFPISGQFIACTNP

SEQ ID NO: 1841843 - protein, 22 aa, Staphylococcus epidermidis
PESKHLGGFPISGQFLICTNPA

SEQ ID NO: 1841844 - protein, 22 aa, Staphylococcus epidermidis
PESKHLGGFPISGQFLICTNPD

SEQ ID NO: 1841845 - protein, 28 aa, Staphylococcus epidermidis
PFIRQLAYDYARFQGHKLSRVDLGLKQW

SEQ ID NO: 1841846 - protein, 18 aa, Staphylococcus epidermidis
PGKKIHFIGHSMGGQTIR

SEQ ID NO: 1841847 - protein, 17 aa, Staphylococcus epidermidis
PGQKVHLVGHSMGGQTI

SEQ ID NO: 1841848 - protein, 17 aa, Staphylococcus epidermidis
PHPQGWHEWVAAAKAKP

SEQ ID NO: 1841849 - protein, 19 aa, Staphylococcus epidermidis
PLGSRKFPSVILPNNNRHQ

SEQ ID NO: 1841850 - protein, 23 aa, Staphylococcus epidermidis
PSNTEILYRLGLGKNIVGVSTVD

SEQ ID NO: 1841851 - protein, 21 aa, Staphylococcus epidermidis
PVKQRGALSIAYDLYVDIPDK

SEQ ID NO: 1841852 - protein, 17 aa, Staphylococcus epidermidis
PVLNQKFAFMIKEKLIE

SEQ ID NO: 1841853 - protein, 24 aa, Staphylococcus epidermidis
PYPHGQCTWYVYHRMNQFDSSISG

SEQ ID NO: 1841854 - protein, 26 aa, Staphylococcus epidermidis
PYPQGQCTWYVYNRMEQYDASLDGNL

SEQ ID NO: 1841855 - protein, 17 aa, Staphylococcus epidermidis
QAYWSFGGLFLVNSKVQ

SEQ ID NO: 1841856 - protein, 19 aa, Staphylococcus epidermidis
QEVILIWNPWDNGFMTQDA

SEQ ID NO: 1841857 - protein, 22 aa, Staphylococcus epidermidis
QFLKNRYEAMRNFPMFDNIEYT

SEQ ID NO: 1841858 - protein, 17 aa, Staphylococcus epidermidis
QGQGLDSIYCFIGKGDV

SEQ ID NO: 1841859 - protein, 25 aa, Staphylococcus epidermidis
QKADYNLFFPFTITANVIGKATEKE

SEQ ID NO: 1841860 - protein, 18 aa, Staphylococcus epidermidis
QNGNTFTARVNWVGNNAP

SEQ ID NO: 1841861 - protein, 24 aa, Staphylococcus epidermidis
QQCLKNKIPLVLVSRSFNGIVSPV

SEQ ID NO: 1841862 - protein, 17 aa, Staphylococcus epidermidis
QVGEPFIDFVICSSESY

SEQ ID NO: 1841863 - protein, 21 aa, Staphylococcus epidermidis
RAVSYPIHFVTGAIGNIFNKD

SEQ ID NO: 1841864 - protein, 21 aa, Staphylococcus epidermidis
RFAWAQSPDTWKCISDNRIKQ

SEQ ID NO: 1841865 - protein, 18 aa, Staphylococcus epidermidis
RFGDLVFDTLGFKPADKK

SEQ ID NO: 1841866 - protein, 17 aa, Staphylococcus epidermidis
RKGLRKYNNKLIAVTIS

SEQ ID NO: 1841867 - protein, 18 aa, Staphylococcus epidermidis
RVQSAIVKKLDQLGIHEK

SEQ ID NO: 1841868 - protein, 19 aa, Staphylococcus epidermidis
SALLLTACGQDGDKSNKDD

SEQ ID NO: 1841869 - protein, 17 aa, Staphylococcus epidermidis
SCVMMVFLTSSLSIVST

SEQ ID NO: 1841870 - protein, 18 aa, Staphylococcus epidermidis
SEFMKFVLEDEGKAAEDA

SEQ ID NO: 1841871 - protein, 19 aa, Staphylococcus epidermidis
SERGWKKCAAGIAGGATTG

SEQ ID NO: 1841872 - protein, 18 aa, Staphylococcus epidermidis
SEVYDIVFLFPKSMQLKH

SEQ ID NO: 1841873 - protein, 17 aa, Staphylococcus epidermidis
SKAARWARKHYVGKKYR

SEQ ID NO: 1841874 - protein, 22 aa, Staphylococcus epidermidis
SKDVKRSLEIGGGHDTDLKEKY

SEQ ID NO: 1841875 - protein, 21 aa, Staphylococcus epidermidis
SNTEILYRLGIGEDIVGVSTV

SEQ ID NO: 1841876 - protein, 20 aa, Staphylococcus epidermidis
SNVKGLGVISFRTIDAGDAQ

SEQ ID NO: 1841877 - protein, 20 aa, Staphylococcus epidermidis
SNVKGLGVISYRTIDAADAS

SEQ ID NO: 1841878 - protein, 18 aa, Staphylococcus epidermidis
SPDTWKCISDNRIKQSML

SEQ ID NO: 1841879 - protein, 21 aa, Staphylococcus epidermidis
SQIKAAIFFGGFYDMKTVKAT

SEQ ID NO: 1841880 - protein, 18 aa, Staphylococcus epidermidis
SSSLMAVGIMAPTILFTT

SEQ ID NO: 1841881 - protein, 20 aa, Staphylococcus epidermidis
SSVAKPRMMYAVNKKTTSSL

SEQ ID NO: 1841882 - protein, 20 aa, Staphylococcus epidermidis
TAAIKDFWEKVGLKTKVKLV

SEQ ID NO: 1841883 - protein, 19 aa, Staphylococcus epidermidis
TCISLLLAGCSFNKHTNEK

SEQ ID NO: 1841884 - protein, 18 aa, Staphylococcus epidermidis
TDVKWCRMMIRQVLSNSL

SEQ ID NO: 1841885 - protein, 24 aa, Staphylococcus epidermidis
TENEIRKSIKLYLDKNEELSEASE

SEQ ID NO: 1841886 - protein, 20 aa, Staphylococcus epidermidis
TGHKYHNVFGIGAFDNNALV

SEQ ID NO: 1841887 - protein, 18 aa, Staphylococcus epidermidis
TGKKYGWVKQDDVVYNTA

SEQ ID NO: 1841888 - protein, 18 aa, Staphylococcus epidermidis
TGKKYGWVKQGDVVYNTA

SEQ ID NO: 1841889 - protein, 21 aa, Staphylococcus epidermidis
TGVLCVVTLLSASPSFAVEKP

SEQ ID NO: 1841890 - protein, 19 aa, Staphylococcus epidermidis
TGYDYSWFILTEDIIKKEF

SEQ ID NO: 1841891 - protein, 19 aa, Staphylococcus epidermidis
THYAISRYLGGTDHTDPHQ

SEQ ID NO: 1841892 - protein, 24 aa, Staphylococcus epidermidis
TISSLALVVPLAFGNAEADAAQTN

SEQ ID NO: 1841893 - protein, 21 aa, Staphylococcus epidermidis
TKFPNVFLIGATVRHQNVILC

SEQ ID NO: 1841894 - protein, 22 aa, Staphylococcus epidermidis
TKSRFNGIMKKHFGNVPLEKVV

SEQ ID NO: 1841895 - protein, 25 aa, Staphylococcus epidermidis
TQPNYRIGTHFKIKLASNDIELPTT

SEQ ID NO: 1841896 - protein, 19 aa, Staphylococcus epidermidis
TRNELGLAIGKSDRVNIGI

SEQ ID NO: 1841897 - protein, 17 aa, Staphylococcus epidermidis
TRVARYLSPFEGDRSQA

SEQ ID NO: 1841898 - protein, 28 aa, Staphylococcus epidermidis
TYYVFDRVGGKICSTWGNANNWANAAAA

SEQ ID NO: 1841899 - protein, 18 aa, Staphylococcus epidermidis
VELYYYIKGGRVDYGAAH

SEQ ID NO: 1841900 - protein, 19 aa, Staphylococcus epidermidis
VELYYYIKGGRVDYGAAHT

SEQ ID NO: 1841901 - protein, 24 aa, Staphylococcus epidermidis
VGRGFTVKVPPEYIGGQNNKNFIN

SEQ ID NO: 1841902 - protein, 24 aa, Staphylococcus epidermidis
VGRGFTVKVPPEYLGGQNNKNFIN

SEQ ID NO: 1841903 - protein, 24 aa, Staphylococcus epidermidis
VILSICLVGLIFLATNQNALAKVH

SEQ ID NO: 1841904 - protein, 19 aa, Staphylococcus epidermidis
VKDVWKYNVAISKAAAKAG

SEQ ID NO: 1841905 - protein, 20 aa, Staphylococcus epidermidis
VKHVLPEVVSVPRYTVQGHN

SEQ ID NO: 1841906 - protein, 17 aa, Staphylococcus epidermidis
VMLGFAGGLGYSHYKDS

SEQ ID NO: 1841907 - protein, 21 aa, Staphylococcus epidermidis
VMPVKHGWDHGDFVGSDSSEV

SEQ ID NO: 1841908 - protein, 23 aa, Staphylococcus epidermidis
VNFVKRGGSVIFISDHYNADRNL

SEQ ID NO: 1841909 - protein, 19 aa, Staphylococcus epidermidis
VNNGQEVILIWNPWDNGFM

SEQ ID NO: 1841910 - protein, 18 aa, Staphylococcus epidermidis
VNNQAWLAAYMLKQNGIK

SEQ ID NO: 1841911 - protein, 19 aa, Staphylococcus epidermidis
VQNEAWKWSNANYSQIKNA

SEQ ID NO: 1841912 - protein, 20 aa, Staphylococcus epidermidis
VQNSKLWKSEDSGLHDLTRD

SEQ ID NO: 1841913 - protein, 19 aa, Staphylococcus epidermidis
VQNSKLWKSQDNGFYDLTR

SEQ ID NO: 1841914 - protein, 27 aa, Staphylococcus epidermidis
VVIILICALGFSVYAAINHHTNSNKND

SEQ ID NO: 1841915 - protein, 28 aa, Staphylococcus epidermidis
VVILLVIALSFSIYAAVNHKNNSSQSDK

SEQ ID NO: 1841916 - protein, 19 aa, Staphylococcus epidermidis
VYEFHLKKNIKFSDGSPLN

SEQ ID NO: 1841917 - protein, 17 aa, Staphylococcus epidermidis
WYDRSTFKTGSYGSNQQ

SEQ ID NO: 1841918 - protein, 23 aa, Staphylococcus epidermidis
YAELYDLIYEKYLIKTGQVAPWG

SEQ ID NO: 1841919 - protein, 17 aa, Staphylococcus epidermidis
YDRAVELYYYIKGGKVD

SEQ ID NO: 1841920 - protein, 18 aa, Staphylococcus epidermidis
YDRAVELYYYIKGGRVDY

SEQ ID NO: 1841921 - protein, 23 aa, Staphylococcus epidermidis
YDRAVELYYYIKGGRVDYGAAHA

SEQ ID NO: 1841922 - protein, 17 aa, Staphylococcus epidermidis
YDYYSFEGIRPKNNSEL

SEQ ID NO: 1841923 - protein, 17 aa, Staphylococcus epidermidis
YGDGIAQQVGQAWDSVG

SEQ ID NO: 1841924 - protein, 21 aa, Staphylococcus epidermidis
YIKMIKKRGGFDKINAVKNTR

SEQ ID NO: 1841925 - protein, 18 aa, Staphylococcus epidermidis
YITDCLIREGRMKLDKGL

SEQ ID NO: 1841926 - protein, 19 aa, Staphylococcus epidermidis
YKWYDRSTFKPGSYGSTQS

SEQ ID NO: 1841927 - protein, 32 aa, Staphylococcus epidermidis
YNITLEFYNTYVYKKGMPKFEEATSDMPAEEY

SEQ ID NO: 1841928 - protein, 21 aa, Staphylococcus epidermidis
YPVVFVHGFVGLVGEDSFSMY

SEQ ID NO: 1841929 - protein, 19 aa, Staphylococcus epidermidis
YRNGVGRPEGIVVHDTAND

SEQ ID NO: 1841930 - protein, 19 aa, Staphylococcus epidermidis
YTAGQCTWYVFDKVGGQIG

SEQ ID NO: 1841931 - protein, 19 aa, Staphylococcus epidermidis
YTDVKWCRMMIRQVLSNSL

SEQ ID NO: 1841932 - protein, 22 aa, Staphylococcus epidermidis
YWGGDRLKIIQDYRAKGYNVME

SEQ ID NO: 1841933 - protein, 23 aa, Staphylococcus epidermidis
YWGGDRLKIIQDYRAKGYNVMEA

SEQ ID NO: 1841934 - protein, 23 aa, Staphylococcus epidermidis
NLYTSGQCTYYVFDRVGGKIGST

SEQ ID NO: 1841935 - protein, 28 aa, Staphylococcus epidermidis
YTIDAEGNYHYTWKGNWSPDRVNTSYNY

SEQ ID NO: 1841936 - protein, 22 aa, Staphylococcus epidermidis
AKPLEKLLSDKLGIPVKVSVST

SEQ ID NO: 1841937 - protein, 22 aa, Staphylococcus epidermidis
DGFNQSMDLLLSKRVDGTFNDS

SEQ ID NO: 1841938 - protein, 25 aa, Staphylococcus epidermidis
DVEPTSIISILVAAADALSAARPGA

SEQ ID NO: 1841939 - protein, 33 aa, Staphylococcus epidermidis
EAYQPALAELAMPRPYVFVSPKDFKHGTTKDGV

SEQ ID NO: 1841940 - protein, 22 aa, Staphylococcus epidermidis
EFEYLVNRKATKRRKLFNGYIE

SEQ ID NO: 1841941 - protein, 18 aa, Staphylococcus epidermidis
EPQHLDYILLDRDHAQPS

SEQ ID NO: 1841942 - protein, 17 aa, Staphylococcus epidermidis
ESKHLGGFPISGQFIAC

SEQ ID NO: 1841943 - protein, 32 aa, Staphylococcus epidermidis; identical to SEQ ID NO: 1719958

SEQ ID NO: 1841944 - protein, 26 aa, Staphylococcus epidermidis
HNMHPDLVKILGRLNYRTSYGQNVLK

SEQ ID NO: 1841945 - protein, 19 aa, Staphylococcus epidermidis
KNRYEAMRNFPMFDNIEYT

SEQ ID NO: 1841946 - protein, 18 aa, Staphylococcus epidermidis
LGGFPISGQFIACTNPQV

SEQ ID NO: 1841947 - protein, 27 aa, Staphylococcus epidermidis
MKSKKVDVGFLPPTAYTLAHDQKAADL

SEQ ID NO: 1841948 - protein, 21 aa, Staphylococcus epidermidis
TGDDPRKVPMKIFPAVHYSMG

SEQ ID NO: 1841949 - protein, 32 aa, Staphylococcus epidermidis; identical to SEQ ID NO: 1720038

SEQ ID NO: 1841950 - protein, 17 aa, Staphylococcus epidermidis
VGAIVTSLTLGACGNSN

SEQ ID NO: 1841951 - protein, 17 aa, Staphylococcus epidermidis
VPVTASALLLGACGSNA

SEQ ID NO: 1841952 - protein, 25 aa, Staphylococcus epidermidis
VVSDLLNVALFFESNLHTLPPHFEL

SEQ ID NO: 1841953 - protein, 33 aa, Staphylococcus epidermidis
AAGKYQFLQSTWDSVAPSQYKGVSPAKAPESVQ

SEQ ID NO: 1841954 - protein, 27 aa, Staphylococcus epidermidis
AARKYGLNEIYLISHALVETGNGTSQL

SEQ ID NO: 1841955 - protein, 17 aa, Staphylococcus epidermidis
ADSLYEIPLQLSKQNMD

SEQ ID NO: 1841956 - protein, 25 aa, Staphylococcus epidermidis
AGKPISTYWSDAKYWASNAANDGYQ

SEQ ID NO: 1841957 - protein, 20 aa, Staphylococcus epidermidis
ALILWLGIKEKKRHANRLEK

SEQ ID NO: 1841958 - protein, 26 aa, Staphylococcus epidermidis
APIKETLAASLIRLANWNGNTPLIDP

SEQ ID NO: 1841959 - protein, 24 aa, Staphylococcus epidermidis
ASAVKNLPLIKYSIDQVLMTKEGC

SEQ ID NO: 1841960 - protein, 26 aa, Staphylococcus epidermidis
AVQFSDIYLMALPTKAIREVSKDIDQ

SEQ ID NO: 1841961 - protein, 25 aa, Staphylococcus epidermidis
DDINPSVLTHYWGGDKMNIRQDLEE

SEQ ID NO: 1841962 - protein, 25 aa, Staphylococcus epidermidis
DGERTLLFGPFANVGPKFLKHGSNL

SEQ ID NO: 1841963 - protein, 24 aa, Staphylococcus epidermidis
DGMALLFRHFYATSLHNQFMYNSK

SEQ ID NO: 1841964 - protein, 23 aa, Staphylococcus epidermidis
DIVIEKGQEYNLLKGISAYDKED

SEQ ID NO: 1841965 - protein, 17 aa, Staphylococcus epidermidis
DLFSIVPVKRSHSVCAQ

SEQ ID NO: 1841966 - protein, 22 aa, Staphylococcus epidermidis
DLKDIPIHFAIYKQSSQDSITP

SEQ ID NO: 1841967 - protein, 25 aa, Staphylococcus epidermidis
DLMFNQTWGLLYDPQSTLAAFKTKT

SEQ ID NO: 1841968 - protein, 17 aa, Staphylococcus epidermidis
DNEDILDYTKLFEKNRT

SEQ ID NO: 1841969 - protein, 23 aa, Staphylococcus epidermidis
DNKGFTHYTLQPKVGNTYAPDKE

SEQ ID NO: 1841970 - protein, 22 aa, Staphylococcus epidermidis
DNYRTILPFKESQARGLLQDNM

SEQ ID NO: 1841971 - protein, 21 aa, Staphylococcus epidermidis
DTISYIPKVGYYDKITHAHAY

SEQ ID NO: 1841972 - protein, 24 aa, Staphylococcus epidermidis
EAFKKVGMMNLATDKGIWQVRPVQ

SEQ ID NO: 1841973 - protein, 21 aa, Staphylococcus epidermidis
EEIIRQVAYDYARSKGNKLSH

SEQ ID NO: 1841974 - protein, 18 aa, Staphylococcus epidermidis
EEQYLSRVALLDKASNHK

SEQ ID NO: 1841975 - protein, 24 aa, Staphylococcus epidermidis
EETAFLIDLLIDIQEPIVITGAMR

SEQ ID NO: 1841976 - protein, 21 aa, Staphylococcus epidermidis
EFVTPLAFQAISRNPVYTNTF

SEQ ID NO: 1841977 - protein, 25 aa, Staphylococcus epidermidis
EGIPHYMIDILPPDASFSAYEFKKR

SEQ ID NO: 1841978 - protein, 17 aa, Staphylococcus epidermidis
EHLKENLNWIWNSLSVK

SEQ ID NO: 1841979 - protein, 20 aa, Staphylococcus epidermidis
EKYNEVTIYCEKAHVIFGGA

SEQ ID NO: 1841980 - protein, 24 aa, Staphylococcus epidermidis
ESAIVRCNLWLRTADRIKIVMGRF

SEQ ID NO: 1841981 - protein, 23 aa, Staphylococcus epidermidis
ESKHLGGFPISGQFLICTNPDVI

SEQ ID NO: 1841982 - protein, 26 aa, Staphylococcus epidermidis
EWREYDYLFLTFGTFSYHDPYDLKGT

SEQ ID NO: 1841983 - protein, 22 aa, Staphylococcus epidermidis
FLKDRYEAMKQFPMFDNIEYTE

SEQ ID NO: 1841984 - protein, 30 aa, Staphylococcus epidermidis
FMVGDGMGPSFNTAYRYYKNKPGAKKMTPT

SEQ ID NO: 1841985 - protein, 25 aa, Staphylococcus epidermidis
FYQYRPPIERILTNLLDNALKFSNS

SEQ ID NO: 1841986 - protein, 19 aa, Staphylococcus epidermidis
GAYDIHFVDNGYQYNFTSN

SEQ ID NO: 1841987 - protein, 26 aa, Staphylococcus epidermidis
GDIDLNAFQHFAFLDQYKKAHKDTNI

SEQ ID NO: 1841988 - protein, 26 aa, Staphylococcus epidermidis
GGQTIRYLEELLRHGSPEEVEYQKQH

SEQ ID NO: 1841989 - protein, 17 aa, Staphylococcus epidermidis
GNASNWAYSANQAGFNV

SEQ ID NO: 1841990 - protein, 24 aa, Staphylococcus epidermidis
GQTIRLMEHFLRNGNQEEIDYQRQ

SEQ ID NO: 1841991 - protein, 25 aa, Staphylococcus epidermidis
GRTYEGIMPDWEPGKKIHLVGHSMG

SEQ ID NO: 1841992 - protein, 25 aa, Staphylococcus epidermidis
GTDARMLYWFTEKEYPVIRKPQGAN

SEQ ID NO: 1841993 - protein, 20 aa, Staphylococcus epidermidis
GTLRLGLYPCHIKEGTLAEK

SEQ ID NO: 1841994 - protein, 19 aa, Staphylococcus epidermidis
HVSLGDWADAIIVAPATAN

SEQ ID NO: 1841995 - protein, 25 aa, Staphylococcus epidermidis
IDGNPSIYKPTWKSEALSYKDATSH

SEQ ID NO: 1841996 - protein, 27 aa, Staphylococcus epidermidis
IEIPKNDFFIACQFHPEFLSRPNRPQP

SEQ ID NO: 1841997 - protein, 28 aa, Staphylococcus epidermidis
IEQTEDGFRYVFSFKDPSKSNTYSIVTL

SEQ ID NO: 1841998 - protein, 19 aa, Staphylococcus epidermidis
IISVIITGVSALRDKSHED

SEQ ID NO: 1841999 - protein, 18 aa, Staphylococcus epidermidis
ILIGAVIGGAAALADKST

SEQ ID NO: 1842000 - protein, 19 aa, Staphylococcus epidermidis
ILIILFIVLSVLEEKRRKK

SEQ ID NO: 1842001 - protein, 21 aa, Staphylococcus epidermidis
ILLGIILGVVVGYIVARNLLH

SEQ ID NO: 1842002 - protein, 27 aa, Staphylococcus epidermidis
IMQLNGLNNYLIFPGQKLKVSGKATSS

SEQ ID NO: 1842003 - protein, 21 aa, Staphylococcus epidermidis
IPFFGICLGMQLATVEFARHV

SEQ ID NO: 1842004 - protein, 28 aa, Staphylococcus epidermidis
IQNPKEFINPLPHISFVRGKNNVKFLKD

SEQ ID NO: 1842005 - protein, 17 aa, Staphylococcus epidermidis
ISIAKLKSLNGLTSNLI

SEQ ID NO: 1842006 - protein, 18 aa, Staphylococcus epidermidis
ISKQFWGHLVKSGEIQNP

SEQ ID NO: 1842007 - protein, 19 aa, Staphylococcus epidermidis
ISKQFWGHLVKSGNISNPR

SEQ ID NO: 1842008 - protein, 28 aa, Staphylococcus epidermidis
ISNPRDFINPLPHISFVRGKNNVKFLKN

SEQ ID NO: 1842009 - protein, 29 aa, Staphylococcus epidermidis
ITLIGVLLIILAIYLFSKPYIDNYLHEKD

SEQ ID NO: 1842010 - protein, 33 aa, Staphylococcus epidermidis
ITSHYRHVNLPAQVPLAWGAHRGASIIAEQLSG

SEQ ID NO: 1842011 - protein, 31 aa, Staphylococcus epidermidis
KAVKSNHIYELDPKLWYFSSGSSTTTIKQID

SEQ ID NO: 1842012 - protein, 24 aa, Staphylococcus epidermidis
KDIVIKHILVRDKSKKRPLNISQY

SEQ ID NO: 1842013 - protein, 22 aa, Staphylococcus epidermidis
KDMPLQIDAPQSNPLLVDMQNS

SEQ ID NO: 1842014 - protein, 23 aa, Staphylococcus epidermidis
KESVDIIVNLLQNAELKGVKSEH

SEQ ID NO: 1842015 - protein, 20 aa, Staphylococcus epidermidis
KGVWQVTPTKHDWDHVDFVG

SEQ ID NO: 1842016 - protein, 18 aa, Staphylococcus epidermidis
KIAAIRYARENNIPFFGI

SEQ ID NO: 1842017 - protein, 20 aa, Staphylococcus epidermidis
KIKKMIPSYGESLIDDVQLM

SEQ ID NO: 1842018 - protein, 28 aa, Staphylococcus epidermidis
KIMQLNGLTNFFIYPGQKLKVPGGSSSS

SEQ ID NO: 1842019 - protein, 23 aa, Staphylococcus epidermidis
KKYKFSEPYTYSSAVLVVRENEK

SEQ ID NO: 1842020 - protein, 22 aa, Staphylococcus epidermidis
KNAIEMYYSLQNYYDTRVDTIK

SEQ ID NO: 1842021 - protein, 24 aa, Staphylococcus epidermidis
KNKYVYNIEIITTSPKISHWNVKI

SEQ ID NO: 1842022 - protein, 18 aa, Staphylococcus epidermidis
KPVQAGAYDIHFVDNGYQ

SEQ ID NO: 1842023 - protein, 17 aa, Staphylococcus epidermidis
KQFTPFSATAQPRTVYS

SEQ ID NO: 1842024 - protein, 27 aa, Staphylococcus epidermidis
KQYKNNDPIILVHGFNGFTDDINPSVL

SEQ ID NO: 1842025 - protein, 28 aa, Staphylococcus epidermidis
KSSDWLSQNFGVRFRYNALGDINTQNIV

SEQ ID NO: 1842026 - protein, 21 aa, Staphylococcus epidermidis
KVASAKPDVIFISGRTANQKN

SEQ ID NO: 1842027 - protein, 23 aa, Staphylococcus epidermidis
KVEYDIKKKLPFHKSLQLVERDQ

SEQ ID NO: 1842028 - protein, 19 aa, Staphylococcus epidermidis
KWIPLMMKGREDKGYMAAS

SEQ ID NO: 1842029 - protein, 18 aa, Staphylococcus epidermidis
KYYEFRTDKGVLLVTANG

SEQ ID NO: 1842030 - protein, 30 aa, Staphylococcus epidermidis
LAGKQKADLNMFLPFTITGNLIGKAKEKEW

SEQ ID NO: 1842031 - protein, 29 aa, Staphylococcus epidermidis
LANDSSLKYQFLRLDQPQYLSAQALNKLL

SEQ ID NO: 1842032 - protein, 26 aa, Staphylococcus epidermidis
LASAVKNLPLIKYSFDQVIMTKEGCM

SEQ ID NO: 1842033 - protein, 18 aa, Staphylococcus epidermidis
LDARVIMPVYPKIPHRDY

SEQ ID NO: 1842034 - protein, 30 aa, Staphylococcus epidermidis
LEADSSNHMFSIQAGFRKYPSTKQSLEDYA

SEQ ID NO: 1842035 - protein, 19 aa, Staphylococcus epidermidis
LITTLVLTACGKSNEKASL

SEQ ID NO: 1842036 - protein, 21 aa, Staphylococcus epidermidis
LNPQQLIDVKAFMGDTADGYS

SEQ ID NO: 1842037 - protein, 22 aa, Staphylococcus epidermidis
LPSMVALTLFGTAFTAHQANAA

SEQ ID NO: 1842038 - protein, 25 aa, Staphylococcus epidermidis
LQQDINNYLIPEFKKYKNSTQHLTA

SEQ ID NO: 1842039 - protein, 17 aa, Staphylococcus epidermidis
LSVQFKRTKDILKYLGE

SEQ ID NO: 1842040 - protein, 20 aa, Staphylococcus epidermidis
LTEFEVAYAPPYSHPKDLIN

SEQ ID NO: 1842041 - protein, 21 aa, Staphylococcus epidermidis
LTLAALTLAFPFSHVAQAHTY

SEQ ID NO: 1842042 - protein, 17 aa, Staphylococcus epidermidis
LTSIAALTVASPLVNTE

SEQ ID NO: 1842043 - protein, 21 aa, Staphylococcus epidermidis
LTTLLVLSSLFLVFSTITYAS

SEQ ID NO: 1842044 - protein, 18 aa, Staphylococcus epidermidis
LVLALTIALAACGGGKDK

SEQ ID NO: 1842045 - protein, 18 aa, Staphylococcus epidermidis
LVLGLVLTGVSVGNNVEA

SEQ ID NO: 1842046 - protein, 19 aa, Staphylococcus epidermidis
LYSIAWGTKNQQLLAPNTL

SEQ ID NO: 1842047 - protein, 20 aa, Staphylococcus epidermidis
MSILLLLTACGDGHKQTSSD

SEQ ID NO: 1842048 - protein, 36 aa, Staphylococcus epidermidis
MSLPMKILLWVVGILFLLAIIAVIYVSAKIFITGDK

SEQ ID NO: 1842049 - protein, 24 aa, Staphylococcus epidermidis
MVDIGKSDLFLYTGDNLDPVAKKI

SEQ ID NO: 1842050 - protein, 19 aa, Staphylococcus epidermidis
MYVHCTLLPYIKAAGEMKT

SEQ ID NO: 1842051 - protein, 24 aa, Staphylococcus epidermidis
NDTKLPVIFWMHGGGFIAGDKQYK

SEQ ID NO: 1842052 - protein, 17 aa, Staphylococcus epidermidis
NEQFEISKQFWGHLVKS

SEQ ID NO: 1842053 - protein, 17 aa, Staphylococcus epidermidis
NITTLLASAVKNLPLIK

SEQ ID NO: 1842054 - protein, 21 aa, Staphylococcus epidermidis
NKKILFYSYENFMLNHASNAV

SEQ ID NO: 1842055 - protein, 24 aa, Staphylococcus epidermidis
NLDLFKSIKPYNITTLLASAVKNL

SEQ ID NO: 1842056 - protein, 22 aa, Staphylococcus epidermidis
NNRKLTIVVPEKDLKSLNIQSL

SEQ ID NO: 1842057 - protein, 19 aa, Staphylococcus epidermidis
NSIIKHYHLTSFDKEKMPN

SEQ ID NO: 1842058 - protein, 25 aa, Staphylococcus epidermidis
PAEQGRFLKFFVDEGLIKLKKGVKI

SEQ ID NO: 1842059 - protein, 22 aa, Staphylococcus epidermidis
PDQWMNTILIDKGSKAGIKNNM

SEQ ID NO: 1842060 - protein, 18 aa, Staphylococcus epidermidis
PKNVIFMVGDGMGPSFNT

SEQ ID NO: 1842061 - protein, 29 aa, Staphylococcus epidermidis
PLGNEVPNIRQFPLFDLTSRVIGGDDNKN

SEQ ID NO: 1842062 - protein, 21 aa, Staphylococcus epidermidis
PPDELIPQFDYVKEISHQFGF

SEQ ID NO: 1842063 - protein, 19 aa, Staphylococcus epidermidis
PSNTEILYRLGIGEDIVGV

SEQ ID NO: 1842064 - protein, 20 aa, Staphylococcus epidermidis
QEIIPYPGNSDLAILRVSPN

SEQ ID NO: 1842065 - protein, 26 aa, Staphylococcus epidermidis
QHSRQYAKRQLTWFKNKMNVHWLNKE

SEQ ID NO: 1842066 - protein, 17 aa, Staphylococcus epidermidis
QKGVWQVTPVKHNWDHG

SEQ ID NO: 1842067 - protein, 29 aa, Staphylococcus epidermidis
QNGSYALSRPLFIYAKDKSLKDNKVMSEF

SEQ ID NO: 1842068 - protein, 17 aa, Staphylococcus epidermidis
QSNPLLVDMQNSALNKL

SEQ ID NO: 1842069 - protein, 40 aa, Staphylococcus epidermidis
QSVDFSKYWEPNKYEDSFSLTSLIQNLFDFDSDITDYEQP

SEQ ID NO: 1842070 - protein, 19 aa, Staphylococcus epidermidis
RAMMTSEGAFKYFAQQFDV

SEQ ID NO: 1842071 - protein, 21 aa, Staphylococcus epidermidis
RFGGTLHHRTAFAGATTGQQL

SEQ ID NO: 1842072 - protein, 28 aa, Staphylococcus epidermidis
RFVALILAVFFFLSVNNVFGNIFNTDDL

SEQ ID NO: 1842073 - protein, 29 aa, Staphylococcus epidermidis
RIEEDYTSYFPKYGYRNGVGRPEGIVVHD

SEQ ID NO: 1842074 - protein, 26 aa, Staphylococcus epidermidis
RIIETAPTDYLSWGAGPYGNQRFINV

SEQ ID NO: 1842075 - protein, 28 aa, Staphylococcus epidermidis
RKRVLRAIEYYLKTKKLLSSRKKVQQFT

SEQ ID NO: 1842076 - protein, 18 aa, Staphylococcus epidermidis
SEMSGFETAFDNAINYAK

SEQ ID NO: 1842077 - protein, 19 aa, Staphylococcus epidermidis
SILVTSVLSVTVIPSTFAS

SEQ ID NO: 1842078 - protein, 33 aa, Staphylococcus epidermidis
SIRKFSVGASSILIAALLFMGGGSAQAAEQQQD

SEQ ID NO: 1842079 - protein, 18 aa, Staphylococcus epidermidis
SIRKLSVGASSIIVASML

SEQ ID NO: 1842080 - protein, 25 aa, Staphylococcus epidermidis
SKNNKGFFLMVEGASIDKAAHPNDI

SEQ ID NO: 1842081 - protein, 17 aa, Staphylococcus epidermidis
SLYEIPLQLSKQNMDDI

SEQ ID NO: 1842082 - protein, 25 aa, Staphylococcus epidermidis
SSKGPDLYVYLTKNGDIKSGKKIST

SEQ ID NO: 1842083 - protein, 17 aa, Staphylococcus epidermidis
SVILPNNNRHQIFNTTQ

SEQ ID NO: 1842084 - protein, 17 aa, Staphylococcus epidermidis
SYLDYRKQKPNAKIKAI

SEQ ID NO: 1842085 - protein, 18 aa, Staphylococcus epidermidis
TAGYTFPLVTLKKEAGID

SEQ ID NO: 1842086 - protein, 20 aa, Staphylococcus epidermidis
TAKELLATTVQRLAAEHTTE

SEQ ID NO: 1842087 - protein, 22 aa, Staphylococcus epidermidis
TKNKEGIGYFGYNFYEQNKDKL

SEQ ID NO: 1842088 - protein, 26 aa, Staphylococcus epidermidis
TKNRVQFYHHPYRQTTYQYIDVNLRV

SEQ ID NO: 1842089 - protein, 17 aa, Staphylococcus epidermidis
TLVAGLGIAFLGHTTHA

SEQ ID NO: 1842090 - protein, 33 aa, Staphylococcus epidermidis
TMITSCLTLSICSIFINPLIQKIKQFNIKTKQF

SEQ ID NO: 1842091 - protein, 24 aa, Staphylococcus epidermidis
TSGQCTWYVYDKTGGKIGSTWGNA

SEQ ID NO: 1842092 - protein, 17 aa, Staphylococcus epidermidis
TTVLGASVLLGACGGND

SEQ ID NO: 1842093 - protein, 19 aa, Staphylococcus epidermidis
TTVYPLKSFAQQIGGKYVN

SEQ ID NO: 1842094 - protein, 20 aa, Staphylococcus epidermidis
TVIFVSGIILAGCGSNKELT

SEQ ID NO: 1842095 - protein, 19 aa, Staphylococcus epidermidis
TYYAFDRRAELGKPIGSLW

SEQ ID NO: 1842096 - protein, 17 aa, Staphylococcus epidermidis
VALVFVLAACGNNSSNN

SEQ ID NO: 1842097 - protein, 29 aa, Staphylococcus epidermidis
VAVILSICLVLLLFLATNQNALAKVHKTI

SEQ ID NO: 1842098 - protein, 48 aa, Staphylococcus epidermidis
VIKQKNINGVKWYYGQLLDGKYVWIKSTDLVKEKIKYAYTGMTLNNAI

SEQ ID NO: 1842099 - protein, 24 aa, Staphylococcus epidermidis
VKAGSTLYTVPWGTPKQVASKVSG

SEQ ID NO: 1842100 - protein, 18 aa, Staphylococcus epidermidis
VLADYVFIGAGGGAIPLL

SEQ ID NO: 1842101 - protein, 21 aa, Staphylococcus epidermidis
VLVLSVVIFAAACGNSSSLDN

SEQ ID NO: 1842102 - protein, 18 aa, Staphylococcus epidermidis
VNYALAPQYKYPTPLVQL

SEQ ID NO: 1842103 - protein, 18 aa, Staphylococcus epidermidis
VSKAIIGGAKFIGNSYVK

SEQ ID NO: 1842104 - protein, 17 aa, Staphylococcus epidermidis
VSVLTLLLAGCMSHEYA

SEQ ID NO: 1842105 - protein, 17 aa, Staphylococcus epidermidis
VTIYCEKAHVIFGGAKL

SEQ ID NO: 1842106 - protein, 20 aa, Staphylococcus epidermidis
VYINDFVQQFLRNNIPDINI

SEQ ID NO: 1842107 - protein, 18 aa, Staphylococcus epidermidis
VYVGKDLYLYGTVNNRTG

SEQ ID NO: 1842108 - protein, 21 aa, Staphylococcus epidermidis
YHFESDGSTWSWSYESTNNAT

SEQ ID NO: 1842109 - protein, 17 aa, Staphylococcus epidermidis
YIGTLLKQHPHLSAYIL

SEQ ID NO: 1842110 - protein, 18 aa, Staphylococcus epidermidis
YKAIDLTSKLIQSGYDVR

SEQ ID NO: 1842111 - protein, 21 aa, Staphylococcus epidermidis
YLLSTALITPTFATQTAFAED

SEQ ID NO: 1842112 - protein, 20 aa, Staphylococcus epidermidis
AAFDLYGDGIAQQVGQAWDS

SEQ ID NO: 1842113 - protein, 21 aa, Staphylococcus epidermidis
AMGFENKVPFLTQSKLEEQGA

SEQ ID NO: 1842114 - protein, 18 aa, Staphylococcus epidermidis
APQYKYPTPLVQLNQAVK

SEQ ID NO: 1842115 - protein, 23 aa, Staphylococcus epidermidis
AQTAHSYWYKYNGYTASGGDFVL

SEQ ID NO: 1842116 - protein, 19 aa, Staphylococcus epidermidis
AQYIQRVKQSKLWTTKDNG

SEQ ID NO: 1842117 - protein, 25 aa, Staphylococcus epidermidis
ASGGDFVLSNSFYQGLKAGNVTFNG

SEQ ID NO: 1842118 - protein, 27 aa, Staphylococcus epidermidis
ATKAMPKEMLPILDKPTIQYIVEEASK

SEQ ID NO: 1842119 - protein, 33 aa, Staphylococcus epidermidis; identical to SEQ ID NO: 1825510

SEQ ID NO: 1842120 - protein, 24 aa, Staphylococcus epidermidis
CVKGISEALLRTSAPKLYVSNVMT

SEQ ID NO: 1842121 - protein, 21 aa, Staphylococcus epidermidis
DEVGKLVAFLASDDSSFITGE

SEQ ID NO: 1842122 - protein, 33 aa, Staphylococcus epidermidis
DKDVIPESYLRKFDYLVFPDNVAIVLGIAQAVG

SEQ ID NO: 1842123 - protein, 26 aa, Staphylococcus epidermidis
DKKLAKEWINFLKSNKAKQILKEYQF

SEQ ID NO: 1842124 - protein, 20 aa, Staphylococcus epidermidis
DLIVLGPGSLYTSVISNLCV

SEQ ID NO: 1842125 - protein, 19 aa, Staphylococcus epidermidis
DLWARSRGLISSEEMAKEL

SEQ ID NO: 1842126 - protein, 20 aa, Staphylococcus epidermidis
DRAVELYYYIKGGRVDYGAA

SEQ ID NO: 1842127 - protein, 17 aa, Staphylococcus epidermidis
DYILLDRDHAQPSSWHN

SEQ ID NO: 1842128 - protein, 20 aa, Staphylococcus epidermidis
EAHHFRLPMYRLTEIPKATS

SEQ ID NO: 1842129 - protein, 17 aa, Staphylococcus epidermidis
EIFDYLIALNDKVGPHY

SEQ ID NO: 1842130 - protein, 27 aa, Staphylococcus epidermidis
EKLGADPMTFLGLGGIGDLIVTCTSTH

SEQ ID NO: 1842131 - protein, 29 aa, Staphylococcus epidermidis
EKLKWIWITTLIILVVSLILAFNLKSHYN

SEQ ID NO: 1842132 - protein, 23 aa, Staphylococcus epidermidis
EKNHKLVMLFGDNLLDFTDPKKS

SEQ ID NO: 1842133 - protein, 17 aa, Staphylococcus epidermidis
EKVQKKPKLLTDAYKEL

SEQ ID NO: 1842134 - protein, 34 aa, Staphylococcus epidermidis
ETGILLHDIYDLKPLKTFVYGRTILMGDAAHATT

SEQ ID NO: 1842135 - protein, 27 aa, Staphylococcus epidermidis
EYKNHDPIILVHGFNGYASGTGPVTGK

SEQ ID NO: 1842136 - protein, 19 aa, Staphylococcus epidermidis
FFVAVLTLALAACGKDSHN

SEQ ID NO: 1842137 - protein, 30 aa, Staphylococcus epidermidis
FKQQEPIVFTAMEPSWFSKELDVKMLKDPD

SEQ ID NO: 1842138 - protein, 22 aa, Staphylococcus epidermidis
FLGLLATLALAIVLSACGNSGN

SEQ ID NO: 1842139 - protein, 24 aa, Staphylococcus epidermidis
FLIGLSLIIICSVGVYAQNKKLSK

SEQ ID NO: 1842140 - protein, 26 aa, Staphylococcus epidermidis
GGTKALDLELGFSQWGFKQQPNESYA

SEQ ID NO: 1842141 - protein, 27 aa, Staphylococcus epidermidis
GHYDAVSFIYIPIDGGYMSGSGVVVGE

SEQ ID NO: 1842142 - protein, 17 aa, Staphylococcus epidermidis
GLNFNPFHSNNRKLTIV

SEQ ID NO: 1842143 - protein, 22 aa, Staphylococcus epidermidis
GMTIGLAMNSVYYYKKEKDGET

SEQ ID NO: 1842144 - protein, 20 aa, Staphylococcus epidermidis
GQNTLYKMRWNPANPGTHQY

SEQ ID NO: 1842145 - protein, 28 aa, Staphylococcus epidermidis
GRSYPLELIQLDQLLVNILQPYEQHIKQ

SEQ ID NO: 1842146 - protein, 28 aa, Staphylococcus epidermidis
GTSPYPHGQCTWYVYHRMNQFDASISGD

SEQ ID NO: 1842147 - protein, 30 aa, Staphylococcus epidermidis
HFKGYLGNNIVKFFDYTLASVGIKPNELKN

SEQ ID NO: 1842148 - protein, 19 aa, Staphylococcus epidermidis
HHGKYDPHIWLDPVVSQKF

SEQ ID NO: 1842149 - protein, 19 aa, Staphylococcus epidermidis
HIDLVFNKDFKEAHPAAYT

SEQ ID NO: 1842150 - protein, 24 aa, Staphylococcus epidermidis
HLNGYLIMPNQILTIPNGGSGSGS

SEQ ID NO: 1842151 - protein, 28 aa, Staphylococcus epidermidis
HNYSYAELYDLIYEKYLIKTKQVAPWGT

SEQ ID NO: 1842152 - protein, 30 aa, Staphylococcus epidermidis
HQFIPGYNLFHIYPLFPIPERQRFLEQLKK

SEQ ID NO: 1842153 - protein, 31 aa, Staphylococcus epidermidis
HSATLVIMFLITLLPIFQYQASAHATLEKST

SEQ ID NO: 1842154 - protein, 19 aa, Staphylococcus epidermidis
HVDVGLSQWGLKQREDETL

SEQ ID NO: 1842155 - protein, 19 aa, Staphylococcus epidermidis
IAFLIILAACGNHSNHEHH

SEQ ID NO: 1842156 - protein, 31 aa, Staphylococcus epidermidis
IGKQRSEQIYYRALTVYLTSNSDFQDAKASL

SEQ ID NO: 1842157 - protein, 22 aa, Staphylococcus epidermidis
IHTAKQFIGNEPFAVLLGDDIV

SEQ ID NO: 1842158 - protein, 18 aa, Staphylococcus epidermidis
IILTLCVVLAGCTNEKGQ

SEQ ID NO: 1842159 - protein, 23 aa, Staphylococcus epidermidis
IKYQYVNLAFLGKDSIVGSRAQH

SEQ ID NO: 1842160 - protein, 21 aa, Staphylococcus epidermidis
ILFLLFTFVKEVRLSKHFYED

SEQ ID NO: 1842161 - protein, 20 aa, Staphylococcus epidermidis
INGKHKVDVMLGGGAKYFGK

SEQ ID NO: 1842162 - protein, 28 aa, Staphylococcus epidermidis
IPKATSYDIVFLFPKSMQLEEVLSHIQP

SEQ ID NO: 1842163 - protein, 21 aa, Staphylococcus epidermidis
IQEPIVITGAMRSSNEIGSDG

SEQ ID NO: 1842164 - protein, 17 aa, Staphylococcus epidermidis
ISTLSTVTLGLASLSSP

SEQ ID NO: 1842165 - protein, 29 aa, Staphylococcus epidermidis
ITIMLAFTLSLALGLFFNSAHADSLPQKN

SEQ ID NO: 1842166 - protein, 17 aa, Staphylococcus epidermidis
IVAILVLSACGGNNGKK

SEQ ID NO: 1842167 - protein, 20 aa, Staphylococcus epidermidis
IVLTSAVLLAGCTIDKKEIK

SEQ ID NO: 1842168 - protein, 24 aa, Staphylococcus epidermidis
KDSRVDFGLEHWGLKQKPNESYIQ

SEQ ID NO: 1842169 - protein, 22 aa, Staphylococcus epidermidis
KGSFVTLIGIGNEKVLIAGTQS

SEQ ID NO: 1842170 - protein, 24 aa, Staphylococcus epidermidis
KHERLIQQYVSIDRIVRGVTTWTA

SEQ ID NO: 1842171 - protein, 19 aa, Staphylococcus epidermidis
KKLSAYQKQLLLDKVNVSD

SEQ ID NO: 1842172 - protein, 29 aa, Staphylococcus epidermidis
KLIVVLCAMIIFIALIGLSIRSQTQSPAE

SEQ ID NO: 1842173 - protein, 18 aa, Staphylococcus epidermidis
KLSKPITYKAGATSDKKL

SEQ ID NO: 1842174 - protein, 24 aa, Staphylococcus epidermidis
KPNESYIQYVKRVQNSKLWKSKDS

SEQ ID NO: 1842175 - protein, 18 aa, Staphylococcus epidermidis
KRRKLFNGYIECTYYQYW

SEQ ID NO: 1842176 - protein, 24 aa, Staphylococcus epidermidis
KSGWISKYYLTAPSKVQALSTQST

SEQ ID NO: 1842177 - protein, 28 aa, Staphylococcus epidermidis
KTYAGAYKDWKPGQKIHLIGHSMGGQTI

SEQ ID NO: 1842178 - protein, 19 aa, Staphylococcus epidermidis
KVDVMLGGGAKYFGKENKN

SEQ ID NO: 1842179 - protein, 23 aa, Staphylococcus epidermidis
KVSNHITITVPKYIKNIDIKTNA

SEQ ID NO: 1842180 - protein, 17 aa, Staphylococcus epidermidis
LALSSIILTACGQENVK

SEQ ID NO: 1842181 - protein, 24 aa, Staphylococcus epidermidis
LIIFIIFFASGAMTWFTIDKNKYD

SEQ ID NO: 1842182 - protein, 19 aa, Staphylococcus epidermidis
LILALSLTLAACSNTNDNN

SEQ ID NO: 1842183 - protein, 29 aa, Staphylococcus epidermidis
LILLSFGLLVVPIIFATQLYQSSESAFES

SEQ ID NO: 1842184 - protein, 21 aa, Staphylococcus epidermidis
LLLLIFLIACAPTSTSQSPHP

SEQ ID NO: 1842185 - protein, 19 aa, Staphylococcus epidermidis
LLSLVLVLTACSNSSNNNS

SEQ ID NO: 1842186 - protein, 22 aa, Staphylococcus epidermidis
LQQCLKKNIPLVLVSRSFNGIV

SEQ ID NO: 1842187 - protein, 17 aa, Staphylococcus epidermidis
MAVSWYQNSAEAKALYL

SEQ ID NO: 1842188 - protein, 20 aa, Staphylococcus epidermidis
MILCMVLLYSCSGPMDSPKH

SEQ ID NO: 1842189 - protein, 18 aa, Staphylococcus epidermidis
MNSVYYYKKEKDGETFSK

SEQ ID NO: 1842190 - protein, 26 aa, Staphylococcus epidermidis
NEAATYLKKLLKPTLAKFIVTHANEH

SEQ ID NO: 1842191 - protein, 26 aa, Staphylococcus epidermidis
NGKSGWISKYYLTTASKPSNPTKPST

SEQ ID NO: 1842192 - protein, 25 aa, Staphylococcus epidermidis
NKKVMYLLVNEGELSTFGPGGRFGG

SEQ ID NO: 1842193 - protein, 28 aa, Staphylococcus epidermidis
NLAVKHPLFEYARSFDFIIITDVGLINV

SEQ ID NO: 1842194 - protein, 26 aa, Staphylococcus epidermidis
NNGQKVILIWNPWDNGLMTQDAHSNI

SEQ ID NO: 1842195 - protein, 21 aa, Staphylococcus epidermidis
NSPLHLRVYFEKDSRKLIRAA

SEQ ID NO: 1842196 - protein, 24 aa, Staphylococcus epidermidis
NYDRAVELYYYIKGGRVDYGAAHA

SEQ ID NO: 1842197 - protein, 27 aa, Staphylococcus epidermidis
QAPLNSYIFYYTPTLGQLQKLLVKNHS

SEQ ID NO: 1842198 - protein, 28 aa, Staphylococcus epidermidis
QAQYKNQYPVVFVHGFVGLVGEDAFSMY

SEQ ID NO: 1842199 - protein, 22 aa, Staphylococcus epidermidis
QDPHAWLSLENGIKYVKTIQKS

SEQ ID NO: 1842200 - protein, 30 aa, Staphylococcus epidermidis
QDTHSNRYYAQVWLTALDSYRGESDLPFDD

SEQ ID NO: 1842201 - protein, 27 aa, Staphylococcus epidermidis
QKEPWTNPIEGYKWYDRSTFKTGSYGS

SEQ ID NO: 1842202 - protein, 21 aa, Staphylococcus epidermidis
QKIHLIGHSMGGQTIRYLEEL

SEQ ID NO: 1842203 - protein, 25 aa, Staphylococcus epidermidis
QQNKKLHSWLKLSTLIDDVKVKDKY

SEQ ID NO: 1842204 - protein, 20 aa, Staphylococcus epidermidis
REDETLAQYIQRVKQSKLWT

SEQ ID NO: 1842205 - protein, 19 aa, Staphylococcus epidermidis
RFGGLVFDTLGFKPADKKV

SEQ ID NO: 1842206 - protein, 19 aa, Staphylococcus epidermidis
RLPMYRLTEIPKATSYDIV

SEQ ID NO: 1842207 - protein, 31 aa, Staphylococcus epidermidis; identical to SEQ ID NO: 1839972

SEQ ID NO: 1842208 - protein, 25 aa, Staphylococcus epidermidis
SKNDLHYYSFLNQLKLQMIQTKSSI

SEQ ID NO: 1842209 - protein, 34 aa, Staphylococcus epidermidis
SLVEMIFTLFIISCLLITTLWSRSLFDIQLIDEE

SEQ ID NO: 1842210 - protein, 24 aa, Staphylococcus epidermidis
SNNPLVTSFLLMPTVIVVNTDLQG

SEQ ID NO: 1842211 - protein, 23 aa, Staphylococcus epidermidis
SPHPLRTLIVYSPYPSHLIRPIL

SEQ ID NO: 1842212 - protein, 27 aa, Staphylococcus epidermidis
SQKIVLKQFKDYWQGTPKLKRINVTYH

SEQ ID NO: 1842213 - protein, 35 aa, Staphylococcus epidermidis
STPYNYTFVINNSKSYFYMDPTKANRYSLKPYYEQ

SEQ ID NO: 1842214 - protein, 17 aa, Staphylococcus epidermidis
STYWWNANNWDNASAAD

SEQ ID NO: 1842215 - protein, 27 aa, Staphylococcus epidermidis
SVGASSIIVASMLFIGGGSVHAAESNH

SEQ ID NO: 1842216 - protein, 23 aa, Staphylococcus epidermidis
TPRSLVIAEVLKKAGYDVTTTPV

SEQ ID NO: 1842217 - protein, 18 aa, Staphylococcus epidermidis
TVIILTIVVSACGNESKR

SEQ ID NO: 1842218 - protein, 32 aa, Staphylococcus epidermidis
VELTLPQNIQPHHPFQFTIKLTGYEPNSTISD

SEQ ID NO: 1842219 - protein, 20 aa, Staphylococcus epidermidis
VIGLLFVLIATAACGNNSSS

SEQ ID NO: 1842220 - protein, 21 aa, Staphylococcus epidermidis
VKWCRMMIRQVLSNSLKYSDN

SEQ ID NO: 1842221 - protein, 25 aa, Staphylococcus epidermidis
VSFGQRVISYPIQFVTGSIGDLFEK

SEQ ID NO: 1842222 - protein, 23 aa, Staphylococcus epidermidis
VSKLIQDLFMNDYLRVYTNNDLV

SEQ ID NO: 1842223 - protein, 17 aa, Staphylococcus epidermidis
VVSGITLGAILGLNVTE

SEQ ID NO: 1842224 - protein, 20 aa, Staphylococcus epidermidis
YFIEPGSGYLACGYVAKGRM

SEQ ID NO: 1842225 - protein, 25 aa, Staphylococcus epidermidis
YKSHDAYAKAYKKALNKEKELFSYL

SEQ ID NO: 1842226 - protein, 22 aa, Staphylococcus epidermidis
YVEHLVRDAAGTPIKFCAVVNK

SEQ ID NO: 1842227 - protein, 18 aa, Staphylococcus epidermidis
AATQLQYYNLKPDSAEND

SEQ ID NO: 1842228 - protein, 20 aa, Staphylococcus epidermidis
AFTILILAGCGLGDSDNNGS

SEQ ID NO: 1842229 - protein, 17 aa, Staphylococcus epidermidis
AGLFQTMPGWGSTGSVN

SEQ ID NO: 1842230 - protein, 17 aa, Staphylococcus epidermidis
AGNKKILFYSYENFMLN

SEQ ID NO: 1842231 - protein, 17 aa, Staphylococcus epidermidis
APSNLAIMGRYVLTPEI

SEQ ID NO: 1842232 - protein, 24 aa, Staphylococcus epidermidis
AVKNDLHFKKFIKNNHIPEEYKDP

SEQ ID NO: 1842233 - protein, 23 aa, Staphylococcus epidermidis
DGKTYTFYLRDDVSFHDGTKFDA

SEQ ID NO: 1842234 - protein, 17 aa, Staphylococcus epidermidis
DLRVGMDSSWMDRKGDG

SEQ ID NO: 1842235 - protein, 22 aa, Staphylococcus epidermidis
DPHVWLDPVLNQKFAFMIKEKL

SEQ ID NO: 1842236 - protein, 19 aa, Staphylococcus epidermidis
DSLYKIALEHNLSLEELYA

SEQ ID NO: 1842237 - protein, 27 aa, Staphylococcus epidermidis
EEELSKLFNINVFGTLFGIQAAANQFI

SEQ ID NO: 1842238 - protein, 23 aa, Staphylococcus epidermidis
EELGQFYMSMINNMLKVEELDGI

SEQ ID NO: 1842239 - protein, 18 aa, Staphylococcus epidermidis
ELKQLDAGSWFNRKHPEY

SEQ ID NO: 1842240 - protein, 17 aa, Staphylococcus epidermidis
FCTDIDAFYQYRPPIER

SEQ ID NO: 1842241 - protein, 29 aa, Staphylococcus epidermidis
FFSMKKVTLSFVTLFIGVGTIGSYNQFAD

SEQ ID NO: 1842242 - protein, 18 aa, Staphylococcus epidermidis
FYFIFPQQNEIIERMSKV

SEQ ID NO: 1842243 - protein, 24 aa, Staphylococcus epidermidis
GQRQMELIKILFQKAQNLKSIDKL

SEQ ID NO: 1842244 - protein, 17 aa, Staphylococcus epidermidis
IAATLVLSACSQNDTKE

SEQ ID NO: 1842245 - protein, 21 aa, Staphylococcus epidermidis
IIIIILIMAMVLNQKFMKDRV

SEQ ID NO: 1842246 - protein, 21 aa, Staphylococcus epidermidis
IISLSIFATSLNFIDTQAQAS

SEQ ID NO: 1842247 - protein, 25 aa, Staphylococcus epidermidis
IKSLKFNKKLYSLGYPVMNGNNTYA

SEQ ID NO: 1842248 - protein, 25 aa, Staphylococcus epidermidis
ILFFLIVMLGFAGGLGYSHYKDSKA

SEQ ID NO: 1842249 - protein, 19 aa, Staphylococcus epidermidis
ILSLIIIGLIKTFNEYDII

SEQ ID NO: 1842250 - protein, 20 aa, Staphylococcus epidermidis
IVLVLCLTVLSGCNLPGLKN

SEQ ID NO: 1842251 - protein, 24 aa, Staphylococcus epidermidis
KALTDADVVFYNGLNLETGNGWFE

SEQ ID NO: 1842252 - protein, 20 aa, Staphylococcus epidermidis
KEMNNKFNAYSKAIEKVKRE

SEQ ID NO: 1842253 - protein, 29 aa, Staphylococcus epidermidis
KGRVGIVPLINQRAYWFITVHAKEGDPKY

SEQ ID NO: 1842254 - protein, 21 aa, Staphylococcus epidermidis
KIPYQFHAKKIYKIPSYDMVV

SEQ ID NO: 1842255 - protein, 20 aa, Staphylococcus epidermidis
KPKLLTDAYKELLKEYKVDY

SEQ ID NO: 1842256 - protein, 17 aa, Staphylococcus epidermidis
KQLKKNYDFIILRAQYG

SEQ ID NO: 1842257 - protein, 34 aa, Staphylococcus epidermidis
KQNSHVDLNSLPATDFRTDWMSESGQKQVNDLAN

SEQ ID NO: 1842258 - protein, 24 aa, Staphylococcus epidermidis
KRTRDELQQFWHGLAEDLVQSEQL

SEQ ID NO: 1842259 - protein, 22 aa, Staphylococcus epidermidis
LARGLREFPIDITAIVTVADNG

SEQ ID NO: 1842260 - protein, 23 aa, Staphylococcus epidermidis
LEDDRKFFPPYDGSPLANEQLIK

SEQ ID NO: 1842261 - protein, 27 aa, Staphylococcus epidermidis
LLFTIFSTTVLVLVIIYNKTQSQSYIS

SEQ ID NO: 1842262 - protein, 30 aa, Staphylococcus epidermidis
LLVVAMIGILVIIFQFVNHSGPFSGSESQH

SEQ ID NO: 1842263 - protein, 22 aa, Staphylococcus epidermidis
LSGFDPIRREIARTALVNLVSD

SEQ ID NO: 1842264 - protein, 18 aa, Staphylococcus epidermidis
NETSWDSMFAGLDAGRFD

SEQ ID NO: 1842265 - protein, 25 aa, Staphylococcus epidermidis
NGNNTYAYWNKLRFLQEASNKSELM

SEQ ID NO: 1842266 - protein, 17 aa, Staphylococcus epidermidis
NPNIVYKTYQGESTRPG

SEQ ID NO: 1842267 - protein, 27 aa, Staphylococcus epidermidis
NTGVQLELTTALRKAFFKNGDTSTKNR

SEQ ID NO: 1842268 - protein, 21 aa, Staphylococcus epidermidis
PDFIVYYLDDSGRPEMKVLNK

SEQ ID NO: 1842269 - protein, 19 aa, Staphylococcus epidermidis
PSTPYPIIDLLPEQKDIED

SEQ ID NO: 1842270 - protein, 17 aa, Staphylococcus epidermidis
PTNKYLYQDGQYLDKKT

SEQ ID NO: 1842271 - protein, 17 aa, Staphylococcus epidermidis
QKAIINFVKNGGSVIFI

SEQ ID NO: 1842272 - protein, 20 aa, Staphylococcus epidermidis
QQARVLVIPEANNPFKENEQ

SEQ ID NO: 1842273 - protein, 20 aa, Staphylococcus epidermidis
QRKRALLFEWSRINEMLDKQ

SEQ ID NO: 1842274 - protein, 19 aa, Staphylococcus epidermidis
QRVKQSKLWTTKDNGFYDL

SEQ ID NO: 1842275 - protein, 33 aa, Staphylococcus epidermidis
QTEFNFSNPQYLPRFVFGHYMKSYLSYYNDQFD

SEQ ID NO: 1842276 - protein, 20 aa, Staphylococcus epidermidis
QYIDVNLRVPLVKAYMGMED

SEQ ID NO: 1842277 - protein, 27 aa, Staphylococcus epidermidis
RGDTGYFFNTAYLPDGALNKGNYSNTK

SEQ ID NO: 1842278 - protein, 20 aa, Staphylococcus epidermidis
RNTAMKLIPNALASAQTKFL

SEQ ID NO: 1842279 - protein, 27 aa, Staphylococcus epidermidis
RNTKDGIKPLLAKKWDISPDGKTYTFY

SEQ ID NO: 1842280 - protein, 20 aa, Staphylococcus epidermidis
SAILAYYLFSPTELDSDDNH

SEQ ID NO: 1842281 - protein, 28 aa, Staphylococcus epidermidis
SLKITTHNVYFLPTAIYPNWGQSQRADL

SEQ ID NO: 1842282 - protein, 25 aa, Staphylococcus epidermidis
SSLLFIFILTTCSFSYITFSKLTSK

SEQ ID NO: 1842283 - protein, 17 aa, Staphylococcus epidermidis
STKFPNVFLIGATVRHQ

SEQ ID NO: 1842284 - protein, 31 aa, Staphylococcus epidermidis
TGPVTGKGNYWGGNRLKIIQDYRAKGYNVME

SEQ ID NO: 1842285 - protein, 26 aa, Staphylococcus epidermidis
VDNGYQYNFTSNGSEWSWSYAVAGSD

SEQ ID NO: 1842286 - protein, 17 aa, Staphylococcus epidermidis
VKLRNTAMKLIPNALAS

SEQ ID NO: 1842287 - protein, 17 aa, Staphylococcus epidermidis
VQKRYVLILKNGKITKR

SEQ ID NO: 1842288 - protein, 17 aa, Staphylococcus epidermidis
VSLASTERKIDKYQSMT

SEQ ID NO: 1842289 - protein, 25 aa, Staphylococcus epidermidis
VTENQSMKYVPLGPLNTVKGKFRVE

SEQ ID NO: 1842290 - protein, 29 aa, Staphylococcus epidermidis
VVIILICALGFSLYAAINHHTNSNKNDKK

SEQ ID NO: 1842291 - protein, 19 aa, Staphylococcus epidermidis
VVLVISAVSLSACGKERTK

SEQ ID NO: 1842292 - protein, 27 aa, Staphylococcus epidermidis
YGKKQCTWWAFKRRAQLGKPVSNRWGN

SEQ ID NO: 1842293 - protein, 18 aa, Staphylococcus epidermidis
YLRINKRVDIMLGHGLFN

SEQ ID NO: 1842294 - protein, 25 aa, Staphylococcus epidermidis
YLSFIFFIFSLMLFTNQSFANDNKR

SEQ ID NO: 1842295 - protein, 25 aa, Staphylococcus epidermidis
YSFGTVRPMQIGLVYDALSSGKLDV

SEQ ID NO: 1842296 - protein, 23 aa, Staphylococcus epidermidis
YSVPSHFQGSWRDADYSKRESQR

SEQ ID NO: 1842297 - protein, 25 aa, Staphylococcus epidermidis
AANSLNYKIKLIGKGTYENGYVNAS

SEQ ID NO: 1842298 - protein, 18 aa, Staphylococcus epidermidis
AAPNAKILFVSPDNDHYL

SEQ ID NO: 1842299 - protein, 20 aa, Staphylococcus epidermidis
ALQQLPNFETALSIAKNEAN

SEQ ID NO: 1842300 - protein, 28 aa, Staphylococcus epidermidis
AQENFISMIKTMYPRSFNTAYKILKMIQ

SEQ ID NO: 1842301 - protein, 19 aa, Staphylococcus epidermidis
ARFKVLMSLIQSLYNSKKF

SEQ ID NO: 1842302 - protein, 25 aa, Staphylococcus epidermidis
ATGDYSFPYHPFSYRLHYSEIQTFT

SEQ ID NO: 1842303 - protein, 17 aa, Staphylococcus epidermidis
DFQFTGLTSNEMLRFGR

SEQ ID NO: 1842304 - protein, 20 aa, Staphylococcus epidermidis
DSARPMQIGLVYDALKNNKL

SEQ ID NO: 1842305 - protein, 18 aa, Staphylococcus epidermidis
EEMYRYIGTLLKQHPHLS

SEQ ID NO: 1842306 - protein, 21 aa, Staphylococcus epidermidis
EEPMQILSVINKFFTQQENVV

SEQ ID NO: 1842307 - protein, 25 aa, Staphylococcus epidermidis
EKKQSKPFETSLPPLNEDWNENEKK

SEQ ID NO: 1842308 - protein, 21 aa, Staphylococcus epidermidis
EYINMKGILNGKPYYEFNIDQ

SEQ ID NO: 1842309 - protein, 18 aa, Staphylococcus epidermidis
FVVTVILTIAALIDEFMT

SEQ ID NO: 1842310 - protein, 23 aa, Staphylococcus epidermidis
GAITITTLLAGCDFGDFVGQYQS

SEQ ID NO: 1842311 - protein, 24 aa, Staphylococcus epidermidis
GEQQLKNIAYLKATFKNSSKVNKD

SEQ ID NO: 1842312 - protein, 25 aa, Staphylococcus epidermidis
GEQQLKNIAYLKATFKNSSKVNKDT

SEQ ID NO: 1842313 - protein, 24 aa, Staphylococcus epidermidis
GERTLLFGPFANIGPKFLRNGSNL

SEQ ID NO: 1842314 - protein, 27 aa, Staphylococcus epidermidis
GKTYEGVYKDWKPGQKIHLVGHSMGGQ

SEQ ID NO: 1842315 - protein, 18 aa, Staphylococcus epidermidis
GMVLYINRNTRTTKGYYF

SEQ ID NO: 1842316 - protein, 17 aa, Staphylococcus epidermidis
HELLDKYGKSSNYKNLA

SEQ ID NO: 1842317 - protein, 28 aa, Staphylococcus epidermidis
HGASGTEEIIYLGGPRSDLRNAIEKQLV

SEQ ID NO: 1842318 - protein, 18 aa, Staphylococcus epidermidis
ICALIVVLAACGQDANHS

SEQ ID NO: 1842319 - protein, 18 aa, Staphylococcus epidermidis
ICALIVVLAACSQDANHS

SEQ ID NO: 1842320 - protein, 19 aa, Staphylococcus epidermidis
IKSPLKFNPDLAKKNWREA

SEQ ID NO: 1842321 - protein, 17 aa, Staphylococcus epidermidis
ILGSLLILSACSNNDEK

SEQ ID NO: 1842322 - protein, 18 aa, Staphylococcus epidermidis
ILLSVCIILSACSNKQSL

SEQ ID NO: 1842323 - protein, 26 aa, Staphylococcus epidermidis
INHNVEVWLIKKGFTIYQRYTLDRFI

SEQ ID NO: 1842324 - protein, 25 aa, Staphylococcus epidermidis
ISLDPDIFYPLIKKLKENNDYVVVN

SEQ ID NO: 1842325 - protein, 21 aa, Staphylococcus epidermidis
ITANKDLLAIHLKLLEDLAEE

SEQ ID NO: 1842326 - protein, 18 aa, Staphylococcus epidermidis
IVLVIFTNKDNKSDKPND

SEQ ID NO: 1842327 - protein, 19 aa, Staphylococcus epidermidis
KENKKFLLDLMLNNKSGDT

SEQ ID NO: 1842328 - protein, 18 aa, Staphylococcus epidermidis
KKNKNFLLDLMLNNKNGD

SEQ ID NO: 1842329 - protein, 25 aa, Staphylococcus epidermidis
KLQVDLERPVPYINELLALNTFNPQ

SEQ ID NO: 1842330 - protein, 25 aa, Staphylococcus epidermidis
KNQSEPIILVIFTNKDNKSDKPNDK

SEQ ID NO: 1842331 - protein, 32 aa, Staphylococcus epidermidis
KQTIQYQRFIRHIQFLIYRLTKGEYLEAQENF

SEQ ID NO: 1842332 - protein, 19 aa, Staphylococcus epidermidis
KRTPIFYSLGNTTSDNFLS

SEQ ID NO: 1842333 - protein, 23 aa, Staphylococcus epidermidis
KSKPELILASFRQAHTKTIDEMK

SEQ ID NO: 1842334 - protein, 20 aa, Staphylococcus epidermidis
KTLTINLRKNAKWSNGDSVT

SEQ ID NO: 1842335 - protein, 26 aa, Staphylococcus epidermidis
KTYEGVYKDWKPGQKIHLVGHSMGGQ

SEQ ID NO: 1842336 - protein, 22 aa, Staphylococcus epidermidis
KYDEKYYHSLGFANTYAFMVTK

SEQ ID NO: 1842337 - protein, 18 aa, Staphylococcus epidermidis
KYHNVFGIGAFDNNALVD

SEQ ID NO: 1842338 - protein, 20 aa, Staphylococcus epidermidis
KYVAPYQSENATRVARCLSP

SEQ ID NO: 1842339 - protein, 24 aa, Staphylococcus epidermidis
LEDDRRFFPPYDASPLASDQLLKE

SEQ ID NO: 1842340 - protein, 24 aa, Staphylococcus epidermidis
LILIALSLIVLSGCSLPGLGDGNA

SEQ ID NO: 1842341 - protein, 20 aa, Staphylococcus epidermidis
LMIAVILFVTACSKDKTQDE

SEQ ID NO: 1842342 - protein, 24 aa, Staphylococcus epidermidis
LQKAEYILLHEAPVAPVYQKGEAH

SEQ ID NO: 1842343 - protein, 21 aa, Staphylococcus epidermidis
LSGFDPIRREIARTALVNLVS

SEQ ID NO: 1842344 - protein, 18 aa, Staphylococcus epidermidis
LSIIIISSFCVATGFQNV

SEQ ID NO: 1842345 - protein, 24 aa, Staphylococcus epidermidis
LSLEELYALNPGVEPLIFPGDEIV

SEQ ID NO: 1842346 - protein, 17 aa, Staphylococcus epidermidis
LSSIAAFIAINTAANAQ

SEQ ID NO: 1842347 - protein, 17 aa, Staphylococcus epidermidis
METRGMVLYINRNTRTT

SEQ ID NO: 1842348 - protein, 19 aa, Staphylococcus epidermidis
NAKILFVSPDNDHYLSSIK

SEQ ID NO: 1842349 - protein, 17 aa, Staphylococcus epidermidis
NEKYYEFRTDKGVLLVT

SEQ ID NO: 1842350 - protein, 25 aa, Staphylococcus epidermidis
NHNVEVWLIKKGFTIYQRYTLDRFI

SEQ ID NO: 1842351 - protein, 21 aa, Staphylococcus epidermidis
NIPVDTLFYDGSHHLHHQYQF

SEQ ID NO: 1842352 - protein, 25 aa, Staphylococcus epidermidis
NNEKLADILLQFKNSNKIISSVCHG

SEQ ID NO: 1842353 - protein, 17 aa, Staphylococcus epidermidis
NNGLYSIAWGTKNQQLL

SEQ ID NO: 1842354 - protein, 29 aa, Staphylococcus epidermidis
NTTGQSYIFAKNKLYPIPGGSIMGIPTDI

SEQ ID NO: 1842355 - protein, 17 aa, Staphylococcus epidermidis
NVYSINYVFGKKLAKMN

SEQ ID NO: 1842356 - protein, 17 aa, Staphylococcus epidermidis
PGRPNFDQLAKSKPELI

SEQ ID NO: 1842357 - protein, 20 aa, Staphylococcus epidermidis
QNDGLYYFIPSDASKNENTQ

SEQ ID NO: 1842358 - protein, 24 aa, Staphylococcus epidermidis
QSWDVSMYSYLSVPRGDTGYFFNT

SEQ ID NO: 1842359 - protein, 20 aa, Staphylococcus epidermidis
RLHSQYPYQTPIVGKGTEGW

SEQ ID NO: 1842360 - protein, 24 aa, Staphylococcus epidermidis
RMEEPMQILSVINKFFTQQKNVVK

SEQ ID NO: 1842361 - protein, 19 aa, Staphylococcus epidermidis
RPNFDQLAKSKPELILASF

SEQ ID NO: 1842362 - protein, 23 aa, Staphylococcus epidermidis
RSQALQQLPNFETALSIAKNEAN

SEQ ID NO: 1842363 - protein, 19 aa, Staphylococcus epidermidis
RVQNSKLWKSKDSGLHDLT

SEQ ID NO: 1842364 - protein, 27 aa, Staphylococcus epidermidis
SDKKYHRIISLIPSNTEILYRLGIGED

SEQ ID NO: 1842365 - protein, 17 aa, Staphylococcus epidermidis
SESQIISHMLRLLIEHD

SEQ ID NO: 1842366 - protein, 20 aa, Staphylococcus epidermidis
SFSDVFGYFIDDEDFLMGED

SEQ ID NO: 1842367 - protein, 27 aa, Staphylococcus epidermidis
SLKITTHNVYFLPTAIYPNWGQSQRAD

SEQ ID NO: 1842368 - protein, 18 aa, Staphylococcus epidermidis
SNEKYYEFRTDKGVLLVT

SEQ ID NO: 1842369 - protein, 25 aa, Staphylococcus epidermidis
SNLGIYIVKPGDSLYKIALEHNLSL

SEQ ID NO: 1842370 - protein, 18 aa, Staphylococcus epidermidis
STPYPIIDLLPEQKDIED

SEQ ID NO: 1842371 - protein, 17 aa, Staphylococcus epidermidis
TENIPVDTLFYDGSHHL

SEQ ID NO: 1842372 - protein, 23 aa, Staphylococcus epidermidis
TFIVFWGIGFFKYADAHVTLNPN

SEQ ID NO: 1842373 - protein, 19 aa, Staphylococcus epidermidis
TILSLMLVGCSNGGNDESS

SEQ ID NO: 1842374 - protein, 24 aa, Staphylococcus epidermidis
TKANRYSLKPYYEQTFTVIKQKNI

SEQ ID NO: 1842375 - protein, 25 aa, Staphylococcus epidermidis
TKANRYSLKPYYEQTFTVIKQKNIN

SEQ ID NO: 1842376 - protein, 24 aa, Staphylococcus epidermidis
TRDKDSIRLTYLGNVTLNKHIRQT

SEQ ID NO: 1842377 - protein, 17 aa, Staphylococcus epidermidis
VDILDRDLWARSRGLIS

SEQ ID NO: 1842378 - protein, 25 aa, Staphylococcus epidermidis
VGEDAFSMYPNYWGGTKYNVKQELT

SEQ ID NO: 1842379 - protein, 22 aa, Staphylococcus epidermidis
VGMAITLQEFYIKDVLIVEKGS

SEQ ID NO: 1842380 - protein, 29 aa, Staphylococcus epidermidis
VHHMNANIPLIRLMNKFELKKATNQDLKN

SEQ ID NO: 1842381 - protein, 33 aa, Staphylococcus epidermidis
VRHQNAILCYIYKFRARFAVLAHLVSLREDLPE

SEQ ID NO: 1842382 - protein, 22 aa, Staphylococcus epidermidis
YHRIVSLIPSNTEILYRLGIGE

SEQ ID NO: 1842383 - protein, 24 aa, Staphylococcus epidermidis
YRTTFELLTKIYKRLLTKIDEPEN

SEQ ID NO: 1842384 - protein, 17 aa, Staphylococcus epidermidis
AATQLQYYNLKPDSAEN

SEQ ID NO: 1842385 - protein, 18 aa, Staphylococcus epidermidis
AGLFQTMPGWGSTGSVND

SEQ ID NO: 1842386 - protein, 18 aa, Staphylococcus epidermidis
AITHLTPEQKANGAGGGG

SEQ ID NO: 1842387 - protein, 28 aa, Staphylococcus epidermidis
AKDFGKKYIIFPNPMYGSWESTLYHNQY

SEQ ID NO: 1842388 - protein, 18 aa, Staphylococcus epidermidis
ALAFYADGVEKYMLTKNE

SEQ ID NO: 1842389 - protein, 17 aa, Staphylococcus epidermidis
ALLAAHLQSDQLIILTA

SEQ ID NO: 1842390 - protein, 23 aa, Staphylococcus epidermidis
ALTDADVVFYNGLNLETGNGWFE

SEQ ID NO: 1842391 - protein, 26 aa, Staphylococcus epidermidis
ANNEKLADILLQFKNSNKIISSVCHG

SEQ ID NO: 1842392 - protein, 25 aa, Staphylococcus epidermidis
APKDMKFYQVYPSKGQFASIVGVNK

SEQ ID NO: 1842393 - protein, 24 aa, Staphylococcus epidermidis
ASALNYKIKLIGKGTYENGYVNAS

SEQ ID NO: 1842394 - protein, 25 aa, Staphylococcus epidermidis
DGERTLLFGPFANIGPKFLRNGSNL

SEQ ID NO: 1842395 - protein, 17 aa, Staphylococcus epidermidis
DLHELLDKYGKSSNYKN

SEQ ID NO: 1842396 - protein, 19 aa, Staphylococcus epidermidis
DNKTYLWDNIRINDDGNWT

SEQ ID NO: 1842397 - protein, 21 aa, Staphylococcus epidermidis
DRAVELYYYVKGGRVDYGAAH

SEQ ID NO: 1842398 - protein, 24 aa, Staphylococcus epidermidis
EDVVKLADFLASRRGKLLGQYGIK

SEQ ID NO: 1842399 - protein, 24 aa, Staphylococcus epidermidis
EELGQFYMSMINNMLKVEELDGIT

SEQ ID NO: 1842400 - protein, 25 aa, Staphylococcus epidermidis
EKRQSKPFETSLPPLNEDWNENEKK

SEQ ID NO: 1842401 - protein, 27 aa, Staphylococcus epidermidis
EPSIPHNFTFHLLFSNNKLKINDPNIS

SEQ ID NO: 1842402 - protein, 21 aa, Staphylococcus epidermidis
ESFSDVFGYFIDDEDFLMGED

SEQ ID NO: 1842403 - protein, 21 aa, Staphylococcus epidermidis
FASLLVLTACGQEEEKKEKDN

SEQ ID NO: 1842404 - protein, 17 aa, Staphylococcus epidermidis
FILDKNFKTSLKADNFK

SEQ ID NO: 1842405 - protein, 28 aa, Staphylococcus epidermidis
GGQNGFGYGDYLAAKEASEKARRGELQG

SEQ ID NO: 1842406 - protein, 24 aa, Staphylococcus epidermidis
GKDVDIDLGFSQWGLKQQPNESYI

SEQ ID NO: 1842407 - protein, 19 aa, Staphylococcus epidermidis
GKFRVEKPYKSGANGWAVP

SEQ ID NO: 1842408 - protein, 31 aa, Staphylococcus epidermidis
GLGGSWGVAPKQDFNLWRNQQAEIQNEHIAP

SEQ ID NO: 1842409 - protein, 17 aa, Staphylococcus epidermidis
GLYYFIPSDASKNENTQ

SEQ ID NO: 1842410 - protein, 22 aa, Staphylococcus epidermidis
GNLLGPTLKLKKGDKVKIKLIN

SEQ ID NO: 1842411 - protein, 22 aa, Staphylococcus epidermidis
GQRKSIHTYKLESLPKKVEGAP

SEQ ID NO: 1842412 - protein, 19 aa, Staphylococcus epidermidis
GQSEPIVLVIFTNKDNKSD

SEQ ID NO: 1842413 - protein, 24 aa, Staphylococcus epidermidis
GRELGQFYLGIMDNIMRIEEADGI

SEQ ID NO: 1842414 - protein, 26 aa, Staphylococcus epidermidis
GRVGIVPLINQRAYWFITVHAKEGDP

SEQ ID NO: 1842415 - protein, 20 aa, Staphylococcus epidermidis
GTEESIYLGGPRSDLRNAIE

SEQ ID NO: 1842416 - protein, 22 aa, Staphylococcus epidermidis
GWKKPGYWSKSSVKKTWSGNKA

SEQ ID NO: 1842417 - protein, 24 aa, Staphylococcus epidermidis
HLQSDQLIILTAVDHVYINYGKEN

SEQ ID NO: 1842418 - protein, 17 aa, Staphylococcus epidermidis
IINFVKNGGSVIFISDH

SEQ ID NO: 1842419 - protein, 20 aa, Staphylococcus epidermidis
IISLSIFATSLNFIDTQAQA

SEQ ID NO: 1842420 - protein, 17 aa, Staphylococcus epidermidis
ITACTWTSKKWPFTTPE

SEQ ID NO: 1842421 - protein, 27 aa, Staphylococcus epidermidis
KDFGKKYIIFPNPMYGSWESTLYHNQY

SEQ ID NO: 1842422 - protein, 23 aa, Staphylococcus epidermidis
KEEKIRLRLLNGSNARDLNLKLS

SEQ ID NO: 1842423 - protein, 21 aa, Staphylococcus epidermidis
KEMNNKFNAYSKAIEKVKREK

SEQ ID NO: 1842424 - protein, 18 aa, Staphylococcus epidermidis
KFRVEKPYKSGANGWAVP

SEQ ID NO: 1842425 - protein, 19 aa, Staphylococcus epidermidis
KGKPDTWIADRKLKGLVFQ

SEQ ID NO: 1842426 - protein, 21 aa, Staphylococcus epidermidis
KGQFKQFRHGLSSFIEALVKD

SEQ ID NO: 1842427 - protein, 20 aa, Staphylococcus epidermidis
KGQSEPIVLVIFTNKDNKSD

SEQ ID NO: 1842428 - protein, 26 aa, Staphylococcus epidermidis
KMLKNTKIYSKYFKKGYLPKDTKDNI

SEQ ID NO: 1842429 - protein, 20 aa, Staphylococcus epidermidis
KRDLPRIFDRGFTSTTDRND

SEQ ID NO: 1842430 - protein, 20 aa, Staphylococcus epidermidis
KRGFRGAGSYWADHLGYTDI

SEQ ID NO: 1842431 - protein, 33 aa, Staphylococcus epidermidis
KRKNTLYTAIVLLVALVLLIFAVNSIQVEPVKS

SEQ ID NO: 1842432 - protein, 24 aa, Staphylococcus epidermidis
KRTRDELQQFWHGLADDLVQSEQL

SEQ ID NO: 1842433 - protein, 22 aa, Staphylococcus epidermidis
LASSLILGFSVTPELFNVTQAH

SEQ ID NO: 1842434 - protein, 22 aa, Staphylococcus epidermidis
LIIIFSIIIIASNDTFAESKND

SEQ ID NO: 1842435 - protein, 25 aa, Staphylococcus epidermidis
LLFTIFSTTVLVLVIIYNKTQSQSY

SEQ ID NO: 1842436 - protein, 17 aa, Staphylococcus epidermidis
LLIVILAEEIRSATNKP

SEQ ID NO: 1842437 - protein, 25 aa, Staphylococcus epidermidis
LSLEELYALNPGVEPLIFPGDEIVV

SEQ ID NO: 1842438 - protein, 20 aa, Staphylococcus epidermidis
LSSLLILGSCGVKHNNSDSN

SEQ ID NO: 1842439 - protein, 25 aa, Staphylococcus epidermidis
MLKNTKIYSKYFKKGYLPKDTKDNI

SEQ ID NO: 1842440 - protein, 17 aa, Staphylococcus epidermidis
NDGLYYFIPSDASKNEN

SEQ ID NO: 1842441 - protein, 28 aa, Staphylococcus epidermidis
NELPNSSEILLLNLTSRIIGKDANKEIR

SEQ ID NO: 1842442 - protein, 17 aa, Staphylococcus epidermidis
NETSWDSMFAGLDAGRF

SEQ ID NO: 1842443 - protein, 23 aa, Staphylococcus epidermidis
NPTKPIGLFYTKEQADKFTKEKG

SEQ ID NO: 1842444 - protein, 26 aa, Staphylococcus epidermidis
NSKKFQNRFLFNLGIKHYNFNNDIRK

SEQ ID NO: 1842445 - protein, 20 aa, Staphylococcus epidermidis
PHVWLDPVLNQKFAFMIKEK

SEQ ID NO: 1842446 - protein, 19 aa, Staphylococcus epidermidis
PKLLTDAYKELLKEYKVDY

SEQ ID NO: 1842447 - protein, 23 aa, Staphylococcus epidermidis
PSIAMTLLLTGCVQKDNDHDEAS

SEQ ID NO: 1842448 - protein, 21 aa, Staphylococcus epidermidis
QKAIINFVKNGGSVIFISDHY

SEQ ID NO: 1842449 - protein, 21 aa, Staphylococcus epidermidis
QQAHVLVIPEANNPFKENEQK

SEQ ID NO: 1842450 - protein, 17 aa, Staphylococcus epidermidis
QSNFILDKNFKTSLKAD

SEQ ID NO: 1842451 - protein, 26 aa, Staphylococcus epidermidis
QSNLGIYIVKPGDSLYKIALEHNLSL

SEQ ID NO: 1842452 - protein, 32 aa, Staphylococcus epidermidis
QTEFNFSNPQYLPRFVFGHYMKSYLSYYNDQF

SEQ ID NO: 1842453 - protein, 18 aa, Staphylococcus epidermidis
QVYQFESNAWYFGEGGNQ

SEQ ID NO: 1842454 - protein, 19 aa, Staphylococcus epidermidis
RDLPRIFDRGFTSTTDRND

SEQ ID NO: 1842455 - protein, 21 aa, Staphylococcus epidermidis
RGYRRVVPSPQPISIVELDSI

SEQ ID NO: 1842456 - protein, 24 aa, Staphylococcus epidermidis
RHNTKVLSKMIYELALELTSTIRF

SEQ ID NO: 1842457 - protein, 25 aa, Staphylococcus epidermidis
RHNTKVLSKMIYELALELTSTIRFT

SEQ ID NO: 1842458 - protein, 24 aa, Staphylococcus epidermidis
RLLTRLHSQYPYQTPIVGKGTEGW

SEQ ID NO: 1842459 - protein, 17 aa, Staphylococcus epidermidis
RLTAATFFIKMNQKTVP

SEQ ID NO: 1842460 - protein, 29 aa, Staphylococcus epidermidis
RNAIEKQLVGCGFTVKVPPEYLGGQNNKN

SEQ ID NO: 1842461 - protein, 19 aa, Staphylococcus epidermidis
RNTAMKLIPNALASAQTKF

SEQ ID NO: 1842462 - protein, 18 aa, Staphylococcus epidermidis
RSQALQQLPNFETALSIA

SEQ ID NO: 1842463 - protein, 23 aa, Staphylococcus epidermidis
RTTFELLTKIYKRLLTKIDEPEN

SEQ ID NO: 1842464 - protein, 20 aa, Staphylococcus epidermidis
RVQNSKLWKSKDSGLHDLTR

SEQ ID NO: 1842465 - protein, 22 aa, Staphylococcus epidermidis
SGKEYQEYLGAKESQHAITHLT

SEQ ID NO: 1842466 - protein, 21 aa, Staphylococcus epidermidis
SIILFAIVLTACGNDKSGNSY

SEQ ID NO: 1842467 - protein, 47 aa, Staphylococcus epidermidis; identical to SEQ ID NO: 1749346

SEQ ID NO: 1842468 - protein, 18 aa, Staphylococcus epidermidis
STKFPNVFLIGATVRHQN

SEQ ID NO: 1842469 - protein, 17 aa, Staphylococcus epidermidis
SWGFSFTDKEGHLEGSY

SEQ ID NO: 1842470 - protein, 22 aa, Staphylococcus epidermidis
TALATITLIPSLMILDTQHEAK

SEQ ID NO: 1842471 - protein, 21 aa, Staphylococcus epidermidis
TALATITLVPSLMILDTQHEA

SEQ ID NO: 1842472 - protein, 23 aa, Staphylococcus epidermidis
TENIPVDTLFYDGSHHLHHQYQF

SEQ ID NO: 1842473 - protein, 22 aa, Staphylococcus epidermidis
TGDYSFPYHPFSYGRHYSEIQT

SEQ ID NO: 1842474 - protein, 18 aa, Staphylococcus epidermidis
TILSLMLVGCSNGGNDES

SEQ ID NO: 1842475 - protein, 17 aa, Staphylococcus epidermidis
TTLNPNIVYTSYTGAAT

SEQ ID NO: 1842476 - protein, 17 aa, Staphylococcus epidermidis
VARCLSPFEGDRSQALQ

SEQ ID NO: 1842477 - protein, 26 aa, Staphylococcus epidermidis
VGEDAFSMYPNYWGGIKYNVKQELTK

SEQ ID NO: 1842478 - protein, 28 aa, Staphylococcus epidermidis
VHHMNANIPLIRLMNKFELKKATNQDLK

SEQ ID NO: 1842479 - protein, 22 aa, Staphylococcus epidermidis
VITANKDLLAIHLKLLEDLAEE

SEQ ID NO: 1842480 - protein, 23 aa, Staphylococcus epidermidis
VLARGLREFPIDITAIVTVADNG

SEQ ID NO: 1842481 - protein, 26 aa, Staphylococcus epidermidis
VNQDSATLWYHPHPSPNTAKQVYNGL

SEQ ID NO: 1842482 - protein, 24 aa, Staphylococcus epidermidis
VTAYDFVYAWRKVVNPKTASEFAY

SEQ ID NO: 1842483 - protein, 17 aa, Staphylococcus epidermidis
WIADRKLKGLVFQSDND

SEQ ID NO: 1842484 - protein, 22 aa, Staphylococcus epidermidis
YGHHRYGRTYKGIMRDWEPGKK

SEQ ID NO: 1842485 - protein, 28 aa, Staphylococcus epidermidis
YGKKQCTWWAFKRRAQLGKPVSNRWGNA

SEQ ID NO: 1842486 - protein, 17 aa, Staphylococcus epidermidis
YGRTLAYVWLKNGDMFN

SEQ ID NO: 1842487 - protein, 18 aa, Staphylococcus epidermidis
YGRTLAYVWLKNGDMFNE

SEQ ID NO: 1842488 - protein, 31 aa, Staphylococcus epidermidis; identical to SEQ ID NO: 1749744

SEQ ID NO: 1842489 - protein, 19 aa, Staphylococcus epidermidis
YLRINKRVDIMLGHGLFNE

SEQ ID NO: 1842490 - protein, 18 aa, Staphylococcus epidermidis
YLVELWAGDAPLDDYKMS

SEQ ID NO: 1842491 - protein, 21 aa, Staphylococcus epidermidis
YQYIDVNLRVPLVKAYMGMED

SEQ ID NO: 1842492 - protein, 23 aa, Staphylococcus epidermidis
AAAAKNLPLIKYSIDQVLMTKEG

SEQ ID NO: 1842493 - protein, 25 aa, Staphylococcus epidermidis
AAFMKKVIDTRAVFKIGGIGLAFKK

SEQ ID NO: 1842494 - protein, 31 aa, Staphylococcus epidermidis
AAGKYQFLQSTWDSVAPSQYKGQSPANAPES

SEQ ID NO: 1842495 - protein, 19 aa, Staphylococcus epidermidis
AAGLGMAITLQEFNIKDVL

SEQ ID NO: 1842496 - protein, 23 aa, Staphylococcus epidermidis
AAIKDFWEKVGLKTKVKLVEFGK

SEQ ID NO: 1842497 - protein, 20 aa, Staphylococcus epidermidis
AAPKMLPMFSDELVSYAVNF

SEQ ID NO: 1842498 - protein, 21 aa, Staphylococcus epidermidis
AAVTPYYTYQGYAGNNASFVL

SEQ ID NO: 1842499 - protein, 42 aa, Staphylococcus epidermidis
ADVGNEPFIRQLAYDYARFQGHKLSRVDLGLKQWGLAQRDGE

SEQ ID NO: 1842500 - protein, 18 aa, Staphylococcus epidermidis
AEDYWFTDPITLEHLRSK

SEQ ID NO: 1842501 - protein, 17 aa, Staphylococcus epidermidis
AENIPVDTLFYDGSHHL

SEQ ID NO: 1842502 - protein, 19 aa, Staphylococcus epidermidis
AFDLYGDGIAQQVGQAWDS

SEQ ID NO: 1842503 - protein, 20 aa, Staphylococcus epidermidis
AFTVLILAGCGLGDSDNKGS

SEQ ID NO: 1842504 - protein, 20 aa, Staphylococcus epidermidis
AFTVLILAGCGLGDSDNNGS

SEQ ID NO: 1842505 - protein, 21 aa, Staphylococcus epidermidis
AGAADWVIDGAFSDYADSMKQ

SEQ ID NO: 1842506 - protein, 33 aa, Staphylococcus epidermidis
AGLMIVMFVLCGLLFPLTVTAIGQITFPHQANG

SEQ ID NO: 1842507 - protein, 25 aa, Staphylococcus epidermidis
AGQNTLYKMRWNPASPGTHQYATDI

SEQ ID NO: 1842508 - protein, 29 aa, Staphylococcus epidermidis
AHAQYKNQYPVVFVHGFVGLVGEDSFSMY

SEQ ID NO: 1842509 - protein, 18 aa, Staphylococcus epidermidis
AIAIISLGLVGCSDQSSD

SEQ ID NO: 1842510 - protein, 25 aa, Staphylococcus epidermidis
AIEKQLVGRGFTVKVPPEYIGGQNN

SEQ ID NO: 1842511 - protein, 25 aa, Staphylococcus epidermidis
AIEKQLVGRGFTVKVPPEYLGGQNN

SEQ ID NO: 1842512 - protein, 26 aa, Staphylococcus epidermidis
AIEKQLVGRGFTVKVPPEYLGGQNNK

SEQ ID NO: 1842513 - protein, 24 aa, Staphylococcus epidermidis
AIIQKRYVLILKNGKIKKREVTYK

SEQ ID NO: 1842514 - protein, 24 aa, Staphylococcus epidermidis
AIKEKLNYYIVLQRNNLAIDKLEN

SEQ ID NO: 1842515 - protein, 21 aa, Staphylococcus epidermidis
AIKNVPLIKYSIDQVIMTKEG

SEQ ID NO: 1842516 - protein, 19 aa, Staphylococcus epidermidis
AILAYYLFSPTELDSDDNH

SEQ ID NO: 1842517 - protein, 22 aa, Staphylococcus epidermidis
AILSSALLLTACGQDGDKSNKD

SEQ ID NO: 1842518 - protein, 18 aa, Staphylococcus epidermidis
AIMGRYVLTPEIFDYLKT

SEQ ID NO: 1842519 - protein, 20 aa, Staphylococcus epidermidis
AIVNFVKRGGSVIFISDHYN

SEQ ID NO: 1842520 - protein, 18 aa, Staphylococcus epidermidis
AIVVGCSVILGACQGVHD

SEQ ID NO: 1842521 - protein, 17 aa, Staphylococcus epidermidis
AIYSARQFIGDEPFAVL

SEQ ID NO: 1842522 - protein, 21 aa, Staphylococcus epidermidis
AKEVYDYYKDTFGRESYDDKG

SEQ ID NO: 1842523 - protein, 24 aa, Staphylococcus epidermidis
AKFLTLKEFLKYKKKGKFPKRSVW

SEQ ID NO: 1842524 - protein, 17 aa, Staphylococcus epidermidis
AKKRGFRGAGSYWADHL

SEQ ID NO: 1842525 - protein, 22 aa, Staphylococcus epidermidis
AKKRGFRGAGSYWADHLGYTDI

SEQ ID NO: 1842526 - protein, 18 aa, Staphylococcus epidermidis
ALSKLDKNKKGFFLMVEG

SEQ ID NO: 1842527 - protein, 18 aa, Staphylococcus epidermidis
ALTNKQHRLRLNETILDV

SEQ ID NO: 1842528 - protein, 22 aa, Staphylococcus epidermidis
ANIGMVFNWNPTAKQLTYGTGT

SEQ ID NO: 1842529 - protein, 18 aa, Staphylococcus epidermidis
ANPYFYQIELVRQYTFED

SEQ ID NO: 1842530 - protein, 20 aa, Staphylococcus epidermidis
ANTPIHMYHYGTPSGKYKND

SEQ ID NO: 1842531 - protein, 26 aa, Staphylococcus epidermidis
APIKETLAASLIRLANWKGDTPLIDP

SEQ ID NO: 1842532 - protein, 20 aa, Staphylococcus epidermidis
ARPYNYTFVISNSNSYYYED

SEQ ID NO: 1842533 - protein, 24 aa, Staphylococcus epidermidis
ASGGDFVLSNSFYQGLKAGNVTFN

SEQ ID NO: 1842534 - protein, 22 aa, Staphylococcus epidermidis
ASIVVLITLSACGIEKTKTFVG

SEQ ID NO: 1842535 - protein, 25 aa, Staphylococcus epidermidis
ASPYPQGQCTWYVYNRMEQYDASLD

SEQ ID NO: 1842536 - protein, 19 aa, Staphylococcus epidermidis
ATAGIATFGFMQHDADAAE

SEQ ID NO: 1842537 - protein, 23 aa, Staphylococcus epidermidis
ATEFPRIQLFMKSYTGMNNWETN

SEQ ID NO: 1842538 - protein, 35 aa, Staphylococcus epidermidis
ATPYNYTFVINNSKSYFYMDPTKANRYSLKPYYEQ

SEQ ID NO: 1842539 - protein, 26 aa, Staphylococcus epidermidis
ATQFSDIFLMALPTKAMREVASNIDE

SEQ ID NO: 1842540 - protein, 19 aa, Staphylococcus epidermidis
AVATLLLSATGVVKAADNK

SEQ ID NO: 1842541 - protein, 32 aa, Staphylococcus epidermidis
AVDMRGTFLVTKFLLPLMMDHGGSIINTASFS

SEQ ID NO: 1842542 - protein, 24 aa, Staphylococcus epidermidis
AVKNDLHFKKFIKNNHIPEEYKNP

SEQ ID NO: 1842543 - protein, 20 aa, Staphylococcus epidermidis
AVLSMLFHMQQEQGLWYVKG

SEQ ID NO: 1842544 - protein, 17 aa, Staphylococcus epidermidis
AYVWLKNGDMFNESLVK

SEQ ID NO: 1842545 - protein, 17 aa, Staphylococcus epidermidis
CTWYVFDKRAQDGHTIS

SEQ ID NO: 1842546 - protein, 18 aa, Staphylococcus epidermidis
CVKGISEALLRSEAPKLY

SEQ ID NO: 1842547 - protein, 17 aa, Staphylococcus epidermidis
DAKVVMPIYPKVPHRDY

SEQ ID NO: 1842548 - protein, 25 aa, Staphylococcus epidermidis
DDINPTVLSHYWGGDKMNIRQDLEE

SEQ ID NO: 1842549 - protein, 17 aa, Staphylococcus epidermidis
DDKGSPIVSLAHVNNFQ

SEQ ID NO: 1842550 - protein, 27 aa, Staphylococcus epidermidis
DDPRIINQFVLVNYPKFSNAPKGMKFY

SEQ ID NO: 1842551 - protein, 17 aa, Staphylococcus epidermidis
DEPVVITGAMRSSNEIG

SEQ ID NO: 1842552 - protein, 25 aa, Staphylococcus epidermidis
DETAIVKCNLWLRTADRIKIVMGRF

SEQ ID NO: 1842553 - protein, 21 aa, Staphylococcus epidermidis
DEVGKLVTFLASDDSSFITGE

SEQ ID NO: 1842554 - protein, 26 aa, Staphylococcus epidermidis
DFGKKYIIFPNPMYGSWESTIYNNNY

SEQ ID NO: 1842555 - protein, 19 aa, Staphylococcus epidermidis
DGDWGFSILDKEGNLEGSY

SEQ ID NO: 1842556 - protein, 26 aa, Staphylococcus epidermidis
DGERTLLFGPFANIGPKFLKFGSNLD

SEQ ID NO: 1842557 - protein, 17 aa, Staphylococcus epidermidis
DGITFYSGKSYNGQHDG

SEQ ID NO: 1842558 - protein, 23 aa, Staphylococcus epidermidis
DGKDVTLVYYEENDKLFVHAQEK

SEQ ID NO: 1842559 - protein, 23 aa, Staphylococcus epidermidis
DGQGTVWTHYAISRYLGGTDHTD

SEQ ID NO: 1842560 - protein, 26 aa, Staphylococcus epidermidis
DGRQKADINIKFSYLVTANVIGKAPE

SEQ ID NO: 1842561 - protein, 18 aa, Staphylococcus epidermidis
DGYWLAAYQAKEPNREKV

SEQ ID NO: 1842562 - protein, 18 aa, Staphylococcus epidermidis
DHELQYKKRYPISNHDVS

SEQ ID NO: 1842563 - protein, 17 aa, Staphylococcus epidermidis
DIKPFIKTRLISPIGKL

SEQ ID NO: 1842564 - protein, 17 aa, Staphylococcus epidermidis
DKDTLNIDIPLKTKSIA

SEQ ID NO: 1842565 - protein, 27 aa, Staphylococcus epidermidis
DKKLAKEWMKFLKSDKAKKILKEYQFS

SEQ ID NO: 1842566 - protein, 18 aa, Staphylococcus epidermidis
DKKPSIAIIYGVKNKKDK

SEQ ID NO: 1842567 - protein, 36 aa, Staphylococcus epidermidis
DKNKKEFIALQKDINNYLIPEFKKYKKSTQQLPAKT

SEQ ID NO: 1842568 - protein, 25 aa, Staphylococcus epidermidis
DKSGRTIYIYYISTKEKFISKGNID

SEQ ID NO: 1842569 - protein, 26 aa, Staphylococcus epidermidis
DKTKTKYHNVFGIGAYDSSPLIEGIK

SEQ ID NO: 1842570 - protein, 19 aa, Staphylococcus epidermidis
DLPIIIQDKTFVSKKLNYS

SEQ ID NO: 1842571 - protein, 25 aa, Staphylococcus epidermidis
DLQAQVPLAWGAHRGASIIAEQLAG

SEQ ID NO: 1842572 - protein, 20 aa, Staphylococcus epidermidis
DNDEVINGLIWSEILSKPKQ

SEQ ID NO: 1842573 - protein, 28 aa, Staphylococcus epidermidis
DNGDIQMKQLPPDIPLRIKNEEGDINLN

SEQ ID NO: 1842574 - protein, 22 aa, Staphylococcus epidermidis
DNGPALAGNYWGGDRIKLTQEL

SEQ ID NO: 1842575 - protein, 24 aa, Staphylococcus epidermidis
DNKGFTHYTLQPKVGHTYAPDKEV

SEQ ID NO: 1842576 - protein, 31 aa, Staphylococcus epidermidis
DNQMFNINAGFRKYPNLKSSLQDYADLIKHG

SEQ ID NO: 1842577 - protein, 23 aa, Staphylococcus epidermidis
DNYRTILPFKESQARGLLQDNMA

SEQ ID NO: 1842578 - protein, 21 aa, Staphylococcus epidermidis
DRAVELYYYIKGGRVDYGAAH

SEQ ID NO: 1842579 - protein, 23 aa, Staphylococcus epidermidis
DSARPMQIGLVYDALKNKKLDVA

SEQ ID NO: 1842580 - protein, 18 aa, Staphylococcus epidermidis
DSARPMQIGLVYDALKNN

SEQ ID NO: 1842581 - protein, 20 aa, Staphylococcus epidermidis
DSDEVINGIIWSEILSKPKQ

SEQ ID NO: 1842582 - protein, 19 aa, Staphylococcus epidermidis
DSLYKIALEHHLTLEELYA

SEQ ID NO: 1842583 - protein, 39 aa, Staphylococcus epidermidis
DSQSYYDTLWTKKDYDLIFYRTYSDALMPYNFMSSVFKN

SEQ ID NO: 1842584 - protein, 21 aa, Staphylococcus epidermidis
DSSPLIEGIKYAKNAGWDSVS

SEQ ID NO: 1842585 - protein, 19 aa, Staphylococcus epidermidis
DSTPFNYEIKKDAGKKFLV

SEQ ID NO: 1842586 - protein, 24 aa, Staphylococcus epidermidis
DTDKYLWDVVNWQKDGNWKVNCRN

SEQ ID NO: 1842587 - protein, 29 aa, Staphylococcus epidermidis
DTHSNKYYAQVWLTALDSYRGDSDLPFDD

SEQ ID NO: 1842588 - protein, 24 aa, Staphylococcus epidermidis
DVADAVLAYYLFSPVELDGKNHKV

SEQ ID NO: 1842589 - protein, 21 aa, Staphylococcus epidermidis
DVSMYSYLSVPRGDTGYFFNT

SEQ ID NO: 1842590 - protein, 37 aa, Staphylococcus epidermidis
DVSMYSYLTVPRGDTGYFFNTAYLPNGALNKGHYNNK

SEQ ID NO: 1842591 - protein, 22 aa, Staphylococcus epidermidis
DYAATQLQYYGLKPDSAENDGQ

SEQ ID NO: 1842592 - protein, 22 aa, Staphylococcus epidermidis
DYDQSFINIKFKGANKLSDKSE

SEQ ID NO: 1842593 - protein, 22 aa, Staphylococcus epidermidis
EAAWNAIVMPESGGNPNAVNPA

SEQ ID NO: 1842594 - protein, 22 aa, Staphylococcus epidermidis
EDGDWGFSILDKEGNLEGSYIV

SEQ ID NO: 1842595 - protein, 24 aa, Staphylococcus epidermidis
EDVVKLADFLASRKGKLLGQYGIK

SEQ ID NO: 1842596 - protein, 22 aa, Staphylococcus epidermidis
EDYLHRMGIKLTPILGWAERGG

SEQ ID NO: 1842597 - protein, 19 aa, Staphylococcus epidermidis
EEKGRVIGMPKLKGLKNKE

SEQ ID NO: 1842598 - protein, 26 aa, Staphylococcus epidermidis
EENSKKYLILSYFSKYIFGADIKNKG

SEQ ID NO: 1842599 - protein, 17 aa, Staphylococcus epidermidis
EEQFEVRAKPYPPTLVT

SEQ ID NO: 1842600 - protein, 30 aa, Staphylococcus epidermidis
EFIQGYNLFHIYPIFPIPERQRFLEQLKSI

SEQ ID NO: 1842601 - protein, 25 aa, Staphylococcus epidermidis
EGERTLLFGPFANIGPKFLRNGSNL

SEQ ID NO: 1842602 - protein, 24 aa, Staphylococcus epidermidis
EGQALQQLPNFKTALDIARKEANM

SEQ ID NO: 1842603 - protein, 19 aa, Staphylococcus epidermidis
EGVFIPVSYGRMTVVAPKD

SEQ ID NO: 1842604 - protein, 17 aa, Staphylococcus epidermidis
EIAFMKRNYNSAFVHAF

SEQ ID NO: 1842605 - protein, 26 aa, Staphylococcus epidermidis
EIPENDFFIACQFHPEFLSRPNRPQP

SEQ ID NO: 1842606 - protein, 28 aa, Staphylococcus epidermidis
EKDFGTKYIIFPNPMYGSWESTLYHNNY

SEQ ID NO: 1842607 - protein, 24 aa, Staphylococcus epidermidis
EKEGKLFLLIPKIDREILDIQNFG

SEQ ID NO: 1842608 - protein, 21 aa, Staphylococcus epidermidis
EKGYKWYDRSTFKPGSYGSTQ

SEQ ID NO: 1842609 - protein, 17 aa, Staphylococcus epidermidis
EKQIYIYNSTWGRGLDI

SEQ ID NO: 1842610 - protein, 18 aa, Staphylococcus epidermidis
EKVQKKPKLLTDAYKELL

SEQ ID NO: 1842611 - protein, 17 aa, Staphylococcus epidermidis
ELALDLTSTIRFTPSDK

SEQ ID NO: 1842612 - protein, 19 aa, Staphylococcus epidermidis
ELIKKYWPKRLGNAPQHMI

SEQ ID NO: 1842613 - protein, 17 aa, Staphylococcus epidermidis
ELKQLDAGSWFNRKHPE

SEQ ID NO: 1842614 - protein, 17 aa, Staphylococcus epidermidis
ELLPYLLDDDRVIFSEL

SEQ ID NO: 1842615 - protein, 23 aa, Staphylococcus epidermidis
ELPALPMLQMKSIGIVNDKVRNY

SEQ ID NO: 1842616 - protein, 26 aa, Staphylococcus epidermidis
ELRQALLYAIDRKKWINAFFNGYGTE

SEQ ID NO: 1842617 - protein, 17 aa, Staphylococcus epidermidis
EMKPFYKQLNMKGYFYD

SEQ ID NO: 1842618 - protein, 23 aa, Staphylococcus epidermidis
EMTPEAWKLVNEGKLQPTSDAMA

SEQ ID NO: 1842619 - protein, 21 aa, Staphylococcus epidermidis
ENAKIFTVSYGKNARILKFKN

SEQ ID NO: 1842620 - protein, 25 aa, Staphylococcus epidermidis
ENVDMPITSALYRVLFEDIPVKDSV

SEQ ID NO: 1842621 - protein, 18 aa, Staphylococcus epidermidis
EPTVDWLRTALKRKKHVI

SEQ ID NO: 1842622 - protein, 17 aa, Staphylococcus epidermidis
EQFFKDNFSLNVKATNV

SEQ ID NO: 1842623 - protein, 23 aa, Staphylococcus epidermidis
EQLPYIYDVYFGKNDKVRVPTDL

SEQ ID NO: 1842624 - protein, 19 aa, Staphylococcus epidermidis
ERKTNWKKCALGTGGSALG

SEQ ID NO: 1842625 - protein, 24 aa, Staphylococcus epidermidis
ESKHLGGFPISGQFLICTNPAVIN

SEQ ID NO: 1842626 - protein, 24 aa, Staphylococcus epidermidis
ESKNLGGFPITGQFLICTNPDTIA

SEQ ID NO: 1842627 - protein, 23 aa, Staphylococcus epidermidis
ESQHAITHLTPEQKANGAGGGGA

SEQ ID NO: 1842628 - protein, 26 aa, Staphylococcus epidermidis
ESVKLYAIVNRHTGEIITTGSAGTHA

SEQ ID NO: 1842629 - protein, 29 aa, Staphylococcus epidermidis
ETIMKTGYDYSWFILTEDIIKKEFVLSGS

SEQ ID NO: 1842630 - protein, 27 aa, Staphylococcus epidermidis
EYKNQDPIILVHGFNGYASGTGPITGK

SEQ ID NO: 1842631 - protein, 17 aa, Staphylococcus epidermidis
EYNFTSNGTNWSWSYQA

SEQ ID NO: 1842632 - protein, 20 aa, Staphylococcus epidermidis
FASLLVLGACGQNGDNSNKD

SEQ ID NO: 1842633 - protein, 17 aa, Staphylococcus epidermidis
FATQLYKSSESAFEKSQ

SEQ ID NO: 1842634 - protein, 26 aa, Staphylococcus epidermidis
FDKAYSPIVKELKPLLKLSDVPAQAV

SEQ ID NO: 1842635 - protein, 28 aa, Staphylococcus epidermidis
FDLGPSILTMPYIFEKLFNYSDKKMSDY

SEQ ID NO: 1842636 - protein, 26 aa, Staphylococcus epidermidis
FEVRAKPYPPTLVTTALQLKGKAGQK

SEQ ID NO: 1842637 - protein, 30 aa, Staphylococcus epidermidis
FFSMKKVTLSFVTVFIGVGTIGSFNQYADA

SEQ ID NO: 1842638 - protein, 19 aa, Staphylococcus epidermidis
FFVAVLALSLAACGKDGHQ

SEQ ID NO: 1842639 - protein, 18 aa, Staphylococcus epidermidis
FGGLVFDTLGFKPADKKV

SEQ ID NO: 1842640 - protein, 19 aa, Staphylococcus epidermidis
FIEPGSGYLACGYVAKGRM

SEQ ID NO: 1842641 - protein, 19 aa, Staphylococcus epidermidis
FIGQSYIKAGQNTLYKMRW

SEQ ID NO: 1842642 - protein, 20 aa, Staphylococcus epidermidis
FIIPLFAVILTACGNDDNKK

SEQ ID NO: 1842643 - protein, 24 aa, Staphylococcus epidermidis
FILILVFLLTSLGFGYHTYSKIKS

SEQ ID NO: 1842644 - protein, 21 aa, Staphylococcus epidermidis
FLKDRYEAMKNFPMFDNIEYT

SEQ ID NO: 1842645 - protein, 18 aa, Staphylococcus epidermidis
FLLDLMLNNKSGDTLIKD

SEQ ID NO: 1842646 - protein, 19 aa, Staphylococcus epidermidis
FMKWFNHDPAFDYFNNMDS

SEQ ID NO: 1842647 - protein, 29 aa, Staphylococcus epidermidis
FMVGDGMGPSFNTAYRYYKNQPGAKKMNP

SEQ ID NO: 1842648 - protein, 18 aa, Staphylococcus epidermidis
FNIVLNKILVDKYKDKVN

SEQ ID NO: 1842649 - protein, 18 aa, Staphylococcus epidermidis
FNQQYYGVPIAYPNETFV

SEQ ID NO: 1842650 - protein, 18 aa, Staphylococcus epidermidis
FSEQESEAFDLCIGADGL

SEQ ID NO: 1842651 - protein, 20 aa, Staphylococcus epidermidis
FSSALILGACGNNGTSNNDS

SEQ ID NO: 1842652 - protein, 23 aa, Staphylococcus epidermidis
FTLLFTLAFTSMNFFNSANAEEN

SEQ ID NO: 1842653 - protein, 17 aa, Staphylococcus epidermidis
FTSLTALSIGLASVSAP

SEQ ID NO: 1842654 - protein, 27 aa, Staphylococcus epidermidis
FVDNGYQYNFTSNGSEWSWSYAVAGSD

SEQ ID NO: 1842655 - protein, 18 aa, Staphylococcus epidermidis
FVLNQQFITSLKYDNFTM

SEQ ID NO: 1842656 - protein, 18 aa, Staphylococcus epidermidis
FVVTVILTIAALIDEFMI

SEQ ID NO: 1842657 - protein, 18 aa, Staphylococcus epidermidis
FYANYNGGGERKSIHTYQ

SEQ ID NO: 1842658 - protein, 19 aa, Staphylococcus epidermidis
GAITITTLLAGCDFGDLVG

SEQ ID NO: 1842659 - protein, 21 aa, Staphylococcus epidermidis
GAITVTTLLEGCDFGDLVGQH

SEQ ID NO: 1842660 - protein, 24 aa, Staphylococcus epidermidis
GDGDGRTFIPLSGANDIVAHEITH

SEQ ID NO: 1842661 - protein, 26 aa, Staphylococcus epidermidis
GDIDMNAFQHFAFLDQYKKAHKDAKI

SEQ ID NO: 1842662 - protein, 20 aa, Staphylococcus epidermidis
GDSLYKIALEHNLSLEELYA

SEQ ID NO: 1842663 - protein, 28 aa, Staphylococcus epidermidis
GEKLGADPMTFLGLGGIGDLIVTCTSTH

SEQ ID NO: 1842664 - protein, 19 aa, Staphylococcus epidermidis
GEQFFKDNFSLNVKATNVV

SEQ ID NO: 1842665 - protein, 24 aa, Staphylococcus epidermidis
GERTLLFGPFANVGPKFLKNGSNL

SEQ ID NO: 1842666 - protein, 24 aa, Staphylococcus epidermidis
GERTLLFGPFASVGPKFLKNGSNL

SEQ ID NO: 1842667 - protein, 22 aa, Staphylococcus epidermidis
GESALNYRLTAATFFIKMNQKT

SEQ ID NO: 1842668 - protein, 20 aa, Staphylococcus epidermidis
GFFNGGLQGNKSNGGGIVNL

SEQ ID NO: 1842669 - protein, 21 aa, Staphylococcus epidermidis
GFITIAILATTVLLNISQASE

SEQ ID NO: 1842670 - protein, 19 aa, Staphylococcus epidermidis
GGCFWCMVKPFSSYPGIKS

SEQ ID NO: 1842671 - protein, 29 aa, Staphylococcus epidermidis
GGEQQLKKIAYLKATFKNSSKITKDTNDV

SEQ ID NO: 1842672 - protein, 18 aa, Staphylococcus epidermidis
GGFDLFEKGVIFSNGLNG

SEQ ID NO: 1842673 - protein, 19 aa, Staphylococcus epidermidis
GGQAYWSFGGLFLVNSKVQ

SEQ ID NO: 1842674 - protein, 22 aa, Staphylococcus epidermidis
GGQRKSIHTYKLEALPKKVEGA

SEQ ID NO: 1842675 - protein, 26 aa, Staphylococcus epidermidis
GGTKALDLELGFSQWGFKQKPNESYA

SEQ ID NO: 1842676 - protein, 31 aa, Staphylococcus epidermidis
GHVIKVKAETFWYNDPYTLDFMRKDLKKKLM

SEQ ID NO: 1842677 - protein, 18 aa, Staphylococcus epidermidis
GISIAKLKSLNGLKSNLI

SEQ ID NO: 1842678 - protein, 20 aa, Staphylococcus epidermidis
GIYTVKPGDSLYKIALEHHL

SEQ ID NO: 1842679 - protein, 22 aa, Staphylococcus epidermidis
GKAQNKVQYPQGAANKNPQQSN

SEQ ID NO: 1842680 - protein, 20 aa, Staphylococcus epidermidis
GKPFVINLKHYAGSNPTFEP

SEQ ID NO: 1842681 - protein, 24 aa, Staphylococcus epidermidis
GKSISTYWSDAKFWADNAANDGYQ

SEQ ID NO: 1842682 - protein, 24 aa, Staphylococcus epidermidis
GKVKGVMFFKLKDTKTPVTLEAKD

SEQ ID NO: 1842683 - protein, 17 aa, Staphylococcus epidermidis
GLGVGAAAGFAVALRNR

SEQ ID NO: 1842684 - protein, 19 aa, Staphylococcus epidermidis
GLGVISYRTIDAADASDLD

SEQ ID NO: 1842685 - protein, 17 aa, Staphylococcus epidermidis
GLGVVAGNAGHDAHASE

SEQ ID NO: 1842686 - protein, 17 aa, Staphylococcus epidermidis
GLGYVGLPVAVTFGKKH

SEQ ID NO: 1842687 - protein, 18 aa, Staphylococcus epidermidis
GLLDFRRFGGTLYHRTAF

SEQ ID NO: 1842688 - protein, 23 aa, Staphylococcus epidermidis
GLQQCLKNKIPLVLVSRSFNGIV

SEQ ID NO: 1842689 - protein, 32 aa, Staphylococcus epidermidis
GLVLIMFVLCGFIFPLTVTALGQVLFPEQANG

SEQ ID NO: 1842690 - protein, 25 aa, Staphylococcus epidermidis
GMITTSILLSCGITKNVQAATNQPD

SEQ ID NO: 1842691 - protein, 17 aa, Staphylococcus epidermidis
GNANNWANAAARSGYTV

SEQ ID NO: 1842692 - protein, 26 aa, Staphylococcus epidermidis
GNFQSIIGINNQLLFIGGTQGGIENF

SEQ ID NO: 1842693 - protein, 30 aa, Staphylococcus epidermidis
GNHEFDFGYNQLLKLQSKVKFPMLSSNIYK

SEQ ID NO: 1842694 - protein, 39 aa, Staphylococcus epidermidis
GNLYTSGQCTYYVFDRVGGKICSTWGNANNWANAAAAAG

SEQ ID NO: 1842695 - protein, 22 aa, Staphylococcus epidermidis
GNPDIYKPTWKDEALTYKDATS

SEQ ID NO: 1842696 - protein, 20 aa, Staphylococcus epidermidis
GQRKSIHTYKLESLPKKVEG

SEQ ID NO: 1842697 - protein, 20 aa, Staphylococcus epidermidis
GQRQMELIKILFQKAQNLKS

SEQ ID NO: 1842698 - protein, 23 aa, Staphylococcus epidermidis
GQRQMELIKILFQKAQNLNSIDK

SEQ ID NO: 1842699 - protein, 26 aa, Staphylococcus epidermidis
GRKNSRVDFGLAQWGLKQKPNESYID

SEQ ID NO: 1842700 - protein, 29 aa, Staphylococcus epidermidis
GRSYPLELIQLDQLLVNILQPYEQHIKQE

SEQ ID NO: 1842701 - protein, 24 aa, Staphylococcus epidermidis
GRTDMGARPYAGIAPRGMTSKQYS

SEQ ID NO: 1842702 - protein, 32 aa, Staphylococcus epidermidis
GRVGIVPLINNQAYWFITVPAKEKDPKYQTFG

SEQ ID NO: 1842703 - protein, 21 aa, Staphylococcus epidermidis
GSMYHFDIPMYRFSQIPQSEV

SEQ ID NO: 1842704 - protein, 18 aa, Staphylococcus epidermidis
GSWGFSFTDKEGHLEGSY

SEQ ID NO: 1842705 - protein, 23 aa, Staphylococcus epidermidis
GTKSDHRYWSKKHPRAYVDFYKS

SEQ ID NO: 1842706 - protein, 20 aa, Staphylococcus epidermidis
GTLRLGLYPCHIKEGTLAES

SEQ ID NO: 1842707 - protein, 28 aa, Staphylococcus epidermidis
GTSPYPHGQCTWYVYHRMNQFDSSISGD

SEQ ID NO: 1842708 - protein, 19 aa, Staphylococcus epidermidis
GVDIPLSAEIWFDGETTPI

SEQ ID NO: 1842709 - protein, 25 aa, Staphylococcus epidermidis
GVLLSISICILMILLTGCGKSSDGL

SEQ ID NO: 1842710 - protein, 17 aa, Staphylococcus epidermidis
GYLAHRYGFKQEGIQNM

SEQ ID NO: 1842711 - protein, 26 aa, Staphylococcus epidermidis
GYLGSNIVKFFDYTLASVGVKPIELD

SEQ ID NO: 1842712 - protein, 28 aa, Staphylococcus epidermidis
HASNKGAPYYLPTTPYNLLHASDVRNIA

SEQ ID NO: 1842713 - protein, 20 aa, Staphylococcus epidermidis
HCLDKGIPIVLVSRSFNGIV

SEQ ID NO: 1842714 - protein, 30 aa, Staphylococcus epidermidis
HFKGYLGNNIVKFFDYTLASVGIKPNELTN

SEQ ID NO: 1842715 - protein, 23 aa, Staphylococcus epidermidis
HGEYDPHIWLEPKMDQTFAKEIK

SEQ ID NO: 1842716 - protein, 25 aa, Staphylococcus epidermidis
HGLDTLPEILKYHGPLKALHGFDYF

SEQ ID NO: 1842717 - protein, 26 aa, Staphylococcus epidermidis
HGNSVPRFHITWGTGPGLVEPFTNYV

SEQ ID NO: 1842718 - protein, 20 aa, Staphylococcus epidermidis
HHGKYDPHIWLDPVVSQKFA

SEQ ID NO: 1842719 - protein, 22 aa, Staphylococcus epidermidis
HHYPRVMSVKKWIKSYPKTKVT

SEQ ID NO: 1842720 - protein, 23 aa, Staphylococcus epidermidis
HIDANYFVYWMNASAQAKSQLNQ

SEQ ID NO: 1842721 - protein, 21 aa, Staphylococcus epidermidis
HIDGKVDVYIVLSHLGIDKNT

SEQ ID NO: 1842722 - protein, 25 aa, Staphylococcus epidermidis
HISYFQVVLTTQAKYPIGTHFKISL

SEQ ID NO: 1842723 - protein, 23 aa, Staphylococcus epidermidis
HITAPSEYYVWGAGAKANPYFYQ

SEQ ID NO: 1842724 - protein, 17 aa, Staphylococcus epidermidis
HLKYLQAKRTYLMDQFL

SEQ ID NO: 1842725 - protein, 30 aa, Staphylococcus epidermidis
HNYSYAELYDLIYEKYLIKTGQVAPWGTTS

SEQ ID NO: 1842726 - protein, 22 aa, Staphylococcus epidermidis
HQSNFILDKNFKTSLKADNFKI

SEQ ID NO: 1842727 - protein, 28 aa, Staphylococcus epidermidis
HRYISNPRLREILGYFIKYVGSSSYDAP

SEQ ID NO: 1842728 - protein, 17 aa, Staphylococcus epidermidis
HSQYPYQTPIVGKGTEG

SEQ ID NO: 1842729 - protein, 23 aa, Staphylococcus epidermidis
HVSNHITITVPKYIKNIDIKTND

SEQ ID NO: 1842730 - protein, 17 aa, Staphylococcus epidermidis
HVYEHILSDGNKKPYIV

SEQ ID NO: 1842731 - protein, 18 aa, Staphylococcus epidermidis
IADKYNTTIYAPQKTFKP

SEQ ID NO: 1842732 - protein, 17 aa, Staphylococcus epidermidis
IADMWHYDQRQKHAKIV

SEQ ID NO: 1842733 - protein, 19 aa, Staphylococcus epidermidis
IAFLIILAACGNQSNHEHH

SEQ ID NO: 1842734 - protein, 18 aa, Staphylococcus epidermidis
IALILVLAACGNNSDSGS

SEQ ID NO: 1842735 - protein, 18 aa, Staphylococcus epidermidis
IALVFVLAACGNNDSSSN

SEQ ID NO: 1842736 - protein, 23 aa, Staphylococcus epidermidis
IANKYGNTIYAPQKTYKPKSTQT

SEQ ID NO: 1842737 - protein, 18 aa, Staphylococcus epidermidis
IASTLAFGTLLGIGATST

SEQ ID NO: 1842738 - protein, 34 aa, Staphylococcus epidermidis
IDKKAYNITLEFYNTYVYKKGMPKFEEATSDMPA

SEQ ID NO: 1842739 - protein, 27 aa, Staphylococcus epidermidis
IDNPREFINPLPHISFVRGKNNVQFLK

SEQ ID NO: 1842740 - protein, 27 aa, Staphylococcus epidermidis
IDQLIKDNFLPYFKEFEKKGIEVFFSE

SEQ ID NO: 1842741 - protein, 17 aa, Staphylococcus epidermidis
IDQLSLMSTFPNFKEKE

SEQ ID NO: 1842742 - protein, 27 aa, Staphylococcus epidermidis
IEATEDGFRYVFSFKDSSKKDNYSIVT

SEQ ID NO: 1842743 - protein, 18 aa, Staphylococcus epidermidis
IEFKIKKGIKWHDGNELT

SEQ ID NO: 1842744 - protein, 28 aa, Staphylococcus epidermidis
IENPREFINPLPHISFVRGKNNVKFLKD

SEQ ID NO: 1842745 - protein, 20 aa, Staphylococcus epidermidis
IENVLTSRKLSRHIEDKFAN

SEQ ID NO: 1842746 - protein, 25 aa, Staphylococcus epidermidis
IEPNHPFQVKIKLKGYPSNSTVDDL

SEQ ID NO: 1842747 - protein, 19 aa, Staphylococcus epidermidis
IEPTVDWLITALKNKKHVI

SEQ ID NO: 1842748 - protein, 24 aa, Staphylococcus epidermidis
IFQSIIEYLKENLNWIWNSLSVKD

SEQ ID NO: 1842749 - protein, 18 aa, Staphylococcus epidermidis
IGANIELIKKYWPKRLGN

SEQ ID NO: 1842750 - protein, 31 aa, Staphylococcus epidermidis
IGKQRSEQIYYRALTVYLTSNSDFQDAKAAL

SEQ ID NO: 1842751 - protein, 18 aa, Staphylococcus epidermidis
IHLYKISGYRSYPTQVKL

SEQ ID NO: 1842752 - protein, 23 aa, Staphylococcus epidermidis
IIFFLAFLFVSGLALATDLDTEA

SEQ ID NO: 1842753 - protein, 17 aa, Staphylococcus epidermidis
IIHLLDRMGVMFSRTNE

SEQ ID NO: 1842754 - protein, 21 aa, Staphylococcus epidermidis
IIIIILIMAMVLNQKFMKDRI

SEQ ID NO: 1842755 - protein, 19 aa, Staphylococcus epidermidis
IIILLVGLGIVPNVNDAFA

SEQ ID NO: 1842756 - protein, 19 aa, Staphylococcus epidermidis
IISIIVTAISAIRDKSHED

SEQ ID NO: 1842757 - protein, 29 aa, Staphylococcus epidermidis
IISNMEVIPTYKYLLHFSQQKIDQLEKTY

SEQ ID NO: 1842758 - protein, 20 aa, Staphylococcus epidermidis
IKAAIFFGGFYDMKTVKATE

SEQ ID NO: 1842759 - protein, 17 aa, Staphylococcus epidermidis
IKEKYKSHDAYAKAYKK

SEQ ID NO: 1842760 - protein, 31 aa, Staphylococcus epidermidis
IKNGSYALSRPLFIYVKDKSLKDNKVMSEFM

SEQ ID NO: 1842761 - protein, 17 aa, Staphylococcus epidermidis
ILFATQLYKSSESAFEK

SEQ ID NO: 1842762 - protein, 24 aa, Staphylococcus epidermidis
ILIALSLLVLSGCSLPGLGDGNAK

SEQ ID NO: 1842763 - protein, 20 aa, Staphylococcus epidermidis
ILIGAIIGGAATLADKSTRN

SEQ ID NO: 1842764 - protein, 31 aa, Staphylococcus epidermidis
ILILIIVLFFLLRNYNPPNAQAKILVNAVDN

SEQ ID NO: 1842765 - protein, 21 aa, Staphylococcus epidermidis
ILLGIILGVVVGYVVARNLLH

SEQ ID NO: 1842766 - protein, 17 aa, Staphylococcus epidermidis
ILLITLSLIGHSYIIFR

SEQ ID NO: 1842767 - protein, 17 aa, Staphylococcus epidermidis
ILNTYLNGLKKNYGPGS

SEQ ID NO: 1842768 - protein, 18 aa, Staphylococcus epidermidis
ILSLIIIGLIKTFNEYDV

SEQ ID NO: 1842769 - protein, 19 aa, Staphylococcus epidermidis
ILSLIIIGLIKTFNEYDVI

SEQ ID NO: 1842770 - protein, 19 aa, Staphylococcus epidermidis
IMAVSWYQNSAEAKALYLQ

SEQ ID NO: 1842771 - protein, 23 aa, Staphylococcus epidermidis
IMGIPTDIKPFIKTKLISPLGKL

SEQ ID NO: 1842772 - protein, 27 aa, Staphylococcus epidermidis
IMGVVYKTHLFLTPYGAKQYIERTGST

SEQ ID NO: 1842773 - protein, 27 aa, Staphylococcus epidermidis
IMSLNGLSNFFIYPGQQLKVPGGGSGS

SEQ ID NO: 1842774 - protein, 24 aa, Staphylococcus epidermidis
INGKHKVDVMLGGGAKYFGKENKN

SEQ ID NO: 1842775 - protein, 28 aa, Staphylococcus epidermidis
IPKDTSYDIVFLFPKSMQLEEVLSHIQP

SEQ ID NO: 1842776 - protein, 28 aa, Staphylococcus epidermidis
IPQSEVYDIVFLFPKSMQLKHVLEDIQP

SEQ ID NO: 1842777 - protein, 20 aa, Staphylococcus epidermidis
IQEPIVITGAMRSSNEIGSD

SEQ ID NO: 1842778 - protein, 26 aa, Staphylococcus epidermidis
IQNNPDKYQHIGGGPGMALSSPNQSY

SEQ ID NO: 1842779 - protein, 18 aa, Staphylococcus epidermidis
IQPLIFPGDKIVVSENAA

SEQ ID NO: 1842780 - protein, 18 aa, Staphylococcus epidermidis
IRKHPIGIGPYKVKKIVQ

SEQ ID NO: 1842781 - protein, 18 aa, Staphylococcus epidermidis
ISAIKYARENNVPFFGIC

SEQ ID NO: 1842782 - protein, 19 aa, Staphylococcus epidermidis
ISALMILIMTNATPISHLN

SEQ ID NO: 1842783 - protein, 18 aa, Staphylococcus epidermidis
ISKQFWGHLVKSGNIDNP

SEQ ID NO: 1842784 - protein, 20 aa, Staphylococcus epidermidis
ISKYAGDYIFLSKPSYGKFD

SEQ ID NO: 1842785 - protein, 22 aa, Staphylococcus epidermidis
ISLIMMLVMTNVTPIFHHNAKA

SEQ ID NO: 1842786 - protein, 18 aa, Staphylococcus epidermidis
ISLMIVITTASIDMLSTE

SEQ ID NO: 1842787 - protein, 22 aa, Staphylococcus epidermidis
ISLSSMFLFSACGQNSNETSHN

SEQ ID NO: 1842788 - protein, 20 aa, Staphylococcus epidermidis
ISSITLLSGLTLTTNTYAAN

SEQ ID NO: 1842789 - protein, 19 aa, Staphylococcus epidermidis
ISTIIVSTLLIGGCSTVHK

SEQ ID NO: 1842790 - protein, 27 aa, Staphylococcus epidermidis
ITGYQYEPWHLRYLGKKKATKVYKSGE

SEQ ID NO: 1842791 - protein, 29 aa, Staphylococcus epidermidis
ITIMLAFTLSLALGLFFNSAHADSLPQKD

SEQ ID NO: 1842792 - protein, 28 aa, Staphylococcus epidermidis
IVAIAVALALIFAIKTFVAKPYTIKGDS

SEQ ID NO: 1842793 - protein, 17 aa, Staphylococcus epidermidis
IVAILVLAACGGNNGKK

SEQ ID NO: 1842794 - protein, 24 aa, Staphylococcus epidermidis
IVETAPTDYLSWGAGPQGNERFIN

SEQ ID NO: 1842795 - protein, 20 aa, Staphylococcus epidermidis
IVGVHAFRVDSGEYKTYHLN

SEQ ID NO: 1842796 - protein, 19 aa, Staphylococcus epidermidis
IVIAILISSAMIYINPIAS

SEQ ID NO: 1842797 - protein, 18 aa, Staphylococcus epidermidis
IVLTSSVLLAGCTVDKKE

SEQ ID NO: 1842798 - protein, 18 aa, Staphylococcus epidermidis
IVLTSTVLLAGCTTDKKE

SEQ ID NO: 1842799 - protein, 17 aa, Staphylococcus epidermidis
IVVSYKLFKDKDQLFYA

SEQ ID NO: 1842800 - protein, 18 aa, Staphylococcus epidermidis
IYFTLISTILLFGCSTMS

SEQ ID NO: 1842801 - protein, 25 aa, Staphylococcus epidermidis
IYISLLFLIILVIGCGDGKEAEIKQ

SEQ ID NO: 1842802 - protein, 23 aa, Staphylococcus epidermidis
KAGQNTLYKMRWNPSNPGTHQYA

SEQ ID NO: 1842803 - protein, 19 aa, Staphylococcus epidermidis
KAHDTYNYAKNKLVLVGDK

SEQ ID NO: 1842804 - protein, 24 aa, Staphylococcus epidermidis
KALTDADVIFYNGLNLETGNGWFE

SEQ ID NO: 1842805 - protein, 22 aa, Staphylococcus epidermidis
KAMGFENKVPFLTQSKLEEQGA

SEQ ID NO: 1842806 - protein, 28 aa, Staphylococcus epidermidis
KASGTKWNFLNFKPGLVGGHCIGVDPYY

SEQ ID NO: 1842807 - protein, 24 aa, Staphylococcus epidermidis
KCIVTTIFVLSSLLLVFSSITYAK

SEQ ID NO: 1842808 - protein, 17 aa, Staphylococcus epidermidis
KCNSYQVPLRVFGTRNE

SEQ ID NO: 1842809 - protein, 30 aa, Staphylococcus epidermidis
KDGSIFISEMNWIAPYIVSTRTISASEVDS

SEQ ID NO: 1842810 - protein, 24 aa, Staphylococcus epidermidis
KDIVIKHILVRDTTKKRPLNISQY

SEQ ID NO: 1842811 - protein, 28 aa, Staphylococcus epidermidis
KDLYDVVPKHQKWYIAINSKGNAYVHYK

SEQ ID NO: 1842812 - protein, 24 aa, Staphylococcus epidermidis
KDNEDILDYTKLFEKNRSQVESDI

SEQ ID NO: 1842813 - protein, 17 aa, Staphylococcus epidermidis
KDNGKIIKNHKWMTGNE

SEQ ID NO: 1842814 - protein, 18 aa, Staphylococcus epidermidis
KDNGKIIKNHKWMTGNEL

SEQ ID NO: 1842815 - protein, 24 aa, Staphylococcus epidermidis
KDPTQRIINYFNALNSTIANVDED

SEQ ID NO: 1842816 - protein, 24 aa, Staphylococcus epidermidis
KDTKLPVIFWMHGGGFIAGDKQYK

SEQ ID NO: 1842817 - protein, 40 aa, Staphylococcus epidermidis; identical to SEQ ID NO: 1749962

SEQ ID NO: 1842818 - protein, 19 aa, Staphylococcus epidermidis
KEKQLFSYLNEDNATQSEV

SEQ ID NO: 1842819 - protein, 28 aa, Staphylococcus epidermidis
KEPSIPHNFTFHLLFSNNKLKINDPNIN

SEQ ID NO: 1842820 - protein, 19 aa, Staphylococcus epidermidis
KEPWSQPEKGYKWYDRSTF

SEQ ID NO: 1842821 - protein, 24 aa, Staphylococcus epidermidis
KESILSVILPQYVESLIYGTILDA

SEQ ID NO: 1842822 - protein, 18 aa, Staphylococcus epidermidis
KEWLEHYNDTIKKGKKAK

SEQ ID NO: 1842823 - protein, 29 aa, Staphylococcus epidermidis
KEWREYDYLFLTFGTFSYHDPYHLKGKKG

SEQ ID NO: 1842824 - protein, 20 aa, Staphylococcus epidermidis
KFSIRKYAIGTFSTVIATLV

SEQ ID NO: 1842825 - protein, 17 aa, Staphylococcus epidermidis
KGKPDTWIADRKLKGLV

SEQ ID NO: 1842826 - protein, 18 aa, Staphylococcus epidermidis
KGKPDTWIADRKLKGLVF

SEQ ID NO: 1842827 - protein, 28 aa, Staphylococcus epidermidis
KGKVTKYDIISVLPFGNLISQIKVKGSD

SEQ ID NO: 1842828 - protein, 20 aa, Staphylococcus epidermidis
KGQFKQFRHGLSSFIEALAK

SEQ ID NO: 1842829 - protein, 21 aa, Staphylococcus epidermidis
KGQSEPIVLVIFTNKDNKSDK

SEQ ID NO: 1842830 - protein, 18 aa, Staphylococcus epidermidis
KHGMITTIDMDELYDELQ

SEQ ID NO: 1842831 - protein, 21 aa, Staphylococcus epidermidis
KHLFENAYYILVFNEKDNKAS

SEQ ID NO: 1842832 - protein, 31 aa, Staphylococcus epidermidis
KHQFIPGYNLFHIYPLFPIPERQRFLEQLKK

SEQ ID NO: 1842833 - protein, 19 aa, Staphylococcus epidermidis
KILFITSFAMILAIVSNHN

SEQ ID NO: 1842834 - protein, 28 aa, Staphylococcus epidermidis
KIMQLNGLNNYLILPGQKLKVSGSVSNS

SEQ ID NO: 1842835 - protein, 31 aa, Staphylococcus epidermidis
KISLHFGQTKTYRTWWFFEKTKKDENNIHFN

SEQ ID NO: 1842836 - protein, 32 aa, Staphylococcus epidermidis
KKDANIYVFNKGKYVILAYKPLSDDAEVHYYT

SEQ ID NO: 1842837 - protein, 17 aa, Staphylococcus epidermidis
KKDGIISNKEFNTKMGY

SEQ ID NO: 1842838 - protein, 20 aa, Staphylococcus epidermidis
KKDIKLYLDSDRKLTDALEP

SEQ ID NO: 1842839 - protein, 24 aa, Staphylococcus epidermidis
KKENKLHYFYYNIKDGKAKFDEEA

SEQ ID NO: 1842840 - protein, 17 aa, Staphylococcus epidermidis
KKFNAYSKAMRKVTQEK

SEQ ID NO: 1842841 - protein, 17 aa, Staphylococcus epidermidis
KKGVWQVMPVKHGWDHG

SEQ ID NO: 1842842 - protein, 24 aa, Staphylococcus epidermidis
KKHPKVLILMGIPGSYLVATDQSY

SEQ ID NO: 1842843 - protein, 25 aa, Staphylococcus epidermidis
KKIAKEWINFLKSNKAKQILKEYQF

SEQ ID NO: 1842844 - protein, 23 aa, Staphylococcus epidermidis
KKIPYQFHAKKIYKIPSYDMVVV

SEQ ID NO: 1842845 - protein, 29 aa, Staphylococcus epidermidis
KKLKWIWITTLIILVVALILAFNLKSHYN

SEQ ID NO: 1842846 - protein, 18 aa, Staphylococcus epidermidis
KKNKNFLLDLMFNNKNGD

SEQ ID NO: 1842847 - protein, 24 aa, Staphylococcus epidermidis
KKNKNFLLDLMFNNKTGDTLIKDG

SEQ ID NO: 1842848 - protein, 25 aa, Staphylococcus epidermidis
KKQSKPYETSLPPLNKDWNEKEKKK

SEQ ID NO: 1842849 - protein, 23 aa, Staphylococcus epidermidis
KKVMYLLVNEGELSTYGPGGRFG

SEQ ID NO: 1842850 - protein, 24 aa, Staphylococcus epidermidis
KKYGINEIYLVAHALVETGNGTSQ

SEQ ID NO: 1842851 - protein, 23 aa, Staphylococcus epidermidis
KKYKFSDPYTYSSAVLVVRDNEK

SEQ ID NO: 1842852 - protein, 26 aa, Staphylococcus epidermidis
KLELSKFKDYWQGKPKLKKINVTYHE

SEQ ID NO: 1842853 - protein, 25 aa, Staphylococcus epidermidis
KLILLIGIILLSGISLYGCGKNDGD

SEQ ID NO: 1842854 - protein, 29 aa, Staphylococcus epidermidis
KLIVVLCAMIIFIALIGLSIRSQTQSPPE

SEQ ID NO: 1842855 - protein, 21 aa, Staphylococcus epidermidis
KLPMYRLTEIPKDTSYDIVFL

SEQ ID NO: 1842856 - protein, 18 aa, Staphylococcus epidermidis
KLSAYQKQLLLDKVNVSD

SEQ ID NO: 1842857 - protein, 17 aa, Staphylococcus epidermidis
KLSHVDVGLSQWGLKQR

SEQ ID NO: 1842858 - protein, 30 aa, Staphylococcus epidermidis
KLVVVLCAIIVFIALIGLSIRSQTQSPPEQ

SEQ ID NO: 1842859 - protein, 20 aa, Staphylococcus epidermidis
KMLNLIDVYEKYKSNAELSI

SEQ ID NO: 1842860 - protein, 22 aa, Staphylococcus epidermidis
KNAIEMYYSLQNYYDTRVDTIE

SEQ ID NO: 1842861 - protein, 23 aa, Staphylococcus epidermidis
KNARYSLKPYYDKTFVVSKQKNI

SEQ ID NO: 1842862 - protein, 31 aa, Staphylococcus epidermidis
KNDTLVLDQAVLYIKDAFVIKDKESENKEIA

SEQ ID NO: 1842863 - protein, 17 aa, Staphylococcus epidermidis
KNNIYPIARIVTFKDTK

SEQ ID NO: 1842864 - protein, 20 aa, Staphylococcus epidermidis
KPMAKNELLPYLLDDDRVIF

SEQ ID NO: 1842865 - protein, 24 aa, Staphylococcus epidermidis
KPNESYIQYVKRVQNSKLWKSEDS

SEQ ID NO: 1842866 - protein, 23 aa, Staphylococcus epidermidis
KQDPHAWLSLDNGIKYVKTIQKS

SEQ ID NO: 1842867 - protein, 32 aa, Staphylococcus epidermidis
KQKNINGVTWYYGKLTNGKYVWIKSTDVAKES

SEQ ID NO: 1842868 - protein, 19 aa, Staphylococcus epidermidis
KQLKKLDAGSWFNKAHPEY

SEQ ID NO: 1842869 - protein, 23 aa, Staphylococcus epidermidis
KQLVKHHFVVKIAPSYLGGDLKE

SEQ ID NO: 1842870 - protein, 18 aa, Staphylococcus epidermidis
KQPIIVLDGHSHTAIKHG

SEQ ID NO: 1842871 - protein, 17 aa, Staphylococcus epidermidis
KQYEYKKVLSKGEHKID

SEQ ID NO: 1842872 - protein, 33 aa, Staphylococcus epidermidis
KRKNTLYTAIVLLVALVLLIFAVNSIKVEPVKS

SEQ ID NO: 1842873 - protein, 19 aa, Staphylococcus epidermidis
KRRKLFNGYIECTYYQYWG

SEQ ID NO: 1842874 - protein, 17 aa, Staphylococcus epidermidis
KRVVVLEYSFVDALAAL

SEQ ID NO: 1842875 - protein, 32 aa, Staphylococcus epidermidis
KSDKYDQSFSLTTLIQNLFNFDSDISNYEQPD

SEQ ID NO: 1842876 - protein, 24 aa, Staphylococcus epidermidis
KSGWISKYYLTTPSKVQTLSTQST

SEQ ID NO: 1842877 - protein, 27 aa, Staphylococcus epidermidis
KSINNSWPNGMYFDWAQGSSAPTSNTP

SEQ ID NO: 1842878 - protein, 26 aa, Staphylococcus epidermidis
KSLYVGKDLYLYGTVNNRTGWIAAKD

SEQ ID NO: 1842879 - protein, 25 aa, Staphylococcus epidermidis
KSNNNEIFIETPFGGINESVKLYAI

SEQ ID NO: 1842880 - protein, 29 aa, Staphylococcus epidermidis
KSSDWLSDNFGVRFRYNALGDLNTKNIVS

SEQ ID NO: 1842881 - protein, 24 aa, Staphylococcus epidermidis
KTFKGNLTILMTPARSIVKENFKE

SEQ ID NO: 1842882 - protein, 34 aa, Staphylococcus epidermidis
KTYAGAYKDWKPGQKIHLIGHSMGGQTIRYLEEL

SEQ ID NO: 1842883 - protein, 25 aa, Staphylococcus epidermidis
KTYEGVYKDWKPGQKVHLVGHSMGG

SEQ ID NO: 1842884 - protein, 20 aa, Staphylococcus epidermidis
KVDVMLGGGSKYFGKENGHL

SEQ ID NO: 1842885 - protein, 24 aa, Staphylococcus epidermidis
KVGDAQFLLPKDIEPNHPFQVKIK

SEQ ID NO: 1842886 - protein, 19 aa, Staphylococcus epidermidis
KVKQFKFSGLTDAPIDYKA

SEQ ID NO: 1842887 - protein, 18 aa, Staphylococcus epidermidis
KVPYNPHRVAVLDYGALD

SEQ ID NO: 1842888 - protein, 27 aa, Staphylococcus epidermidis
KVRKHHKLVMLFGDNLLDFADPKQPTA

SEQ ID NO: 1842889 - protein, 18 aa, Staphylococcus epidermidis
KVTVHFSEQESEAFDLCI

SEQ ID NO: 1842890 - protein, 23 aa, Staphylococcus epidermidis
KYDEKFYHSLGFANTYAFMVTKE

SEQ ID NO: 1842891 - protein, 17 aa, Staphylococcus epidermidis
KYHNVFGIGAFDNNALV

SEQ ID NO: 1842892 - protein, 17 aa, Staphylococcus epidermidis
KYNEVTIYCEKAHVIFG

SEQ ID NO: 1842893 - protein, 17 aa, Staphylococcus epidermidis
LADYVFIGAGGGAIPLL

SEQ ID NO: 1842894 - protein, 26 aa, Staphylococcus epidermidis
LAEAKPLLKKLKKNNIYPIARIVTFK

SEQ ID NO: 1842895 - protein, 19 aa, Staphylococcus epidermidis
LAFIMILAACGNQHNEHSS

SEQ ID NO: 1842896 - protein, 25 aa, Staphylococcus epidermidis
LAGNKKILYYSYENFMINHVANAVS

SEQ ID NO: 1842897 - protein, 21 aa, Staphylococcus epidermidis
LASSLILGFSVTPELFNVTQA

SEQ ID NO: 1842898 - protein, 20 aa, Staphylococcus epidermidis
LASTLMLTACGKSNEKASLE

SEQ ID NO: 1842899 - protein, 26 aa, Staphylococcus epidermidis
LCISFLLITFFIGGCGFINKDDSKEK

SEQ ID NO: 1842900 - protein, 17 aa, Staphylococcus epidermidis
LCSLFILTACSASVDKT

SEQ ID NO: 1842901 - protein, 47 aa, Staphylococcus epidermidis
LDAQTYYDTLWTKKDYDLIFYRTYSDALMPYNFMNSVFKNAGGKPGV

SEQ ID NO: 1842902 - protein, 30 aa, Staphylococcus epidermidis
LDHGITLDQLYALNPGIQPLIFPGDKIVVS

SEQ ID NO: 1842903 - protein, 20 aa, Staphylococcus epidermidis
LDHRVIKHYGSLVPLTELDD

SEQ ID NO: 1842904 - protein, 18 aa, Staphylococcus epidermidis
LDKLDLPIVGKPTSYKKL

SEQ ID NO: 1842905 - protein, 26 aa, Staphylococcus epidermidis
LDKNKKGFFLMVEGASIDKAAHPNDV

SEQ ID NO: 1842906 - protein, 17 aa, Staphylococcus epidermidis
LDLFKSIKPYNITTLLS

SEQ ID NO: 1842907 - protein, 29 aa, Staphylococcus epidermidis
LDLFKSVKPYNITTLLAAAAKNLPLIKYS

SEQ ID NO: 1842908 - protein, 25 aa, Staphylococcus epidermidis
LEEAARTGKPIKLMIGFNARDSSSN

SEQ ID NO: 1842909 - protein, 17 aa, Staphylococcus epidermidis
LEEAGAPYNILTEEGIN

SEQ ID NO: 1842910 - protein, 29 aa, Staphylococcus epidermidis
LEHHLTLEELYALNPGIEPLIFPGDEIVV

SEQ ID NO: 1842911 - protein, 20 aa, Staphylococcus epidermidis
LFFFLKHQLSPEQTVDQISD

SEQ ID NO: 1842912 - protein, 19 aa, Staphylococcus epidermidis
LFNGYIECTYYQYWGKKPE

SEQ ID NO: 1842913 - protein, 30 aa, Staphylococcus epidermidis
LGHSNHENMIYWFAIPRDQTPAGPVTLTII

SEQ ID NO: 1842914 - protein, 25 aa, Staphylococcus epidermidis
LGVFILVIGALMLVGKIYGEHHPND

SEQ ID NO: 1842915 - protein, 18 aa, Staphylococcus epidermidis
LHFKKFVKNNKIPKEYKD

SEQ ID NO: 1842916 - protein, 29 aa, Staphylococcus epidermidis
LHQMNSHVPLIRLMNKFELLNASEQDLKA

SEQ ID NO: 1842917 - protein, 33 aa, Staphylococcus epidermidis
LIAILSIVFIGLVLFVVSFAKDTLFNNDTKAHS

SEQ ID NO: 1842918 - protein, 18 aa, Staphylococcus epidermidis
LIGQQWTEPKYFHGRISA

SEQ ID NO: 1842919 - protein, 18 aa, Staphylococcus epidermidis
LIIAVCLVLAGCSNSSNS

SEQ ID NO: 1842920 - protein, 20 aa, Staphylococcus epidermidis
LIIAVILFVTACSKDKTQDE

SEQ ID NO: 1842921 - protein, 24 aa, Staphylococcus epidermidis
LIIFIIFFASGTMTWFTIDKNKYD

SEQ ID NO: 1842922 - protein, 18 aa, Staphylococcus epidermidis
LILALSLTLAACSNTNDN

SEQ ID NO: 1842923 - protein, 18 aa, Staphylococcus epidermidis
LILIATVVVLAACQNKPE

SEQ ID NO: 1842924 - protein, 28 aa, Staphylococcus epidermidis
LILLSFGLLVVPIIFATQLYQSSESAFE

SEQ ID NO: 1842925 - protein, 24 aa, Staphylococcus epidermidis
LILLTLVLVVGPILFATQLYKSSE

SEQ ID NO: 1842926 - protein, 24 aa, Staphylococcus epidermidis
LILVALSLIVLSGCSLPGLGDGNA

SEQ ID NO: 1842927 - protein, 17 aa, Staphylococcus epidermidis
LIMIIIGVVGCSHDSDS

SEQ ID NO: 1842928 - protein, 17 aa, Staphylococcus epidermidis
LIPFIYFFYTRLTDVRN

SEQ ID NO: 1842929 - protein, 20 aa, Staphylococcus epidermidis
LISVFLLGIVFSIPVHAQEN

SEQ ID NO: 1842930 - protein, 18 aa, Staphylococcus epidermidis
LIVLGPGSLYTSVISNLC

SEQ ID NO: 1842931 - protein, 25 aa, Staphylococcus epidermidis
LKDDRKFFPPYDGSPLATEKLVKDN

SEQ ID NO: 1842932 - protein, 24 aa, Staphylococcus epidermidis
LKDDRRFFPPYDASPLASDQLLKE

SEQ ID NO: 1842933 - protein, 19 aa, Staphylococcus epidermidis
LKDNGINEFLIWNAANDYT

SEQ ID NO: 1842934 - protein, 24 aa, Staphylococcus epidermidis
LKGKKGFIKTPYPTYNTLDDVEDS

SEQ ID NO: 1842935 - protein, 25 aa, Staphylococcus epidermidis
LKHERLIQQYVSIDRIVRGVTTWTA

SEQ ID NO: 1842936 - protein, 23 aa, Staphylococcus epidermidis
LKNTHILVIPEANNPFKEKEQQA

SEQ ID NO: 1842937 - protein, 18 aa, Staphylococcus epidermidis
LLARLHSQYPYQTPIVGK

SEQ ID NO: 1842938 - protein, 24 aa, Staphylococcus epidermidis
LLDDDRVIFSELLRFAGIGESKVE

SEQ ID NO: 1842939 - protein, 18 aa, Staphylococcus epidermidis
LLIFSIILVSCSNSIDNN

SEQ ID NO: 1842940 - protein, 25 aa, Staphylococcus epidermidis
LLIGLSLIIICSVGVYAQNKKLSKD

SEQ ID NO: 1842941 - protein, 18 aa, Staphylococcus epidermidis
LLLALSLTLAACSNNSED

SEQ ID NO: 1842942 - protein, 18 aa, Staphylococcus epidermidis
LLSLVLVLSACSNGSNNN

SEQ ID NO: 1842943 - protein, 18 aa, Staphylococcus epidermidis
LLSLVLVLTACNNSSNNN

SEQ ID NO: 1842944 - protein, 21 aa, Staphylococcus epidermidis
LMGVIRMTKAVLPSMRARREG

SEQ ID NO: 1842945 - protein, 19 aa, Staphylococcus epidermidis
LMLIINYAKKKALSEVCPE

SEQ ID NO: 1842946 - protein, 26 aa, Staphylococcus epidermidis
LMPSNTEILYRLGLGKNIVGVSTVDD

SEQ ID NO: 1842947 - protein, 29 aa, Staphylococcus epidermidis
LNDIYDMKPLKTFVYGRTLLLGDAAHATT

SEQ ID NO: 1842948 - protein, 21 aa, Staphylococcus epidermidis
LNSIIKHYNLTEFDKKRMPNL

SEQ ID NO: 1842949 - protein, 20 aa, Staphylococcus epidermidis
LNSPSYQEYLNAKKLTENIQ

SEQ ID NO: 1842950 - protein, 17 aa, Staphylococcus epidermidis
LNWIWNSLSVKDQEEFN

SEQ ID NO: 1842951 - protein, 18 aa, Staphylococcus epidermidis
LPIIIQDKTFVSKKLNYS

SEQ ID NO: 1842952 - protein, 17 aa, Staphylococcus epidermidis
LPMFSDELVSYAVNFLE

SEQ ID NO: 1842953 - protein, 23 aa, Staphylococcus epidermidis
LPSMVALTLFGTAFTAHHAHAAE

SEQ ID NO: 1842954 - protein, 18 aa, Staphylococcus epidermidis
LQIVSVIHQFFDNKEAKS

SEQ ID NO: 1842955 - protein, 19 aa, Staphylococcus epidermidis
LSCLLVLGACSNSGNKSTT

SEQ ID NO: 1842956 - protein, 21 aa, Staphylococcus epidermidis
LSSFLILTACGNKDTSSTKDD

SEQ ID NO: 1842957 - protein, 23 aa, Staphylococcus epidermidis
LSSFLVLGACSHTDSSDKKETDS

SEQ ID NO: 1842958 - protein, 31 aa, Staphylococcus epidermidis
LSTLRKKKILILISTIILVLGLTYACTNKQE

SEQ ID NO: 1842959 - protein, 28 aa, Staphylococcus epidermidis
LSVGASSIIVASMLFIGGGSVHAAESNH

SEQ ID NO: 1842960 - protein, 21 aa, Staphylococcus epidermidis
LSVTGLLFTSSVGIADCHINS

SEQ ID NO: 1842961 - protein, 19 aa, Staphylococcus epidermidis
LTDAYKDLLDDYKVDYKDR

SEQ ID NO: 1842962 - protein, 19 aa, Staphylococcus epidermidis
LTLSLLLFGCSTINHHLNK

SEQ ID NO: 1842963 - protein, 17 aa, Staphylococcus epidermidis
LTSIAALTVASPLVNTD

SEQ ID NO: 1842964 - protein, 17 aa, Staphylococcus epidermidis
LVELWAGDAPLDDYKMS

SEQ ID NO: 1842965 - protein, 18 aa, Staphylococcus epidermidis
LVGILVSGSGIASVQTNI

SEQ ID NO: 1842966 - protein, 17 aa, Staphylococcus epidermidis
LVKGIDFNFNNFNNFIS

SEQ ID NO: 1842967 - protein, 18 aa, Staphylococcus epidermidis
LVLALTVALAACGGGDKS

SEQ ID NO: 1842968 - protein, 19 aa, Staphylococcus epidermidis
LVQYIQRVKQSKLWTTKDN

SEQ ID NO: 1842969 - protein, 17 aa, Staphylococcus epidermidis
LVSGLVLTGVSAGHHAE

SEQ ID NO: 1842970 - protein, 17 aa, Staphylococcus epidermidis
LVSSLILGFSVTPELFN

SEQ ID NO: 1842971 - protein, 21 aa, Staphylococcus epidermidis
LVTSLIIILVAVVLGLHLKSH

SEQ ID NO: 1842972 - protein, 17 aa, Staphylococcus epidermidis
LWARSRGLISSEEMAKE

SEQ ID NO: 1842973 - protein, 18 aa, Staphylococcus epidermidis
LWARSRGLISSEEMAKEL

SEQ ID NO: 1842974 - protein, 20 aa, Staphylococcus epidermidis
LYTAGQCTWYVFDKRAQDGH

SEQ ID NO: 1842975 - protein, 22 aa, Staphylococcus epidermidis
LYTSGQCTYYVFDKVGGKIGST

SEQ ID NO: 1842976 - protein, 21 aa, Staphylococcus epidermidis
LYVQWQKYMNEELPALPMLQM

SEQ ID NO: 1842977 - protein, 18 aa, Staphylococcus epidermidis
MGIPTDIKPFIKTRLISP

SEQ ID NO: 1842978 - protein, 22 aa, Staphylococcus epidermidis
MGIPTDIKPFIKTRLISPIGKL

SEQ ID NO: 1842979 - protein, 19 aa, Staphylococcus epidermidis
MILCMVLLYSCSGPMDSPK

SEQ ID NO: 1842980 - protein, 26 aa, Staphylococcus epidermidis
MNAAYRQLLSLYKIYCGKEIEVLNIY

SEQ ID NO: 1842981 - protein, 18 aa, Staphylococcus epidermidis
MNSVYYYKKEKDGETYSK

SEQ ID NO: 1842982 - protein, 26 aa, Staphylococcus epidermidis
MPPRTAKLLIQLIQKGELEIKKNLHD

SEQ ID NO: 1842983 - protein, 20 aa, Staphylococcus epidermidis
MSIGLAMNSVYYYKKEKDGE

SEQ ID NO: 1842984 - protein, 35 aa, Staphylococcus epidermidis
MSLPTKILLWVVGILFLLTVIAVIYVGAKIFITGD

SEQ ID NO: 1842985 - protein, 29 aa, Staphylococcus epidermidis
MTFIGILLIILAIYLFAKPHIDNYFHDKD

SEQ ID NO: 1842986 - protein, 17 aa, Staphylococcus epidermidis
MVLYINRNTRTTKGSYF

SEQ ID NO: 1842987 - protein, 26 aa, Staphylococcus epidermidis
NAQEFVTPLAFQAISRNPVYTNTFKE

SEQ ID NO: 1842988 - protein, 19 aa, Staphylococcus epidermidis
NDGLYYFIPSDASKNENTQ

SEQ ID NO: 1842989 - protein, 22 aa, Staphylococcus epidermidis
NDIWKHFKAVKNNQVYDLEEIP

SEQ ID NO: 1842990 - protein, 22 aa, Staphylococcus epidermidis
NDLGYKIKLIGKGTYENGRVNA

SEQ ID NO: 1842991 - protein, 19 aa, Staphylococcus epidermidis
NDMESYINLVFKLIDNGSV

SEQ ID NO: 1842992 - protein, 18 aa, Staphylococcus epidermidis
NELTQVRPLRIMSPHSVE

SEQ ID NO: 1842993 - protein, 28 aa, Staphylococcus epidermidis
NEPIKDNDWLIYGYPHTLRLEKSTGRNN

SEQ ID NO: 1842994 - protein, 26 aa, Staphylococcus epidermidis
NESATYLKKLLKPTLAKFIVTHANEH

SEQ ID NO: 1842995 - protein, 25 aa, Staphylococcus epidermidis
NESFSDVFGYFVDNDDFLMGEDVYT

SEQ ID NO: 1842996 - protein, 17 aa, Staphylococcus epidermidis
NFTSNGSEWSWSYTVAG

SEQ ID NO: 1842997 - protein, 24 aa, Staphylococcus epidermidis
NFTSNGTNWSWSYQAAGSQSSSAD

SEQ ID NO: 1842998 - protein, 24 aa, Staphylococcus epidermidis
NGAAPRDFFRLQNGNTFTARVNWV

SEQ ID NO: 1842999 - protein, 25 aa, Staphylococcus epidermidis
NGKSGWISKYYLTSASKPSNPTKPS

SEQ ID NO: 1843000 - protein, 25 aa, Staphylococcus epidermidis
NGQEVILIWNPWDNGFMTQDAHSNI

SEQ ID NO: 1843001 - protein, 17 aa, Staphylococcus epidermidis
NGQHKVDVMLGGGSKYF

SEQ ID NO: 1843002 - protein, 24 aa, Staphylococcus epidermidis
NGTKYLIFDNMSFTAPTKKPIIKP

SEQ ID NO: 1843003 - protein, 19 aa, Staphylococcus epidermidis
NHGNGFLNGGLQGNKNNGG

SEQ ID NO: 1843004 - protein, 24 aa, Staphylococcus epidermidis
NHSYVLHPYMKWGDSVIDVKDKSG

SEQ ID NO: 1843005 - protein, 28 aa, Staphylococcus epidermidis
NIKGMTIGLAMNSVYYYQKEKDGETYSK

SEQ ID NO: 1843006 - protein, 20 aa, Staphylococcus epidermidis
NIPVDTLFYDGSHHLHHQYQ

SEQ ID NO: 1843007 - protein, 25 aa, Staphylococcus epidermidis
NKDTRVDFGLEHWGLKQKPNESYIQ

SEQ ID NO: 1843008 - protein, 33 aa, Staphylococcus epidermidis
NKDVIPESYLRKFDYLVFPDNVAIVLGIAQAVG

SEQ ID NO: 1843009 - protein, 22 aa, Staphylococcus epidermidis
NKEKELFTYLNQDGATQSEVDS

SEQ ID NO: 1843010 - protein, 31 aa, Staphylococcus epidermidis
NKKVKPLGSRKFPSVILPNNNRHQISNTQEG

SEQ ID NO: 1843011 - protein, 25 aa, Staphylococcus epidermidis
NKKVMYLLVNEGELSTFGPGGRFGD

SEQ ID NO: 1843012 - protein, 33 aa, Staphylococcus epidermidis
NKSFPQIQYKNHDPIILVHGFNGYTADNGPALA

SEQ ID NO: 1843013 - protein, 24 aa, Staphylococcus epidermidis
NKSIENLYIRIKAIDIVAPTGNHR

SEQ ID NO: 1843014 - protein, 25 aa, Staphylococcus epidermidis
NNEKLADILLQFKNSNKVISSVCHG

SEQ ID NO: 1843015 - protein, 23 aa, Staphylococcus epidermidis
NNGLYSIAWGTKNQQLLPSNTIA

SEQ ID NO: 1843016 - protein, 24 aa, Staphylococcus epidermidis
NNLNGYLITPGQTLKIPSGGSGSG

SEQ ID NO: 1843017 - protein, 19 aa, Staphylococcus epidermidis
NPKNVIFMVGDGMGPSFNT

SEQ ID NO: 1843018 - protein, 18 aa, Staphylococcus epidermidis
NPNIVYKTYTGESTHASL

SEQ ID NO: 1843019 - protein, 21 aa, Staphylococcus epidermidis
NQAWLAAYMLKQNGIKPTLAD

SEQ ID NO: 1843020 - protein, 32 aa, Staphylococcus epidermidis
NQNDFEFQNPQYLPRFVFGHYMKSYLSQYDEQ

SEQ ID NO: 1843021 - protein, 18 aa, Staphylococcus epidermidis
NQPVIYLGGLDTPLKEAI

SEQ ID NO: 1843022 - protein, 24 aa, Staphylococcus epidermidis
NSGKEYQEYLGAKESQHAITHLTP

SEQ ID NO: 1843023 - protein, 21 aa, Staphylococcus epidermidis
NSYQVPLRVFGTRNELGLAIG

SEQ ID NO: 1843024 - protein, 33 aa, Staphylococcus epidermidis
NTQRDVNIALMNELALIFDKLNIDTNEVLKASG

SEQ ID NO: 1843025 - protein, 18 aa, Staphylococcus epidermidis
NTSFSIVLNKILADKYKD

SEQ ID NO: 1843026 - protein, 19 aa, Staphylococcus epidermidis
NTYVLLQDSTRNTPLGWVN

SEQ ID NO: 1843027 - protein, 17 aa, Staphylococcus epidermidis
NVFLIGATVRHQNVILC

SEQ ID NO: 1843028 - protein, 26 aa, Staphylococcus epidermidis
NVKAGSTLYTVPWGTPSQVASKVSGS

SEQ ID NO: 1843029 - protein, 21 aa, Staphylococcus epidermidis
NVMYVHCTLLPYIKAAGEMKT

SEQ ID NO: 1843030 - protein, 21 aa, Staphylococcus epidermidis
NVNPIGYYQMMAEPGSSGGAV

SEQ ID NO: 1843031 - protein, 20 aa, Staphylococcus epidermidis
NVPFFGICLGMQLATVEYAR

SEQ ID NO: 1843032 - protein, 21 aa, Staphylococcus epidermidis
NVPSHFQGSWRDADYSKRESQ

SEQ ID NO: 1843033 - protein, 24 aa, Staphylococcus epidermidis
NVSKLIQDLFMNDYLRVYTNNDLV

SEQ ID NO: 1843034 - protein, 17 aa, Staphylococcus epidermidis
NVTFDYNGFTYHFESDG

SEQ ID NO: 1843035 - protein, 24 aa, Staphylococcus epidermidis
NYDRAVELYYYIKGGRVDYGAAHT

SEQ ID NO: 1843036 - protein, 18 aa, Staphylococcus epidermidis
NYRIGTHFKIKLASNDIE

SEQ ID NO: 1843037 - protein, 26 aa, Staphylococcus epidermidis
PAEQGRFLKFFVDEGLIKLKKGVKIE

SEQ ID NO: 1843038 - protein, 24 aa, Staphylococcus epidermidis
PASLTKMMTMYLTLDAVKSGKLHM

SEQ ID NO: 1843039 - protein, 20 aa, Staphylococcus epidermidis
PCIFSLLQGFFVIYSVCSNK

SEQ ID NO: 1843040 - protein, 25 aa, Staphylococcus epidermidis
PDKAKGIVYLPDNLSNNQKWSHAVD

SEQ ID NO: 1843041 - protein, 20 aa, Staphylococcus epidermidis
PFNQAFVPATKEIKKGVWQV

SEQ ID NO: 1843042 - protein, 18 aa, Staphylococcus epidermidis
PHQYFRSHNYSYAELYDL

SEQ ID NO: 1843043 - protein, 18 aa, Staphylococcus epidermidis
PIISLAHVNNFQGQDNRN

SEQ ID NO: 1843044 - protein, 18 aa, Staphylococcus epidermidis
PIIVSCHSGLRSYIAERI

SEQ ID NO: 1843045 - protein, 18 aa, Staphylococcus epidermidis
PIVSLAHVNNFQGSDNRN

SEQ ID NO: 1843046 - protein, 20 aa, Staphylococcus epidermidis
PLQWRNFFSNGETIDLYENN

SEQ ID NO: 1843047 - protein, 26 aa, Staphylococcus epidermidis
PNEKPTLIYFMATWCPSCIYNEEIFK

SEQ ID NO: 1843048 - protein, 21 aa, Staphylococcus epidermidis
PNREKVLWQYTDSYYSPELNQ

SEQ ID NO: 1843049 - protein, 30 aa, Staphylococcus epidermidis
PQIEENYTSYFPKYGYRNGVGRPEGIVVHD

SEQ ID NO: 1843050 - protein, 22 aa, Staphylococcus epidermidis
PRSLVIAEVLKKAGYDVTTTPV

SEQ ID NO: 1843051 - protein, 17 aa, Staphylococcus epidermidis
PTDIKPFIKTRLISPIG

SEQ ID NO: 1843052 - protein, 17 aa, Staphylococcus epidermidis
PTMKKDIKLYLDSDRKL

SEQ ID NO: 1843053 - protein, 18 aa, Staphylococcus epidermidis
PTNKYLYQDGQYLDKKTI

SEQ ID NO: 1843054 - protein, 23 aa, Staphylococcus epidermidis
PVQAGAYDIHFVNNGFEYNFTSN

SEQ ID NO: 1843055 - protein, 18 aa, Staphylococcus epidermidis
PYQHVFQAVVYISGQKVN

SEQ ID NO: 1843056 - protein, 17 aa, Staphylococcus epidermidis
QAGAYDIHFVDNGYQYN

SEQ ID NO: 1843057 - protein, 18 aa, Staphylococcus epidermidis
QAIGGQAYWSFGGLFLVN

SEQ ID NO: 1843058 - protein, 23 aa, Staphylococcus epidermidis
QAWDVSMYSYLSVPRGDTGYFFN

SEQ ID NO: 1843059 - protein, 20 aa, Staphylococcus epidermidis
QDPHAWLSLDNGIKYVKTIQ

SEQ ID NO: 1843060 - protein, 24 aa, Staphylococcus epidermidis
QEFKSQIQWLKAHDAKFLTLKEFI

SEQ ID NO: 1843061 - protein, 28 aa, Staphylococcus epidermidis
QETYALGYDKLVLSPGAKPFIPPANGLE

SEQ ID NO: 1843062 - protein, 30 aa, Staphylococcus epidermidis
QFDAMNLNKEKLLKAKPDLILAHESQKHSS

SEQ ID NO: 1843063 - protein, 17 aa, Staphylococcus epidermidis
QFKNDTLVLDQAVLYIK

SEQ ID NO: 1843064 - protein, 28 aa, Staphylococcus epidermidis
QGHYDAVSFIYIPIHGGYMSGSGVVVGE

SEQ ID NO: 1843065 - protein, 26 aa, Staphylococcus epidermidis
QGIFNKPVITPIKPYKNFYPAETYHQ

SEQ ID NO: 1843066 - protein, 26 aa, Staphylococcus epidermidis
QGTEHYYEFRTHKGVLLVTTNGKKDK

SEQ ID NO: 1843067 - protein, 24 aa, Staphylococcus epidermidis
QHVSLGDWADAIIIAPATANTIAK

SEQ ID NO: 1843068 - protein, 25 aa, Staphylococcus epidermidis
QIIEQFNVLLKPLKDKYRLTTSSTN

SEQ ID NO: 1843069 - protein, 25 aa, Staphylococcus epidermidis
QIVGKVSFRFWPFSEFKSNFNPDHT

SEQ ID NO: 1843070 - protein, 24 aa, Staphylococcus epidermidis
QKDGGIFYYKPTKKSLEVWFVVDN

SEQ ID NO: 1843071 - protein, 26 aa, Staphylococcus epidermidis
QKEPWTNPIEGYKWYDRSTFKKGSYG

SEQ ID NO: 1843072 - protein, 23 aa, Staphylococcus epidermidis
QKKLSAYQKQLLLDKVKVSDKEI

SEQ ID NO: 1843073 - protein, 21 aa, Staphylococcus epidermidis
QKKPKLLTDAYKDLLDDYKVD

SEQ ID NO: 1843074 - protein, 22 aa, Staphylococcus epidermidis
QKQSIFMEVSSKPDIYTAGKGT

SEQ ID NO: 1843075 - protein, 17 aa, Staphylococcus epidermidis
QLELTTALRKSLFVNEK

SEQ ID NO: 1843076 - protein, 18 aa, Staphylococcus epidermidis
QLNKLPYQHVFQAVVYIS

SEQ ID NO: 1843077 - protein, 19 aa, Staphylococcus epidermidis
QNYDFIIIRGQYGSEYVDQ

SEQ ID NO: 1843078 - protein, 26 aa, Staphylococcus epidermidis
QQIDKAIYLYGTVNGKSGWISKYYLT

SEQ ID NO: 1843079 - protein, 25 aa, Staphylococcus epidermidis
QQNKKLHSWLKISTLIDNVKVKDKY

SEQ ID NO: 1843080 - protein, 21 aa, Staphylococcus epidermidis
QREDETLVQYIQRVKQSKLWT

SEQ ID NO: 1843081 - protein, 21 aa, Staphylococcus epidermidis
QRKRALLFEWSRINEMLDKQL

SEQ ID NO: 1843082 - protein, 20 aa, Staphylococcus epidermidis
QRTILYIHGGAWFQDPLDSH

SEQ ID NO: 1843083 - protein, 20 aa, Staphylococcus epidermidis
QRVKQSKLWTTKDNGFYDLT

SEQ ID NO: 1843084 - protein, 20 aa, Staphylococcus epidermidis
QSFKAFVQNKDELIFNKDKS

SEQ ID NO: 1843085 - protein, 21 aa, Staphylococcus epidermidis
QTAHSYWYKYNGYTASGGDFV

SEQ ID NO: 1843086 - protein, 26 aa, Staphylococcus epidermidis
QTIYQNAFPILKKYKIPATGFVITGH

SEQ ID NO: 1843087 - protein, 17 aa, Staphylococcus epidermidis
QTSQGAFGHVAYVESVN

SEQ ID NO: 1843088 - protein, 20 aa, Staphylococcus epidermidis
QTVRLLEEMLRNGNPEEVDY

SEQ ID NO: 1843089 - protein, 33 aa, Staphylococcus epidermidis
QYIATTYYNNWLFYYIFAYSFLNQHEKKNSVDA

SEQ ID NO: 1843090 - protein, 26 aa, Staphylococcus epidermidis
QYKNHDPIILVHGFNGFTDDINPTVL

SEQ ID NO: 1843091 - protein, 19 aa, Staphylococcus epidermidis
RAMMTSEGAFKYFAKQFNV

SEQ ID NO: 1843092 - protein, 25 aa, Staphylococcus epidermidis
RAQDGHTISTFWGDARNWAGQASSA

SEQ ID NO: 1843093 - protein, 17 aa, Staphylococcus epidermidis
RATYLESVKSKESSIKD

SEQ ID NO: 1843094 - protein, 17 aa, Staphylococcus epidermidis
RAYWFITVHAKEGDPKY

SEQ ID NO: 1843095 - protein, 18 aa, Staphylococcus epidermidis
RDLPRIFDRGFTSTTDRN

SEQ ID NO: 1843096 - protein, 20 aa, Staphylococcus epidermidis
REDVKILFKVQPSKPQIDAN

SEQ ID NO: 1843097 - protein, 24 aa, Staphylococcus epidermidis
RELDLHELLNKYGKSSNYKDIANQ

SEQ ID NO: 1843098 - protein, 17 aa, Staphylococcus epidermidis
RELGFVLMALNIRKVTA

SEQ ID NO: 1843099 - protein, 22 aa, Staphylococcus epidermidis
RFGDLVFDTLGFKPADKKVSKS

SEQ ID NO: 1843100 - protein, 23 aa, Staphylococcus epidermidis
RFGGTLYHRTAFAGATTGQQLLY

SEQ ID NO: 1843101 - protein, 21 aa, Staphylococcus epidermidis
RFSIRKYAVGVVSIITGATIF

SEQ ID NO: 1843102 - protein, 28 aa, Staphylococcus epidermidis
RFSIRKYAVGVVSIITGVTIFIGGQQAQ

SEQ ID NO: 1843103 - protein, 28 aa, Staphylococcus epidermidis
RFVALILAVFFFLSVNNVFGNVFNTDDI

SEQ ID NO: 1843104 - protein, 27 aa, Staphylococcus epidermidis
RGDTGYFFNTAYLPEGALNKGNYSNPK

SEQ ID NO: 1843105 - protein, 23 aa, Staphylococcus epidermidis
RGESALNYRLTAATFFIKMNQKT

SEQ ID NO: 1843106 - protein, 26 aa, Staphylococcus epidermidis
RGESALNYRLTAATFFIKMNQKTVPE

SEQ ID NO: 1843107 - protein, 19 aa, Staphylococcus epidermidis
RGFRGAGSYWADHLGYTDI

SEQ ID NO: 1843108 - protein, 22 aa, Staphylococcus epidermidis
RGQRQMDLIKILFQKAQSLDSI

SEQ ID NO: 1843109 - protein, 24 aa, Staphylococcus epidermidis
RHNTKVLSKMIYELALDLTSTIQF

SEQ ID NO: 1843110 - protein, 25 aa, Staphylococcus epidermidis
RHNTKVLSKMIYELALDLTSTIRFT

SEQ ID NO: 1843111 - protein, 17 aa, Staphylococcus epidermidis
RKAFFKNGDTSTKNRTN

SEQ ID NO: 1843112 - protein, 19 aa, Staphylococcus epidermidis
RLLTRLHSQYPYQTPIVGK

SEQ ID NO: 1843113 - protein, 25 aa, Staphylococcus epidermidis
RMNNLPKNPYKFKSYIGIVIHEVGE

SEQ ID NO: 1843114 - protein, 17 aa, Staphylococcus epidermidis
RNRSQNYAMIRLLKWFE

SEQ ID NO: 1843115 - protein, 27 aa, Staphylococcus epidermidis
RNTKDGIKPLLAKKWDISPDGKTYTFH

SEQ ID NO: 1843116 - protein, 28 aa, Staphylococcus epidermidis
RNTKDGIKPLLAKKWDISPDGKTYTFHL

SEQ ID NO: 1843117 - protein, 26 aa, Staphylococcus epidermidis
RNTKEGIKPLLAKKWDISDDGQTYTF

SEQ ID NO: 1843118 - protein, 17 aa, Staphylococcus epidermidis
RPMQIGLVYDALKNNKL

SEQ ID NO: 1843119 - protein, 25 aa, Staphylococcus epidermidis
RQNVKGGTDYGLIDPKEANESSQSQ

SEQ ID NO: 1843120 - protein, 17 aa, Staphylococcus epidermidis
RSDTIMILSINPKEKKT

SEQ ID NO: 1843121 - protein, 34 aa, Staphylococcus epidermidis
RSHNYSYAELYDLIYEKYLIKTGQVAPWGTSSTS

SEQ ID NO: 1843122 - protein, 25 aa, Staphylococcus epidermidis
RSQSRSLMAPRRPYSSGAPYTSQYM

SEQ ID NO: 1843123 - protein, 21 aa, Staphylococcus epidermidis
RVDHYTLKQLKKLDAGSWFNK

SEQ ID NO: 1843124 - protein, 17 aa, Staphylococcus epidermidis
RVIGMPKLKGLKNKENP

SEQ ID NO: 1843125 - protein, 19 aa, Staphylococcus epidermidis
RVKQSKLWTTKDNGFYDLT

SEQ ID NO: 1843126 - protein, 17 aa, Staphylococcus epidermidis
RVQNSKLWKSEDSGLHD

SEQ ID NO: 1843127 - protein, 23 aa, Staphylococcus epidermidis
SAEYLKKLFKTTLAKFITTNANE

SEQ ID NO: 1843128 - protein, 25 aa, Staphylococcus epidermidis
SANDMNFLRWPNIREDYSITWSSDK

SEQ ID NO: 1843129 - protein, 20 aa, Staphylococcus epidermidis
SCVMMVFLTSSLSIVSTYSH

SEQ ID NO: 1843130 - protein, 26 aa, Staphylococcus epidermidis
SDDEIMWQLNLNLMGVIRMTKAVLPS

SEQ ID NO: 1843131 - protein, 24 aa, Staphylococcus epidermidis
SDDEYLKLNRLIFKAQPKNSHQTW

SEQ ID NO: 1843132 - protein, 23 aa, Staphylococcus epidermidis
SDHGLYIILPYALTDNFTDEYKL

SEQ ID NO: 1843133 - protein, 24 aa, Staphylococcus epidermidis
SDLKDIPIHFAIYKQSGQDSISPG

SEQ ID NO: 1843134 - protein, 19 aa, Staphylococcus epidermidis
SEETVLADYVFIGAGGGAI

SEQ ID NO: 1843135 - protein, 24 aa, Staphylococcus epidermidis
SEKDMPLQIDAPSKNPLLVDMEQS

SEQ ID NO: 1843136 - protein, 23 aa, Staphylococcus epidermidis
SELGPAVSTAWVVDKKTGEIIKT

SEQ ID NO: 1843137 - protein, 18 aa, Staphylococcus epidermidis
SESQIISHMLRLLIEHDT

SEQ ID NO: 1843138 - protein, 35 aa, Staphylococcus epidermidis
SETGILLHDIYDLKPLKTFVYGRTILMGDAAHATT

SEQ ID NO: 1843139 - protein, 17 aa, Staphylococcus epidermidis
SFTIVPTSNLAVKHPLF

SEQ ID NO: 1843140 - protein, 23 aa, Staphylococcus epidermidis
SGARYQFLRLDQPQSLSVAALNE

SEQ ID NO: 1843141 - protein, 18 aa, Staphylococcus epidermidis
SGFETAFDNAINYAKTHK

SEQ ID NO: 1843142 - protein, 23 aa, Staphylococcus epidermidis
SGKPLPKFWETAGGINPSVANYF

SEQ ID NO: 1843143 - protein, 29 aa, Staphylococcus epidermidis
SGNLYTAGQCTWYVFDKVGGQIGSTWGNA

SEQ ID NO: 1843144 - protein, 21 aa, Staphylococcus epidermidis
SGWVSKYYLTTPTQSKVAVSK

SEQ ID NO: 1843145 - protein, 26 aa, Staphylococcus epidermidis
SIGASSIIVASMLFIGGQTAHAAEQD

SEQ ID NO: 1843146 - protein, 28 aa, Staphylococcus epidermidis
SIGKDKAQQIYYRALTDYLSSNSDFQDA

SEQ ID NO: 1843147 - protein, 20 aa, Staphylococcus epidermidis
SIGTAIVRVFKMAAASTGLN

SEQ ID NO: 1843148 - protein, 19 aa, Staphylococcus epidermidis
SIILYAIVLTACGNDKSGN

SEQ ID NO: 1843149 - protein, 26 aa, Staphylococcus epidermidis
SINHQLKVPLIKAYMGMESDLLDFYA

SEQ ID NO: 1843150 - protein, 33 aa, Staphylococcus epidermidis
SIRKFSVGTSSILIAALLFIGGNSAQAAEENHN

SEQ ID NO: 1843151 - protein, 19 aa, Staphylococcus epidermidis
SIRKLSIGASSIIVASMLF

SEQ ID NO: 1843152 - protein, 26 aa, Staphylococcus epidermidis
SKKHPRAYVDFYKSDCWYHAKAYKCS

SEQ ID NO: 1843153 - protein, 19 aa, Staphylococcus epidermidis
SLAVGLGVVAGNAGHDAHA

SEQ ID NO: 1843154 - protein, 20 aa, Staphylococcus epidermidis
SLEVWFVVDNNHVVEASIGH

SEQ ID NO: 1843155 - protein, 17 aa, Staphylococcus epidermidis
SLFLVFSTITYASERDS

SEQ ID NO: 1843156 - protein, 19 aa, Staphylococcus epidermidis
SLSTQPNYRIGTHFKIKLA

SEQ ID NO: 1843157 - protein, 17 aa, Staphylococcus epidermidis
SMLSYTFGTNGIKPPHP

SEQ ID NO: 1843158 - protein, 25 aa, Staphylococcus epidermidis
SNLDLFRSVKPYNITTLLAAAIKNV

SEQ ID NO: 1843159 - protein, 27 aa, Staphylococcus epidermidis
SNNVYELDPKLWYFSSGSSTTTIKQID

SEQ ID NO: 1843160 - protein, 25 aa, Staphylococcus epidermidis
SNPKEFIQPLPHISFVRGKNNVQFL

SEQ ID NO: 1843161 - protein, 26 aa, Staphylococcus epidermidis
SPISSPQFIIYPYSLNQYIPSKAVRA

SEQ ID NO: 1843162 - protein, 21 aa, Staphylococcus epidermidis
SPLHLRVYFEKDSRKLLRAAA

SEQ ID NO: 1843163 - protein, 17 aa, Staphylococcus epidermidis
SQALQQLPNFETALSIA

SEQ ID NO: 1843164 - protein, 27 aa, Staphylococcus epidermidis
SQPKKNYYNKPPKRWPSNIPGGDNVRD

SEQ ID NO: 1843165 - protein, 26 aa, Staphylococcus epidermidis
SSAVKNLPLIKYSFDQILMTKEGCMN

SEQ ID NO: 1843166 - protein, 25 aa, Staphylococcus epidermidis
SSKGPDLYVFLTKDGDIKSGKKIST

SEQ ID NO: 1843167 - protein, 21 aa, Staphylococcus epidermidis
SSLAVDFPPLPLTNGNRVVVV

SEQ ID NO: 1843168 - protein, 25 aa, Staphylococcus epidermidis
SSLLFIFILTTCSFSYITFSKLTSE

SEQ ID NO: 1843169 - protein, 24 aa, Staphylococcus epidermidis
SSLLFIFIVTTCSFGYITFSKLTS

SEQ ID NO: 1843170 - protein, 24 aa, Staphylococcus epidermidis
SSSLMAVGIMAPTILFTTNEAKAY

SEQ ID NO: 1843171 - protein, 27 aa, Staphylococcus epidermidis
SSSNPETLVPVKLYVKPQLQQKISYWH

SEQ ID NO: 1843172 - protein, 23 aa, Staphylococcus epidermidis
SSTVSHFMAFNPNNPVLKKRAIR

SEQ ID NO: 1843173 - protein, 19 aa, Staphylococcus epidermidis
SSWKGKPKHKNWPKTAWYR

SEQ ID NO: 1843174 - protein, 36 aa, Staphylococcus epidermidis
STHASLFGRQKADYNLFFPFTITANVIGKATEKEWR

SEQ ID NO: 1843175 - protein, 19 aa, Staphylococcus epidermidis
STLYKGPYDAFRKDFSHKI

SEQ ID NO: 1843176 - protein, 21 aa, Staphylococcus epidermidis
STSEGYILQKLLITEVKDDHT

SEQ ID NO: 1843177 - protein, 18 aa, Staphylococcus epidermidis
STTVLAPLGIYSDKVKNI

SEQ ID NO: 1843178 - protein, 17 aa, Staphylococcus epidermidis
STVIKRNGVRYGIIGVT

SEQ ID NO: 1843179 - protein, 21 aa, Staphylococcus epidermidis
STVSHFMAFNPDKNVLKQRTI

SEQ ID NO: 1843180 - protein, 20 aa, Staphylococcus epidermidis
SVITIILLFGCSKQPSSTND

SEQ ID NO: 1843181 - protein, 17 aa, Staphylococcus epidermidis
SVLGLSFILTACGGSGE

SEQ ID NO: 1843182 - protein, 25 aa, Staphylococcus epidermidis
SVTAYDFVYAWRKVVNPKTASEFAY

SEQ ID NO: 1843183 - protein, 18 aa, Staphylococcus epidermidis
SVYIWQNYKKYKPENKFL

SEQ ID NO: 1843184 - protein, 17 aa, Staphylococcus epidermidis
SYLDYKKQKPNAKIKAI

SEQ ID NO: 1843185 - protein, 20 aa, Staphylococcus epidermidis
TAGYTFPLATLKKETGINAT

SEQ ID NO: 1843186 - protein, 20 aa, Staphylococcus epidermidis
TAKELLATTVQRLAADHTTE

SEQ ID NO: 1843187 - protein, 22 aa, Staphylococcus epidermidis
TALATITLVPSLMILDTQHEAK

SEQ ID NO: 1843188 - protein, 19 aa, Staphylococcus epidermidis
TANKDLLAVHLKLLEDLAE

SEQ ID NO: 1843189 - protein, 24 aa, Staphylococcus epidermidis
TASIALMSLSLFYAPDTNAKGLSH

SEQ ID NO: 1843190 - protein, 20 aa, Staphylococcus epidermidis
TCISLLLAGCSFNKHTNEKT

SEQ ID NO: 1843191 - protein, 18 aa, Staphylococcus epidermidis
TEFEVAYAPPYSHPKDLI

SEQ ID NO: 1843192 - protein, 19 aa, Staphylococcus epidermidis
TFYFIFPQQNEIIERMSKV

SEQ ID NO: 1843193 - protein, 24 aa, Staphylococcus epidermidis
TGDYSFPYHPFSYGLHYSEIQTFT

SEQ ID NO: 1843194 - protein, 31 aa, Staphylococcus epidermidis
TGPITGKGNYWGGDRLKIIQDYRAKGYNVME

SEQ ID NO: 1843195 - protein, 31 aa, Staphylococcus epidermidis
TGPVTGKGNYWGGDRLKIIQDYRAKGYNVME

SEQ ID NO: 1843196 - protein, 23 aa, Staphylococcus epidermidis
TGVLCVVTLLSASPSFAVEKPTS

SEQ ID NO: 1843197 - protein, 29 aa, Staphylococcus epidermidis
TGVQLELTTALRKVFFKNGDTSTKNRTNK

SEQ ID NO: 1843198 - protein, 18 aa, Staphylococcus epidermidis
THILSLHNISISNLKILE

SEQ ID NO: 1843199 - protein, 21 aa, Staphylococcus epidermidis
THSLSWFKKRYAKKGKWMKIY

SEQ ID NO: 1843200 - protein, 31 aa, Staphylococcus epidermidis
TILLIIMSYKYLLLRYDILKITKQLDDLSNE

SEQ ID NO: 1843201 - protein, 18 aa, Staphylococcus epidermidis
TILSLMLVGCSNGGNDEA

SEQ ID NO: 1843202 - protein, 17 aa, Staphylococcus epidermidis
TILTLSIVLAGCTNERG

SEQ ID NO: 1843203 - protein, 19 aa, Staphylococcus epidermidis
TISYIPKVGYYDKITHAHA

SEQ ID NO: 1843204 - protein, 20 aa, Staphylococcus epidermidis
TIVIFAITLTACGSKSTKDL

SEQ ID NO: 1843205 - protein, 25 aa, Staphylococcus epidermidis
TIYDNAFPVLKKYHIPATGFLITNH

SEQ ID NO: 1843206 - protein, 26 aa, Staphylococcus epidermidis
TKAMPKEMLPILDKPTIQYIVEEASR

SEQ ID NO: 1843207 - protein, 17 aa, Staphylococcus epidermidis
TKAQRALVVGAGYISLE

SEQ ID NO: 1843208 - protein, 18 aa, Staphylococcus epidermidis
TKAQRALVVGAGYISLEI

SEQ ID NO: 1843209 - protein, 18 aa, Staphylococcus epidermidis
TKAWDVSMYSYLTVPRGD

SEQ ID NO: 1843210 - protein, 18 aa, Staphylococcus epidermidis
TKGPVLNGFFGHCSLAID

SEQ ID NO: 1843211 - protein, 21 aa, Staphylococcus epidermidis
TKNKEGIGYFGYNFYEQNKDK

SEQ ID NO: 1843212 - protein, 19 aa, Staphylococcus epidermidis
TKRRKLFNGYIECTYYQYW

SEQ ID NO: 1843213 - protein, 21 aa, Staphylococcus epidermidis
TKVIHIIEELIDYGLDVHVSD

SEQ ID NO: 1843214 - protein, 17 aa, Staphylococcus epidermidis
TLAVSLGIAGYGLSGHE

SEQ ID NO: 1843215 - protein, 27 aa, Staphylococcus epidermidis
TLEETAFLLDLLLDIDEPVVITGAMRS

SEQ ID NO: 1843216 - protein, 19 aa, Staphylococcus epidermidis
TLIIFIILLSGCDSSGKDK

SEQ ID NO: 1843217 - protein, 18 aa, Staphylococcus epidermidis
TLLLTGCVQKDNDHDEAS

SEQ ID NO: 1843218 - protein, 21 aa, Staphylococcus epidermidis
TLSSTLILGACSIGTNQDNKE

SEQ ID NO: 1843219 - protein, 21 aa, Staphylococcus epidermidis
TLVLIIILVLSGCGKGKQQDA

SEQ ID NO: 1843220 - protein, 17 aa, Staphylococcus epidermidis
TNKYLYQDGQYLDKKTI

SEQ ID NO: 1843221 - protein, 25 aa, Staphylococcus epidermidis
TNKYVYNVELITTSPKIAHWNVKVD

SEQ ID NO: 1843222 - protein, 21 aa, Staphylococcus epidermidis
TPLHLRVYFEKDSRKLLRAAA

SEQ ID NO: 1843223 - protein, 25 aa, Staphylococcus epidermidis
TPLNSYTFYYTPTLGQLQKLLVKNH

SEQ ID NO: 1843224 - protein, 23 aa, Staphylococcus epidermidis
TREELQQFWHNLADDLVQSEQLT

SEQ ID NO: 1843225 - protein, 29 aa, Staphylococcus epidermidis
TSIKPFKYHGKYFAGLAKITYHSTSEGYI

SEQ ID NO: 1843226 - protein, 25 aa, Staphylococcus epidermidis
TSMLAIILLLCGCSTFKYGNTKKPQ

SEQ ID NO: 1843227 - protein, 18 aa, Staphylococcus epidermidis
TTVLGASFLLGACGGNNG

SEQ ID NO: 1843228 - protein, 25 aa, Staphylococcus epidermidis
TVATAIVSGPVYFTLESHKANAETM

SEQ ID NO: 1843229 - protein, 18 aa, Staphylococcus epidermidis
TVIILTIVVSACGNETKR

SEQ ID NO: 1843230 - protein, 20 aa, Staphylococcus epidermidis
TVLLISGLILTGCGGNKELE

SEQ ID NO: 1843231 - protein, 18 aa, Staphylococcus epidermidis
TVLSLLLAACSHNENNEN

SEQ ID NO: 1843232 - protein, 27 aa, Staphylococcus epidermidis
TVNGKSGWISKYYLTTPSSSNTKPSKP

SEQ ID NO: 1843233 - protein, 18 aa, Staphylococcus epidermidis
TVTLPLVGTVGGGVVGAV

SEQ ID NO: 1843234 - protein, 23 aa, Staphylococcus epidermidis
VAKPRMMYAVNKKTTSSLPKYTP

SEQ ID NO: 1843235 - protein, 23 aa, Staphylococcus epidermidis
VALLMIIGLSALFQINEAGAATK

SEQ ID NO: 1843236 - protein, 21 aa, Staphylococcus epidermidis
VASAKPEVIFISGRTANQKNL

SEQ ID NO: 1843237 - protein, 29 aa, Staphylococcus epidermidis
VAVILSICLVGLIFLATNQNALAKVHQTI

SEQ ID NO: 1843238 - protein, 25 aa, Staphylococcus epidermidis
VAVLTGFYVGDFIKLGIKPIAVSDI

SEQ ID NO: 1843239 - protein, 21 aa, Staphylococcus epidermidis
VDNGYQYNFTSNGSEWSWSYT

SEQ ID NO: 1843240 - protein, 32 aa, Staphylococcus epidermidis
VELTLPQNIQPHHPFQFTIKLTGYEPNSTIND

SEQ ID NO: 1843241 - protein, 17 aa, Staphylococcus epidermidis
VETVLADYVFIGAGGGA

SEQ ID NO: 1843242 - protein, 25 aa, Staphylococcus epidermidis
VFASFLILMIFIVGCGSMTKEDKKE

SEQ ID NO: 1843243 - protein, 17 aa, Staphylococcus epidermidis
VFATSALLLSACSHDEG

SEQ ID NO: 1843244 - protein, 19 aa, Staphylococcus epidermidis
VFVSVILTIAAVIDEFMIQ

SEQ ID NO: 1843245 - protein, 25 aa, Staphylococcus epidermidis
VGEDSFSMYPNYWGGTKYNVKQELT

SEQ ID NO: 1843246 - protein, 17 aa, Staphylococcus epidermidis
VGKAFGRKNSRVDFGLA

SEQ ID NO: 1843247 - protein, 17 aa, Staphylococcus epidermidis
VGTLEPGDYFITVKLGD

SEQ ID NO: 1843248 - protein, 27 aa, Staphylococcus epidermidis
VGYQNEYFYITYLSRNLKEYRKYYEPL

SEQ ID NO: 1843249 - protein, 20 aa, Staphylococcus epidermidis
VIGLLFVLIATAACGNNNSS

SEQ ID NO: 1843250 - protein, 22 aa, Staphylococcus epidermidis
VIGLMLVLVLVAACGSNGSNDS

SEQ ID NO: 1843251 - protein, 18 aa, Staphylococcus epidermidis
VISFSVLATSLGIVNAHA

SEQ ID NO: 1843252 - protein, 20 aa, Staphylococcus epidermidis
VITANKDLLAVHLKLLEDLA

SEQ ID NO: 1843253 - protein, 24 aa, Staphylococcus epidermidis
VITSFYRHVDLQAQVPLAWGAHRG

SEQ ID NO: 1843254 - protein, 21 aa, Staphylococcus epidermidis
VKDVWKYNVAISKAAAKAGFR

SEQ ID NO: 1843255 - protein, 24 aa, Staphylococcus epidermidis
VKFQYVNLAFLGKDSIIGSRAQHA

SEQ ID NO: 1843256 - protein, 22 aa, Staphylococcus epidermidis
VKGLKQVPILDKLDPLMTEKTF

SEQ ID NO: 1843257 - protein, 23 aa, Staphylococcus epidermidis
VKNDLHFKKFIKNNHIPEEYKDP

SEQ ID NO: 1843258 - protein, 18 aa, Staphylococcus epidermidis
VKNDLHFKKFVKNNKIPK

SEQ ID NO: 1843259 - protein, 22 aa, Staphylococcus epidermidis
VLGLLATLALAIVLSACGNGGS

SEQ ID NO: 1843260 - protein, 18 aa, Staphylococcus epidermidis
VLLTSFLLSACTINIERD

SEQ ID NO: 1843261 - protein, 29 aa, Staphylococcus epidermidis
VLQENIEKSIWYKLLVNLGINTITAIGHQ

SEQ ID NO: 1843262 - protein, 17 aa, Staphylococcus epidermidis
VLTPEIFDYLKTQKKGA

SEQ ID NO: 1843263 - protein, 21 aa, Staphylococcus epidermidis
VLVLSVVIFAAACGNSSSLNN

SEQ ID NO: 1843264 - protein, 17 aa, Staphylococcus epidermidis
VMVSFILASCGNHSKTD

SEQ ID NO: 1843265 - protein, 33 aa, Staphylococcus epidermidis
VNIKGTIHVLQATLPYLLKQSSGHIINLASVSG

SEQ ID NO: 1843266 - protein, 27 aa, Staphylococcus epidermidis
VNNNIHTWKKFKDKVLFTGIFNSQEAH

SEQ ID NO: 1843267 - protein, 17 aa, Staphylococcus epidermidis
VNNQAWLAAYMLKQNGI

SEQ ID NO: 1843268 - protein, 18 aa, Staphylococcus epidermidis
VNPFVKDVWKYNVAISKA

SEQ ID NO: 1843269 - protein, 30 aa, Staphylococcus epidermidis
VNQNYSIKPGVKLYTVPWGTYNQVASTVSG

SEQ ID NO: 1843270 - protein, 17 aa, Staphylococcus epidermidis
VNTLKYSDFGFNDDTSK

SEQ ID NO: 1843271 - protein, 25 aa, Staphylococcus epidermidis
VNYLTGFISGPLLSKKYLSDVPVKD

SEQ ID NO: 1843272 - protein, 23 aa, Staphylococcus epidermidis
VPNNSQKYRIAKRKGISFSRQTA

SEQ ID NO: 1843273 - protein, 22 aa, Staphylococcus epidermidis
VQDLPELEFTYAPPFGSAKDPV

SEQ ID NO: 1843274 - protein, 24 aa, Staphylococcus epidermidis
VQFLKDRYYAMKDFPMFDNIEYTE

SEQ ID NO: 1843275 - protein, 26 aa, Staphylococcus epidermidis
VQQNKKLHSWLRLSTLIDDVKVKDKY

SEQ ID NO: 1843276 - protein, 41 aa, Staphylococcus epidermidis
VQRKGLRKYNNKLIAVTISSLALVVPLAFGNAEADAAQTND

SEQ ID NO: 1843277 - protein, 34 aa, Staphylococcus epidermidis
VRHQNAILCYIYKFRARFAVLARIVSLREGLPED

SEQ ID NO: 1843278 - protein, 35 aa, Staphylococcus epidermidis
VRHQNAILCYIYKFRARFAVLARIVSLREGLPEDT

SEQ ID NO: 1843279 - protein, 35 aa, Staphylococcus epidermidis
VRHQNVILCYIYKFRARFAVLARIVSLREGLPEDA

SEQ ID NO: 1843280 - protein, 25 aa, Staphylococcus epidermidis
VSFGQRVISYPIQFVTGSIGNLFEK

SEQ ID NO: 1843281 - protein, 24 aa, Staphylococcus epidermidis
VSKAIIGGAKFIGQSYIKAGQNTL

SEQ ID NO: 1843282 - protein, 27 aa, Staphylococcus epidermidis
VSLGQRAVSYPIHFVTGAIGNIFNKDG

SEQ ID NO: 1843283 - protein, 35 aa, Staphylococcus epidermidis
VSYRISFKTSGLPTERLYYAAGGRALEFNQLYNYN

SEQ ID NO: 1843284 - protein, 28 aa, Staphylococcus epidermidis
VTAITGSGPAFLYHVFEQYVKAGTELGL

SEQ ID NO: 1843285 - protein, 23 aa, Staphylococcus epidermidis
VTGEGALAGIYKAYEEKGNDLNT

SEQ ID NO: 1843286 - protein, 32 aa, Staphylococcus epidermidis; identical to SEQ ID NO: 1753999

SEQ ID NO: 1843287 - protein, 26 aa, Staphylococcus epidermidis
VTYCSKLVWQSYYYGAGRLSVLPVVT

SEQ ID NO: 1843288 - protein, 27 aa, Staphylococcus epidermidis
VVIILICALGFSVYAAINHHTNSNKND

SEQ ID NO: 1843289 - protein, 30 aa, Staphylococcus epidermidis; identical to SEQ ID NO: 1841456

SEQ ID NO: 1843290 - protein, 18 aa, Staphylococcus epidermidis
VVIVISAVSLSACGKERT

SEQ ID NO: 1843291 - protein, 19 aa, Staphylococcus epidermidis
VVIVLSTVALTACSKERTK

SEQ ID NO: 1843292 - protein, 23 aa, Staphylococcus epidermidis
VYHGKMIKLQYKVTQGFVTSVTI

SEQ ID NO: 1843293 - protein, 17 aa, Staphylococcus epidermidis
WGGIKYNVKQELTKLGY

SEQ ID NO: 1843294 - protein, 18 aa, Staphylococcus epidermidis
WGGIKYNVKQELTKLGYR

SEQ ID NO: 1843295 - protein, 17 aa, Staphylococcus epidermidis
WIPLMMKGRENNSGVMA

SEQ ID NO: 1843296 - protein, 17 aa, Staphylococcus epidermidis
WKKCALGTGGSALGGAG

SEQ ID NO: 1843297 - protein, 17 aa, Staphylococcus epidermidis
YAFNRRAELGKPIGSLW

SEQ ID NO: 1843298 - protein, 26 aa, Staphylococcus epidermidis
YAGAYREWQPGQKIHLIGHSMGGQTV

SEQ ID NO: 1843299 - protein, 20 aa, Staphylococcus epidermidis
YARENNVPFFGICLGMQLAT

SEQ ID NO: 1843300 - protein, 19 aa, Staphylococcus epidermidis
YCSEIVWYSYYKAGKQYMI

SEQ ID NO: 1843301 - protein, 24 aa, Staphylococcus epidermidis
YCSKLVWQSYYYGAGLYSVSPISS

SEQ ID NO: 1843302 - protein, 24 aa, Staphylococcus epidermidis
YDANTGQAYLMQDKDRNFVDDEQR

SEQ ID NO: 1843303 - protein, 26 aa, Staphylococcus epidermidis
YDLMFNQTWGLLYDPQSTLAAFKTKT

SEQ ID NO: 1843304 - protein, 23 aa, Staphylococcus epidermidis
YDRAVELYYYIKGGKVDYGAAHA

SEQ ID NO: 1843305 - protein, 23 aa, Staphylococcus epidermidis
YDRAVELYYYIKGGRVDYGAAHA

SEQ ID NO: 1843306 - protein, 37 aa, Staphylococcus epidermidis
YFRHGAAHGYQFYNTPYYQLNKFWDFARGSDEFAPNS

SEQ ID NO: 1843307 - protein, 20 aa, Staphylococcus epidermidis
YHFIEPGDGYLACGYVAKGR

SEQ ID NO: 1843308 - protein, 17 aa, Staphylococcus epidermidis
YHGFKRFNTPSSIAKDL

SEQ ID NO: 1843309 - protein, 20 aa, Staphylococcus epidermidis
YIYSSATIEHKKWGKGVDVK

SEQ ID NO: 1843310 - protein, 24 aa, Staphylococcus epidermidis
YKAHDAYAKAYKKALNKEKELFTY

SEQ ID NO: 1843311 - protein, 29 aa, Staphylococcus epidermidis
YKQQKPIVFTAMEPSWFSKELDIKMLKDP

SEQ ID NO: 1843312 - protein, 26 aa, Staphylococcus epidermidis
YKSHDAYAKAYKKALNKEKQLFSYLN

SEQ ID NO: 1843313 - protein, 21 aa, Staphylococcus epidermidis
YKVYATMRNLNKQDTLLQIAQ

SEQ ID NO: 1843314 - protein, 25 aa, Staphylococcus epidermidis
YLLSTTLIMPTFTTQTAIAKDDSDA

SEQ ID NO: 1843315 - protein, 24 aa, Staphylococcus epidermidis
YLSFIFFIFSLMLFTNQSFANDNK

SEQ ID NO: 1843316 - protein, 25 aa, Staphylococcus epidermidis
YLSFIFFIFSLMLFTNQSFANDNKS

SEQ ID NO: 1843317 - protein, 17 aa, Staphylococcus epidermidis
YLSPFEGDRSQALQQLP

SEQ ID NO: 1843318 - protein, 17 aa, Staphylococcus epidermidis
YMESRGMFLYINRNTRT

SEQ ID NO: 1843319 - protein, 25 aa, Staphylococcus epidermidis
YNAKFVLDKQFRTALNKGKVTFNGI

SEQ ID NO: 1843320 - protein, 30 aa, Staphylococcus epidermidis
YNGFTYHFESDGNNWSWNYAQTGQATPQQD

SEQ ID NO: 1843321 - protein, 27 aa, Staphylococcus epidermidis
YNSKKFQNRFLFNLGIKHYNFNNDIRK

SEQ ID NO: 1843322 - protein, 23 aa, Staphylococcus epidermidis
YPGDKPLATMWESKGKILSINGN

SEQ ID NO: 1843323 - protein, 17 aa, Staphylococcus epidermidis
YQIELVRQYTFEDFAKS

SEQ ID NO: 1843324 - protein, 25 aa, Staphylococcus epidermidis
YRTTFELLNKLYPHLLNKVDDPNQM

SEQ ID NO: 1843325 - protein, 24 aa, Staphylococcus epidermidis
YRTTFELLTKIYKRLLTKIDKPEN

SEQ ID NO: 1843326 - protein, 17 aa, Staphylococcus epidermidis
YRYIGTLLKQHPHLSAY

SEQ ID NO: 1843327 - protein, 22 aa, Staphylococcus epidermidis
YSVPSHFQGSWRDADYSKRESQ

SEQ ID NO: 1843328 - protein, 26 aa, Staphylococcus epidermidis
YTIDQEGNYHYTWQGNWSPDRLDNNY

SEQ ID NO: 1843329 - protein, 27 aa, Staphylococcus epidermidis
YTIDQQGNYHYNWQGNWSPNQAQQGNN

SEQ ID NO: 1843330 - protein, 32 aa, Staphylococcus epidermidis
YTSQYMATSYYNNWLYFYIIASSSHDQQAKKD

SEQ ID NO: 1843331 - protein, 20 aa, Staphylococcus epidermidis
YVGQFLSQLGFKEALTDDVT

SEQ ID NO: 1843332 - protein, 20 aa, Staphylococcus epidermidis
YVSFANCGLPYYVAGEIGER

SEQ ID NO: 1843333 - protein, 17 aa, Staphylococcus epidermidis
YYGVYTADYIFIATGDY

SEQ ID NO: 1843334 - protein, 17 aa, Staphylococcus epidermidis
YYILVFNEKDNKASAEY

SEQ ID NO: 1843335 - protein, 29 aa, Staphylococcus epidermidis
YYPNAKTIVLKLLFHPTTGKIYGAQAIGE

SEQ ID NO: 1843336 - protein, 17 aa, Staphylococcus epidermidis
YYVFDKVGGKIGSTWGN

SEQ ID NO: 1843337 - protein, 28 aa, Staphylococcus epidermidis
NQAVFFTRQLWNMLVLARVITIGAYNRN

SEQ ID NO: 1843338 - protein, 25 aa, Staphylococcus epidermidis
AVILSICLVLLLFLATNQNALAKVH

SEQ ID NO: 1843339 - protein, 18 aa, Staphylococcus epidermidis
FFIACQFHPEFLSRPNRP

SEQ ID NO: 1843340 - protein, 18 aa, Staphylococcus epidermidis
GLNEIYLISHALVETGNG

SEQ ID NO: 1843341 - protein, 19 aa, Staphylococcus epidermidis
GNNIVKFFDYTLASVGIKP

SEQ ID NO: 1843342 - protein, 18 aa, Staphylococcus epidermidis
HIYELDPKLWYFSSGSST

SEQ ID NO: 1843343 - protein, 17 aa, Staphylococcus epidermidis
HMFSIQAGFRKYPSTKQ

SEQ ID NO: 1843344 - protein, 17 aa, Staphylococcus epidermidis
IISVIITGVSALRDKSH

SEQ ID NO: 1843345 - protein, 18 aa, Staphylococcus epidermidis
ILLGIILGVVVGYIVARN

SEQ ID NO: 1843346 - protein, 17 aa, Staphylococcus epidermidis
ITIMLAFTLSLALGLFF

SEQ ID NO: 1843347 - protein, 25 aa, Staphylococcus epidermidis
IVVLCAMIIFIALIGLSIRSQTQSP

SEQ ID NO: 1843348 - protein, 20 aa, Staphylococcus epidermidis
KGPDLYVYLTKNGDIKSGKK

SEQ ID NO: 1843349 - protein, 25 aa, Staphylococcus epidermidis
KQKADLNMFLPFTITGNLIGKAKEK

SEQ ID NO: 1843350 - protein, 20 aa, Staphylococcus epidermidis
KWYYGQLLDGKYVWIKSTDL

SEQ ID NO: 1843351 - protein, 22 aa, Staphylococcus epidermidis
LILLSFGLLVVPIIFATQLYQS

SEQ ID NO: 1843352 - protein, 18 aa, Staphylococcus epidermidis
LPSMVALTLFGTAFTAHQ

SEQ ID NO: 1843353 - protein, 19 aa, Staphylococcus epidermidis
MQLNGLTNFFIYPGQKLKV

SEQ ID NO: 1843354 - protein, 30 aa, Staphylococcus epidermidis; identical to SEQ ID NO: 1839756

SEQ ID NO: 1843355 - protein, 24 aa, Staphylococcus epidermidis
NDSSLKYQFLRLDQPQYLSAQALN

SEQ ID NO: 1843356 - protein, 17 aa, Staphylococcus epidermidis
NLPLIKYSFDQVIMTKE

SEQ ID NO: 1843357 - protein, 19 aa, Staphylococcus epidermidis
PSVLTHYWGGDKMNIRQDL

SEQ ID NO: 1843358 - protein, 26 aa, Staphylococcus epidermidis
RFVALILAVFFFLSVNNVFGNIFNTD

SEQ ID NO: 1843359 - protein, 23 aa, Staphylococcus epidermidis
TEDGFRYVFSFKDPSKSNTYSIV

SEQ ID NO: 1843360 - protein, 18 aa, Staphylococcus epidermidis
TVIFVSGIILAGCGSNKE

SEQ ID NO: 1843361 - protein, 25 aa, Staphylococcus epidermidis
VGASSILIAALLFMGGGSAQAAEQQ

SEQ ID NO: 1843362 - protein, 24 aa, Staphylococcus epidermidis
VQFSDIYLMALPTKAIREVSKDID

SEQ ID NO: 1843363 - protein, 22 aa, Staphylococcus epidermidis
YALSRPLFIYAKDKSLKDNKVM

SEQ ID NO: 1843364 - protein, 17 aa, Staphylococcus epidermidis
YLLSTALITPTFATQTA

SEQ ID NO: 1843365 - protein, 18 aa, Staphylococcus epidermidis
AGAYKDWKPGQKIHLIGH

SEQ ID NO: 1843366 - protein, 22 aa, Staphylococcus epidermidis
DAVSFIYIPIDGGYMSGSGVVV

SEQ ID NO: 1843367 - protein, 22 aa, Staphylococcus epidermidis
EKLKWIWITTLIILVVSLILAF

SEQ ID NO: 1843368 - protein, 17 aa, Staphylococcus epidermidis
FFVAVLTLALAACGKDS

SEQ ID NO: 1843369 - protein, 19 aa, Staphylococcus epidermidis
FLGLLATLALAIVLSACGN

SEQ ID NO: 1843370 - protein, 20 aa, Staphylococcus epidermidis
FLIGLSLIIICSVGVYAQNK

SEQ ID NO: 1843371 - protein, 18 aa, Staphylococcus epidermidis
IISCLLITTLWSRSLFDI

SEQ ID NO: 1843372 - protein, 23 aa, Staphylococcus epidermidis
KLAKEWINFLKSNKAKQILKEYQ

SEQ ID NO: 1843373 - protein, 23 aa, Staphylococcus epidermidis
LIIFIIFFASGAMTWFTIDKNKY

SEQ ID NO: 1843374 - protein, 20 aa, Staphylococcus epidermidis
LLFTIFSTTVLVLVIIYNKT

SEQ ID NO: 1843375 - protein, 20 aa, Staphylococcus epidermidis
LLLLIFLIACAPTSTSQSPH

SEQ ID NO: 1843376 - protein, 24 aa, Staphylococcus epidermidis
LVTKFLLPLMMKQGGSIINTASFS

SEQ ID NO: 1843377 - protein, 18 aa, Staphylococcus epidermidis
LYDLIYEKYLIKTKQVAP

SEQ ID NO: 1843378 - protein, 18 aa, Staphylococcus epidermidis
MILCMVLLYSCSGPMDSP

SEQ ID NO: 1843379 - protein, 26 aa, Staphylococcus epidermidis
PKATSYDIVFLFPKSMQLEEVLSHIQ

SEQ ID NO: 1843380 - protein, 21 aa, Staphylococcus epidermidis
QKVILIWNPWDNGLMTQDAHS

SEQ ID NO: 1843381 - protein, 18 aa, Staphylococcus epidermidis
RKFDYLVFPDNVAIVLGI

SEQ ID NO: 1843382 - protein, 28 aa, Staphylococcus epidermidis
SAIVVLLLLIGLAFGIYSFVDSSKKGNE

SEQ ID NO: 1843383 - protein, 17 aa, Staphylococcus epidermidis
TIRYLEELLRHGSPEEV

SEQ ID NO: 1843384 - protein, 17 aa, Staphylococcus epidermidis
VKHPLFEYARSFDFIII

SEQ ID NO: 1843385 - protein, 20 aa, Staphylococcus epidermidis
YLSFIFFIFSLMLFTNQSFA

SEQ ID NO: 1843386 - protein, 19 aa, Staphylococcus epidermidis
YNLFHIYPLFPIPERQRFL

SEQ ID NO: 1843387 - protein, 21 aa, Staphylococcus epidermidis
AELAMPRPYVFVSPKDFKHGT

SEQ ID NO: 1843388 - protein, 19 aa, Staphylococcus epidermidis
ENWTPTMEAFINALYEGIN

SEQ ID NO: 1843389 - protein, 20 aa, Staphylococcus epidermidis
GILVIIFQFVNHSGPFSGSE

SEQ ID NO: 1843390 - protein, 23 aa, Staphylococcus epidermidis
ILFFLIVMLGFAGGLGYSHYKDS

SEQ ID NO: 1843391 - protein, 20 aa, Staphylococcus epidermidis
ILFLLFTFVKEVRLSKHFYE

SEQ ID NO: 1843392 - protein, 18 aa, Staphylococcus epidermidis
IVLVLCLTVLSGCNLPGL

SEQ ID NO: 1843393 - protein, 24 aa, Staphylococcus epidermidis
MKKVTLSFVTLFIGVGTIGSYNQF

SEQ ID NO: 1843394 - protein, 17 aa, Staphylococcus epidermidis
PVTGKGNYWGGNRLKII

SEQ ID NO: 1843395 - protein, 17 aa, Staphylococcus epidermidis
QLLDGKYVWIKSTDLVK

SEQ ID NO: 1843396 - protein, 20 aa, Staphylococcus epidermidis
TGKGNYWGGNRLKIIQDYRA

SEQ ID NO: 1843397 - protein, 22 aa, Staphylococcus epidermidis
TGYFFNTAYLPDGALNKGNYSN

SEQ ID NO: 1843398 - protein, 25 aa, Staphylococcus epidermidis
VVIILICALGFSLYAAINHHTNSNK

SEQ ID NO: 1843399 - protein, 17 aa, Staphylococcus epidermidis
VVLVISAVSLSACGKER

SEQ ID NO: 1843400 - protein, 17 aa, Staphylococcus epidermidis
FFSMKKVTLSFVTLFIG

SEQ ID NO: 1843401 - protein, 20 aa, Staphylococcus epidermidis
GTEEIIYLGGPRSDLRNAIE

SEQ ID NO: 1843402 - protein, 22 aa, Staphylococcus epidermidis
HSNRYYAQVWLTALDSYRGESD

SEQ ID NO: 1843403 - protein, 17 aa, Staphylococcus epidermidis
ISKYYLTTASKPSNPTK

SEQ ID NO: 1843404 - protein, 27 aa, Staphylococcus epidermidis
ITLIGVLLIILAIYLFSKPYIDNYLHE

SEQ ID NO: 1843405 - protein, 20 aa, Staphylococcus epidermidis
LILIALSLIVLSGCSLPGLG

SEQ ID NO: 1843406 - protein, 22 aa, Staphylococcus epidermidis
LVIMFLITLLPIFQYQASAHAT

SEQ ID NO: 1843407 - protein, 20 aa, Staphylococcus epidermidis
NANIPLIRLMNKFELKKATN

SEQ ID NO: 1843408 - protein, 25 aa, Staphylococcus epidermidis
RHQNAILCYIYKFRARFAVLAHLVS

SEQ ID NO: 1843409 - protein, 17 aa, Staphylococcus epidermidis
SSLLFIFILTTCSFSYI

SEQ ID NO: 1843410 - protein, 17 aa, Staphylococcus epidermidis
SYAELYDLIYEKYLIKT

SEQ ID NO: 1843411 - protein, 17 aa, Staphylococcus epidermidis
TFIVFWGIGFFKYADAH

SEQ ID NO: 1843412 - protein, 26 aa, Staphylococcus epidermidis
TLIGVLLIILAIYLFSKPYIDNYLHE

SEQ ID NO: 1843413 - protein, 20 aa, Staphylococcus epidermidis
AELAMPRPYVFVSPKDFKHG

SEQ ID NO: 1843414 - protein, 25 aa, Staphylococcus epidermidis
AQFKNQYPVVFVHGFLGFAGDNQFS

SEQ ID NO: 1843415 - protein, 17 aa, Staphylococcus epidermidis
DGIKPLLAKKWDISPDG

SEQ ID NO: 1843416 - protein, 17 aa, Staphylococcus epidermidis
EIYLISHALVETGNGTS

SEQ ID NO: 1843417 - protein, 20 aa, Staphylococcus epidermidis
EKQLVGCGFTVKVPPEYLGG

SEQ ID NO: 1843418 - protein, 24 aa, Staphylococcus epidermidis
ELPNSSEILLLNLTSRIIGKDANK

SEQ ID NO: 1843419 - protein, 17 aa, Staphylococcus epidermidis
FASLLVLTACGQEEEKK

SEQ ID NO: 1843420 - protein, 19 aa, Staphylococcus epidermidis
GDNQFSLAPKYWGGTKYNI

SEQ ID NO: 1843421 - protein, 17 aa, Staphylococcus epidermidis
GVKWYYGQLLDGKYVWI

SEQ ID NO: 1843422 - protein, 18 aa, Staphylococcus epidermidis
LIIIFSIIIIASNDTFAE

SEQ ID NO: 1843423 - protein, 20 aa, Staphylococcus epidermidis
LLFIFILTTCSFSYITFSKL

SEQ ID NO: 1843424 - protein, 21 aa, Staphylococcus epidermidis
NANIPLIRLMNKFELKKATNQ

SEQ ID NO: 1843425 - protein, 27 aa, Staphylococcus epidermidis
NTLYTAIVLLVALVLLIFAVNSIQVEP

SEQ ID NO: 1843426 - protein, 21 aa, Staphylococcus epidermidis
PSIAMTLLLTGCVQKDNDHDE

SEQ ID NO: 1843427 - protein, 24 aa, Staphylococcus epidermidis
RHQNAILCYIYKFRARFAVLARIV

SEQ ID NO: 1843428 - protein, 17 aa, Staphylococcus epidermidis
SIILFAIVLTACGNDKS

SEQ ID NO: 1843429 - protein, 18 aa, Staphylococcus epidermidis
SIPHNFTFHLLFSNNKLK

SEQ ID NO: 1843430 - protein, 22 aa, Staphylococcus epidermidis
SSLLFIFILTTCSFSYITFSKL

SEQ ID NO: 1843431 - protein, 17 aa, Staphylococcus epidermidis
AELYDLIYEKYLIKTKQ

SEQ ID NO: 1843432 - protein, 19 aa, Staphylococcus epidermidis
AGAYKDWKPGQKIHLIGHS

SEQ ID NO: 1843433 - protein, 18 aa, Staphylococcus epidermidis
AILSSALLLTACGQDGDK

SEQ ID NO: 1843434 - protein, 17 aa, Staphylococcus epidermidis
ASLLAGGLLIARRKSLL

SEQ ID NO: 1843435 - protein, 28 aa, Staphylococcus epidermidis
ATTYYNNWLFYYIFAYSFLNQHEKKNSV

SEQ ID NO: 1843436 - protein, 18 aa, Staphylococcus epidermidis
DPIILVHGFNGYASGTGP

SEQ ID NO: 1843437 - protein, 23 aa, Staphylococcus epidermidis
ENSKKYLILSYFSKYIFGADIKN

SEQ ID NO: 1843438 - protein, 22 aa, Staphylococcus epidermidis
EVYDIVFLFPKSMQLKHVLEDI

SEQ ID NO: 1843439 - protein, 17 aa, Staphylococcus epidermidis
FASLLVLGACGQNGDNS

SEQ ID NO: 1843440 - protein, 18 aa, Staphylococcus epidermidis
FFSMKKVTLSFVTLFIGV

SEQ ID NO: 1843441 - protein, 17 aa, Staphylococcus epidermidis
FFSMKKVTLSFVTVFIG

SEQ ID NO: 1843442 - protein, 17 aa, Staphylococcus epidermidis
FFVAVLALSLAACGKDG

SEQ ID NO: 1843443 - protein, 17 aa, Staphylococcus epidermidis
FIACQFHPEFLSRPNRP

SEQ ID NO: 1843444 - protein, 18 aa, Staphylococcus epidermidis
FIIPLFAVILTACGNDDN

SEQ ID NO: 1843445 - protein, 22 aa, Staphylococcus epidermidis
FILILVFLLTSLGFGYHTYSKI

SEQ ID NO: 1843446 - protein, 17 aa, Staphylococcus epidermidis
FQNPQYLPRFVFGHYMK

SEQ ID NO: 1843447 - protein, 23 aa, Staphylococcus epidermidis
FYNTPYYQLNKFWDFARGSDEFA

SEQ ID NO: 1843448 - protein, 19 aa, Staphylococcus epidermidis
GKGNYWGGDRLKIIQDYRA

SEQ ID NO: 1843449 - protein, 19 aa, Staphylococcus epidermidis
GLPTERLYYAAGGRALEFN

SEQ ID NO: 1843450 - protein, 26 aa, Staphylococcus epidermidis
GLVLIMFVLCGFIFPLTVTALGQVLF

SEQ ID NO: 1843451 - protein, 18 aa, Staphylococcus epidermidis
GMITTSILLSCGITKNVQ

SEQ ID NO: 1843452 - protein, 22 aa, Staphylococcus epidermidis
GTKWNFLNFKPGLVGGHCIGVD

SEQ ID NO: 1843453 - protein, 22 aa, Staphylococcus epidermidis
GVLLSISICILMILLTGCGKSS

SEQ ID NO: 1843454 - protein, 19 aa, Staphylococcus epidermidis
GYNLFHIYPIFPIPERQRF

SEQ ID NO: 1843455 - protein, 26 aa, Staphylococcus epidermidis
HSNHENMIYWFAIPRDQTPAGPVTLT

SEQ ID NO: 1843456 - protein, 23 aa, Staphylococcus epidermidis
HSNKYYAQVWLTALDSYRGDSDL

SEQ ID NO: 1843457 - protein, 23 aa, Staphylococcus epidermidis
HSNRYYAQVWLTALDSYRGESDL

SEQ ID NO: 1843458 - protein, 24 aa, Staphylococcus epidermidis
HSNRYYAQVWLTALDSYRGESDLP

SEQ ID NO: 1843459 - protein, 18 aa, Staphylococcus epidermidis
HVPLIRLMNKFELLNASE

SEQ ID NO: 1843460 - protein, 20 aa, Staphylococcus epidermidis
IEKSIWYKLLVNLGINTITA

SEQ ID NO: 1843461 - protein, 22 aa, Staphylococcus epidermidis
IIFFLAFLFVSGLALATDLDTE

SEQ ID NO: 1843462 - protein, 18 aa, Staphylococcus epidermidis
IIILLVGLGIVPNVNDAF

SEQ ID NO: 1843463 - protein, 19 aa, Staphylococcus epidermidis
ILFLLFTFVKEVRLSKHFY

SEQ ID NO: 1843464 - protein, 18 aa, Staphylococcus epidermidis
ILIALSLLVLSGCSLPGL

SEQ ID NO: 1843465 - protein, 26 aa, Staphylococcus epidermidis
ILILIIVLFFLLRNYNPPNAQAKILV

SEQ ID NO: 1843466 - protein, 18 aa, Staphylococcus epidermidis
ILLGIILGVVVGYVVARN

SEQ ID NO: 1843467 - protein, 19 aa, Staphylococcus epidermidis
ILTMPYIFEKLFNYSDKKM

SEQ ID NO: 1843468 - protein, 19 aa, Staphylococcus epidermidis
IMFLITLLPIFQYQASAHA

SEQ ID NO: 1843469 - protein, 17 aa, Staphylococcus epidermidis
IPHNFTFHLLFSNNKLK

SEQ ID NO: 1843470 - protein, 17 aa, Staphylococcus epidermidis
ISLSSMFLFSACGQNSN

SEQ ID NO: 1843471 - protein, 17 aa, Staphylococcus epidermidis
ISTIIVSTLLIGGCSTV

SEQ ID NO: 1843472 - protein, 17 aa, Staphylococcus epidermidis
IVLKLLFHPTTGKIYGA

SEQ ID NO: 1843473 - protein, 20 aa, Staphylococcus epidermidis
IYISLLFLIILVIGCGDGKE

SEQ ID NO: 1843474 - protein, 22 aa, Staphylococcus epidermidis
KDKAQQIYYRALTDYLSSNSDF

SEQ ID NO: 1843475 - protein, 20 aa, Staphylococcus epidermidis
KENWTPTMEAFINALYEGIN

SEQ ID NO: 1843476 - protein, 18 aa, Staphylococcus epidermidis
KGNYWGGDRLKIIQDYRA

SEQ ID NO: 1843477 - protein, 18 aa, Staphylococcus epidermidis
KHPKVLILMGIPGSYLVA

SEQ ID NO: 1843478 - protein, 23 aa, Staphylococcus epidermidis
KIAKEWINFLKSNKAKQILKEYQ

SEQ ID NO: 1843479 - protein, 24 aa, Staphylococcus epidermidis
KKDYDLIFYRTYSDALMPYNFMNS

SEQ ID NO: 1843480 - protein, 22 aa, Staphylococcus epidermidis
KKLKWIWITTLIILVVALILAF

SEQ ID NO: 1843481 - protein, 24 aa, Staphylococcus epidermidis
KLAKEWMKFLKSDKAKKILKEYQF

SEQ ID NO: 1843482 - protein, 23 aa, Staphylococcus epidermidis
KLILLIGIILLSGISLYGCGKND

SEQ ID NO: 1843483 - protein, 17 aa, Staphylococcus epidermidis
KLVWQSYYYGAGRLSVL

SEQ ID NO: 1843484 - protein, 19 aa, Staphylococcus epidermidis
KTHLFLTPYGAKQYIERTG

SEQ ID NO: 1843485 - protein, 18 aa, Staphylococcus epidermidis
KYHGKYFAGLAKITYHST

SEQ ID NO: 1843486 - protein, 24 aa, Staphylococcus epidermidis
LAELAMPRPYVFVSPKDFKHGTTK

SEQ ID NO: 1843487 - protein, 18 aa, Staphylococcus epidermidis
LCGLLFPLTVTAIGQITF

SEQ ID NO: 1843488 - protein, 24 aa, Staphylococcus epidermidis
LCISFLLITFFIGGCGFINKDDSK

SEQ ID NO: 1843489 - protein, 19 aa, Staphylococcus epidermidis
LFIFILTTCSFSYITFSKL

SEQ ID NO: 1843490 - protein, 29 aa, Staphylococcus epidermidis
LIAILSIVFIGLVLFVVSFAKDTLFNNDT

SEQ ID NO: 1843491 - protein, 17 aa, Staphylococcus epidermidis
LIIAVILFVTACSKDKT

SEQ ID NO: 1843492 - protein, 22 aa, Staphylococcus epidermidis
LIIFIIFFASGTMTWFTIDKNK

SEQ ID NO: 1843493 - protein, 22 aa, Staphylococcus epidermidis
LILLTLVLVVGPILFATQLYKS

SEQ ID NO: 1843494 - protein, 17 aa, Staphylococcus epidermidis
LILMGIPGSYLVATDQS

SEQ ID NO: 1843495 - protein, 19 aa, Staphylococcus epidermidis
LILVALSLIVLSGCSLPGL

SEQ ID NO: 1843496 - protein, 19 aa, Staphylococcus epidermidis
LLFTIFSTTVLVLVIIYNK

SEQ ID NO: 1843497 - protein, 21 aa, Staphylococcus epidermidis
LLIGLSLIIICSVGVYAQNKK

SEQ ID NO: 1843498 - protein, 26 aa, Staphylococcus epidermidis
LLIIMSYKYLLLRYDILKITKQLDDL

SEQ ID NO: 1843499 - protein, 21 aa, Staphylococcus epidermidis
LPSMVALTLFGTAFTAHHAHA

SEQ ID NO: 1843500 - protein, 18 aa, Staphylococcus epidermidis
LQATLPYLLKQSSGHIIN

SEQ ID NO: 1843501 - protein, 19 aa, Staphylococcus epidermidis
LRKFDYLVFPDNVAIVLGI

SEQ ID NO: 1843502 - protein, 19 aa, Staphylococcus epidermidis
LSSFLILTACGNKDTSSTK

SEQ ID NO: 1843503 - protein, 21 aa, Staphylococcus epidermidis
LSSFLVLGACSHTDSSDKKET

SEQ ID NO: 1843504 - protein, 17 aa, Staphylococcus epidermidis
LVIMFLITLLPIFQYQA

SEQ ID NO: 1843505 - protein, 21 aa, Staphylococcus epidermidis
LVIMFLITLLPIFQYQASAHA

SEQ ID NO: 1843506 - protein, 26 aa, Staphylococcus epidermidis
LVVVLCAIIVFIALIGLSIRSQTQSP

SEQ ID NO: 1843507 - protein, 18 aa, Staphylococcus epidermidis
LYDLIYEKYLIKTGQVAP

SEQ ID NO: 1843508 - protein, 19 aa, Staphylococcus epidermidis
LYDLIYEKYLIKTGQVAPW

SEQ ID NO: 1843509 - protein, 17 aa, Staphylococcus epidermidis
MILCMVLLYSCSGPMDS

SEQ ID NO: 1843510 - protein, 21 aa, Staphylococcus epidermidis
MIVMFVLCGLLFPLTVTAIGQ

SEQ ID NO: 1843511 - protein, 29 aa, Staphylococcus epidermidis
MSLPTKILLWVVGILFLLTVIAVIYVGAK

SEQ ID NO: 1843512 - protein, 27 aa, Staphylococcus epidermidis
MTFIGILLIILAIYLFAKPHIDNYFHD

SEQ ID NO: 1843513 - protein, 17 aa, Staphylococcus epidermidis
NHDPIILVHGFNGYASG

SEQ ID NO: 1843514 - protein, 24 aa, Staphylococcus epidermidis
NITLEFYNTYVYKKGMPKFEEATS

SEQ ID NO: 1843515 - protein, 18 aa, Staphylococcus epidermidis
NSWPNGMYFDWAQGSSAP

SEQ ID NO: 1843516 - protein, 28 aa, Staphylococcus epidermidis
NTLYTAIVLLVALVLLIFAVNSIKVEPV

SEQ ID NO: 1843517 - protein, 25 aa, Staphylococcus epidermidis
PIKDNDWLIYGYPHTLRLEKSTGRN

SEQ ID NO: 1843518 - protein, 17 aa, Staphylococcus epidermidis
PITGKGNYWGGDRLKII

SEQ ID NO: 1843519 - protein, 26 aa, Staphylococcus epidermidis
PKDTSYDIVFLFPKSMQLEEVLSHIQ

SEQ ID NO: 1843520 - protein, 17 aa, Staphylococcus epidermidis
PSILTMPYIFEKLFNYS

SEQ ID NO: 1843521 - protein, 19 aa, Staphylococcus epidermidis
PTVLSHYWGGDKMNIRQDL

SEQ ID NO: 1843522 - protein, 21 aa, Staphylococcus epidermidis
QDPIILVHGFNGYASGTGPIT

SEQ ID NO: 1843523 - protein, 21 aa, Staphylococcus epidermidis
QEVILIWNPWDNGFMTQDAHS

SEQ ID NO: 1843524 - protein, 20 aa, Staphylococcus epidermidis
QNEYFYITYLSRNLKEYRKY

SEQ ID NO: 1843525 - protein, 22 aa, Staphylococcus epidermidis
QNVILCYIYKFRARFAVLARIV

SEQ ID NO: 1843526 - protein, 17 aa, Staphylococcus epidermidis
QSEVYDIVFLFPKSMQL

SEQ ID NO: 1843527 - protein, 18 aa, Staphylococcus epidermidis
QTIRYLEELLRHGSPEEV

SEQ ID NO: 1843528 - protein, 17 aa, Staphylococcus epidermidis
REFINPLPHISFVRGKN

SEQ ID NO: 1843529 - protein, 26 aa, Staphylococcus epidermidis
RFVALILAVFFFLSVNNVFGNVFNTD

SEQ ID NO: 1843530 - protein, 33 aa, Staphylococcus epidermidis
RKYNNKLIAVTISSLALVVPLAFGNAEADAAQT

SEQ ID NO: 1843531 - protein, 26 aa, Staphylococcus epidermidis
RQKADYNLFFPFTITANVIGKATEKE

SEQ ID NO: 1843532 - protein, 17 aa, Staphylococcus epidermidis
SIILYAIVLTACGNDKS

SEQ ID NO: 1843533 - protein, 19 aa, Staphylococcus epidermidis
SYAELYDLIYEKYLIKTKQ

SEQ ID NO: 1843534 - protein, 23 aa, Staphylococcus epidermidis
SYALSRPLFIYVKDKSLKDNKVM

SEQ ID NO: 1843535 - protein, 17 aa, Staphylococcus epidermidis
TCISLLLAGCSFNKHTN

SEQ ID NO: 1843536 - protein, 22 aa, Staphylococcus epidermidis
TGYFFNTAYLPEGALNKGNYSN

SEQ ID NO: 1843537 - protein, 22 aa, Staphylococcus epidermidis
TGYFFNTAYLPNGALNKGHYNN

SEQ ID NO: 1843538 - protein, 17 aa, Staphylococcus epidermidis
TIVIFAITLTACGSKST

SEQ ID NO: 1843539 - protein, 17 aa, Staphylococcus epidermidis
TKFLLPLMMDHGGSIIN

SEQ ID NO: 1843540 - protein, 25 aa, Staphylococcus epidermidis
TKKDYDLIFYRTYSDALMPYNFMSS

SEQ ID NO: 1843541 - protein, 18 aa, Staphylococcus epidermidis
TKTYRTWWFFEKTKKDEN

SEQ ID NO: 1843542 - protein, 17 aa, Staphylococcus epidermidis
TLLLTGCVQKDNDHDEA

SEQ ID NO: 1843543 - protein, 25 aa, Staphylococcus epidermidis
TLRKKKILILISTIILVLGLTYACT

SEQ ID NO: 1843544 - protein, 18 aa, Staphylococcus epidermidis
TLVLIIILVLSGCGKGKQ

SEQ ID NO: 1843545 - protein, 18 aa, Staphylococcus epidermidis
TLVPVKLYVKPQLQQKIS

SEQ ID NO: 1843546 - protein, 24 aa, Staphylococcus epidermidis
TQFSDIFLMALPTKAMREVASNID

SEQ ID NO: 1843547 - protein, 23 aa, Staphylococcus epidermidis
TSMLAIILLLCGCSTFKYGNTKK

SEQ ID NO: 1843548 - protein, 17 aa, Staphylococcus epidermidis
TVIILTIVVSACGNETK

SEQ ID NO: 1843549 - protein, 17 aa, Staphylococcus epidermidis
TVLLISGLILTGCGGNK

SEQ ID NO: 1843550 - protein, 19 aa, Staphylococcus epidermidis
VALLMIIGLSALFQINEAG

SEQ ID NO: 1843551 - protein, 21 aa, Staphylococcus epidermidis
VFASFLILMIFIVGCGSMTKE

SEQ ID NO: 1843552 - protein, 25 aa, Staphylococcus epidermidis
VGTSSILIAALLFIGGNSAQAAEEN

SEQ ID NO: 1843553 - protein, 19 aa, Staphylococcus epidermidis
VKNLPLIKYSFDQILMTKE

SEQ ID NO: 1843554 - protein, 23 aa, Staphylococcus epidermidis
VVIILICALGFSVYAAINHHTNS

SEQ ID NO: 1843555 - protein, 25 aa, Staphylococcus epidermidis
VVILLVIALSFSIYAAVNHKNNSSQ

SEQ ID NO: 1843556 - protein, 17 aa, Staphylococcus epidermidis
VVIVISAVSLSACGKER

SEQ ID NO: 1843557 - protein, 18 aa, Staphylococcus epidermidis
VVIVLSTVALTACSKERT

SEQ ID NO: 1843558 - protein, 17 aa, Staphylococcus epidermidis
VVYKTHLFLTPYGAKQY

SEQ ID NO: 1843559 - protein, 18 aa, Staphylococcus epidermidis
YLLSTTLIMPTFTTQTAI

SEQ ID NO: 1843560 - protein, 19 aa, Staphylococcus epidermidis
YLSFIFFIFSLMLFTNQSF

SEQ ID NO: 1843561 - protein, 18 aa, Staphylococcus epidermidis
YNLFHIYPLFPIPERQRF

SEQ ID NO: 1843562 - protein, 10 aa, Staphylococcus
QRAENNQKIY

SEQ ID NO: 1843563 - protein, 5 aa, Staphylococcus
SSLTE

SEQ ID NO: 1843564 - protein, 5 aa, Staphylococcus
SRGRT

SEQ ID NO: 1843565 - protein, 10 aa, Staphylococcus
VGPSGSGKST

SEQ ID NO: 1843566 - protein, 5 aa, Staphylococcus
IGPTL

SEQ ID NO: 1843567 - protein, 14 aa, Staphylococcus
KKLSEPETKNIYSQ

SEQ ID NO: 1843568 - protein, 6 aa, Staphylococcus
PPHPGP

SEQ ID NO: 1843569 - protein, 23 aa, Staphylococcus
SDLTGKATTTDPVEVTTDPNTKV

SEQ ID NO: 1843570 - protein, 6 aa, Staphylococcus
SKGRSI

SEQ ID NO: 1843571 - protein, 5 aa, Staphylococcus
AAGNA

SEQ ID NO: 1843572 - protein, 5 aa, Staphylococcus
ADSAT

SEQ ID NO: 1843573 - protein, 9 aa, Staphylococcus
AGADEEKQE

SEQ ID NO: 1843574 - protein, 6 aa, Staphylococcus
AGAGET

SEQ ID NO: 1843575 - protein, 13 aa, Staphylococcus
AGESENPERAVPK

SEQ ID NO: 1843576 - protein, 4 aa, Staphylococcus
AGGL

SEQ ID NO: 1843577 - protein, 11 aa, Staphylococcus
AGSRVGTGNIA

SEQ ID NO: 1843578 - protein, 9 aa, Staphylococcus
AGYGSESNY

SEQ ID NO: 1843579 - protein, 6 aa, Staphylococcus
AIGPTL

SEQ ID NO: 1843580 - protein, 5 aa, Staphylococcus
AMSTV

SEQ ID NO: 1843581 - protein, 6 aa, Staphylococcus
ANRQEI

SEQ ID NO: 1843582 - protein, 8 aa, Staphylococcus
APIPGRSA

SEQ ID NO: 1843583 - protein, 7 aa, Staphylococcus
EAPTPVS

SEQ ID NO: 1843584 - protein, 10 aa, Staphylococcus
EDHDNELTKE

SEQ ID NO: 1843585 - protein, 4 aa, Staphylococcus
FPPY

SEQ ID NO: 1843586 - protein, 5 aa, Staphylococcus
GAGIG

SEQ ID NO: 1843587 - protein, 9 aa, Staphylococcus
GEFSPGPGV

SEQ ID NO: 1843588 - protein, 4 aa, Staphylococcus
GGIG

SEQ ID NO: 1843589 - protein, 10 aa, Staphylococcus
GGPPSTTYGE

SEQ ID NO: 1843590 - protein, 5 aa, Staphylococcus
GNDEI

SEQ ID NO: 1843591 - protein, 6 aa, Staphylococcus
GNPGKA

SEQ ID NO: 1843592 - protein, 4 aa, Staphylococcus
GPFN

SEQ ID NO: 1843593 - protein, 8 aa, Staphylococcus
GPKSDQIK

SEQ ID NO: 1843594 - protein, 8 aa, Staphylococcus
GPPGTGKT

SEQ ID NO: 1843595 - protein, 8 aa, Staphylococcus
GSPAAGWT

SEQ ID NO: 1843596 - protein, 8 aa, Staphylococcus
GSTGSGKS

SEQ ID NO: 1843597 - protein, 4 aa, Staphylococcus
GTIT

SEQ ID NO: 1843598 - protein, 7 aa, Staphylococcus
GVGGGAT

SEQ ID NO: 1843599 - protein, 11 aa, Staphylococcus
HMKNGQLKPGY

SEQ ID NO: 1843600 - protein, 12 aa, Staphylococcus
IKPADKNHPYGH

SEQ ID NO: 1843601 - protein, 4 aa, Staphylococcus
IKWT

SEQ ID NO: 1843602 - protein, 5 aa, Staphylococcus
IPDNE

SEQ ID NO: 1843603 - protein, 6 aa, Staphylococcus
IPQTAE

SEQ ID NO: 1843604 - protein, 14 aa, Staphylococcus
IQNHESKMNEDSKA

SEQ ID NO: 1843605 - protein, 8 aa, Staphylococcus
ISGPTGAL

SEQ ID NO: 1843606 - protein, 13 aa, Staphylococcus
KARSRDSGGTGLG

SEQ ID NO: 1843607 - protein, 13 aa, Staphylococcus
KDRNSYSKTDHDA

SEQ ID NO: 1843608 - protein, 4 aa, Staphylococcus
KEIE

SEQ ID NO: 1843609 - protein, 9 aa, Staphylococcus
KIKKYKKQI

SEQ ID NO: 1843610 - protein, 9 aa, Staphylococcus
KLSGGQRQR

SEQ ID NO: 1843611 - protein, 7 aa, Staphylococcus
KNPPINE

SEQ ID NO: 1843612 - protein, 17 aa, Staphylococcus
KRVQEAQANTESEKRRL

SEQ ID NO: 1843613 - protein, 8 aa, Staphylococcus
KTKKYKSD

SEQ ID NO: 1843614 - protein, 5 aa, Staphylococcus
KYGYK

SEQ ID NO: 1843615 - protein, 10 aa, Staphylococcus
MSGNSGTQSL

SEQ ID NO: 1843616 - protein, 4 aa, Staphylococcus
NIPS

SEQ ID NO: 1843617 - protein, 8 aa, Staphylococcus
NKLPRAGR

SEQ ID NO: 1843618 - protein, 11 aa, Staphylococcus
NNEKCTKTRKQ

SEQ ID NO: 1843619 - protein, 8 aa, Staphylococcus
NQKPSYKT

SEQ ID NO: 1843620 - protein, 5 aa, Staphylococcus
NRPDI

SEQ ID NO: 1843621 - protein, 8 aa, Staphylococcus
NSKTNKKI

SEQ ID NO: 1843622 - protein, 8 aa, Staphylococcus
NTKKQIGG

SEQ ID NO: 1843623 - protein, 4 aa, Staphylococcus
PDKM

SEQ ID NO: 1843624 - protein, 8 aa, Staphylococcus
PEGGAQTH

SEQ ID NO: 1843625 - protein, 4 aa, Staphylococcus
PFGT

SEQ ID NO: 1843626 - protein, 5 aa, Staphylococcus
PNKHR

SEQ ID NO: 1843627 - protein, 7 aa, Staphylococcus
PRGQAGG

SEQ ID NO: 1843628 - protein, 7 aa, Staphylococcus
QKASTSL

SEQ ID NO: 1843629 - protein, 8 aa, Staphylococcus
QKPSQKKI

SEQ ID NO: 1843630 - protein, 4 aa, Staphylococcus
QNGC

SEQ ID NO: 1843631 - protein, 7 aa, Staphylococcus
QNPTDTR

SEQ ID NO: 1843632 - protein, 5 aa, Staphylococcus
QRPSV

SEQ ID NO: 1843633 - protein, 12 aa, Staphylococcus
QTVEMSKGNYTQ

SEQ ID NO: 1843634 - protein, 7 aa, Staphylococcus
SAGASDM

SEQ ID NO: 1843635 - protein, 5 aa, Staphylococcus
SDDID

SEQ ID NO: 1843636 - protein, 7 aa, Staphylococcus
SGGGKST

SEQ ID NO: 1843637 - protein, 4 aa, Staphylococcus
SNGM

SEQ ID NO: 1843638 - protein, 9 aa, Staphylococcus
SPTGNSAAV

SEQ ID NO: 1843639 - protein, 9 aa, Staphylococcus
SRSGSTIST

SEQ ID NO: 1843640 - protein, 7 aa, Staphylococcus
SSGPIDR

SEQ ID NO: 1843641 - protein, 12 aa, Staphylococcus
SSPSSVGGGIRT

SEQ ID NO: 1843642 - protein, 4 aa, Staphylococcus
STGV

SEQ ID NO: 1843643 - protein, 5 aa, Staphylococcus
TDDTK

SEQ ID NO: 1843644 - protein, 4 aa, Staphylococcus
TRNQ

SEQ ID NO: 1843645 - protein, 18 aa, Staphylococcus
VGDPDSGKYEPKVTPITK

SEQ ID NO: 1843646 - protein, 4 aa, Staphylococcus
VGGT

SEQ ID NO: 1843647 - protein, 20 aa, Staphylococcus
VGRQRGAGVGGGHDEREQTL

SEQ ID NO: 1843648 - protein, 6 aa, Staphylococcus
YPGLEG

SEQ ID NO: 1843649 - protein, 11 aa, Staphylococcus
AAINPGNSGGA

SEQ ID NO: 1843650 - protein, 7 aa, Staphylococcus
AAPTPVS

SEQ ID NO: 1843651 - protein, 11 aa, Staphylococcus
AASATNSGIYS

SEQ ID NO: 1843652 - protein, 8 aa, Staphylococcus
ASSCNSGI

SEQ ID NO: 1843653 - protein, 7 aa, Staphylococcus
ASSRAMK

SEQ ID NO: 1843654 - protein, 7 aa, Staphylococcus
ATGKTNT

SEQ ID NO: 1843655 - protein, 11 aa, Staphylococcus
DGGEGGTGATF

SEQ ID NO: 1843656 - protein, 8 aa, Staphylococcus
DKSLGEGI

SEQ ID NO: 1843657 - protein, 5 aa, Staphylococcus
EIQPE

SEQ ID NO: 1843658 - protein, 7 aa, Staphylococcus
EKSVGYR

SEQ ID NO: 1843659 - protein, 4 aa, Staphylococcus
FATG

SEQ ID NO: 1843660 - protein, 4 aa, Staphylococcus
GGGA

SEQ ID NO: 1843661 - protein, 5 aa, Staphylococcus
GGGTG

SEQ ID NO: 1843662 - protein, 6 aa, Staphylococcus
GHHRLN

SEQ ID NO: 1843663 - protein, 9 aa, Staphylococcus
GKEPGQGVG

SEQ ID NO: 1843664 - protein, 6 aa, Staphylococcus
GPGSFS

SEQ ID NO: 1843665 - protein, 7 aa, Staphylococcus
GQRTTST

SEQ ID NO: 1843666 - protein, 5 aa, Staphylococcus
GSAIG

SEQ ID NO: 1843667 - protein, 6 aa, Staphylococcus
GTGTEV

SEQ ID NO: 1843668 - protein, 5 aa, Staphylococcus
GVGDT

SEQ ID NO: 1843669 - protein, 8 aa, Staphylococcus
HNNPGGGF

SEQ ID NO: 1843670 - protein, 6 aa, Staphylococcus
IEANAN

SEQ ID NO: 1843671 - protein, 7 aa, Staphylococcus
KKAPGHA

SEQ ID NO: 1843672 - protein, 6 aa, Staphylococcus
KTPITS

SEQ ID NO: 1843673 - protein, 5 aa, Staphylococcus
KVPEG

SEQ ID NO: 1843674 - protein, 4 aa, Staphylococcus
LTSV

SEQ ID NO: 1843675 - protein, 9 aa, Staphylococcus
MSPLSDTTN

SEQ ID NO: 1843676 - protein, 7 aa, Staphylococcus
NINGSKS

SEQ ID NO: 1843677 - protein, 6 aa, Staphylococcus
NNPGGL

SEQ ID NO: 1843678 - protein, 6 aa, Staphylococcus
PAADPE

SEQ ID NO: 1843679 - protein, 10 aa, Staphylococcus
PANGAAADLS

SEQ ID NO: 1843680 - protein, 9 aa, Staphylococcus
PKGQTEAAY

SEQ ID NO: 1843681 - protein, 7 aa, Staphylococcus
PNKTNTL

SEQ ID NO: 1843682 - protein, 6 aa, Staphylococcus
PPFSGF

SEQ ID NO: 1843683 - protein, 7 aa, Staphylococcus
PTADATV

SEQ ID NO: 1843684 - protein, 7 aa, Staphylococcus
RGATSYH

SEQ ID NO: 1843685 - protein, 7 aa, Staphylococcus
RNPLASP

SEQ ID NO: 1843686 - protein, 5 aa, Staphylococcus
RPDLD

SEQ ID NO: 1843687 - protein, 11 aa, Staphylococcus
SDLGPKITPIG

SEQ ID NO: 1843688 - protein, 4 aa, Staphylococcus
SGLS

SEQ ID NO: 1843689 - protein, 5 aa, Staphylococcus
SGQKI

SEQ ID NO: 1843690 - protein, 10 aa, Staphylococcus
SGQNSTITGT

SEQ ID NO: 1843691 - protein, 8 aa, Staphylococcus
SGSGQALT

SEQ ID NO: 1843692 - protein, 20 aa, Staphylococcus
SIREEGPQSHMKKTGTPTMG

SEQ ID NO: 1843693 - protein, 4 aa, Staphylococcus
SLGG

SEQ ID NO: 1843694 - protein, 4 aa, Staphylococcus
SSSG

SEQ ID NO: 1843695 - protein, 5 aa, Staphylococcus
TEPYS

SEQ ID NO: 1843696 - protein, 11 aa, Staphylococcus
TEQQQVERERR

SEQ ID NO: 1843697 - protein, 4 aa, Staphylococcus
TGSL

SEQ ID NO: 1843698 - protein, 6 aa, Staphylococcus
TSPIDL

SEQ ID NO: 1843699 - protein, 9 aa, Staphylococcus
TTAASGTSH

SEQ ID NO: 1843700 - protein, 10 aa, Staphylococcus
TYPDGSKDHV

SEQ ID NO: 1843701 - protein, 4 aa, Staphylococcus
VEQT

SEQ ID NO: 1843702 - protein, 8 aa, Staphylococcus
VKEEEKQS

SEQ ID NO: 1843703 - protein, 7 aa, Staphylococcus
VNGKEVT

SEQ ID NO: 1843704 - protein, 9 aa, Staphylococcus
VSPTTAGTM

SEQ ID NO: 1843705 - protein, 5 aa, Staphylococcus
VTSGI

SEQ ID NO: 1843706 - protein, 4 aa, Staphylococcus
WGGS

SEQ ID NO: 1843707 - protein, 7 aa, Staphylococcus
YASSTAE

SEQ ID NO: 1843708 - protein, 6 aa, Staphylococcus
YTPGGG

SEQ ID NO: 1843709 - protein, 7 aa, Staphylococcus
AAAGGYG

SEQ ID NO: 1843710 - protein, 5 aa, Staphylococcus
AAQRA

SEQ ID NO: 1843711 - protein, 4 aa, Staphylococcus
AATS

SEQ ID NO: 1843712 - protein, 5 aa, Staphylococcus
AESNA

SEQ ID NO: 1843713 - protein, 6 aa, Staphylococcus
AGASIP

SEQ ID NO: 1843714 - protein, 6 aa, Staphylococcus
ANNGYR

SEQ ID NO: 1843715 - protein, 9 aa, Staphylococcus
AQGGGGGGR

SEQ ID NO: 1843716 - protein, 6 aa, Staphylococcus
ASIYGA

SEQ ID NO: 1843717 - protein, 6 aa, Staphylococcus
ASVSGS

SEQ ID NO: 1843718 - protein, 7 aa, Staphylococcus
ATARAGA

SEQ ID NO: 1843719 - protein, 6 aa, Staphylococcus
ATMPGS

SEQ ID NO: 1843720 - protein, 4 aa, Staphylococcus
ATPI

SEQ ID NO: 1843721 - protein, 5 aa, Staphylococcus
ATTTS

SEQ ID NO: 1843722 - protein, 7 aa, Staphylococcus
AVSNEQL

SEQ ID NO: 1843723 - protein, 7 aa, Staphylococcus
DANQERK

SEQ ID NO: 1843724 - protein, 8 aa, Staphylococcus
DPAVASGP

SEQ ID NO: 1843725 - protein, 4 aa, Staphylococcus
DPSL

SEQ ID NO: 1843726 - protein, 5 aa, Staphylococcus
DQTGV

SEQ ID NO: 1843727 - protein, 21 aa, Staphylococcus
DTTAPTVKEISDQTKEVNTEI

SEQ ID NO: 1843728 - protein, 6 aa, Staphylococcus
EAESEV

SEQ ID NO: 1843729 - protein, 8 aa, Staphylococcus
EATNHEST

SEQ ID NO: 1843730 - protein, 5 aa, Staphylococcus
EDEAN

SEQ ID NO: 1843731 - protein, 9 aa, Staphylococcus
EEASEDYSR

SEQ ID NO: 1843732 - protein, 18 aa, Staphylococcus
EGKSNGLSGAISGGAEQL

SEQ ID NO: 1843733 - protein, 6 aa, Staphylococcus
EHLGSA

SEQ ID NO: 1843734 - protein, 7 aa, Staphylococcus
ESNVKET

SEQ ID NO: 1843735 - protein, 5 aa, Staphylococcus
EVENA

SEQ ID NO: 1843736 - protein, 15 aa, Staphylococcus
EVSTGASNDFERATQ

SEQ ID NO: 1843737 - protein, 12 aa, Staphylococcus
FSHGTNDAQKSM

SEQ ID NO: 1843738 - protein, 5 aa, Staphylococcus
FSTGQ

SEQ ID NO: 1843739 - protein, 12 aa, Staphylococcus
FTTSGKKRRGFR

SEQ ID NO: 1843740 - protein, 8 aa, Staphylococcus
GFAGGELK

SEQ ID NO: 1843741 - protein, 7 aa, Staphylococcus
GGGTSGL

SEQ ID NO: 1843742 - protein, 9 aa, Staphylococcus
GGKAVATSA

SEQ ID NO: 1843743 - protein, 8 aa, Staphylococcus
GGTTAGTT

SEQ ID NO: 1843744 - protein, 7 aa, Staphylococcus
GIKRPEE

SEQ ID NO: 1843745 - protein, 4 aa, Staphylococcus
GLAR

SEQ ID NO: 1843746 - protein, 9 aa, Staphylococcus
GLDDHTSVG

SEQ ID NO: 1843747 - protein, 4 aa, Staphylococcus
GNDT

SEQ ID NO: 1843748 - protein, 4 aa, Staphylococcus
GPTT

SEQ ID NO: 1843749 - protein, 9 aa, Staphylococcus
GTPGGNKIP

SEQ ID NO: 1843750 - protein, 4 aa, Staphylococcus
GTVD

SEQ ID NO: 1843751 - protein, 13 aa, Staphylococcus
HNRESQSTTGIGE

SEQ ID NO: 1843752 - protein, 5 aa, Staphylococcus
IEVPN

SEQ ID NO: 1843753 - protein, 4 aa, Staphylococcus
IQPT

SEQ ID NO: 1843754 - protein, 8 aa, Staphylococcus
ISENHNNA

SEQ ID NO: 1843755 - protein, 4 aa, Staphylococcus
ISPQ

SEQ ID NO: 1843756 - protein, 11 aa, Staphylococcus
ISQRTPGFSGA

SEQ ID NO: 1843757 - protein, 6 aa, Staphylococcus
ISSGAD

SEQ ID NO: 1843758 - protein, 8 aa, Staphylococcus
ITGTRGAT

SEQ ID NO: 1843759 - protein, 8 aa, Staphylococcus
KDDASGLA

SEQ ID NO: 1843760 - protein, 7 aa, Staphylococcus
KEVPPNI

SEQ ID NO: 1843761 - protein, 6 aa, Staphylococcus
KEYKHA

SEQ ID NO: 1843762 - protein, 6 aa, Staphylococcus
KGAGHS

SEQ ID NO: 1843763 - protein, 8 aa, Staphylococcus
KGLDSGTA

SEQ ID NO: 1843764 - protein, 6 aa, Staphylococcus
KGRYHG

SEQ ID NO: 1843765 - protein, 7 aa, Staphylococcus
KNESGQL

SEQ ID NO: 1843766 - protein, 6 aa, Staphylococcus
KRIRPE

SEQ ID NO: 1843767 - protein, 8 aa, Staphylococcus
KYSRGDKR

SEQ ID NO: 1843768 - protein, 18 aa, Staphylococcus
LGGPTGYAINPARDLGPR

SEQ ID NO: 1843769 - protein, 11 aa, Staphylococcus
LGKPNDKPEFN

SEQ ID NO: 1843770 - protein, 5 aa, Staphylococcus
LKGSD

SEQ ID NO: 1843771 - protein, 10 aa, Staphylococcus
LTEGNAAPIT

SEQ ID NO: 1843772 - protein, 5 aa, Staphylococcus
LTESA

SEQ ID NO: 1843773 - protein, 6 aa, Staphylococcus
MKTEGK

SEQ ID NO: 1843774 - protein, 4 aa, Staphylococcus
MPIS

SEQ ID NO: 1843775 - protein, 10 aa, Staphylococcus
MQGEPNYSGQ

SEQ ID NO: 1843776 - protein, 14 aa, Staphylococcus
NDENITVNESVPRG

SEQ ID NO: 1843777 - protein, 22 aa, Staphylococcus
NDLTGKATTKTPITVTTDPNTH

SEQ ID NO: 1843778 - protein, 10 aa, Staphylococcus
NISQNEDKIS

SEQ ID NO: 1843779 - protein, 4 aa, Staphylococcus
NKAN

SEQ ID NO: 1843780 - protein, 8 aa, Staphylococcus
NKDTMSGT

SEQ ID NO: 1843781 - protein, 8 aa, Staphylococcus
NNQGLTSK

SEQ ID NO: 1843782 - protein, 9 aa, Staphylococcus
NPHKASQAL

SEQ ID NO: 1843783 - protein, 6 aa, Staphylococcus
NPPYGD

SEQ ID NO: 1843784 - protein, 5 aa, Staphylococcus
NSTFT

SEQ ID NO: 1843785 - protein, 6 aa, Staphylococcus
NTVGGV

SEQ ID NO: 1843786 - protein, 8 aa, Staphylococcus
NYSKTYGS

SEQ ID NO: 1843787 - protein, 7 aa, Staphylococcus
PKGGGAY

SEQ ID NO: 1843788 - protein, 4 aa, Staphylococcus
PKGI

SEQ ID NO: 1843789 - protein, 7 aa, Staphylococcus
PPGSAPV

SEQ ID NO: 1843790 - protein, 7 aa, Staphylococcus
PSSSSHA

SEQ ID NO: 1843791 - protein, 4 aa, Staphylococcus
PTPV

SEQ ID NO: 1843792 - protein, 7 aa, Staphylococcus
PTTGSFA

SEQ ID NO: 1843793 - protein, 12 aa, Staphylococcus
PYGKQGLQALSG

SEQ ID NO: 1843794 - protein, 6 aa, Staphylococcus
QAIETT

SEQ ID NO: 1843795 - protein, 5 aa, Staphylococcus
QHPPE

SEQ ID NO: 1843796 - protein, 7 aa, Staphylococcus
QPVPPPW

SEQ ID NO: 1843797 - protein, 9 aa, Staphylococcus
QSTISSSLN

SEQ ID NO: 1843798 - protein, 7 aa, Staphylococcus
RDYSQGT

SEQ ID NO: 1843799 - protein, 5 aa, Staphylococcus
RTPLT

SEQ ID NO: 1843800 - protein, 13 aa, Staphylococcus
SEIPNEAPQETPV

SEQ ID NO: 1843801 - protein, 12 aa, Staphylococcus
SEMEKTSWPTKE

SEQ ID NO: 1843802 - protein, 8 aa, Staphylococcus
SHRNNGAA

SEQ ID NO: 1843803 - protein, 6 aa, Staphylococcus
SITNPI

SEQ ID NO: 1843804 - protein, 7 aa, Staphylococcus
SKAVHTK

SEQ ID NO: 1843805 - protein, 4 aa, Staphylococcus
SNRI

SEQ ID NO: 1843806 - protein, 10 aa, Staphylococcus
SQKKVIGEPL

SEQ ID NO: 1843807 - protein, 10 aa, Staphylococcus
SSGASSLTGV

SEQ ID NO: 1843808 - protein, 8 aa, Staphylococcus
SSTRNIEG

SEQ ID NO: 1843809 - protein, 7 aa, Staphylococcus
STDAELK

SEQ ID NO: 1843810 - protein, 7 aa, Staphylococcus
STKAYTA

SEQ ID NO: 1843811 - protein, 5 aa, Staphylococcus
SVYST

SEQ ID NO: 1843812 - protein, 5 aa, Staphylococcus
TPITA

SEQ ID NO: 1843813 - protein, 5 aa, Staphylococcus
TRQPK

SEQ ID NO: 1843814 - protein, 4 aa, Staphylococcus
TSAN

SEQ ID NO: 1843815 - protein, 4 aa, Staphylococcus
TSSG

SEQ ID NO: 1843816 - protein, 4 aa, Staphylococcus
TSVG

SEQ ID NO: 1843817 - protein, 13 aa, Staphylococcus
VDKPRNLAKSVTV

SEQ ID NO: 1843818 - protein, 15 aa, Staphylococcus
VIGSGTTDSNGRVTI

SEQ ID NO: 1843819 - protein, 4 aa, Staphylococcus
VSED

SEQ ID NO: 1843820 - protein, 4 aa, Staphylococcus
VYTT

SEQ ID NO: 1843821 - protein, 4 aa, Staphylococcus
YARG

SEQ ID NO: 1843822 - protein, 8 aa, Staphylococcus
YENEDKYD

SEQ ID NO: 1843823 - protein, 6 aa, Staphylococcus
YGSGMT

SEQ ID NO: 1843824 - protein, 16 aa, Staphylococcus
AANSAEAINPQKTMPR

SEQ ID NO: 1843825 - protein, 7 aa, Staphylococcus
AATKQNT

SEQ ID NO: 1843826 - protein, 10 aa, Staphylococcus
ADGGGANRIA

SEQ ID NO: 1843827 - protein, 6 aa, Staphylococcus
ADSTTH

SEQ ID NO: 1843828 - protein, 6 aa, Staphylococcus
AETYRV

SEQ ID NO: 1843829 - protein, 6 aa, Staphylococcus
AGASDM

SEQ ID NO: 1843830 - protein, 6 aa, Staphylococcus
AGGCSI

SEQ ID NO: 1843831 - protein, 4 aa, Staphylococcus
AGGG

SEQ ID NO: 1843832 - protein, 10 aa, Staphylococcus
AGNRQGFAGG

SEQ ID NO: 1843833 - protein, 8 aa, Staphylococcus
AGNSGMYA

SEQ ID NO: 1843834 - protein, 6 aa, Staphylococcus
AGQLGK

SEQ ID NO: 1843835 - protein, 8 aa, Staphylococcus
AGTKESAG

SEQ ID NO: 1843836 - protein, 7 aa, Staphylococcus
AHGGPVS

SEQ ID NO: 1843837 - protein, 6 aa, Staphylococcus
AIGSGQ

SEQ ID NO: 1843838 - protein, 6 aa, Staphylococcus
AISNSI

SEQ ID NO: 1843839 - protein, 4 aa, Staphylococcus
AKDT

SEQ ID NO: 1843840 - protein, 5 aa, Staphylococcus
AKKNA

SEQ ID NO: 1843841 - protein, 5 aa, Staphylococcus
AKNRD

SEQ ID NO: 1843842 - protein, 7 aa, Staphylococcus
ANSGIYT

SEQ ID NO: 1843843 - protein, 6 aa, Staphylococcus
APGGMS

SEQ ID NO: 1843844 - protein, 13 aa, Staphylococcus
APREATGDNWDGL

SEQ ID NO: 1843845 - protein, 7 aa, Staphylococcus
ASAIPPK

SEQ ID NO: 1843846 - protein, 4 aa, Staphylococcus
ASPF

SEQ ID NO: 1843847 - protein, 7 aa, Staphylococcus
ASSCNSG

SEQ ID NO: 1843848 - protein, 7 aa, Staphylococcus
ATDRRGR

SEQ ID NO: 1843849 - protein, 8 aa, Staphylococcus
ATEQQDET

SEQ ID NO: 1843850 - protein, 8 aa, Staphylococcus
ATGQGRGA

SEQ ID NO: 1843851 - protein, 7 aa, Staphylococcus
ATKQQDL

SEQ ID NO: 1843852 - protein, 5 aa, Staphylococcus
ATSLS

SEQ ID NO: 1843853 - protein, 10 aa, Staphylococcus
ATTDPKKEKA

SEQ ID NO: 1843854 - protein, 9 aa, Staphylococcus
ATTRSAGLQ

SEQ ID NO: 1843855 - protein, 11 aa, Staphylococcus
AVEKSAYDTLT

SEQ ID NO: 1843856 - protein, 15 aa, Staphylococcus
DANDSVKREKGQRGL

SEQ ID NO: 1843857 - protein, 8 aa, Staphylococcus
DEFDDDEV

SEQ ID NO: 1843858 - protein, 14 aa, Staphylococcus
DFGTPTTTDDVTKA

SEQ ID NO: 1843859 - protein, 15 aa, Staphylococcus
DGNIIGSGTTDDTGH

SEQ ID NO: 1843860 - protein, 6 aa, Staphylococcus
DKGDLK

SEQ ID NO: 1843861 - protein, 7 aa, Staphylococcus
DKKPELK

SEQ ID NO: 1843862 - protein, 8 aa, Staphylococcus
DKNSTYRY

SEQ ID NO: 1843863 - protein, 6 aa, Staphylococcus
DKPGLV

SEQ ID NO: 1843864 - protein, 5 aa, Staphylococcus
DPVGP

SEQ ID NO: 1843865 - protein, 7 aa, Staphylococcus
DSEDIDT

SEQ ID NO: 1843866 - protein, 6 aa, Staphylococcus
DSEKAR

SEQ ID NO: 1843867 - protein, 5 aa, Staphylococcus
DSNTG

SEQ ID NO: 1843868 - protein, 20 aa, Staphylococcus
DTTAPTVKEISDQTKEVNTA

SEQ ID NO: 1843869 - protein, 20 aa, Staphylococcus
EAGMGSAPNAAATAAVPHPV

SEQ ID NO: 1843870 - protein, 10 aa, Staphylococcus
EAGNKGWGST

SEQ ID NO: 1843871 - protein, 9 aa, Staphylococcus
EDEAEAEDN

SEQ ID NO: 1843872 - protein, 7 aa, Staphylococcus
EDTAGGI

SEQ ID NO: 1843873 - protein, 5 aa, Staphylococcus
EEATD

SEQ ID NO: 1843874 - protein, 7 aa, Staphylococcus
EETGSIS

SEQ ID NO: 1843875 - protein, 6 aa, Staphylococcus
EGDTSQ

SEQ ID NO: 1843876 - protein, 10 aa, Staphylococcus
EGSASASEVF

SEQ ID NO: 1843877 - protein, 6 aa, Staphylococcus
EHAGPA

SEQ ID NO: 1843878 - protein, 5 aa, Staphylococcus
EIEEI

SEQ ID NO: 1843879 - protein, 7 aa, Staphylococcus
EIQENND

SEQ ID NO: 1843880 - protein, 7 aa, Staphylococcus
EKADHEI

SEQ ID NO: 1843881 - protein, 8 aa, Staphylococcus
EKGVENVT

SEQ ID NO: 1843882 - protein, 9 aa, Staphylococcus
EPPFNGETA

SEQ ID NO: 1843883 - protein, 6 aa, Staphylococcus
ERPQNL

SEQ ID NO: 1843884 - protein, 8 aa, Staphylococcus
ETDRFDGK

SEQ ID NO: 1843885 - protein, 6 aa, Staphylococcus
ETDRPE

SEQ ID NO: 1843886 - protein, 4 aa, Staphylococcus
ETGA

SEQ ID NO: 1843887 - protein, 5 aa, Staphylococcus
ETIQS

SEQ ID NO: 1843888 - protein, 4 aa, Staphylococcus
FGEN

SEQ ID NO: 1843889 - protein, 5 aa, Staphylococcus
FSPNK

SEQ ID NO: 1843890 - protein, 4 aa, Staphylococcus
FTPE

SEQ ID NO: 1843891 - protein, 6 aa, Staphylococcus
GAGQVG

SEQ ID NO: 1843892 - protein, 8 aa, Staphylococcus
GATPGLGG

SEQ ID NO: 1843893 - protein, 7 aa, Staphylococcus
GATPNAM

SEQ ID NO: 1843894 - protein, 7 aa, Staphylococcus
GGAGEET

SEQ ID NO: 1843895 - protein, 13 aa, Staphylococcus
GGETTSLIKATLG

SEQ ID NO: 1843896 - protein, 7 aa, Staphylococcus
GGGGTFP

SEQ ID NO: 1843897 - protein, 9 aa, Staphylococcus
GGGGWGPVN

SEQ ID NO: 1843898 - protein, 5 aa, Staphylococcus
GGGLI

SEQ ID NO: 1843899 - protein, 13 aa, Staphylococcus
GGKTDPMEKRTRV

SEQ ID NO: 1843900 - protein, 9 aa, Staphylococcus
GGTLQATGG

SEQ ID NO: 1843901 - protein, 5 aa, Staphylococcus
GIASY

SEQ ID NO: 1843902 - protein, 18 aa, Staphylococcus
GLPQGSAYSLKGDNTYQS

SEQ ID NO: 1843903 - protein, 7 aa, Staphylococcus
GMGSSAM

SEQ ID NO: 1843904 - protein, 5 aa, Staphylococcus
GPTLS

SEQ ID NO: 1843905 - protein, 6 aa, Staphylococcus
GRSTVD

SEQ ID NO: 1843906 - protein, 6 aa, Staphylococcus
GSAYTS

SEQ ID NO: 1843907 - protein, 6 aa, Staphylococcus
GSFSTY

SEQ ID NO: 1843908 - protein, 6 aa, Staphylococcus
GTAGGT

SEQ ID NO: 1843909 - protein, 9 aa, Staphylococcus
GTAKATSYG

SEQ ID NO: 1843910 - protein, 5 aa, Staphylococcus
GTAVP

SEQ ID NO: 1843911 - protein, 5 aa, Staphylococcus
GTPPN

SEQ ID NO: 1843912 - protein, 4 aa, Staphylococcus
GTQA

SEQ ID NO: 1843913 - protein, 10 aa, Staphylococcus
GVARQPEARG

SEQ ID NO: 1843914 - protein, 4 aa, Staphylococcus
GVPL

SEQ ID NO: 1843915 - protein, 9 aa, Staphylococcus
HASTKSSTL

SEQ ID NO: 1843916 - protein, 4 aa, Staphylococcus
HELR

SEQ ID NO: 1843917 - protein, 4 aa, Staphylococcus
HVSR

SEQ ID NO: 1843918 - protein, 4 aa, Staphylococcus
IAER

SEQ ID NO: 1843919 - protein, 4 aa, Staphylococcus
IGPE

SEQ ID NO: 1843920 - protein, 4 aa, Staphylococcus
IGPT

SEQ ID NO: 1843921 - protein, 5 aa, Staphylococcus
INAPH

SEQ ID NO: 1843922 - protein, 4 aa, Staphylococcus
INTI

SEQ ID NO: 1843923 - protein, 5 aa, Staphylococcus
IPDGD

SEQ ID NO: 1843924 - protein, 4 aa, Staphylococcus
IQKL

SEQ ID NO: 1843925 - protein, 12 aa, Staphylococcus
ISATDNSGEVVT

SEQ ID NO: 1843926 - protein, 13 aa, Staphylococcus
ITQNMNDTQRSEI

SEQ ID NO: 1843927 - protein, 8 aa, Staphylococcus
ITSISQDQ

SEQ ID NO: 1843928 - protein, 11 aa, Staphylococcus
KARTRKMGGTG

SEQ ID NO: 1843929 - protein, 5 aa, Staphylococcus
KDPSQ

SEQ ID NO: 1843930 - protein, 6 aa, Staphylococcus
KESGPV

SEQ ID NO: 1843931 - protein, 8 aa, Staphylococcus
KEVGKESE

SEQ ID NO: 1843932 - protein, 5 aa, Staphylococcus
KFPVN

SEQ ID NO: 1843933 - protein, 6 aa, Staphylococcus
KGEYDS

SEQ ID NO: 1843934 - protein, 6 aa, Staphylococcus
KGLEKA

SEQ ID NO: 1843935 - protein, 11 aa, Staphylococcus
KGYSRNDRVGK

SEQ ID NO: 1843936 - protein, 6 aa, Staphylococcus
KILPKG

SEQ ID NO: 1843937 - protein, 11 aa, Staphylococcus
KKFKQMGSRIP

SEQ ID NO: 1843938 - protein, 6 aa, Staphylococcus
KKGLYD

SEQ ID NO: 1843939 - protein, 13 aa, Staphylococcus
KKQSAQRLGSQAT

SEQ ID NO: 1843940 - protein, 9 aa, Staphylococcus
KLEQAAKEM

SEQ ID NO: 1843941 - protein, 28 aa, Staphylococcus
KNIGADLQTEQALADKNIAQAKAEERRA

SEQ ID NO: 1843942 - protein, 8 aa, Staphylococcus
KNKPLDET

SEQ ID NO: 1843943 - protein, 6 aa, Staphylococcus
KPITDM

SEQ ID NO: 1843944 - protein, 7 aa, Staphylococcus
KQATGNL

SEQ ID NO: 1843945 - protein, 7 aa, Staphylococcus
KRFGGNP

SEQ ID NO: 1843946 - protein, 6 aa, Staphylococcus
KSGKNV

SEQ ID NO: 1843947 - protein, 8 aa, Staphylococcus
KSPASPGS

SEQ ID NO: 1843948 - protein, 13 aa, Staphylococcus
KSRARSQGGNGLG

SEQ ID NO: 1843949 - protein, 4 aa, Staphylococcus
KTPH

SEQ ID NO: 1843950 - protein, 4 aa, Staphylococcus
KVGV

SEQ ID NO: 1843951 - protein, 4 aa, Staphylococcus
LENI

SEQ ID NO: 1843952 - protein, 7 aa, Staphylococcus
LEPNGVP

SEQ ID NO: 1843953 - protein, 6 aa, Staphylococcus
LESDTG

SEQ ID NO: 1843954 - protein, 7 aa, Staphylococcus
LGEGGVT

SEQ ID NO: 1843955 - protein, 5 aa, Staphylococcus
LGGGG

SEQ ID NO: 1843956 - protein, 5 aa, Staphylococcus
LITPD

SEQ ID NO: 1843957 - protein, 8 aa, Staphylococcus
LKKQAEKM

SEQ ID NO: 1843958 - protein, 7 aa, Staphylococcus
LNNTDRE

SEQ ID NO: 1843959 - protein, 7 aa, Staphylococcus
LPPEQRK

SEQ ID NO: 1843960 - protein, 4 aa, Staphylococcus
LPQF

SEQ ID NO: 1843961 - protein, 11 aa, Staphylococcus
LPSTPNKELTF

SEQ ID NO: 1843962 - protein, 6 aa, Staphylococcus
LSQSGL

SEQ ID NO: 1843963 - protein, 4 aa, Staphylococcus
LTEG

SEQ ID NO: 1843964 - protein, 4 aa, Staphylococcus
MKPT

SEQ ID NO: 1843965 - protein, 8 aa, Staphylococcus
NENEKNKI

SEQ ID NO: 1843966 - protein, 5 aa, Staphylococcus
NGGEE

SEQ ID NO: 1843967 - protein, 6 aa, Staphylococcus
NGSMGE

SEQ ID NO: 1843968 - protein, 13 aa, Staphylococcus
NHFSKKAKNQLSS

SEQ ID NO: 1843969 - protein, 6 aa, Staphylococcus
NLTRAN

SEQ ID NO: 1843970 - protein, 5 aa, Staphylococcus
NPAGS

SEQ ID NO: 1843971 - protein, 5 aa, Staphylococcus
NPKKA

SEQ ID NO: 1843972 - protein, 6 aa, Staphylococcus
NPKNGD

SEQ ID NO: 1843973 - protein, 4 aa, Staphylococcus
NRNH

SEQ ID NO: 1843974 - protein, 6 aa, Staphylococcus
NRYKRS

SEQ ID NO: 1843975 - protein, 11 aa, Staphylococcus
PATPSNTARAG

SEQ ID NO: 1843976 - protein, 7 aa, Staphylococcus
PDSGTRI

SEQ ID NO: 1843977 - protein, 11 aa, Staphylococcus
PDSQSGNNTDL

SEQ ID NO: 1843978 - protein, 27 aa, Staphylococcus
PEKMADNLKKQGSYVPGIRPGEQTKKY

SEQ ID NO: 1843979 - protein, 4 aa, Staphylococcus
PEPH

SEQ ID NO: 1843980 - protein, 5 aa, Staphylococcus
PLASP

SEQ ID NO: 1843981 - protein, 7 aa, Staphylococcus
PNISTTV

SEQ ID NO: 1843982 - protein, 5 aa, Staphylococcus
PNVKT

SEQ ID NO: 1843983 - protein, 11 aa, Staphylococcus
PSSNSDGNYTK

SEQ ID NO: 1843984 - protein, 5 aa, Staphylococcus
PVSST

SEQ ID NO: 1843985 - protein, 7 aa, Staphylococcus
QEVASTT

SEQ ID NO: 1843986 - protein, 6 aa, Staphylococcus
QEYSKD

SEQ ID NO: 1843987 - protein, 12 aa, Staphylococcus
QFGSGNTGATNS

SEQ ID NO: 1843988 - protein, 19 aa, Staphylococcus
QGAKTRGGHMEGNKVTEEI

SEQ ID NO: 1843989 - protein, 8 aa, Staphylococcus
QKELPGQF

SEQ ID NO: 1843990 - protein, 7 aa, Staphylococcus
QPTEQRL

SEQ ID NO: 1843991 - protein, 9 aa, Staphylococcus
QQKRAKEHR

SEQ ID NO: 1843992 - protein, 4 aa, Staphylococcus
RAGA

SEQ ID NO: 1843993 - protein, 9 aa, Staphylococcus
RDLGATESQ

SEQ ID NO: 1843994 - protein, 4 aa, Staphylococcus
RGES

SEQ ID NO: 1843995 - protein, 6 aa, Staphylococcus
RSDEYS

SEQ ID NO: 1843996 - protein, 7 aa, Staphylococcus
RSTSIGA

SEQ ID NO: 1843997 - protein, 6 aa, Staphylococcus
RTASTS

SEQ ID NO: 1843998 - protein, 7 aa, Staphylococcus
RTMGASE

SEQ ID NO: 1843999 - protein, 8 aa, Staphylococcus
RVGKTESI

SEQ ID NO: 1844000 - protein, 5 aa, Staphylococcus
SAFGS

SEQ ID NO: 1844001 - protein, 5 aa, Staphylococcus
SDDRT

SEQ ID NO: 1844002 - protein, 7 aa, Staphylococcus
SGATFGS

SEQ ID NO: 1844003 - protein, 12 aa, Staphylococcus
SGDTHNNFIYNE

SEQ ID NO: 1844004 - protein, 8 aa, Staphylococcus
SGETADSR

SEQ ID NO: 1844005 - protein, 7 aa, Staphylococcus
SIEDTNN

SEQ ID NO: 1844006 - protein, 7 aa, Staphylococcus
SKKEEVY

SEQ ID NO: 1844007 - protein, 9 aa, Staphylococcus
SKNAMSKTQ

SEQ ID NO: 1844008 - protein, 5 aa, Staphylococcus
SNPSD

SEQ ID NO: 1844009 - protein, 7 aa, Staphylococcus
SNSSNAA

SEQ ID NO: 1844010 - protein, 4 aa, Staphylococcus
SPEF

SEQ ID NO: 1844011 - protein, 5 aa, Staphylococcus
SPQQG

SEQ ID NO: 1844012 - protein, 5 aa, Staphylococcus
SQSTK

SEQ ID NO: 1844013 - protein, 8 aa, Staphylococcus
SRSSAGAL

SEQ ID NO: 1844014 - protein, 6 aa, Staphylococcus
SSAKRW

SEQ ID NO: 1844015 - protein, 4 aa, Staphylococcus
SSLG

SEQ ID NO: 1844016 - protein, 5 aa, Staphylococcus
SSNDR

SEQ ID NO: 1844017 - protein, 20 aa, Staphylococcus
SSQTDSRTIIGSGGAEKLLG

SEQ ID NO: 1844018 - protein, 5 aa, Staphylococcus
SSTGS

SEQ ID NO: 1844019 - protein, 10 aa, Staphylococcus
STDADGNSVE

SEQ ID NO: 1844020 - protein, 8 aa, Staphylococcus
STRALTPR

SEQ ID NO: 1844021 - protein, 6 aa, Staphylococcus
STREAP

SEQ ID NO: 1844022 - protein, 10 aa, Staphylococcus
SYNGGEINQT

SEQ ID NO: 1844023 - protein, 9 aa, Staphylococcus
TAKPENKKV

SEQ ID NO: 1844024 - protein, 4 aa, Staphylococcus
TATA

SEQ ID NO: 1844025 - protein, 7 aa, Staphylococcus
TATRETP

SEQ ID NO: 1844026 - protein, 7 aa, Staphylococcus
TFSTGGQ

SEQ ID NO: 1844027 - protein, 16 aa, Staphylococcus
TIQNNQQKALASEDDL

SEQ ID NO: 1844028 - protein, 8 aa, Staphylococcus
TKEQRGSI

SEQ ID NO: 1844029 - protein, 9 aa, Staphylococcus
TKNGLADPS

SEQ ID NO: 1844030 - protein, 4 aa, Staphylococcus
TKPL

SEQ ID NO: 1844031 - protein, 4 aa, Staphylococcus
TKVG

SEQ ID NO: 1844032 - protein, 5 aa, Staphylococcus
TNLGE

SEQ ID NO: 1844033 - protein, 4 aa, Staphylococcus
TPGP

SEQ ID NO: 1844034 - protein, 4 aa, Staphylococcus
TPSY

SEQ ID NO: 1844035 - protein, 43 aa, Staphylococcus
TPTKPIPEGNVTAKATDNAEHPNSSTSQPKKATDTTPPTAPVV

SEQ ID NO: 1844036 - protein, 9 aa, Staphylococcus
TRDESKDQM

SEQ ID NO: 1844037 - protein, 6 aa, Staphylococcus
TSALDL

SEQ ID NO: 1844038 - protein, 7 aa, Staphylococcus
TSNTATA

SEQ ID NO: 1844039 - protein, 6 aa, Staphylococcus
TSSSEA

SEQ ID NO: 1844040 - protein, 11 aa, Staphylococcus
TTHYSSGPAPI

SEQ ID NO: 1844041 - protein, 21 aa, Staphylococcus
TTTTTSYIESTSGVAVGARTG

SEQ ID NO: 1844042 - protein, 6 aa, Staphylococcus
TTYGGL

SEQ ID NO: 1844043 - protein, 32 aa, Staphylococcus
TVKATDNAEHPNSSTSDPVKATDTTPPTVPTL

SEQ ID NO: 1844044 - protein, 9 aa, Staphylococcus
TYPDGTQDH

SEQ ID NO: 1844045 - protein, 4 aa, Staphylococcus
VDIK

SEQ ID NO: 1844046 - protein, 6 aa, Staphylococcus
VEGPIG

SEQ ID NO: 1844047 - protein, 6 aa, Staphylococcus
VEGQGT

SEQ ID NO: 1844048 - protein, 7 aa, Staphylococcus
VGEGTEN

SEQ ID NO: 1844049 - protein, 9 aa, Staphylococcus
VGRPDVKGR

SEQ ID NO: 1844050 - protein, 11 aa, Staphylococcus
VIGSGTTGANG

SEQ ID NO: 1844051 - protein, 4 aa, Staphylococcus
VNTE

SEQ ID NO: 1844052 - protein, 4 aa, Staphylococcus
VPFG

SEQ ID NO: 1844053 - protein, 40 aa, Staphylococcus
VPIPEGNVRAKATDNAEHPNSSLSQPKKATDTTPPGSPIV

SEQ ID NO: 1844054 - protein, 7 aa, Staphylococcus
VSGLPEG

SEQ ID NO: 1844055 - protein, 5 aa, Staphylococcus
YGGTA

SEQ ID NO: 1844056 - protein, 4 aa, Staphylococcus
YPGL

SEQ ID NO: 1844057 - protein, 7 aa, Staphylococcus
YSLGGPE

SEQ ID NO: 1844058 - protein, 7 aa, Staphylococcus
AAEKSGY

SEQ ID NO: 1844059 - protein, 7 aa, Staphylococcus
AAGQLGK

SEQ ID NO: 1844060 - protein, 11 aa, Staphylococcus
AAGSASIGISA

SEQ ID NO: 1844061 - protein, 6 aa, Staphylococcus
AAPTPV

SEQ ID NO: 1844062 - protein, 6 aa, Staphylococcus
AASGAF

SEQ ID NO: 1844063 - protein, 7 aa, Staphylococcus
ADKPGFA

SEQ ID NO: 1844064 - protein, 7 aa, Staphylococcus
AETERDT

SEQ ID NO: 1844065 - protein, 7 aa, Staphylococcus
AFGGPDS

SEQ ID NO: 1844066 - protein, 6 aa, Staphylococcus
AGEAGA

SEQ ID NO: 1844067 - protein, 13 aa, Staphylococcus
AGETKNPHKTIPQ

SEQ ID NO: 1844068 - protein, 6 aa, Staphylococcus
AGGTRI

SEQ ID NO: 1844069 - protein, 5 aa, Staphylococcus
AGGVT

SEQ ID NO: 1844070 - protein, 5 aa, Staphylococcus
AGNLG

SEQ ID NO: 1844071 - protein, 4 aa, Staphylococcus
AGPS

SEQ ID NO: 1844072 - protein, 5 aa, Staphylococcus
AGSLG

SEQ ID NO: 1844073 - protein, 10 aa, Staphylococcus
AGSTLSREAD

SEQ ID NO: 1844074 - protein, 5 aa, Staphylococcus
AHAPN

SEQ ID NO: 1844075 - protein, 6 aa, Staphylococcus
AIHDAG

SEQ ID NO: 1844076 - protein, 9 aa, Staphylococcus
AKEATETAT

SEQ ID NO: 1844077 - protein, 9 aa, Staphylococcus
AKKNDGAVA

SEQ ID NO: 1844078 - protein, 14 aa, Staphylococcus
AKQGEVGKRKLSNV

SEQ ID NO: 1844079 - protein, 4 aa, Staphylococcus
ALGA

SEQ ID NO: 1844080 - protein, 6 aa, Staphylococcus
ALGASG

SEQ ID NO: 1844081 - protein, 8 aa, Staphylococcus
ALGSTEFT

SEQ ID NO: 1844082 - protein, 10 aa, Staphylococcus
ANGGTYNNAH

SEQ ID NO: 1844083 - protein, 7 aa, Staphylococcus
ANIKENN

SEQ ID NO: 1844084 - protein, 7 aa, Staphylococcus
ANLKKQS

SEQ ID NO: 1844085 - protein, 11 aa, Staphylococcus
ANSSKVQTGDS

SEQ ID NO: 1844086 - protein, 5 aa, Staphylococcus
APKAF

SEQ ID NO: 1844087 - protein, 4 aa, Staphylococcus
APKS

SEQ ID NO: 1844088 - protein, 5 aa, Staphylococcus
APLSS

SEQ ID NO: 1844089 - protein, 6 aa, Staphylococcus
APMYPS

SEQ ID NO: 1844090 - protein, 4 aa, Staphylococcus
APPD

SEQ ID NO: 1844091 - protein, 5 aa, Staphylococcus
APTPV

SEQ ID NO: 1844092 - protein, 6 aa, Staphylococcus
APVSST

SEQ ID NO: 1844093 - protein, 6 aa, Staphylococcus
AQEKNI

SEQ ID NO: 1844094 - protein, 9 aa, Staphylococcus
AREGKNKID

SEQ ID NO: 1844095 - protein, 4 aa, Staphylococcus
ASAK

SEQ ID NO: 1844096 - protein, 7 aa, Staphylococcus
ASEQEMK

SEQ ID NO: 1844097 - protein, 7 aa, Staphylococcus
ASGKPIK

SEQ ID NO: 1844098 - protein, 7 aa, Staphylococcus
ASISQDQ

SEQ ID NO: 1844099 - protein, 14 aa, Staphylococcus
ASNYEDIKQDTDRL

SEQ ID NO: 1844100 - protein, 9 aa, Staphylococcus
ASSGPDEDW

SEQ ID NO: 1844101 - protein, 9 aa, Staphylococcus
ASVGTTNMD

SEQ ID NO: 1844102 - protein, 5 aa, Staphylococcus
ATAEM

SEQ ID NO: 1844103 - protein, 6 aa, Staphylococcus
ATANNT

SEQ ID NO: 1844104 - protein, 5 aa, Staphylococcus
ATGDI

SEQ ID NO: 1844105 - protein, 6 aa, Staphylococcus
ATKGRT

SEQ ID NO: 1844106 - protein, 6 aa, Staphylococcus
ATKVGT

SEQ ID NO: 1844107 - protein, 7 aa, Staphylococcus
ATTATGT

SEQ ID NO: 1844108 - protein, 7 aa, Staphylococcus
AVGEDGY

SEQ ID NO: 1844109 - protein, 7 aa, Staphylococcus
AVGTAGS

SEQ ID NO: 1844110 - protein, 5 aa, Staphylococcus
AVTTP

SEQ ID NO: 1844111 - protein, 5 aa, Staphylococcus
CATGT

SEQ ID NO: 1844112 - protein, 16 aa, Staphylococcus
CEGEKRAKKELNEKGL

SEQ ID NO: 1844113 - protein, 6 aa, Staphylococcus
CKPEDK

SEQ ID NO: 1844114 - protein, 5 aa, Staphylococcus
DAGIR

SEQ ID NO: 1844115 - protein, 6 aa, Staphylococcus
DDVLSG

SEQ ID NO: 1844116 - protein, 7 aa, Staphylococcus
DDVPRQS

SEQ ID NO: 1844117 - protein, 8 aa, Staphylococcus
DETEDELE

SEQ ID NO: 1844118 - protein, 29 aa, Staphylococcus
DGNVIGSGTTDSTGHATITPTVPIPEGNV

SEQ ID NO: 1844119 - protein, 9 aa, Staphylococcus
DGVNDAPAL

SEQ ID NO: 1844120 - protein, 4 aa, Staphylococcus
DIES

SEQ ID NO: 1844121 - protein, 11 aa, Staphylococcus
DKEGGFRGGPA

SEQ ID NO: 1844122 - protein, 5 aa, Staphylococcus
DKIGE

SEQ ID NO: 1844123 - protein, 21 aa, Staphylococcus
DLTGKATTKTPVDVSSDPNTR

SEQ ID NO: 1844124 - protein, 5 aa, Staphylococcus
DMNPG

SEQ ID NO: 1844125 - protein, 6 aa, Staphylococcus
DMSENI

SEQ ID NO: 1844126 - protein, 9 aa, Staphylococcus
DNGKGFNVD

SEQ ID NO: 1844127 - protein, 8 aa, Staphylococcus
DNGQREEV

SEQ ID NO: 1844128 - protein, 6 aa, Staphylococcus
DPKNPP

SEQ ID NO: 1844129 - protein, 7 aa, Staphylococcus
DRPDGFK

SEQ ID NO: 1844130 - protein, 6 aa, Staphylococcus
DRTSTR

SEQ ID NO: 1844131 - protein, 5 aa, Staphylococcus
DSELE

SEQ ID NO: 1844132 - protein, 7 aa, Staphylococcus
DSGRILP

SEQ ID NO: 1844133 - protein, 6 aa, Staphylococcus
DSNPTK

SEQ ID NO: 1844134 - protein, 23 aa, Staphylococcus
DTDLGGKAGTQTPITVTTDPNTH

SEQ ID NO: 1844135 - protein, 9 aa, Staphylococcus
DTGSGIAPE

SEQ ID NO: 1844136 - protein, 21 aa, Staphylococcus
DTTAPTVKGISDQTKEVNTEI

SEQ ID NO: 1844137 - protein, 4 aa, Staphylococcus
DTYT

SEQ ID NO: 1844138 - protein, 8 aa, Staphylococcus
DYQSDGNK

SEQ ID NO: 1844139 - protein, 7 aa, Staphylococcus
EAGGTRI

SEQ ID NO: 1844140 - protein, 7 aa, Staphylococcus
EAGTRDI

SEQ ID NO: 1844141 - protein, 14 aa, Staphylococcus
EAQVSQKEYKGFGG

SEQ ID NO: 1844142 - protein, 6 aa, Staphylococcus
EDIDPT

SEQ ID NO: 1844143 - protein, 6 aa, Staphylococcus
EDPNYS

SEQ ID NO: 1844144 - protein, 11 aa, Staphylococcus
EGVARQPEARG

SEQ ID NO: 1844145 - protein, 5 aa, Staphylococcus
EHNLD

SEQ ID NO: 1844146 - protein, 9 aa, Staphylococcus
EKEGKMDEK

SEQ ID NO: 1844147 - protein, 14 aa, Staphylococcus
EKESRKRYSPNSTY

SEQ ID NO: 1844148 - protein, 19 aa, Staphylococcus
EKYELYGKTGTGIVNGKYN

SEQ ID NO: 1844149 - protein, 9 aa, Staphylococcus
ENEAGKSTI

SEQ ID NO: 1844150 - protein, 9 aa, Staphylococcus
ENPDNISKT

SEQ ID NO: 1844151 - protein, 5 aa, Staphylococcus
EPLNP

SEQ ID NO: 1844152 - protein, 15 aa, Staphylococcus
EPTAKASLKKGYRRL

SEQ ID NO: 1844153 - protein, 7 aa, Staphylococcus
EQAPDAE

SEQ ID NO: 1844154 - protein, 7 aa, Staphylococcus
EQDNTPM

SEQ ID NO: 1844155 - protein, 5 aa, Staphylococcus
EQGSN

SEQ ID NO: 1844156 - protein, 5 aa, Staphylococcus
ERPQN

SEQ ID NO: 1844157 - protein, 11 aa, Staphylococcus
ERTGGSGNASS

SEQ ID NO: 1844158 - protein, 8 aa, Staphylococcus
ESAKYNAS

SEQ ID NO: 1844159 - protein, 7 aa, Staphylococcus
ESQSNHP

SEQ ID NO: 1844160 - protein, 7 aa, Staphylococcus
ETGKKHP

SEQ ID NO: 1844161 - protein, 6 aa, Staphylococcus
ETGLQD

SEQ ID NO: 1844162 - protein, 11 aa, Staphylococcus
EYSKTGDNDHS

SEQ ID NO: 1844163 - protein, 17 aa, Staphylococcus
FDPRTNTISGVATKVGT

SEQ ID NO: 1844164 - protein, 11 aa, Staphylococcus
FDSRTNTISGV

SEQ ID NO: 1844165 - protein, 6 aa, Staphylococcus
FEEDED

SEQ ID NO: 1844166 - protein, 7 aa, Staphylococcus
FGASSSS

SEQ ID NO: 1844167 - protein, 5 aa, Staphylococcus
FGENE

SEQ ID NO: 1844168 - protein, 5 aa, Staphylococcus
FGKES

SEQ ID NO: 1844169 - protein, 6 aa, Staphylococcus
FKADNQ

SEQ ID NO: 1844170 - protein, 4 aa, Staphylococcus
FNQQ

SEQ ID NO: 1844171 - protein, 4 aa, Staphylococcus
FPGY

SEQ ID NO: 1844172 - protein, 9 aa, Staphylococcus
FTTEQQDET

SEQ ID NO: 1844173 - protein, 7 aa, Staphylococcus
GAETYRV

SEQ ID NO: 1844174 - protein, 7 aa, Staphylococcus
GAPGGMS

SEQ ID NO: 1844175 - protein, 10 aa, Staphylococcus
GDAAGGLGGV

SEQ ID NO: 1844176 - protein, 8 aa, Staphylococcus
GDKQYKNP

SEQ ID NO: 1844177 - protein, 5 aa, Staphylococcus
GDLGR

SEQ ID NO: 1844178 - protein, 11 aa, Staphylococcus
GDQIKESSKQM

SEQ ID NO: 1844179 - protein, 8 aa, Staphylococcus
GEKAEPVK

SEQ ID NO: 1844180 - protein, 7 aa, Staphylococcus
GEKIPVD

SEQ ID NO: 1844181 - protein, 10 aa, Staphylococcus
GENEAGKSTI

SEQ ID NO: 1844182 - protein, 5 aa, Staphylococcus
GEQRT

SEQ ID NO: 1844183 - protein, 4 aa, Staphylococcus
GFEV

SEQ ID NO: 1844184 - protein, 6 aa, Staphylococcus
GGAAYE

SEQ ID NO: 1844185 - protein, 4 aa, Staphylococcus
GGAQ

SEQ ID NO: 1844186 - protein, 5 aa, Staphylococcus
GGAQF

SEQ ID NO: 1844187 - protein, 5 aa, Staphylococcus
GGASL

SEQ ID NO: 1844188 - protein, 7 aa, Staphylococcus
GGASTIH

SEQ ID NO: 1844189 - protein, 5 aa, Staphylococcus
GGDLG

SEQ ID NO: 1844190 - protein, 14 aa, Staphylococcus
GGGGHLTNAATQIK

SEQ ID NO: 1844191 - protein, 4 aa, Staphylococcus
GGGT

SEQ ID NO: 1844192 - protein, 4 aa, Staphylococcus
GGHA

SEQ ID NO: 1844193 - protein, 10 aa, Staphylococcus
GGIEPGTTEL

SEQ ID NO: 1844194 - protein, 5 aa, Staphylococcus
GGIGT

SEQ ID NO: 1844195 - protein, 12 aa, Staphylococcus
GGKENIKDVTNC

SEQ ID NO: 1844196 - protein, 13 aa, Staphylococcus
GGKENIKDVTNCT

SEQ ID NO: 1844197 - protein, 10 aa, Staphylococcus
GGPYNQIRGT

SEQ ID NO: 1844198 - protein, 5 aa, Staphylococcus
GGREM

SEQ ID NO: 1844199 - protein, 4 aa, Staphylococcus
GGTF

SEQ ID NO: 1844200 - protein, 6 aa, Staphylococcus
GGTSVA

SEQ ID NO: 1844201 - protein, 5 aa, Staphylococcus
GIPPL

SEQ ID NO: 1844202 - protein, 16 aa, Staphylococcus
GKNVTVPKGQNGTSVT

SEQ ID NO: 1844203 - protein, 7 aa, Staphylococcus
GKQKQRG

SEQ ID NO: 1844204 - protein, 16 aa, Staphylococcus
GKSKEGVDYQSLDGQP

SEQ ID NO: 1844205 - protein, 11 aa, Staphylococcus
GKTKNDEDYSS

SEQ ID NO: 1844206 - protein, 4 aa, Staphylococcus
GLAS

SEQ ID NO: 1844207 - protein, 8 aa, Staphylococcus
GLGSGAAN

SEQ ID NO: 1844208 - protein, 5 aa, Staphylococcus
GLNDP

SEQ ID NO: 1844209 - protein, 6 aa, Staphylococcus
GMAGVP

SEQ ID NO: 1844210 - protein, 5 aa, Staphylococcus
GNTLP

SEQ ID NO: 1844211 - protein, 5 aa, Staphylococcus
GPENS

SEQ ID NO: 1844212 - protein, 10 aa, Staphylococcus
GPSGAGKTTL

SEQ ID NO: 1844213 - protein, 4 aa, Staphylococcus
GPTL

SEQ ID NO: 1844214 - protein, 6 aa, Staphylococcus
GPTTAD

SEQ ID NO: 1844215 - protein, 7 aa, Staphylococcus
GPTTADR

SEQ ID NO: 1844216 - protein, 8 aa, Staphylococcus
GQSSATGI

SEQ ID NO: 1844217 - protein, 7 aa, Staphylococcus
GRGGDQV

SEQ ID NO: 1844218 - protein, 6 aa, Staphylococcus
GRTYTT

SEQ ID NO: 1844219 - protein, 7 aa, Staphylococcus
GRVGTGN

SEQ ID NO: 1844220 - protein, 9 aa, Staphylococcus
GSNASGKST

SEQ ID NO: 1844221 - protein, 4 aa, Staphylococcus
GTGA

SEQ ID NO: 1844222 - protein, 5 aa, Staphylococcus
GTIGG

SEQ ID NO: 1844223 - protein, 5 aa, Staphylococcus
GTLQS

SEQ ID NO: 1844224 - protein, 7 aa, Staphylococcus
GTPLSAG

SEQ ID NO: 1844225 - protein, 7 aa, Staphylococcus
GTQALRP

SEQ ID NO: 1844226 - protein, 7 aa, Staphylococcus
GTSGHTL

SEQ ID NO: 1844227 - protein, 5 aa, Staphylococcus
GTTQI

SEQ ID NO: 1844228 - protein, 6 aa, Staphylococcus
GTTRQA

SEQ ID NO: 1844229 - protein, 5 aa, Staphylococcus
GTTSI

SEQ ID NO: 1844230 - protein, 4 aa, Staphylococcus
GVPF

SEQ ID NO: 1844231 - protein, 5 aa, Staphylococcus
GVTEK

SEQ ID NO: 1844232 - protein, 5 aa, Staphylococcus
GWVTG

SEQ ID NO: 1844233 - protein, 5 aa, Staphylococcus
HGTEM

SEQ ID NO: 1844234 - protein, 4 aa, Staphylococcus
HKDK

SEQ ID NO: 1844235 - protein, 6 aa, Staphylococcus
HKSASD

SEQ ID NO: 1844236 - protein, 4 aa, Staphylococcus
HSPR

SEQ ID NO: 1844237 - protein, 16 aa, Staphylococcus
IAGPAKKSRVISEKER

SEQ ID NO: 1844238 - protein, 7 aa, Staphylococcus
IAKEAGV

SEQ ID NO: 1844239 - protein, 4 aa, Staphylococcus
IAMT

SEQ ID NO: 1844240 - protein, 6 aa, Staphylococcus
IAQTRT

SEQ ID NO: 1844241 - protein, 7 aa, Staphylococcus
IFGSNSG

SEQ ID NO: 1844242 - protein, 4 aa, Staphylococcus
IGDS

SEQ ID NO: 1844243 - protein, 9 aa, Staphylococcus
IGKPDPVRG

SEQ ID NO: 1844244 - protein, 10 aa, Staphylococcus
IGPSGSGKST

SEQ ID NO: 1844245 - protein, 6 aa, Staphylococcus
INDAPS

SEQ ID NO: 1844246 - protein, 14 aa, Staphylococcus
INSGGTTVAEGTVK

SEQ ID NO: 1844247 - protein, 5 aa, Staphylococcus
IPEGA

SEQ ID NO: 1844248 - protein, 4 aa, Staphylococcus
IPGG

SEQ ID NO: 1844249 - protein, 5 aa, Staphylococcus
IPGYD

SEQ ID NO: 1844250 - protein, 4 aa, Staphylococcus
IPQG

SEQ ID NO: 1844251 - protein, 6 aa, Staphylococcus
ISASTG

SEQ ID NO: 1844252 - protein, 9 aa, Staphylococcus
ISQAGPGGA

SEQ ID NO: 1844253 - protein, 10 aa, Staphylococcus
ITEDGDKDHI

SEQ ID NO: 1844254 - protein, 18 aa, Staphylococcus
ITGKKLERKDFRKGYTAE

SEQ ID NO: 1844255 - protein, 4 aa, Staphylococcus
KAAS

SEQ ID NO: 1844256 - protein, 7 aa, Staphylococcus
KAIGSGQ

SEQ ID NO: 1844257 - protein, 9 aa, Staphylococcus
KAVEAGKAI

SEQ ID NO: 1844258 - protein, 4 aa, Staphylococcus
KDGL

SEQ ID NO: 1844259 - protein, 4 aa, Staphylococcus
KDRT

SEQ ID NO: 1844260 - protein, 14 aa, Staphylococcus
KGKTYRKSYNMNNR

SEQ ID NO: 1844261 - protein, 7 aa, Staphylococcus
KGPVASS

SEQ ID NO: 1844262 - protein, 6 aa, Staphylococcus
KGQTDK

SEQ ID NO: 1844263 - protein, 4 aa, Staphylococcus
KGRR

SEQ ID NO: 1844264 - protein, 5 aa, Staphylococcus
KGRTL

SEQ ID NO: 1844265 - protein, 4 aa, Staphylococcus
KGYN

SEQ ID NO: 1844266 - protein, 9 aa, Staphylococcus
KIRDKGPDY

SEQ ID NO: 1844267 - protein, 6 aa, Staphylococcus
KITGTG

SEQ ID NO: 1844268 - protein, 12 aa, Staphylococcus
KKLKGVASAAGI

SEQ ID NO: 1844269 - protein, 4 aa, Staphylococcus
KKPL

SEQ ID NO: 1844270 - protein, 6 aa, Staphylococcus
KKTKGH

SEQ ID NO: 1844271 - protein, 8 aa, Staphylococcus
KLGSEPSI

SEQ ID NO: 1844272 - protein, 5 aa, Staphylococcus
KLKEG

SEQ ID NO: 1844273 - protein, 9 aa, Staphylococcus
KLPKTRSGK

SEQ ID NO: 1844274 - protein, 7 aa, Staphylococcus
KNEFKTY

SEQ ID NO: 1844275 - protein, 5 aa, Staphylococcus
KNGYK

SEQ ID NO: 1844276 - protein, 4 aa, Staphylococcus
KPHI

SEQ ID NO: 1844277 - protein, 6 aa, Staphylococcus
KQKQRG

SEQ ID NO: 1844278 - protein, 4 aa, Staphylococcus
KRIP

SEQ ID NO: 1844279 - protein, 9 aa, Staphylococcus
KSGRSVETC

SEQ ID NO: 1844280 - protein, 5 aa, Staphylococcus
KSIVG

SEQ ID NO: 1844281 - protein, 7 aa, Staphylococcus
KSRTEAM

SEQ ID NO: 1844282 - protein, 7 aa, Staphylococcus
KTESIQN

SEQ ID NO: 1844283 - protein, 5 aa, Staphylococcus
KTQGV

SEQ ID NO: 1844284 - protein, 4 aa, Staphylococcus
KTTI

SEQ ID NO: 1844285 - protein, 7 aa, Staphylococcus
KVNAPSV

SEQ ID NO: 1844286 - protein, 7 aa, Staphylococcus
KVNEEDD

SEQ ID NO: 1844287 - protein, 4 aa, Staphylococcus
KYEA

SEQ ID NO: 1844288 - protein, 5 aa, Staphylococcus
KYKTP

SEQ ID NO: 1844289 - protein, 7 aa, Staphylococcus
LAGGDGV

SEQ ID NO: 1844290 - protein, 7 aa, Staphylococcus
LAGQRGD

SEQ ID NO: 1844291 - protein, 7 aa, Staphylococcus
LAKGLGQ

SEQ ID NO: 1844292 - protein, 6 aa, Staphylococcus
LAPTQH

SEQ ID NO: 1844293 - protein, 17 aa, Staphylococcus
LDGVEGQVQGITRESTD

SEQ ID NO: 1844294 - protein, 5 aa, Staphylococcus
LGETA

SEQ ID NO: 1844295 - protein, 5 aa, Staphylococcus
LGINP

SEQ ID NO: 1844296 - protein, 6 aa, Staphylococcus
LNGEGF

SEQ ID NO: 1844297 - protein, 4 aa, Staphylococcus
LPEQ

SEQ ID NO: 1844298 - protein, 8 aa, Staphylococcus
LPLGDKEV

SEQ ID NO: 1844299 - protein, 8 aa, Staphylococcus
LSGAKKNK

SEQ ID NO: 1844300 - protein, 5 aa, Staphylococcus
LSQSG

SEQ ID NO: 1844301 - protein, 4 aa, Staphylococcus
LTKD

SEQ ID NO: 1844302 - protein, 7 aa, Staphylococcus
LTSSEDT

SEQ ID NO: 1844303 - protein, 7 aa, Staphylococcus
MGGKENI

SEQ ID NO: 1844304 - protein, 4 aa, Staphylococcus
MNYE

SEQ ID NO: 1844305 - protein, 6 aa, Staphylococcus
NAKKNA

SEQ ID NO: 1844306 - protein, 4 aa, Staphylococcus
NATY

SEQ ID NO: 1844307 - protein, 6 aa, Staphylococcus
NDLSND

SEQ ID NO: 1844308 - protein, 8 aa, Staphylococcus
NETDNTVG

SEQ ID NO: 1844309 - protein, 11 aa, Staphylococcus
NFDRPSVAGTA

SEQ ID NO: 1844310 - protein, 6 aa, Staphylococcus
NIPEGA

SEQ ID NO: 1844311 - protein, 7 aa, Staphylococcus
NKPLDET

SEQ ID NO: 1844312 - protein, 5 aa, Staphylococcus
NKTNS

SEQ ID NO: 1844313 - protein, 8 aa, Staphylococcus
NLGEGGVT

SEQ ID NO: 1844314 - protein, 8 aa, Staphylococcus
NLRNGSAN

SEQ ID NO: 1844315 - protein, 16 aa, Staphylococcus
NLTGGFGSQGASTLTQ

SEQ ID NO: 1844316 - protein, 15 aa, Staphylococcus
NNQAPTVESKSHDLN

SEQ ID NO: 1844317 - protein, 5 aa, Staphylococcus
NPDLK

SEQ ID NO: 1844318 - protein, 11 aa, Staphylococcus
NPKNPGEHQYA

SEQ ID NO: 1844319 - protein, 13 aa, Staphylococcus
NQAGNVESMGGAV

SEQ ID NO: 1844320 - protein, 10 aa, Staphylococcus
NREVSKDSRA

SEQ ID NO: 1844321 - protein, 7 aa, Staphylococcus
NSGDMKG

SEQ ID NO: 1844322 - protein, 6 aa, Staphylococcus
NSLSGS

SEQ ID NO: 1844323 - protein, 9 aa, Staphylococcus
NTGEGGLSE

SEQ ID NO: 1844324 - protein, 4 aa, Staphylococcus
NTIT

SEQ ID NO: 1844325 - protein, 5 aa, Staphylococcus
NVGKT

SEQ ID NO: 1844326 - protein, 4 aa, Staphylococcus
NYAS

SEQ ID NO: 1844327 - protein, 6 aa, Staphylococcus
PAASAT

SEQ ID NO: 1844328 - protein, 9 aa, Staphylococcus
PAPKTSLGS

SEQ ID NO: 1844329 - protein, 8 aa, Staphylococcus
PAPQTSLG

SEQ ID NO: 1844330 - protein, 31 aa, Staphylococcus
PDYPSEKGKPTITVDDPSKLPDGNTPGTSNV

SEQ ID NO: 1844331 - protein, 5 aa, Staphylococcus
PELSN

SEQ ID NO: 1844332 - protein, 4 aa, Staphylococcus
PESA

SEQ ID NO: 1844333 - protein, 8 aa, Staphylococcus
PGGTSSNV

SEQ ID NO: 1844334 - protein, 6 aa, Staphylococcus
PKNRGK

SEQ ID NO: 1844335 - protein, 5 aa, Staphylococcus
PMYPS

SEQ ID NO: 1844336 - protein, 4 aa, Staphylococcus
PNNT

SEQ ID NO: 1844337 - protein, 6 aa, Staphylococcus
PPEVQS

SEQ ID NO: 1844338 - protein, 5 aa, Staphylococcus
PQAAT

SEQ ID NO: 1844339 - protein, 8 aa, Staphylococcus
PQKSHSDI

SEQ ID NO: 1844340 - protein, 13 aa, Staphylococcus
PQSGGMSNYAQYT

SEQ ID NO: 1844341 - protein, 8 aa, Staphylococcus
QAATQAGG

SEQ ID NO: 1844342 - protein, 12 aa, Staphylococcus
QAQNDKSSAELL

SEQ ID NO: 1844343 - protein, 10 aa, Staphylococcus
QAYSKANKSS

SEQ ID NO: 1844344 - protein, 4 aa, Staphylococcus
QDNG

SEQ ID NO: 1844345 - protein, 8 aa, Staphylococcus
QELGGTDT

SEQ ID NO: 1844346 - protein, 8 aa, Staphylococcus
QERNRIGQ

SEQ ID NO: 1844347 - protein, 6 aa, Staphylococcus
QGLGPK

SEQ ID NO: 1844348 - protein, 4 aa, Staphylococcus
QGSN

SEQ ID NO: 1844349 - protein, 6 aa, Staphylococcus
QKYDKN

SEQ ID NO: 1844350 - protein, 9 aa, Staphylococcus
QNLTNENYN

SEQ ID NO: 1844351 - protein, 5 aa, Staphylococcus
QNPEL

SEQ ID NO: 1844352 - protein, 4 aa, Staphylococcus
QNSI

SEQ ID NO: 1844353 - protein, 7 aa, Staphylococcus
QQIGTSG

SEQ ID NO: 1844354 - protein, 5 aa, Staphylococcus
QTETT

SEQ ID NO: 1844355 - protein, 7 aa, Staphylococcus
QTISLTG

SEQ ID NO: 1844356 - protein, 6 aa, Staphylococcus
QVRQPN

SEQ ID NO: 1844357 - protein, 4 aa, Staphylococcus
RADA

SEQ ID NO: 1844358 - protein, 12 aa, Staphylococcus
RDPLAGKTVTGG

SEQ ID NO: 1844359 - protein, 13 aa, Staphylococcus
RDRVKDKESGRKT

SEQ ID NO: 1844360 - protein, 4 aa, Staphylococcus
RDTN

SEQ ID NO: 1844361 - protein, 4 aa, Staphylococcus
REDN

SEQ ID NO: 1844362 - protein, 5 aa, Staphylococcus
REETE

SEQ ID NO: 1844363 - protein, 4 aa, Staphylococcus
RERP

SEQ ID NO: 1844364 - protein, 6 aa, Staphylococcus
RGQEVS

SEQ ID NO: 1844365 - protein, 15 aa, Staphylococcus
RKEEGAGGDFGRQER

SEQ ID NO: 1844366 - protein, 4 aa, Staphylococcus
RPKY

SEQ ID NO: 1844367 - protein, 7 aa, Staphylococcus
RQKNNTF

SEQ ID NO: 1844368 - protein, 5 aa, Staphylococcus
RRDIS

SEQ ID NO: 1844369 - protein, 6 aa, Staphylococcus
RRGESF

SEQ ID NO: 1844370 - protein, 8 aa, Staphylococcus
RTGSRTFD

SEQ ID NO: 1844371 - protein, 9 aa, Staphylococcus
RTGSRTFDA

SEQ ID NO: 1844372 - protein, 5 aa, Staphylococcus
RTTDL

SEQ ID NO: 1844373 - protein, 5 aa, Staphylococcus
RVGPF

SEQ ID NO: 1844374 - protein, 9 aa, Staphylococcus
SAGNSGMYA

SEQ ID NO: 1844375 - protein, 5 aa, Staphylococcus
SAIKS

SEQ ID NO: 1844376 - protein, 55 aa, Staphylococcus
SAKAYDNAEVPNVATSQPKKATDTTPPTTPTLDTDLGGKAGTQTPITVTTDPNTH

SEQ ID NO: 1844377 - protein, 5 aa, Staphylococcus
SASTG

SEQ ID NO: 1844378 - protein, 8 aa, Staphylococcus
SASTVGKA

SEQ ID NO: 1844379 - protein, 5 aa, Staphylococcus
SAYTS

SEQ ID NO: 1844380 - protein, 12 aa, Staphylococcus
SDGKPSGKNAEL

SEQ ID NO: 1844381 - protein, 6 aa, Staphylococcus
SDIDPT

SEQ ID NO: 1844382 - protein, 4 aa, Staphylococcus
SELE

SEQ ID NO: 1844383 - protein, 4 aa, Staphylococcus
SENI

SEQ ID NO: 1844384 - protein, 10 aa, Staphylococcus
SFPSGHSNAS

SEQ ID NO: 1844385 - protein, 5 aa, Staphylococcus
SGMKG

SEQ ID NO: 1844386 - protein, 6 aa, Staphylococcus
SHAFGT

SEQ ID NO: 1844387 - protein, 5 aa, Staphylococcus
SHELR

SEQ ID NO: 1844388 - protein, 7 aa, Staphylococcus
SIENEKE

SEQ ID NO: 1844389 - protein, 4 aa, Staphylococcus
SIKS

SEQ ID NO: 1844390 - protein, 11 aa, Staphylococcus
SIVPHGDTQLR

SEQ ID NO: 1844391 - protein, 5 aa, Staphylococcus
SKDKY

SEQ ID NO: 1844392 - protein, 6 aa, Staphylococcus
SKESKL

SEQ ID NO: 1844393 - protein, 11 aa, Staphylococcus
SKGFKDGPRTY

SEQ ID NO: 1844394 - protein, 6 aa, Staphylococcus
SKKKLQ

SEQ ID NO: 1844395 - protein, 6 aa, Staphylococcus
SKKSQR

SEQ ID NO: 1844396 - protein, 5 aa, Staphylococcus
SKPKV

SEQ ID NO: 1844397 - protein, 10 aa, Staphylococcus
SKRNKAIGRA

SEQ ID NO: 1844398 - protein, 4 aa, Staphylococcus
SLGS

SEQ ID NO: 1844399 - protein, 12 aa, Staphylococcus
SMGPTAVSEVTE

SEQ ID NO: 1844400 - protein, 5 aa, Staphylococcus
SNGHG

SEQ ID NO: 1844401 - protein, 4 aa, Staphylococcus
SNLD

SEQ ID NO: 1844402 - protein, 4 aa, Staphylococcus
SPND

SEQ ID NO: 1844403 - protein, 9 aa, Staphylococcus
SRSSAGSLP

SEQ ID NO: 1844404 - protein, 7 aa, Staphylococcus
SSIAGPA

SEQ ID NO: 1844405 - protein, 11 aa, Staphylococcus
STDAEGNSIET

SEQ ID NO: 1844406 - protein, 8 aa, Staphylococcus
STGGEYAG

SEQ ID NO: 1844407 - protein, 10 aa, Staphylococcus
STTPKENRKK

SEQ ID NO: 1844408 - protein, 7 aa, Staphylococcus
SVEGQGT

SEQ ID NO: 1844409 - protein, 4 aa, Staphylococcus
SVKG

SEQ ID NO: 1844410 - protein, 5 aa, Staphylococcus
TAAAQ

SEQ ID NO: 1844411 - protein, 13 aa, Staphylococcus
TANLDSESEQKIQ

SEQ ID NO: 1844412 - protein, 4 aa, Staphylococcus
TDGL

SEQ ID NO: 1844413 - protein, 8 aa, Staphylococcus
TDGLDGLA

SEQ ID NO: 1844414 - protein, 22 aa, Staphylococcus
TDLTGKATTRTPVDVSSDPNTR

SEQ ID NO: 1844415 - protein, 4 aa, Staphylococcus
TDYN

SEQ ID NO: 1844416 - protein, 6 aa, Staphylococcus
TEKTSR

SEQ ID NO: 1844417 - protein, 6 aa, Staphylococcus
TEKYDS

SEQ ID NO: 1844418 - protein, 5 aa, Staphylococcus
TGGAV

SEQ ID NO: 1844419 - protein, 7 aa, Staphylococcus
TGGSTDL

SEQ ID NO: 1844420 - protein, 8 aa, Staphylococcus
TGKAAENG

SEQ ID NO: 1844421 - protein, 4 aa, Staphylococcus
TGLN

SEQ ID NO: 1844422 - protein, 12 aa, Staphylococcus
TGQGKTSDAEFT

SEQ ID NO: 1844423 - protein, 7 aa, Staphylococcus
TGTITYG

SEQ ID NO: 1844424 - protein, 8 aa, Staphylococcus
TGTLTEGN

SEQ ID NO: 1844425 - protein, 9 aa, Staphylococcus
TIGSSEHHT

SEQ ID NO: 1844426 - protein, 12 aa, Staphylococcus
TKTGSEDGCGSS

SEQ ID NO: 1844427 - protein, 5 aa, Staphylococcus
TKVGT

SEQ ID NO: 1844428 - protein, 4 aa, Staphylococcus
TLGA

SEQ ID NO: 1844429 - protein, 6 aa, Staphylococcus
TLTDRA

SEQ ID NO: 1844430 - protein, 6 aa, Staphylococcus
TNPAIQ

SEQ ID NO: 1844431 - protein, 7 aa, Staphylococcus
TNPAVQS

SEQ ID NO: 1844432 - protein, 4 aa, Staphylococcus
TNYK

SEQ ID NO: 1844433 - protein, 11 aa, Staphylococcus
TPKPGETEKSV

SEQ ID NO: 1844434 - protein, 8 aa, Staphylococcus
TPTRPIPV

SEQ ID NO: 1844435 - protein, 40 aa, Staphylococcus
TQPIPEGNVTAKAYDNAEHPNVSTSEPKKATDTTPPTEPV

SEQ ID NO: 1844436 - protein, 6 aa, Staphylococcus
TQVSRA

SEQ ID NO: 1844437 - protein, 5 aa, Staphylococcus
TSALD

SEQ ID NO: 1844438 - protein, 5 aa, Staphylococcus
TSSEY

SEQ ID NO: 1844439 - protein, 4 aa, Staphylococcus
TSYH

SEQ ID NO: 1844440 - protein, 19 aa, Staphylococcus
TTAPTVKEISDQTKEVNTA

SEQ ID NO: 1844441 - protein, 4 aa, Staphylococcus
TTRI

SEQ ID NO: 1844442 - protein, 4 aa, Staphylococcus
TTSY

SEQ ID NO: 1844443 - protein, 5 aa, Staphylococcus
TTYGG

SEQ ID NO: 1844444 - protein, 5 aa, Staphylococcus
TVPTD

SEQ ID NO: 1844445 - protein, 10 aa, Staphylococcus
TYPDGTKDHV

SEQ ID NO: 1844446 - protein, 6 aa, Staphylococcus
TYRKPG

SEQ ID NO: 1844447 - protein, 6 aa, Staphylococcus
VAGNTI

SEQ ID NO: 1844448 - protein, 14 aa, Staphylococcus
VATGTAWGSASTAG

SEQ ID NO: 1844449 - protein, 9 aa, Staphylococcus
VDKGQTEAA

SEQ ID NO: 1844450 - protein, 6 aa, Staphylococcus
VGAGGL

SEQ ID NO: 1844451 - protein, 5 aa, Staphylococcus
VGANK

SEQ ID NO: 1844452 - protein, 9 aa, Staphylococcus
VGAQFGQDA

SEQ ID NO: 1844453 - protein, 11 aa, Staphylococcus
VGGATDDINTA

SEQ ID NO: 1844454 - protein, 10 aa, Staphylococcus
VGRPDVKGRE

SEQ ID NO: 1844455 - protein, 5 aa, Staphylococcus
VHTNN

SEQ ID NO: 1844456 - protein, 33 aa, Staphylococcus
VKEQPDKDKYEPKVTPVTKDFGTPTTADDVTKA

SEQ ID NO: 1844457 - protein, 14 aa, Staphylococcus
VKRARTQEEKMAAN

SEQ ID NO: 1844458 - protein, 23 aa, Staphylococcus
VKSNYEKYSQVRSTSGKTGREVA

SEQ ID NO: 1844459 - protein, 6 aa, Staphylococcus
VNPHDS

SEQ ID NO: 1844460 - protein, 7 aa, Staphylococcus
VQPAQGV

SEQ ID NO: 1844461 - protein, 7 aa, Staphylococcus
VSENGGI

SEQ ID NO: 1844462 - protein, 4 aa, Staphylococcus
VSPQ

SEQ ID NO: 1844463 - protein, 4 aa, Staphylococcus
VSRR

SEQ ID NO: 1844464 - protein, 7 aa, Staphylococcus
VTDPNTK

SEQ ID NO: 1844465 - protein, 4 aa, Staphylococcus
VTTP

SEQ ID NO: 1844466 - protein, 11 aa, Staphylococcus
VTYPDGSKDHV

SEQ ID NO: 1844467 - protein, 11 aa, Staphylococcus
VTYPDGTKDHV

SEQ ID NO: 1844468 - protein, 8 aa, Staphylococcus
WPNGGRQT

SEQ ID NO: 1844469 - protein, 7 aa, Staphylococcus
YAPKEMT

SEQ ID NO: 1844470 - protein, 6 aa, Staphylococcus
YGGTAG

SEQ ID NO: 1844471 - protein, 6 aa, Staphylococcus
YTASQD

SEQ ID NO: 1844472 - protein, 12 aa, Staphylococcus
YTGQTAAENGIT

SEQ ID NO: 1844473 - protein, 8 aa, Staphylococcus
AAAGAYGA

SEQ ID NO: 1844474 - protein, 4 aa, Staphylococcus
AAAQ

SEQ ID NO: 1844475 - protein, 4 aa, Staphylococcus
AAEG

SEQ ID NO: 1844476 - protein, 8 aa, Staphylococcus
AAHPSPVA

SEQ ID NO: 1844477 - protein, 8 aa, Staphylococcus
AAIASQGS

SEQ ID NO: 1844478 - protein, 8 aa, Staphylococcus
AALNGQKR

SEQ ID NO: 1844479 - protein, 9 aa, Staphylococcus
AALNPQKRE

SEQ ID NO: 1844480 - protein, 9 aa, Staphylococcus
AALNSQKRE

SEQ ID NO: 1844481 - protein, 8 aa, Staphylococcus
AANIKENN

SEQ ID NO: 1844482 - protein, 10 aa, Staphylococcus
AAREGKNKID

SEQ ID NO: 1844483 - protein, 5 aa, Staphylococcus
AATAT

SEQ ID NO: 1844484 - protein, 8 aa, Staphylococcus
AATKSSTL

SEQ ID NO: 1844485 - protein, 6 aa, Staphylococcus
AAVPGT

SEQ ID NO: 1844486 - protein, 16 aa, Staphylococcus
ADDSSYSSAPSHIDTN

SEQ ID NO: 1844487 - protein, 7 aa, Staphylococcus
ADGHEIS

SEQ ID NO: 1844488 - protein, 9 aa, Staphylococcus
ADISTANNT

SEQ ID NO: 1844489 - protein, 7 aa, Staphylococcus
ADNAEPV

SEQ ID NO: 1844490 - protein, 22 aa, Staphylococcus
ADQTGTFRGRNSNFNGEGFSRQ

SEQ ID NO: 1844491 - protein, 5 aa, Staphylococcus
ADSTY

SEQ ID NO: 1844492 - protein, 7 aa, Staphylococcus
ADYQSKM

SEQ ID NO: 1844493 - protein, 4 aa, Staphylococcus
AEGL

SEQ ID NO: 1844494 - protein, 5 aa, Staphylococcus
AEGLS

SEQ ID NO: 1844495 - protein, 9 aa, Staphylococcus
AEGYEDRKN

SEQ ID NO: 1844496 - protein, 10 aa, Staphylococcus
AELRTGPNAA

SEQ ID NO: 1844497 - protein, 4 aa, Staphylococcus
AEQL

SEQ ID NO: 1844498 - protein, 8 aa, Staphylococcus
AEREATRS

SEQ ID NO: 1844499 - protein, 9 aa, Staphylococcus
AESSKPLKE

SEQ ID NO: 1844500 - protein, 6 aa, Staphylococcus
AFENGV

SEQ ID NO: 1844501 - protein, 6 aa, Staphylococcus
AFQQNR

SEQ ID NO: 1844502 - protein, 6 aa, Staphylococcus
AGAPPL

SEQ ID NO: 1844503 - protein, 5 aa, Staphylococcus
AGASR

SEQ ID NO: 1844504 - protein, 10 aa, Staphylococcus
AGAVGGGGIG

SEQ ID NO: 1844505 - protein, 7 aa, Staphylococcus
AGDPYYS

SEQ ID NO: 1844506 - protein, 5 aa, Staphylococcus
AGEHA

SEQ ID NO: 1844507 - protein, 8 aa, Staphylococcus
AGESIPTD

SEQ ID NO: 1844508 - protein, 11 aa, Staphylococcus
AGETKDPQKNI

SEQ ID NO: 1844509 - protein, 14 aa, Staphylococcus
AGETKDPQKNIKSA

SEQ ID NO: 1844510 - protein, 14 aa, Staphylococcus
AGETKDPQKTIPKA

SEQ ID NO: 1844511 - protein, 14 aa, Staphylococcus
AGETKNPEKTIPKA

SEQ ID NO: 1844512 - protein, 7 aa, Staphylococcus
AGGCSIG

SEQ ID NO: 1844513 - protein, 6 aa, Staphylococcus
AGGDGV

SEQ ID NO: 1844514 - protein, 13 aa, Staphylococcus
AGGEGAKNYGDPK

SEQ ID NO: 1844515 - protein, 6 aa, Staphylococcus
AGGGVE

SEQ ID NO: 1844516 - protein, 4 aa, Staphylococcus
AGIT

SEQ ID NO: 1844517 - protein, 10 aa, Staphylococcus
AGITTPTQKT

SEQ ID NO: 1844518 - protein, 8 aa, Staphylococcus
AGKGGSNW

SEQ ID NO: 1844519 - protein, 8 aa, Staphylococcus
AGKGKSNW

SEQ ID NO: 1844520 - protein, 9 aa, Staphylococcus
AGLNLTTNQ

SEQ ID NO: 1844521 - protein, 10 aa, Staphylococcus
AGNPSKGDQT

SEQ ID NO: 1844522 - protein, 5 aa, Staphylococcus
AGPSS

SEQ ID NO: 1844523 - protein, 6 aa, Staphylococcus
AGQDHI

SEQ ID NO: 1844524 - protein, 5 aa, Staphylococcus
AGSLS

SEQ ID NO: 1844525 - protein, 9 aa, Staphylococcus
AGTDVAVDS

SEQ ID NO: 1844526 - protein, 5 aa, Staphylococcus
AHAKS

SEQ ID NO: 1844527 - protein, 8 aa, Staphylococcus
AHGRDGSR

SEQ ID NO: 1844528 - protein, 5 aa, Staphylococcus
AIHDA

SEQ ID NO: 1844529 - protein, 7 aa, Staphylococcus
AIPETGG

SEQ ID NO: 1844530 - protein, 4 aa, Staphylococcus
AIST

SEQ ID NO: 1844531 - protein, 7 aa, Staphylococcus
AKDNKTY

SEQ ID NO: 1844532 - protein, 6 aa, Staphylococcus
AKGNST

SEQ ID NO: 1844533 - protein, 6 aa, Staphylococcus
AKGSRE

SEQ ID NO: 1844534 - protein, 8 aa, Staphylococcus
AKIDGANR

SEQ ID NO: 1844535 - protein, 32 aa, Staphylococcus
AKKPASQQAKSAAVTQTAKYKVQKDKSTETSV

SEQ ID NO: 1844536 - protein, 11 aa, Staphylococcus
AKNEVEETKDV

SEQ ID NO: 1844537 - protein, 9 aa, Staphylococcus
AKPEVDGIQ

SEQ ID NO: 1844538 - protein, 7 aa, Staphylococcus
AKSSELI

SEQ ID NO: 1844539 - protein, 7 aa, Staphylococcus
AKTGSLL

SEQ ID NO: 1844540 - protein, 9 aa, Staphylococcus
ALDAAGQAF

SEQ ID NO: 1844541 - protein, 27 aa, Staphylococcus
ALEEQEATFGRKRSSGAPLTGKKEFDE

SEQ ID NO: 1844542 - protein, 7 aa, Staphylococcus
ALPSDKV

SEQ ID NO: 1844543 - protein, 6 aa, Staphylococcus
AMGASP

SEQ ID NO: 1844544 - protein, 9 aa, Staphylococcus
AMGGGQYSA

SEQ ID NO: 1844545 - protein, 9 aa, Staphylococcus
AMGQGIAKA

SEQ ID NO: 1844546 - protein, 6 aa, Staphylococcus
AMQGES

SEQ ID NO: 1844547 - protein, 8 aa, Staphylococcus
ANAVATAV

SEQ ID NO: 1844548 - protein, 7 aa, Staphylococcus
ANQQGTP

SEQ ID NO: 1844549 - protein, 4 aa, Staphylococcus
ANVS

SEQ ID NO: 1844550 - protein, 5 aa, Staphylococcus
APDSG

SEQ ID NO: 1844551 - protein, 5 aa, Staphylococcus
APISS

SEQ ID NO: 1844552 - protein, 7 aa, Staphylococcus
APKFDND

SEQ ID NO: 1844553 - protein, 10 aa, Staphylococcus
APKMTDTGST

SEQ ID NO: 1844554 - protein, 4 aa, Staphylococcus
APSA

SEQ ID NO: 1844555 - protein, 4 aa, Staphylococcus
APSV

SEQ ID NO: 1844556 - protein, 8 aa, Staphylococcus
AQPPSPEW

SEQ ID NO: 1844557 - protein, 6 aa, Staphylococcus
AQQGNS

SEQ ID NO: 1844558 - protein, 8 aa, Staphylococcus
AQTGTALE

SEQ ID NO: 1844559 - protein, 11 aa, Staphylococcus
ARAKSQTTNAL

SEQ ID NO: 1844560 - protein, 10 aa, Staphylococcus
ARSDKGTAGL

SEQ ID NO: 1844561 - protein, 8 aa, Staphylococcus
ASAQAING

SEQ ID NO: 1844562 - protein, 8 aa, Staphylococcus
ASGAAHGI

SEQ ID NO: 1844563 - protein, 5 aa, Staphylococcus
ASGGA

SEQ ID NO: 1844564 - protein, 7 aa, Staphylococcus
ASGTQQL

SEQ ID NO: 1844565 - protein, 7 aa, Staphylococcus
ASKGMSL

SEQ ID NO: 1844566 - protein, 6 aa, Staphylococcus
ASKGNG

SEQ ID NO: 1844567 - protein, 10 aa, Staphylococcus
ASKKEGTWSL

SEQ ID NO: 1844568 - protein, 6 aa, Staphylococcus
ASNDAK

SEQ ID NO: 1844569 - protein, 7 aa, Staphylococcus
ASNEPPG

SEQ ID NO: 1844570 - protein, 14 aa, Staphylococcus
ASNYEDIKQDTDKL

SEQ ID NO: 1844571 - protein, 4 aa, Staphylococcus
ASPE

SEQ ID NO: 1844572 - protein, 4 aa, Staphylococcus
ASQT

SEQ ID NO: 1844573 - protein, 11 aa, Staphylococcus
ASRKRGKQGTG

SEQ ID NO: 1844574 - protein, 11 aa, Staphylococcus
ASSDLGASPFT

SEQ ID NO: 1844575 - protein, 4 aa, Staphylococcus
ASSL

SEQ ID NO: 1844576 - protein, 7 aa, Staphylococcus
ASTEPPG

SEQ ID NO: 1844577 - protein, 7 aa, Staphylococcus
ATAQGLN

SEQ ID NO: 1844578 - protein, 5 aa, Staphylococcus
ATATT

SEQ ID NO: 1844579 - protein, 4 aa, Staphylococcus
ATAV

SEQ ID NO: 1844580 - protein, 8 aa, Staphylococcus
ATDRRGRV

SEQ ID NO: 1844581 - protein, 6 aa, Staphylococcus
ATDSQV

SEQ ID NO: 1844582 - protein, 4 aa, Staphylococcus
ATEF

SEQ ID NO: 1844583 - protein, 9 aa, Staphylococcus
ATGKGIGPN

SEQ ID NO: 1844584 - protein, 4 aa, Staphylococcus
ATPG

SEQ ID NO: 1844585 - protein, 20 aa, Staphylococcus
ATPSTDTAVAQAPDEKVGVA

SEQ ID NO: 1844586 - protein, 8 aa, Staphylococcus
ATQDPAMA

SEQ ID NO: 1844587 - protein, 9 aa, Staphylococcus
ATRKKTPNE

SEQ ID NO: 1844588 - protein, 10 aa, Staphylococcus
ATTNGGLDIT

SEQ ID NO: 1844589 - protein, 11 aa, Staphylococcus
ATTNGGLDITG

SEQ ID NO: 1844590 - protein, 10 aa, Staphylococcus
ATVVERNGKK

SEQ ID NO: 1844591 - protein, 7 aa, Staphylococcus
AVQSGSV

SEQ ID NO: 1844592 - protein, 9 aa, Staphylococcus
AVQTKVNQA

SEQ ID NO: 1844593 - protein, 8 aa, Staphylococcus
AVRPEQTK

SEQ ID NO: 1844594 - protein, 4 aa, Staphylococcus
AYDD

SEQ ID NO: 1844595 - protein, 7 aa, Staphylococcus
AYGGPKM

SEQ ID NO: 1844596 - protein, 4 aa, Staphylococcus
AYRT

SEQ ID NO: 1844597 - protein, 6 aa, Staphylococcus
DADPFY

SEQ ID NO: 1844598 - protein, 8 aa, Staphylococcus
DAEGDFGR

SEQ ID NO: 1844599 - protein, 4 aa, Staphylococcus
DAGI

SEQ ID NO: 1844600 - protein, 11 aa, Staphylococcus
DALSSVAYGPE

SEQ ID NO: 1844601 - protein, 8 aa, Staphylococcus
DANQTVEQ

SEQ ID NO: 1844602 - protein, 9 aa, Staphylococcus
DANVQRTSY

SEQ ID NO: 1844603 - protein, 5 aa, Staphylococcus
DATTT

SEQ ID NO: 1844604 - protein, 12 aa, Staphylococcus
DDEGNELPPNRM

SEQ ID NO: 1844605 - protein, 5 aa, Staphylococcus
DDISG

SEQ ID NO: 1844606 - protein, 8 aa, Staphylococcus
DDKDYSIP

SEQ ID NO: 1844607 - protein, 4 aa, Staphylococcus
DDPL

SEQ ID NO: 1844608 - protein, 17 aa, Staphylococcus
DDPTQLPDGNTPGTSNV

SEQ ID NO: 1844609 - protein, 5 aa, Staphylococcus
DDQNT

SEQ ID NO: 1844610 - protein, 4 aa, Staphylococcus
DDVV

SEQ ID NO: 1844611 - protein, 8 aa, Staphylococcus
DEATGKVT

SEQ ID NO: 1844612 - protein, 7 aa, Staphylococcus
DEDIKTQ

SEQ ID NO: 1844613 - protein, 6 aa, Staphylococcus
DEDQSE

SEQ ID NO: 1844614 - protein, 8 aa, Staphylococcus
DEKQAPKF

SEQ ID NO: 1844615 - protein, 9 aa, Staphylococcus
DELDKTNPV

SEQ ID NO: 1844616 - protein, 9 aa, Staphylococcus
DENNNKLNT

SEQ ID NO: 1844617 - protein, 11 aa, Staphylococcus
DEQARNNLNGP

SEQ ID NO: 1844618 - protein, 6 aa, Staphylococcus
DEQVGR

SEQ ID NO: 1844619 - protein, 21 aa, Staphylococcus
DESAITGESAPVIKESGGDFN

SEQ ID NO: 1844620 - protein, 15 aa, Staphylococcus
DETDDTVDVKDGMGK

SEQ ID NO: 1844621 - protein, 7 aa, Staphylococcus
DETEDEI

SEQ ID NO: 1844622 - protein, 8 aa, Staphylococcus
DETEDEIN

SEQ ID NO: 1844623 - protein, 9 aa, Staphylococcus
DETGRTRPT

SEQ ID NO: 1844624 - protein, 6 aa, Staphylococcus
DEVPTI

SEQ ID NO: 1844625 - protein, 9 aa, Staphylococcus
DFGGPDSVR

SEQ ID NO: 1844626 - protein, 14 aa, Staphylococcus
DFGTPTTADDVTKA

SEQ ID NO: 1844627 - protein, 4 aa, Staphylococcus
DGAS

SEQ ID NO: 1844628 - protein, 5 aa, Staphylococcus
DGASE

SEQ ID NO: 1844629 - protein, 7 aa, Staphylococcus
DGDGTTT

SEQ ID NO: 1844630 - protein, 11 aa, Staphylococcus
DGLEEPPVEPG

SEQ ID NO: 1844631 - protein, 11 aa, Staphylococcus
DGLEEPPVQPG

SEQ ID NO: 1844632 - protein, 15 aa, Staphylococcus
DGNIIGSGTTGDTGH

SEQ ID NO: 1844633 - protein, 15 aa, Staphylococcus
DGNVIGSGTTDDTGH

SEQ ID NO: 1844634 - protein, 14 aa, Staphylococcus
DGNVIGSGTTDNTG

SEQ ID NO: 1844635 - protein, 15 aa, Staphylococcus
DGNVIGSGTTDNTGH

SEQ ID NO: 1844636 - protein, 4 aa, Staphylococcus
DGPL

SEQ ID NO: 1844637 - protein, 7 aa, Staphylococcus
DGVTGVK

SEQ ID NO: 1844638 - protein, 7 aa, Staphylococcus
DIATGLG

SEQ ID NO: 1844639 - protein, 4 aa, Staphylococcus
DIPE

SEQ ID NO: 1844640 - protein, 5 aa, Staphylococcus
DIPGG

SEQ ID NO: 1844641 - protein, 9 aa, Staphylococcus
DIPNPTQGL

SEQ ID NO: 1844642 - protein, 9 aa, Staphylococcus
DISGGHLNP

SEQ ID NO: 1844643 - protein, 12 aa, Staphylococcus
DKAQSGKSRTDS

SEQ ID NO: 1844644 - protein, 11 aa, Staphylococcus
DKDGGFRGGPA

SEQ ID NO: 1844645 - protein, 5 aa, Staphylococcus
DKKNV

SEQ ID NO: 1844646 - protein, 8 aa, Staphylococcus
DKKPELKE

SEQ ID NO: 1844647 - protein, 9 aa, Staphylococcus
DKKTIRNSA

SEQ ID NO: 1844648 - protein, 8 aa, Staphylococcus
DKKTSDFV

SEQ ID NO: 1844649 - protein, 10 aa, Staphylococcus
DKKVPTGGEY

SEQ ID NO: 1844650 - protein, 6 aa, Staphylococcus
DKLDEG

SEQ ID NO: 1844651 - protein, 6 aa, Staphylococcus
DKNGDL

SEQ ID NO: 1844652 - protein, 6 aa, Staphylococcus
DKNSKG

SEQ ID NO: 1844653 - protein, 5 aa, Staphylococcus
DKQTI

SEQ ID NO: 1844654 - protein, 5 aa, Staphylococcus
DKRHK

SEQ ID NO: 1844655 - protein, 5 aa, Staphylococcus
DKRLP

SEQ ID NO: 1844656 - protein, 6 aa, Staphylococcus
DKRLPQ

SEQ ID NO: 1844657 - protein, 4 aa, Staphylococcus
DKYG

SEQ ID NO: 1844658 - protein, 6 aa, Staphylococcus
DLGASG

SEQ ID NO: 1844659 - protein, 7 aa, Staphylococcus
DLKQNLS

SEQ ID NO: 1844660 - protein, 8 aa, Staphylococcus
DLQPKGTF

SEQ ID NO: 1844661 - protein, 5 aa, Staphylococcus
DNEAL

SEQ ID NO: 1844662 - protein, 18 aa, Staphylococcus
DNEGRRKNGQTTEHSRTD

SEQ ID NO: 1844663 - protein, 11 aa, Staphylococcus
DNIKQDDDYVQ

SEQ ID NO: 1844664 - protein, 5 aa, Staphylococcus
DNKYQ

SEQ ID NO: 1844665 - protein, 5 aa, Staphylococcus
DNNSR

SEQ ID NO: 1844666 - protein, 9 aa, Staphylococcus
DPGDKEDAA

SEQ ID NO: 1844667 - protein, 6 aa, Staphylococcus
DPKNGD

SEQ ID NO: 1844668 - protein, 8 aa, Staphylococcus
DQAKTGGS

SEQ ID NO: 1844669 - protein, 4 aa, Staphylococcus
DQEV

SEQ ID NO: 1844670 - protein, 11 aa, Staphylococcus
DQIPKNYTATQ

SEQ ID NO: 1844671 - protein, 18 aa, Staphylococcus
DQLPEKLRAQYSQKLEQL

SEQ ID NO: 1844672 - protein, 7 aa, Staphylococcus
DQYTIES

SEQ ID NO: 1844673 - protein, 5 aa, Staphylococcus
DRIGE

SEQ ID NO: 1844674 - protein, 6 aa, Staphylococcus
DRNIKG

SEQ ID NO: 1844675 - protein, 5 aa, Staphylococcus
DRTNT

SEQ ID NO: 1844676 - protein, 6 aa, Staphylococcus
DRTTDL

SEQ ID NO: 1844677 - protein, 7 aa, Staphylococcus
DSKSEWR

SEQ ID NO: 1844678 - protein, 7 aa, Staphylococcus
DSKTGGL

SEQ ID NO: 1844679 - protein, 7 aa, Staphylococcus
DSNEAME

SEQ ID NO: 1844680 - protein, 5 aa, Staphylococcus
DSNNY

SEQ ID NO: 1844681 - protein, 4 aa, Staphylococcus
DSQS

SEQ ID NO: 1844682 - protein, 4 aa, Staphylococcus
DSQV

SEQ ID NO: 1844683 - protein, 7 aa, Staphylococcus
DSYSPHR

SEQ ID NO: 1844684 - protein, 18 aa, Staphylococcus
DTANAVATAVSTRALTPR

SEQ ID NO: 1844685 - protein, 11 aa, Staphylococcus
DTPEDEEKDAY

SEQ ID NO: 1844686 - protein, 6 aa, Staphylococcus
DTPNVA

SEQ ID NO: 1844687 - protein, 9 aa, Staphylococcus
DTSMNNQNA

SEQ ID NO: 1844688 - protein, 4 aa, Staphylococcus
DTYI

SEQ ID NO: 1844689 - protein, 7 aa, Staphylococcus
DVDTTPR

SEQ ID NO: 1844690 - protein, 5 aa, Staphylococcus
DVENA

SEQ ID NO: 1844691 - protein, 8 aa, Staphylococcus
DVTDVERS

SEQ ID NO: 1844692 - protein, 7 aa, Staphylococcus
DYGNGKE

SEQ ID NO: 1844693 - protein, 7 aa, Staphylococcus
DYSKNYA

SEQ ID NO: 1844694 - protein, 8 aa, Staphylococcus
EAAKASET

SEQ ID NO: 1844695 - protein, 8 aa, Staphylococcus
EADTGMRN

SEQ ID NO: 1844696 - protein, 10 aa, Staphylococcus
EAQSSKAPIQ

SEQ ID NO: 1844697 - protein, 14 aa, Staphylococcus
EAQVNQKEYKGFGG

SEQ ID NO: 1844698 - protein, 13 aa, Staphylococcus
ECSVEDDTPEGSS

SEQ ID NO: 1844699 - protein, 9 aa, Staphylococcus
EDAYSQTSG

SEQ ID NO: 1844700 - protein, 7 aa, Staphylococcus
EDDLTNV

SEQ ID NO: 1844701 - protein, 6 aa, Staphylococcus
EDERQR

SEQ ID NO: 1844702 - protein, 7 aa, Staphylococcus
EDERQRL

SEQ ID NO: 1844703 - protein, 17 aa, Staphylococcus
EDIERKTKEIVSDIENN

SEQ ID NO: 1844704 - protein, 18 aa, Staphylococcus
EDIERKTKEIVSDIESNN

SEQ ID NO: 1844705 - protein, 5 aa, Staphylococcus
EDKKA

SEQ ID NO: 1844706 - protein, 5 aa, Staphylococcus
EDPDR

SEQ ID NO: 1844707 - protein, 5 aa, Staphylococcus
EDQDT

SEQ ID NO: 1844708 - protein, 8 aa, Staphylococcus
EDSEDIDT

SEQ ID NO: 1844709 - protein, 5 aa, Staphylococcus
EDSND

SEQ ID NO: 1844710 - protein, 11 aa, Staphylococcus
EEAQGSKAPIQ

SEQ ID NO: 1844711 - protein, 8 aa, Staphylococcus
EEDTAGGI

SEQ ID NO: 1844712 - protein, 29 aa, Staphylococcus
EEERGNKEVNNELKEKVSANFDTKKADAI

SEQ ID NO: 1844713 - protein, 8 aa, Staphylococcus
EEITEGTA

SEQ ID NO: 1844714 - protein, 11 aa, Staphylococcus
EEKRNDPNFGS

SEQ ID NO: 1844715 - protein, 12 aa, Staphylococcus
EERTGGSGNASS

SEQ ID NO: 1844716 - protein, 16 aa, Staphylococcus
EESLSRYQSTNGRQNI

SEQ ID NO: 1844717 - protein, 4 aa, Staphylococcus
EETG

SEQ ID NO: 1844718 - protein, 6 aa, Staphylococcus
EFDQNQ

SEQ ID NO: 1844719 - protein, 6 aa, Staphylococcus
EGDSVN

SEQ ID NO: 1844720 - protein, 5 aa, Staphylococcus
EGGYP

SEQ ID NO: 1844721 - protein, 4 aa, Staphylococcus
EGIT

SEQ ID NO: 1844722 - protein, 8 aa, Staphylococcus
EGKDGQVQ

SEQ ID NO: 1844723 - protein, 10 aa, Staphylococcus
EGTKSISQKF

SEQ ID NO: 1844724 - protein, 10 aa, Staphylococcus
EIKNPEKNIA

SEQ ID NO: 1844725 - protein, 15 aa, Staphylococcus
EITQNMNDTQRSEIN

SEQ ID NO: 1844726 - protein, 9 aa, Staphylococcus
EKDGTGYAS

SEQ ID NO: 1844727 - protein, 4 aa, Staphylococcus
EKEA

SEQ ID NO: 1844728 - protein, 5 aa, Staphylococcus
EKETG

SEQ ID NO: 1844729 - protein, 10 aa, Staphylococcus
EKGKTAGYTV

SEQ ID NO: 1844730 - protein, 11 aa, Staphylococcus
EKGPNSQSTEN

SEQ ID NO: 1844731 - protein, 6 aa, Staphylococcus
EKGRIA

SEQ ID NO: 1844732 - protein, 6 aa, Staphylococcus
EKIKHT

SEQ ID NO: 1844733 - protein, 4 aa, Staphylococcus
EKKR

SEQ ID NO: 1844734 - protein, 5 aa, Staphylococcus
EKLTD

SEQ ID NO: 1844735 - protein, 7 aa, Staphylococcus
EKQANNI

SEQ ID NO: 1844736 - protein, 5 aa, Staphylococcus
EKRGF

SEQ ID NO: 1844737 - protein, 8 aa, Staphylococcus
EKSPTGIS

SEQ ID NO: 1844738 - protein, 5 aa, Staphylococcus
EKTGY

SEQ ID NO: 1844739 - protein, 8 aa, Staphylococcus
EMSAKDTT

SEQ ID NO: 1844740 - protein, 4 aa, Staphylococcus
ENGN

SEQ ID NO: 1844741 - protein, 13 aa, Staphylococcus
ENIKDAGKGMGMT

SEQ ID NO: 1844742 - protein, 5 aa, Staphylococcus
ENKRA

SEQ ID NO: 1844743 - protein, 23 aa, Staphylococcus
ENNKGVYDRYNRSSQHRHDDELR

SEQ ID NO: 1844744 - protein, 9 aa, Staphylococcus
ENSDTQEAT

SEQ ID NO: 1844745 - protein, 4 aa, Staphylococcus
ENTG

SEQ ID NO: 1844746 - protein, 7 aa, Staphylococcus
EQITPAK

SEQ ID NO: 1844747 - protein, 8 aa, Staphylococcus
EQQTEIET

SEQ ID NO: 1844748 - protein, 7 aa, Staphylococcus
EQQYSKN

SEQ ID NO: 1844749 - protein, 6 aa, Staphylococcus
ERASKE

SEQ ID NO: 1844750 - protein, 9 aa, Staphylococcus
EREAGESKW

SEQ ID NO: 1844751 - protein, 5 aa, Staphylococcus
ERGKY

SEQ ID NO: 1844752 - protein, 6 aa, Staphylococcus
ERSFTR

SEQ ID NO: 1844753 - protein, 5 aa, Staphylococcus
ERTEE

SEQ ID NO: 1844754 - protein, 6 aa, Staphylococcus
ERTSKE

SEQ ID NO: 1844755 - protein, 6 aa, Staphylococcus
ERTTDL

SEQ ID NO: 1844756 - protein, 12 aa, Staphylococcus
ERTTGSGSASSL

SEQ ID NO: 1844757 - protein, 6 aa, Staphylococcus
ESGNYN

SEQ ID NO: 1844758 - protein, 6 aa, Staphylococcus
ESKNRD

SEQ ID NO: 1844759 - protein, 4 aa, Staphylococcus
ESNA

SEQ ID NO: 1844760 - protein, 7 aa, Staphylococcus
ESTYGYR

SEQ ID NO: 1844761 - protein, 17 aa, Staphylococcus
ESVEPGITKHIEEQVIK

SEQ ID NO: 1844762 - protein, 9 aa, Staphylococcus
ETDIYAPGT

SEQ ID NO: 1844763 - protein, 7 aa, Staphylococcus
ETDRPEL

SEQ ID NO: 1844764 - protein, 11 aa, Staphylococcus
ETGEQIPNDGQ

SEQ ID NO: 1844765 - protein, 13 aa, Staphylococcus
ETIPGEGASGSRI

SEQ ID NO: 1844766 - protein, 4 aa, Staphylococcus
ETPV

SEQ ID NO: 1844767 - protein, 10 aa, Staphylococcus
ETQGGVGAEN

SEQ ID NO: 1844768 - protein, 10 aa, Staphylococcus
ETQKELPGQF

SEQ ID NO: 1844769 - protein, 8 aa, Staphylococcus
ETRGRSLE

SEQ ID NO: 1844770 - protein, 5 aa, Staphylococcus
ETTRI

SEQ ID NO: 1844771 - protein, 6 aa, Staphylococcus
ETTRIS

SEQ ID NO: 1844772 - protein, 4 aa, Staphylococcus
ETYN

SEQ ID NO: 1844773 - protein, 4 aa, Staphylococcus
EVPN

SEQ ID NO: 1844774 - protein, 5 aa, Staphylococcus
EVPTI

SEQ ID NO: 1844775 - protein, 9 aa, Staphylococcus
EYANPSNTY

SEQ ID NO: 1844776 - protein, 17 aa, Staphylococcus
FDPRTSTISGVATKVGT

SEQ ID NO: 1844777 - protein, 9 aa, Staphylococcus
FDSRTNTIS

SEQ ID NO: 1844778 - protein, 6 aa, Staphylococcus
FGEGFN

SEQ ID NO: 1844779 - protein, 5 aa, Staphylococcus
FGGNG

SEQ ID NO: 1844780 - protein, 4 aa, Staphylococcus
FGKE

SEQ ID NO: 1844781 - protein, 4 aa, Staphylococcus
FGPR

SEQ ID NO: 1844782 - protein, 6 aa, Staphylococcus
FGRDGS

SEQ ID NO: 1844783 - protein, 6 aa, Staphylococcus
FNGKKS

SEQ ID NO: 1844784 - protein, 11 aa, Staphylococcus
FNKAEQEMGKA

SEQ ID NO: 1844785 - protein, 10 aa, Staphylococcus
FNKNDTPATM

SEQ ID NO: 1844786 - protein, 12 aa, Staphylococcus
FNPTTNTISGVA

SEQ ID NO: 1844787 - protein, 5 aa, Staphylococcus
FPGAV

SEQ ID NO: 1844788 - protein, 4 aa, Staphylococcus
FQPK

SEQ ID NO: 1844789 - protein, 4 aa, Staphylococcus
FSDA

SEQ ID NO: 1844790 - protein, 4 aa, Staphylococcus
FSDG

SEQ ID NO: 1844791 - protein, 4 aa, Staphylococcus
FSPE

SEQ ID NO: 1844792 - protein, 9 aa, Staphylococcus
FSTGGEYAG

SEQ ID NO: 1844793 - protein, 11 aa, Staphylococcus
FSTKGDNRGLG

SEQ ID NO: 1844794 - protein, 12 aa, Staphylococcus
FSTKGKNRGLGL

SEQ ID NO: 1844795 - protein, 14 aa, Staphylococcus
FSTTAEKMGGVTST

SEQ ID NO: 1844796 - protein, 4 aa, Staphylococcus
FTTG

SEQ ID NO: 1844797 - protein, 7 aa, Staphylococcus
GAFENGV

SEQ ID NO: 1844798 - protein, 6 aa, Staphylococcus
GAGEQI

SEQ ID NO: 1844799 - protein, 5 aa, Staphylococcus
GAHAK

SEQ ID NO: 1844800 - protein, 9 aa, Staphylococcus
GAKNDEESL

SEQ ID NO: 1844801 - protein, 7 aa, Staphylococcus
GANQTKF

SEQ ID NO: 1844802 - protein, 9 aa, Staphylococcus
GAQPPSPEW

SEQ ID NO: 1844803 - protein, 12 aa, Staphylococcus
GASNRAKGVKWN

SEQ ID NO: 1844804 - protein, 15 aa, Staphylococcus
GASPAMSEAPEEAEE

SEQ ID NO: 1844805 - protein, 6 aa, Staphylococcus
GASSSS

SEQ ID NO: 1844806 - protein, 6 aa, Staphylococcus
GASSYR

SEQ ID NO: 1844807 - protein, 4 aa, Staphylococcus
GCNS

SEQ ID NO: 1844808 - protein, 7 aa, Staphylococcus
GDAFQGL

SEQ ID NO: 1844809 - protein, 7 aa, Staphylococcus
GDNNEVA

SEQ ID NO: 1844810 - protein, 9 aa, Staphylococcus
GDNQLTAAT

SEQ ID NO: 1844811 - protein, 8 aa, Staphylococcus
GDRKSTIS

SEQ ID NO: 1844812 - protein, 10 aa, Staphylococcus
GDSAYKDEDG

SEQ ID NO: 1844813 - protein, 5 aa, Staphylococcus
GDSGF

SEQ ID NO: 1844814 - protein, 5 aa, Staphylococcus
GEFKN

SEQ ID NO: 1844815 - protein, 6 aa, Staphylococcus
GEGDGF

SEQ ID NO: 1844816 - protein, 8 aa, Staphylococcus
GEGTVENV

SEQ ID NO: 1844817 - protein, 4 aa, Staphylococcus
GENY

SEQ ID NO: 1844818 - protein, 8 aa, Staphylococcus
GETVGIND

SEQ ID NO: 1844819 - protein, 6 aa, Staphylococcus
GFSTGQ

SEQ ID NO: 1844820 - protein, 13 aa, Staphylococcus
GGDASKRRVSGAG

SEQ ID NO: 1844821 - protein, 6 aa, Staphylococcus
GGDPVI

SEQ ID NO: 1844822 - protein, 8 aa, Staphylococcus
GGDTSHNL

SEQ ID NO: 1844823 - protein, 8 aa, Staphylococcus
GGDYAGKM

SEQ ID NO: 1844824 - protein, 4 aa, Staphylococcus
GGEA

SEQ ID NO: 1844825 - protein, 6 aa, Staphylococcus
GGEENL

SEQ ID NO: 1844826 - protein, 8 aa, Staphylococcus
GGGGWGPV

SEQ ID NO: 1844827 - protein, 12 aa, Staphylococcus
GGKTDPMEKRTR

SEQ ID NO: 1844828 - protein, 6 aa, Staphylococcus
GGNGIK

SEQ ID NO: 1844829 - protein, 11 aa, Staphylococcus
GGPYNQIRGTT

SEQ ID NO: 1844830 - protein, 5 aa, Staphylococcus
GGRNF

SEQ ID NO: 1844831 - protein, 5 aa, Staphylococcus
GGSGF

SEQ ID NO: 1844832 - protein, 7 aa, Staphylococcus
GGSLAGS

SEQ ID NO: 1844833 - protein, 5 aa, Staphylococcus
GGSLE

SEQ ID NO: 1844834 - protein, 8 aa, Staphylococcus
GGTKESAG

SEQ ID NO: 1844835 - protein, 7 aa, Staphylococcus
GGVSGTT

SEQ ID NO: 1844836 - protein, 6 aa, Staphylococcus
GHGTEM

SEQ ID NO: 1844837 - protein, 4 aa, Staphylococcus
GIAT

SEQ ID NO: 1844838 - protein, 4 aa, Staphylococcus
GIGI

SEQ ID NO: 1844839 - protein, 7 aa, Staphylococcus
GIKQQTP

SEQ ID NO: 1844840 - protein, 4 aa, Staphylococcus
GIPK

SEQ ID NO: 1844841 - protein, 7 aa, Staphylococcus
GIPKEDQ

SEQ ID NO: 1844842 - protein, 4 aa, Staphylococcus
GIPT

SEQ ID NO: 1844843 - protein, 4 aa, Staphylococcus
GITK

SEQ ID NO: 1844844 - protein, 7 aa, Staphylococcus
GKEGTTV

SEQ ID NO: 1844845 - protein, 13 aa, Staphylococcus
GKEGTVDKTYAGQ

SEQ ID NO: 1844846 - protein, 6 aa, Staphylococcus
GKFEKN

SEQ ID NO: 1844847 - protein, 9 aa, Staphylococcus
GKLGSEPSV

SEQ ID NO: 1844848 - protein, 7 aa, Staphylococcus
GKRQPSL

SEQ ID NO: 1844849 - protein, 16 aa, Staphylococcus
GKTLTVPKGQDGTSIG

SEQ ID NO: 1844850 - protein, 4 aa, Staphylococcus
GKTV

SEQ ID NO: 1844851 - protein, 11 aa, Staphylococcus
GKVYKKERLET

SEQ ID NO: 1844852 - protein, 5 aa, Staphylococcus
GLARA

SEQ ID NO: 1844853 - protein, 7 aa, Staphylococcus
GLDSYNA

SEQ ID NO: 1844854 - protein, 7 aa, Staphylococcus
GLESKDG

SEQ ID NO: 1844855 - protein, 6 aa, Staphylococcus
GLNDPV

SEQ ID NO: 1844856 - protein, 7 aa, Staphylococcus
GLNKYNA

SEQ ID NO: 1844857 - protein, 5 aa, Staphylococcus
GLPGP

SEQ ID NO: 1844858 - protein, 5 aa, Staphylococcus
GMGST

SEQ ID NO: 1844859 - protein, 5 aa, Staphylococcus
GMSPN

SEQ ID NO: 1844860 - protein, 7 aa, Staphylococcus
GNAGDAL

SEQ ID NO: 1844861 - protein, 6 aa, Staphylococcus
GNDDTT

SEQ ID NO: 1844862 - protein, 8 aa, Staphylococcus
GNGNMPKQ

SEQ ID NO: 1844863 - protein, 8 aa, Staphylococcus
GPKITPIG

SEQ ID NO: 1844864 - protein, 4 aa, Staphylococcus
GPKR

SEQ ID NO: 1844865 - protein, 13 aa, Staphylococcus
GPLQFSSSGGGQV

SEQ ID NO: 1844866 - protein, 4 aa, Staphylococcus
GPLS

SEQ ID NO: 1844867 - protein, 7 aa, Staphylococcus
GPNDGME

SEQ ID NO: 1844868 - protein, 4 aa, Staphylococcus
GQEN

SEQ ID NO: 1844869 - protein, 4 aa, Staphylococcus
GQHD

SEQ ID NO: 1844870 - protein, 5 aa, Staphylococcus
GQIKP

SEQ ID NO: 1844871 - protein, 7 aa, Staphylococcus
GQKETYY

SEQ ID NO: 1844872 - protein, 6 aa, Staphylococcus
GQMDGS

SEQ ID NO: 1844873 - protein, 7 aa, Staphylococcus
GQSGMSY

SEQ ID NO: 1844874 - protein, 9 aa, Staphylococcus
GQSGMSYGA

SEQ ID NO: 1844875 - protein, 7 aa, Staphylococcus
GQSGPIA

SEQ ID NO: 1844876 - protein, 6 aa, Staphylococcus
GQTDKF

SEQ ID NO: 1844877 - protein, 6 aa, Staphylococcus
GRGGDQ

SEQ ID NO: 1844878 - protein, 4 aa, Staphylococcus
GRIA

SEQ ID NO: 1844879 - protein, 8 aa, Staphylococcus
GRKQGPPF

SEQ ID NO: 1844880 - protein, 4 aa, Staphylococcus
GRLP

SEQ ID NO: 1844881 - protein, 5 aa, Staphylococcus
GRLPS

SEQ ID NO: 1844882 - protein, 6 aa, Staphylococcus
GRSRRS

SEQ ID NO: 1844883 - protein, 4 aa, Staphylococcus
GRTY

SEQ ID NO: 1844884 - protein, 4 aa, Staphylococcus
GSFE

SEQ ID NO: 1844885 - protein, 6 aa, Staphylococcus
GSFSSY

SEQ ID NO: 1844886 - protein, 5 aa, Staphylococcus
GSFST

SEQ ID NO: 1844887 - protein, 5 aa, Staphylococcus
GSIKE

SEQ ID NO: 1844888 - protein, 4 aa, Staphylococcus
GSMS

SEQ ID NO: 1844889 - protein, 10 aa, Staphylococcus
GSNASGKSTF

SEQ ID NO: 1844890 - protein, 10 aa, Staphylococcus
GSNVNSNDYT

SEQ ID NO: 1844891 - protein, 8 aa, Staphylococcus
GSPASLSM

SEQ ID NO: 1844892 - protein, 15 aa, Staphylococcus
GSPFNDAKLSAEQKA

SEQ ID NO: 1844893 - protein, 7 aa, Staphylococcus
GSRDLRK

SEQ ID NO: 1844894 - protein, 7 aa, Staphylococcus
GSRTLRK

SEQ ID NO: 1844895 - protein, 5 aa, Staphylococcus
GSSFG

SEQ ID NO: 1844896 - protein, 8 aa, Staphylococcus
GSSVKGGT

SEQ ID NO: 1844897 - protein, 4 aa, Staphylococcus
GSTF

SEQ ID NO: 1844898 - protein, 4 aa, Staphylococcus
GSTL

SEQ ID NO: 1844899 - protein, 10 aa, Staphylococcus
GSTVEDEEKI

SEQ ID NO: 1844900 - protein, 10 aa, Staphylococcus
GSTVENEEKI

SEQ ID NO: 1844901 - protein, 7 aa, Staphylococcus
GSVSKGI

SEQ ID NO: 1844902 - protein, 8 aa, Staphylococcus
GSVSTDAH

SEQ ID NO: 1844903 - protein, 5 aa, Staphylococcus
GSYSN

SEQ ID NO: 1844904 - protein, 4 aa, Staphylococcus
GTAG

SEQ ID NO: 1844905 - protein, 7 aa, Staphylococcus
GTAGVPG

SEQ ID NO: 1844906 - protein, 4 aa, Staphylococcus
GTDK

SEQ ID NO: 1844907 - protein, 9 aa, Staphylococcus
GTEITKKER

SEQ ID NO: 1844908 - protein, 4 aa, Staphylococcus
GTGN

SEQ ID NO: 1844909 - protein, 4 aa, Staphylococcus
GTKN

SEQ ID NO: 1844910 - protein, 8 aa, Staphylococcus
GTNSTDGT

SEQ ID NO: 1844911 - protein, 9 aa, Staphylococcus
GTNSTDGTT

SEQ ID NO: 1844912 - protein, 12 aa, Staphylococcus
GTNTTERIAASE

SEQ ID NO: 1844913 - protein, 6 aa, Staphylococcus
GTPMSA

SEQ ID NO: 1844914 - protein, 6 aa, Staphylococcus
GTRTSR

SEQ ID NO: 1844915 - protein, 10 aa, Staphylococcus
GTSLTGGKGR

SEQ ID NO: 1844916 - protein, 5 aa, Staphylococcus
GTSVG

SEQ ID NO: 1844917 - protein, 4 aa, Staphylococcus
GTTP

SEQ ID NO: 1844918 - protein, 4 aa, Staphylococcus
GTTQ

SEQ ID NO: 1844919 - protein, 22 aa, Staphylococcus
GTTTTTSYIESTSGVAVGARTG

SEQ ID NO: 1844920 - protein, 8 aa, Staphylococcus
GVDQGKRG

SEQ ID NO: 1844921 - protein, 5 aa, Staphylococcus
GVGAE

SEQ ID NO: 1844922 - protein, 6 aa, Staphylococcus
GVGDTI

SEQ ID NO: 1844923 - protein, 6 aa, Staphylococcus
GVSGTT

SEQ ID NO: 1844924 - protein, 20 aa, Staphylococcus
GYDTEVGERGVKLSGGQKQR

SEQ ID NO: 1844925 - protein, 4 aa, Staphylococcus
HAKP

SEQ ID NO: 1844926 - protein, 10 aa, Staphylococcus
HDKKADTKTI

SEQ ID NO: 1844927 - protein, 10 aa, Staphylococcus
HDPEGDFGRV

SEQ ID NO: 1844928 - protein, 8 aa, Staphylococcus
HEASRKGS

SEQ ID NO: 1844929 - protein, 10 aa, Staphylococcus
HEKSEKVVEN

SEQ ID NO: 1844930 - protein, 4 aa, Staphylococcus
HERG

SEQ ID NO: 1844931 - protein, 6 aa, Staphylococcus
HFPNDQ

SEQ ID NO: 1844932 - protein, 6 aa, Staphylococcus
HGSNDK

SEQ ID NO: 1844933 - protein, 150 aa, Staphylococcus
HPNETDDSQSDTSAEKRNKDKHQQDPGDKSVPPASEKQQAHVKQQQQTQQNNDTHASNNEDTSSRTTTPSNNSETTTQSSSSTPTPSSHESSAQQGEKKQVTTAASKNKAHAAQQHKDKNKRTPAFDRNADKSYHTDGNKQPNVNLPKHT

SEQ ID NO: 1844934 - protein, 137 aa, Staphylococcus
HQAQAAENAVEPAHSAVASENNTPAQSKPVAPTVETNEQPNADHTDKTVATTTTNDKSRAQANDKQTVTPATNVSNTTQPKAAPASTALTTNAVNPKSSTAVSNPAKQAVDQSIKDAVKDKTYTNKPHDTSNSRPVS

SEQ ID NO: 1844935 - protein, 8 aa, Staphylococcus
HSENSRLS

SEQ ID NO: 1844936 - protein, 7 aa, Staphylococcus
HSEQEYP

SEQ ID NO: 1844937 - protein, 17 aa, Staphylococcus
HSQAQEKYDYDTEISGQ

SEQ ID NO: 1844938 - protein, 11 aa, Staphylococcus
HTGKQSEGASD

SEQ ID NO: 1844939 - protein, 10 aa, Staphylococcus
HYDNQRDDID

SEQ ID NO: 1844940 - protein, 6 aa, Staphylococcus
HYDPKK

SEQ ID NO: 1844941 - protein, 6 aa, Staphylococcus
HYDPNK

SEQ ID NO: 1844942 - protein, 6 aa, Staphylococcus
HYDPSK

SEQ ID NO: 1844943 - protein, 6 aa, Staphylococcus
HYQNTK

SEQ ID NO: 1844944 - protein, 11 aa, Staphylococcus
IAAGSASIGIA

SEQ ID NO: 1844945 - protein, 8 aa, Staphylococcus
IADKYDKG

SEQ ID NO: 1844946 - protein, 16 aa, Staphylococcus
IAGPAKKSRVISDKER

SEQ ID NO: 1844947 - protein, 17 aa, Staphylococcus
IAGPAKKSRVISDKERN

SEQ ID NO: 1844948 - protein, 6 aa, Staphylococcus
IAGPSS

SEQ ID NO: 1844949 - protein, 5 aa, Staphylococcus
IAKDN

SEQ ID NO: 1844950 - protein, 9 aa, Staphylococcus
IAKGLGQKT

SEQ ID NO: 1844951 - protein, 4 aa, Staphylococcus
IALT

SEQ ID NO: 1844952 - protein, 11 aa, Staphylococcus
IANGGTYNNAH

SEQ ID NO: 1844953 - protein, 5 aa, Staphylococcus
IAQPD

SEQ ID NO: 1844954 - protein, 7 aa, Staphylococcus
IAQTRTQ

SEQ ID NO: 1844955 - protein, 4 aa, Staphylococcus
IATS

SEQ ID NO: 1844956 - protein, 5 aa, Staphylococcus
IATSD

SEQ ID NO: 1844957 - protein, 5 aa, Staphylococcus
IDAVS

SEQ ID NO: 1844958 - protein, 6 aa, Staphylococcus
IDESTS

SEQ ID NO: 1844959 - protein, 5 aa, Staphylococcus
IDKTT

SEQ ID NO: 1844960 - protein, 8 aa, Staphylococcus
IDLPNETI

SEQ ID NO: 1844961 - protein, 7 aa, Staphylococcus
IDPDSSP

SEQ ID NO: 1844962 - protein, 5 aa, Staphylococcus
IDPGE

SEQ ID NO: 1844963 - protein, 6 aa, Staphylococcus
IDPGEI

SEQ ID NO: 1844964 - protein, 7 aa, Staphylococcus
IEEATDR

SEQ ID NO: 1844965 - protein, 34 aa, Staphylococcus
IEGKNEKIINTNKAKDERTSEFEVSKTSGKVDGK

SEQ ID NO: 1844966 - protein, 4 aa, Staphylococcus
IEKD

SEQ ID NO: 1844967 - protein, 12 aa, Staphylococcus
IEQDADDKKTFR

SEQ ID NO: 1844968 - protein, 6 aa, Staphylococcus
IGGPSK

SEQ ID NO: 1844969 - protein, 5 aa, Staphylococcus
IGRGD

SEQ ID NO: 1844970 - protein, 9 aa, Staphylococcus
IGTSPATIT

SEQ ID NO: 1844971 - protein, 4 aa, Staphylococcus
IGTT

SEQ ID NO: 1844972 - protein, 5 aa, Staphylococcus
IITPG

SEQ ID NO: 1844973 - protein, 11 aa, Staphylococcus
IKDAGKGMGMT

SEQ ID NO: 1844974 - protein, 15 aa, Staphylococcus
IKDKPSKSKDPKDHP

SEQ ID NO: 1844975 - protein, 5 aa, Staphylococcus
IKDPK

SEQ ID NO: 1844976 - protein, 8 aa, Staphylococcus
IKNDPKAF

SEQ ID NO: 1844977 - protein, 5 aa, Staphylococcus
IKTEG

SEQ ID NO: 1844978 - protein, 4 aa, Staphylococcus
IKTL

SEQ ID NO: 1844979 - protein, 7 aa, Staphylococcus
INDAPSL

SEQ ID NO: 1844980 - protein, 9 aa, Staphylococcus
INPGSRGDD

SEQ ID NO: 1844981 - protein, 9 aa, Staphylococcus
INPGSRGHD

SEQ ID NO: 1844982 - protein, 4 aa, Staphylococcus
INPM

SEQ ID NO: 1844983 - protein, 10 aa, Staphylococcus
INTTKPIQEF

SEQ ID NO: 1844984 - protein, 12 aa, Staphylococcus
INTTTEVSAKDK

SEQ ID NO: 1844985 - protein, 6 aa, Staphylococcus
IPALNE

SEQ ID NO: 1844986 - protein, 5 aa, Staphylococcus
IPAYL

SEQ ID NO: 1844987 - protein, 15 aa, Staphylococcus
IPDDSLKPTDSSEYK

SEQ ID NO: 1844988 - protein, 4 aa, Staphylococcus
IPKD

SEQ ID NO: 1844989 - protein, 4 aa, Staphylococcus
IPKN

SEQ ID NO: 1844990 - protein, 5 aa, Staphylococcus
IPTPV

SEQ ID NO: 1844991 - protein, 6 aa, Staphylococcus
IQENND

SEQ ID NO: 1844992 - protein, 8 aa, Staphylococcus
IQPAQGVK

SEQ ID NO: 1844993 - protein, 4 aa, Staphylococcus
IQPR

SEQ ID NO: 1844994 - protein, 4 aa, Staphylococcus
IQPS

SEQ ID NO: 1844995 - protein, 10 aa, Staphylococcus
IREPKEAIKD

SEQ ID NO: 1844996 - protein, 21 aa, Staphylococcus
ISATDNSGQAVTNKVSGLPQG

SEQ ID NO: 1844997 - protein, 8 aa, Staphylococcus
ISDKPGFA

SEQ ID NO: 1844998 - protein, 10 aa, Staphylococcus
ISKSLGTRHR

SEQ ID NO: 1844999 - protein, 13 aa, Staphylococcus
ISNTLRHSKGTKV

SEQ ID NO: 1845000 - protein, 11 aa, Staphylococcus
ISTGEIDEQSK

SEQ ID NO: 1845001 - protein, 9 aa, Staphylococcus
ITADKKGPK

SEQ ID NO: 1845002 - protein, 10 aa, Staphylococcus
ITEDGDKDHV

SEQ ID NO: 1845003 - protein, 5 aa, Staphylococcus
ITETT

SEQ ID NO: 1845004 - protein, 19 aa, Staphylococcus
ITKPSETTVTEDTSDEPVQ

SEQ ID NO: 1845005 - protein, 4 aa, Staphylococcus
ITNK

SEQ ID NO: 1845006 - protein, 4 aa, Staphylococcus
ITPD

SEQ ID NO: 1845007 - protein, 9 aa, Staphylococcus
ITPQANGDT

SEQ ID NO: 1845008 - protein, 10 aa, Staphylococcus
ITPQPNGDTK

SEQ ID NO: 1845009 - protein, 4 aa, Staphylococcus
ITSS

SEQ ID NO: 1845010 - protein, 6 aa, Staphylococcus
ITTPSA

SEQ ID NO: 1845011 - protein, 10 aa, Staphylococcus
ITTSANGDKV

SEQ ID NO: 1845012 - protein, 7 aa, Staphylococcus
KAGISDV

SEQ ID NO: 1845013 - protein, 9 aa, Staphylococcus
KAGTQSAIN

SEQ ID NO: 1845014 - protein, 32 aa, Staphylococcus
KAKDGVNGQDGKSVTVTGSEVQPDGSTKVTFS

SEQ ID NO: 1845015 - protein, 8 aa, Staphylococcus
KANNSELV

SEQ ID NO: 1845016 - protein, 12 aa, Staphylococcus
KARTRKMGGTGL

SEQ ID NO: 1845017 - protein, 7 aa, Staphylococcus
KASPEPF

SEQ ID NO: 1845018 - protein, 7 aa, Staphylococcus
KAVGASS

SEQ ID NO: 1845019 - protein, 4 aa, Staphylococcus
KDDI

SEQ ID NO: 1845020 - protein, 8 aa, Staphylococcus
KDHSKETQ

SEQ ID NO: 1845021 - protein, 6 aa, Staphylococcus
KDIPGG

SEQ ID NO: 1845022 - protein, 9 aa, Staphylococcus
KDKNKTTVE

SEQ ID NO: 1845023 - protein, 11 aa, Staphylococcus
KDLGETEESMG

SEQ ID NO: 1845024 - protein, 5 aa, Staphylococcus
KDPGQ

SEQ ID NO: 1845025 - protein, 12 aa, Staphylococcus
KDTPNFEEEPDK

SEQ ID NO: 1845026 - protein, 8 aa, Staphylococcus
KDTVNDKR

SEQ ID NO: 1845027 - protein, 14 aa, Staphylococcus
KDVKDKPVKPARKV

SEQ ID NO: 1845028 - protein, 7 aa, Staphylococcus
KDVSGTK

SEQ ID NO: 1845029 - protein, 8 aa, Staphylococcus
KDVTDNHN

SEQ ID NO: 1845030 - protein, 4 aa, Staphylococcus
KDYD

SEQ ID NO: 1845031 - protein, 10 aa, Staphylococcus
KEAGGHIPDD

SEQ ID NO: 1845032 - protein, 6 aa, Staphylococcus
KEDRKG

SEQ ID NO: 1845033 - protein, 7 aa, Staphylococcus
KEEQAKG

SEQ ID NO: 1845034 - protein, 8 aa, Staphylococcus
KEESSAIK

SEQ ID NO: 1845035 - protein, 4 aa, Staphylococcus
KEGS

SEQ ID NO: 1845036 - protein, 11 aa, Staphylococcus
KELGETEESMG

SEQ ID NO: 1845037 - protein, 6 aa, Staphylococcus
KENGKT

SEQ ID NO: 1845038 - protein, 5 aa, Staphylococcus
KENVG

SEQ ID NO: 1845039 - protein, 9 aa, Staphylococcus
KEQDLNTAM

SEQ ID NO: 1845040 - protein, 10 aa, Staphylococcus
KEQDLNTAMQ

SEQ ID NO: 1845041 - protein, 7 aa, Staphylococcus
KERDMTA

SEQ ID NO: 1845042 - protein, 6 aa, Staphylococcus
KETPHI

SEQ ID NO: 1845043 - protein, 5 aa, Staphylococcus
KFKEY

SEQ ID NO: 1845044 - protein, 15 aa, Staphylococcus
KFQSGKDAVKGITGR

SEQ ID NO: 1845045 - protein, 4 aa, Staphylococcus
KGAS

SEQ ID NO: 1845046 - protein, 7 aa, Staphylococcus
KGDKITL

SEQ ID NO: 1845047 - protein, 6 aa, Staphylococcus
KGEKIN

SEQ ID NO: 1845048 - protein, 4 aa, Staphylococcus
KGFV

SEQ ID NO: 1845049 - protein, 5 aa, Staphylococcus
KGGAL

SEQ ID NO: 1845050 - protein, 20 aa, Staphylococcus
KGIGDSVQTLNGSVDRVTNS

SEQ ID NO: 1845051 - protein, 7 aa, Staphylococcus
KGIPEEE

SEQ ID NO: 1845052 - protein, 8 aa, Staphylococcus
KGISESGL

SEQ ID NO: 1845053 - protein, 4 aa, Staphylococcus
KGIY

SEQ ID NO: 1845054 - protein, 5 aa, Staphylococcus
KGKYR

SEQ ID NO: 1845055 - protein, 6 aa, Staphylococcus
KGNASE

SEQ ID NO: 1845056 - protein, 5 aa, Staphylococcus
KGQMP

SEQ ID NO: 1845057 - protein, 7 aa, Staphylococcus
KGRSRRS

SEQ ID NO: 1845058 - protein, 5 aa, Staphylococcus
KGSYA

SEQ ID NO: 1845059 - protein, 8 aa, Staphylococcus
KGTPDSAG

SEQ ID NO: 1845060 - protein, 8 aa, Staphylococcus
KGTPLSAG

SEQ ID NO: 1845061 - protein, 5 aa, Staphylococcus
KGTTR

SEQ ID NO: 1845062 - protein, 10 aa, Staphylococcus
KGTVKAVDET

SEQ ID NO: 1845063 - protein, 12 aa, Staphylococcus
KGYSRNDRVGKS

SEQ ID NO: 1845064 - protein, 7 aa, Staphylococcus
KGYTGAT

SEQ ID NO: 1845065 - protein, 8 aa, Staphylococcus
KHPGNGET

SEQ ID NO: 1845066 - protein, 7 aa, Staphylococcus
KHPPRWQ

SEQ ID NO: 1845067 - protein, 7 aa, Staphylococcus
KIASAAS

SEQ ID NO: 1845068 - protein, 6 aa, Staphylococcus
KIERPS

SEQ ID NO: 1845069 - protein, 5 aa, Staphylococcus
KIPNI

SEQ ID NO: 1845070 - protein, 6 aa, Staphylococcus
KIQPRY

SEQ ID NO: 1845071 - protein, 8 aa, Staphylococcus
KIRNGGTH

SEQ ID NO: 1845072 - protein, 7 aa, Staphylococcus
KITPAKF

SEQ ID NO: 1845073 - protein, 6 aa, Staphylococcus
KKDKRQ

SEQ ID NO: 1845074 - protein, 11 aa, Staphylococcus
KKDLDQEVASA

SEQ ID NO: 1845075 - protein, 7 aa, Staphylococcus
KKDPAVL

SEQ ID NO: 1845076 - protein, 6 aa, Staphylococcus
KKDRRQ

SEQ ID NO: 1845077 - protein, 8 aa, Staphylococcus
KKEENKLS

SEQ ID NO: 1845078 - protein, 13 aa, Staphylococcus
KKGAYEHLYSIQN

SEQ ID NO: 1845079 - protein, 8 aa, Staphylococcus
KKKGVDTV

SEQ ID NO: 1845080 - protein, 8 aa, Staphylococcus
KKPTGGTI

SEQ ID NO: 1845081 - protein, 7 aa, Staphylococcus
KKQPSLP

SEQ ID NO: 1845082 - protein, 7 aa, Staphylococcus
KKRKELN

SEQ ID NO: 1845083 - protein, 9 aa, Staphylococcus
KKRPSGKQN

SEQ ID NO: 1845084 - protein, 8 aa, Staphylococcus
KKRPTGKQ

SEQ ID NO: 1845085 - protein, 7 aa, Staphylococcus
KKSIVGD

SEQ ID NO: 1845086 - protein, 5 aa, Staphylococcus
KKTTM

SEQ ID NO: 1845087 - protein, 10 aa, Staphylococcus
KKTYQNLTED

SEQ ID NO: 1845088 - protein, 8 aa, Staphylococcus
KKVSEPYL

SEQ ID NO: 1845089 - protein, 5 aa, Staphylococcus
KLEEG

SEQ ID NO: 1845090 - protein, 5 aa, Staphylococcus
KLPDP

SEQ ID NO: 1845091 - protein, 8 aa, Staphylococcus
KLPGVNTS

SEQ ID NO: 1845092 - protein, 6 aa, Staphylococcus
KLPQFG

SEQ ID NO: 1845093 - protein, 11 aa, Staphylococcus
KLRSQGAKDMD

SEQ ID NO: 1845094 - protein, 8 aa, Staphylococcus
KLSEEEYN

SEQ ID NO: 1845095 - protein, 6 aa, Staphylococcus
KLSSAS

SEQ ID NO: 1845096 - protein, 8 aa, Staphylococcus
KLTDTGSS

SEQ ID NO: 1845097 - protein, 7 aa, Staphylococcus
KLTGGKN

SEQ ID NO: 1845098 - protein, 6 aa, Staphylococcus
KMDNDE

SEQ ID NO: 1845099 - protein, 15 aa, Staphylococcus
KNEGRNQVMFNPIIK

SEQ ID NO: 1845100 - protein, 15 aa, Staphylococcus
KNEGRNQVMFNPIVK

SEQ ID NO: 1845101 - protein, 7 aa, Staphylococcus
KNKDGDL

SEQ ID NO: 1845102 - protein, 7 aa, Staphylococcus
KNKSEYV

SEQ ID NO: 1845103 - protein, 11 aa, Staphylococcus
KNNAKKGGFSD

SEQ ID NO: 1845104 - protein, 6 aa, Staphylococcus
KNNITN

SEQ ID NO: 1845105 - protein, 8 aa, Staphylococcus
KNNKQNTE

SEQ ID NO: 1845106 - protein, 7 aa, Staphylococcus
KNPIAEP

SEQ ID NO: 1845107 - protein, 7 aa, Staphylococcus
KNRSRVR

SEQ ID NO: 1845108 - protein, 4 aa, Staphylococcus
KNSP

SEQ ID NO: 1845109 - protein, 8 aa, Staphylococcus
KNVKTDLS

SEQ ID NO: 1845110 - protein, 8 aa, Staphylococcus
KPAKESEV

SEQ ID NO: 1845111 - protein, 9 aa, Staphylococcus
KPAKYTKDS

SEQ ID NO: 1845112 - protein, 9 aa, Staphylococcus
KPAKYTKNS

SEQ ID NO: 1845113 - protein, 4 aa, Staphylococcus
KPDH

SEQ ID NO: 1845114 - protein, 8 aa, Staphylococcus
KPESKENI

SEQ ID NO: 1845115 - protein, 10 aa, Staphylococcus
KPGKANTRNA

SEQ ID NO: 1845116 - protein, 5 aa, Staphylococcus
KPLHN

SEQ ID NO: 1845117 - protein, 7 aa, Staphylococcus
KPPTPEL

SEQ ID NO: 1845118 - protein, 5 aa, Staphylococcus
KPSKI

SEQ ID NO: 1845119 - protein, 42 aa, Staphylococcus
KPVPQPAKAQASKAQALDVQSTQKNAVKPETLAQAKNVARPS

SEQ ID NO: 1845120 - protein, 9 aa, Staphylococcus
KQAEERYKN

SEQ ID NO: 1845121 - protein, 12 aa, Staphylococcus
KQIDKNGKLTDY

SEQ ID NO: 1845122 - protein, 6 aa, Staphylococcus
KQKYSG

SEQ ID NO: 1845123 - protein, 6 aa, Staphylococcus
KQLPNT

SEQ ID NO: 1845124 - protein, 6 aa, Staphylococcus
KQQTHY

SEQ ID NO: 1845125 - protein, 7 aa, Staphylococcus
KQYGTNS

SEQ ID NO: 1845126 - protein, 10 aa, Staphylococcus
KRASQSTDSF

SEQ ID NO: 1845127 - protein, 6 aa, Staphylococcus
KRGLKD

SEQ ID NO: 1845128 - protein, 6 aa, Staphylococcus
KRPGIN

SEQ ID NO: 1845129 - protein, 7 aa, Staphylococcus
KRQKQHS

SEQ ID NO: 1845130 - protein, 8 aa, Staphylococcus
KRSAGNNA

SEQ ID NO: 1845131 - protein, 8 aa, Staphylococcus
KRSYFNKN

SEQ ID NO: 1845132 - protein, 6 aa, Staphylococcus
KRTQLA

SEQ ID NO: 1845133 - protein, 7 aa, Staphylococcus
KSAGKHP

SEQ ID NO: 1845134 - protein, 4 aa, Staphylococcus
KSAQ

SEQ ID NO: 1845135 - protein, 9 aa, Staphylococcus
KSAVRYSEV

SEQ ID NO: 1845136 - protein, 6 aa, Staphylococcus
KSGKSV

SEQ ID NO: 1845137 - protein, 4 aa, Staphylococcus
KSLA

SEQ ID NO: 1845138 - protein, 10 aa, Staphylococcus
KSLNSEKGDV

SEQ ID NO: 1845139 - protein, 8 aa, Staphylococcus
KSNGTSKI

SEQ ID NO: 1845140 - protein, 4 aa, Staphylococcus
KSNY

SEQ ID NO: 1845141 - protein, 6 aa, Staphylococcus
KSPGVS

SEQ ID NO: 1845142 - protein, 7 aa, Staphylococcus
KSRTRMP

SEQ ID NO: 1845143 - protein, 8 aa, Staphylococcus
KSTFETSY

SEQ ID NO: 1845144 - protein, 7 aa, Staphylococcus
KSTTPVK

SEQ ID NO: 1845145 - protein, 9 aa, Staphylococcus
KTAQNKEGA

SEQ ID NO: 1845146 - protein, 7 aa, Staphylococcus
KTHTDPM

SEQ ID NO: 1845147 - protein, 6 aa, Staphylococcus
KTMEPK

SEQ ID NO: 1845148 - protein, 4 aa, Staphylococcus
KTPA

SEQ ID NO: 1845149 - protein, 8 aa, Staphylococcus
KTPSDGIE

SEQ ID NO: 1845150 - protein, 7 aa, Staphylococcus
KTRKEYR

SEQ ID NO: 1845151 - protein, 7 aa, Staphylococcus
KTSGNPA

SEQ ID NO: 1845152 - protein, 7 aa, Staphylococcus
KVEGPIG

SEQ ID NO: 1845153 - protein, 7 aa, Staphylococcus
KVERPSI

SEQ ID NO: 1845154 - protein, 7 aa, Staphylococcus
KVKPGGL

SEQ ID NO: 1845155 - protein, 5 aa, Staphylococcus
KVLPK

SEQ ID NO: 1845156 - protein, 6 aa, Staphylococcus
KVLPKG

SEQ ID NO: 1845157 - protein, 7 aa, Staphylococcus
KVLPKGS

SEQ ID NO: 1845158 - protein, 8 aa, Staphylococcus
KVQARKQH

SEQ ID NO: 1845159 - protein, 6 aa, Staphylococcus
KVRKSV

SEQ ID NO: 1845160 - protein, 11 aa, Staphylococcus
KVTEEISKKQE

SEQ ID NO: 1845161 - protein, 6 aa, Staphylococcus
KVTGTG

SEQ ID NO: 1845162 - protein, 5 aa, Staphylococcus
KYEAD

SEQ ID NO: 1845163 - protein, 7 aa, Staphylococcus
KYPYGDS

SEQ ID NO: 1845164 - protein, 5 aa, Staphylococcus
LADKL

SEQ ID NO: 1845165 - protein, 32 aa, Staphylococcus
LAEGRGKAQAKALRQTQTEMTARRIKSDGSYE

SEQ ID NO: 1845166 - protein, 5 aa, Staphylococcus
LASGV

SEQ ID NO: 1845167 - protein, 7 aa, Staphylococcus
LATEDNR

SEQ ID NO: 1845168 - protein, 5 aa, Staphylococcus
LDGAG

SEQ ID NO: 1845169 - protein, 16 aa, Staphylococcus
LDGVEGQVQGITRETT

SEQ ID NO: 1845170 - protein, 5 aa, Staphylococcus
LDKGY

SEQ ID NO: 1845171 - protein, 21 aa, Staphylococcus
LDSEPSKNVVPGMNAEVKIHK

SEQ ID NO: 1845172 - protein, 7 aa, Staphylococcus
LEGKLSD

SEQ ID NO: 1845173 - protein, 8 aa, Staphylococcus
LEKEGDTY

SEQ ID NO: 1845174 - protein, 6 aa, Staphylococcus
LEQSYG

SEQ ID NO: 1845175 - protein, 5 aa, Staphylococcus
LGASG

SEQ ID NO: 1845176 - protein, 4 aa, Staphylococcus
LGET

SEQ ID NO: 1845177 - protein, 4 aa, Staphylococcus
LGGD

SEQ ID NO: 1845178 - protein, 7 aa, Staphylococcus
LGGLSGS

SEQ ID NO: 1845179 - protein, 4 aa, Staphylococcus
LGGP

SEQ ID NO: 1845180 - protein, 18 aa, Staphylococcus
LGGTTGYAINPARDLGPR

SEQ ID NO: 1845181 - protein, 11 aa, Staphylococcus
LGKEGEDPEFS

SEQ ID NO: 1845182 - protein, 11 aa, Staphylococcus
LGKPDDKPEFN

SEQ ID NO: 1845183 - protein, 8 aa, Staphylococcus
LGRGGDQV

SEQ ID NO: 1845184 - protein, 4 aa, Staphylococcus
LGRK

SEQ ID NO: 1845185 - protein, 9 aa, Staphylococcus
LGTNGGGFL

SEQ ID NO: 1845186 - protein, 8 aa, Staphylococcus
LGTSGHTL

SEQ ID NO: 1845187 - protein, 9 aa, Staphylococcus
LGYPESNSF

SEQ ID NO: 1845188 - protein, 4 aa, Staphylococcus
LKGG

SEQ ID NO: 1845189 - protein, 6 aa, Staphylococcus
LLGTNN

SEQ ID NO: 1845190 - protein, 7 aa, Staphylococcus
LNEDDYE

SEQ ID NO: 1845191 - protein, 6 aa, Staphylococcus
LNGGGT

SEQ ID NO: 1845192 - protein, 8 aa, Staphylococcus
LNNETNNV

SEQ ID NO: 1845193 - protein, 8 aa, Staphylococcus
LNNLNDKD

SEQ ID NO: 1845194 - protein, 8 aa, Staphylococcus
LNPADSPY

SEQ ID NO: 1845195 - protein, 6 aa, Staphylococcus
LNSTTT

SEQ ID NO: 1845196 - protein, 11 aa, Staphylococcus
LNYGNKNLGSY

SEQ ID NO: 1845197 - protein, 5 aa, Staphylococcus
LPEQH

SEQ ID NO: 1845198 - protein, 9 aa, Staphylococcus
LPGRRAEEE

SEQ ID NO: 1845199 - protein, 18 aa, Staphylococcus
LPLSDSAKISKSLGTRHR

SEQ ID NO: 1845200 - protein, 7 aa, Staphylococcus
LPNNPYF

SEQ ID NO: 1845201 - protein, 14 aa, Staphylococcus
LPNTGQENATTSAS

SEQ ID NO: 1845202 - protein, 4 aa, Staphylococcus
LPTA

SEQ ID NO: 1845203 - protein, 7 aa, Staphylococcus
LPTDRGE

SEQ ID NO: 1845204 - protein, 6 aa, Staphylococcus
LQTTIN

SEQ ID NO: 1845205 - protein, 4 aa, Staphylococcus
LRHP

SEQ ID NO: 1845206 - protein, 9 aa, Staphylococcus
LSETSLTQT

SEQ ID NO: 1845207 - protein, 9 aa, Staphylococcus
LSETSMTQT

SEQ ID NO: 1845208 - protein, 8 aa, Staphylococcus
LSGGRGGI

SEQ ID NO: 1845209 - protein, 13 aa, Staphylococcus
LSNAGEKKAIAAK

SEQ ID NO: 1845210 - protein, 6 aa, Staphylococcus
LSQSTK

SEQ ID NO: 1845211 - protein, 8 aa, Staphylococcus
LSSGKQDF

SEQ ID NO: 1845212 - protein, 6 aa, Staphylococcus
LSSSDR

SEQ ID NO: 1845213 - protein, 7 aa, Staphylococcus
LTGEEKK

SEQ ID NO: 1845214 - protein, 6 aa, Staphylococcus
LTGLDG

SEQ ID NO: 1845215 - protein, 5 aa, Staphylococcus
LTNTQ

SEQ ID NO: 1845216 - protein, 10 aa, Staphylococcus
LTRKRSQALA

SEQ ID NO: 1845217 - protein, 6 aa, Staphylococcus
LTYGNA

SEQ ID NO: 1845218 - protein, 28 aa, Staphylococcus
LVTGESKKVQKNQNDNVIGGSINGSGTI

SEQ ID NO: 1845219 - protein, 10 aa, Staphylococcus
MDNESDQITK

SEQ ID NO: 1845220 - protein, 5 aa, Staphylococcus
MKPTN

SEQ ID NO: 1845221 - protein, 10 aa, Staphylococcus
MQGDPEYSGQ

SEQ ID NO: 1845222 - protein, 6 aa, Staphylococcus
MSEAAR

SEQ ID NO: 1845223 - protein, 4 aa, Staphylococcus
MSGS

SEQ ID NO: 1845224 - protein, 4 aa, Staphylococcus
MSGT

SEQ ID NO: 1845225 - protein, 8 aa, Staphylococcus
NAAGDAAP

SEQ ID NO: 1845226 - protein, 7 aa, Staphylococcus
NAAGEII

SEQ ID NO: 1845227 - protein, 7 aa, Staphylococcus
NAAGTTF

SEQ ID NO: 1845228 - protein, 8 aa, Staphylococcus
NAAGTTFT

SEQ ID NO: 1845229 - protein, 7 aa, Staphylococcus
NADDRTQ

SEQ ID NO: 1845230 - protein, 7 aa, Staphylococcus
NAEEKLA

SEQ ID NO: 1845231 - protein, 117 aa, Staphylococcus
NAISKKADAETPTTPNNKKEAKPDINQADTATSNNKKADKPIVKPADTTTDHKKVTKSVVTTTHAPANHKQMNKPTVSVASNTGHTKQTVVQQTAAHNHTHSNTSHQNVSTKTQIST

SEQ ID NO: 1845232 - protein, 8 aa, Staphylococcus
NARPERKK

SEQ ID NO: 1845233 - protein, 11 aa, Staphylococcus
NATAGGPTTAA

SEQ ID NO: 1845234 - protein, 7 aa, Staphylococcus
NDADNQW

SEQ ID NO: 1845235 - protein, 7 aa, Staphylococcus
NDDEINR

SEQ ID NO: 1845236 - protein, 8 aa, Staphylococcus
NDENSRMS

SEQ ID NO: 1845237 - protein, 14 aa, Staphylococcus
NDESKFKTREDFET

SEQ ID NO: 1845238 - protein, 7 aa, Staphylococcus
NDIGRNF

SEQ ID NO: 1845239 - protein, 7 aa, Staphylococcus
NDTSIAN

SEQ ID NO: 1845240 - protein, 21 aa, Staphylococcus
NEAGMGSAPNAAATAAVPHPV

SEQ ID NO: 1845241 - protein, 6 aa, Staphylococcus
NEHNLD

SEQ ID NO: 1845242 - protein, 10 aa, Staphylococcus
NEKGRASSAL

SEQ ID NO: 1845243 - protein, 5 aa, Staphylococcus
NEQDE

SEQ ID NO: 1845244 - protein, 9 aa, Staphylococcus
NEQDNTPMY

SEQ ID NO: 1845245 - protein, 5 aa, Staphylococcus
NEQPA

SEQ ID NO: 1845246 - protein, 7 aa, Staphylococcus
NERSFTR

SEQ ID NO: 1845247 - protein, 16 aa, Staphylococcus
NERTIESNTTSGGTKV

SEQ ID NO: 1845248 - protein, 4 aa, Staphylococcus
NESY

SEQ ID NO: 1845249 - protein, 7 aa, Staphylococcus
NETDNTV

SEQ ID NO: 1845250 - protein, 5 aa, Staphylococcus
NEVEA

SEQ ID NO: 1845251 - protein, 5 aa, Staphylococcus
NFGDA

SEQ ID NO: 1845252 - protein, 7 aa, Staphylococcus
NFGEGYN

SEQ ID NO: 1845253 - protein, 11 aa, Staphylococcus
NFKDPAPKNAV

SEQ ID NO: 1845254 - protein, 4 aa, Staphylococcus
NGHI

SEQ ID NO: 1845255 - protein, 59 aa, Staphylococcus
NGKDSGSSSAATPGINKSENGGTGSAASDAGNGTSSDSNSASTDGSSVENPQTSAGTPA

SEQ ID NO: 1845256 - protein, 9 aa, Staphylococcus
NGKIERPSI

SEQ ID NO: 1845257 - protein, 5 aa, Staphylococcus
NGLNT

SEQ ID NO: 1845258 - protein, 6 aa, Staphylococcus
NGMGST

SEQ ID NO: 1845259 - protein, 4 aa, Staphylococcus
NGMS

SEQ ID NO: 1845260 - protein, 11 aa, Staphylococcus
NGNGNTPKQLS

SEQ ID NO: 1845261 - protein, 7 aa, Staphylococcus
NGNSQLG

SEQ ID NO: 1845262 - protein, 9 aa, Staphylococcus
NGPVKNDGK

SEQ ID NO: 1845263 - protein, 5 aa, Staphylococcus
NHSEY

SEQ ID NO: 1845264 - protein, 8 aa, Staphylococcus
NIRQNDDY

SEQ ID NO: 1845265 - protein, 5 aa, Staphylococcus
NITQY

SEQ ID NO: 1845266 - protein, 9 aa, Staphylococcus
NKAAEEYQV

SEQ ID NO: 1845267 - protein, 8 aa, Staphylococcus
NKAKTLER

SEQ ID NO: 1845268 - protein, 12 aa, Staphylococcus
NKDKTKQKSTMN

SEQ ID NO: 1845269 - protein, 5 aa, Staphylococcus
NKGET

SEQ ID NO: 1845270 - protein, 9 aa, Staphylococcus
NKGLKDNNT

SEQ ID NO: 1845271 - protein, 8 aa, Staphylococcus
NKKANDKN

SEQ ID NO: 1845272 - protein, 7 aa, Staphylococcus
NKKNGAA

SEQ ID NO: 1845273 - protein, 5 aa, Staphylococcus
NKNEN

SEQ ID NO: 1845274 - protein, 9 aa, Staphylococcus
NKNGSRFKQ

SEQ ID NO: 1845275 - protein, 4 aa, Staphylococcus
NKQL

SEQ ID NO: 1845276 - protein, 6 aa, Staphylococcus
NKQSIS

SEQ ID NO: 1845277 - protein, 13 aa, Staphylococcus
NKRTDQNDDESPE

SEQ ID NO: 1845278 - protein, 5 aa, Staphylococcus
NKSPL

SEQ ID NO: 1845279 - protein, 4 aa, Staphylococcus
NKTI

SEQ ID NO: 1845280 - protein, 5 aa, Staphylococcus
NKTIE

SEQ ID NO: 1845281 - protein, 4 aa, Staphylococcus
NKTR

SEQ ID NO: 1845282 - protein, 8 aa, Staphylococcus
NKVGKESE

SEQ ID NO: 1845283 - protein, 9 aa, Staphylococcus
NLGDGGTVG

SEQ ID NO: 1845284 - protein, 8 aa, Staphylococcus
NLGSSIGS

SEQ ID NO: 1845285 - protein, 4 aa, Staphylococcus
NLNQ

SEQ ID NO: 1845286 - protein, 8 aa, Staphylococcus
NLPDSAAK

SEQ ID NO: 1845287 - protein, 5 aa, Staphylococcus
NLSSS

SEQ ID NO: 1845288 - protein, 6 aa, Staphylococcus
NLSSSM

SEQ ID NO: 1845289 - protein, 17 aa, Staphylococcus
NLTGGFGAQGASTLTQQ

SEQ ID NO: 1845290 - protein, 9 aa, Staphylococcus
NNDRQQNSD

SEQ ID NO: 1845291 - protein, 9 aa, Staphylococcus
NNQGLTSKQ

SEQ ID NO: 1845292 - protein, 4 aa, Staphylococcus
NNQV

SEQ ID NO: 1845293 - protein, 11 aa, Staphylococcus
NNSKTKPDAAI

SEQ ID NO: 1845294 - protein, 5 aa, Staphylococcus
NPDGN

SEQ ID NO: 1845295 - protein, 5 aa, Staphylococcus
NPGEI

SEQ ID NO: 1845296 - protein, 8 aa, Staphylococcus
NPHKAAQA

SEQ ID NO: 1845297 - protein, 6 aa, Staphylococcus
NPIASP

SEQ ID NO: 1845298 - protein, 6 aa, Staphylococcus
NPLASP

SEQ ID NO: 1845299 - protein, 5 aa, Staphylococcus
NQAQD

SEQ ID NO: 1845300 - protein, 13 aa, Staphylococcus
NQASNVESMGGAV

SEQ ID NO: 1845301 - protein, 8 aa, Staphylococcus
NQGDKTLT

SEQ ID NO: 1845302 - protein, 5 aa, Staphylococcus
NQMRG

SEQ ID NO: 1845303 - protein, 4 aa, Staphylococcus
NQTT

SEQ ID NO: 1845304 - protein, 5 aa, Staphylococcus
NQYQD

SEQ ID NO: 1845305 - protein, 11 aa, Staphylococcus
NREVSKDSRSF

SEQ ID NO: 1845306 - protein, 12 aa, Staphylococcus
NREVYKGAPNSM

SEQ ID NO: 1845307 - protein, 4 aa, Staphylococcus
NRIE

SEQ ID NO: 1845308 - protein, 8 aa, Staphylococcus
NRRSASST

SEQ ID NO: 1845309 - protein, 4 aa, Staphylococcus
NSAA

SEQ ID NO: 1845310 - protein, 9 aa, Staphylococcus
NSASTVGKA

SEQ ID NO: 1845311 - protein, 13 aa, Staphylococcus
NSGGTTVAEGTVK

SEQ ID NO: 1845312 - protein, 12 aa, Staphylococcus
NSGTMSAKEAAN

SEQ ID NO: 1845313 - protein, 5 aa, Staphylococcus
NSLNT

SEQ ID NO: 1845314 - protein, 7 aa, Staphylococcus
NSPDAQA

SEQ ID NO: 1845315 - protein, 4 aa, Staphylococcus
NSPR

SEQ ID NO: 1845316 - protein, 10 aa, Staphylococcus
NSSKVQTGDS

SEQ ID NO: 1845317 - protein, 11 aa, Staphylococcus
NSSTGKSTAAA

SEQ ID NO: 1845318 - protein, 4 aa, Staphylococcus
NTFA

SEQ ID NO: 1845319 - protein, 9 aa, Staphylococcus
NTGEGGLSD

SEQ ID NO: 1845320 - protein, 9 aa, Staphylococcus
NTNDTSIAN

SEQ ID NO: 1845321 - protein, 4 aa, Staphylococcus
NTNN

SEQ ID NO: 1845322 - protein, 8 aa, Staphylococcus
NVAQGGAA

SEQ ID NO: 1845323 - protein, 6 aa, Staphylococcus
NVGKTS

SEQ ID NO: 1845324 - protein, 10 aa, Staphylococcus
NYTKGEAPFV

SEQ ID NO: 1845325 - protein, 7 aa, Staphylococcus
PAASATA

SEQ ID NO: 1845326 - protein, 14 aa, Staphylococcus
PAFTESKLEDPIPA

SEQ ID NO: 1845327 - protein, 26 aa, Staphylococcus
PAHAAEANTTQNEPATHQENKVETNI

SEQ ID NO: 1845328 - protein, 11 aa, Staphylococcus
PAQLEDPSKGF

SEQ ID NO: 1845329 - protein, 5 aa, Staphylococcus
PDEEM

SEQ ID NO: 1845330 - protein, 6 aa, Staphylococcus
PDREEI

SEQ ID NO: 1845331 - protein, 6 aa, Staphylococcus
PDSPTA

SEQ ID NO: 1845332 - protein, 14 aa, Staphylococcus
PDYPADKEQPTITV

SEQ ID NO: 1845333 - protein, 5 aa, Staphylococcus
PEDKA

SEQ ID NO: 1845334 - protein, 6 aa, Staphylococcus
PEDKES

SEQ ID NO: 1845335 - protein, 4 aa, Staphylococcus
PEKL

SEQ ID NO: 1845336 - protein, 6 aa, Staphylococcus
PEKRGV

SEQ ID NO: 1845337 - protein, 94 aa, Staphylococcus
PELTTAKPETPKTKPANKTNKAKTSTTKPTKANKENKANKTKKVDKAKNNAPKVVQPATTVNQHSKAAATHKTIKTSHVSTTVNHDATATQHHT

SEQ ID NO: 1845338 - protein, 8 aa, Staphylococcus
PENDTRID

SEQ ID NO: 1845339 - protein, 10 aa, Staphylococcus
PETRGRSLEE

SEQ ID NO: 1845340 - protein, 7 aa, Staphylococcus
PGEKIPV

SEQ ID NO: 1845341 - protein, 7 aa, Staphylococcus
PGRSTVD

SEQ ID NO: 1845342 - protein, 11 aa, Staphylococcus
PKKAAGTAAGL

SEQ ID NO: 1845343 - protein, 10 aa, Staphylococcus
PKNPGEHQYA

SEQ ID NO: 1845344 - protein, 5 aa, Staphylococcus
PKNPP

SEQ ID NO: 1845345 - protein, 17 aa, Staphylococcus
PKTFDTENLSDPKSVIK

SEQ ID NO: 1845346 - protein, 17 aa, Staphylococcus
PLDSEESARIEYDEDTG

SEQ ID NO: 1845347 - protein, 5 aa, Staphylococcus
PLGAT

SEQ ID NO: 1845348 - protein, 4 aa, Staphylococcus
PLSD

SEQ ID NO: 1845349 - protein, 6 aa, Staphylococcus
PNKTIE

SEQ ID NO: 1845350 - protein, 6 aa, Staphylococcus
PNNTHT

SEQ ID NO: 1845351 - protein, 4 aa, Staphylococcus
PNQH

SEQ ID NO: 1845352 - protein, 12 aa, Staphylococcus
PNSVREASYGLG

SEQ ID NO: 1845353 - protein, 4 aa, Staphylococcus
PNVG

SEQ ID NO: 1845354 - protein, 4 aa, Staphylococcus
PNYK

SEQ ID NO: 1845355 - protein, 31 aa, Staphylococcus
PNYPSEKGKPTITVDDPSKLPDGNTPGTSNV

SEQ ID NO: 1845356 - protein, 6 aa, Staphylococcus
PPEQRK

SEQ ID NO: 1845357 - protein, 5 aa, Staphylococcus
PPIPE

SEQ ID NO: 1845358 - protein, 5 aa, Staphylococcus
PPLPE

SEQ ID NO: 1845359 - protein, 9 aa, Staphylococcus
PPNTDTSST

SEQ ID NO: 1845360 - protein, 6 aa, Staphylococcus
PQAVEG

SEQ ID NO: 1845361 - protein, 4 aa, Staphylococcus
PRIP

SEQ ID NO: 1845362 - protein, 5 aa, Staphylococcus
PSAVT

SEQ ID NO: 1845363 - protein, 6 aa, Staphylococcus
PSISGN

SEQ ID NO: 1845364 - protein, 6 aa, Staphylococcus
PSSSSH

SEQ ID NO: 1845365 - protein, 13 aa, Staphylococcus
PSTAQEDGHQVNK

SEQ ID NO: 1845366 - protein, 7 aa, Staphylococcus
PTFNDQQ

SEQ ID NO: 1845367 - protein, 5 aa, Staphylococcus
PTGVP

SEQ ID NO: 1845368 - protein, 9 aa, Staphylococcus
PVERKSEGI

SEQ ID NO: 1845369 - protein, 4 aa, Staphylococcus
PVGP

SEQ ID NO: 1845370 - protein, 4 aa, Staphylococcus
PVSG

SEQ ID NO: 1845371 - protein, 4 aa, Staphylococcus
QAAT

SEQ ID NO: 1845372 - protein, 4 aa, Staphylococcus
QAEF

SEQ ID NO: 1845373 - protein, 4 aa, Staphylococcus
QAES

SEQ ID NO: 1845374 - protein, 6 aa, Staphylococcus
QAGQSM

SEQ ID NO: 1845375 - protein, 4 aa, Staphylococcus
QAGS

SEQ ID NO: 1845376 - protein, 8 aa, Staphylococcus
QAHRPQFE

SEQ ID NO: 1845377 - protein, 5 aa, Staphylococcus
QANEI

SEQ ID NO: 1845378 - protein, 10 aa, Staphylococcus
QATQGAEAFN

SEQ ID NO: 1845379 - protein, 12 aa, Staphylococcus
QATQGAEAFNKA

SEQ ID NO: 1845380 - protein, 9 aa, Staphylococcus
QDGEPRVNS

SEQ ID NO: 1845381 - protein, 15 aa, Staphylococcus
QDKTTEYARKTRRSV

SEQ ID NO: 1845382 - protein, 7 aa, Staphylococcus
QDPTNVE

SEQ ID NO: 1845383 - protein, 4 aa, Staphylococcus
QEQS

SEQ ID NO: 1845384 - protein, 8 aa, Staphylococcus
QEVASTSY

SEQ ID NO: 1845385 - protein, 8 aa, Staphylococcus
QFAGTNDG

SEQ ID NO: 1845386 - protein, 5 aa, Staphylococcus
QFPVN

SEQ ID NO: 1845387 - protein, 4 aa, Staphylococcus
QFSP

SEQ ID NO: 1845388 - protein, 9 aa, Staphylococcus
QGARNNTIT

SEQ ID NO: 1845389 - protein, 8 aa, Staphylococcus
QGEKSGKL

SEQ ID NO: 1845390 - protein, 6 aa, Staphylococcus
QGIDKN

SEQ ID NO: 1845391 - protein, 6 aa, Staphylococcus
QGKENE

SEQ ID NO: 1845392 - protein, 6 aa, Staphylococcus
QGKENQ

SEQ ID NO: 1845393 - protein, 5 aa, Staphylococcus
QGNQL

SEQ ID NO: 1845394 - protein, 9 aa, Staphylococcus
QGSKPYKLD

SEQ ID NO: 1845395 - protein, 7 aa, Staphylococcus
QITNSKS

SEQ ID NO: 1845396 - protein, 4 aa, Staphylococcus
QKAN

SEQ ID NO: 1845397 - protein, 5 aa, Staphylococcus
QKANY

SEQ ID NO: 1845398 - protein, 4 aa, Staphylococcus
QKFA

SEQ ID NO: 1845399 - protein, 5 aa, Staphylococcus
QKFTT

SEQ ID NO: 1845400 - protein, 8 aa, Staphylococcus
QKQGYTSN

SEQ ID NO: 1845401 - protein, 6 aa, Staphylococcus
QKVETV

SEQ ID NO: 1845402 - protein, 6 aa, Staphylococcus
QLKKGD

SEQ ID NO: 1845403 - protein, 6 aa, Staphylococcus
QLSAAK

SEQ ID NO: 1845404 - protein, 10 aa, Staphylococcus
QNGESRVNST

SEQ ID NO: 1845405 - protein, 8 aa, Staphylococcus
QNKELTTT

SEQ ID NO: 1845406 - protein, 9 aa, Staphylococcus
QNKHEDKQH

SEQ ID NO: 1845407 - protein, 14 aa, Staphylococcus
QNKSKKGNKKRSKT

SEQ ID NO: 1845408 - protein, 4 aa, Staphylococcus
QNNA

SEQ ID NO: 1845409 - protein, 4 aa, Staphylococcus
QPKY

SEQ ID NO: 1845410 - protein, 5 aa, Staphylococcus
QPLTE

SEQ ID NO: 1845411 - protein, 86 aa, Staphylococcus
QPQNQAATTNQTPKTEQNHTQANKQQAKSNQAAAVTSDSKSQNDAQASPQQSSTSKQDAVKQQATQANTKAPAQPATQQTREAQPV

SEQ ID NO: 1845412 - protein, 7 aa, Staphylococcus
QPRTPQG

SEQ ID NO: 1845413 - protein, 8 aa, Staphylococcus
QPTEQRLT

SEQ ID NO: 1845414 - protein, 4 aa, Staphylococcus
QQAN

SEQ ID NO: 1845415 - protein, 6 aa, Staphylococcus
QQASKL

SEQ ID NO: 1845416 - protein, 8 aa, Staphylococcus
QQEDYESD

SEQ ID NO: 1845417 - protein, 5 aa, Staphylococcus
QQGDF

SEQ ID NO: 1845418 - protein, 13 aa, Staphylococcus
QQKSIGRKAQEAY

SEQ ID NO: 1845419 - protein, 16 aa, Staphylococcus
QQNYTTQSANNEVRPQ

SEQ ID NO: 1845420 - protein, 5 aa, Staphylococcus
QRLTS

SEQ ID NO: 1845421 - protein, 5 aa, Staphylococcus
QRPKY

SEQ ID NO: 1845422 - protein, 6 aa, Staphylococcus
QRRDPV

SEQ ID NO: 1845423 - protein, 10 aa, Staphylococcus
QSAHSEQTYE

SEQ ID NO: 1845424 - protein, 9 aa, Staphylococcus
QSAPAIGPT

SEQ ID NO: 1845425 - protein, 10 aa, Staphylococcus
QSDDDDLSTM

SEQ ID NO: 1845426 - protein, 5 aa, Staphylococcus
QSGHG

SEQ ID NO: 1845427 - protein, 7 aa, Staphylococcus
QSGPIAS

SEQ ID NO: 1845428 - protein, 5 aa, Staphylococcus
QSKIG

SEQ ID NO: 1845429 - protein, 4 aa, Staphylococcus
QSKY

SEQ ID NO: 1845430 - protein, 5 aa, Staphylococcus
QSPLA

SEQ ID NO: 1845431 - protein, 10 aa, Staphylococcus
QTGLKDSSKH

SEQ ID NO: 1845432 - protein, 6 aa, Staphylococcus
QTNKPA

SEQ ID NO: 1845433 - protein, 6 aa, Staphylococcus
QTYDNG

SEQ ID NO: 1845434 - protein, 4 aa, Staphylococcus
QVGG

SEQ ID NO: 1845435 - protein, 9 aa, Staphylococcus
QWTHSSNAQ

SEQ ID NO: 1845436 - protein, 6 aa, Staphylococcus
QYEEGF

SEQ ID NO: 1845437 - protein, 11 aa, Staphylococcus
RAHAAGKAATL

SEQ ID NO: 1845438 - protein, 4 aa, Staphylococcus
RAKF

SEQ ID NO: 1845439 - protein, 4 aa, Staphylococcus
RAMP

SEQ ID NO: 1845440 - protein, 6 aa, Staphylococcus
RANVDD

SEQ ID NO: 1845441 - protein, 8 aa, Staphylococcus
RDISGEPM

SEQ ID NO: 1845442 - protein, 13 aa, Staphylococcus
RDRVKDKASGRKT

SEQ ID NO: 1845443 - protein, 9 aa, Staphylococcus
REAESTTAI

SEQ ID NO: 1845444 - protein, 6 aa, Staphylococcus
REETER

SEQ ID NO: 1845445 - protein, 8 aa, Staphylococcus
RFGSPKDI

SEQ ID NO: 1845446 - protein, 9 aa, Staphylococcus
RGKKGTKVT

SEQ ID NO: 1845447 - protein, 7 aa, Staphylococcus
RGQFSPR

SEQ ID NO: 1845448 - protein, 7 aa, Staphylococcus
RHGSHYE

SEQ ID NO: 1845449 - protein, 5 aa, Staphylococcus
RIDAV

SEQ ID NO: 1845450 - protein, 6 aa, Staphylococcus
RIDAVS

SEQ ID NO: 1845451 - protein, 4 aa, Staphylococcus
RIPG

SEQ ID NO: 1845452 - protein, 16 aa, Staphylococcus
RKEPDKFSYPKERIQI

SEQ ID NO: 1845453 - protein, 5 aa, Staphylococcus
RLGYS

SEQ ID NO: 1845454 - protein, 11 aa, Staphylococcus
RLTEDIQGKVE

SEQ ID NO: 1845455 - protein, 5 aa, Staphylococcus
RMSQT

SEQ ID NO: 1845456 - protein, 7 aa, Staphylococcus
RNEDNVV

SEQ ID NO: 1845457 - protein, 5 aa, Staphylococcus
RNGLI

SEQ ID NO: 1845458 - protein, 4 aa, Staphylococcus
RNIG

SEQ ID NO: 1845459 - protein, 8 aa, Staphylococcus
RNPIASPG

SEQ ID NO: 1845460 - protein, 6 aa, Staphylococcus
RQQAED

SEQ ID NO: 1845461 - protein, 13 aa, Staphylococcus
RQYGSGNTGATNS

SEQ ID NO: 1845462 - protein, 5 aa, Staphylococcus
RRDGF

SEQ ID NO: 1845463 - protein, 5 aa, Staphylococcus
RRNNL

SEQ ID NO: 1845464 - protein, 8 aa, Staphylococcus
RSAGHTEY

SEQ ID NO: 1845465 - protein, 8 aa, Staphylococcus
RSEGHTEY

SEQ ID NO: 1845466 - protein, 7 aa, Staphylococcus
RSYFNQN

SEQ ID NO: 1845467 - protein, 7 aa, Staphylococcus
RTASTSF

SEQ ID NO: 1845468 - protein, 8 aa, Staphylococcus
RTMGASES

SEQ ID NO: 1845469 - protein, 4 aa, Staphylococcus
RTPL

SEQ ID NO: 1845470 - protein, 10 aa, Staphylococcus
RTQKTKMSDK

SEQ ID NO: 1845471 - protein, 12 aa, Staphylococcus
RTRTNAASSLSV

SEQ ID NO: 1845472 - protein, 4 aa, Staphylococcus
RTSK

SEQ ID NO: 1845473 - protein, 10 aa, Staphylococcus
SAEKGSEHPL

SEQ ID NO: 1845474 - protein, 10 aa, Staphylococcus
SAENNSEHPL

SEQ ID NO: 1845475 - protein, 4 aa, Staphylococcus
SAPQ

SEQ ID NO: 1845476 - protein, 5 aa, Staphylococcus
SAPQK

SEQ ID NO: 1845477 - protein, 4 aa, Staphylococcus
SASA

SEQ ID NO: 1845478 - protein, 8 aa, Staphylococcus
SASDKNGV

SEQ ID NO: 1845479 - protein, 9 aa, Staphylococcus
SASDKNGVI

SEQ ID NO: 1845480 - protein, 7 aa, Staphylococcus
SATSLSS

SEQ ID NO: 1845481 - protein, 11 aa, Staphylococcus
SATTNGGLDIT

SEQ ID NO: 1845482 - protein, 9 aa, Staphylococcus
SDGGGATRI

SEQ ID NO: 1845483 - protein, 9 aa, Staphylococcus
SDIDRNSPF

SEQ ID NO: 1845484 - protein, 10 aa, Staphylococcus
SDLGPKITPI

SEQ ID NO: 1845485 - protein, 11 aa, Staphylococcus
SEAIKPNVHQG

SEQ ID NO: 1845486 - protein, 6 aa, Staphylococcus
SENGGI

SEQ ID NO: 1845487 - protein, 5 aa, Staphylococcus
SENRT

SEQ ID NO: 1845488 - protein, 5 aa, Staphylococcus
SEQVE

SEQ ID NO: 1845489 - protein, 8 aa, Staphylococcus
SERGSKTA

SEQ ID NO: 1845490 - protein, 5 aa, Staphylococcus
SETDT

SEQ ID NO: 1845491 - protein, 4 aa, Staphylococcus
SETI

SEQ ID NO: 1845492 - protein, 6 aa, Staphylococcus
SEVKTS

SEQ ID NO: 1845493 - protein, 5 aa, Staphylococcus
SFGDA

SEQ ID NO: 1845494 - protein, 8 aa, Staphylococcus
SFNGKKSL

SEQ ID NO: 1845495 - protein, 6 aa, Staphylococcus
SFSSYS

SEQ ID NO: 1845496 - protein, 10 aa, Staphylococcus
SGADAQKGGI

SEQ ID NO: 1845497 - protein, 10 aa, Staphylococcus
SGAEGTRVED

SEQ ID NO: 1845498 - protein, 11 aa, Staphylococcus
SGAEGTRVEDT

SEQ ID NO: 1845499 - protein, 7 aa, Staphylococcus
SGAGQVG

SEQ ID NO: 1845500 - protein, 7 aa, Staphylococcus
SGAKKNN

SEQ ID NO: 1845501 - protein, 4 aa, Staphylococcus
SGAS

SEQ ID NO: 1845502 - protein, 7 aa, Staphylococcus
SGDTSFR

SEQ ID NO: 1845503 - protein, 5 aa, Staphylococcus
SGFSG

SEQ ID NO: 1845504 - protein, 5 aa, Staphylococcus
SGGAY

SEQ ID NO: 1845505 - protein, 11 aa, Staphylococcus
SGGPGTQGKTI

SEQ ID NO: 1845506 - protein, 6 aa, Staphylococcus
SGGRAK

SEQ ID NO: 1845507 - protein, 6 aa, Staphylococcus
SGGRGG

SEQ ID NO: 1845508 - protein, 7 aa, Staphylococcus
SGGRGGI

SEQ ID NO: 1845509 - protein, 5 aa, Staphylococcus
SGHAM

SEQ ID NO: 1845510 - protein, 9 aa, Staphylococcus
SGHAMGSTS

SEQ ID NO: 1845511 - protein, 4 aa, Staphylococcus
SGNL

SEQ ID NO: 1845512 - protein, 7 aa, Staphylococcus
SGQFSTI

SEQ ID NO: 1845513 - protein, 6 aa, Staphylococcus
SGRILP

SEQ ID NO: 1845514 - protein, 5 aa, Staphylococcus
SGSFE

SEQ ID NO: 1845515 - protein, 9 aa, Staphylococcus
SGSTGQPKG

SEQ ID NO: 1845516 - protein, 5 aa, Staphylococcus
SGTIP

SEQ ID NO: 1845517 - protein, 12 aa, Staphylococcus
SGVGESKTVGRY

SEQ ID NO: 1845518 - protein, 6 aa, Staphylococcus
SHGTEA

SEQ ID NO: 1845519 - protein, 11 aa, Staphylococcus
SHGTNDAQKSM

SEQ ID NO: 1845520 - protein, 28 aa, Staphylococcus
SIDLGSAEHSRGTEISKQAKDLTANTLP

SEQ ID NO: 1845521 - protein, 5 aa, Staphylococcus
SIGPY

SEQ ID NO: 1845522 - protein, 4 aa, Staphylococcus
SIKE

SEQ ID NO: 1845523 - protein, 5 aa, Staphylococcus
SIPNL

SEQ ID NO: 1845524 - protein, 12 aa, Staphylococcus
SKAKMYDNQKRR

SEQ ID NO: 1845525 - protein, 8 aa, Staphylococcus
SKDLKRAN

SEQ ID NO: 1845526 - protein, 5 aa, Staphylococcus
SKDRT

SEQ ID NO: 1845527 - protein, 15 aa, Staphylococcus
SKEYVDELKQELEFY

SEQ ID NO: 1845528 - protein, 5 aa, Staphylococcus
SKGNG

SEQ ID NO: 1845529 - protein, 4 aa, Staphylococcus
SKGY

SEQ ID NO: 1845530 - protein, 9 aa, Staphylococcus
SKIDRNSPF

SEQ ID NO: 1845531 - protein, 4 aa, Staphylococcus
SKIG

SEQ ID NO: 1845532 - protein, 10 aa, Staphylococcus
SKKEERKESY

SEQ ID NO: 1845533 - protein, 6 aa, Staphylococcus
SKKEEV

SEQ ID NO: 1845534 - protein, 6 aa, Staphylococcus
SKKTYQ

SEQ ID NO: 1845535 - protein, 4 aa, Staphylococcus
SKLN

SEQ ID NO: 1845536 - protein, 5 aa, Staphylococcus
SKNGR

SEQ ID NO: 1845537 - protein, 5 aa, Staphylococcus
SKNGT

SEQ ID NO: 1845538 - protein, 6 aa, Staphylococcus
SKPNQA

SEQ ID NO: 1845539 - protein, 6 aa, Staphylococcus
SKSEQL

SEQ ID NO: 1845540 - protein, 10 aa, Staphylococcus
SKSKTKPDAA

SEQ ID NO: 1845541 - protein, 8 aa, Staphylococcus
SKTLAQSY

SEQ ID NO: 1845542 - protein, 9 aa, Staphylococcus
SKTMPQEQR

SEQ ID NO: 1845543 - protein, 7 aa, Staphylococcus
SLDTTQG

SEQ ID NO: 1845544 - protein, 7 aa, Staphylococcus
SLGGEFD

SEQ ID NO: 1845545 - protein, 5 aa, Staphylococcus
SLGGF

SEQ ID NO: 1845546 - protein, 4 aa, Staphylococcus
SLGN

SEQ ID NO: 1845547 - protein, 8 aa, Staphylococcus
SLSQSDEK

SEQ ID NO: 1845548 - protein, 9 aa, Staphylococcus
SMGKPLPGI

SEQ ID NO: 1845549 - protein, 18 aa, Staphylococcus
SMSMEGGHGNAAAYGKTI

SEQ ID NO: 1845550 - protein, 6 aa, Staphylococcus
SNAIAS

SEQ ID NO: 1845551 - protein, 6 aa, Staphylococcus
SNAQRW

SEQ ID NO: 1845552 - protein, 6 aa, Staphylococcus
SNDPQV

SEQ ID NO: 1845553 - protein, 6 aa, Staphylococcus
SNGTKE

SEQ ID NO: 1845554 - protein, 7 aa, Staphylococcus
SNNPIDG

SEQ ID NO: 1845555 - protein, 6 aa, Staphylococcus
SNPTDE

SEQ ID NO: 1845556 - protein, 17 aa, Staphylococcus
SNPYDSGQVNDEGDTAI

SEQ ID NO: 1845557 - protein, 5 aa, Staphylococcus
SNQPI

SEQ ID NO: 1845558 - protein, 6 aa, Staphylococcus
SNTERL

SEQ ID NO: 1845559 - protein, 8 aa, Staphylococcus
SNTIAESL

SEQ ID NO: 1845560 - protein, 11 aa, Staphylococcus
SNWENERSYPD

SEQ ID NO: 1845561 - protein, 5 aa, Staphylococcus
SNYRG

SEQ ID NO: 1845562 - protein, 4 aa, Staphylococcus
SPDK

SEQ ID NO: 1845563 - protein, 8 aa, Staphylococcus
SPDNSVGT

SEQ ID NO: 1845564 - protein, 6 aa, Staphylococcus
SPGNPV

SEQ ID NO: 1845565 - protein, 7 aa, Staphylococcus
SPGVGKT

SEQ ID NO: 1845566 - protein, 4 aa, Staphylococcus
SPSN

SEQ ID NO: 1845567 - protein, 6 aa, Staphylococcus
SQLKTA

SEQ ID NO: 1845568 - protein, 4 aa, Staphylococcus
SQVT

SEQ ID NO: 1845569 - protein, 8 aa, Staphylococcus
SQYDNLKG

SEQ ID NO: 1845570 - protein, 7 aa, Staphylococcus
SQYRRKR

SEQ ID NO: 1845571 - protein, 12 aa, Staphylococcus
SRGHAAGKSATL

SEQ ID NO: 1845572 - protein, 7 aa, Staphylococcus
SRRDGFN

SEQ ID NO: 1845573 - protein, 6 aa, Staphylococcus
SRTGAI

SEQ ID NO: 1845574 - protein, 4 aa, Staphylococcus
SRVS

SEQ ID NO: 1845575 - protein, 11 aa, Staphylococcus
SSAMGGGQYSA

SEQ ID NO: 1845576 - protein, 5 aa, Staphylococcus
SSEQS

SEQ ID NO: 1845577 - protein, 8 aa, Staphylococcus
SSISHDGW

SEQ ID NO: 1845578 - protein, 6 aa, Staphylococcus
SSRSRG

SEQ ID NO: 1845579 - protein, 11 aa, Staphylococcus
SSSAFAEGQSL

SEQ ID NO: 1845580 - protein, 18 aa, Staphylococcus
SSSSANNGSGFEGLKDNT

SEQ ID NO: 1845581 - protein, 9 aa, Staphylococcus
SSSTPSMAG

SEQ ID NO: 1845582 - protein, 7 aa, Staphylococcus
SSVAGPA

SEQ ID NO: 1845583 - protein, 7 aa, Staphylococcus
SSVAYGP

SEQ ID NO: 1845584 - protein, 8 aa, Staphylococcus
SSVAYGPE

SEQ ID NO: 1845585 - protein, 7 aa, Staphylococcus
STAGDAA

SEQ ID NO: 1845586 - protein, 12 aa, Staphylococcus
STDADGNSVETK

SEQ ID NO: 1845587 - protein, 12 aa, Staphylococcus
STDAEGNSVETK

SEQ ID NO: 1845588 - protein, 6 aa, Staphylococcus
STDAEL

SEQ ID NO: 1845589 - protein, 12 aa, Staphylococcus
STDNQGNKVDTT

SEQ ID NO: 1845590 - protein, 4 aa, Staphylococcus
STEA

SEQ ID NO: 1845591 - protein, 6 aa, Staphylococcus
STGRDY

SEQ ID NO: 1845592 - protein, 6 aa, Staphylococcus
STIGQS

SEQ ID NO: 1845593 - protein, 7 aa, Staphylococcus
STKGMTP

SEQ ID NO: 1845594 - protein, 4 aa, Staphylococcus
STNR

SEQ ID NO: 1845595 - protein, 13 aa, Staphylococcus
STQIYNDPETNYD

SEQ ID NO: 1845596 - protein, 4 aa, Staphylococcus
STQQ

SEQ ID NO: 1845597 - protein, 16 aa, Staphylococcus
SVGGPSPADPTGSTNS

SEQ ID NO: 1845598 - protein, 5 aa, Staphylococcus
SYGHA

SEQ ID NO: 1845599 - protein, 11 aa, Staphylococcus
SYNGGEINQTE

SEQ ID NO: 1845600 - protein, 4 aa, Staphylococcus
TAGL

SEQ ID NO: 1845601 - protein, 7 aa, Staphylococcus
TAIGPSG

SEQ ID NO: 1845602 - protein, 5 aa, Staphylococcus
TASTW

SEQ ID NO: 1845603 - protein, 6 aa, Staphylococcus
TDDYGR

SEQ ID NO: 1845604 - protein, 6 aa, Staphylococcus
TDENPI

SEQ ID NO: 1845605 - protein, 10 aa, Staphylococcus
TDLGRNFSGT

SEQ ID NO: 1845606 - protein, 5 aa, Staphylococcus
TDMPD

SEQ ID NO: 1845607 - protein, 5 aa, Staphylococcus
TDMPN

SEQ ID NO: 1845608 - protein, 7 aa, Staphylococcus
TDRFDGK

SEQ ID NO: 1845609 - protein, 10 aa, Staphylococcus
TDVEGNSIET

SEQ ID NO: 1845610 - protein, 6 aa, Staphylococcus
TDYREM

SEQ ID NO: 1845611 - protein, 5 aa, Staphylococcus
TEDNR

SEQ ID NO: 1845612 - protein, 6 aa, Staphylococcus
TEISGQ

SEQ ID NO: 1845613 - protein, 4 aa, Staphylococcus
TENP

SEQ ID NO: 1845614 - protein, 18 aa, Staphylococcus
TFDPSTNTISGVATKVGT

SEQ ID NO: 1845615 - protein, 7 aa, Staphylococcus
TGDATFG

SEQ ID NO: 1845616 - protein, 8 aa, Staphylococcus
TGDATFGS

SEQ ID NO: 1845617 - protein, 11 aa, Staphylococcus
TGDGTNDAPAL

SEQ ID NO: 1845618 - protein, 6 aa, Staphylococcus
TGKDLA

SEQ ID NO: 1845619 - protein, 4 aa, Staphylococcus
TGLQ

SEQ ID NO: 1845620 - protein, 5 aa, Staphylococcus
TGLQD

SEQ ID NO: 1845621 - protein, 4 aa, Staphylococcus
TGNI

SEQ ID NO: 1845622 - protein, 7 aa, Staphylococcus
TGRAAEN

SEQ ID NO: 1845623 - protein, 4 aa, Staphylococcus
TGSS

SEQ ID NO: 1845624 - protein, 12 aa, Staphylococcus
TGTAWGSASTAG

SEQ ID NO: 1845625 - protein, 12 aa, Staphylococcus
TGTSVNPARSIG

SEQ ID NO: 1845626 - protein, 6 aa, Staphylococcus
THEGEL

SEQ ID NO: 1845627 - protein, 6 aa, Staphylococcus
THEGQL

SEQ ID NO: 1845628 - protein, 8 aa, Staphylococcus
TIDPGPME

SEQ ID NO: 1845629 - protein, 10 aa, Staphylococcus
TIENGQEKQQ

SEQ ID NO: 1845630 - protein, 4 aa, Staphylococcus
TIGG

SEQ ID NO: 1845631 - protein, 6 aa, Staphylococcus
TINSPN

SEQ ID NO: 1845632 - protein, 5 aa, Staphylococcus
TISPA

SEQ ID NO: 1845633 - protein, 9 aa, Staphylococcus
TITTKRDGF

SEQ ID NO: 1845634 - protein, 13 aa, Staphylococcus
TKDGGSKSTIERD

SEQ ID NO: 1845635 - protein, 11 aa, Staphylococcus
TKGDGPILGGN

SEQ ID NO: 1845636 - protein, 19 aa, Staphylococcus
TKKEKEPRLEPRLGNQYGG

SEQ ID NO: 1845637 - protein, 7 aa, Staphylococcus
TKKIPLE

SEQ ID NO: 1845638 - protein, 4 aa, Staphylococcus
TKKL

SEQ ID NO: 1845639 - protein, 8 aa, Staphylococcus
TKNPIAEP

SEQ ID NO: 1845640 - protein, 10 aa, Staphylococcus
TKPQPAQQSH

SEQ ID NO: 1845641 - protein, 11 aa, Staphylococcus
TKTGSEDGCGA

SEQ ID NO: 1845642 - protein, 5 aa, Staphylococcus
TLGAS

SEQ ID NO: 1845643 - protein, 11 aa, Staphylococcus
TLGEEGEDPEF

SEQ ID NO: 1845644 - protein, 4 aa, Staphylococcus
TLGG

SEQ ID NO: 1845645 - protein, 18 aa, Staphylococcus
TLKTDLDQYGANLPGDLS

SEQ ID NO: 1845646 - protein, 12 aa, Staphylococcus
TLPATGQTTNHA

SEQ ID NO: 1845647 - protein, 5 aa, Staphylococcus
TNART

SEQ ID NO: 1845648 - protein, 4 aa, Staphylococcus
TNGT

SEQ ID NO: 1845649 - protein, 4 aa, Staphylococcus
TNQN

SEQ ID NO: 1845650 - protein, 11 aa, Staphylococcus
TNSDGQPDSII

SEQ ID NO: 1845651 - protein, 4 aa, Staphylococcus
TNTI

SEQ ID NO: 1845652 - protein, 10 aa, Staphylococcus
TNTYSRDEEK

SEQ ID NO: 1845653 - protein, 7 aa, Staphylococcus
TPGNAKY

SEQ ID NO: 1845654 - protein, 9 aa, Staphylococcus
TPLEDGTTE

SEQ ID NO: 1845655 - protein, 5 aa, Staphylococcus
TPLSD

SEQ ID NO: 1845656 - protein, 5 aa, Staphylococcus
TPQQG

SEQ ID NO: 1845657 - protein, 5 aa, Staphylococcus
TPSNP

SEQ ID NO: 1845658 - protein, 5 aa, Staphylococcus
TQQAY

SEQ ID NO: 1845659 - protein, 8 aa, Staphylococcus
TQQDIERA

SEQ ID NO: 1845660 - protein, 6 aa, Staphylococcus
TQRLTS

SEQ ID NO: 1845661 - protein, 6 aa, Staphylococcus
TQVTRA

SEQ ID NO: 1845662 - protein, 4 aa, Staphylococcus
TQVY

SEQ ID NO: 1845663 - protein, 9 aa, Staphylococcus
TRARGAATG

SEQ ID NO: 1845664 - protein, 14 aa, Staphylococcus
TRHHDSDLKRGERQ

SEQ ID NO: 1845665 - protein, 4 aa, Staphylococcus
TRMS

SEQ ID NO: 1845666 - protein, 6 aa, Staphylococcus
TSIATH

SEQ ID NO: 1845667 - protein, 6 aa, Staphylococcus
TSIGTT

SEQ ID NO: 1845668 - protein, 6 aa, Staphylococcus
TSITGD

SEQ ID NO: 1845669 - protein, 5 aa, Staphylococcus
TSLQT

SEQ ID NO: 1845670 - protein, 5 aa, Staphylococcus
TSNKK

SEQ ID NO: 1845671 - protein, 8 aa, Staphylococcus
TSNPGQSF

SEQ ID NO: 1845672 - protein, 6 aa, Staphylococcus
TSPEQI

SEQ ID NO: 1845673 - protein, 17 aa, Staphylococcus
TSQDSIANALKQKSGAY

SEQ ID NO: 1845674 - protein, 5 aa, Staphylococcus
TSYHA

SEQ ID NO: 1845675 - protein, 6 aa, Staphylococcus
TSYSNY

SEQ ID NO: 1845676 - protein, 20 aa, Staphylococcus
TTAPTVKEISDQTKEVNTEI

SEQ ID NO: 1845677 - protein, 19 aa, Staphylococcus
TTAPTVKGISDQTKEVNTA

SEQ ID NO: 1845678 - protein, 6 aa, Staphylococcus
TTLENI

SEQ ID NO: 1845679 - protein, 8 aa, Staphylococcus
TTNYEETD

SEQ ID NO: 1845680 - protein, 9 aa, Staphylococcus
TTPSQPTKD

SEQ ID NO: 1845681 - protein, 8 aa, Staphylococcus
TTQSGNTV

SEQ ID NO: 1845682 - protein, 7 aa, Staphylococcus
TTRTAGF

SEQ ID NO: 1845683 - protein, 19 aa, Staphylococcus
TTSADNADAIKKGTSKNYG

SEQ ID NO: 1845684 - protein, 19 aa, Staphylococcus
TTVPTVKGISDQTKEVNTA

SEQ ID NO: 1845685 - protein, 4 aa, Staphylococcus
TTYG

SEQ ID NO: 1845686 - protein, 14 aa, Staphylococcus
TVPDYPSSKGTPVV

SEQ ID NO: 1845687 - protein, 32 aa, Staphylococcus
TVPNYPSDKPAPKVSVDDPSTLPNGKTPGTYT

SEQ ID NO: 1845688 - protein, 22 aa, Staphylococcus
TYKPAKDEVKAQATMAQPTTQQ

SEQ ID NO: 1845689 - protein, 10 aa, Staphylococcus
TYPDGSKTHV

SEQ ID NO: 1845690 - protein, 12 aa, Staphylococcus
TYPDGTKDHTNV

SEQ ID NO: 1845691 - protein, 9 aa, Staphylococcus
TYPDGTTDH

SEQ ID NO: 1845692 - protein, 11 aa, Staphylococcus
TYRKPGLYKDY

SEQ ID NO: 1845693 - protein, 7 aa, Staphylococcus
VAGEAGA

SEQ ID NO: 1845694 - protein, 5 aa, Staphylococcus
VAKTP

SEQ ID NO: 1845695 - protein, 7 aa, Staphylococcus
VDANGNN

SEQ ID NO: 1845696 - protein, 5 aa, Staphylococcus
VDEQM

SEQ ID NO: 1845697 - protein, 21 aa, Staphylococcus
VDGEGNEVQETEEGTHDAPGI

SEQ ID NO: 1845698 - protein, 6 aa, Staphylococcus
VDGPIG

SEQ ID NO: 1845699 - protein, 5 aa, Staphylococcus
VDGSE

SEQ ID NO: 1845700 - protein, 4 aa, Staphylococcus
VDIT

SEQ ID NO: 1845701 - protein, 6 aa, Staphylococcus
VDQGRR

SEQ ID NO: 1845702 - protein, 11 aa, Staphylococcus
VDRTTNGSGKV

SEQ ID NO: 1845703 - protein, 21 aa, Staphylococcus
VDSEGNEVQETEEGTHDAPGI

SEQ ID NO: 1845704 - protein, 7 aa, Staphylococcus
VEDGRNP

SEQ ID NO: 1845705 - protein, 6 aa, Staphylococcus
VEDQGQ

SEQ ID NO: 1845706 - protein, 6 aa, Staphylococcus
VEDSRN

SEQ ID NO: 1845707 - protein, 9 aa, Staphylococcus
VEEDTKEIE

SEQ ID NO: 1845708 - protein, 4 aa, Staphylococcus
VEKG

SEQ ID NO: 1845709 - protein, 4 aa, Staphylococcus
VESP

SEQ ID NO: 1845710 - protein, 9 aa, Staphylococcus
VESVGTALT

SEQ ID NO: 1845711 - protein, 5 aa, Staphylococcus
VGAGG

SEQ ID NO: 1845712 - protein, 4 aa, Staphylococcus
VGAS

SEQ ID NO: 1845713 - protein, 7 aa, Staphylococcus
VGEGSEN

SEQ ID NO: 1845714 - protein, 5 aa, Staphylococcus
VGGDL

SEQ ID NO: 1845715 - protein, 5 aa, Staphylococcus
VGGKM

SEQ ID NO: 1845716 - protein, 7 aa, Staphylococcus
VGPRPAL

SEQ ID NO: 1845717 - protein, 5 aa, Staphylococcus
VGQGD

SEQ ID NO: 1845718 - protein, 6 aa, Staphylococcus
VGTAGS

SEQ ID NO: 1845719 - protein, 9 aa, Staphylococcus
VKDTQGKTK

SEQ ID NO: 1845720 - protein, 4 aa, Staphylococcus
VKGS

SEQ ID NO: 1845721 - protein, 11 aa, Staphylococcus
VKSATSETTED

SEQ ID NO: 1845722 - protein, 6 aa, Staphylococcus
VKSGSV

SEQ ID NO: 1845723 - protein, 9 aa, Staphylococcus
VKSKRGAEL

SEQ ID NO: 1845724 - protein, 5 aa, Staphylococcus
VNAEY

SEQ ID NO: 1845725 - protein, 10 aa, Staphylococcus
VNDKSKVDVE

SEQ ID NO: 1845726 - protein, 5 aa, Staphylococcus
VNFGA

SEQ ID NO: 1845727 - protein, 7 aa, Staphylococcus
VNGKPFK

SEQ ID NO: 1845728 - protein, 7 aa, Staphylococcus
VNSGGTI

SEQ ID NO: 1845729 - protein, 8 aa, Staphylococcus
VPGVSGGT

SEQ ID NO: 1845730 - protein, 40 aa, Staphylococcus
VPIPEGNVRAKATDNAEHPNSSLSKPKKATDTTPPGSPIV

SEQ ID NO: 1845731 - protein, 5 aa, Staphylococcus
VPKNM

SEQ ID NO: 1845732 - protein, 31 aa, Staphylococcus
VQHNNQRSHHTQQQDVTKPLSHAQNNHTVQS

SEQ ID NO: 1845733 - protein, 7 aa, Staphylococcus
VRPEQTQ

SEQ ID NO: 1845734 - protein, 6 aa, Staphylococcus
VRYSEV

SEQ ID NO: 1845735 - protein, 8 aa, Staphylococcus
VSGNGQAT

SEQ ID NO: 1845736 - protein, 6 aa, Staphylococcus
VSGNVN

SEQ ID NO: 1845737 - protein, 4 aa, Staphylococcus
VSKK

SEQ ID NO: 1845738 - protein, 9 aa, Staphylococcus
VSKKGGTPL

SEQ ID NO: 1845739 - protein, 4 aa, Staphylococcus
VSRL

SEQ ID NO: 1845740 - protein, 6 aa, Staphylococcus
VSRTGS

SEQ ID NO: 1845741 - protein, 4 aa, Staphylococcus
VSST

SEQ ID NO: 1845742 - protein, 11 aa, Staphylococcus
VTKDDTSKNIK

SEQ ID NO: 1845743 - protein, 9 aa, Staphylococcus
VTKNSSGGL

SEQ ID NO: 1845744 - protein, 6 aa, Staphylococcus
VTPGSE

SEQ ID NO: 1845745 - protein, 9 aa, Staphylococcus
VTPKGESTK

SEQ ID NO: 1845746 - protein, 9 aa, Staphylococcus
VTTDPNTSV

SEQ ID NO: 1845747 - protein, 8 aa, Staphylococcus
VTTGSEQH

SEQ ID NO: 1845748 - protein, 35 aa, Staphylococcus
VTTNPEKDNNAYEPETTPVTKEHGTPTTEDDVTGA

SEQ ID NO: 1845749 - protein, 15 aa, Staphylococcus
VTVPDYPSSKGTPVV

SEQ ID NO: 1845750 - protein, 8 aa, Staphylococcus
VVDNGGKI

SEQ ID NO: 1845751 - protein, 13 aa, Staphylococcus
VVPSAGKTGTAEV

SEQ ID NO: 1845752 - protein, 5 aa, Staphylococcus
WAKNG

SEQ ID NO: 1845753 - protein, 9 aa, Staphylococcus
WDPYGNTKN

SEQ ID NO: 1845754 - protein, 5 aa, Staphylococcus
WGGSG

SEQ ID NO: 1845755 - protein, 8 aa, Staphylococcus
WPNGGRTT

SEQ ID NO: 1845756 - protein, 5 aa, Staphylococcus
WPPSG

SEQ ID NO: 1845757 - protein, 8 aa, Staphylococcus
YAGNAEPV

SEQ ID NO: 1845758 - protein, 8 aa, Staphylococcus
YASDKARR

SEQ ID NO: 1845759 - protein, 11 aa, Staphylococcus
YEKPPESKEDP

SEQ ID NO: 1845760 - protein, 4 aa, Staphylococcus
YGGN

SEQ ID NO: 1845761 - protein, 6 aa, Staphylococcus
YGGTDA

SEQ ID NO: 1845762 - protein, 5 aa, Staphylococcus
YGITK

SEQ ID NO: 1845763 - protein, 5 aa, Staphylococcus
YGNTG

SEQ ID NO: 1845764 - protein, 6 aa, Staphylococcus
YGQDTK

SEQ ID NO: 1845765 - protein, 8 aa, Staphylococcus
YGTQALRP

SEQ ID NO: 1845766 - protein, 12 aa, Staphylococcus
YKEKKSNDEKIL

SEQ ID NO: 1845767 - protein, 6 aa, Staphylococcus
YKPQAK

SEQ ID NO: 1845768 - protein, 6 aa, Staphylococcus
YNEMGG

SEQ ID NO: 1845769 - protein, 8 aa, Staphylococcus
YNPETDDA

SEQ ID NO: 1845770 - protein, 8 aa, Staphylococcus
YPKDQRKT

SEQ ID NO: 1845771 - protein, 5 aa, Staphylococcus
YQGHK

SEQ ID NO: 1845772 - protein, 7 aa, Staphylococcus
YQGIDKN

SEQ ID NO: 1845773 - protein, 9 aa, Staphylococcus
YQTTTKDNY

SEQ ID NO: 1845774 - protein, 7 aa, Staphylococcus
YRGYDSA

SEQ ID NO: 1845775 - protein, 11 aa, Staphylococcus
YRTQPDKNGDI

SEQ ID NO: 1845776 - protein, 9 aa, Staphylococcus
YSASNPLGG

SEQ ID NO: 1845777 - protein, 7 aa, Staphylococcus
YSEGSDQ

SEQ ID NO: 1845778 - protein, 5 aa, Staphylococcus
YSSDL

SEQ ID NO: 1845779 - protein, 5 aa, Staphylococcus
YTASQ

SEQ ID NO: 1845780 - protein, 4 aa, Staphylococcus
YTGI

SEQ ID NO: 1845781 - protein, 5 aa, Staphylococcus
YTGLK

SEQ ID NO: 1845782 - protein, 6 aa, Staphylococcus
YTGLKK

SEQ ID NO: 1845783 - protein, 12 aa, Staphylococcus
YTGQTTTADGIT

SEQ ID NO: 1845784 - protein, 6 aa, Staphylococcus
YYTREE

SEQ ID NO: 1845785 - protein, 7 aa, Staphylococcus
AAAAGQI

SEQ ID NO: 1845786 - protein, 7 aa, Staphylococcus
AAAKHKN

SEQ ID NO: 1845787 - protein, 24 aa, Staphylococcus
AAAKQREQIDENHEATQEERNTAL

SEQ ID NO: 1845788 - protein, 29 aa, Staphylococcus
AAALGDSGSPASDSTLGPTAGLDIDGQHD

SEQ ID NO: 1845789 - protein, 10 aa, Staphylococcus
AAANPDKTSR

SEQ ID NO: 1845790 - protein, 6 aa, Staphylococcus
AAAPNM

SEQ ID NO: 1845791 - protein, 5 aa, Staphylococcus
AAAQN

SEQ ID NO: 1845792 - protein, 5 aa, Staphylococcus
AAASG

SEQ ID NO: 1845793 - protein, 7 aa, Staphylococcus
AAATKTG

SEQ ID NO: 1845794 - protein, 15 aa, Staphylococcus
AADGSFYGSAAGAGF

SEQ ID NO: 1845795 - protein, 15 aa, Staphylococcus
AADGSLYGSGSGAGF

SEQ ID NO: 1845796 - protein, 15 aa, Staphylococcus
AADGSLYGSTAGAGF

SEQ ID NO: 1845797 - protein, 5 aa, Staphylococcus
AADPE

SEQ ID NO: 1845798 - protein, 6 aa, Staphylococcus
AADTYA

SEQ ID NO: 1845799 - protein, 4 aa, Staphylococcus
AADY

SEQ ID NO: 1845800 - protein, 14 aa, Staphylococcus
AAEAARAGYPFPRP

SEQ ID NO: 1845801 - protein, 12 aa, Staphylococcus
AAEASGADMATT

SEQ ID NO: 1845802 - protein, 4 aa, Staphylococcus
AAEF

SEQ ID NO: 1845803 - protein, 25 aa, Staphylococcus
AAEHIDSDEVEATPSKHSKQQRDKS

SEQ ID NO: 1845804 - protein, 142 aa, Staphylococcus
AAELDEQSQSAQQKVTETSGTDDTNQKSTAPDNASSQVESKEDTSYPSSKVETKADNNPAPKQNSVDDTSAKSSKSETLSNNKNSNKDLAETKSEANNVDTNQPSTEEKTLSNEKSIKAKHKRVKRDANDTSSNPQTQPDPM

SEQ ID NO: 1845805 - protein, 31 aa, Staphylococcus
AAENQSEIQKSNATTTQQINTSSQDSTPRAH

SEQ ID NO: 1845806 - protein, 10 aa, Staphylococcus
AAESNDVSNQ

SEQ ID NO: 1845807 - protein, 300 aa, Staphylococcus
AAESNQQATNEVDSSNVSSDTDTQERQNSSNNINENHQSDTQDSTELEKNNNNQNSGKSNSSSNDENDANENSDNTVDQSDSSDNSNSGSKTDLNNGDDTNNSGDNDTSNPDDGEQPGDNDSSDNPDDGEQPGDNDSGNPDDGQQSGNNDSSSNPDDEEQPGDNDSSSNPDDGEKPGDNDSGKPDTGNNPGNNDSGEQDDGGNKPGDSGNHQQPPKHDGNPGSNQGDHHSNSGSNGSNNGSQNNSNSNSNNNSNYPGNHSGHSSTNDTVKPNKPVFNNNNGSTNGNHSTGSNHHNNSVSD

SEQ ID NO: 1845808 - protein, 5 aa, Staphylococcus
AAGAA

SEQ ID NO: 1845809 - protein, 6 aa, Staphylococcus
AAGAAG

SEQ ID NO: 1845810 - protein, 5 aa, Staphylococcus
AAGAF

SEQ ID NO: 1845811 - protein, 7 aa, Staphylococcus
AAGASKW

SEQ ID NO: 1845812 - protein, 7 aa, Staphylococcus
AAGASSW

SEQ ID NO: 1845813 - protein, 7 aa, Staphylococcus
AAGAYGA

SEQ ID NO: 1845814 - protein, 11 aa, Staphylococcus
AAGHHQPEKRP

SEQ ID NO: 1845815 - protein, 10 aa, Staphylococcus
AAGNGKGGTN

SEQ ID NO: 1845816 - protein, 8 aa, Staphylococcus
AAIASEGS

SEQ ID NO: 1845817 - protein, 8 aa, Staphylococcus
AAIASTGS

SEQ ID NO: 1845818 - protein, 52 aa, Staphylococcus
AAIDTVADATDEEKQAAKDKVDAEATKAKAAIDQATTNNDVEQAKSSGVTTI

SEQ ID NO: 1845819 - protein, 12 aa, Staphylococcus
AAINPGNSGGAL

SEQ ID NO: 1845820 - protein, 160 aa, Staphylococcus
AAKEEGQPEEKVNTTKVDSGSNKKAAAQKETTAKKEEPTAKVESKTVNNTTTTKTETSKTTDTPKKTAATTTKQAKASSSKDATKTTTKTTRKPAAKGSKTTTQKTTTKTKSQGQNNSQKSSAKNKTTGSANKAQSTTKQTTNQPKGEATKKKIEKKTFN

SEQ ID NO: 1845821 - protein, 42 aa, Staphylococcus
AAKGDEGQSGSGSETRQNGPSSSSMSAMSQSNQSQGSSSGEI

SEQ ID NO: 1845822 - protein, 7 aa, Staphylococcus
AAKGSKE

SEQ ID NO: 1845823 - protein, 16 aa, Staphylococcus
AAKGSNSSKNQVIGPR

SEQ ID NO: 1845824 - protein, 7 aa, Staphylococcus
AAKKHKN

SEQ ID NO: 1845825 - protein, 11 aa, Staphylococcus
AAKKKKKFEMP

SEQ ID NO: 1845826 - protein, 5 aa, Staphylococcus
AAKLG

SEQ ID NO: 1845827 - protein, 9 aa, Staphylococcus
AAKPTPDQL

SEQ ID NO: 1845828 - protein, 7 aa, Staphylococcus
AAKQKEV

SEQ ID NO: 1845829 - protein, 10 aa, Staphylococcus
AAKQSLPKIN

SEQ ID NO: 1845830 - protein, 8 aa, Staphylococcus
AAKSATAL

SEQ ID NO: 1845831 - protein, 12 aa, Staphylococcus
AAKTGTGTYGEE

SEQ ID NO: 1845832 - protein, 28 aa, Staphylococcus
AALGDSGSPASDSTLGPTAGLDVDGQHD

SEQ ID NO: 1845833 - protein, 29 aa, Staphylococcus
AALGDSGSPASDSTLGPTAGLNVDGQHDH

SEQ ID NO: 1845834 - protein, 9 aa, Staphylococcus
AALNGQKRE

SEQ ID NO: 1845835 - protein, 10 aa, Staphylococcus
AANEKLDAIN

SEQ ID NO: 1845836 - protein, 8 aa, Staphylococcus
AANIKDNN

SEQ ID NO: 1845837 - protein, 9 aa, Staphylococcus
AANKIDPTR

SEQ ID NO: 1845838 - protein, 9 aa, Staphylococcus
AANQSGRNV

SEQ ID NO: 1845839 - protein, 9 aa, Staphylococcus
AANQSLPEI

SEQ ID NO: 1845840 - protein, 11 aa, Staphylococcus
AANRAKGVKWN

SEQ ID NO: 1845841 - protein, 6 aa, Staphylococcus
AANRVK

SEQ ID NO: 1845842 - protein, 15 aa, Staphylococcus
AANSAEAINPQRTMP

SEQ ID NO: 1845843 - protein, 17 aa, Staphylococcus
AANSAEAINPSKTMPRG

SEQ ID NO: 1845844 - protein, 17 aa, Staphylococcus
AANSGEAINPQKTMPRG

SEQ ID NO: 1845845 - protein, 7 aa, Staphylococcus
AANSGLY

SEQ ID NO: 1845846 - protein, 8 aa, Staphylococcus
AANSGLYT

SEQ ID NO: 1845847 - protein, 8 aa, Staphylococcus
AANSGMYT

SEQ ID NO: 1845848 - protein, 11 aa, Staphylococcus
AAPKDRDAAYE

SEQ ID NO: 1845849 - protein, 5 aa, Staphylococcus
AAPKY

SEQ ID NO: 1845850 - protein, 4 aa, Staphylococcus
AAPN

SEQ ID NO: 1845851 - protein, 17 aa, Staphylococcus
AAPPNADPKTAAAYTEA

SEQ ID NO: 1845852 - protein, 17 aa, Staphylococcus
AAPPNAKPETAQAYTEA

SEQ ID NO: 1845853 - protein, 17 aa, Staphylococcus
AAPPTADPKTTEAYTEA

SEQ ID NO: 1845854 - protein, 8 aa, Staphylococcus
AAPSCNSG

SEQ ID NO: 1845855 - protein, 21 aa, Staphylococcus
AAPVQASSNYINADNDLKNQF

SEQ ID NO: 1845856 - protein, 140 aa, Staphylococcus
AAQAAEQTDNGDTKAQTSTQTTADSTKQTVGNNSSATSENTNLVEQNTNVTSQNSSNDTTAQSQLDNTKTQTQQAQSPNEQSSQPNPEDSVGEKSQPVTQNAPTTSEQKTENTANENSSVQETNNQTKEQKTDQTDQSQL

SEQ ID NO: 1845857 - protein, 9 aa, Staphylococcus
AAQDMQDDG

SEQ ID NO: 1845858 - protein, 6 aa, Staphylococcus
AAQNAP

SEQ ID NO: 1845859 - protein, 10 aa, Staphylococcus
AAQNDIDDAN

SEQ ID NO: 1845860 - protein, 10 aa, Staphylococcus
AAQSELDDAN

SEQ ID NO: 1845861 - protein, 8 aa, Staphylococcus
AAQTEIDD

SEQ ID NO: 1845862 - protein, 17 aa, Staphylococcus
AARETSKIQQALDNARS

SEQ ID NO: 1845863 - protein, 7 aa, Staphylococcus
AARNGNY

SEQ ID NO: 1845864 - protein, 5 aa, Staphylococcus
AARVE

SEQ ID NO: 1845865 - protein, 10 aa, Staphylococcus
AASAANSGLF

SEQ ID NO: 1845866 - protein, 11 aa, Staphylococcus
AASEEEVTSPQ

SEQ ID NO: 1845867 - protein, 7 aa, Staphylococcus
AASGAFG

SEQ ID NO: 1845868 - protein, 6 aa, Staphylococcus
AASGGF

SEQ ID NO: 1845869 - protein, 9 aa, Staphylococcus
AASGVGPIA

SEQ ID NO: 1845870 - protein, 7 aa, Staphylococcus
AASNPLG

SEQ ID NO: 1845871 - protein, 14 aa, Staphylococcus
AASPKLASKDAVRD

SEQ ID NO: 1845872 - protein, 9 aa, Staphylococcus
AASQGEGGN

SEQ ID NO: 1845873 - protein, 7 aa, Staphylococcus
AASRETP

SEQ ID NO: 1845874 - protein, 7 aa, Staphylococcus
AASVATP

SEQ ID NO: 1845875 - protein, 18 aa, Staphylococcus
AASVEQTTMKNSSQGGDA

SEQ ID NO: 1845876 - protein, 6 aa, Staphylococcus
AATATT

SEQ ID NO: 1845877 - protein, 18 aa, Staphylococcus
AATEEEKVRPKRKKRQFD

SEQ ID NO: 1845878 - protein, 8 aa, Staphylococcus
AATFKDTN

SEQ ID NO: 1845879 - protein, 5 aa, Staphylococcus
AATGS

SEQ ID NO: 1845880 - protein, 5 aa, Staphylococcus
AATGT

SEQ ID NO: 1845881 - protein, 5 aa, Staphylococcus
AATKI

SEQ ID NO: 1845882 - protein, 8 aa, Staphylococcus
AATKKQPI

SEQ ID NO: 1845883 - protein, 18 aa, Staphylococcus
AATKKQPIPERLKPRQKN

SEQ ID NO: 1845884 - protein, 11 aa, Staphylococcus
AATKKQPIPKR

SEQ ID NO: 1845885 - protein, 12 aa, Staphylococcus
AATKSKAESIAE

SEQ ID NO: 1845886 - protein, 14 aa, Staphylococcus
AATPKLASKASIRE

SEQ ID NO: 1845887 - protein, 14 aa, Staphylococcus
AATPKLASKGAIRE

SEQ ID NO: 1845888 - protein, 14 aa, Staphylococcus
AATPKLASKSSIRE

SEQ ID NO: 1845889 - protein, 6 aa, Staphylococcus
AATQAF

SEQ ID NO: 1845890 - protein, 5 aa, Staphylococcus
AATSG

SEQ ID NO: 1845891 - protein, 6 aa, Staphylococcus
AATSGV

SEQ ID NO: 1845892 - protein, 5 aa, Staphylococcus
AATSL

SEQ ID NO: 1845893 - protein, 14 aa, Staphylococcus
AATSNYGKTALETG

SEQ ID NO: 1845894 - protein, 5 aa, Staphylococcus
AATSS

SEQ ID NO: 1845895 - protein, 10 aa, Staphylococcus
AATSSRAEGM

SEQ ID NO: 1845896 - protein, 7 aa, Staphylococcus
AATYPDA

SEQ ID NO: 1845897 - protein, 7 aa, Staphylococcus
AATYPDR

SEQ ID NO: 1845898 - protein, 6 aa, Staphylococcus
AAVKEA

SEQ ID NO: 1845899 - protein, 13 aa, Staphylococcus
AAVTGNPRIRNKK

SEQ ID NO: 1845900 - protein, 15 aa, Staphylococcus
AAYDPEGAINVSQTG

SEQ ID NO: 1845901 - protein, 18 aa, Staphylococcus
AAYEPEELESVVDYEIPS

SEQ ID NO: 1845902 - protein, 10 aa, Staphylococcus
AAYSKSHEVN

SEQ ID NO: 1845903 - protein, 13 aa, Staphylococcus
ADAAEDNEKTDIQ

SEQ ID NO: 1845904 - protein, 91 aa, Staphylococcus
ADAATDQPRQSDSTRTANTDAGADTNTKRSNATNVDQSNNSQQSTQKEETPQSTAAHESQTGKDDSTKSENQTSSHADLPEAGHVDHPEQG

SEQ ID NO: 1845905 - protein, 6 aa, Staphylococcus
ADAGTA

SEQ ID NO: 1845906 - protein, 5 aa, Staphylococcus
ADALS

SEQ ID NO: 1845907 - protein, 9 aa, Staphylococcus
ADATHTGTV

SEQ ID NO: 1845908 - protein, 11 aa, Staphylococcus
ADAYAKQNKDL

SEQ ID NO: 1845909 - protein, 28 aa, Staphylococcus
ADDEAPNEDEEATVDPGVDDKEASENEP

SEQ ID NO: 1845910 - protein, 27 aa, Staphylococcus
ADDEATEEEAAEAQGTPASTTDSNEPY

SEQ ID NO: 1845911 - protein, 40 aa, Staphylococcus
ADDEATKEEEAEAQENEANASGAVASTSASEHANDSNEPY

SEQ ID NO: 1845912 - protein, 34 aa, Staphylococcus
ADDEATKEEEAEAQQNEADATAASTGVDAEDNEP

SEQ ID NO: 1845913 - protein, 36 aa, Staphylococcus
ADDEATKEEEKEAQEQEAAAAGATSGSANTTDANEP

SEQ ID NO: 1845914 - protein, 30 aa, Staphylococcus
ADDEATKEEEKEAQEQEAAEANSSVDSTEP

SEQ ID NO: 1845915 - protein, 35 aa, Staphylococcus
ADDEATKEEEKEAQKQEDEAQATTGASANDNANEP

SEQ ID NO: 1845916 - protein, 8 aa, Staphylococcus
ADDGEITA

SEQ ID NO: 1845917 - protein, 13 aa, Staphylococcus
ADDKKGRASTIAS

SEQ ID NO: 1845918 - protein, 7 aa, Staphylococcus
ADDQEDV

SEQ ID NO: 1845919 - protein, 10 aa, Staphylococcus
ADDQEDVAQK

SEQ ID NO: 1845920 - protein, 10 aa, Staphylococcus
ADDQEDVAQT

SEQ ID NO: 1845921 - protein, 8 aa, Staphylococcus
ADDQEHVA

SEQ ID NO: 1845922 - protein, 5 aa, Staphylococcus
ADDTI

SEQ ID NO: 1845923 - protein, 7 aa, Staphylococcus
ADDVLSG

SEQ ID NO: 1845924 - protein, 8 aa, Staphylococcus
ADEDLQNQ

SEQ ID NO: 1845925 - protein, 9 aa, Staphylococcus
ADEGNGNAK

SEQ ID NO: 1845926 - protein, 9 aa, Staphylococcus
ADEGNSGAK

SEQ ID NO: 1845927 - protein, 6 aa, Staphylococcus
ADEGYH

SEQ ID NO: 1845928 - protein, 13 aa, Staphylococcus
ADEIKANPNRNYR

SEQ ID NO: 1845929 - protein, 10 aa, Staphylococcus
ADERAKHVRQ

SEQ ID NO: 1845930 - protein, 7 aa, Staphylococcus
ADESCVP

SEQ ID NO: 1845931 - protein, 22 aa, Staphylococcus
ADETGTFRGRNSNFNGEGFSRQ

SEQ ID NO: 1845932 - protein, 6 aa, Staphylococcus
ADFTTD

SEQ ID NO: 1845933 - protein, 9 aa, Staphylococcus
ADGDDTYSK

SEQ ID NO: 1845934 - protein, 8 aa, Staphylococcus
ADGEQVDY

SEQ ID NO: 1845935 - protein, 7 aa, Staphylococcus
ADGEQVN

SEQ ID NO: 1845936 - protein, 5 aa, Staphylococcus
ADGEV

SEQ ID NO: 1845937 - protein, 16 aa, Staphylococcus
ADGEVIATGTNNATGQ

SEQ ID NO: 1845938 - protein, 9 aa, Staphylococcus
ADGGGATRI

SEQ ID NO: 1845939 - protein, 10 aa, Staphylococcus
ADGGGATRIA

SEQ ID NO: 1845940 - protein, 17 aa, Staphylococcus
ADGKNGQNGRNGRQGTE

SEQ ID NO: 1845941 - protein, 6 aa, Staphylococcus
ADGMPS

SEQ ID NO: 1845942 - protein, 6 aa, Staphylococcus
ADGMPT

SEQ ID NO: 1845943 - protein, 7 aa, Staphylococcus
ADGQAPK

SEQ ID NO: 1845944 - protein, 7 aa, Staphylococcus
ADGSATI

SEQ ID NO: 1845945 - protein, 14 aa, Staphylococcus
ADGSFYGSEAGAGF

SEQ ID NO: 1845946 - protein, 9 aa, Staphylococcus
ADGSTTKLN

SEQ ID NO: 1845947 - protein, 6 aa, Staphylococcus
ADHKNE

SEQ ID NO: 1845948 - protein, 17 aa, Staphylococcus
ADHKTPKDKKDYGVASN

SEQ ID NO: 1845949 - protein, 23 aa, Staphylococcus
ADHNQDKSDKNYGVASNNPIATR

SEQ ID NO: 1845950 - protein, 8 aa, Staphylococcus
ADHTGPSV

SEQ ID NO: 1845951 - protein, 9 aa, Staphylococcus
ADHTTESTV

SEQ ID NO: 1845952 - protein, 7 aa, Staphylococcus
ADIIGGK

SEQ ID NO: 1845953 - protein, 14 aa, Staphylococcus
ADITSEDQTEVYGD

SEQ ID NO: 1845954 - protein, 8 aa, Staphylococcus
ADKDISKF

SEQ ID NO: 1845955 - protein, 5 aa, Staphylococcus
ADKEQ

SEQ ID NO: 1845956 - protein, 13 aa, Staphylococcus
ADKGETFKQLDKK

SEQ ID NO: 1845957 - protein, 12 aa, Staphylococcus
ADKNDRHGTQKV

SEQ ID NO: 1845958 - protein, 7 aa, Staphylococcus
ADKNTSK

SEQ ID NO: 1845959 - protein, 8 aa, Staphylococcus
ADKPGFAS

SEQ ID NO: 1845960 - protein, 7 aa, Staphylococcus
ADKPGMA

SEQ ID NO: 1845961 - protein, 7 aa, Staphylococcus
ADKQHTS

SEQ ID NO: 1845962 - protein, 9 aa, Staphylococcus
ADKSKVDVQ

SEQ ID NO: 1845963 - protein, 6 aa, Staphylococcus
ADKYDR

SEQ ID NO: 1845964 - protein, 6 aa, Staphylococcus
ADKYGQ

SEQ ID NO: 1845965 - protein, 17 aa, Staphylococcus
ADLAKKDKQAIDNDIET

SEQ ID NO: 1845966 - protein, 6 aa, Staphylococcus
ADLARG

SEQ ID NO: 1845967 - protein, 14 aa, Staphylococcus
ADLREKRKSEHISE

SEQ ID NO: 1845968 - protein, 5 aa, Staphylococcus
ADMKG

SEQ ID NO: 1845969 - protein, 11 aa, Staphylococcus
ADNDKDEPKAN

SEQ ID NO: 1845970 - protein, 63 aa, Staphylococcus
ADNDRAHKNGRRTNNTNQKDSKHNSGNTGDQGDNLSGYNQNDSNQNTVRSLPNTGYSNSESST

SEQ ID NO: 1845971 - protein, 11 aa, Staphylococcus
ADNMKKDYERL

SEQ ID NO: 1845972 - protein, 5 aa, Staphylococcus
ADNMT

SEQ ID NO: 1845973 - protein, 10 aa, Staphylococcus
ADNNDIDGSI

SEQ ID NO: 1845974 - protein, 10 aa, Staphylococcus
ADNNDTDGHV

SEQ ID NO: 1845975 - protein, 6 aa, Staphylococcus
ADNRKE

SEQ ID NO: 1845976 - protein, 12 aa, Staphylococcus
ADNSKASNPLKG

SEQ ID NO: 1845977 - protein, 13 aa, Staphylococcus
ADNSKKSAPLKGK

SEQ ID NO: 1845978 - protein, 7 aa, Staphylococcus
ADNTTSQ

SEQ ID NO: 1845979 - protein, 13 aa, Staphylococcus
ADNYNALKTKNQL

SEQ ID NO: 1845980 - protein, 7 aa, Staphylococcus
ADPAIAA

SEQ ID NO: 1845981 - protein, 5 aa, Staphylococcus
ADPFY

SEQ ID NO: 1845982 - protein, 27 aa, Staphylococcus
ADPTETDNNHHAVPDNGEGQSKYYNTA

SEQ ID NO: 1845983 - protein, 14 aa, Staphylococcus
ADQAIAKEKELREK

SEQ ID NO: 1845984 - protein, 6 aa, Staphylococcus
ADQEVA

SEQ ID NO: 1845985 - protein, 8 aa, Staphylococcus
ADQISSDF

SEQ ID NO: 1845986 - protein, 8 aa, Staphylococcus
ADQNTQLS

SEQ ID NO: 1845987 - protein, 36 aa, Staphylococcus
ADQPSKSKEQPSNQNDKLTKDDDNSIGYNGEKKTAL

SEQ ID NO: 1845988 - protein, 4 aa, Staphylococcus
ADRG

SEQ ID NO: 1845989 - protein, 13 aa, Staphylococcus
ADRHDISEGKDVH

SEQ ID NO: 1845990 - protein, 11 aa, Staphylococcus
ADSEATDGNVG

SEQ ID NO: 1845991 - protein, 7 aa, Staphylococcus
ADSETQQ

SEQ ID NO: 1845992 - protein, 8 aa, Staphylococcus
ADSNDIDG

SEQ ID NO: 1845993 - protein, 5 aa, Staphylococcus
ADSQV

SEQ ID NO: 1845994 - protein, 5 aa, Staphylococcus
ADSSL

SEQ ID NO: 1845995 - protein, 10 aa, Staphylococcus
ADTANPSSNI

SEQ ID NO: 1845996 - protein, 9 aa, Staphylococcus
ADTDEALNS

SEQ ID NO: 1845997 - protein, 13 aa, Staphylococcus
ADTDELKNITEKE

SEQ ID NO: 1845998 - protein, 6 aa, Staphylococcus
ADTDQA

SEQ ID NO: 1845999 - protein, 9 aa, Staphylococcus
ADTDVTDPK

SEQ ID NO: 1846000 - protein, 5 aa, Staphylococcus
ADTGG

SEQ ID NO: 1846001 - protein, 6 aa, Staphylococcus
ADTKDY

SEQ ID NO: 1846002 - protein, 27 aa, Staphylococcus
ADTMSQQDAITTAKQAMARSGGNPDLQ

SEQ ID NO: 1846003 - protein, 7 aa, Staphylococcus
ADTPSVP

SEQ ID NO: 1846004 - protein, 10 aa, Staphylococcus
ADTTATVNEN

SEQ ID NO: 1846005 - protein, 12 aa, Staphylococcus
ADVNKQENPFKN

SEQ ID NO: 1846006 - protein, 7 aa, Staphylococcus
ADVPKDA

SEQ ID NO: 1846007 - protein, 26 aa, Staphylococcus
ADVSSYQKTLDKQNEGAEAPAKQTFD

SEQ ID NO: 1846008 - protein, 19 aa, Staphylococcus
ADYKKNALESAKSYQEDMN

SEQ ID NO: 1846009 - protein, 13 aa, Staphylococcus
ADYYGSKDSPKPL

SEQ ID NO: 1846010 - protein, 69 aa, Staphylococcus
AEAAENENTTEAAQTSNVTGETEQSVQSSNSNSNEVNQVKSEKTNTAETVKEQVSEKAQEATKATENKI

SEQ ID NO: 1846011 - protein, 8 aa, Staphylococcus
AEALKGAN

SEQ ID NO: 1846012 - protein, 12 aa, Staphylococcus
AEALKNDEFSKG

SEQ ID NO: 1846013 - protein, 16 aa, Staphylococcus
AEALPETGETDNVPTA

SEQ ID NO: 1846014 - protein, 6 aa, Staphylococcus
AEANIS

SEQ ID NO: 1846015 - protein, 18 aa, Staphylococcus
AEAPKDDALTPIDIGDSS

SEQ ID NO: 1846016 - protein, 10 aa, Staphylococcus
AEAQKDGITK

SEQ ID NO: 1846017 - protein, 5 aa, Staphylococcus
AEDKG

SEQ ID NO: 1846018 - protein, 5 aa, Staphylococcus
AEDKP

SEQ ID NO: 1846019 - protein, 7 aa, Staphylococcus
AEDMERK

SEQ ID NO: 1846020 - protein, 6 aa, Staphylococcus
AEDNGT

SEQ ID NO: 1846021 - protein, 6 aa, Staphylococcus
AEDRAI

SEQ ID NO: 1846022 - protein, 6 aa, Staphylococcus
AEDVYS

SEQ ID NO: 1846023 - protein, 8 aa, Staphylococcus
AEEEETAT

SEQ ID NO: 1846024 - protein, 8 aa, Staphylococcus
AEEEETRT

SEQ ID NO: 1846025 - protein, 9 aa, Staphylococcus
AEEGNRSAK

SEQ ID NO: 1846026 - protein, 5 aa, Staphylococcus
AEEGT

SEQ ID NO: 1846027 - protein, 8 aa, Staphylococcus
AEEITDNR

SEQ ID NO: 1846028 - protein, 13 aa, Staphylococcus
AEERKLAKERTLN

SEQ ID NO: 1846029 - protein, 13 aa, Staphylococcus
AEFGATESGSITG

SEQ ID NO: 1846030 - protein, 10 aa, Staphylococcus
AEGETYNNRI

SEQ ID NO: 1846031 - protein, 5 aa, Staphylococcus
AEGKN

SEQ ID NO: 1846032 - protein, 6 aa, Staphylococcus
AEGLSV

SEQ ID NO: 1846033 - protein, 14 aa, Staphylococcus
AEGLSVEKESQPIA

SEQ ID NO: 1846034 - protein, 4 aa, Staphylococcus
AEGP

SEQ ID NO: 1846035 - protein, 5 aa, Staphylococcus
AEGPI

SEQ ID NO: 1846036 - protein, 6 aa, Staphylococcus
AEGSYK

SEQ ID NO: 1846037 - protein, 18 aa, Staphylococcus
AEHESRNYDDNNNIETSV

SEQ ID NO: 1846038 - protein, 20 aa, Staphylococcus
AEHGLHGEQKLQQAKNNAIN

SEQ ID NO: 1846039 - protein, 24 aa, Staphylococcus
AEHLDEDHSLDTPSKESKSQREQS

SEQ ID NO: 1846040 - protein, 5 aa, Staphylococcus
AEHRG

SEQ ID NO: 1846041 - protein, 9 aa, Staphylococcus
AEHSSEHPL

SEQ ID NO: 1846042 - protein, 4 aa, Staphylococcus
AEIE

SEQ ID NO: 1846043 - protein, 6 aa, Staphylococcus
AEINGD

SEQ ID NO: 1846044 - protein, 4 aa, Staphylococcus
AEIP

SEQ ID NO: 1846045 - protein, 11 aa, Staphylococcus
AEIRTGPNAGY

SEQ ID NO: 1846046 - protein, 6 aa, Staphylococcus
AEKAES

SEQ ID NO: 1846047 - protein, 16 aa, Staphylococcus
AEKAQKYLQSKDKVKT

SEQ ID NO: 1846048 - protein, 9 aa, Staphylococcus
AEKDTEYGH

SEQ ID NO: 1846049 - protein, 6 aa, Staphylococcus
AEKEGT

SEQ ID NO: 1846050 - protein, 7 aa, Staphylococcus
AEKEGTL

SEQ ID NO: 1846051 - protein, 5 aa, Staphylococcus
AEKGQ

SEQ ID NO: 1846052 - protein, 11 aa, Staphylococcus
AEKHQDEDLPQ

SEQ ID NO: 1846053 - protein, 17 aa, Staphylococcus
AEKRGDNIDDITGGSVK

SEQ ID NO: 1846054 - protein, 6 aa, Staphylococcus
AEKSGY

SEQ ID NO: 1846055 - protein, 12 aa, Staphylococcus
AELPTTHESFRT

SEQ ID NO: 1846056 - protein, 5 aa, Staphylococcus
AELRK

SEQ ID NO: 1846057 - protein, 13 aa, Staphylococcus
AELRTGPSAAYPE

SEQ ID NO: 1846058 - protein, 17 aa, Staphylococcus
AENAADVEAKKNEGINS

SEQ ID NO: 1846059 - protein, 9 aa, Staphylococcus
AENASEHPL

SEQ ID NO: 1846060 - protein, 14 aa, Staphylococcus
AENATGSFNEDTRE

SEQ ID NO: 1846061 - protein, 9 aa, Staphylococcus
AENDNNEQL

SEQ ID NO: 1846062 - protein, 6 aa, Staphylococcus
AENDSY

SEQ ID NO: 1846063 - protein, 6 aa, Staphylococcus
AENEGT

SEQ ID NO: 1846064 - protein, 9 aa, Staphylococcus
AENEGTTAI

SEQ ID NO: 1846065 - protein, 14 aa, Staphylococcus
AENEKITVPRQSDI

SEQ ID NO: 1846066 - protein, 5 aa, Staphylococcus
AENGK

SEQ ID NO: 1846067 - protein, 8 aa, Staphylococcus
AENSKISR

SEQ ID NO: 1846068 - protein, 9 aa, Staphylococcus
AENSKPLKE

SEQ ID NO: 1846069 - protein, 269 aa, Staphylococcus
AENSNKPPQSDTTQTNDSNQNNNDKNNAEPSTDDKKDTSQSSDSNQSDSNQSDQDQTNPDNSSNTSDGSKDDTPNSGQNDGSNSNDNTDSNNGTSDNNDKPGNQDNQDQTDNNQDKPNDDQNDGSDSNQDSNSNQDNPSTKPDDKPNDKDDGSNSNQNGQTNPDKPGSNQNGQDKPNGSNNQDKPNGSNNQDKPDSNQNNDKPSTQPGSGQTHHQHQKPSNQQPPINQGQQSSQDGNSQYPGENNSNHQANGTGSTHHGQSNNQRPNHW

SEQ ID NO: 1846070 - protein, 7 aa, Staphylococcus
AENTATI

SEQ ID NO: 1846071 - protein, 10 aa, Staphylococcus
AENVTTNDIN

SEQ ID NO: 1846072 - protein, 16 aa, Staphylococcus
AEQDHRNYDDNDYIEQ

SEQ ID NO: 1846073 - protein, 8 aa, Staphylococcus
AEQIGTKG

SEQ ID NO: 1846074 - protein, 9 aa, Staphylococcus
AEQNGEDVR

SEQ ID NO: 1846075 - protein, 5 aa, Staphylococcus
AEQTV

SEQ ID NO: 1846076 - protein, 12 aa, Staphylococcus
AERATESNRRYY

SEQ ID NO: 1846077 - protein, 4 aa, Staphylococcus
AERE

SEQ ID NO: 1846078 - protein, 4 aa, Staphylococcus
AERI

SEQ ID NO: 1846079 - protein, 5 aa, Staphylococcus
AERTH

SEQ ID NO: 1846080 - protein, 8 aa, Staphylococcus
AESAQKKQ

SEQ ID NO: 1846081 - protein, 9 aa, Staphylococcus
AESETKNQS

SEQ ID NO: 1846082 - protein, 240 aa, Staphylococcus
AESKDVEQSNQTSTQQVENAEQAQQTSNQNTNDIKNQNTTDQSQAEKGQSEKNTDNNNESNQSSGTQSNIDNTPGDNTNSDNNNESTTGNSDNPANQTNGESSSMNNTSQNATDSSDSTDSSNSSDNDTDSNDNSTSNPDANDQNNPGTNTGESNTDNGDTSENTDNQTNSSGGQTNTENNSGSQENSNGQNSAPNEKPDNNPNNSNTNSSESTPSDSQNGGDNTNPSDNKNEQGSGNVI

SEQ ID NO: 1846083 - protein, 7 aa, Staphylococcus
AESNGEY

SEQ ID NO: 1846084 - protein, 31 aa, Staphylococcus
AESNNVKNSSKYLNEDSKFQDQYDQKVTEAK

SEQ ID NO: 1846085 - protein, 6 aa, Staphylococcus
AESPEE

SEQ ID NO: 1846086 - protein, 6 aa, Staphylococcus
AESQLG

SEQ ID NO: 1846087 - protein, 9 aa, Staphylococcus
AESSKPLKD

SEQ ID NO: 1846088 - protein, 10 aa, Staphylococcus
AESSKPLKEQ

SEQ ID NO: 1846089 - protein, 15 aa, Staphylococcus
AESSPDKKRNSLGSG

SEQ ID NO: 1846090 - protein, 16 aa, Staphylococcus
AESSPDKRRNSLGSGL

SEQ ID NO: 1846091 - protein, 12 aa, Staphylococcus
AESSPDKSRNRL

SEQ ID NO: 1846092 - protein, 4 aa, Staphylococcus
AETF

SEQ ID NO: 1846093 - protein, 17 aa, Staphylococcus
AETFYNPSVYTDSVLGG

SEQ ID NO: 1846094 - protein, 8 aa, Staphylococcus
AETKQQKQ

SEQ ID NO: 1846095 - protein, 9 aa, Staphylococcus
AETNNGGVK

SEQ ID NO: 1846096 - protein, 6 aa, Staphylococcus
AETPDE

SEQ ID NO: 1846097 - protein, 6 aa, Staphylococcus
AETPVK

SEQ ID NO: 1846098 - protein, 7 aa, Staphylococcus
AETQSAF

SEQ ID NO: 1846099 - protein, 6 aa, Staphylococcus
AETQSK

SEQ ID NO: 1846100 - protein, 4 aa, Staphylococcus
AETR

SEQ ID NO: 1846101 - protein, 13 aa, Staphylococcus
AETTPNNAVPGSR

SEQ ID NO: 1846102 - protein, 19 aa, Staphylococcus
AEVKEGQQQYSNKDKQLKK

SEQ ID NO: 1846103 - protein, 17 aa, Staphylococcus
AEVPDLKGKTEKEAEKI

SEQ ID NO: 1846104 - protein, 70 aa, Staphylococcus
AEVPDTASTLQNDAISSQSKAMTSSPQEKTSQNHQTTFSEKTTSEKATTENVSTIKTSQDNVSTQNKTQI

SEQ ID NO: 1846105 - protein, 20 aa, Staphylococcus
AEYKKVKNDIDNLGPHIDKE

SEQ ID NO: 1846106 - protein, 8 aa, Staphylococcus
AEYRTNAR

SEQ ID NO: 1846107 - protein, 12 aa, Staphylococcus
AFDTNKDGSIIQ

SEQ ID NO: 1846108 - protein, 12 aa, Staphylococcus
AFESNEYGELTT

SEQ ID NO: 1846109 - protein, 4 aa, Staphylococcus
AFGA

SEQ ID NO: 1846110 - protein, 4 aa, Staphylococcus
AFGG

SEQ ID NO: 1846111 - protein, 6 aa, Staphylococcus
AFGGPD

SEQ ID NO: 1846112 - protein, 4 aa, Staphylococcus
AFGR

SEQ ID NO: 1846113 - protein, 7 aa, Staphylococcus
AFHAPDS

SEQ ID NO: 1846114 - protein, 6 aa, Staphylococcus
AFHEGD

SEQ ID NO: 1846115 - protein, 13 aa, Staphylococcus
AFHTSSNQSDTQS

SEQ ID NO: 1846116 - protein, 9 aa, Staphylococcus
AFNKANKSS

SEQ ID NO: 1846117 - protein, 11 aa, Staphylococcus
AFSEGETETPL

SEQ ID NO: 1846118 - protein, 7 aa, Staphylococcus
AFSGTSM

SEQ ID NO: 1846119 - protein, 8 aa, Staphylococcus
AFSSNYDR

SEQ ID NO: 1846120 - protein, 21 aa, Staphylococcus
AFTGRGSTILTGKGGYGKSET

SEQ ID NO: 1846121 - protein, 9 aa, Staphylococcus
AFTTGSVNN

SEQ ID NO: 1846122 - protein, 11 aa, Staphylococcus
AFVGSGAAQFK

SEQ ID NO: 1846123 - protein, 4 aa, Staphylococcus
AGAD

SEQ ID NO: 1846124 - protein, 8 aa, Staphylococcus
AGAGETIL

SEQ ID NO: 1846125 - protein, 6 aa, Staphylococcus
AGAGGS

SEQ ID NO: 1846126 - protein, 6 aa, Staphylococcus
AGAGPT

SEQ ID NO: 1846127 - protein, 15 aa, Staphylococcus
AGANEIKGTSEPNST

SEQ ID NO: 1846128 - protein, 6 aa, Staphylococcus
AGASRL

SEQ ID NO: 1846129 - protein, 5 aa, Staphylococcus
AGATR

SEQ ID NO: 1846130 - protein, 5 aa, Staphylococcus
AGDAT

SEQ ID NO: 1846131 - protein, 4 aa, Staphylococcus
AGDE

SEQ ID NO: 1846132 - protein, 5 aa, Staphylococcus
AGDPY

SEQ ID NO: 1846133 - protein, 11 aa, Staphylococcus
AGDPYSSGMSL

SEQ ID NO: 1846134 - protein, 26 aa, Staphylococcus
AGDPYSSGMTLPTDISAAGQKLRKGL

SEQ ID NO: 1846135 - protein, 4 aa, Staphylococcus
AGDQ

SEQ ID NO: 1846136 - protein, 10 aa, Staphylococcus
AGDRQGFAGG

SEQ ID NO: 1846137 - protein, 15 aa, Staphylococcus
AGDRQGLAGGLNSTF

SEQ ID NO: 1846138 - protein, 7 aa, Staphylococcus
AGDRYEG

SEQ ID NO: 1846139 - protein, 4 aa, Staphylococcus
AGDS

SEQ ID NO: 1846140 - protein, 6 aa, Staphylococcus
AGEAFN

SEQ ID NO: 1846141 - protein, 5 aa, Staphylococcus
AGEAG

SEQ ID NO: 1846142 - protein, 7 aa, Staphylococcus
AGEAGTP

SEQ ID NO: 1846143 - protein, 10 aa, Staphylococcus
AGEASSMKNP

SEQ ID NO: 1846144 - protein, 4 aa, Staphylococcus
AGEH

SEQ ID NO: 1846145 - protein, 7 aa, Staphylococcus
AGERRTE

SEQ ID NO: 1846146 - protein, 13 aa, Staphylococcus
AGESNNPQKSMPK

SEQ ID NO: 1846147 - protein, 10 aa, Staphylococcus
AGETENPKQV

SEQ ID NO: 1846148 - protein, 13 aa, Staphylococcus
AGETKDPEQTIPK

SEQ ID NO: 1846149 - protein, 14 aa, Staphylococcus
AGETKDPESTIPKA

SEQ ID NO: 1846150 - protein, 14 aa, Staphylococcus
AGETKDPQKNIKKA

SEQ ID NO: 1846151 - protein, 14 aa, Staphylococcus
AGETKDPTKTIPKA

SEQ ID NO: 1846152 - protein, 14 aa, Staphylococcus
AGETKHPEKTIPQA

SEQ ID NO: 1846153 - protein, 12 aa, Staphylococcus
AGETKNPHETIP

SEQ ID NO: 1846154 - protein, 14 aa, Staphylococcus
AGETKNPKKNIKSA

SEQ ID NO: 1846155 - protein, 14 aa, Staphylococcus
AGETKNPQENIKSA

SEQ ID NO: 1846156 - protein, 12 aa, Staphylococcus
AGETKNPYKTIP

SEQ ID NO: 1846157 - protein, 14 aa, Staphylococcus
AGETQNPHKTIPQA

SEQ ID NO: 1846158 - protein, 4 aa, Staphylococcus
AGEV

SEQ ID NO: 1846159 - protein, 13 aa, Staphylococcus
AGFETNSRKYGDH

SEQ ID NO: 1846160 - protein, 7 aa, Staphylococcus
AGFGESA

SEQ ID NO: 1846161 - protein, 5 aa, Staphylococcus
AGGAL

SEQ ID NO: 1846162 - protein, 6 aa, Staphylococcus
AGGAVG

SEQ ID NO: 1846163 - protein, 13 aa, Staphylococcus
AGGEGAKDYGNPK

SEQ ID NO: 1846164 - protein, 13 aa, Staphylococcus
AGGEGAKNYGNPK

SEQ ID NO: 1846165 - protein, 13 aa, Staphylococcus
AGGEGDKHYGDPK

SEQ ID NO: 1846166 - protein, 12 aa, Staphylococcus
AGGERESNLREE

SEQ ID NO: 1846167 - protein, 11 aa, Staphylococcus
AGGFAQHNDQG

SEQ ID NO: 1846168 - protein, 9 aa, Staphylococcus
AGGGDAETN

SEQ ID NO: 1846169 - protein, 5 aa, Staphylococcus
AGGLT

SEQ ID NO: 1846170 - protein, 13 aa, Staphylococcus
AGGQGAKDYGNPK

SEQ ID NO: 1846171 - protein, 11 aa, Staphylococcus
AGGQGSKDYGD

SEQ ID NO: 1846172 - protein, 6 aa, Staphylococcus
AGGRAK

SEQ ID NO: 1846173 - protein, 7 aa, Staphylococcus
AGGRFGD

SEQ ID NO: 1846174 - protein, 12 aa, Staphylococcus
AGGSGPLSDRIG

SEQ ID NO: 1846175 - protein, 8 aa, Staphylococcus
AGGSIGSE

SEQ ID NO: 1846176 - protein, 4 aa, Staphylococcus
AGGT

SEQ ID NO: 1846177 - protein, 6 aa, Staphylococcus
AGGVEW

SEQ ID NO: 1846178 - protein, 13 aa, Staphylococcus
AGGYKGPKGPNSF

SEQ ID NO: 1846179 - protein, 11 aa, Staphylococcus
AGHGKAGAKHA

SEQ ID NO: 1846180 - protein, 10 aa, Staphylococcus
AGHGKAGAQH

SEQ ID NO: 1846181 - protein, 5 aa, Staphylococcus
AGIDR

SEQ ID NO: 1846182 - protein, 4 aa, Staphylococcus
AGIK

SEQ ID NO: 1846183 - protein, 6 aa, Staphylococcus
AGITNP

SEQ ID NO: 1846184 - protein, 10 aa, Staphylococcus
AGITTPTQRS

SEQ ID NO: 1846185 - protein, 9 aa, Staphylococcus
AGKADTRNA

SEQ ID NO: 1846186 - protein, 7 aa, Staphylococcus
AGKAFSS

SEQ ID NO: 1846187 - protein, 8 aa, Staphylococcus
AGKGASNW

SEQ ID NO: 1846188 - protein, 7 aa, Staphylococcus
AGKGGSN

SEQ ID NO: 1846189 - protein, 9 aa, Staphylococcus
AGKGKSNWS

SEQ ID NO: 1846190 - protein, 5 aa, Staphylococcus
AGKLP

SEQ ID NO: 1846191 - protein, 12 aa, Staphylococcus
AGKSFKQPASNL

SEQ ID NO: 1846192 - protein, 8 aa, Staphylococcus
AGLGDSAS

SEQ ID NO: 1846193 - protein, 6 aa, Staphylococcus
AGLGEA

SEQ ID NO: 1846194 - protein, 8 aa, Staphylococcus
AGLGGSAS

SEQ ID NO: 1846195 - protein, 10 aa, Staphylococcus
AGLGSSSSIL

SEQ ID NO: 1846196 - protein, 4 aa, Staphylococcus
AGLN

SEQ ID NO: 1846197 - protein, 10 aa, Staphylococcus
AGLNLTTNQL

SEQ ID NO: 1846198 - protein, 4 aa, Staphylococcus
AGMR

SEQ ID NO: 1846199 - protein, 6 aa, Staphylococcus
AGMTIE

SEQ ID NO: 1846200 - protein, 22 aa, Staphylococcus
AGNDFSEKNQITPLEDLGDKEK

SEQ ID NO: 1846201 - protein, 24 aa, Staphylococcus
AGNDISHQTQSESKQHTEKQNADK

SEQ ID NO: 1846202 - protein, 5 aa, Staphylococcus
AGNEH

SEQ ID NO: 1846203 - protein, 5 aa, Staphylococcus
AGNLN

SEQ ID NO: 1846204 - protein, 23 aa, Staphylococcus
AGNNTATLDYPTYEGTQSNVTQQ

SEQ ID NO: 1846205 - protein, 5 aa, Staphylococcus
AGNPW

SEQ ID NO: 1846206 - protein, 6 aa, Staphylococcus
AGNSGI

SEQ ID NO: 1846207 - protein, 14 aa, Staphylococcus
AGNSIHFGDHLFNI

SEQ ID NO: 1846208 - protein, 30 aa, Staphylococcus
AGPDKVNQYSDSLKNSDGASKKAADQMKNN

SEQ ID NO: 1846209 - protein, 4 aa, Staphylococcus
AGPE

SEQ ID NO: 1846210 - protein, 6 aa, Staphylococcus
AGPGGF

SEQ ID NO: 1846211 - protein, 5 aa, Staphylococcus
AGPSA

SEQ ID NO: 1846212 - protein, 6 aa, Staphylococcus
AGQFGS

SEQ ID NO: 1846213 - protein, 4 aa, Staphylococcus
AGQG

SEQ ID NO: 1846214 - protein, 5 aa, Staphylococcus
AGQGI

SEQ ID NO: 1846215 - protein, 46 aa, Staphylococcus
AGQGNQSSDDSNNSDSDNESLMPKENSNSSQSGSKMASSNGKMPSV

SEQ ID NO: 1846216 - protein, 47 aa, Staphylococcus
AGQGQSSDSNDNSISSTGQEDSQSSSSSQSRANSSLKETNGQMPSVP

SEQ ID NO: 1846217 - protein, 8 aa, Staphylococcus
AGQIGAKG

SEQ ID NO: 1846218 - protein, 10 aa, Staphylococcus
AGQKITTIGG

SEQ ID NO: 1846219 - protein, 9 aa, Staphylococcus
AGQKLRKGL

SEQ ID NO: 1846220 - protein, 9 aa, Staphylococcus
AGQKTSDTA

SEQ ID NO: 1846221 - protein, 11 aa, Staphylococcus
AGQKTTTNSVN

SEQ ID NO: 1846222 - protein, 7 aa, Staphylococcus
AGQNAEE

SEQ ID NO: 1846223 - protein, 7 aa, Staphylococcus
AGQNAEQ

SEQ ID NO: 1846224 - protein, 48 aa, Staphylococcus
AGQSQNSNQSSNSKQTSASNSQSNDTSALASSKPQSSDSLTSTGNIPS

SEQ ID NO: 1846225 - protein, 6 aa, Staphylococcus
AGRAEA

SEQ ID NO: 1846226 - protein, 6 aa, Staphylococcus
AGRGGS

SEQ ID NO: 1846227 - protein, 7 aa, Staphylococcus
AGRKRTT

SEQ ID NO: 1846228 - protein, 5 aa, Staphylococcus
AGSAN

SEQ ID NO: 1846229 - protein, 6 aa, Staphylococcus
AGSDHH

SEQ ID NO: 1846230 - protein, 7 aa, Staphylococcus
AGSDHHV

SEQ ID NO: 1846231 - protein, 8 aa, Staphylococcus
AGSDHHVP

SEQ ID NO: 1846232 - protein, 4 aa, Staphylococcus
AGSG

SEQ ID NO: 1846233 - protein, 5 aa, Staphylococcus
AGSGF

SEQ ID NO: 1846234 - protein, 5 aa, Staphylococcus
AGSGL

SEQ ID NO: 1846235 - protein, 8 aa, Staphylococcus
AGSGRAAE

SEQ ID NO: 1846236 - protein, 4 aa, Staphylococcus
AGSI

SEQ ID NO: 1846237 - protein, 6 aa, Staphylococcus
AGSIGT

SEQ ID NO: 1846238 - protein, 7 aa, Staphylococcus
AGSIGTA

SEQ ID NO: 1846239 - protein, 7 aa, Staphylococcus
AGSLAAK

SEQ ID NO: 1846240 - protein, 8 aa, Staphylococcus
AGSNLNQQ

SEQ ID NO: 1846241 - protein, 5 aa, Staphylococcus
AGSPI

SEQ ID NO: 1846242 - protein, 9 aa, Staphylococcus
AGSPYTPNM

SEQ ID NO: 1846243 - protein, 6 aa, Staphylococcus
AGSSEI

SEQ ID NO: 1846244 - protein, 12 aa, Staphylococcus
AGSSGPLADKLG

SEQ ID NO: 1846245 - protein, 13 aa, Staphylococcus
AGSSGPLSDKIGR

SEQ ID NO: 1846246 - protein, 19 aa, Staphylococcus
AGSSGTRGHANKIGAGVPA

SEQ ID NO: 1846247 - protein, 10 aa, Staphylococcus
AGSSPTASLN

SEQ ID NO: 1846248 - protein, 10 aa, Staphylococcus
AGSSPTSSLT

SEQ ID NO: 1846249 - protein, 8 aa, Staphylococcus
AGSTFEES

SEQ ID NO: 1846250 - protein, 7 aa, Staphylococcus
AGSTFTE

SEQ ID NO: 1846251 - protein, 25 aa, Staphylococcus
AGSTLDPQTIKNEDVTEKEYAAVSQ

SEQ ID NO: 1846252 - protein, 11 aa, Staphylococcus
AGSTLSRESNH

SEQ ID NO: 1846253 - protein, 11 aa, Staphylococcus
AGSTPDSSFSL

SEQ ID NO: 1846254 - protein, 11 aa, Staphylococcus
AGSTPSASLDL

SEQ ID NO: 1846255 - protein, 10 aa, Staphylococcus
AGSTPTASLD

SEQ ID NO: 1846256 - protein, 10 aa, Staphylococcus
AGSTPTASLN

SEQ ID NO: 1846257 - protein, 11 aa, Staphylococcus
AGSTPTSSLSL

SEQ ID NO: 1846258 - protein, 7 aa, Staphylococcus
AGTDVAV

SEQ ID NO: 1846259 - protein, 8 aa, Staphylococcus
AGTDVAVD

SEQ ID NO: 1846260 - protein, 4 aa, Staphylococcus
AGTF

SEQ ID NO: 1846261 - protein, 6 aa, Staphylococcus
AGTGNS

SEQ ID NO: 1846262 - protein, 11 aa, Staphylococcus
AGTPGRNGTSV

SEQ ID NO: 1846263 - protein, 7 aa, Staphylococcus
AGTPTEV

SEQ ID NO: 1846264 - protein, 21 aa, Staphylococcus
AGTRVDIDSDTKLSQPKVERT

SEQ ID NO: 1846265 - protein, 18 aa, Staphylococcus
AGTRVDLQSKEALTQSKV

SEQ ID NO: 1846266 - protein, 5 aa, Staphylococcus
AGTSG

SEQ ID NO: 1846267 - protein, 7 aa, Staphylococcus
AGTSGVQ

SEQ ID NO: 1846268 - protein, 5 aa, Staphylococcus
AGTSM

SEQ ID NO: 1846269 - protein, 11 aa, Staphylococcus
AGTTGSGKSEI

SEQ ID NO: 1846270 - protein, 5 aa, Staphylococcus
AGVAN

SEQ ID NO: 1846271 - protein, 10 aa, Staphylococcus
AGVNQKLSPR

SEQ ID NO: 1846272 - protein, 13 aa, Staphylococcus
AGVSDTKSTDQSV

SEQ ID NO: 1846273 - protein, 5 aa, Staphylococcus
AGVVS

SEQ ID NO: 1846274 - protein, 4 aa, Staphylococcus
AGYI

SEQ ID NO: 1846275 - protein, 4 aa, Staphylococcus
AGYP

SEQ ID NO: 1846276 - protein, 9 aa, Staphylococcus
AGYQSQVDE

SEQ ID NO: 1846277 - protein, 5 aa, Staphylococcus
AGYTA

SEQ ID NO: 1846278 - protein, 10 aa, Staphylococcus
AHAAGKAATL

SEQ ID NO: 1846279 - protein, 12 aa, Staphylococcus
AHAAGKASTLGS

SEQ ID NO: 1846280 - protein, 10 aa, Staphylococcus
AHADNGGNAR

SEQ ID NO: 1846281 - protein, 7 aa, Staphylococcus
AHAERTS

SEQ ID NO: 1846282 - protein, 10 aa, Staphylococcus
AHAESDSMSE

SEQ ID NO: 1846283 - protein, 6 aa, Staphylococcus
AHAGTG

SEQ ID NO: 1846284 - protein, 4 aa, Staphylococcus
AHAK

SEQ ID NO: 1846285 - protein, 4 aa, Staphylococcus
AHAR

SEQ ID NO: 1846286 - protein, 23 aa, Staphylococcus
AHATLEKTTPAQNGIVSKQPDTI

SEQ ID NO: 1846287 - protein, 7 aa, Staphylococcus
AHATPNA

SEQ ID NO: 1846288 - protein, 5 aa, Staphylococcus
AHDQG

SEQ ID NO: 1846289 - protein, 5 aa, Staphylococcus
AHEEL

SEQ ID NO: 1846290 - protein, 7 aa, Staphylococcus
AHERANG

SEQ ID NO: 1846291 - protein, 7 aa, Staphylococcus
AHGAHAK

SEQ ID NO: 1846292 - protein, 7 aa, Staphylococcus
AHGDGGN

SEQ ID NO: 1846293 - protein, 7 aa, Staphylococcus
AHGGPVA

SEQ ID NO: 1846294 - protein, 8 aa, Staphylococcus
AHGGTVSK

SEQ ID NO: 1846295 - protein, 7 aa, Staphylococcus
AHGPSNI

SEQ ID NO: 1846296 - protein, 7 aa, Staphylococcus
AHGRDND

SEQ ID NO: 1846297 - protein, 7 aa, Staphylococcus
AHGRDNG

SEQ ID NO: 1846298 - protein, 7 aa, Staphylococcus
AHGSDDK

SEQ ID NO: 1846299 - protein, 8 aa, Staphylococcus
AHGSDDKI

SEQ ID NO: 1846300 - protein, 7 aa, Staphylococcus
AHGSDEK

SEQ ID NO: 1846301 - protein, 7 aa, Staphylococcus
AHGSNDK

SEQ ID NO: 1846302 - protein, 19 aa, Staphylococcus
AHGSSMTNTAQQISGSIGT

SEQ ID NO: 1846303 - protein, 10 aa, Staphylococcus
AHGSSMTNTV

SEQ ID NO: 1846304 - protein, 54 aa, Staphylococcus
AHGYDKNGTEFSEEREETFYEDKKDDISNNDLTSQRRRNDDEKPSRHDLDDDNK

SEQ ID NO: 1846305 - protein, 11 aa, Staphylococcus
AHKEAGKMDEK

SEQ ID NO: 1846306 - protein, 6 aa, Staphylococcus
AHKEGI

SEQ ID NO: 1846307 - protein, 6 aa, Staphylococcus
AHKGTG

SEQ ID NO: 1846308 - protein, 5 aa, Staphylococcus
AHKNL

SEQ ID NO: 1846309 - protein, 11 aa, Staphylococcus
AHKREKQSITR

SEQ ID NO: 1846310 - protein, 4 aa, Staphylococcus
AHMK

SEQ ID NO: 1846311 - protein, 5 aa, Staphylococcus
AHNDP

SEQ ID NO: 1846312 - protein, 5 aa, Staphylococcus
AHNQG

SEQ ID NO: 1846313 - protein, 11 aa, Staphylococcus
AHQSDNEKDVV

SEQ ID NO: 1846314 - protein, 8 aa, Staphylococcus
AHSAEEYK

SEQ ID NO: 1846315 - protein, 12 aa, Staphylococcus
AHSEGMRSKPRR

SEQ ID NO: 1846316 - protein, 8 aa, Staphylococcus
AHSPESGK

SEQ ID NO: 1846317 - protein, 6 aa, Staphylococcus
AHTGTG

SEQ ID NO: 1846318 - protein, 4 aa, Staphylococcus
AHTN

SEQ ID NO: 1846319 - protein, 7 aa, Staphylococcus
AHTPEVP

SEQ ID NO: 1846320 - protein, 6 aa, Staphylococcus
AHYTPA

SEQ ID NO: 1846321 - protein, 6 aa, Staphylococcus
AIAEGG

SEQ ID NO: 1846322 - protein, 6 aa, Staphylococcus
AIAENQ

SEQ ID NO: 1846323 - protein, 4 aa, Staphylococcus
AIAF

SEQ ID NO: 1846324 - protein, 17 aa, Staphylococcus
AIAGGTPKYKTTGFSTK

SEQ ID NO: 1846325 - protein, 25 aa, Staphylococcus
AIAKQASPGPEAERKETKKESEHLN

SEQ ID NO: 1846326 - protein, 20 aa, Staphylococcus
AIATKNAQDTKDAAEAAKVK

SEQ ID NO: 1846327 - protein, 11 aa, Staphylococcus
AIENGTQSRKD

SEQ ID NO: 1846328 - protein, 9 aa, Staphylococcus
AIEPENDTV

SEQ ID NO: 1846329 - protein, 10 aa, Staphylococcus
AIGAGTDVAI

SEQ ID NO: 1846330 - protein, 6 aa, Staphylococcus
AIGPKK

SEQ ID NO: 1846331 - protein, 6 aa, Staphylococcus
AIGPSG

SEQ ID NO: 1846332 - protein, 5 aa, Staphylococcus
AIGPT

SEQ ID NO: 1846333 - protein, 6 aa, Staphylococcus
AIGRKT

SEQ ID NO: 1846334 - protein, 6 aa, Staphylococcus
AIHSAG

SEQ ID NO: 1846335 - protein, 19 aa, Staphylococcus
AIKAETSDDLSDKSPQAIE

SEQ ID NO: 1846336 - protein, 88 aa, Staphylococcus
AIKAETSNNLADQSPQAQEIQEAKAEAKKDSKSKEISATELAAQQNAIKAETSDDLSDQSPQAQEIQEAKADEIQNLRNNEDNSAEEI

SEQ ID NO: 1846337 - protein, 4 aa, Staphylococcus
AIKD

SEQ ID NO: 1846338 - protein, 68 aa, Staphylococcus
AIKEESSLSDPSQTKDKAAQTSSADKLASAAHTKKQKMNNDSQVLSDTSDLTKEQDVAKSNKQTTPNL

SEQ ID NO: 1846339 - protein, 41 aa, Staphylococcus
AIKKESSDNDLADPTTKEGKNEDAHQKTQAENLATAAKNKK

SEQ ID NO: 1846340 - protein, 6 aa, Staphylococcus
AIKQHK

SEQ ID NO: 1846341 - protein, 4 aa, Staphylococcus
AIKS

SEQ ID NO: 1846342 - protein, 7 aa, Staphylococcus
AINGKAN

SEQ ID NO: 1846343 - protein, 18 aa, Staphylococcus
AINNNGVDTAKTNGVDSI

SEQ ID NO: 1846344 - protein, 4 aa, Staphylococcus
AIPD

SEQ ID NO: 1846345 - protein, 5 aa, Staphylococcus
AIPED

SEQ ID NO: 1846346 - protein, 8 aa, Staphylococcus
AIPETGGL

SEQ ID NO: 1846347 - protein, 12 aa, Staphylococcus
AIPNDAPQETPV

SEQ ID NO: 1846348 - protein, 4 aa, Staphylococcus
AIPT

SEQ ID NO: 1846349 - protein, 7 aa, Staphylococcus
AIPTEKA

SEQ ID NO: 1846350 - protein, 4 aa, Staphylococcus
AIQD

SEQ ID NO: 1846351 - protein, 7 aa, Staphylococcus
AIQDESS

SEQ ID NO: 1846352 - protein, 26 aa, Staphylococcus
AIQDESSYQVEGSTFRNYDQKGHGTV

SEQ ID NO: 1846353 - protein, 6 aa, Staphylococcus
AIQSGQ

SEQ ID NO: 1846354 - protein, 12 aa, Staphylococcus
AIQSLNDKADEK

SEQ ID NO: 1846355 - protein, 6 aa, Staphylococcus
AIQSNT

SEQ ID NO: 1846356 - protein, 4 aa, Staphylococcus
AISG

SEQ ID NO: 1846357 - protein, 7 aa, Staphylococcus
AISGSRG

SEQ ID NO: 1846358 - protein, 4 aa, Staphylococcus
AISN

SEQ ID NO: 1846359 - protein, 4 aa, Staphylococcus
AITA

SEQ ID NO: 1846360 - protein, 5 aa, Staphylococcus
AITDT

SEQ ID NO: 1846361 - protein, 10 aa, Staphylococcus
AITEGKKGFS

SEQ ID NO: 1846362 - protein, 4 aa, Staphylococcus
AITP

SEQ ID NO: 1846363 - protein, 6 aa, Staphylococcus
AITPSD

SEQ ID NO: 1846364 - protein, 6 aa, Staphylococcus
AITQSK

SEQ ID NO: 1846365 - protein, 7 aa, Staphylococcus
AITQSKG

SEQ ID NO: 1846366 - protein, 7 aa, Staphylococcus
AITQSKS

SEQ ID NO: 1846367 - protein, 11 aa, Staphylococcus
AITQSKSVTGQ

SEQ ID NO: 1846368 - protein, 7 aa, Staphylococcus
AITTPTV

SEQ ID NO: 1846369 - protein, 31 aa, Staphylococcus
AKAAETSTELTQAQADEDCSGITDQAQQEEM

SEQ ID NO: 1846370 - protein, 17 aa, Staphylococcus
AKAAEVHGADKAQQAEH

SEQ ID NO: 1846371 - protein, 7 aa, Staphylococcus
AKADHEI

SEQ ID NO: 1846372 - protein, 15 aa, Staphylococcus
AKAFAPKPHAGASKE

SEQ ID NO: 1846373 - protein, 11 aa, Staphylococcus
AKAKTQTTNAL

SEQ ID NO: 1846374 - protein, 6 aa, Staphylococcus
AKALGM

SEQ ID NO: 1846375 - protein, 5 aa, Staphylococcus
AKALK

SEQ ID NO: 1846376 - protein, 9 aa, Staphylococcus
AKANYAPGD

SEQ ID NO: 1846377 - protein, 5 aa, Staphylococcus
AKAPH

SEQ ID NO: 1846378 - protein, 32 aa, Staphylococcus
AKAPNIRQTSDYINEDTPQKEAYDNAIKKGQA

SEQ ID NO: 1846379 - protein, 4 aa, Staphylococcus
AKAQ

SEQ ID NO: 1846380 - protein, 10 aa, Staphylococcus
AKAQNDYKHY

SEQ ID NO: 1846381 - protein, 4 aa, Staphylococcus
AKAR

SEQ ID NO: 1846382 - protein, 8 aa, Staphylococcus
AKASLEKK

SEQ ID NO: 1846383 - protein, 8 aa, Staphylococcus
AKASYERI

SEQ ID NO: 1846384 - protein, 6 aa, Staphylococcus
AKATAP

SEQ ID NO: 1846385 - protein, 7 aa, Staphylococcus
AKATPFT

SEQ ID NO: 1846386 - protein, 6 aa, Staphylococcus
AKATTI

SEQ ID NO: 1846387 - protein, 30 aa, Staphylococcus
AKAYDQTDETNNATSDPRHVTDTTPPRKPV

SEQ ID NO: 1846388 - protein, 18 aa, Staphylococcus
AKDAEKYLQSKKKVKTVQ

SEQ ID NO: 1846389 - protein, 13 aa, Staphylococcus
AKDAYRTVGTDQG

SEQ ID NO: 1846390 - protein, 9 aa, Staphylococcus
AKDEAAKQL

SEQ ID NO: 1846391 - protein, 8 aa, Staphylococcus
AKDGGNAR

SEQ ID NO: 1846392 - protein, 7 aa, Staphylococcus
AKDIPDK

SEQ ID NO: 1846393 - protein, 17 aa, Staphylococcus
AKDISDEYGVDPRKSAS

SEQ ID NO: 1846394 - protein, 23 aa, Staphylococcus
AKDITPDPQIDAQTKKANDDFLK

SEQ ID NO: 1846395 - protein, 9 aa, Staphylococcus
AKDKAKNFG

SEQ ID NO: 1846396 - protein, 12 aa, Staphylococcus
AKDLGETEESMG

SEQ ID NO: 1846397 - protein, 6 aa, Staphylococcus
AKDNHV

SEQ ID NO: 1846398 - protein, 8 aa, Staphylococcus
AKDYSKSK

SEQ ID NO: 1846399 - protein, 9 aa, Staphylococcus
AKDYSKSKV

SEQ ID NO: 1846400 - protein, 10 aa, Staphylococcus
AKDYSKSKYV

SEQ ID NO: 1846401 - protein, 8 aa, Staphylococcus
AKEAQNKI

SEQ ID NO: 1846402 - protein, 10 aa, Staphylococcus
AKEATSDNTL

SEQ ID NO: 1846403 - protein, 12 aa, Staphylococcus
AKEFGATPGLGG

SEQ ID NO: 1846404 - protein, 7 aa, Staphylococcus
AKEHAKD

SEQ ID NO: 1846405 - protein, 7 aa, Staphylococcus
AKEIPSE

SEQ ID NO: 1846406 - protein, 8 aa, Staphylococcus
AKEKDNIH

SEQ ID NO: 1846407 - protein, 7 aa, Staphylococcus
AKEKRVN

SEQ ID NO: 1846408 - protein, 5 aa, Staphylococcus
AKEKS

SEQ ID NO: 1846409 - protein, 8 aa, Staphylococcus
AKENANNV

SEQ ID NO: 1846410 - protein, 10 aa, Staphylococcus
AKENLSSSEL

SEQ ID NO: 1846411 - protein, 6 aa, Staphylococcus
AKEPKV

SEQ ID NO: 1846412 - protein, 8 aa, Staphylococcus
AKEPKVKV

SEQ ID NO: 1846413 - protein, 8 aa, Staphylococcus
AKEQTSLY

SEQ ID NO: 1846414 - protein, 9 aa, Staphylococcus
AKESGAANG

SEQ ID NO: 1846415 - protein, 9 aa, Staphylococcus
AKESGTANG

SEQ ID NO: 1846416 - protein, 5 aa, Staphylococcus
AKESI

SEQ ID NO: 1846417 - protein, 25 aa, Staphylococcus
AKETLNDKDKSEADKKAAVDKVKAE

SEQ ID NO: 1846418 - protein, 10 aa, Staphylococcus
AKEVTQESKG

SEQ ID NO: 1846419 - protein, 5 aa, Staphylococcus
AKFGT

SEQ ID NO: 1846420 - protein, 6 aa, Staphylococcus
AKGAKE

SEQ ID NO: 1846421 - protein, 13 aa, Staphylococcus
AKGDKGDKGDSVT

SEQ ID NO: 1846422 - protein, 25 aa, Staphylococcus
AKGHTDDDVAYDEEGRASLNEDDKK

SEQ ID NO: 1846423 - protein, 33 aa, Staphylococcus
AKGHTDDKGVDGDYEEAPTKEGTLKDEHINHRE

SEQ ID NO: 1846424 - protein, 6 aa, Staphylococcus
AKGLGQ

SEQ ID NO: 1846425 - protein, 5 aa, Staphylococcus
AKGNH

SEQ ID NO: 1846426 - protein, 8 aa, Staphylococcus
AKGNLNKS

SEQ ID NO: 1846427 - protein, 7 aa, Staphylococcus
AKGNSPI

SEQ ID NO: 1846428 - protein, 7 aa, Staphylococcus
AKGNSSL

SEQ ID NO: 1846429 - protein, 7 aa, Staphylococcus
AKGNSSM

SEQ ID NO: 1846430 - protein, 12 aa, Staphylococcus
AKGQINNATTLT

SEQ ID NO: 1846431 - protein, 8 aa, Staphylococcus
AKGSNEAD

SEQ ID NO: 1846432 - protein, 9 aa, Staphylococcus
AKGVASSAI

SEQ ID NO: 1846433 - protein, 22 aa, Staphylococcus
AKGYPAEKAGLKAGDKIEQIGN

SEQ ID NO: 1846434 - protein, 10 aa, Staphylococcus
AKHEIDQSAI

SEQ ID NO: 1846435 - protein, 5 aa, Staphylococcus
AKHKP

SEQ ID NO: 1846436 - protein, 5 aa, Staphylococcus
AKHQG

SEQ ID NO: 1846437 - protein, 4 aa, Staphylococcus
AKHV

SEQ ID NO: 1846438 - protein, 38 aa, Staphylococcus
AKIDNKIESLDSKIDNLESKMNKKIDDLESKINNKFDG

SEQ ID NO: 1846439 - protein, 14 aa, Staphylococcus
AKIGTSYISTGEDK

SEQ ID NO: 1846440 - protein, 15 aa, Staphylococcus
AKITNDDVGGASQKI

SEQ ID NO: 1846441 - protein, 7 aa, Staphylococcus
AKITTPE

SEQ ID NO: 1846442 - protein, 77 aa, Staphylococcus
AKIVNKDDTDFSDGKYGKSYDEIREEQLEQGDKDEDTNKDASEKDRASESDDTAHEQAPNIDKPYNPSDPNQPDHRQ

SEQ ID NO: 1846443 - protein, 36 aa, Staphylococcus
AKKAGAELEAKDNTQKQVETAQNVSKEQVDKAQAEI

SEQ ID NO: 1846444 - protein, 9 aa, Staphylococcus
AKKAVTYGT

SEQ ID NO: 1846445 - protein, 6 aa, Staphylococcus
AKKDHA

SEQ ID NO: 1846446 - protein, 12 aa, Staphylococcus
AKKDKNLSASEI

SEQ ID NO: 1846447 - protein, 12 aa, Staphylococcus
AKKDNKYSSDEI

SEQ ID NO: 1846448 - protein, 7 aa, Staphylococcus
AKKDTYY

SEQ ID NO: 1846449 - protein, 9 aa, Staphylococcus
AKKEDSKHN

SEQ ID NO: 1846450 - protein, 12 aa, Staphylococcus
AKKEKEENSLKN

SEQ ID NO: 1846451 - protein, 7 aa, Staphylococcus
AKKEPLY

SEQ ID NO: 1846452 - protein, 11 aa, Staphylococcus
AKKETEYGEFS

SEQ ID NO: 1846453 - protein, 14 aa, Staphylococcus
AKKGEYEHLYSIQD

SEQ ID NO: 1846454 - protein, 6 aa, Staphylococcus
AKKGVK

SEQ ID NO: 1846455 - protein, 8 aa, Staphylococcus
AKKHITSY

SEQ ID NO: 1846456 - protein, 8 aa, Staphylococcus
AKKITDNG

SEQ ID NO: 1846457 - protein, 6 aa, Staphylococcus
AKKKLQ

SEQ ID NO: 1846458 - protein, 5 aa, Staphylococcus
AKKKN

SEQ ID NO: 1846459 - protein, 4 aa, Staphylococcus
AKKN

SEQ ID NO: 1846460 - protein, 8 aa, Staphylococcus
AKKNDGAV

SEQ ID NO: 1846461 - protein, 9 aa, Staphylococcus
AKKNDGAVT

SEQ ID NO: 1846462 - protein, 4 aa, Staphylococcus
AKKP

SEQ ID NO: 1846463 - protein, 61 aa, Staphylococcus
AKKQEIDNNENAIQEEKDAAKTKVDEEATKAKAAIDQASTNNGVDQAKTSGETTISSIQPE

SEQ ID NO: 1846464 - protein, 11 aa, Staphylococcus
AKKQVGNQTFK

SEQ ID NO: 1846465 - protein, 54 aa, Staphylococcus
AKKSEIDNNHNATREEKDSAKSKVDEEAKKAKDNIDKGATNNDVDQAKNSSSNI

SEQ ID NO: 1846466 - protein, 6 aa, Staphylococcus
AKKSGR

SEQ ID NO: 1846467 - protein, 5 aa, Staphylococcus
AKKSI

SEQ ID NO: 1846468 - protein, 6 aa, Staphylococcus
AKKSIY

SEQ ID NO: 1846469 - protein, 24 aa, Staphylococcus
AKKSLNSFARQKAKATVEVNEGAA

SEQ ID NO: 1846470 - protein, 19 aa, Staphylococcus
AKKTNSSSLKSAAKDNLSD

SEQ ID NO: 1846471 - protein, 20 aa, Staphylococcus
AKKTNSSSLNSAAKDNLSDS

SEQ ID NO: 1846472 - protein, 19 aa, Staphylococcus
AKKTNSSSLRSAAKDNLSD

SEQ ID NO: 1846473 - protein, 7 aa, Staphylococcus
AKKVDNK

SEQ ID NO: 1846474 - protein, 156 aa, Staphylococcus
AKLEATKDDFEQQNKPSATELTAQQNAIQQESKLADQSPEAQEIQEAKAEAQDQQNKPSATELTAQQNAIQQESKLADQSPEAQEIQEAKAESQDQQNKPSATELTAQQNAIQQESKLADQSPEAQEIQEAKAESHKEDSQEASHIESDKKPSAEE

SEQ ID NO: 1846475 - protein, 9 aa, Staphylococcus
AKLESVERH

SEQ ID NO: 1846476 - protein, 13 aa, Staphylococcus
AKLGTSYISSGDN

SEQ ID NO: 1846477 - protein, 4 aa, Staphylococcus
AKLK

SEQ ID NO: 1846478 - protein, 9 aa, Staphylococcus
AKLSEEEYN

SEQ ID NO: 1846479 - protein, 9 aa, Staphylococcus
AKLSPEQKQ

SEQ ID NO: 1846480 - protein, 4 aa, Staphylococcus
AKMT

SEQ ID NO: 1846481 - protein, 17 aa, Staphylococcus
AKNDKSDEGGKNVEQTE

SEQ ID NO: 1846482 - protein, 11 aa, Staphylococcus
AKNDVEETKEV

SEQ ID NO: 1846483 - protein, 4 aa, Staphylococcus
AKNE

SEQ ID NO: 1846484 - protein, 17 aa, Staphylococcus
AKNEALNNITNATTTQL

SEQ ID NO: 1846485 - protein, 6 aa, Staphylococcus
AKNENI

SEQ ID NO: 1846486 - protein, 13 aa, Staphylococcus
AKNEVEESKEDIT

SEQ ID NO: 1846487 - protein, 14 aa, Staphylococcus
AKNEVEETKEQITD

SEQ ID NO: 1846488 - protein, 4 aa, Staphylococcus
AKNG

SEQ ID NO: 1846489 - protein, 17 aa, Staphylococcus
AKNIADEYEVDPRKSAS

SEQ ID NO: 1846490 - protein, 4 aa, Staphylococcus
AKNK

SEQ ID NO: 1846491 - protein, 19 aa, Staphylococcus
AKNLASAAKTKKSKLDNDL

SEQ ID NO: 1846492 - protein, 11 aa, Staphylococcus
AKNLKESQKGA

SEQ ID NO: 1846493 - protein, 5 aa, Staphylococcus
AKNMR

SEQ ID NO: 1846494 - protein, 9 aa, Staphylococcus
AKNNLNGVE

SEQ ID NO: 1846495 - protein, 11 aa, Staphylococcus
AKNQGQKPTRY

SEQ ID NO: 1846496 - protein, 6 aa, Staphylococcus
AKNRDI

SEQ ID NO: 1846497 - protein, 22 aa, Staphylococcus
AKNSEKPLEAKENTNNLQEGAS

SEQ ID NO: 1846498 - protein, 13 aa, Staphylococcus
AKNYQETSDTKNM

SEQ ID NO: 1846499 - protein, 7 aa, Staphylococcus
AKPEHKK

SEQ ID NO: 1846500 - protein, 8 aa, Staphylococcus
AKPERKKV

SEQ ID NO: 1846501 - protein, 7 aa, Staphylococcus
AKPERRK

SEQ ID NO: 1846502 - protein, 25 aa, Staphylococcus
AKPEVDGVQEKVKRARTQEEKMAAN

SEQ ID NO: 1846503 - protein, 26 aa, Staphylococcus
AKPEVEGVQEKVKRARTQEEKMAANQ

SEQ ID NO: 1846504 - protein, 26 aa, Staphylococcus
AKPEVSEVQEKVKRARTQEEKMAANQ

SEQ ID NO: 1846505 - protein, 13 aa, Staphylococcus
AKPGGSLDGDELP

SEQ ID NO: 1846506 - protein, 7 aa, Staphylococcus
AKPGTTD

SEQ ID NO: 1846507 - protein, 6 aa, Staphylococcus
AKPKNT

SEQ ID NO: 1846508 - protein, 10 aa, Staphylococcus
AKPNPPTIET

SEQ ID NO: 1846509 - protein, 4 aa, Staphylococcus
AKPQ

SEQ ID NO: 1846510 - protein, 7 aa, Staphylococcus
AKPQHKK

SEQ ID NO: 1846511 - protein, 5 aa, Staphylococcus
AKPQI

SEQ ID NO: 1846512 - protein, 6 aa, Staphylococcus
AKPQNA

SEQ ID NO: 1846513 - protein, 8 aa, Staphylococcus
AKPQNAKT

SEQ ID NO: 1846514 - protein, 6 aa, Staphylococcus
AKPQNL

SEQ ID NO: 1846515 - protein, 7 aa, Staphylococcus
AKPTKQI

SEQ ID NO: 1846516 - protein, 12 aa, Staphylococcus
AKQAAARSELNN

SEQ ID NO: 1846517 - protein, 6 aa, Staphylococcus
AKQAFG

SEQ ID NO: 1846518 - protein, 44 aa, Staphylococcus
AKQAIDDTVTAKKNAIDQDGTTTQEEKDAAKAKVDEEATKAKQL

SEQ ID NO: 1846519 - protein, 7 aa, Staphylococcus
AKQAKDI

SEQ ID NO: 1846520 - protein, 4 aa, Staphylococcus
AKQC

SEQ ID NO: 1846521 - protein, 7 aa, Staphylococcus
AKQDINE

SEQ ID NO: 1846522 - protein, 10 aa, Staphylococcus
AKQEDEIKQL

SEQ ID NO: 1846523 - protein, 10 aa, Staphylococcus
AKQGDVGRRK

SEQ ID NO: 1846524 - protein, 9 aa, Staphylococcus
AKQGEMGRR

SEQ ID NO: 1846525 - protein, 8 aa, Staphylococcus
AKQGNKNI

SEQ ID NO: 1846526 - protein, 12 aa, Staphylococcus
AKQLSKDYVNDN

SEQ ID NO: 1846527 - protein, 10 aa, Staphylococcus
AKQLSKDYVS

SEQ ID NO: 1846528 - protein, 6 aa, Staphylococcus
AKQNNL

SEQ ID NO: 1846529 - protein, 7 aa, Staphylococcus
AKQPDNI

SEQ ID NO: 1846530 - protein, 7 aa, Staphylococcus
AKQPDTI

SEQ ID NO: 1846531 - protein, 8 aa, Staphylococcus
AKQPNGDT

SEQ ID NO: 1846532 - protein, 9 aa, Staphylococcus
AKQPNGDTV

SEQ ID NO: 1846533 - protein, 24 aa, Staphylococcus
AKQQEMQDKVKSGEIPPEAAQQMA

SEQ ID NO: 1846534 - protein, 5 aa, Staphylococcus
AKQSI

SEQ ID NO: 1846535 - protein, 20 aa, Staphylococcus
AKQTKSSSLDSASKDNLSDG

SEQ ID NO: 1846536 - protein, 5 aa, Staphylococcus
AKRDQ

SEQ ID NO: 1846537 - protein, 9 aa, Staphylococcus
AKRDRTGEH

SEQ ID NO: 1846538 - protein, 7 aa, Staphylococcus
AKRHKRR

SEQ ID NO: 1846539 - protein, 4 aa, Staphylococcus
AKRI

SEQ ID NO: 1846540 - protein, 6 aa, Staphylococcus
AKRKEV

SEQ ID NO: 1846541 - protein, 19 aa, Staphylococcus
AKRTNSSSLNSAAKDNLSD

SEQ ID NO: 1846542 - protein, 16 aa, Staphylococcus
AKSADDSVKAITTGNS

SEQ ID NO: 1846543 - protein, 5 aa, Staphylococcus
AKSGV

SEQ ID NO: 1846544 - protein, 6 aa, Staphylococcus
AKSHGV

SEQ ID NO: 1846545 - protein, 4 aa, Staphylococcus
AKSI

SEQ ID NO: 1846546 - protein, 17 aa, Staphylococcus
AKSIADEYDVDPRKSAS

SEQ ID NO: 1846547 - protein, 8 aa, Staphylococcus
AKSLGQKT

SEQ ID NO: 1846548 - protein, 9 aa, Staphylococcus
AKSNQNKDL

SEQ ID NO: 1846549 - protein, 6 aa, Staphylococcus
AKSPFE

SEQ ID NO: 1846550 - protein, 6 aa, Staphylococcus
AKSPRV

SEQ ID NO: 1846551 - protein, 4 aa, Staphylococcus
AKSQ

SEQ ID NO: 1846552 - protein, 9 aa, Staphylococcus
AKSQGQKTT

SEQ ID NO: 1846553 - protein, 7 aa, Staphylococcus
AKSSEFL

SEQ ID NO: 1846554 - protein, 8 aa, Staphylococcus
AKSSELIE

SEQ ID NO: 1846555 - protein, 8 aa, Staphylococcus
AKSSQKKQ

SEQ ID NO: 1846556 - protein, 22 aa, Staphylococcus
AKSTIEDKNKSNKEKQSALADI

SEQ ID NO: 1846557 - protein, 10 aa, Staphylococcus
AKSTKPLKEQ

SEQ ID NO: 1846558 - protein, 9 aa, Staphylococcus
AKSTVQPEI

SEQ ID NO: 1846559 - protein, 41 aa, Staphylococcus
AKSVEENDKQSNETNGQQIKRDRTYITPDEFKSKSPKKDNQ

SEQ ID NO: 1846560 - protein, 10 aa, Staphylococcus
AKSYKGVNVK

SEQ ID NO: 1846561 - protein, 6 aa, Staphylococcus
AKTAGV

SEQ ID NO: 1846562 - protein, 10 aa, Staphylococcus
AKTAGVSGKE

SEQ ID NO: 1846563 - protein, 4 aa, Staphylococcus
AKTE

SEQ ID NO: 1846564 - protein, 7 aa, Staphylococcus
AKTEKDY

SEQ ID NO: 1846565 - protein, 9 aa, Staphylococcus
AKTEQKKRV

SEQ ID NO: 1846566 - protein, 10 aa, Staphylococcus
AKTGDPLSPA

SEQ ID NO: 1846567 - protein, 20 aa, Staphylococcus
AKTGEISRIATNNKNTELQG

SEQ ID NO: 1846568 - protein, 26 aa, Staphylococcus
AKTNINQAQTNAQVDQAKENGTNSIN

SEQ ID NO: 1846569 - protein, 6 aa, Staphylococcus
AKTPRH

SEQ ID NO: 1846570 - protein, 8 aa, Staphylococcus
AKTQGSEY

SEQ ID NO: 1846571 - protein, 8 aa, Staphylococcus
AKTSQQKQ

SEQ ID NO: 1846572 - protein, 9 aa, Staphylococcus
AKVSENADI

SEQ ID NO: 1846573 - protein, 7 aa, Staphylococcus
AKVSGKS

SEQ ID NO: 1846574 - protein, 5 aa, Staphylococcus
AKVSP

SEQ ID NO: 1846575 - protein, 6 aa, Staphylococcus
AKVSPL

SEQ ID NO: 1846576 - protein, 77 aa, Staphylococcus
AKVVEEDKNDFEDGKYGKSYEDVRKEQLNRSDDDQKDDHEDEESGDNEKDGENSEPTGHEQAPDIDRPGNSNDPGRR

SEQ ID NO: 1846577 - protein, 8 aa, Staphylococcus
AKYDLDGK

SEQ ID NO: 1846578 - protein, 5 aa, Staphylococcus
AKYKG

SEQ ID NO: 1846579 - protein, 28 aa, Staphylococcus
AKYKQKSPDEVKEQQEMDRYEREQARID

SEQ ID NO: 1846580 - protein, 5 aa, Staphylococcus
AKYQN

SEQ ID NO: 1846581 - protein, 6 aa, Staphylococcus
ALAGGS

SEQ ID NO: 1846582 - protein, 8 aa, Staphylococcus
ALAGSGSG

SEQ ID NO: 1846583 - protein, 6 aa, Staphylococcus
ALAQGG

SEQ ID NO: 1846584 - protein, 9 aa, Staphylococcus
ALASRAVSA

SEQ ID NO: 1846585 - protein, 9 aa, Staphylococcus
ALATQDNNA

SEQ ID NO: 1846586 - protein, 8 aa, Staphylococcus
ALDAAGQA

SEQ ID NO: 1846587 - protein, 9 aa, Staphylococcus
ALDDNEKAL

SEQ ID NO: 1846588 - protein, 8 aa, Staphylococcus
ALEDYSGL

SEQ ID NO: 1846589 - protein, 7 aa, Staphylococcus
ALEEKNK

SEQ ID NO: 1846590 - protein, 13 aa, Staphylococcus
ALEEQEATFGRKR

SEQ ID NO: 1846591 - protein, 27 aa, Staphylococcus
ALEEQEATFGRKRSTGAPLTGKKEFDN

SEQ ID NO: 1846592 - protein, 15 aa, Staphylococcus
ALERDDSGNLKKSGY

SEQ ID NO: 1846593 - protein, 8 aa, Staphylococcus
ALESSNAA

SEQ ID NO: 1846594 - protein, 5 aa, Staphylococcus
ALGAS

SEQ ID NO: 1846595 - protein, 5 aa, Staphylococcus
ALGET

SEQ ID NO: 1846596 - protein, 6 aa, Staphylococcus
ALGETA

SEQ ID NO: 1846597 - protein, 5 aa, Staphylococcus
ALGGK

SEQ ID NO: 1846598 - protein, 5 aa, Staphylococcus
ALGPT

SEQ ID NO: 1846599 - protein, 6 aa, Staphylococcus
ALGRKQ

SEQ ID NO: 1846600 - protein, 6 aa, Staphylococcus
ALGSSE

SEQ ID NO: 1846601 - protein, 8 aa, Staphylococcus
ALGSSEFT

SEQ ID NO: 1846602 - protein, 7 aa, Staphylococcus
ALGSTEF

SEQ ID NO: 1846603 - protein, 7 aa, Staphylococcus
ALGSTQF

SEQ ID NO: 1846604 - protein, 44 aa, Staphylococcus
ALHENRSNEEKYELDQTKTKTMSFSKDEISKKIDDTPKEKSIEE

SEQ ID NO: 1846605 - protein, 15 aa, Staphylococcus
ALKANYNTALDRAND

SEQ ID NO: 1846606 - protein, 8 aa, Staphylococcus
ALKDKTQQ

SEQ ID NO: 1846607 - protein, 11 aa, Staphylococcus
ALKENGQYGEV

SEQ ID NO: 1846608 - protein, 8 aa, Staphylococcus
ALKESFGK

SEQ ID NO: 1846609 - protein, 7 aa, Staphylococcus
ALKSATH

SEQ ID NO: 1846610 - protein, 12 aa, Staphylococcus
ALKSKTNEGMQN

SEQ ID NO: 1846611 - protein, 10 aa, Staphylococcus
ALKSSGANGV

SEQ ID NO: 1846612 - protein, 5 aa, Staphylococcus
ALLTE

SEQ ID NO: 1846613 - protein, 13 aa, Staphylococcus
ALMGGDDNIATSP

SEQ ID NO: 1846614 - protein, 13 aa, Staphylococcus
ALMGGDNSIATSP

SEQ ID NO: 1846615 - protein, 13 aa, Staphylococcus
ALMGGGDDIATSP

SEQ ID NO: 1846616 - protein, 13 aa, Staphylococcus
ALMGGGDDISTSP

SEQ ID NO: 1846617 - protein, 7 aa, Staphylococcus
ALNEDTA

SEQ ID NO: 1846618 - protein, 69 aa, Staphylococcus
ALNEEQKESNVKPTSEQQNGIDTNQQPTAEAVESEANNPPVLATESNSKHNEDTDNSAESLTTEQKVEK

SEQ ID NO: 1846619 - protein, 12 aa, Staphylococcus
ALNEKEAHQASL

SEQ ID NO: 1846620 - protein, 36 aa, Staphylococcus
ALNGDEDDSTAKQQTNSKIDQNKNDVYTISENNTEL

SEQ ID NO: 1846621 - protein, 8 aa, Staphylococcus
ALNGKADD

SEQ ID NO: 1846622 - protein, 7 aa, Staphylococcus
ALNGTAS

SEQ ID NO: 1846623 - protein, 33 aa, Staphylococcus
ALNQPDPTHGMTPQTITNYNAKKQAAQAELQKA

SEQ ID NO: 1846624 - protein, 19 aa, Staphylococcus
ALNSAKNDLRADKSELQTA

SEQ ID NO: 1846625 - protein, 10 aa, Staphylococcus
ALNSGLGSYR

SEQ ID NO: 1846626 - protein, 12 aa, Staphylococcus
ALNTAAGANNFS

SEQ ID NO: 1846627 - protein, 7 aa, Staphylococcus
ALNTNPI

SEQ ID NO: 1846628 - protein, 5 aa, Staphylococcus
ALPEK

SEQ ID NO: 1846629 - protein, 11 aa, Staphylococcus
ALPETGETTSL

SEQ ID NO: 1846630 - protein, 6 aa, Staphylococcus
ALPNET

SEQ ID NO: 1846631 - protein, 14 aa, Staphylococcus
ALPNTGKEETPEHS

SEQ ID NO: 1846632 - protein, 12 aa, Staphylococcus
ALPNTGSDNTAP

SEQ ID NO: 1846633 - protein, 6 aa, Staphylococcus
ALPPYN

SEQ ID NO: 1846634 - protein, 5 aa, Staphylococcus
ALPRS

SEQ ID NO: 1846635 - protein, 22 aa, Staphylococcus
ALPTKMGTHGTAANNTARQVAS

SEQ ID NO: 1846636 - protein, 26 aa, Staphylococcus
ALQDESSYQVDGSTFRNYDTKSHGTV

SEQ ID NO: 1846637 - protein, 19 aa, Staphylococcus
ALRRKKGAFATWTSPDRGK

SEQ ID NO: 1846638 - protein, 15 aa, Staphylococcus
ALSAARPGARKETLE

SEQ ID NO: 1846639 - protein, 12 aa, Staphylococcus
ALSKGSTGKAEA

SEQ ID NO: 1846640 - protein, 8 aa, Staphylococcus
ALSNPNTV

SEQ ID NO: 1846641 - protein, 9 aa, Staphylococcus
ALSNPSTVK

SEQ ID NO: 1846642 - protein, 5 aa, Staphylococcus
ALSPN

SEQ ID NO: 1846643 - protein, 16 aa, Staphylococcus
ALSTAVSNAPESKVGM

SEQ ID NO: 1846644 - protein, 16 aa, Staphylococcus
ALSTAVSTTPAEKVGV

SEQ ID NO: 1846645 - protein, 53 aa, Staphylococcus
ALSTEAKNKNDLIDQTPNATAEEMEEANNKVDSIQEKANANIGKANTTDEVNQ

SEQ ID NO: 1846646 - protein, 15 aa, Staphylococcus
ALTNDEVANAVTNGI

SEQ ID NO: 1846647 - protein, 5 aa, Staphylococcus
ALVGQ

SEQ ID NO: 1846648 - protein, 12 aa, Staphylococcus
AMAGAVGGGGIG

SEQ ID NO: 1846649 - protein, 8 aa, Staphylococcus
AMEEENIA

SEQ ID NO: 1846650 - protein, 15 aa, Staphylococcus
AMEETGDLKVPQDEG

SEQ ID NO: 1846651 - protein, 6 aa, Staphylococcus
AMEQPK

SEQ ID NO: 1846652 - protein, 8 aa, Staphylococcus
AMGGGQYS

SEQ ID NO: 1846653 - protein, 8 aa, Staphylococcus
AMGGNEKA

SEQ ID NO: 1846654 - protein, 11 aa, Staphylococcus
AMGQGISKTGG

SEQ ID NO: 1846655 - protein, 4 aa, Staphylococcus
AMKQ

SEQ ID NO: 1846656 - protein, 5 aa, Staphylococcus
AMNEN

SEQ ID NO: 1846657 - protein, 6 aa, Staphylococcus
AMPGNV

SEQ ID NO: 1846658 - protein, 28 aa, Staphylococcus
AMQDESSYSIDGGTFRNYDGQGHGTVSA

SEQ ID NO: 1846659 - protein, 4 aa, Staphylococcus
AMSN

SEQ ID NO: 1846660 - protein, 5 aa, Staphylococcus
AMSNS

SEQ ID NO: 1846661 - protein, 4 aa, Staphylococcus
AMTS

SEQ ID NO: 1846662 - protein, 13 aa, Staphylococcus
ANAADDQEDVAQK

SEQ ID NO: 1846663 - protein, 4 aa, Staphylococcus
ANAG

SEQ ID NO: 1846664 - protein, 6 aa, Staphylococcus
ANAGTG

SEQ ID NO: 1846665 - protein, 7 aa, Staphylococcus
ANAGTGF

SEQ ID NO: 1846666 - protein, 4 aa, Staphylococcus
ANAI

SEQ ID NO: 1846667 - protein, 4 aa, Staphylococcus
ANAN

SEQ ID NO: 1846668 - protein, 16 aa, Staphylococcus
ANASEDMKKPERNLPR

SEQ ID NO: 1846669 - protein, 9 aa, Staphylococcus
ANATATVNA

SEQ ID NO: 1846670 - protein, 10 aa, Staphylococcus
ANATATVNDN

SEQ ID NO: 1846671 - protein, 10 aa, Staphylococcus
ANATATVNTN

SEQ ID NO: 1846672 - protein, 11 aa, Staphylococcus
ANATQAVNDNL

SEQ ID NO: 1846673 - protein, 6 aa, Staphylococcus
ANAYTA

SEQ ID NO: 1846674 - protein, 9 aa, Staphylococcus
ANDDGLNKR

SEQ ID NO: 1846675 - protein, 9 aa, Staphylococcus
ANDDSLNRD

SEQ ID NO: 1846676 - protein, 6 aa, Staphylococcus
ANDGYR

SEQ ID NO: 1846677 - protein, 6 aa, Staphylococcus
ANDIGS

SEQ ID NO: 1846678 - protein, 8 aa, Staphylococcus
ANDKIANN

SEQ ID NO: 1846679 - protein, 11 aa, Staphylococcus
ANDMQDDGNFY

SEQ ID NO: 1846680 - protein, 4 aa, Staphylococcus
ANEC

SEQ ID NO: 1846681 - protein, 12 aa, Staphylococcus
ANEEEDKQDPVN

SEQ ID NO: 1846682 - protein, 25 aa, Staphylococcus
ANEGLDHYEQNELKNGEQQYLSKGA

SEQ ID NO: 1846683 - protein, 25 aa, Staphylococcus
ANEGLDNYEKNELKDATEQYLSKGA

SEQ ID NO: 1846684 - protein, 7 aa, Staphylococcus
ANEGTGF

SEQ ID NO: 1846685 - protein, 11 aa, Staphylococcus
ANEGTTITDPQ

SEQ ID NO: 1846686 - protein, 5 aa, Staphylococcus
ANEIE

SEQ ID NO: 1846687 - protein, 5 aa, Staphylococcus
ANEKL

SEQ ID NO: 1846688 - protein, 17 aa, Staphylococcus
ANELKDDDVKSDSISKF

SEQ ID NO: 1846689 - protein, 12 aa, Staphylococcus
ANELNDKEKHKV

SEQ ID NO: 1846690 - protein, 8 aa, Staphylococcus
ANELNSEM

SEQ ID NO: 1846691 - protein, 9 aa, Staphylococcus
ANEPQSTKA

SEQ ID NO: 1846692 - protein, 5 aa, Staphylococcus
ANEPW

SEQ ID NO: 1846693 - protein, 8 aa, Staphylococcus
ANEQFNKT

SEQ ID NO: 1846694 - protein, 8 aa, Staphylococcus
ANEQFNQT

SEQ ID NO: 1846695 - protein, 7 aa, Staphylococcus
ANEQGTP

SEQ ID NO: 1846696 - protein, 17 aa, Staphylococcus
ANERTIDANTSSGGTKV

SEQ ID NO: 1846697 - protein, 12 aa, Staphylococcus
ANETSGGSTITQ

SEQ ID NO: 1846698 - protein, 10 aa, Staphylococcus
ANFDTKKADA

SEQ ID NO: 1846699 - protein, 6 aa, Staphylococcus
ANFGPN

SEQ ID NO: 1846700 - protein, 8 aa, Staphylococcus
ANFSGTPG

SEQ ID NO: 1846701 - protein, 6 aa, Staphylococcus
ANGHLS

SEQ ID NO: 1846702 - protein, 24 aa, Staphylococcus
ANGQVQEREKYTAEIDASDAEKGV

SEQ ID NO: 1846703 - protein, 11 aa, Staphylococcus
ANGSEPEAQWS

SEQ ID NO: 1846704 - protein, 14 aa, Staphylococcus
ANHADADHSNQVTS

SEQ ID NO: 1846705 - protein, 7 aa, Staphylococcus
ANHDSLD

SEQ ID NO: 1846706 - protein, 11 aa, Staphylococcus
ANHEATLEERE

SEQ ID NO: 1846707 - protein, 7 aa, Staphylococcus
ANHGGAA

SEQ ID NO: 1846708 - protein, 10 aa, Staphylococcus
ANHHDKYSAR

SEQ ID NO: 1846709 - protein, 5 aa, Staphylococcus
ANHHT

SEQ ID NO: 1846710 - protein, 6 aa, Staphylococcus
ANHKEV

SEQ ID NO: 1846711 - protein, 24 aa, Staphylococcus
ANHKQSGNQKNYGVASNNAIATKV

SEQ ID NO: 1846712 - protein, 8 aa, Staphylococcus
ANHKSITK

SEQ ID NO: 1846713 - protein, 4 aa, Staphylococcus
ANHL

SEQ ID NO: 1846714 - protein, 7 aa, Staphylococcus
ANIKETN

SEQ ID NO: 1846715 - protein, 6 aa, Staphylococcus
ANIPGV

SEQ ID NO: 1846716 - protein, 4 aa, Staphylococcus
ANIS

SEQ ID NO: 1846717 - protein, 4 aa, Staphylococcus
ANKE

SEQ ID NO: 1846718 - protein, 6 aa, Staphylococcus
ANKNGG

SEQ ID NO: 1846719 - protein, 7 aa, Staphylococcus
ANKNGGA

SEQ ID NO: 1846720 - protein, 5 aa, Staphylococcus
ANKPW

SEQ ID NO: 1846721 - protein, 12 aa, Staphylococcus
ANKQKRGISSCE

SEQ ID NO: 1846722 - protein, 37 aa, Staphylococcus
ANKQSKQGYTDTSNALGQMSDAEGQLIDGNNQVTDGL

SEQ ID NO: 1846723 - protein, 4 aa, Staphylococcus
ANKR

SEQ ID NO: 1846724 - protein, 7 aa, Staphylococcus
ANKRNAV

SEQ ID NO: 1846725 - protein, 7 aa, Staphylococcus
ANLKPTN

SEQ ID NO: 1846726 - protein, 12 aa, Staphylococcus
ANLNQRDTKQDI

SEQ ID NO: 1846727 - protein, 6 aa, Staphylococcus
ANLSSE

SEQ ID NO: 1846728 - protein, 8 aa, Staphylococcus
ANLTIRDA

SEQ ID NO: 1846729 - protein, 37 aa, Staphylococcus
ANLTIRDADDNVKLTGKDIQQGSAKQEFKQNTNQPAV

SEQ ID NO: 1846730 - protein, 6 aa, Staphylococcus
ANMTNS

SEQ ID NO: 1846731 - protein, 7 aa, Staphylococcus
ANNDRVE

SEQ ID NO: 1846732 - protein, 22 aa, Staphylococcus
ANNKEIGEASSSETYGPYDPNE

SEQ ID NO: 1846733 - protein, 23 aa, Staphylococcus
ANNNINQANTTDDVTTAKNNGIA

SEQ ID NO: 1846734 - protein, 12 aa, Staphylococcus
ANNNQTHNSTND

SEQ ID NO: 1846735 - protein, 9 aa, Staphylococcus
ANPDKEGSF

SEQ ID NO: 1846736 - protein, 9 aa, Staphylococcus
ANPEDEGTF

SEQ ID NO: 1846737 - protein, 6 aa, Staphylococcus
ANPGET

SEQ ID NO: 1846738 - protein, 7 aa, Staphylococcus
ANPHGDL

SEQ ID NO: 1846739 - protein, 9 aa, Staphylococcus
ANPKLSQTD

SEQ ID NO: 1846740 - protein, 8 aa, Staphylococcus
ANQATSIG

SEQ ID NO: 1846741 - protein, 6 aa, Staphylococcus
ANQERK

SEQ ID NO: 1846742 - protein, 8 aa, Staphylococcus
ANQLNDSM

SEQ ID NO: 1846743 - protein, 10 aa, Staphylococcus
ANQSEGKEQV

SEQ ID NO: 1846744 - protein, 5 aa, Staphylococcus
ANQTS

SEQ ID NO: 1846745 - protein, 13 aa, Staphylococcus
ANQYSNNNKSISP

SEQ ID NO: 1846746 - protein, 4 aa, Staphylococcus
ANRP

SEQ ID NO: 1846747 - protein, 6 aa, Staphylococcus
ANRYPT

SEQ ID NO: 1846748 - protein, 10 aa, Staphylococcus
ANSDNHNTFS

SEQ ID NO: 1846749 - protein, 6 aa, Staphylococcus
ANSKEE

SEQ ID NO: 1846750 - protein, 14 aa, Staphylococcus
ANSNTVDVNEDFNE

SEQ ID NO: 1846751 - protein, 6 aa, Staphylococcus
ANSPEE

SEQ ID NO: 1846752 - protein, 6 aa, Staphylococcus
ANSQLG

SEQ ID NO: 1846753 - protein, 5 aa, Staphylococcus
ANSRE

SEQ ID NO: 1846754 - protein, 7 aa, Staphylococcus
ANSREIE

SEQ ID NO: 1846755 - protein, 8 aa, Staphylococcus
ANSTQEVR

SEQ ID NO: 1846756 - protein, 10 aa, Staphylococcus
ANSTSTDKGI

SEQ ID NO: 1846757 - protein, 20 aa, Staphylococcus
ANTAIGAANTTNEVNEARDH

SEQ ID NO: 1846758 - protein, 9 aa, Staphylococcus
ANTGDQSLD

SEQ ID NO: 1846759 - protein, 5 aa, Staphylococcus
ANTGV

SEQ ID NO: 1846760 - protein, 6 aa, Staphylococcus
ANTIKG

SEQ ID NO: 1846761 - protein, 13 aa, Staphylococcus
ANTKTPVKVTTDP

SEQ ID NO: 1846762 - protein, 4 aa, Staphylococcus
ANTN

SEQ ID NO: 1846763 - protein, 4 aa, Staphylococcus
ANTT

SEQ ID NO: 1846764 - protein, 16 aa, Staphylococcus
ANVDDLQSIEKKSNFV

SEQ ID NO: 1846765 - protein, 24 aa, Staphylococcus
ANVDDLQTIENKSNFVSSDNMPNY

SEQ ID NO: 1846766 - protein, 17 aa, Staphylococcus
ANVDEKDIADVEEGKDV

SEQ ID NO: 1846767 - protein, 7 aa, Staphylococcus
ANVGGDY

SEQ ID NO: 1846768 - protein, 7 aa, Staphylococcus
ANVQKGD

SEQ ID NO: 1846769 - protein, 5 aa, Staphylococcus
ANYAS

SEQ ID NO: 1846770 - protein, 11 aa, Staphylococcus
ANYDRPSVAGT

SEQ ID NO: 1846771 - protein, 12 aa, Staphylococcus
ANYDRPSVAGTA

SEQ ID NO: 1846772 - protein, 17 aa, Staphylococcus
ANYEKNALEKAKSYAKD

SEQ ID NO: 1846773 - protein, 24 aa, Staphylococcus
ANYESADDIKVDDRSDDKGPEAEN

SEQ ID NO: 1846774 - protein, 9 aa, Staphylococcus
ANYNELTTQ

SEQ ID NO: 1846775 - protein, 6 aa, Staphylococcus
ANYQAK

SEQ ID NO: 1846776 - protein, 12 aa, Staphylococcus
APAATKKQPIPK

SEQ ID NO: 1846777 - protein, 4 aa, Staphylococcus
APAI

SEQ ID NO: 1846778 - protein, 4 aa, Staphylococcus
APAR

SEQ ID NO: 1846779 - protein, 9 aa, Staphylococcus
APASTYSKK

SEQ ID NO: 1846780 - protein, 5 aa, Staphylococcus
APDDG

SEQ ID NO: 1846781 - protein, 10 aa, Staphylococcus
APDDVQAGDS

SEQ ID NO: 1846782 - protein, 11 aa, Staphylococcus
APDGKQGQYQG

SEQ ID NO: 1846783 - protein, 8 aa, Staphylococcus
APDKEEEV

SEQ ID NO: 1846784 - protein, 6 aa, Staphylococcus
APDSTF

SEQ ID NO: 1846785 - protein, 9 aa, Staphylococcus
APEDTAQGA

SEQ ID NO: 1846786 - protein, 7 aa, Staphylococcus
APEEALT

SEQ ID NO: 1846787 - protein, 11 aa, Staphylococcus
APEGKQGQYQG

SEQ ID NO: 1846788 - protein, 6 aa, Staphylococcus
APEHRG

SEQ ID NO: 1846789 - protein, 16 aa, Staphylococcus
APEQAKGESTNEGTDI

SEQ ID NO: 1846790 - protein, 17 aa, Staphylococcus
APETKAVQTKETKRAKF

SEQ ID NO: 1846791 - protein, 6 aa, Staphylococcus
APGTMN

SEQ ID NO: 1846792 - protein, 5 aa, Staphylococcus
APGTN

SEQ ID NO: 1846793 - protein, 4 aa, Staphylococcus
APGV

SEQ ID NO: 1846794 - protein, 7 aa, Staphylococcus
APGVTET

SEQ ID NO: 1846795 - protein, 11 aa, Staphylococcus
APIAKSKMTKV

SEQ ID NO: 1846796 - protein, 10 aa, Staphylococcus
APISSAGGIK

SEQ ID NO: 1846797 - protein, 6 aa, Staphylococcus
APKAFN

SEQ ID NO: 1846798 - protein, 4 aa, Staphylococcus
APKG

SEQ ID NO: 1846799 - protein, 4 aa, Staphylococcus
APKK

SEQ ID NO: 1846800 - protein, 8 aa, Staphylococcus
APKKPKEM

SEQ ID NO: 1846801 - protein, 18 aa, Staphylococcus
APKKYKNEMSSRASAKDY

SEQ ID NO: 1846802 - protein, 12 aa, Staphylococcus
APKMTNAGTSAI

SEQ ID NO: 1846803 - protein, 16 aa, Staphylococcus
APKNATIETTDKGIII

SEQ ID NO: 1846804 - protein, 20 aa, Staphylococcus
APKNVQSYLDDDSGSIPTRS

SEQ ID NO: 1846805 - protein, 4 aa, Staphylococcus
APKQ

SEQ ID NO: 1846806 - protein, 6 aa, Staphylococcus
APKQLS

SEQ ID NO: 1846807 - protein, 8 aa, Staphylococcus
APKRAWTD

SEQ ID NO: 1846808 - protein, 4 aa, Staphylococcus
APLG

SEQ ID NO: 1846809 - protein, 11 aa, Staphylococcus
APLGPKKPNIS

SEQ ID NO: 1846810 - protein, 54 aa, Staphylococcus
APLPESEDKALEVPTDQTKDEESHESNGATVNRVGTKAGSKNLPVNTNNQQVQV

SEQ ID NO: 1846811 - protein, 6 aa, Staphylococcus
APNGMR

SEQ ID NO: 1846812 - protein, 6 aa, Staphylococcus
APNGPL

SEQ ID NO: 1846813 - protein, 6 aa, Staphylococcus
APNSTT

SEQ ID NO: 1846814 - protein, 6 aa, Staphylococcus
APNTEG

SEQ ID NO: 1846815 - protein, 5 aa, Staphylococcus
APNTH

SEQ ID NO: 1846816 - protein, 7 aa, Staphylococcus
APPIQTT

SEQ ID NO: 1846817 - protein, 6 aa, Staphylococcus
APPQRL

SEQ ID NO: 1846818 - protein, 13 aa, Staphylococcus
APPTADPETKAAM

SEQ ID NO: 1846819 - protein, 16 aa, Staphylococcus
APPTASPKTTEAFTES

SEQ ID NO: 1846820 - protein, 5 aa, Staphylococcus
APPYH

SEQ ID NO: 1846821 - protein, 8 aa, Staphylococcus
APQATDIG

SEQ ID NO: 1846822 - protein, 10 aa, Staphylococcus
APQATDIGGK

SEQ ID NO: 1846823 - protein, 11 aa, Staphylococcus
APQGKQGQYQG

SEQ ID NO: 1846824 - protein, 6 aa, Staphylococcus
APQHRG

SEQ ID NO: 1846825 - protein, 9 aa, Staphylococcus
APQLQQETQ

SEQ ID NO: 1846826 - protein, 4 aa, Staphylococcus
APQN

SEQ ID NO: 1846827 - protein, 10 aa, Staphylococcus
APQPEQASAK

SEQ ID NO: 1846828 - protein, 6 aa, Staphylococcus
APQSEH

SEQ ID NO: 1846829 - protein, 10 aa, Staphylococcus
APQSSPNTER

SEQ ID NO: 1846830 - protein, 9 aa, Staphylococcus
APRSQPSTV

SEQ ID NO: 1846831 - protein, 19 aa, Staphylococcus
APSATKKQPIPERLRRGKK

SEQ ID NO: 1846832 - protein, 8 aa, Staphylococcus
APSGETVK

SEQ ID NO: 1846833 - protein, 6 aa, Staphylococcus
APSGMR

SEQ ID NO: 1846834 - protein, 5 aa, Staphylococcus
APSGN

SEQ ID NO: 1846835 - protein, 9 aa, Staphylococcus
APSKPKDLK

SEQ ID NO: 1846836 - protein, 8 aa, Staphylococcus
APSNINTK

SEQ ID NO: 1846837 - protein, 7 aa, Staphylococcus
APSNSDS

SEQ ID NO: 1846838 - protein, 6 aa, Staphylococcus
APSSGV

SEQ ID NO: 1846839 - protein, 30 aa, Staphylococcus
APSSKTKDIVKASQKTINESQGEDDANGYA

SEQ ID NO: 1846840 - protein, 5 aa, Staphylococcus
APTAA

SEQ ID NO: 1846841 - protein, 11 aa, Staphylococcus
APTELRGSLGS

SEQ ID NO: 1846842 - protein, 11 aa, Staphylococcus
APTEQRGSLSS

SEQ ID NO: 1846843 - protein, 11 aa, Staphylococcus
APTESRGSLSS

SEQ ID NO: 1846844 - protein, 7 aa, Staphylococcus
APTKTQV

SEQ ID NO: 1846845 - protein, 17 aa, Staphylococcus
APTKVTSKESYKIKSSK

SEQ ID NO: 1846846 - protein, 7 aa, Staphylococcus
APTNNEI

SEQ ID NO: 1846847 - protein, 5 aa, Staphylococcus
APTQH

SEQ ID NO: 1846848 - protein, 8 aa, Staphylococcus
APTTDSGV

SEQ ID NO: 1846849 - protein, 33 aa, Staphylococcus
APVKATKDQKSNHDNQKNKTQHVHSNHTQKSNK

SEQ ID NO: 1846850 - protein, 8 aa, Staphylococcus
APVKSSAF

SEQ ID NO: 1846851 - protein, 28 aa, Staphylococcus
APVNGSSNATQSTQSQGNAQRQQSYNNA

SEQ ID NO: 1846852 - protein, 18 aa, Staphylococcus
APVNPGNSGGAVVDENGD

SEQ ID NO: 1846853 - protein, 17 aa, Staphylococcus
APVNPGNSGGAVVDKDG

SEQ ID NO: 1846854 - protein, 12 aa, Staphylococcus
APVQDGKLGANG

SEQ ID NO: 1846855 - protein, 6 aa, Staphylococcus
APVQNT

SEQ ID NO: 1846856 - protein, 20 aa, Staphylococcus
APVYKDAGPLTWPSQTAKVK

SEQ ID NO: 1846857 - protein, 16 aa, Staphylococcus
APYKAPHKPHHDDQDH

SEQ ID NO: 1846858 - protein, 23 aa, Staphylococcus
AQAANAEDAATTQADKDAQAVNA

SEQ ID NO: 1846859 - protein, 8 aa, Staphylococcus
AQAGPGGA

SEQ ID NO: 1846860 - protein, 4 aa, Staphylococcus
AQAM

SEQ ID NO: 1846861 - protein, 15 aa, Staphylococcus
AQAQINQAKNEADKV

SEQ ID NO: 1846862 - protein, 10 aa, Staphylococcus
AQASGGEMKA

SEQ ID NO: 1846863 - protein, 8 aa, Staphylococcus
AQDANTVQ

SEQ ID NO: 1846864 - protein, 9 aa, Staphylococcus
AQDANTVQV

SEQ ID NO: 1846865 - protein, 13 aa, Staphylococcus
AQDKNEIYNILKE

SEQ ID NO: 1846866 - protein, 6 aa, Staphylococcus
AQDNTL

SEQ ID NO: 1846867 - protein, 18 aa, Staphylococcus
AQEDCKKKHAENESKDLK

SEQ ID NO: 1846868 - protein, 13 aa, Staphylococcus
AQEEAKQNKVNLW

SEQ ID NO: 1846869 - protein, 4 aa, Staphylococcus
AQEK

SEQ ID NO: 1846870 - protein, 5 aa, Staphylococcus
AQEKS

SEQ ID NO: 1846871 - protein, 10 aa, Staphylococcus
AQENKAPTQA

SEQ ID NO: 1846872 - protein, 11 aa, Staphylococcus
AQFDDKNKKPL

SEQ ID NO: 1846873 - protein, 6 aa, Staphylococcus
AQFKEQ

SEQ ID NO: 1846874 - protein, 11 aa, Staphylococcus
AQGEGGQSKEM

SEQ ID NO: 1846875 - protein, 19 aa, Staphylococcus
AQGEINEDEYEKLKKVLKK

SEQ ID NO: 1846876 - protein, 5 aa, Staphylococcus
AQGEQ

SEQ ID NO: 1846877 - protein, 10 aa, Staphylococcus
AQGERAPAQA

SEQ ID NO: 1846878 - protein, 10 aa, Staphylococcus
AQGGGGGGGR

SEQ ID NO: 1846879 - protein, 9 aa, Staphylococcus
AQGGGQGGR

SEQ ID NO: 1846880 - protein, 5 aa, Staphylococcus
AQGGQ

SEQ ID NO: 1846881 - protein, 4 aa, Staphylococcus
AQGI

SEQ ID NO: 1846882 - protein, 4 aa, Staphylococcus
AQGL

SEQ ID NO: 1846883 - protein, 7 aa, Staphylococcus
AQHDHDT

SEQ ID NO: 1846884 - protein, 7 aa, Staphylococcus
AQHHEPD

SEQ ID NO: 1846885 - protein, 8 aa, Staphylococcus
AQHPTGEL

SEQ ID NO: 1846886 - protein, 10 aa, Staphylococcus
AQIDASKSYD

SEQ ID NO: 1846887 - protein, 11 aa, Staphylococcus
AQIRDEEAKLT

SEQ ID NO: 1846888 - protein, 12 aa, Staphylococcus
AQIRDEETKLDE

SEQ ID NO: 1846889 - protein, 12 aa, Staphylococcus
AQIREEESKLDE

SEQ ID NO: 1846890 - protein, 9 aa, Staphylococcus
AQKAKKTVI

SEQ ID NO: 1846891 - protein, 12 aa, Staphylococcus
AQKEETSQVSTG

SEQ ID NO: 1846892 - protein, 20 aa, Staphylococcus
AQKIAKQLEDKGKVVYPNTG

SEQ ID NO: 1846893 - protein, 9 aa, Staphylococcus
AQKMSKEEV

SEQ ID NO: 1846894 - protein, 6 aa, Staphylococcus
AQLDPR

SEQ ID NO: 1846895 - protein, 18 aa, Staphylococcus
AQLQDSTNKISDSDNPIV

SEQ ID NO: 1846896 - protein, 9 aa, Staphylococcus
AQLSNTESG

SEQ ID NO: 1846897 - protein, 19 aa, Staphylococcus
AQNAAKEQEAQAKAARELN

SEQ ID NO: 1846898 - protein, 14 aa, Staphylococcus
AQNEINSEKERAIA

SEQ ID NO: 1846899 - protein, 6 aa, Staphylococcus
AQNIER

SEQ ID NO: 1846900 - protein, 13 aa, Staphylococcus
AQNKIREAKADSE

SEQ ID NO: 1846901 - protein, 4 aa, Staphylococcus
AQNL

SEQ ID NO: 1846902 - protein, 10 aa, Staphylococcus
AQNNQANSKI

SEQ ID NO: 1846903 - protein, 5 aa, Staphylococcus
AQNSA

SEQ ID NO: 1846904 - protein, 6 aa, Staphylococcus
AQPDNL

SEQ ID NO: 1846905 - protein, 5 aa, Staphylococcus
AQPNQ

SEQ ID NO: 1846906 - protein, 4 aa, Staphylococcus
AQPP

SEQ ID NO: 1846907 - protein, 7 aa, Staphylococcus
AQPPEVM

SEQ ID NO: 1846908 - protein, 4 aa, Staphylococcus
AQPT

SEQ ID NO: 1846909 - protein, 9 aa, Staphylococcus
AQQASIDGF

SEQ ID NO: 1846910 - protein, 8 aa, Staphylococcus
AQQDDQIV

SEQ ID NO: 1846911 - protein, 5 aa, Staphylococcus
AQQFG

SEQ ID NO: 1846912 - protein, 7 aa, Staphylococcus
AQQGNQG

SEQ ID NO: 1846913 - protein, 8 aa, Staphylococcus
AQQIGTSA

SEQ ID NO: 1846914 - protein, 9 aa, Staphylococcus
AQQIGTSGS

SEQ ID NO: 1846915 - protein, 7 aa, Staphylococcus
AQQSTNQ

SEQ ID NO: 1846916 - protein, 5 aa, Staphylococcus
AQQTV

SEQ ID NO: 1846917 - protein, 13 aa, Staphylococcus
AQRAEINQKHYKK

SEQ ID NO: 1846918 - protein, 11 aa, Staphylococcus
AQRRQLESEGK

SEQ ID NO: 1846919 - protein, 10 aa, Staphylococcus
AQRTPGFSGA

SEQ ID NO: 1846920 - protein, 14 aa, Staphylococcus
AQSEINSEKERALA

SEQ ID NO: 1846921 - protein, 14 aa, Staphylococcus
AQSEINSQKERAIA

SEQ ID NO: 1846922 - protein, 20 aa, Staphylococcus
AQSEINSQKERAISEINDEV

SEQ ID NO: 1846923 - protein, 7 aa, Staphylococcus
AQSEYIE

SEQ ID NO: 1846924 - protein, 5 aa, Staphylococcus
AQSFY

SEQ ID NO: 1846925 - protein, 7 aa, Staphylococcus
AQSIANE

SEQ ID NO: 1846926 - protein, 8 aa, Staphylococcus
AQSKQQKQ

SEQ ID NO: 1846927 - protein, 9 aa, Staphylococcus
AQSNSEGLI

SEQ ID NO: 1846928 - protein, 6 aa, Staphylococcus
AQSPGM

SEQ ID NO: 1846929 - protein, 5 aa, Staphylococcus
AQSPK

SEQ ID NO: 1846930 - protein, 10 aa, Staphylococcus
AQSSNNDSKF

SEQ ID NO: 1846931 - protein, 10 aa, Staphylococcus
AQSTKGQEAI

SEQ ID NO: 1846932 - protein, 7 aa, Staphylococcus
AQTGTAL

SEQ ID NO: 1846933 - protein, 14 aa, Staphylococcus
AQTISQTANPSNTY

SEQ ID NO: 1846934 - protein, 14 aa, Staphylococcus
AQTNSQVTEAKDNV

SEQ ID NO: 1846935 - protein, 5 aa, Staphylococcus
AQTPG

SEQ ID NO: 1846936 - protein, 8 aa, Staphylococcus
AQTTIPDV

SEQ ID NO: 1846937 - protein, 10 aa, Staphylococcus
AQVDGKEVPV

SEQ ID NO: 1846938 - protein, 13 aa, Staphylococcus
AQVTQKEYKGFGG

SEQ ID NO: 1846939 - protein, 8 aa, Staphylococcus
AQVTSEYG

SEQ ID NO: 1846940 - protein, 4 aa, Staphylococcus
AQYA

SEQ ID NO: 1846941 - protein, 10 aa, Staphylococcus
AQYGGQSEAV

SEQ ID NO: 1846942 - protein, 9 aa, Staphylococcus
ARAAKKQGV

SEQ ID NO: 1846943 - protein, 10 aa, Staphylococcus
ARAKSQTTHA

SEQ ID NO: 1846944 - protein, 11 aa, Staphylococcus
ARAKSQTTSAL

SEQ ID NO: 1846945 - protein, 11 aa, Staphylococcus
ARAKTQTTNAL

SEQ ID NO: 1846946 - protein, 10 aa, Staphylococcus
ARARKMGGTG

SEQ ID NO: 1846947 - protein, 8 aa, Staphylococcus
ARATQKKI

SEQ ID NO: 1846948 - protein, 6 aa, Staphylococcus
ARAYGQ

SEQ ID NO: 1846949 - protein, 8 aa, Staphylococcus
ARDEAQRL

SEQ ID NO: 1846950 - protein, 9 aa, Staphylococcus
ARDKARQEL

SEQ ID NO: 1846951 - protein, 4 aa, Staphylococcus
ARDY

SEQ ID NO: 1846952 - protein, 14 aa, Staphylococcus
AREAIANNAQQKIA

SEQ ID NO: 1846953 - protein, 5 aa, Staphylococcus
AREEA

SEQ ID NO: 1846954 - protein, 18 aa, Staphylococcus
ARELGQKADDRSDEVDNV

SEQ ID NO: 1846955 - protein, 6 aa, Staphylococcus
ARENRF

SEQ ID NO: 1846956 - protein, 17 aa, Staphylococcus
ARESINASASKNKAKFA

SEQ ID NO: 1846957 - protein, 16 aa, Staphylococcus
ARESINASSSRNNAKF

SEQ ID NO: 1846958 - protein, 16 aa, Staphylococcus
ARESINISSSRDRAKF

SEQ ID NO: 1846959 - protein, 17 aa, Staphylococcus
ARESINISSSRKNAKFA

SEQ ID NO: 1846960 - protein, 17 aa, Staphylococcus
ARESINVSSSRKNAKFA

SEQ ID NO: 1846961 - protein, 16 aa, Staphylococcus
ARESINVSSSRNNAKF

SEQ ID NO: 1846962 - protein, 8 aa, Staphylococcus
ARESTVQG

SEQ ID NO: 1846963 - protein, 15 aa, Staphylococcus
ARETKNPEKNLPKAI

SEQ ID NO: 1846964 - protein, 5 aa, Staphylococcus
ARGAK

SEQ ID NO: 1846965 - protein, 7 aa, Staphylococcus
ARGIQPP

SEQ ID NO: 1846966 - protein, 5 aa, Staphylococcus
ARGLG

SEQ ID NO: 1846967 - protein, 8 aa, Staphylococcus
ARGLTYGN

SEQ ID NO: 1846968 - protein, 4 aa, Staphylococcus
ARIG

SEQ ID NO: 1846969 - protein, 12 aa, Staphylococcus
ARIRKDGENLNI

SEQ ID NO: 1846970 - protein, 12 aa, Staphylococcus
ARITYDEKGRRI

SEQ ID NO: 1846971 - protein, 12 aa, Staphylococcus
ARKESRKETHRI

SEQ ID NO: 1846972 - protein, 9 aa, Staphylococcus
ARKGQKIMQ

SEQ ID NO: 1846973 - protein, 8 aa, Staphylococcus
ARKHDPDL

SEQ ID NO: 1846974 - protein, 14 aa, Staphylococcus
ARKLEVNNQSDLGL

SEQ ID NO: 1846975 - protein, 14 aa, Staphylococcus
ARKLQEEKDNDPYK

SEQ ID NO: 1846976 - protein, 13 aa, Staphylococcus
ARLRNSRKGQVKQ

SEQ ID NO: 1846977 - protein, 4 aa, Staphylococcus
ARNA

SEQ ID NO: 1846978 - protein, 24 aa, Staphylococcus
ARNHKSGQTDDKSDQHRHSDQPTL

SEQ ID NO: 1846979 - protein, 11 aa, Staphylococcus
ARNKTSIATHD

SEQ ID NO: 1846980 - protein, 10 aa, Staphylococcus
ARPEKPENVE

SEQ ID NO: 1846981 - protein, 4 aa, Staphylococcus
ARPK

SEQ ID NO: 1846982 - protein, 12 aa, Staphylococcus
ARPKKPEHVEQK

SEQ ID NO: 1846983 - protein, 12 aa, Staphylococcus
ARPKKPENVEQK

SEQ ID NO: 1846984 - protein, 4 aa, Staphylococcus
ARPT

SEQ ID NO: 1846985 - protein, 6 aa, Staphylococcus
ARPYSV

SEQ ID NO: 1846986 - protein, 38 aa, Staphylococcus
ARQAIDDEATIKKAEIENNHNATKEEKDVARQKVDEEV

SEQ ID NO: 1846987 - protein, 5 aa, Staphylococcus
ARQDD

SEQ ID NO: 1846988 - protein, 13 aa, Staphylococcus
ARQFDAAQQHQVS

SEQ ID NO: 1846989 - protein, 7 aa, Staphylococcus
ARQHNEK

SEQ ID NO: 1846990 - protein, 5 aa, Staphylococcus
ARQSI

SEQ ID NO: 1846991 - protein, 8 aa, Staphylococcus
ARSFHPQA

SEQ ID NO: 1846992 - protein, 7 aa, Staphylococcus
ARSGGGQ

SEQ ID NO: 1846993 - protein, 10 aa, Staphylococcus
ARSGNPNRAI

SEQ ID NO: 1846994 - protein, 5 aa, Staphylococcus
ARSKQ

SEQ ID NO: 1846995 - protein, 8 aa, Staphylococcus
ARSLGQRT

SEQ ID NO: 1846996 - protein, 4 aa, Staphylococcus
ARSM

SEQ ID NO: 1846997 - protein, 9 aa, Staphylococcus
ARTAEDKGF

SEQ ID NO: 1846998 - protein, 10 aa, Staphylococcus
ARTQNNANQA

SEQ ID NO: 1846999 - protein, 9 aa, Staphylococcus
ARTSDGSIA

SEQ ID NO: 1847000 - protein, 5 aa, Staphylococcus
ARTSN

SEQ ID NO: 1847001 - protein, 14 aa, Staphylococcus
ARTSNGSISLSGFG

SEQ ID NO: 1847002 - protein, 9 aa, Staphylococcus
ARTSTDLRP

SEQ ID NO: 1847003 - protein, 4 aa, Staphylococcus
ARTT

SEQ ID NO: 1847004 - protein, 10 aa, Staphylococcus
ARTTANMKKE

SEQ ID NO: 1847005 - protein, 5 aa, Staphylococcus
ARTTN

SEQ ID NO: 1847006 - protein, 11 aa, Staphylococcus
ARVERNGEAVE

SEQ ID NO: 1847007 - protein, 11 aa, Staphylococcus
ARVLRDNKEQM

SEQ ID NO: 1847008 - protein, 6 aa, Staphylococcus
ARYPDR

SEQ ID NO: 1847009 - protein, 6 aa, Staphylococcus
ASACNS

SEQ ID NO: 1847010 - protein, 7 aa, Staphylococcus
ASACNSG

SEQ ID NO: 1847011 - protein, 6 aa, Staphylococcus
ASADIA

SEQ ID NO: 1847012 - protein, 10 aa, Staphylococcus
ASAEEDSNWN

SEQ ID NO: 1847013 - protein, 5 aa, Staphylococcus
ASAGA

SEQ ID NO: 1847014 - protein, 8 aa, Staphylococcus
ASAGEGAV

SEQ ID NO: 1847015 - protein, 7 aa, Staphylococcus
ASAGHQE

SEQ ID NO: 1847016 - protein, 18 aa, Staphylococcus
ASAGVDAGLQGLNEAQGY

SEQ ID NO: 1847017 - protein, 5 aa, Staphylococcus
ASAKW

SEQ ID NO: 1847018 - protein, 29 aa, Staphylococcus
ASALGDSGSPASDSTLGPTAGLDIDGQHD

SEQ ID NO: 1847019 - protein, 30 aa, Staphylococcus
ASALGDSGSPASDSTLGPTAGLDVDGQHDH

SEQ ID NO: 1847020 - protein, 24 aa, Staphylococcus
ASALGDSGSPASDSTLGPTAGLNI

SEQ ID NO: 1847021 - protein, 24 aa, Staphylococcus
ASALGDSGSPASDSTLGPTAGLNM

SEQ ID NO: 1847022 - protein, 7 aa, Staphylococcus
ASANDGL

SEQ ID NO: 1847023 - protein, 8 aa, Staphylococcus
ASANDGLR

SEQ ID NO: 1847024 - protein, 5 aa, Staphylococcus
ASANV

SEQ ID NO: 1847025 - protein, 8 aa, Staphylococcus
ASAQALNG

SEQ ID NO: 1847026 - protein, 7 aa, Staphylococcus
ASASIDP

SEQ ID NO: 1847027 - protein, 7 aa, Staphylococcus
ASATYTV

SEQ ID NO: 1847028 - protein, 9 aa, Staphylococcus
ASDALTNPQ

SEQ ID NO: 1847029 - protein, 6 aa, Staphylococcus
ASDGAA

SEQ ID NO: 1847030 - protein, 5 aa, Staphylococcus
ASDHH

SEQ ID NO: 1847031 - protein, 7 aa, Staphylococcus
ASDHTGI

SEQ ID NO: 1847032 - protein, 20 aa, Staphylococcus
ASDIEGLTNPVNVDSHTVNK

SEQ ID NO: 1847033 - protein, 7 aa, Staphylococcus
ASDIQNS

SEQ ID NO: 1847034 - protein, 4 aa, Staphylococcus
ASDK

SEQ ID NO: 1847035 - protein, 10 aa, Staphylococcus
ASDKYSGNDL

SEQ ID NO: 1847036 - protein, 12 aa, Staphylococcus
ASDLKSPLDREQ

SEQ ID NO: 1847037 - protein, 7 aa, Staphylococcus
ASDNGSS

SEQ ID NO: 1847038 - protein, 9 aa, Staphylococcus
ASDNSNQDV

SEQ ID NO: 1847039 - protein, 5 aa, Staphylococcus
ASDQL

SEQ ID NO: 1847040 - protein, 8 aa, Staphylococcus
ASDQTGMN

SEQ ID NO: 1847041 - protein, 6 aa, Staphylococcus
ASDRTR

SEQ ID NO: 1847042 - protein, 7 aa, Staphylococcus
ASDRTRR

SEQ ID NO: 1847043 - protein, 14 aa, Staphylococcus
ASDSVNSKDAPKAV

SEQ ID NO: 1847044 - protein, 11 aa, Staphylococcus
ASDTGTGSALE

SEQ ID NO: 1847045 - protein, 5 aa, Staphylococcus
ASDYH

SEQ ID NO: 1847046 - protein, 17 aa, Staphylococcus
ASDYHQIKEDGEQIESR

SEQ ID NO: 1847047 - protein, 22 aa, Staphylococcus
ASEEGTFRGRNSNFNGEGFSRQ

SEQ ID NO: 1847048 - protein, 5 aa, Staphylococcus
ASEEV

SEQ ID NO: 1847049 - protein, 6 aa, Staphylococcus
ASEHRG

SEQ ID NO: 1847050 - protein, 6 aa, Staphylococcus
ASEIQT

SEQ ID NO: 1847051 - protein, 14 aa, Staphylococcus
ASEKPKGVRSDDSL

SEQ ID NO: 1847052 - protein, 6 aa, Staphylococcus
ASEKVI

SEQ ID NO: 1847053 - protein, 5 aa, Staphylococcus
ASEKY

SEQ ID NO: 1847054 - protein, 6 aa, Staphylococcus
ASEQSL

SEQ ID NO: 1847055 - protein, 6 aa, Staphylococcus
ASEQVE

SEQ ID NO: 1847056 - protein, 17 aa, Staphylococcus
ASERTIDANTSAGNTKV

SEQ ID NO: 1847057 - protein, 17 aa, Staphylococcus
ASERTIDTQTSAGSNKV

SEQ ID NO: 1847058 - protein, 112 aa, Staphylococcus
ASESLSGSLSTSTSKSTSDSTVVSESHSASDSYSESNSLSLANSVSKSTSESIEASASNSESMAASTSSSTAISESLSGSLSTSTRKSTSDSTVVSESHSASDSASEADSLS

SEQ ID NO: 1847059 - protein, 7 aa, Staphylococcus
ASESMGG

SEQ ID NO: 1847060 - protein, 14 aa, Staphylococcus
ASETLGNSDPSEKI

SEQ ID NO: 1847061 - protein, 14 aa, Staphylococcus
ASFESEKERKQKQY

SEQ ID NO: 1847062 - protein, 6 aa, Staphylococcus
ASFSPN

SEQ ID NO: 1847063 - protein, 5 aa, Staphylococcus
ASGAD

SEQ ID NO: 1847064 - protein, 6 aa, Staphylococcus
ASGAFG

SEQ ID NO: 1847065 - protein, 7 aa, Staphylococcus
ASGAGSI

SEQ ID NO: 1847066 - protein, 7 aa, Staphylococcus
ASGAGSV

SEQ ID NO: 1847067 - protein, 6 aa, Staphylococcus
ASGAYK

SEQ ID NO: 1847068 - protein, 6 aa, Staphylococcus
ASGDGV

SEQ ID NO: 1847069 - protein, 7 aa, Staphylococcus
ASGDGVA

SEQ ID NO: 1847070 - protein, 9 aa, Staphylococcus
ASGDTSDIK

SEQ ID NO: 1847071 - protein, 5 aa, Staphylococcus
ASGGG

SEQ ID NO: 1847072 - protein, 6 aa, Staphylococcus
ASGGGN

SEQ ID NO: 1847073 - protein, 8 aa, Staphylococcus
ASGISPNE

SEQ ID NO: 1847074 - protein, 9 aa, Staphylococcus
ASGISSRTP

SEQ ID NO: 1847075 - protein, 6 aa, Staphylococcus
ASGKPI

SEQ ID NO: 1847076 - protein, 6 aa, Staphylococcus
ASGKTI

SEQ ID NO: 1847077 - protein, 5 aa, Staphylococcus
ASGNG

SEQ ID NO: 1847078 - protein, 5 aa, Staphylococcus
ASGPF

SEQ ID NO: 1847079 - protein, 6 aa, Staphylococcus
ASGRTI

SEQ ID NO: 1847080 - protein, 6 aa, Staphylococcus
ASGSFE

SEQ ID NO: 1847081 - protein, 7 aa, Staphylococcus
ASGSGHR

SEQ ID NO: 1847082 - protein, 33 aa, Staphylococcus
ASGVAVAGAEAGAAATAPVEVEENTPDYNSREH

SEQ ID NO: 1847083 - protein, 7 aa, Staphylococcus
ASHEAYQ

SEQ ID NO: 1847084 - protein, 34 aa, Staphylococcus
ASHQSTSDNKTRIREQREAYKNSRQELKEERKLR

SEQ ID NO: 1847085 - protein, 7 aa, Staphylococcus
ASHQSYA

SEQ ID NO: 1847086 - protein, 23 aa, Staphylococcus
ASHVSGVDEGHGFTKDDNDTQEK

SEQ ID NO: 1847087 - protein, 4 aa, Staphylococcus
ASIG

SEQ ID NO: 1847088 - protein, 7 aa, Staphylococcus
ASIGADD

SEQ ID NO: 1847089 - protein, 4 aa, Staphylococcus
ASIK

SEQ ID NO: 1847090 - protein, 10 aa, Staphylococcus
ASISPNYKHG

SEQ ID NO: 1847091 - protein, 9 aa, Staphylococcus
ASKEDVKNA

SEQ ID NO: 1847092 - protein, 7 aa, Staphylococcus
ASKESKL

SEQ ID NO: 1847093 - protein, 6 aa, Staphylococcus
ASKGSG

SEQ ID NO: 1847094 - protein, 7 aa, Staphylococcus
ASKHNES

SEQ ID NO: 1847095 - protein, 4 aa, Staphylococcus
ASKI

SEQ ID NO: 1847096 - protein, 13 aa, Staphylococcus
ASKLGNKDKNLDN

SEQ ID NO: 1847097 - protein, 9 aa, Staphylococcus
ASKNFQPTM

SEQ ID NO: 1847098 - protein, 15 aa, Staphylococcus
ASKPKLKGDQEMKDT

SEQ ID NO: 1847099 - protein, 25 aa, Staphylococcus
ASLPDGRALGTGQQKNGVEGITSRK

SEQ ID NO: 1847100 - protein, 29 aa, Staphylococcus
ASLQPYKTNESQSSSNSKHKDLPYEQNTN

SEQ ID NO: 1847101 - protein, 12 aa, Staphylococcus
ASLSGAASGMTN

SEQ ID NO: 1847102 - protein, 8 aa, Staphylococcus
ASNDVPQA

SEQ ID NO: 1847103 - protein, 5 aa, Staphylococcus
ASNEK

SEQ ID NO: 1847104 - protein, 11 aa, Staphylococcus
ASNEPNDNVDY

SEQ ID NO: 1847105 - protein, 9 aa, Staphylococcus
ASNGESEEN

SEQ ID NO: 1847106 - protein, 6 aa, Staphylococcus
ASNGKG

SEQ ID NO: 1847107 - protein, 6 aa, Staphylococcus
ASNKEF

SEQ ID NO: 1847108 - protein, 4 aa, Staphylococcus
ASNL

SEQ ID NO: 1847109 - protein, 4 aa, Staphylococcus
ASNN

SEQ ID NO: 1847110 - protein, 6 aa, Staphylococcus
ASNNYM

SEQ ID NO: 1847111 - protein, 6 aa, Staphylococcus
ASNQEI

SEQ ID NO: 1847112 - protein, 18 aa, Staphylococcus
ASNQTNDVSSQERQPSAR

SEQ ID NO: 1847113 - protein, 4 aa, Staphylococcus
ASNS

SEQ ID NO: 1847114 - protein, 11 aa, Staphylococcus
ASNSGKVTYQF

SEQ ID NO: 1847115 - protein, 4 aa, Staphylococcus
ASNT

SEQ ID NO: 1847116 - protein, 5 aa, Staphylococcus
ASNVN

SEQ ID NO: 1847117 - protein, 5 aa, Staphylococcus
ASPDL

SEQ ID NO: 1847118 - protein, 6 aa, Staphylococcus
ASPDQV

SEQ ID NO: 1847119 - protein, 5 aa, Staphylococcus
ASPDV

SEQ ID NO: 1847120 - protein, 5 aa, Staphylococcus
ASPEF

SEQ ID NO: 1847121 - protein, 5 aa, Staphylococcus
ASPFI

SEQ ID NO: 1847122 - protein, 23 aa, Staphylococcus
ASPNYTESSDDRKETLNQSLNNA

SEQ ID NO: 1847123 - protein, 17 aa, Staphylococcus
ASPPDADPKTTEAYTEA

SEQ ID NO: 1847124 - protein, 17 aa, Staphylococcus
ASPPDADPKTTQAYTEA

SEQ ID NO: 1847125 - protein, 17 aa, Staphylococcus
ASPPNADPKTTEAYTEA

SEQ ID NO: 1847126 - protein, 8 aa, Staphylococcus
ASPSYETL

SEQ ID NO: 1847127 - protein, 18 aa, Staphylococcus
ASPYKTVESDAQTTQSDF

SEQ ID NO: 1847128 - protein, 12 aa, Staphylococcus
ASQADTEAFSKN

SEQ ID NO: 1847129 - protein, 21 aa, Staphylococcus
ASQAFSPDIQQYSGMTKAEMT

SEQ ID NO: 1847130 - protein, 7 aa, Staphylococcus
ASQATTV

SEQ ID NO: 1847131 - protein, 28 aa, Staphylococcus
ASQDGTSEVAKAYGATVYETKEDSQWYG

SEQ ID NO: 1847132 - protein, 8 aa, Staphylococcus
ASQDPAMA

SEQ ID NO: 1847133 - protein, 11 aa, Staphylococcus
ASQDSKEDSHI

SEQ ID NO: 1847134 - protein, 5 aa, Staphylococcus
ASQKV

SEQ ID NO: 1847135 - protein, 8 aa, Staphylococcus
ASQPNKNI

SEQ ID NO: 1847136 - protein, 4 aa, Staphylococcus
ASQQ

SEQ ID NO: 1847137 - protein, 30 aa, Staphylococcus
ASQQQTARDNVQQATKLDEIATAKANAQAL

SEQ ID NO: 1847138 - protein, 7 aa, Staphylococcus
ASQRNEK

SEQ ID NO: 1847139 - protein, 6 aa, Staphylococcus
ASQYQR

SEQ ID NO: 1847140 - protein, 11 aa, Staphylococcus
ASRKRGKEGTG

SEQ ID NO: 1847141 - protein, 7 aa, Staphylococcus
ASRNNTI

SEQ ID NO: 1847142 - protein, 11 aa, Staphylococcus
ASRTRGKQGTG

SEQ ID NO: 1847143 - protein, 12 aa, Staphylococcus
ASRTRGKQGTGL

SEQ ID NO: 1847144 - protein, 10 aa, Staphylococcus
ASRYTEPGDE

SEQ ID NO: 1847145 - protein, 10 aa, Staphylococcus
ASRYTQPGDA

SEQ ID NO: 1847146 - protein, 21 aa, Staphylococcus
ASRYTQPGDTISVKTDEDDRS

SEQ ID NO: 1847147 - protein, 11 aa, Staphylococcus
ASRYTSPGDAI

SEQ ID NO: 1847148 - protein, 9 aa, Staphylococcus
ASSAAGPAA

SEQ ID NO: 1847149 - protein, 8 aa, Staphylococcus
ASSACNSG

SEQ ID NO: 1847150 - protein, 6 aa, Staphylococcus
ASSATI

SEQ ID NO: 1847151 - protein, 12 aa, Staphylococcus
ASSDLGANPLTT

SEQ ID NO: 1847152 - protein, 10 aa, Staphylococcus
ASSDLGANTF

SEQ ID NO: 1847153 - protein, 9 aa, Staphylococcus
ASSDLGASP

SEQ ID NO: 1847154 - protein, 35 aa, Staphylococcus
ASSEVPSSKSLKDTQTSQSSVKTLPSTGDDTQQHS

SEQ ID NO: 1847155 - protein, 7 aa, Staphylococcus
ASSFGTL

SEQ ID NO: 1847156 - protein, 9 aa, Staphylococcus
ASSGPDEEW

SEQ ID NO: 1847157 - protein, 7 aa, Staphylococcus
ASSHKAE

SEQ ID NO: 1847158 - protein, 4 aa, Staphylococcus
ASSM

SEQ ID NO: 1847159 - protein, 6 aa, Staphylococcus
ASSNPV

SEQ ID NO: 1847160 - protein, 23 aa, Staphylococcus
ASSNYINEDNEPKEAYNQAVTNA

SEQ ID NO: 1847161 - protein, 7 aa, Staphylococcus
ASSQYKE

SEQ ID NO: 1847162 - protein, 6 aa, Staphylococcus
ASSSLD

SEQ ID NO: 1847163 - protein, 8 aa, Staphylococcus
ASSSLDRK

SEQ ID NO: 1847164 - protein, 6 aa, Staphylococcus
ASSTAE

SEQ ID NO: 1847165 - protein, 5 aa, Staphylococcus
ASTEH

SEQ ID NO: 1847166 - protein, 4 aa, Staphylococcus
ASTG

SEQ ID NO: 1847167 - protein, 8 aa, Staphylococcus
ASTGDSGF

SEQ ID NO: 1847168 - protein, 38 aa, Staphylococcus
ASTGIENAEVSHSNSIYNERNSQVSSGEVPAANGAQAF

SEQ ID NO: 1847169 - protein, 5 aa, Staphylococcus
ASTLL

SEQ ID NO: 1847170 - protein, 19 aa, Staphylococcus
ASTQLPKKYPDAYKQSPFK

SEQ ID NO: 1847171 - protein, 5 aa, Staphylococcus
ASTRI

SEQ ID NO: 1847172 - protein, 4 aa, Staphylococcus
ASTS

SEQ ID NO: 1847173 - protein, 7 aa, Staphylococcus
ASVGNEY

SEQ ID NO: 1847174 - protein, 8 aa, Staphylococcus
ASVGSSNM

SEQ ID NO: 1847175 - protein, 8 aa, Staphylococcus
ASVGTANM

SEQ ID NO: 1847176 - protein, 11 aa, Staphylococcus
ASVGTANMDNR

SEQ ID NO: 1847177 - protein, 6 aa, Staphylococcus
ASVSGT

SEQ ID NO: 1847178 - protein, 8 aa, Staphylococcus
ASVSRDQR

SEQ ID NO: 1847179 - protein, 12 aa, Staphylococcus
ASVTVTPQGNAD

SEQ ID NO: 1847180 - protein, 5 aa, Staphylococcus
ASVYN

SEQ ID NO: 1847181 - protein, 7 aa, Staphylococcus
ASVYSGT

SEQ ID NO: 1847182 - protein, 9 aa, Staphylococcus
ASYNNQVSQ

SEQ ID NO: 1847183 - protein, 5 aa, Staphylococcus
ASYPT

SEQ ID NO: 1847184 - protein, 21 aa, Staphylococcus
ATAAKEKQAKLTKGSKESQLT

SEQ ID NO: 1847185 - protein, 12 aa, Staphylococcus
ATAATNKKNRQL

SEQ ID NO: 1847186 - protein, 15 aa, Staphylococcus
ATAAVERAKSNSSIS

SEQ ID NO: 1847187 - protein, 29 aa, Staphylococcus
ATAGASEVTASEETHQADVAQTNNINEET

SEQ ID NO: 1847188 - protein, 4 aa, Staphylococcus
ATAL

SEQ ID NO: 1847189 - protein, 7 aa, Staphylococcus
ATALGTK

SEQ ID NO: 1847190 - protein, 13 aa, Staphylococcus
ATAPILKSKEKDI

SEQ ID NO: 1847191 - protein, 5 aa, Staphylococcus
ATAPT

SEQ ID NO: 1847192 - protein, 8 aa, Staphylococcus
ATAQSINS

SEQ ID NO: 1847193 - protein, 7 aa, Staphylococcus
ATAQSLN

SEQ ID NO: 1847194 - protein, 7 aa, Staphylococcus
ATATGST

SEQ ID NO: 1847195 - protein, 12 aa, Staphylococcus
ATDASGNVSTTS

SEQ ID NO: 1847196 - protein, 6 aa, Staphylococcus
ATDDKR

SEQ ID NO: 1847197 - protein, 8 aa, Staphylococcus
ATDDQGAK

SEQ ID NO: 1847198 - protein, 44 aa, Staphylococcus
ATDEEKAAAKAKVDEAVTTAKNAIDQTTNNVGVDAAKESGVESI

SEQ ID NO: 1847199 - protein, 5 aa, Staphylococcus
ATDGR

SEQ ID NO: 1847200 - protein, 53 aa, Staphylococcus
ATDHAEHPNSSTSDPIEATDTTPPSVPKVNTGLNGKANTYTPVSVSTDPNTKV

SEQ ID NO: 1847201 - protein, 4 aa, Staphylococcus
ATDK

SEQ ID NO: 1847202 - protein, 7 aa, Staphylococcus
ATDKNGV

SEQ ID NO: 1847203 - protein, 12 aa, Staphylococcus
ATDKSNNQTEQS

SEQ ID NO: 1847204 - protein, 43 aa, Staphylococcus
ATDNAARPNSSVSKPVKTTDTTPPPKPVVKGSMNGKAGTKDPI

SEQ ID NO: 1847205 - protein, 16 aa, Staphylococcus
ATDNAEHPNSTTSQPV

SEQ ID NO: 1847206 - protein, 13 aa, Staphylococcus
ATDNDNNQQTKTI

SEQ ID NO: 1847207 - protein, 11 aa, Staphylococcus
ATDNLKNEAEA

SEQ ID NO: 1847208 - protein, 19 aa, Staphylococcus
ATDNSGQAVTNKVRGLPEG

SEQ ID NO: 1847209 - protein, 19 aa, Staphylococcus
ATDNSGQAVTNKVSGLPEG

SEQ ID NO: 1847210 - protein, 19 aa, Staphylococcus
ATDNSGQTMTNTVSGLPEG

SEQ ID NO: 1847211 - protein, 32 aa, Staphylococcus
ATDNSGQTVTNTVSGLPSGVTFDSRTNTISGV

SEQ ID NO: 1847212 - protein, 18 aa, Staphylococcus
ATDQDKKQAEEMADQSAE

SEQ ID NO: 1847213 - protein, 10 aa, Staphylococcus
ATDQEDVAQT

SEQ ID NO: 1847214 - protein, 6 aa, Staphylococcus
ATDRRG

SEQ ID NO: 1847215 - protein, 6 aa, Staphylococcus
ATDVPT

SEQ ID NO: 1847216 - protein, 5 aa, Staphylococcus
ATDVS

SEQ ID NO: 1847217 - protein, 8 aa, Staphylococcus
ATEDQATK

SEQ ID NO: 1847218 - protein, 8 aa, Staphylococcus
ATEDQGAK

SEQ ID NO: 1847219 - protein, 10 aa, Staphylococcus
ATEDSQSEAI

SEQ ID NO: 1847220 - protein, 17 aa, Staphylococcus
ATEEEKEAAKQKVDEEV

SEQ ID NO: 1847221 - protein, 10 aa, Staphylococcus
ATEGTGQTHA

SEQ ID NO: 1847222 - protein, 15 aa, Staphylococcus
ATEKATIDYPNDQYE

SEQ ID NO: 1847223 - protein, 10 aa, Staphylococcus
ATEKDKHNRY

SEQ ID NO: 1847224 - protein, 11 aa, Staphylococcus
ATEKDKTVRYQ

SEQ ID NO: 1847225 - protein, 11 aa, Staphylococcus
ATEKDRADRYR

SEQ ID NO: 1847226 - protein, 14 aa, Staphylococcus
ATEKGTDSAEFTEN

SEQ ID NO: 1847227 - protein, 12 aa, Staphylococcus
ATEKNPKDRYQT

SEQ ID NO: 1847228 - protein, 11 aa, Staphylococcus
ATELGETETSM

SEQ ID NO: 1847229 - protein, 9 aa, Staphylococcus
ATENATKLN

SEQ ID NO: 1847230 - protein, 18 aa, Staphylococcus
ATETKGNSDESAESKINM

SEQ ID NO: 1847231 - protein, 29 aa, Staphylococcus
ATETKGNSDVSTESKVTMPRKEVAPEAPD

SEQ ID NO: 1847232 - protein, 30 aa, Staphylococcus
ATFDQKQDNDMETASEQEDGDETSRSHTTT

SEQ ID NO: 1847233 - protein, 7 aa, Staphylococcus
ATFKDTN

SEQ ID NO: 1847234 - protein, 5 aa, Staphylococcus
ATFPD

SEQ ID NO: 1847235 - protein, 5 aa, Staphylococcus
ATGAA

SEQ ID NO: 1847236 - protein, 10 aa, Staphylococcus
ATGASGTEGT

SEQ ID NO: 1847237 - protein, 5 aa, Staphylococcus
ATGDV

SEQ ID NO: 1847238 - protein, 6 aa, Staphylococcus
ATGGAQ

SEQ ID NO: 1847239 - protein, 11 aa, Staphylococcus
ATGGKENPKVK

SEQ ID NO: 1847240 - protein, 10 aa, Staphylococcus
ATGGSENPKI

SEQ ID NO: 1847241 - protein, 11 aa, Staphylococcus
ATGGSENPKVK

SEQ ID NO: 1847242 - protein, 10 aa, Staphylococcus
ATGGVDNPKV

SEQ ID NO: 1847243 - protein, 6 aa, Staphylococcus
ATGIKH

SEQ ID NO: 1847244 - protein, 7 aa, Staphylococcus
ATGKDVK

SEQ ID NO: 1847245 - protein, 7 aa, Staphylococcus
ATGKDVN

SEQ ID NO: 1847246 - protein, 5 aa, Staphylococcus
ATGLS

SEQ ID NO: 1847247 - protein, 9 aa, Staphylococcus
ATGNESSGI

SEQ ID NO: 1847248 - protein, 10 aa, Staphylococcus
ATGQAEPHMQ

SEQ ID NO: 1847249 - protein, 9 aa, Staphylococcus
ATGQAQPDM

SEQ ID NO: 1847250 - protein, 8 aa, Staphylococcus
ATGQEDSG

SEQ ID NO: 1847251 - protein, 7 aa, Staphylococcus
ATGQGRG

SEQ ID NO: 1847252 - protein, 8 aa, Staphylococcus
ATGQTEPH

SEQ ID NO: 1847253 - protein, 13 aa, Staphylococcus
ATGTAWGSASTAG

SEQ ID NO: 1847254 - protein, 14 aa, Staphylococcus
ATGTEIKKAMDSKN

SEQ ID NO: 1847255 - protein, 5 aa, Staphylococcus
ATGTW

SEQ ID NO: 1847256 - protein, 5 aa, Staphylococcus
ATGVK

SEQ ID NO: 1847257 - protein, 7 aa, Staphylococcus
ATGVKHT

SEQ ID NO: 1847258 - protein, 6 aa, Staphylococcus
ATGVNH

SEQ ID NO: 1847259 - protein, 6 aa, Staphylococcus
ATGVTH

SEQ ID NO: 1847260 - protein, 5 aa, Staphylococcus
ATHDY

SEQ ID NO: 1847261 - protein, 44 aa, Staphylococcus
ATIAGQGQSSDSGSDDNQDSESLMPSEPSSASSSKQGSSSSMPS

SEQ ID NO: 1847262 - protein, 10 aa, Staphylococcus
ATINSSKNYD

SEQ ID NO: 1847263 - protein, 7 aa, Staphylococcus
ATISKTY

SEQ ID NO: 1847264 - protein, 19 aa, Staphylococcus
ATISSHQRNHSGKPSNRTV

SEQ ID NO: 1847265 - protein, 9 aa, Staphylococcus
ATKAISGMS

SEQ ID NO: 1847266 - protein, 10 aa, Staphylococcus
ATKEMDDQKF

SEQ ID NO: 1847267 - protein, 6 aa, Staphylococcus
ATKGGA

SEQ ID NO: 1847268 - protein, 9 aa, Staphylococcus
ATKGPDLKD

SEQ ID NO: 1847269 - protein, 8 aa, Staphylococcus
ATKGSSIT

SEQ ID NO: 1847270 - protein, 9 aa, Staphylococcus
ATKGTLTGG

SEQ ID NO: 1847271 - protein, 14 aa, Staphylococcus
ATKGTLTGGAEVSG

SEQ ID NO: 1847272 - protein, 10 aa, Staphylococcus
ATKGTLTGGL

SEQ ID NO: 1847273 - protein, 10 aa, Staphylococcus
ATKGTLTGGV

SEQ ID NO: 1847274 - protein, 11 aa, Staphylococcus
ATKGTLTGGVE

SEQ ID NO: 1847275 - protein, 13 aa, Staphylococcus
ATKGTLTGGVPVS

SEQ ID NO: 1847276 - protein, 7 aa, Staphylococcus
ATKNAVG

SEQ ID NO: 1847277 - protein, 10 aa, Staphylococcus
ATKNIDGKKF

SEQ ID NO: 1847278 - protein, 8 aa, Staphylococcus
ATKNNESK

SEQ ID NO: 1847279 - protein, 5 aa, Staphylococcus
ATKQL

SEQ ID NO: 1847280 - protein, 6 aa, Staphylococcus
ATKQNT

SEQ ID NO: 1847281 - protein, 7 aa, Staphylococcus
ATKQTDL

SEQ ID NO: 1847282 - protein, 10 aa, Staphylococcus
ATKSSKAEAM

SEQ ID NO: 1847283 - protein, 13 aa, Staphylococcus
ATKTENGKDYKGQ

SEQ ID NO: 1847284 - protein, 9 aa, Staphylococcus
ATKTNDNWS

SEQ ID NO: 1847285 - protein, 8 aa, Staphylococcus
ATKTPGRY

SEQ ID NO: 1847286 - protein, 9 aa, Staphylococcus
ATKVEGNLI

SEQ ID NO: 1847287 - protein, 10 aa, Staphylococcus
ATKYSRGDKR

SEQ ID NO: 1847288 - protein, 6 aa, Staphylococcus
ATLNNN

SEQ ID NO: 1847289 - protein, 6 aa, Staphylococcus
ATLPTH

SEQ ID NO: 1847290 - protein, 9 aa, Staphylococcus
ATMGATSRV

SEQ ID NO: 1847291 - protein, 7 aa, Staphylococcus
ATMKSKQ

SEQ ID NO: 1847292 - protein, 13 aa, Staphylococcus
ATNDSKAEGISTW

SEQ ID NO: 1847293 - protein, 6 aa, Staphylococcus
ATNGRT

SEQ ID NO: 1847294 - protein, 13 aa, Staphylococcus
ATNSETVNVTEDF

SEQ ID NO: 1847295 - protein, 8 aa, Staphylococcus
ATNSGVYT

SEQ ID NO: 1847296 - protein, 9 aa, Staphylococcus
ATNSSTPVF

SEQ ID NO: 1847297 - protein, 9 aa, Staphylococcus
ATNSSYPVY

SEQ ID NO: 1847298 - protein, 6 aa, Staphylococcus
ATPETL

SEQ ID NO: 1847299 - protein, 5 aa, Staphylococcus
ATPFS

SEQ ID NO: 1847300 - protein, 17 aa, Staphylococcus
ATPHNGTPAADKLGNTD

SEQ ID NO: 1847301 - protein, 6 aa, Staphylococcus
ATPKYQ

SEQ ID NO: 1847302 - protein, 17 aa, Staphylococcus
ATPNKAARDKLPKEVRE

SEQ ID NO: 1847303 - protein, 10 aa, Staphylococcus
ATPNKAARNL

SEQ ID NO: 1847304 - protein, 10 aa, Staphylococcus
ATPNKAARQL

SEQ ID NO: 1847305 - protein, 9 aa, Staphylococcus
ATPSDSEVK

SEQ ID NO: 1847306 - protein, 9 aa, Staphylococcus
ATPSLQKEA

SEQ ID NO: 1847307 - protein, 7 aa, Staphylococcus
ATPSTDM

SEQ ID NO: 1847308 - protein, 19 aa, Staphylococcus
ATPSTDTAISHSPEEKVGV

SEQ ID NO: 1847309 - protein, 18 aa, Staphylococcus
ATPSTDTAISNCAESEVG

SEQ ID NO: 1847310 - protein, 19 aa, Staphylococcus
ATPSTDTAISNSPEDKVGV

SEQ ID NO: 1847311 - protein, 20 aa, Staphylococcus
ATPSTDTAVAEAPDEKVGVA

SEQ ID NO: 1847312 - protein, 20 aa, Staphylococcus
ATPSTDTAVDQAPDDKVGVA

SEQ ID NO: 1847313 - protein, 22 aa, Staphylococcus
ATPSTDTAVSSAPDNKVGAASG

SEQ ID NO: 1847314 - protein, 21 aa, Staphylococcus
ATPSTDTAVTTAPDDKVGVAS

SEQ ID NO: 1847315 - protein, 10 aa, Staphylococcus
ATPTLQRDAE

SEQ ID NO: 1847316 - protein, 8 aa, Staphylococcus
ATPTSAKY

SEQ ID NO: 1847317 - protein, 5 aa, Staphylococcus
ATPVH

SEQ ID NO: 1847318 - protein, 4 aa, Staphylococcus
ATQA

SEQ ID NO: 1847319 - protein, 7 aa, Staphylococcus
ATQAEND

SEQ ID NO: 1847320 - protein, 8 aa, Staphylococcus
ATQDPAMS

SEQ ID NO: 1847321 - protein, 10 aa, Staphylococcus
ATQDPAMSDT

SEQ ID NO: 1847322 - protein, 6 aa, Staphylococcus
ATQDPV

SEQ ID NO: 1847323 - protein, 8 aa, Staphylococcus
ATQIGTKG

SEQ ID NO: 1847324 - protein, 7 aa, Staphylococcus
ATQMGTQ

SEQ ID NO: 1847325 - protein, 25 aa, Staphylococcus
ATQNPELNKGTIEQATQAVQNAEQA

SEQ ID NO: 1847326 - protein, 7 aa, Staphylococcus
ATQTPGR

SEQ ID NO: 1847327 - protein, 4 aa, Staphylococcus
ATRQ

SEQ ID NO: 1847328 - protein, 7 aa, Staphylococcus
ATRSQTV

SEQ ID NO: 1847329 - protein, 22 aa, Staphylococcus
ATRYTQPGDSISITTTTDDSYQ

SEQ ID NO: 1847330 - protein, 21 aa, Staphylococcus
ATRYTQPGDTISITSEDTDKY

SEQ ID NO: 1847331 - protein, 10 aa, Staphylococcus
ATSAVSAFKA

SEQ ID NO: 1847332 - protein, 4 aa, Staphylococcus
ATSD

SEQ ID NO: 1847333 - protein, 11 aa, Staphylococcus
ATSFAKTSFSE

SEQ ID NO: 1847334 - protein, 10 aa, Staphylococcus
ATSKGEKQQL

SEQ ID NO: 1847335 - protein, 45 aa, Staphylococcus
ATSLSDKSKDKVKDNLDDLKDKHNLQTELTGNGMSGSVETGGASE

SEQ ID NO: 1847336 - protein, 24 aa, Staphylococcus
ATSMTQDGKDNVQDKVDKLEDDHN

SEQ ID NO: 1847337 - protein, 6 aa, Staphylococcus
ATSNKK

SEQ ID NO: 1847338 - protein, 6 aa, Staphylococcus
ATSPEE

SEQ ID NO: 1847339 - protein, 6 aa, Staphylococcus
ATSPKF

SEQ ID NO: 1847340 - protein, 12 aa, Staphylococcus
ATSSLDPENETL

SEQ ID NO: 1847341 - protein, 8 aa, Staphylococcus
ATTATGTI

SEQ ID NO: 1847342 - protein, 11 aa, Staphylococcus
ATTDPKKEKGL

SEQ ID NO: 1847343 - protein, 10 aa, Staphylococcus
ATTDPKREKG

SEQ ID NO: 1847344 - protein, 8 aa, Staphylococcus
ATTEQGAK

SEQ ID NO: 1847345 - protein, 5 aa, Staphylococcus
ATTFY

SEQ ID NO: 1847346 - protein, 6 aa, Staphylococcus
ATTGID

SEQ ID NO: 1847347 - protein, 7 aa, Staphylococcus
ATTKDGV

SEQ ID NO: 1847348 - protein, 26 aa, Staphylococcus
ATTKENEINANATATAQEKEAAIQNV

SEQ ID NO: 1847349 - protein, 8 aa, Staphylococcus
ATTNPKLE

SEQ ID NO: 1847350 - protein, 9 aa, Staphylococcus
ATTNQNNSY

SEQ ID NO: 1847351 - protein, 8 aa, Staphylococcus
ATTRSAGL

SEQ ID NO: 1847352 - protein, 13 aa, Staphylococcus
ATTSHEGFKDGTG

SEQ ID NO: 1847353 - protein, 29 aa, Staphylococcus
ATTSKYDDLDEAQKKGKVDPNLEDPEHFS

SEQ ID NO: 1847354 - protein, 7 aa, Staphylococcus
ATTSTAV

SEQ ID NO: 1847355 - protein, 7 aa, Staphylococcus
ATTTFSD

SEQ ID NO: 1847356 - protein, 6 aa, Staphylococcus
ATTTKL

SEQ ID NO: 1847357 - protein, 10 aa, Staphylococcus
ATTVEEDEVG

SEQ ID NO: 1847358 - protein, 7 aa, Staphylococcus
ATVAGIS

SEQ ID NO: 1847359 - protein, 11 aa, Staphylococcus
ATVGTANMDNR

SEQ ID NO: 1847360 - protein, 6 aa, Staphylococcus
ATYAST

SEQ ID NO: 1847361 - protein, 6 aa, Staphylococcus
ATYKLP

SEQ ID NO: 1847362 - protein, 11 aa, Staphylococcus
AVAEGGDTLDS

SEQ ID NO: 1847363 - protein, 45 aa, Staphylococcus
AVAESDKKADTKTTKPEKSKSASKAAPKPAEKRTNQTHEKASMDK

SEQ ID NO: 1847364 - protein, 18 aa, Staphylococcus
AVAGDSGKGRKTMQKARN

SEQ ID NO: 1847365 - protein, 4 aa, Staphylococcus
AVAP

SEQ ID NO: 1847366 - protein, 12 aa, Staphylococcus
AVAPEDKQAEIT

SEQ ID NO: 1847367 - protein, 7 aa, Staphylococcus
AVASQGS

SEQ ID NO: 1847368 - protein, 27 aa, Staphylococcus
AVATDDSGNSSTSDPKKATDTTPPDKP

SEQ ID NO: 1847369 - protein, 8 aa, Staphylococcus
AVATQAKN

SEQ ID NO: 1847370 - protein, 46 aa, Staphylococcus
AVDAAQKIEQAEFTPESVKPLETAKEAGKQLAADNAATPEQLKGAT

SEQ ID NO: 1847371 - protein, 8 aa, Staphylococcus
AVDADTEE

SEQ ID NO: 1847372 - protein, 12 aa, Staphylococcus
AVDSGQTEAARS

SEQ ID NO: 1847373 - protein, 14 aa, Staphylococcus
AVEEEEDGITKQER

SEQ ID NO: 1847374 - protein, 13 aa, Staphylococcus
AVEPNEDETPKQR

SEQ ID NO: 1847375 - protein, 8 aa, Staphylococcus
AVGASQAE

SEQ ID NO: 1847376 - protein, 8 aa, Staphylococcus
AVGDNNPY

SEQ ID NO: 1847377 - protein, 8 aa, Staphylococcus
AVGDSNPY

SEQ ID NO: 1847378 - protein, 8 aa, Staphylococcus
AVGGPVPE

SEQ ID NO: 1847379 - protein, 10 aa, Staphylococcus
AVGSSVKGGT

SEQ ID NO: 1847380 - protein, 86 aa, Staphylococcus
AVKATDQAIQSVQPETTVKDNAKQDIQNSINQQKDAVNQNPQATNEEKQLASNKLDDIANQVTGNIDHANTNNDVDQAKNEGTTQI

SEQ ID NO: 1847381 - protein, 4 aa, Staphylococcus
AVKD

SEQ ID NO: 1847382 - protein, 7 aa, Staphylococcus
AVKESPL

SEQ ID NO: 1847383 - protein, 7 aa, Staphylococcus
AVKNDGK

SEQ ID NO: 1847384 - protein, 8 aa, Staphylococcus
AVKSPAIA

SEQ ID NO: 1847385 - protein, 19 aa, Staphylococcus
AVNDNNEPTKQSGNYINAD

SEQ ID NO: 1847386 - protein, 5 aa, Staphylococcus
AVNED

SEQ ID NO: 1847387 - protein, 11 aa, Staphylococcus
AVNPPKSDVNE

SEQ ID NO: 1847388 - protein, 6 aa, Staphylococcus
AVNTDS

SEQ ID NO: 1847389 - protein, 6 aa, Staphylococcus
AVNTPA

SEQ ID NO: 1847390 - protein, 7 aa, Staphylococcus
AVPALNE

SEQ ID NO: 1847391 - protein, 8 aa, Staphylococcus
AVPTYKDE

SEQ ID NO: 1847392 - protein, 6 aa, Staphylococcus
AVQASE

SEQ ID NO: 1847393 - protein, 23 aa, Staphylococcus
AVQKGTDQEKIAKTEIENADVTS

SEQ ID NO: 1847394 - protein, 21 aa, Staphylococcus
AVQKSTEQEKIAQTEIENASI

SEQ ID NO: 1847395 - protein, 5 aa, Staphylococcus
AVQSL

SEQ ID NO: 1847396 - protein, 6 aa, Staphylococcus
AVRADA

SEQ ID NO: 1847397 - protein, 8 aa, Staphylococcus
AVRADSLN

SEQ ID NO: 1847398 - protein, 8 aa, Staphylococcus
AVRPEQTQ

SEQ ID NO: 1847399 - protein, 6 aa, Staphylococcus
AVRYSE

SEQ ID NO: 1847400 - protein, 7 aa, Staphylococcus
AVRYSEV

SEQ ID NO: 1847401 - protein, 7 aa, Staphylococcus
AVSGFGN

SEQ ID NO: 1847402 - protein, 25 aa, Staphylococcus
AVSKNNSNTEITGTAPNVTSQTTKA

SEQ ID NO: 1847403 - protein, 10 aa, Staphylococcus
AVSNEQLKRM

SEQ ID NO: 1847404 - protein, 10 aa, Staphylococcus
AVSQAASQCH

SEQ ID NO: 1847405 - protein, 7 aa, Staphylococcus
AVSSEQL

SEQ ID NO: 1847406 - protein, 4 aa, Staphylococcus
AVST

SEQ ID NO: 1847407 - protein, 11 aa, Staphylococcus
AVSTKDISGEI

SEQ ID NO: 1847408 - protein, 50 aa, Staphylococcus
AVTAAKQAITQATTNDNVDQEQNSGTSTITGIQPEVTKKAAARKAIDDEV

SEQ ID NO: 1847409 - protein, 9 aa, Staphylococcus
AVTNKPNEL

SEQ ID NO: 1847410 - protein, 8 aa, Staphylococcus
AVTPNRDK

SEQ ID NO: 1847411 - protein, 5 aa, Staphylococcus
AVTQS

SEQ ID NO: 1847412 - protein, 40 aa, Staphylococcus
AVTRAESNLHGDTKLQQDKDRAKQAISQLPNLNDAQKHME

SEQ ID NO: 1847413 - protein, 6 aa, Staphylococcus
AVTSPA

SEQ ID NO: 1847414 - protein, 11 aa, Staphylococcus
AVTSVGDSNPY

SEQ ID NO: 1847415 - protein, 30 aa, Staphylococcus
AVTTANDEINAATTNAQVDTAVQNGETNIG

SEQ ID NO: 1847416 - protein, 18 aa, Staphylococcus
AVYDKKNKKVDVGSDVGN

SEQ ID NO: 1847417 - protein, 18 aa, Staphylococcus
AVYDKNKKSVDVGSDVGN

SEQ ID NO: 1847418 - protein, 6 aa, Staphylococcus
AWSQSA

SEQ ID NO: 1847419 - protein, 14 aa, Staphylococcus
AYAKQNNDGHYTDI

SEQ ID NO: 1847420 - protein, 4 aa, Staphylococcus
AYAT

SEQ ID NO: 1847421 - protein, 5 aa, Staphylococcus
AYDAT

SEQ ID NO: 1847422 - protein, 11 aa, Staphylococcus
AYDKAKAQYDI

SEQ ID NO: 1847423 - protein, 51 aa, Staphylococcus
AYDPANNVSTSAPRKATDTTPPTKPRVTSPLGGKAGTTDPVTVTTDPNTNV

SEQ ID NO: 1847424 - protein, 12 aa, Staphylococcus
AYDTKGKIADLD

SEQ ID NO: 1847425 - protein, 12 aa, Staphylococcus
AYDTNDKIAELD

SEQ ID NO: 1847426 - protein, 38 aa, Staphylococcus
AYDTNGKIADLDSKIEQQSSKNSAIQSEIKKSSSYQRI

SEQ ID NO: 1847427 - protein, 9 aa, Staphylococcus
AYDTRGKIA

SEQ ID NO: 1847428 - protein, 38 aa, Staphylococcus
AYDTRGKIADLDQKIEKQTSENSALKSEIKKNSSYERI

SEQ ID NO: 1847429 - protein, 38 aa, Staphylococcus
AYDTRGKIAELDQKIEKQSSENSALKSEIKKNSSYERI

SEQ ID NO: 1847430 - protein, 5 aa, Staphylococcus
AYEPE

SEQ ID NO: 1847431 - protein, 4 aa, Staphylococcus
AYEV

SEQ ID NO: 1847432 - protein, 4 aa, Staphylococcus
AYGE

SEQ ID NO: 1847433 - protein, 7 aa, Staphylococcus
AYGGPDM

SEQ ID NO: 1847434 - protein, 12 aa, Staphylococcus
AYGGPTASMDSV

SEQ ID NO: 1847435 - protein, 6 aa, Staphylococcus
AYGGPV

SEQ ID NO: 1847436 - protein, 7 aa, Staphylococcus
AYGRDGE

SEQ ID NO: 1847437 - protein, 7 aa, Staphylococcus
AYGYDGK

SEQ ID NO: 1847438 - protein, 6 aa, Staphylococcus
AYHGIK

SEQ ID NO: 1847439 - protein, 19 aa, Staphylococcus
AYKEDASIAYQTKEDIDSN

SEQ ID NO: 1847440 - protein, 17 aa, Staphylococcus
AYKEDASIAYQTKEEID

SEQ ID NO: 1847441 - protein, 17 aa, Staphylococcus
AYKEDEQIAYQTKEEID

SEQ ID NO: 1847442 - protein, 18 aa, Staphylococcus
AYKEDETIAYQTKEDIDS

SEQ ID NO: 1847443 - protein, 5 aa, Staphylococcus
AYKEN

SEQ ID NO: 1847444 - protein, 18 aa, Staphylococcus
AYKENASIAYQNKEDIDA

SEQ ID NO: 1847445 - protein, 18 aa, Staphylococcus
AYKENDTIAYQSKKDIDK

SEQ ID NO: 1847446 - protein, 5 aa, Staphylococcus
AYNGE

SEQ ID NO: 1847447 - protein, 16 aa, Staphylococcus
AYNGEDYLPPLSIRFF

SEQ ID NO: 1847448 - protein, 9 aa, Staphylococcus
AYNPKPKEL

SEQ ID NO: 1847449 - protein, 9 aa, Staphylococcus
AYNPKPKEM

SEQ ID NO: 1847450 - protein, 9 aa, Staphylococcus
AYNPKPKNI

SEQ ID NO: 1847451 - protein, 8 aa, Staphylococcus
AYNQNATT

SEQ ID NO: 1847452 - protein, 7 aa, Staphylococcus
AYNQRDN

SEQ ID NO: 1847453 - protein, 22 aa, Staphylococcus
AYPALGQTQIAANPPKSEANEI

SEQ ID NO: 1847454 - protein, 6 aa, Staphylococcus
AYQGHK

SEQ ID NO: 1847455 - protein, 28 aa, Staphylococcus
AYQGKADNDADKRHEATSKLNEDSELQD

SEQ ID NO: 1847456 - protein, 15 aa, Staphylococcus
AYQHAKQEAQTESNL

SEQ ID NO: 1847457 - protein, 9 aa, Staphylococcus
AYQKSQVKV

SEQ ID NO: 1847458 - protein, 4 aa, Staphylococcus
AYRD

SEQ ID NO: 1847459 - protein, 12 aa, Staphylococcus
AYRGDAELDADV

SEQ ID NO: 1847460 - protein, 23 aa, Staphylococcus
AYRREGDITSLGTQKEFKEEEMP

SEQ ID NO: 1847461 - protein, 5 aa, Staphylococcus
AYRTG

SEQ ID NO: 1847462 - protein, 5 aa, Staphylococcus
AYSGA

SEQ ID NO: 1847463 - protein, 10 aa, Staphylococcus
AYSNGDGYHL

SEQ ID NO: 1847464 - protein, 10 aa, Staphylococcus
AYSQNGFSHP

SEQ ID NO: 1847465 - protein, 7 aa, Staphylococcus
AYSQQGL

SEQ ID NO: 1847466 - protein, 10 aa, Staphylococcus
AYSSGDGYHL

SEQ ID NO: 1847467 - protein, 18 aa, Staphylococcus
AYTDANGKEHKYSATSGQ

SEQ ID NO: 1847468 - protein, 24 aa, Staphylococcus
AYTREGDISALGSQKEFKESEMPG

SEQ ID NO: 1847469 - protein, 13 aa, Staphylococcus
AYVDPDNEQKIQS

SEQ ID NO: 1847470 - protein, 12 aa, Staphylococcus
AYVGSGAAQFKN

SEQ ID NO: 1847471 - protein, 7 aa, Staphylococcus
CATGTYY

SEQ ID NO: 1847472 - protein, 10 aa, Staphylococcus
CATGTYYRAG

SEQ ID NO: 1847473 - protein, 11 aa, Staphylococcus
CDEAKRQSYDS

SEQ ID NO: 1847474 - protein, 4 aa, Staphylococcus
CDHC

SEQ ID NO: 1847475 - protein, 16 aa, Staphylococcus
CEGEKRAKDALNDKGL

SEQ ID NO: 1847476 - protein, 16 aa, Staphylococcus
CEGEKRAKKELDEKGL

SEQ ID NO: 1847477 - protein, 14 aa, Staphylococcus
CEGEKRAKQELDKH

SEQ ID NO: 1847478 - protein, 4 aa, Staphylococcus
CGAD

SEQ ID NO: 1847479 - protein, 5 aa, Staphylococcus
CGKDR

SEQ ID NO: 1847480 - protein, 7 aa, Staphylococcus
CGNGNDT

SEQ ID NO: 1847481 - protein, 27 aa, Staphylococcus
CGTPVDQHQHPSRASQHNNHSPRKPMS

SEQ ID NO: 1847482 - protein, 6 aa, Staphylococcus
CKQDNH

SEQ ID NO: 1847483 - protein, 9 aa, Staphylococcus
CNDAITNPQ

SEQ ID NO: 1847484 - protein, 5 aa, Staphylococcus
CNEDE

SEQ ID NO: 1847485 - protein, 4 aa, Staphylococcus
CNRK

SEQ ID NO: 1847486 - protein, 5 aa, Staphylococcus
CSNYN

SEQ ID NO: 1847487 - protein, 17 aa, Staphylococcus
CTGNLGTSFSNGEPVTE

SEQ ID NO: 1847488 - protein, 6 aa, Staphylococcus
DAALSG

SEQ ID NO: 1847489 - protein, 9 aa, Staphylococcus
DAANEKSNV

SEQ ID NO: 1847490 - protein, 11 aa, Staphylococcus
DAATKNQQVEA

SEQ ID NO: 1847491 - protein, 8 aa, Staphylococcus
DAATQAGG

SEQ ID NO: 1847492 - protein, 9 aa, Staphylococcus
DADPFYSQN

SEQ ID NO: 1847493 - protein, 13 aa, Staphylococcus
DADVTDDSGSPVE

SEQ ID NO: 1847494 - protein, 9 aa, Staphylococcus
DAEGDFGRV

SEQ ID NO: 1847495 - protein, 8 aa, Staphylococcus
DAEGKTYH

SEQ ID NO: 1847496 - protein, 11 aa, Staphylococcus
DAEKTNVNGGA

SEQ ID NO: 1847497 - protein, 8 aa, Staphylococcus
DAENHEST

SEQ ID NO: 1847498 - protein, 6 aa, Staphylococcus
DAENPV

SEQ ID NO: 1847499 - protein, 7 aa, Staphylococcus
DAENTSK

SEQ ID NO: 1847500 - protein, 7 aa, Staphylococcus
DAEQQIS

SEQ ID NO: 1847501 - protein, 7 aa, Staphylococcus
DAESDSQ

SEQ ID NO: 1847502 - protein, 22 aa, Staphylococcus
DAESIAKQLEAKGEVKYPNTGI

SEQ ID NO: 1847503 - protein, 5 aa, Staphylococcus
DAFDQ

SEQ ID NO: 1847504 - protein, 4 aa, Staphylococcus
DAFG

SEQ ID NO: 1847505 - protein, 6 aa, Staphylococcus
DAFQGL

SEQ ID NO: 1847506 - protein, 19 aa, Staphylococcus
DAFQGLPVSNKSKGEEMAK

SEQ ID NO: 1847507 - protein, 7 aa, Staphylococcus
DAGEQAT

SEQ ID NO: 1847508 - protein, 7 aa, Staphylococcus
DAGNYGH

SEQ ID NO: 1847509 - protein, 5 aa, Staphylococcus
DAGSW

SEQ ID NO: 1847510 - protein, 6 aa, Staphylococcus
DAGTRI

SEQ ID NO: 1847511 - protein, 7 aa, Staphylococcus
DAHADNF

SEQ ID NO: 1847512 - protein, 22 aa, Staphylococcus
DAIATGHSYAKEHDWTTPSKAI

SEQ ID NO: 1847513 - protein, 29 aa, Staphylococcus
DAIDDAYDKKMDEDDDSDSSDSGEVTRSN

SEQ ID NO: 1847514 - protein, 23 aa, Staphylococcus
DAIDGKGKAMKDAIKAKDQTQLK

SEQ ID NO: 1847515 - protein, 6 aa, Staphylococcus
DAIPED

SEQ ID NO: 1847516 - protein, 13 aa, Staphylococcus
DAISETKDALNGI

SEQ ID NO: 1847517 - protein, 6 aa, Staphylococcus
DAITSA

SEQ ID NO: 1847518 - protein, 4 aa, Staphylococcus
DAIV

SEQ ID NO: 1847519 - protein, 105 aa, Staphylococcus
DAKALDAKQAPKKDPKNQNVTTTKEKTPKNQETKNQGTTKQGPAATTGNGKVAQAQPGKDQTAKVTTEQKTGQNLAQAKVTKDEAKAQQKAEAAKKQLPETGEQD

SEQ ID NO: 1847520 - protein, 22 aa, Staphylococcus
DAKDNSGQAVTNKVSGLPNGVT

SEQ ID NO: 1847521 - protein, 20 aa, Staphylococcus
DAKDNSGQAVTNTVRGLPNG

SEQ ID NO: 1847522 - protein, 33 aa, Staphylococcus
DAKDNSGQEVTNTVRDLPSGVTFDPSTNTISGI

SEQ ID NO: 1847523 - protein, 38 aa, Staphylococcus
DAKDNSGQEVTNTVRGLPSGVTFDPRTNTISGVATKVG

SEQ ID NO: 1847524 - protein, 33 aa, Staphylococcus
DAKDNSGQPVTNTVSGLPSGVTFDPTTNTISGI

SEQ ID NO: 1847525 - protein, 10 aa, Staphylococcus
DAKDNSLGSV

SEQ ID NO: 1847526 - protein, 10 aa, Staphylococcus
DAKDSSGEYV

SEQ ID NO: 1847527 - protein, 9 aa, Staphylococcus
DAKDSSGQY

SEQ ID NO: 1847528 - protein, 8 aa, Staphylococcus
DAKFDPKA

SEQ ID NO: 1847529 - protein, 32 aa, Staphylococcus
DAKKAQDAKDADEKAKQDAKDVDEKTKQAALD

SEQ ID NO: 1847530 - protein, 21 aa, Staphylococcus
DAKKAQDAKDTDAKTKQAALD

SEQ ID NO: 1847531 - protein, 8 aa, Staphylococcus
DAKKEDRK

SEQ ID NO: 1847532 - protein, 13 aa, Staphylococcus
DAKKQKVLDQDTF

SEQ ID NO: 1847533 - protein, 6 aa, Staphylococcus
DAKKRK

SEQ ID NO: 1847534 - protein, 6 aa, Staphylococcus
DAKNNE

SEQ ID NO: 1847535 - protein, 21 aa, Staphylococcus
DAKPITNNNLEKSSRKEQELK

SEQ ID NO: 1847536 - protein, 23 aa, Staphylococcus
DAKPKQSKKEQASRKVQELKRKR

SEQ ID NO: 1847537 - protein, 8 aa, Staphylococcus
DAKPPKIR

SEQ ID NO: 1847538 - protein, 13 aa, Staphylococcus
DAKSKKTISQDEF

SEQ ID NO: 1847539 - protein, 13 aa, Staphylococcus
DAKSKKTLSQDEF

SEQ ID NO: 1847540 - protein, 26 aa, Staphylococcus
DAKSTIADKDKSQSDKAKALKDVKKE

SEQ ID NO: 1847541 - protein, 8 aa, Staphylococcus
DAKSTLEH

SEQ ID NO: 1847542 - protein, 13 aa, Staphylococcus
DAKTGEILDIIEC

SEQ ID NO: 1847543 - protein, 9 aa, Staphylococcus
DAKTNDEVA

SEQ ID NO: 1847544 - protein, 9 aa, Staphylococcus
DAKTNRDGI

SEQ ID NO: 1847545 - protein, 117 aa, Staphylococcus
DAKTSTKDNKDDDTNNNESDSSATSGSADDTSSSNTGNSTSSSASPSSNTGSHQDASSSSSKATPSKEDSSSSAPKESEPQESKSAIPNSENTPKSSNDVTSNSAPSSAPSDSSSES

SEQ ID NO: 1847546 - protein, 30 aa, Staphylococcus
DALAGNETVKQTSNYINEDTAQKGNYDNYV

SEQ ID NO: 1847547 - protein, 4 aa, Staphylococcus
DALE

SEQ ID NO: 1847548 - protein, 13 aa, Staphylococcus
DAMASVPNKIREG

SEQ ID NO: 1847549 - protein, 5 aa, Staphylococcus
DAMEK

SEQ ID NO: 1847550 - protein, 6 aa, Staphylococcus
DAMEPN

SEQ ID NO: 1847551 - protein, 15 aa, Staphylococcus
DANDSIKREKGQRGL

SEQ ID NO: 1847552 - protein, 16 aa, Staphylococcus
DANDSVKREKGQRGLD

SEQ ID NO: 1847553 - protein, 5 aa, Staphylococcus
DANEI

SEQ ID NO: 1847554 - protein, 7 aa, Staphylococcus
DANGRTI

SEQ ID NO: 1847555 - protein, 7 aa, Staphylococcus
DANKERK

SEQ ID NO: 1847556 - protein, 7 aa, Staphylococcus
DANQTVQ

SEQ ID NO: 1847557 - protein, 8 aa, Staphylococcus
DANQTVQQ

SEQ ID NO: 1847558 - protein, 6 aa, Staphylococcus
DANRER

SEQ ID NO: 1847559 - protein, 9 aa, Staphylococcus
DANSERKAL

SEQ ID NO: 1847560 - protein, 16 aa, Staphylococcus
DANTDTVIGNGDIQAG

SEQ ID NO: 1847561 - protein, 9 aa, Staphylococcus
DANVNRTSY

SEQ ID NO: 1847562 - protein, 4 aa, Staphylococcus
DANY

SEQ ID NO: 1847563 - protein, 5 aa, Staphylococcus
DAPNN

SEQ ID NO: 1847564 - protein, 9 aa, Staphylococcus
DAPNTYEGR

SEQ ID NO: 1847565 - protein, 4 aa, Staphylococcus
DAPV

SEQ ID NO: 1847566 - protein, 53 aa, Staphylococcus
DAQASEHLNPTQQHTNNNPENSINESSNTSIKPSDNKNTTGQVQSNQTSDTIR

SEQ ID NO: 1847567 - protein, 8 aa, Staphylococcus
DAQEADVL

SEQ ID NO: 1847568 - protein, 45 aa, Staphylococcus
DAQEEDRISNEESTKETGEKASTSNESSLSTAKQSSTNEENKLDE

SEQ ID NO: 1847569 - protein, 11 aa, Staphylococcus
DAQGTTVSGKV

SEQ ID NO: 1847570 - protein, 8 aa, Staphylococcus
DAQNHEST

SEQ ID NO: 1847571 - protein, 13 aa, Staphylococcus
DAQNRNQEVNNRL

SEQ ID NO: 1847572 - protein, 24 aa, Staphylococcus
DAQRAKAKENVEHATTRSNITSQL

SEQ ID NO: 1847573 - protein, 6 aa, Staphylococcus
DAQRHR

SEQ ID NO: 1847574 - protein, 18 aa, Staphylococcus
DAQTSTAIIGPSGSGKST

SEQ ID NO: 1847575 - protein, 10 aa, Staphylococcus
DAQYQEYKDN

SEQ ID NO: 1847576 - protein, 21 aa, Staphylococcus
DARDNSGQAVTNTVNGLPEGV

SEQ ID NO: 1847577 - protein, 20 aa, Staphylococcus
DARDNSGQAVTNTVRGLPEG

SEQ ID NO: 1847578 - protein, 9 aa, Staphylococcus
DASGISPNE

SEQ ID NO: 1847579 - protein, 6 aa, Staphylococcus
DASMAN

SEQ ID NO: 1847580 - protein, 5 aa, Staphylococcus
DASNS

SEQ ID NO: 1847581 - protein, 7 aa, Staphylococcus
DASNSKL

SEQ ID NO: 1847582 - protein, 7 aa, Staphylococcus
DASNSNL

SEQ ID NO: 1847583 - protein, 6 aa, Staphylococcus
DASNTK

SEQ ID NO: 1847584 - protein, 7 aa, Staphylococcus
DASPTMI

SEQ ID NO: 1847585 - protein, 7 aa, Staphylococcus
DASYPGR

SEQ ID NO: 1847586 - protein, 9 aa, Staphylococcus
DATAKENDF

SEQ ID NO: 1847587 - protein, 37 aa, Staphylococcus
DATDENQAREDGSEADNTSSQDTKHSAQSTTTTDITA

SEQ ID NO: 1847588 - protein, 8 aa, Staphylococcus
DATEKENE

SEQ ID NO: 1847589 - protein, 9 aa, Staphylococcus
DATGTATPI

SEQ ID NO: 1847590 - protein, 21 aa, Staphylococcus
DATIDAKDIEKLKAEASAMEN

SEQ ID NO: 1847591 - protein, 10 aa, Staphylococcus
DATKDKAMQE

SEQ ID NO: 1847592 - protein, 8 aa, Staphylococcus
DATKNYTK

SEQ ID NO: 1847593 - protein, 8 aa, Staphylococcus
DATKTGGS

SEQ ID NO: 1847594 - protein, 13 aa, Staphylococcus
DATNETLKAYPNL

SEQ ID NO: 1847595 - protein, 13 aa, Staphylococcus
DATNKDELGPVKR

SEQ ID NO: 1847596 - protein, 18 aa, Staphylococcus
DATNSDDIGPVKQKIKGN

SEQ ID NO: 1847597 - protein, 18 aa, Staphylococcus
DATNSDQVGPVKDKIKGN

SEQ ID NO: 1847598 - protein, 15 aa, Staphylococcus
DATQAENINNAIQTN

SEQ ID NO: 1847599 - protein, 9 aa, Staphylococcus
DATQEEKDV

SEQ ID NO: 1847600 - protein, 4 aa, Staphylococcus
DATS

SEQ ID NO: 1847601 - protein, 8 aa, Staphylococcus
DATSEEND

SEQ ID NO: 1847602 - protein, 7 aa, Staphylococcus
DATSPFE

SEQ ID NO: 1847603 - protein, 18 aa, Staphylococcus
DATTADKVISEKDHKIEK

SEQ ID NO: 1847604 - protein, 13 aa, Staphylococcus
DATVEEKDAAIND

SEQ ID NO: 1847605 - protein, 9 aa, Staphylococcus
DATVEEKQE

SEQ ID NO: 1847606 - protein, 15 aa, Staphylococcus
DAVLSPSQIATQYGY

SEQ ID NO: 1847607 - protein, 8 aa, Staphylococcus
DAVNSANE

SEQ ID NO: 1847608 - protein, 7 aa, Staphylococcus
DAVSGAI

SEQ ID NO: 1847609 - protein, 13 aa, Staphylococcus
DAVSKANDSIPKI

SEQ ID NO: 1847610 - protein, 7 aa, Staphylococcus
DAVSSAL

SEQ ID NO: 1847611 - protein, 6 aa, Staphylococcus
DAYGRK

SEQ ID NO: 1847612 - protein, 6 aa, Staphylococcus
DAYNDQ

SEQ ID NO: 1847613 - protein, 8 aa, Staphylococcus
DAYNQTSG

SEQ ID NO: 1847614 - protein, 15 aa, Staphylococcus
DDAERQQENLGQRSD

SEQ ID NO: 1847615 - protein, 5 aa, Staphylococcus
DDANE

SEQ ID NO: 1847616 - protein, 13 aa, Staphylococcus
DDAPTYRTKSKEH

SEQ ID NO: 1847617 - protein, 23 aa, Staphylococcus
DDAQNALNGQSRFDAAQKEALKE

SEQ ID NO: 1847618 - protein, 15 aa, Staphylococcus
DDAQRHQENLGQRSD

SEQ ID NO: 1847619 - protein, 9 aa, Staphylococcus
DDATAYESF

SEQ ID NO: 1847620 - protein, 7 aa, Staphylococcus
DDATRKQ

SEQ ID NO: 1847621 - protein, 7 aa, Staphylococcus
DDDDAVD

SEQ ID NO: 1847622 - protein, 11 aa, Staphylococcus
DDDDEDSKELE

SEQ ID NO: 1847623 - protein, 5 aa, Staphylococcus
DDDEY

SEQ ID NO: 1847624 - protein, 14 aa, Staphylococcus
DDDKVDKDRLSNND

SEQ ID NO: 1847625 - protein, 11 aa, Staphylococcus
DDDPNKQKLTI

SEQ ID NO: 1847626 - protein, 9 aa, Staphylococcus
DDDPQKRKL

SEQ ID NO: 1847627 - protein, 39 aa, Staphylococcus
DDDSELANKYADTNVNPYADQTTNNEPENINTKTLNRGD

SEQ ID NO: 1847628 - protein, 6 aa, Staphylococcus
DDDTTE

SEQ ID NO: 1847629 - protein, 6 aa, Staphylococcus
DDEATD

SEQ ID NO: 1847630 - protein, 5 aa, Staphylococcus
DDEDY

SEQ ID NO: 1847631 - protein, 6 aa, Staphylococcus
DDEDYE

SEQ ID NO: 1847632 - protein, 4 aa, Staphylococcus
DDEE

SEQ ID NO: 1847633 - protein, 13 aa, Staphylococcus
DDEEETQPPKRSR

SEQ ID NO: 1847634 - protein, 6 aa, Staphylococcus
DDEEYE

SEQ ID NO: 1847635 - protein, 10 aa, Staphylococcus
DDEKFKTTTK

SEQ ID NO: 1847636 - protein, 24 aa, Staphylococcus
DDESKKINQRIKEQQQNKDSNIKN

SEQ ID NO: 1847637 - protein, 69 aa, Staphylococcus
DDETGRRPRHEPAYEKRDRELAEEEDDTRVYQPRRDGEGAAYTASEFKDEPESEHADAQASDNLEEEPQ

SEQ ID NO: 1847638 - protein, 7 aa, Staphylococcus
DDETREN

SEQ ID NO: 1847639 - protein, 12 aa, Staphylococcus
DDEYVFGDPFIR

SEQ ID NO: 1847640 - protein, 10 aa, Staphylococcus
DDFDESKNSK

SEQ ID NO: 1847641 - protein, 8 aa, Staphylococcus
DDFNPEGA

SEQ ID NO: 1847642 - protein, 7 aa, Staphylococcus
DDFNSYE

SEQ ID NO: 1847643 - protein, 12 aa, Staphylococcus
DDFTKAAKDKHV

SEQ ID NO: 1847644 - protein, 15 aa, Staphylococcus
DDGKINYDYNGQTHT

SEQ ID NO: 1847645 - protein, 20 aa, Staphylococcus
DDGNASAQQIAAEKTKVDQA

SEQ ID NO: 1847646 - protein, 10 aa, Staphylococcus
DDGNISLPAA

SEQ ID NO: 1847647 - protein, 14 aa, Staphylococcus
DDGNLSLPDAGQAV

SEQ ID NO: 1847648 - protein, 15 aa, Staphylococcus
DDGPDKVGVVSSDNE

SEQ ID NO: 1847649 - protein, 9 aa, Staphylococcus
DDGPEKRKA

SEQ ID NO: 1847650 - protein, 11 aa, Staphylococcus
DDGPGMSEETK

SEQ ID NO: 1847651 - protein, 5 aa, Staphylococcus
DDHIP

SEQ ID NO: 1847652 - protein, 4 aa, Staphylococcus
DDID

SEQ ID NO: 1847653 - protein, 14 aa, Staphylococcus
DDIKDNNESYRSNR

SEQ ID NO: 1847654 - protein, 5 aa, Staphylococcus
DDIKK

SEQ ID NO: 1847655 - protein, 5 aa, Staphylococcus
DDIPN

SEQ ID NO: 1847656 - protein, 7 aa, Staphylococcus
DDIPQTF

SEQ ID NO: 1847657 - protein, 4 aa, Staphylococcus
DDIQ

SEQ ID NO: 1847658 - protein, 5 aa, Staphylococcus
DDISN

SEQ ID NO: 1847659 - protein, 7 aa, Staphylococcus
DDITRSK

SEQ ID NO: 1847660 - protein, 11 aa, Staphylococcus
DDKDKAERRLN

SEQ ID NO: 1847661 - protein, 10 aa, Staphylococcus
DDKDKSSRHL

SEQ ID NO: 1847662 - protein, 8 aa, Staphylococcus
DDKDYTIS

SEQ ID NO: 1847663 - protein, 10 aa, Staphylococcus
DDKEANKGTI

SEQ ID NO: 1847664 - protein, 46 aa, Staphylococcus
DDKKHEQQEIKDQYSHNSDRESHDLNNHSKDNHHDFNSNDTKRDDF

SEQ ID NO: 1847665 - protein, 14 aa, Staphylococcus
DDKKLTNAKGVNDL

SEQ ID NO: 1847666 - protein, 9 aa, Staphylococcus
DDKKSLSAK

SEQ ID NO: 1847667 - protein, 16 aa, Staphylococcus
DDKNEHNKDHNKQHEH

SEQ ID NO: 1847668 - protein, 5 aa, Staphylococcus
DDKNI

SEQ ID NO: 1847669 - protein, 8 aa, Staphylococcus
DDKSSIQV

SEQ ID NO: 1847670 - protein, 6 aa, Staphylococcus
DDKTIT

SEQ ID NO: 1847671 - protein, 15 aa, Staphylococcus
DDKTYTISSDDKADI

SEQ ID NO: 1847672 - protein, 5 aa, Staphylococcus
DDKVG

SEQ ID NO: 1847673 - protein, 14 aa, Staphylococcus
DDKVNKDKLNDNPL

SEQ ID NO: 1847674 - protein, 9 aa, Staphylococcus
DDKVTQGQP

SEQ ID NO: 1847675 - protein, 16 aa, Staphylococcus
DDLDERSKKLKEDPYK

SEQ ID NO: 1847676 - protein, 5 aa, Staphylococcus
DDLDT

SEQ ID NO: 1847677 - protein, 5 aa, Staphylococcus
DDLGR

SEQ ID NO: 1847678 - protein, 10 aa, Staphylococcus
DDLNGKNLDK

SEQ ID NO: 1847679 - protein, 13 aa, Staphylococcus
DDLPRKEKDKVMN

SEQ ID NO: 1847680 - protein, 8 aa, Staphylococcus
DDLSTAQP

SEQ ID NO: 1847681 - protein, 15 aa, Staphylococcus
DDLTDKYGQASRTYP

SEQ ID NO: 1847682 - protein, 11 aa, Staphylococcus
DDMKSRDKDVN

SEQ ID NO: 1847683 - protein, 4 aa, Staphylococcus
DDMP

SEQ ID NO: 1847684 - protein, 10 aa, Staphylococcus
DDNATPAQVT

SEQ ID NO: 1847685 - protein, 4 aa, Staphylococcus
DDND

SEQ ID NO: 1847686 - protein, 12 aa, Staphylococcus
DDNGSLEDRRSG

SEQ ID NO: 1847687 - protein, 9 aa, Staphylococcus
DDNKLSGKI

SEQ ID NO: 1847688 - protein, 11 aa, Staphylococcus
DDNKTSKTTIK

SEQ ID NO: 1847689 - protein, 14 aa, Staphylococcus
DDNKVDKDALDDNT

SEQ ID NO: 1847690 - protein, 15 aa, Staphylococcus
DDNKVDKDALSDNPL

SEQ ID NO: 1847691 - protein, 14 aa, Staphylococcus
DDNKVDKEALSNNT

SEQ ID NO: 1847692 - protein, 8 aa, Staphylococcus
DDNMSPTL

SEQ ID NO: 1847693 - protein, 29 aa, Staphylococcus
DDNNKKPDKNSHIDDPEKPVIDNSHKNGI

SEQ ID NO: 1847694 - protein, 11 aa, Staphylococcus
DDNQKIPEDAP

SEQ ID NO: 1847695 - protein, 8 aa, Staphylococcus
DDNTRNQL

SEQ ID NO: 1847696 - protein, 6 aa, Staphylococcus
DDNVPQ

SEQ ID NO: 1847697 - protein, 10 aa, Staphylococcus
DDPFSKASMN

SEQ ID NO: 1847698 - protein, 28 aa, Staphylococcus
DDPKGSMGKAESINTIARKGLKEDEPEA

SEQ ID NO: 1847699 - protein, 12 aa, Staphylococcus
DDQARNNLNGPL

SEQ ID NO: 1847700 - protein, 12 aa, Staphylococcus
DDQIKSPHSKIF

SEQ ID NO: 1847701 - protein, 6 aa, Staphylococcus
DDQNTL

SEQ ID NO: 1847702 - protein, 6 aa, Staphylococcus
DDQPMT

SEQ ID NO: 1847703 - protein, 19 aa, Staphylococcus
DDQTTDDGVTREKEAGINK

SEQ ID NO: 1847704 - protein, 6 aa, Staphylococcus
DDQTTE

SEQ ID NO: 1847705 - protein, 18 aa, Staphylococcus
DDRPNNDDIEVQRNSEFT

SEQ ID NO: 1847706 - protein, 42 aa, Staphylococcus
DDRRGYGEDHFPENDSQYRRSQYRQDETESYVDEPSRQRREH

SEQ ID NO: 1847707 - protein, 7 aa, Staphylococcus
DDRYSKN

SEQ ID NO: 1847708 - protein, 5 aa, Staphylococcus
DDSEI

SEQ ID NO: 1847709 - protein, 9 aa, Staphylococcus
DDSEIEKEL

SEQ ID NO: 1847710 - protein, 13 aa, Staphylococcus
DDSGKEVQQGEYG

SEQ ID NO: 1847711 - protein, 12 aa, Staphylococcus
DDSKLIDQSGKS

SEQ ID NO: 1847712 - protein, 19 aa, Staphylococcus
DDSKQIKNATVSKNGAWNS

SEQ ID NO: 1847713 - protein, 16 aa, Staphylococcus
DDSKQSATEILNNNLQ

SEQ ID NO: 1847714 - protein, 11 aa, Staphylococcus
DDSNDRTAEIA

SEQ ID NO: 1847715 - protein, 28 aa, Staphylococcus
DDSNKDRVKEGLQDINSDIKDTVGKDSY

SEQ ID NO: 1847716 - protein, 6 aa, Staphylococcus
DDSTQF

SEQ ID NO: 1847717 - protein, 7 aa, Staphylococcus
DDTDSKH

SEQ ID NO: 1847718 - protein, 7 aa, Staphylococcus
DDTDYSI

SEQ ID NO: 1847719 - protein, 14 aa, Staphylococcus
DDTGDYGNQISKQL

SEQ ID NO: 1847720 - protein, 36 aa, Staphylococcus
DDTGNKSQIKISTNKEDSADSNEDYIAKRNKSVKDV

SEQ ID NO: 1847721 - protein, 15 aa, Staphylococcus
DDTISKENKTPASIR

SEQ ID NO: 1847722 - protein, 8 aa, Staphylococcus
DDTPKMEQ

SEQ ID NO: 1847723 - protein, 9 aa, Staphylococcus
DDTQKASSI

SEQ ID NO: 1847724 - protein, 5 aa, Staphylococcus
DDTRD

SEQ ID NO: 1847725 - protein, 13 aa, Staphylococcus
DDTTISVSQSEVD

SEQ ID NO: 1847726 - protein, 9 aa, Staphylococcus
DDVGMKNSG

SEQ ID NO: 1847727 - protein, 6 aa, Staphylococcus
DDVLDD

SEQ ID NO: 1847728 - protein, 7 aa, Staphylococcus
DDVPKDS

SEQ ID NO: 1847729 - protein, 5 aa, Staphylococcus
DDVSN

SEQ ID NO: 1847730 - protein, 9 aa, Staphylococcus
DDYDDSHTS

SEQ ID NO: 1847731 - protein, 5 aa, Staphylococcus
DDYGR

SEQ ID NO: 1847732 - protein, 6 aa, Staphylococcus
DDYGRD

SEQ ID NO: 1847733 - protein, 9 aa, Staphylococcus
DDYKSQRKV

SEQ ID NO: 1847734 - protein, 16 aa, Staphylococcus
DDYPTSKKETFETELT

SEQ ID NO: 1847735 - protein, 29 aa, Staphylococcus
DEAAKQAKAATDAATTNNAVDEATNNNTT

SEQ ID NO: 1847736 - protein, 6 aa, Staphylococcus
DEAITA

SEQ ID NO: 1847737 - protein, 9 aa, Staphylococcus
DEANEDNKL

SEQ ID NO: 1847738 - protein, 13 aa, Staphylococcus
DEANEKLNSINDR

SEQ ID NO: 1847739 - protein, 6 aa, Staphylococcus
DEAQRF

SEQ ID NO: 1847740 - protein, 13 aa, Staphylococcus
DEATDNQAAPDNR

SEQ ID NO: 1847741 - protein, 4 aa, Staphylococcus
DEAY

SEQ ID NO: 1847742 - protein, 7 aa, Staphylococcus
DEDATWN

SEQ ID NO: 1847743 - protein, 6 aa, Staphylococcus
DEDDAV

SEQ ID NO: 1847744 - protein, 6 aa, Staphylococcus
DEDDID

SEQ ID NO: 1847745 - protein, 6 aa, Staphylococcus
DEDEYE

SEQ ID NO: 1847746 - protein, 5 aa, Staphylococcus
DEDKI

SEQ ID NO: 1847747 - protein, 7 aa, Staphylococcus
DEDLKTQ

SEQ ID NO: 1847748 - protein, 7 aa, Staphylococcus
DEDMKTQ

SEQ ID NO: 1847749 - protein, 9 aa, Staphylococcus
DEDNGTITI

SEQ ID NO: 1847750 - protein, 28 aa, Staphylococcus
DEDPIKTGAEYAKKHGWDTPEKAIKGGA

SEQ ID NO: 1847751 - protein, 28 aa, Staphylococcus
DEDPIKTGAQYAKKHGWDTPEKAIRGGA

SEQ ID NO: 1847752 - protein, 28 aa, Staphylococcus
DEDPIKTGSEYAKKHGWDTPQKAISGGA

SEQ ID NO: 1847753 - protein, 6 aa, Staphylococcus
DEDSTY

SEQ ID NO: 1847754 - protein, 8 aa, Staphylococcus
DEDTAGGI

SEQ ID NO: 1847755 - protein, 12 aa, Staphylococcus
DEDTDKALSNID

SEQ ID NO: 1847756 - protein, 7 aa, Staphylococcus
DEDTNMN

SEQ ID NO: 1847757 - protein, 6 aa, Staphylococcus
DEDTTL

SEQ ID NO: 1847758 - protein, 4 aa, Staphylococcus
DEED

SEQ ID NO: 1847759 - protein, 7 aa, Staphylococcus
DEEDKDT

SEQ ID NO: 1847760 - protein, 19 aa, Staphylococcus
DEEINAKERIEDNEDEAVP

SEQ ID NO: 1847761 - protein, 9 aa, Staphylococcus
DEEITESTA

SEQ ID NO: 1847762 - protein, 5 aa, Staphylococcus
DEESY

SEQ ID NO: 1847763 - protein, 6 aa, Staphylococcus
DEESYY

SEQ ID NO: 1847764 - protein, 7 aa, Staphylococcus
DEESYYS

SEQ ID NO: 1847765 - protein, 7 aa, Staphylococcus
DEEVSEV

SEQ ID NO: 1847766 - protein, 8 aa, Staphylococcus
DEFDDDEI

SEQ ID NO: 1847767 - protein, 9 aa, Staphylococcus
DEFDDDEVN

SEQ ID NO: 1847768 - protein, 8 aa, Staphylococcus
DEFDSNQL

SEQ ID NO: 1847769 - protein, 8 aa, Staphylococcus
DEFGEGYN

SEQ ID NO: 1847770 - protein, 8 aa, Staphylococcus
DEFPKDLQ

SEQ ID NO: 1847771 - protein, 14 aa, Staphylococcus
DEFYGSRNENIASS

SEQ ID NO: 1847772 - protein, 11 aa, Staphylococcus
DEGKGISEKDL

SEQ ID NO: 1847773 - protein, 7 aa, Staphylococcus
DEGKLER

SEQ ID NO: 1847774 - protein, 13 aa, Staphylococcus
DEGNLSLPNTGEV

SEQ ID NO: 1847775 - protein, 10 aa, Staphylococcus
DEGRGISQKD

SEQ ID NO: 1847776 - protein, 11 aa, Staphylococcus
DEGTSIQGEKM

SEQ ID NO: 1847777 - protein, 12 aa, Staphylococcus
DEHARSNLDGPI

SEQ ID NO: 1847778 - protein, 5 aa, Staphylococcus
DEHDY

SEQ ID NO: 1847779 - protein, 12 aa, Staphylococcus
DEHGDEIDSGYG

SEQ ID NO: 1847780 - protein, 10 aa, Staphylococcus
DEHGTDRTNK

SEQ ID NO: 1847781 - protein, 8 aa, Staphylococcus
DEHKVENV

SEQ ID NO: 1847782 - protein, 9 aa, Staphylococcus
DEHRDQTDI

SEQ ID NO: 1847783 - protein, 6 aa, Staphylococcus
DEIHPE

SEQ ID NO: 1847784 - protein, 26 aa, Staphylococcus
DEILDQKESKIEERQQQVDAKESSVQ

SEQ ID NO: 1847785 - protein, 4 aa, Staphylococcus
DEIN

SEQ ID NO: 1847786 - protein, 10 aa, Staphylococcus
DEINSQPVND

SEQ ID NO: 1847787 - protein, 7 aa, Staphylococcus
DEIPDNR

SEQ ID NO: 1847788 - protein, 10 aa, Staphylococcus
DEIPNNQNQI

SEQ ID NO: 1847789 - protein, 19 aa, Staphylococcus
DEIQSYVDKKEKEENSFRN

SEQ ID NO: 1847790 - protein, 15 aa, Staphylococcus
DEKDISDVEKGNDVD

SEQ ID NO: 1847791 - protein, 38 aa, Staphylococcus
DEKDISDVEKGNDVDVDIDGQKASIKGKVEQVGEATAA

SEQ ID NO: 1847792 - protein, 10 aa, Staphylococcus
DEKDKSERHL

SEQ ID NO: 1847793 - protein, 15 aa, Staphylococcus
DEKDVSSVEKGDKVD

SEQ ID NO: 1847794 - protein, 14 aa, Staphylococcus
DEKENQDTADRNSY

SEQ ID NO: 1847795 - protein, 7 aa, Staphylococcus
DEKGDYI

SEQ ID NO: 1847796 - protein, 7 aa, Staphylococcus
DEKHKDL

SEQ ID NO: 1847797 - protein, 7 aa, Staphylococcus
DEKKDIT

SEQ ID NO: 1847798 - protein, 7 aa, Staphylococcus
DEKKSGV

SEQ ID NO: 1847799 - protein, 4 aa, Staphylococcus
DEKM

SEQ ID NO: 1847800 - protein, 5 aa, Staphylococcus
DEKQL

SEQ ID NO: 1847801 - protein, 7 aa, Staphylococcus
DEKSIET

SEQ ID NO: 1847802 - protein, 5 aa, Staphylococcus
DEKSY

SEQ ID NO: 1847803 - protein, 9 aa, Staphylococcus
DEKTQEVNG

SEQ ID NO: 1847804 - protein, 12 aa, Staphylococcus
DEKVDKDKLYEN

SEQ ID NO: 1847805 - protein, 5 aa, Staphylococcus
DEKYP

SEQ ID NO: 1847806 - protein, 8 aa, Staphylococcus
DELENQFS

SEQ ID NO: 1847807 - protein, 7 aa, Staphylococcus
DELKDKY

SEQ ID NO: 1847808 - protein, 7 aa, Staphylococcus
DELKKEF

SEQ ID NO: 1847809 - protein, 12 aa, Staphylococcus
DELSANQKIDQA

SEQ ID NO: 1847810 - protein, 15 aa, Staphylococcus
DEMDKEEQEKLQQQR

SEQ ID NO: 1847811 - protein, 9 aa, Staphylococcus
DEMDQREQN

SEQ ID NO: 1847812 - protein, 4 aa, Staphylococcus
DEMT

SEQ ID NO: 1847813 - protein, 15 aa, Staphylococcus
DENDLSSIEKGDKVD

SEQ ID NO: 1847814 - protein, 32 aa, Staphylococcus
DENEIQQAEMKSSSLKQEIDDYERQEADLKTS

SEQ ID NO: 1847815 - protein, 9 aa, Staphylococcus
DENNRGKQM

SEQ ID NO: 1847816 - protein, 5 aa, Staphylococcus
DENPA

SEQ ID NO: 1847817 - protein, 16 aa, Staphylococcus
DENQIEQNTLSQEIEN

SEQ ID NO: 1847818 - protein, 11 aa, Staphylococcus
DENQPKAKEAL

SEQ ID NO: 1847819 - protein, 6 aa, Staphylococcus
DENQQA

SEQ ID NO: 1847820 - protein, 7 aa, Staphylococcus
DENSRMS

SEQ ID NO: 1847821 - protein, 7 aa, Staphylococcus
DENVPKH

SEQ ID NO: 1847822 - protein, 6 aa, Staphylococcus
DENVPN

SEQ ID NO: 1847823 - protein, 7 aa, Staphylococcus
DEPDEIK

SEQ ID NO: 1847824 - protein, 5 aa, Staphylococcus
DEPEN

SEQ ID NO: 1847825 - protein, 8 aa, Staphylococcus
DEPKETAK

SEQ ID NO: 1847826 - protein, 4 aa, Staphylococcus
DEPN

SEQ ID NO: 1847827 - protein, 81 aa, Staphylococcus
DEPNKEFEPIPIPKKEKPNPKRPTKLTKTSSKTKTLTVTKDRKSDQSQTVTVTKDSKSNKSQSTDKSKTLPNTGLDSSQTT

SEQ ID NO: 1847828 - protein, 12 aa, Staphylococcus
DEQARNNLSGPI

SEQ ID NO: 1847829 - protein, 11 aa, Staphylococcus
DEQARNNMNGP

SEQ ID NO: 1847830 - protein, 7 aa, Staphylococcus
DEQDKDT

SEQ ID NO: 1847831 - protein, 7 aa, Staphylococcus
DEQEETW

SEQ ID NO: 1847832 - protein, 7 aa, Staphylococcus
DEQEKVD

SEQ ID NO: 1847833 - protein, 4 aa, Staphylococcus
DEQM

SEQ ID NO: 1847834 - protein, 8 aa, Staphylococcus
DEQQRTRD

SEQ ID NO: 1847835 - protein, 7 aa, Staphylococcus
DEQSNSG

SEQ ID NO: 1847836 - protein, 5 aa, Staphylococcus
DEQVG

SEQ ID NO: 1847837 - protein, 6 aa, Staphylococcus
DEQYKE

SEQ ID NO: 1847838 - protein, 12 aa, Staphylococcus
DEQYKEAMSQLS

SEQ ID NO: 1847839 - protein, 5 aa, Staphylococcus
DEQYT

SEQ ID NO: 1847840 - protein, 6 aa, Staphylococcus
DERFDE

SEQ ID NO: 1847841 - protein, 4 aa, Staphylococcus
DERK

SEQ ID NO: 1847842 - protein, 16 aa, Staphylococcus
DERQGEHQSNAQQQSY

SEQ ID NO: 1847843 - protein, 7 aa, Staphylococcus
DERQSKD

SEQ ID NO: 1847844 - protein, 13 aa, Staphylococcus
DERTGGNGSASSL

SEQ ID NO: 1847845 - protein, 13 aa, Staphylococcus
DERTGGSGSASSL

SEQ ID NO: 1847846 - protein, 21 aa, Staphylococcus
DESAITGESAPVIKESGGDFD

SEQ ID NO: 1847847 - protein, 13 aa, Staphylococcus
DESANSNNDRTDY

SEQ ID NO: 1847848 - protein, 8 aa, Staphylococcus
DESDTKKQ

SEQ ID NO: 1847849 - protein, 9 aa, Staphylococcus
DESETKKQS

SEQ ID NO: 1847850 - protein, 9 aa, Staphylococcus
DESETKNQS

SEQ ID NO: 1847851 - protein, 8 aa, Staphylococcus
DESKAQTF

SEQ ID NO: 1847852 - protein, 13 aa, Staphylococcus
DESKSGKGSSSSL

SEQ ID NO: 1847853 - protein, 11 aa, Staphylococcus
DESKVDEETLS

SEQ ID NO: 1847854 - protein, 12 aa, Staphylococcus
DESPFINQQGKN

SEQ ID NO: 1847855 - protein, 12 aa, Staphylococcus
DESTKGRGSASS

SEQ ID NO: 1847856 - protein, 7 aa, Staphylococcus
DESTPQT

SEQ ID NO: 1847857 - protein, 13 aa, Staphylococcus
DESVNSANDRTDY

SEQ ID NO: 1847858 - protein, 23 aa, Staphylococcus
DETDAWKRTKAKQTLEKKENSPI

SEQ ID NO: 1847859 - protein, 19 aa, Staphylococcus
DETEADANRRYSTAITSDV

SEQ ID NO: 1847860 - protein, 8 aa, Staphylococcus
DETEDEIE

SEQ ID NO: 1847861 - protein, 9 aa, Staphylococcus
DETEDELES

SEQ ID NO: 1847862 - protein, 7 aa, Staphylococcus
DETEDEM

SEQ ID NO: 1847863 - protein, 8 aa, Staphylococcus
DETEDEMS

SEQ ID NO: 1847864 - protein, 6 aa, Staphylococcus
DETENE

SEQ ID NO: 1847865 - protein, 9 aa, Staphylococcus
DETETKNQS

SEQ ID NO: 1847866 - protein, 7 aa, Staphylococcus
DETGNDH

SEQ ID NO: 1847867 - protein, 8 aa, Staphylococcus
DETGRTRA

SEQ ID NO: 1847868 - protein, 11 aa, Staphylococcus
DETGRTRPTSF

SEQ ID NO: 1847869 - protein, 6 aa, Staphylococcus
DETHST

SEQ ID NO: 1847870 - protein, 7 aa, Staphylococcus
DETKAQA

SEQ ID NO: 1847871 - protein, 9 aa, Staphylococcus
DETKQTRAT

SEQ ID NO: 1847872 - protein, 8 aa, Staphylococcus
DETKRTKV

SEQ ID NO: 1847873 - protein, 4 aa, Staphylococcus
DETM

SEQ ID NO: 1847874 - protein, 11 aa, Staphylococcus
DETQATLDTNA

SEQ ID NO: 1847875 - protein, 8 aa, Staphylococcus
DETTGKVT

SEQ ID NO: 1847876 - protein, 5 aa, Staphylococcus
DETTT

SEQ ID NO: 1847877 - protein, 7 aa, Staphylococcus
DETVEDP

SEQ ID NO: 1847878 - protein, 9 aa, Staphylococcus
DETVTQGQP

SEQ ID NO: 1847879 - protein, 28 aa, Staphylococcus
DEVKTSNGSKDKSELPETGLSDESDYAT

SEQ ID NO: 1847880 - protein, 25 aa, Staphylococcus
DEVNANVNPSTEKATIEYNPNVTSL

SEQ ID NO: 1847881 - protein, 6 aa, Staphylococcus
DEVPES

SEQ ID NO: 1847882 - protein, 6 aa, Staphylococcus
DEVRNA

SEQ ID NO: 1847883 - protein, 11 aa, Staphylococcus
DEYETLKSQPL

SEQ ID NO: 1847884 - protein, 6 aa, Staphylococcus
DEYKKL

SEQ ID NO: 1847885 - protein, 7 aa, Staphylococcus
DEYLGKD

SEQ ID NO: 1847886 - protein, 5 aa, Staphylococcus
DEYND

SEQ ID NO: 1847887 - protein, 12 aa, Staphylococcus
DEYNQTYNQTYN

SEQ ID NO: 1847888 - protein, 15 aa, Staphylococcus
DEYYKDTSSEELGTA

SEQ ID NO: 1847889 - protein, 21 aa, Staphylococcus
DFDKIKPSEYEYKTGPKGQER

SEQ ID NO: 1847890 - protein, 6 aa, Staphylococcus
DFDKND

SEQ ID NO: 1847891 - protein, 110 aa, Staphylococcus
DFERNRQSIDPSHTNEDQKTPEESVDSADSKETNNQEPKTGATHFPPRGSQRRRRRRRETATHKQEEGNKQEEVHTDEKQKAEEKNTSTNKNTSKDKGSDAAAASVGGGV

SEQ ID NO: 1847892 - protein, 18 aa, Staphylococcus
DFERQRRKSSTKRRRNRL

SEQ ID NO: 1847893 - protein, 4 aa, Staphylococcus
DFES

SEQ ID NO: 1847894 - protein, 13 aa, Staphylococcus
DFGDPFGGGFGFF

SEQ ID NO: 1847895 - protein, 4 aa, Staphylococcus
DFGE

SEQ ID NO: 1847896 - protein, 4 aa, Staphylococcus
DFGG

SEQ ID NO: 1847897 - protein, 10 aa, Staphylococcus
DFGTPTTADD

SEQ ID NO: 1847898 - protein, 14 aa, Staphylococcus
DFGTPTTADEVKKA

SEQ ID NO: 1847899 - protein, 13 aa, Staphylococcus
DFGTPTTADEVQK

SEQ ID NO: 1847900 - protein, 9 aa, Staphylococcus
DFGTTTSEI

SEQ ID NO: 1847901 - protein, 20 aa, Staphylococcus
DFKKIDPSKYEYKTGPKGNQ

SEQ ID NO: 1847902 - protein, 21 aa, Staphylococcus
DFKKVDPSKYEYKPGPKGNEK

SEQ ID NO: 1847903 - protein, 11 aa, Staphylococcus
DFNPVNKEKKL

SEQ ID NO: 1847904 - protein, 10 aa, Staphylococcus
DFNTTTANAQ

SEQ ID NO: 1847905 - protein, 12 aa, Staphylococcus
DFPEVKQQHKDI

SEQ ID NO: 1847906 - protein, 62 aa, Staphylococcus
DFRNRKRKRFGDRVNNDEYSNEETQENDVSENDSPETESTNEDKKTQSENEHNKDSLNYGDE

SEQ ID NO: 1847907 - protein, 19 aa, Staphylococcus
DFRREQQLEEDNIRQKKSK

SEQ ID NO: 1847908 - protein, 20 aa, Staphylococcus
DFRREQQLEEENEKNKKSKK

SEQ ID NO: 1847909 - protein, 5 aa, Staphylococcus
DFSSN

SEQ ID NO: 1847910 - protein, 11 aa, Staphylococcus
DFTANKGDGYD

SEQ ID NO: 1847911 - protein, 10 aa, Staphylococcus
DFTANQGDGY

SEQ ID NO: 1847912 - protein, 11 aa, Staphylococcus
DFTASGGDGYD

SEQ ID NO: 1847913 - protein, 14 aa, Staphylococcus
DFTEDEAKYAADNV

SEQ ID NO: 1847914 - protein, 5 aa, Staphylococcus
DFTGD

SEQ ID NO: 1847915 - protein, 5 aa, Staphylococcus
DFTKK

SEQ ID NO: 1847916 - protein, 15 aa, Staphylococcus
DFTTSKKDNNDKDDV

SEQ ID NO: 1847917 - protein, 15 aa, Staphylococcus
DGADQLDSKHTKVKI

SEQ ID NO: 1847918 - protein, 10 aa, Staphylococcus
DGAKNDEQTL

SEQ ID NO: 1847919 - protein, 15 aa, Staphylococcus
DGAKTLGQSAKDPAH

SEQ ID NO: 1847920 - protein, 5 aa, Staphylococcus
DGANE

SEQ ID NO: 1847921 - protein, 26 aa, Staphylococcus
DGASVQEVSNSKGGNQLDGKSDKYKS

SEQ ID NO: 1847922 - protein, 15 aa, Staphylococcus
DGATQKIKDYKLKLI

SEQ ID NO: 1847923 - protein, 5 aa, Staphylococcus
DGDDL

SEQ ID NO: 1847924 - protein, 18 aa, Staphylococcus
DGDIGSTVNVSDKNLKDI

SEQ ID NO: 1847925 - protein, 8 aa, Staphylococcus
DGDKGPAM

SEQ ID NO: 1847926 - protein, 6 aa, Staphylococcus
DGEITD

SEQ ID NO: 1847927 - protein, 8 aa, Staphylococcus
DGEQENVY

SEQ ID NO: 1847928 - protein, 34 aa, Staphylococcus
DGERGERGLQGINGVDGKSIRVSSSRDNQKHETT

SEQ ID NO: 1847929 - protein, 23 aa, Staphylococcus
DGFAQSNDRIDNVSSEMTSVQNK

SEQ ID NO: 1847930 - protein, 14 aa, Staphylococcus
DGFNETNSKEHQQV

SEQ ID NO: 1847931 - protein, 10 aa, Staphylococcus
DGGETFSGGQ

SEQ ID NO: 1847932 - protein, 27 aa, Staphylococcus
DGGTATISKGDKGDAGEKGADGSSVTV

SEQ ID NO: 1847933 - protein, 19 aa, Staphylococcus
DGGTAVISKGDKGAGGQSI

SEQ ID NO: 1847934 - protein, 15 aa, Staphylococcus
DGGTQTIHDYKLKLL

SEQ ID NO: 1847935 - protein, 6 aa, Staphylococcus
DGHEVS

SEQ ID NO: 1847936 - protein, 15 aa, Staphylococcus
DGHTKSLDVTPKKQV

SEQ ID NO: 1847937 - protein, 8 aa, Staphylococcus
DGHVNTKQ

SEQ ID NO: 1847938 - protein, 6 aa, Staphylococcus
DGIDEV

SEQ ID NO: 1847939 - protein, 10 aa, Staphylococcus
DGIDTYDYNG

SEQ ID NO: 1847940 - protein, 6 aa, Staphylococcus
DGIEGQ

SEQ ID NO: 1847941 - protein, 7 aa, Staphylococcus
DGIGGVK

SEQ ID NO: 1847942 - protein, 7 aa, Staphylococcus
DGIKPDD

SEQ ID NO: 1847943 - protein, 7 aa, Staphylococcus
DGIKPSV

SEQ ID NO: 1847944 - protein, 8 aa, Staphylococcus
DGINDAPA

SEQ ID NO: 1847945 - protein, 9 aa, Staphylococcus
DGINDAPAL

SEQ ID NO: 1847946 - protein, 9 aa, Staphylococcus
DGKATSYEQ

SEQ ID NO: 1847947 - protein, 11 aa, Staphylococcus
DGKATSYKQTA

SEQ ID NO: 1847948 - protein, 9 aa, Staphylococcus
DGKATTYKQ

SEQ ID NO: 1847949 - protein, 31 aa, Staphylococcus
DGKDGGATGSPNIVQDKSTAENPQTSGGIPT

SEQ ID NO: 1847950 - protein, 20 aa, Staphylococcus
DGKDNEVQETTEGKHEPPGI

SEQ ID NO: 1847951 - protein, 11 aa, Staphylococcus
DGKDYDTSKGN

SEQ ID NO: 1847952 - protein, 13 aa, Staphylococcus
DGKEKEVTVTLGK

SEQ ID NO: 1847953 - protein, 7 aa, Staphylococcus
DGKEPKV

SEQ ID NO: 1847954 - protein, 17 aa, Staphylococcus
DGKGTDGKDAYKEAHAN

SEQ ID NO: 1847955 - protein, 14 aa, Staphylococcus
DGKITEELNVTISN

SEQ ID NO: 1847956 - protein, 7 aa, Staphylococcus
DGKKKID

SEQ ID NO: 1847957 - protein, 11 aa, Staphylococcus
DGKKVKDDTDL

SEQ ID NO: 1847958 - protein, 11 aa, Staphylococcus
DGKLASTTNTL

SEQ ID NO: 1847959 - protein, 10 aa, Staphylococcus
DGKLTSTTNT

SEQ ID NO: 1847960 - protein, 9 aa, Staphylococcus
DGKNLNGDK

SEQ ID NO: 1847961 - protein, 11 aa, Staphylococcus
DGKQAKSYPIT

SEQ ID NO: 1847962 - protein, 21 aa, Staphylococcus
DGKQTKREGDVVKQPALASTI

SEQ ID NO: 1847963 - protein, 26 aa, Staphylococcus
DGKSITIPKGDKGDAGVKGADGHSIT

SEQ ID NO: 1847964 - protein, 26 aa, Staphylococcus
DGKSITVPKGDKGDAGVKGADGHSIT

SEQ ID NO: 1847965 - protein, 11 aa, Staphylococcus
DGKSVKEDTDL

SEQ ID NO: 1847966 - protein, 53 aa, Staphylococcus
DGKTATISKGDKGDTGAQGAKGDRGETGATGAQGAKGETGATGLKGDKGDSIS

SEQ ID NO: 1847967 - protein, 44 aa, Staphylococcus
DGKTATISKGDTGATGAQGPKGDPGQNAAPLTVTGERKDTAGNT

SEQ ID NO: 1847968 - protein, 36 aa, Staphylococcus
DGKTATVSKGDTGAKGADAKPLTVTGEAKDKDGNTV

SEQ ID NO: 1847969 - protein, 8 aa, Staphylococcus
DGKTETIN

SEQ ID NO: 1847970 - protein, 6 aa, Staphylococcus
DGKTID

SEQ ID NO: 1847971 - protein, 8 aa, Staphylococcus
DGKTKDIE

SEQ ID NO: 1847972 - protein, 7 aa, Staphylococcus
DGKTKFD

SEQ ID NO: 1847973 - protein, 51 aa, Staphylococcus
DGKTVTIPKGVKGDKGDTGAQGEKGADAAPLTVTGSPQTPEGNTEVTFSDG

SEQ ID NO: 1847974 - protein, 11 aa, Staphylococcus
DGKTYVGQEPA

SEQ ID NO: 1847975 - protein, 5 aa, Staphylococcus
DGLEE

SEQ ID NO: 1847976 - protein, 10 aa, Staphylococcus
DGLEEPPVQP

SEQ ID NO: 1847977 - protein, 19 aa, Staphylococcus
DGLGKDKIDQKSNSFNTDL

SEQ ID NO: 1847978 - protein, 9 aa, Staphylococcus
DGLGSGAAN

SEQ ID NO: 1847979 - protein, 4 aa, Staphylococcus
DGLN

SEQ ID NO: 1847980 - protein, 6 aa, Staphylococcus
DGMYNK

SEQ ID NO: 1847981 - protein, 15 aa, Staphylococcus
DGNIIGSGTTDEQGH

SEQ ID NO: 1847982 - protein, 16 aa, Staphylococcus
DGNIIGSGTTDSNGHV

SEQ ID NO: 1847983 - protein, 18 aa, Staphylococcus
DGNIIGSGTTDSNGHVTI

SEQ ID NO: 1847984 - protein, 29 aa, Staphylococcus
DGNIIGSGTTDSTGHATITPTVPIPEGNV

SEQ ID NO: 1847985 - protein, 23 aa, Staphylococcus
DGNIQERDAYTAEIDASDAEKGV

SEQ ID NO: 1847986 - protein, 9 aa, Staphylococcus
DGNPITNLN

SEQ ID NO: 1847987 - protein, 4 aa, Staphylococcus
DGNQ

SEQ ID NO: 1847988 - protein, 6 aa, Staphylococcus
DGNSDI

SEQ ID NO: 1847989 - protein, 29 aa, Staphylococcus
DGNSITIPRGQDGHSVTVKESHQDQSGNT

SEQ ID NO: 1847990 - protein, 4 aa, Staphylococcus
DGNT

SEQ ID NO: 1847991 - protein, 8 aa, Staphylococcus
DGNTKEID

SEQ ID NO: 1847992 - protein, 16 aa, Staphylococcus
DGNVIGSGTTDDTGHV

SEQ ID NO: 1847993 - protein, 16 aa, Staphylococcus
DGNVIGSGTTDSNGHV

SEQ ID NO: 1847994 - protein, 18 aa, Staphylococcus
DGNVIGSGTTDSTGHATI

SEQ ID NO: 1847995 - protein, 23 aa, Staphylococcus
DGNVQDRDTYTAQIDASDAEKGI

SEQ ID NO: 1847996 - protein, 5 aa, Staphylococcus
DGNYV

SEQ ID NO: 1847997 - protein, 4 aa, Staphylococcus
DGPI

SEQ ID NO: 1847998 - protein, 10 aa, Staphylococcus
DGQEAKKTVV

SEQ ID NO: 1847999 - protein, 6 aa, Staphylococcus
DGQEIE

SEQ ID NO: 1848000 - protein, 7 aa, Staphylococcus
DGQPAKI

SEQ ID NO: 1848001 - protein, 8 aa, Staphylococcus
DGQTAKKT

SEQ ID NO: 1848002 - protein, 48 aa, Staphylococcus
DGQTATISKGDKGDKGNTGATGANGQDGQSVTITSTTTEPNGDTKVTF

SEQ ID NO: 1848003 - protein, 41 aa, Staphylococcus
DGQTATVSKGDKGDTGATGAAGKDAAPLTVTSTTKDNDGNT

SEQ ID NO: 1848004 - protein, 28 aa, Staphylococcus
DGQTATVSKGEKGDTGATGAAGRDGQSI

SEQ ID NO: 1848005 - protein, 5 aa, Staphylococcus
DGREA

SEQ ID NO: 1848006 - protein, 12 aa, Staphylococcus
DGREWEEKGDLE

SEQ ID NO: 1848007 - protein, 9 aa, Staphylococcus
DGSASASEV

SEQ ID NO: 1848008 - protein, 18 aa, Staphylococcus
DGSELKNYDGNATDDGPI

SEQ ID NO: 1848009 - protein, 6 aa, Staphylococcus
DGSGLK

SEQ ID NO: 1848010 - protein, 25 aa, Staphylococcus
DGSHATISKGDKGDTGAKGETGDSV

SEQ ID NO: 1848011 - protein, 26 aa, Staphylococcus
DGSHATVAKGKDGAAGQDGKSISITD

SEQ ID NO: 1848012 - protein, 9 aa, Staphylococcus
DGSIAPESI

SEQ ID NO: 1848013 - protein, 8 aa, Staphylococcus
DGSIRDES

SEQ ID NO: 1848014 - protein, 8 aa, Staphylococcus
DGSISTTG

SEQ ID NO: 1848015 - protein, 6 aa, Staphylococcus
DGSITN

SEQ ID NO: 1848016 - protein, 9 aa, Staphylococcus
DGSKDKTIN

SEQ ID NO: 1848017 - protein, 9 aa, Staphylococcus
DGSKDNTID

SEQ ID NO: 1848018 - protein, 9 aa, Staphylococcus
DGSKDNTIE

SEQ ID NO: 1848019 - protein, 8 aa, Staphylococcus
DGSKDNTR

SEQ ID NO: 1848020 - protein, 8 aa, Staphylococcus
DGSKDRTI

SEQ ID NO: 1848021 - protein, 8 aa, Staphylococcus
DGSKDRTL

SEQ ID NO: 1848022 - protein, 9 aa, Staphylococcus
DGSKDSTID

SEQ ID NO: 1848023 - protein, 9 aa, Staphylococcus
DGSKDSTIQ

SEQ ID NO: 1848024 - protein, 9 aa, Staphylococcus
DGSKDTTID

SEQ ID NO: 1848025 - protein, 41 aa, Staphylococcus
DGSKVTVPKGKDGKSITVPKGQDGRSVSVKGSHLDKDGNTV

SEQ ID NO: 1848026 - protein, 4 aa, Staphylococcus
DGSL

SEQ ID NO: 1848027 - protein, 41 aa, Staphylococcus
DGSNATISKGDKGDRGETGAAGKDATPLTVTSTDKDKDGNT

SEQ ID NO: 1848028 - protein, 34 aa, Staphylococcus
DGSQITISKGDKGAKGEKGDSITITSTEPQANGD

SEQ ID NO: 1848029 - protein, 10 aa, Staphylococcus
DGSRETENFG

SEQ ID NO: 1848030 - protein, 9 aa, Staphylococcus
DGSSDNSAE

SEQ ID NO: 1848031 - protein, 9 aa, Staphylococcus
DGSSDNTAE

SEQ ID NO: 1848032 - protein, 51 aa, Staphylococcus
DGSSVTIPKGAKGDTGAQGEAGQNGADAQPLTITGSTQTPDGNTEVTFSDG

SEQ ID NO: 1848033 - protein, 18 aa, Staphylococcus
DGSTDQTAEIARAAGASV

SEQ ID NO: 1848034 - protein, 8 aa, Staphylococcus
DGSTISNA

SEQ ID NO: 1848035 - protein, 8 aa, Staphylococcus
DGSVRDEE

SEQ ID NO: 1848036 - protein, 17 aa, Staphylococcus
DGTGSDGKDAYAKVGAK

SEQ ID NO: 1848037 - protein, 16 aa, Staphylococcus
DGTGSDGSNAYDKAKV

SEQ ID NO: 1848038 - protein, 5 aa, Staphylococcus
DGTLN

SEQ ID NO: 1848039 - protein, 11 aa, Staphylococcus
DGTNEDTGALN

SEQ ID NO: 1848040 - protein, 5 aa, Staphylococcus
DGTNL

SEQ ID NO: 1848041 - protein, 5 aa, Staphylococcus
DGTRS

SEQ ID NO: 1848042 - protein, 35 aa, Staphylococcus
DGTSATVSKGDKGEQGLQGLQGEAGVKGDKGDSIT

SEQ ID NO: 1848043 - protein, 7 aa, Staphylococcus
DGTVQSL

SEQ ID NO: 1848044 - protein, 16 aa, Staphylococcus
DGTVTAGSSAPLTDGS

SEQ ID NO: 1848045 - protein, 16 aa, Staphylococcus
DGTVTAGTSAPLSDGT

SEQ ID NO: 1848046 - protein, 10 aa, Staphylococcus
DGVATTSSDD

SEQ ID NO: 1848047 - protein, 6 aa, Staphylococcus
DGVDQA

SEQ ID NO: 1848048 - protein, 15 aa, Staphylococcus
DGVEGQVQGITRETT

SEQ ID NO: 1848049 - protein, 13 aa, Staphylococcus
DGVHATKDMMLVR

SEQ ID NO: 1848050 - protein, 6 aa, Staphylococcus
DGVQNA

SEQ ID NO: 1848051 - protein, 16 aa, Staphylococcus
DGVQNAQLNGQTNREV

SEQ ID NO: 1848052 - protein, 16 aa, Staphylococcus
DGVQNAQLNGQTSREV

SEQ ID NO: 1848053 - protein, 15 aa, Staphylococcus
DGVQNAQLNGQTTRE

SEQ ID NO: 1848054 - protein, 4 aa, Staphylococcus
DGVT

SEQ ID NO: 1848055 - protein, 9 aa, Staphylococcus
DGYDTVVGE

SEQ ID NO: 1848056 - protein, 22 aa, Staphylococcus
DGYETEVGERGVKLSGGQKQRI

SEQ ID NO: 1848057 - protein, 4 aa, Staphylococcus
DHAE

SEQ ID NO: 1848058 - protein, 14 aa, Staphylococcus
DHAQRSDSESRTTD

SEQ ID NO: 1848059 - protein, 4 aa, Staphylococcus
DHEG

SEQ ID NO: 1848060 - protein, 9 aa, Staphylococcus
DHEKTRKGS

SEQ ID NO: 1848061 - protein, 10 aa, Staphylococcus
DHETGTRDIN

SEQ ID NO: 1848062 - protein, 4 aa, Staphylococcus
DHEV

SEQ ID NO: 1848063 - protein, 7 aa, Staphylococcus
DHEVEGS

SEQ ID NO: 1848064 - protein, 10 aa, Staphylococcus
DHGQGIPKAD

SEQ ID NO: 1848065 - protein, 9 aa, Staphylococcus
DHGSGIPKD

SEQ ID NO: 1848066 - protein, 131 aa, Staphylococcus
DHKEKNNNTADNKTEQTENKDNAKDKATNEKDQSNEKVATKEDKSSESDNSTKKDSNESNEVATTENSTSNNNNDKNSTESATSENDNNKSNVYNNSSSSDNNSNSQSTQNSTQSSNSAGQQTHVVSGNDN

SEQ ID NO: 1848067 - protein, 55 aa, Staphylococcus
DHKNESDNKQHTYNATNDVSKNYQQEVQNQSDNIKKQVEDAKNDIKDKIDTESRL

SEQ ID NO: 1848068 - protein, 22 aa, Staphylococcus
DHKSSGSNKKYGVASNNAIATR

SEQ ID NO: 1848069 - protein, 7 aa, Staphylococcus
DHKTSGL

SEQ ID NO: 1848070 - protein, 16 aa, Staphylococcus
DHKVNKVKDHQGGGNA

SEQ ID NO: 1848071 - protein, 6 aa, Staphylococcus
DHLGSA

SEQ ID NO: 1848072 - protein, 33 aa, Staphylococcus
DHNGNTKDNIFQSSDNANKEKTYTDTMKSANSA

SEQ ID NO: 1848073 - protein, 7 aa, Staphylococcus
DHNQEPL

SEQ ID NO: 1848074 - protein, 9 aa, Staphylococcus
DHPDSMEGQ

SEQ ID NO: 1848075 - protein, 10 aa, Staphylococcus
DHPDSYEGAI

SEQ ID NO: 1848076 - protein, 4 aa, Staphylococcus
DHPE

SEQ ID NO: 1848077 - protein, 12 aa, Staphylococcus
DHPEVKKPLNKL

SEQ ID NO: 1848078 - protein, 6 aa, Staphylococcus
DHPGRD

SEQ ID NO: 1848079 - protein, 9 aa, Staphylococcus
DHPRTSNKF

SEQ ID NO: 1848080 - protein, 8 aa, Staphylococcus
DHQANGNA

SEQ ID NO: 1848081 - protein, 7 aa, Staphylococcus
DHQEERQ

SEQ ID NO: 1848082 - protein, 4 aa, Staphylococcus
DHRE

SEQ ID NO: 1848083 - protein, 5 aa, Staphylococcus
DHRSM

SEQ ID NO: 1848084 - protein, 11 aa, Staphylococcus
DHSKSNKYGIK

SEQ ID NO: 1848085 - protein, 7 aa, Staphylococcus
DHSKSYD

SEQ ID NO: 1848086 - protein, 5 aa, Staphylococcus
DHSNA

SEQ ID NO: 1848087 - protein, 15 aa, Staphylococcus
DHSNAAMTHTSEGIA

SEQ ID NO: 1848088 - protein, 8 aa, Staphylococcus
DHSSGEPI

SEQ ID NO: 1848089 - protein, 9 aa, Staphylococcus
DHSTGTRDI

SEQ ID NO: 1848090 - protein, 10 aa, Staphylococcus
DHSTGTRDVK

SEQ ID NO: 1848091 - protein, 10 aa, Staphylococcus
DHSTGTRDVR

SEQ ID NO: 1848092 - protein, 8 aa, Staphylococcus
DHTDRGNT

SEQ ID NO: 1848093 - protein, 63 aa, Staphylococcus
DHTEEDDFESHKNDDSKNHQFENDSVANKEDNNSEASSEHSNTSDTDLKDSAKYTEDRHSSVV

SEQ ID NO: 1848094 - protein, 7 aa, Staphylococcus
DHTGKVT

SEQ ID NO: 1848095 - protein, 5 aa, Staphylococcus
DHTGM

SEQ ID NO: 1848096 - protein, 16 aa, Staphylococcus
DHYPAQEAGLKPGDKI

SEQ ID NO: 1848097 - protein, 20 aa, Staphylococcus
DHYPAQEAGLKSGDKIEQIG

SEQ ID NO: 1848098 - protein, 10 aa, Staphylococcus
DIAEEQPPSR

SEQ ID NO: 1848099 - protein, 11 aa, Staphylococcus
DIAQDKKKQII

SEQ ID NO: 1848100 - protein, 103 aa, Staphylococcus
DIASEGIDAASSQLNDAQGYLTQAKQRVKDYQEAAGRAQEVNGAVNKDLNNHTTTQQQSATQSHKDQGHSYSNIKTSQMSTMGDSSNNDSDLTQNDVKSMNTA

SEQ ID NO: 1848101 - protein, 7 aa, Staphylococcus
DIATANN

SEQ ID NO: 1848102 - protein, 17 aa, Staphylococcus
DIDDDERQSIKLPDSVK

SEQ ID NO: 1848103 - protein, 12 aa, Staphylococcus
DIDDVENGVAIK

SEQ ID NO: 1848104 - protein, 28 aa, Staphylococcus
DIDKGKSTGNKRPNNLKVPNNASDNNTD

SEQ ID NO: 1848105 - protein, 18 aa, Staphylococcus
DIDNKRNHQIHASKNDSH

SEQ ID NO: 1848106 - protein, 4 aa, Staphylococcus
DIDQ

SEQ ID NO: 1848107 - protein, 8 aa, Staphylococcus
DIDRNSPF

SEQ ID NO: 1848108 - protein, 10 aa, Staphylococcus
DIDSETGAYS

SEQ ID NO: 1848109 - protein, 8 aa, Staphylococcus
DIDTTPRI

SEQ ID NO: 1848110 - protein, 5 aa, Staphylococcus
DIEKA

SEQ ID NO: 1848111 - protein, 5 aa, Staphylococcus
DIEKG

SEQ ID NO: 1848112 - protein, 7 aa, Staphylococcus
DIEQKRN

SEQ ID NO: 1848113 - protein, 8 aa, Staphylococcus
DIEQSQAD

SEQ ID NO: 1848114 - protein, 13 aa, Staphylococcus
DIESKDDASDNGK

SEQ ID NO: 1848115 - protein, 8 aa, Staphylococcus
DIESSIDD

SEQ ID NO: 1848116 - protein, 9 aa, Staphylococcus
DIGRNFSGT

SEQ ID NO: 1848117 - protein, 4 aa, Staphylococcus
DIGS

SEQ ID NO: 1848118 - protein, 5 aa, Staphylococcus
DIIPR

SEQ ID NO: 1848119 - protein, 4 aa, Staphylococcus
DIKK

SEQ ID NO: 1848120 - protein, 11 aa, Staphylococcus
DIKNGIGAQPI

SEQ ID NO: 1848121 - protein, 12 aa, Staphylococcus
DIKNGRGAQPIE

SEQ ID NO: 1848122 - protein, 12 aa, Staphylococcus
DIKNGVGAQPIE

SEQ ID NO: 1848123 - protein, 19 aa, Staphylococcus
DIKPDRGKINKSVSTYYGD

SEQ ID NO: 1848124 - protein, 8 aa, Staphylococcus
DIKQSQAD

SEQ ID NO: 1848125 - protein, 19 aa, Staphylococcus
DIKSTVETLNKSDSKEAIN

SEQ ID NO: 1848126 - protein, 18 aa, Staphylococcus
DIKSYKEDIEDARNQSEI

SEQ ID NO: 1848127 - protein, 13 aa, Staphylococcus
DILSDGKERIDTI

SEQ ID NO: 1848128 - protein, 5 aa, Staphylococcus
DILSG

SEQ ID NO: 1848129 - protein, 15 aa, Staphylococcus
DINDNDLDKADASLS

SEQ ID NO: 1848130 - protein, 7 aa, Staphylococcus
DINPNIE

SEQ ID NO: 1848131 - protein, 17 aa, Staphylococcus
DIPDSYKKELKTDRDTG

SEQ ID NO: 1848132 - protein, 17 aa, Staphylococcus
DIPDSYKKELNTDRDDG

SEQ ID NO: 1848133 - protein, 18 aa, Staphylococcus
DIPDSYKKELNTDSQSGV

SEQ ID NO: 1848134 - protein, 20 aa, Staphylococcus
DIPNPSQGRALSLGDSSDDF

SEQ ID NO: 1848135 - protein, 7 aa, Staphylococcus
DIPNPVQ

SEQ ID NO: 1848136 - protein, 14 aa, Staphylococcus
DIPYSGKDDESQTV

SEQ ID NO: 1848137 - protein, 7 aa, Staphylococcus
DIQDDDI

SEQ ID NO: 1848138 - protein, 10 aa, Staphylococcus
DIQKDQSGNT

SEQ ID NO: 1848139 - protein, 4 aa, Staphylococcus
DIQT

SEQ ID NO: 1848140 - protein, 18 aa, Staphylococcus
DIQTQMRQASTPEIRKEA

SEQ ID NO: 1848141 - protein, 9 aa, Staphylococcus
DISEHAKGV

SEQ ID NO: 1848142 - protein, 16 aa, Staphylococcus
DISELGSQKSFSQEEM

SEQ ID NO: 1848143 - protein, 18 aa, Staphylococcus
DISEVKQDIKVSDKMSDE

SEQ ID NO: 1848144 - protein, 11 aa, Staphylococcus
DISLEDAKERL

SEQ ID NO: 1848145 - protein, 20 aa, Staphylococcus
DISNPSPGRALSLGDSSGSF

SEQ ID NO: 1848146 - protein, 17 aa, Staphylococcus
DISSEEREEANLPSSVN

SEQ ID NO: 1848147 - protein, 12 aa, Staphylococcus
DISTTLKNRQAT

SEQ ID NO: 1848148 - protein, 13 aa, Staphylococcus
DITAPDVKPIENQ

SEQ ID NO: 1848149 - protein, 18 aa, Staphylococcus
DITGAEPVNGFETSVPEE

SEQ ID NO: 1848150 - protein, 21 aa, Staphylococcus
DITGATTKEQIQNAKDQFNNA

SEQ ID NO: 1848151 - protein, 14 aa, Staphylococcus
DITIPGQNNQVKES

SEQ ID NO: 1848152 - protein, 8 aa, Staphylococcus
DITKNKKN

SEQ ID NO: 1848153 - protein, 5 aa, Staphylococcus
DITSN

SEQ ID NO: 1848154 - protein, 19 aa, Staphylococcus
DITSQLASGQQALSTVQSK

SEQ ID NO: 1848155 - protein, 91 aa, Staphylococcus
DITSSDDGDFKKPDSVNGSSADNLSVSGHPDNNTTNREVNGSSGSSSSNSSNSSNNSSNSNTSNTNNSGNTNSGTTNNNSTTQGTNTVGST

SEQ ID NO: 1848156 - protein, 131 aa, Staphylococcus
DITSSNDGDFKKPDSVTGSSASTLSVKDHPDNNTTSGSKYDNKSTSSSDSSSSNDSSNSSSTESSSSNSTSTSDNNSNTTSTTNGNTTTNTGNTTDNSANNSTTNNSANNSTTSTQQNNNNDNTNNNSSLS

SEQ ID NO: 1848157 - protein, 12 aa, Staphylococcus
DIVSAQDKLNAV

SEQ ID NO: 1848158 - protein, 20 aa, Staphylococcus
DIVTENEEGPINAEYNQDQK

SEQ ID NO: 1848159 - protein, 7 aa, Staphylococcus
DKAADMM

SEQ ID NO: 1848160 - protein, 40 aa, Staphylococcus
DKAAKKQIDNYTSQQVSNKNNDAWRDASSTEIKSAMDSSQ

SEQ ID NO: 1848161 - protein, 10 aa, Staphylococcus
DKAERSMDQY

SEQ ID NO: 1848162 - protein, 8 aa, Staphylococcus
DKAGKFDQ

SEQ ID NO: 1848163 - protein, 9 aa, Staphylococcus
DKAGKLSDI

SEQ ID NO: 1848164 - protein, 9 aa, Staphylococcus
DKAGKLSDV

SEQ ID NO: 1848165 - protein, 10 aa, Staphylococcus
DKAGNFSKEQ

SEQ ID NO: 1848166 - protein, 12 aa, Staphylococcus
DKAIDKAKAKID

SEQ ID NO: 1848167 - protein, 9 aa, Staphylococcus
DKAKALNKA

SEQ ID NO: 1848168 - protein, 9 aa, Staphylococcus
DKALQGGSY

SEQ ID NO: 1848169 - protein, 17 aa, Staphylococcus
DKANEVAKERTEEDPYK

SEQ ID NO: 1848170 - protein, 8 aa, Staphylococcus
DKANTIEY

SEQ ID NO: 1848171 - protein, 12 aa, Staphylococcus
DKAQGGKSRTDS

SEQ ID NO: 1848172 - protein, 11 aa, Staphylococcus
DKASAKRYKNL

SEQ ID NO: 1848173 - protein, 12 aa, Staphylococcus
DKASGGKSRSDS

SEQ ID NO: 1848174 - protein, 13 aa, Staphylococcus
DKASKDMQDDSSF

SEQ ID NO: 1848175 - protein, 12 aa, Staphylococcus
DKASKEMSDDGN

SEQ ID NO: 1848176 - protein, 38 aa, Staphylococcus
DKASKKQIDNYTSQQVSNKSNNAWRDASATEIKTAMDS

SEQ ID NO: 1848177 - protein, 7 aa, Staphylococcus
DKASNNK

SEQ ID NO: 1848178 - protein, 15 aa, Staphylococcus
DKASNSNLSEAQKGF

SEQ ID NO: 1848179 - protein, 7 aa, Staphylococcus
DKATNNR

SEQ ID NO: 1848180 - protein, 19 aa, Staphylococcus
DKDADIDKPNTGDSTVDGY

SEQ ID NO: 1848181 - protein, 44 aa, Staphylococcus
DKDAHTCQNCGQSIKKETKNKSKQSNSEQHENSTNQSSNKTTNI

SEQ ID NO: 1848182 - protein, 6 aa, Staphylococcus
DKDDAI

SEQ ID NO: 1848183 - protein, 7 aa, Staphylococcus
DKDDAVD

SEQ ID NO: 1848184 - protein, 5 aa, Staphylococcus
DKDDK

SEQ ID NO: 1848185 - protein, 7 aa, Staphylococcus
DKDDSYD

SEQ ID NO: 1848186 - protein, 10 aa, Staphylococcus
DKDEKKDIYN

SEQ ID NO: 1848187 - protein, 32 aa, Staphylococcus
DKDGDLAGSYTVDKDDGYVTEYDEHGDEVGSG

SEQ ID NO: 1848188 - protein, 32 aa, Staphylococcus
DKDGDLAGSYTVDSEDGEVTEYDENGDEVGSG

SEQ ID NO: 1848189 - protein, 32 aa, Staphylococcus
DKDGDLAGSYTVDTDDGYVTEYDEDGEKVGSG

SEQ ID NO: 1848190 - protein, 32 aa, Staphylococcus
DKDGDLAGSYTVDTGDGYVTEYDEDGEEVGSG

SEQ ID NO: 1848191 - protein, 14 aa, Staphylococcus
DKDGEGTSPSQTFK

SEQ ID NO: 1848192 - protein, 8 aa, Staphylococcus
DKDGGFSE

SEQ ID NO: 1848193 - protein, 9 aa, Staphylococcus
DKDGNFSDE

SEQ ID NO: 1848194 - protein, 9 aa, Staphylococcus
DKDGNYDTL

SEQ ID NO: 1848195 - protein, 14 aa, Staphylococcus
DKDITGNKAKITNL

SEQ ID NO: 1848196 - protein, 9 aa, Staphylococcus
DKDKFRALE

SEQ ID NO: 1848197 - protein, 14 aa, Staphylococcus
DKDKPSNYVSKVAN

SEQ ID NO: 1848198 - protein, 9 aa, Staphylococcus
DKDKRQPVY

SEQ ID NO: 1848199 - protein, 7 aa, Staphylococcus
DKDLTGG

SEQ ID NO: 1848200 - protein, 10 aa, Staphylococcus
DKDNDGSEAI

SEQ ID NO: 1848201 - protein, 9 aa, Staphylococcus
DKDNKNDEL

SEQ ID NO: 1848202 - protein, 9 aa, Staphylococcus
DKDNKNDEW

SEQ ID NO: 1848203 - protein, 6 aa, Staphylococcus
DKDNQY

SEQ ID NO: 1848204 - protein, 16 aa, Staphylococcus
DKDNSGTSASQTFSIK

SEQ ID NO: 1848205 - protein, 6 aa, Staphylococcus
DKDNSY

SEQ ID NO: 1848206 - protein, 28 aa, Staphylococcus
DKDPIKTGAEYAKKHNWDTPEKAIDGGA

SEQ ID NO: 1848207 - protein, 26 aa, Staphylococcus
DKDPVKTGAEYAKKHGWDTPQKAIYG

SEQ ID NO: 1848208 - protein, 6 aa, Staphylococcus
DKDQSE

SEQ ID NO: 1848209 - protein, 5 aa, Staphylococcus
DKDRD

SEQ ID NO: 1848210 - protein, 8 aa, Staphylococcus
DKDRRESI

SEQ ID NO: 1848211 - protein, 9 aa, Staphylococcus
DKDTRDVQV

SEQ ID NO: 1848212 - protein, 5 aa, Staphylococcus
DKDYE

SEQ ID NO: 1848213 - protein, 6 aa, Staphylococcus
DKDYEP

SEQ ID NO: 1848214 - protein, 28 aa, Staphylococcus
DKEATFHRSTKSMDEYDNGTYGILRNVY

SEQ ID NO: 1848215 - protein, 7 aa, Staphylococcus
DKEESML

SEQ ID NO: 1848216 - protein, 15 aa, Staphylococcus
DKEGEKKESDKLTTK

SEQ ID NO: 1848217 - protein, 4 aa, Staphylococcus
DKEI

SEQ ID NO: 1848218 - protein, 20 aa, Staphylococcus
DKEIGDESSSETYGPYDPDE

SEQ ID NO: 1848219 - protein, 18 aa, Staphylococcus
DKEIQDKEREKEGLKSNI

SEQ ID NO: 1848220 - protein, 11 aa, Staphylococcus
DKEKAESLRTD

SEQ ID NO: 1848221 - protein, 10 aa, Staphylococcus
DKEKEDRYGR

SEQ ID NO: 1848222 - protein, 13 aa, Staphylococcus
DKEKGSKAPNVRE

SEQ ID NO: 1848223 - protein, 10 aa, Staphylococcus
DKEKNDRYGR

SEQ ID NO: 1848224 - protein, 17 aa, Staphylococcus
DKELEKITDKAQNQDGL

SEQ ID NO: 1848225 - protein, 5 aa, Staphylococcus
DKELK

SEQ ID NO: 1848226 - protein, 9 aa, Staphylococcus
DKENNSRLV

SEQ ID NO: 1848227 - protein, 4 aa, Staphylococcus
DKEQ

SEQ ID NO: 1848228 - protein, 11 aa, Staphylococcus
DKEQGGISRTD

SEQ ID NO: 1848229 - protein, 15 aa, Staphylococcus
DKESDIKKGLKDEKY

SEQ ID NO: 1848230 - protein, 15 aa, Staphylococcus
DKESDLKKGFDNEKY

SEQ ID NO: 1848231 - protein, 7 aa, Staphylococcus
DKETPKY

SEQ ID NO: 1848232 - protein, 13 aa, Staphylococcus
DKEVEKGSAKYGN

SEQ ID NO: 1848233 - protein, 8 aa, Staphylococcus
DKEVTSPE

SEQ ID NO: 1848234 - protein, 4 aa, Staphylococcus
DKEY

SEQ ID NO: 1848235 - protein, 7 aa, Staphylococcus
DKFKDKF

SEQ ID NO: 1848236 - protein, 6 aa, Staphylococcus
DKFKEK

SEQ ID NO: 1848237 - protein, 8 aa, Staphylococcus
DKFKNQNL

SEQ ID NO: 1848238 - protein, 13 aa, Staphylococcus
DKGEGFTKINQTG

SEQ ID NO: 1848239 - protein, 6 aa, Staphylococcus
DKGELK

SEQ ID NO: 1848240 - protein, 5 aa, Staphylococcus
DKGEN

SEQ ID NO: 1848241 - protein, 10 aa, Staphylococcus
DKGGKTDKYG

SEQ ID NO: 1848242 - protein, 4 aa, Staphylococcus
DKGI

SEQ ID NO: 1848243 - protein, 7 aa, Staphylococcus
DKGLHAK

SEQ ID NO: 1848244 - protein, 12 aa, Staphylococcus
DKGPQAKSTDDL

SEQ ID NO: 1848245 - protein, 6 aa, Staphylococcus
DKGQNF

SEQ ID NO: 1848246 - protein, 7 aa, Staphylococcus
DKGTPQT

SEQ ID NO: 1848247 - protein, 9 aa, Staphylococcus
DKGYDDDRT

SEQ ID NO: 1848248 - protein, 6 aa, Staphylococcus
DKGYKA

SEQ ID NO: 1848249 - protein, 8 aa, Staphylococcus
DKHDYVGT

SEQ ID NO: 1848250 - protein, 12 aa, Staphylococcus
DKHEKAPKKLKN

SEQ ID NO: 1848251 - protein, 6 aa, Staphylococcus
DKHLPN

SEQ ID NO: 1848252 - protein, 7 aa, Staphylococcus
DKHQDFT

SEQ ID NO: 1848253 - protein, 7 aa, Staphylococcus
DKHSKGI

SEQ ID NO: 1848254 - protein, 100 aa, Staphylococcus
DKIDKPGKKARKGKKNDKDSLATSKDDNKGKTSNVKEKVQDKVNDNDSKGDNLKDKAENQFNNQKDNASSKGQDLKDKASEKVSDHKDDITDRAKDTFDK

SEQ ID NO: 1848255 - protein, 20 aa, Staphylococcus
DKIDKYVKEKEKEENSLKNK

SEQ ID NO: 1848256 - protein, 6 aa, Staphylococcus
DKIDYE

SEQ ID NO: 1848257 - protein, 5 aa, Staphylococcus
DKIKS

SEQ ID NO: 1848258 - protein, 19 aa, Staphylococcus
DKIKTKEKPYGLNLTVSYY

SEQ ID NO: 1848259 - protein, 8 aa, Staphylococcus
DKINDEKL

SEQ ID NO: 1848260 - protein, 7 aa, Staphylococcus
DKIPKDY

SEQ ID NO: 1848261 - protein, 6 aa, Staphylococcus
DKIQQA

SEQ ID NO: 1848262 - protein, 8 aa, Staphylococcus
DKISETTN

SEQ ID NO: 1848263 - protein, 8 aa, Staphylococcus
DKISTTQA

SEQ ID NO: 1848264 - protein, 9 aa, Staphylococcus
DKITDRDKK

SEQ ID NO: 1848265 - protein, 9 aa, Staphylococcus
DKITDRDKQ

SEQ ID NO: 1848266 - protein, 8 aa, Staphylococcus
DKITERDK

SEQ ID NO: 1848267 - protein, 9 aa, Staphylococcus
DKITERDKK

SEQ ID NO: 1848268 - protein, 9 aa, Staphylococcus
DKITKQDKQ

SEQ ID NO: 1848269 - protein, 4 aa, Staphylococcus
DKIV

SEQ ID NO: 1848270 - protein, 18 aa, Staphylococcus
DKKDGITDKSTKKDIEKA

SEQ ID NO: 1848271 - protein, 11 aa, Staphylococcus
DKKDNPQEMQK

SEQ ID NO: 1848272 - protein, 67 aa, Staphylococcus
DKKEELEEKRQAKKEAKENDPERIKTKGEKLEKKNRKEAEKMAKKLDKNLEKRRKEEEKDDEKTRKR

SEQ ID NO: 1848273 - protein, 5 aa, Staphylococcus
DKKES

SEQ ID NO: 1848274 - protein, 14 aa, Staphylococcus
DKKGEDVEAKRMTT

SEQ ID NO: 1848275 - protein, 8 aa, Staphylococcus
DKKHKDLT

SEQ ID NO: 1848276 - protein, 8 aa, Staphylococcus
DKKHTENF

SEQ ID NO: 1848277 - protein, 12 aa, Staphylococcus
DKKIETKGDIDS

SEQ ID NO: 1848278 - protein, 10 aa, Staphylococcus
DKKIPTGEQY

SEQ ID NO: 1848279 - protein, 8 aa, Staphylococcus
DKKKPANM

SEQ ID NO: 1848280 - protein, 8 aa, Staphylococcus
DKKLSLND

SEQ ID NO: 1848281 - protein, 7 aa, Staphylococcus
DKKQDIT

SEQ ID NO: 1848282 - protein, 7 aa, Staphylococcus
DKKTADF

SEQ ID NO: 1848283 - protein, 7 aa, Staphylococcus
DKKTIRN

SEQ ID NO: 1848284 - protein, 6 aa, Staphylococcus
DKKTQL

SEQ ID NO: 1848285 - protein, 7 aa, Staphylococcus
DKKTSDF

SEQ ID NO: 1848286 - protein, 10 aa, Staphylococcus
DKKVKEDTDV

SEQ ID NO: 1848287 - protein, 10 aa, Staphylococcus
DKKVPTGDEY

SEQ ID NO: 1848288 - protein, 11 aa, Staphylococcus
DKKVPTSEQYR

SEQ ID NO: 1848289 - protein, 10 aa, Staphylococcus
DKKYDVKKAN

SEQ ID NO: 1848290 - protein, 7 aa, Staphylococcus
DKLASDV

SEQ ID NO: 1848291 - protein, 7 aa, Staphylococcus
DKLKDNH

SEQ ID NO: 1848292 - protein, 16 aa, Staphylococcus
DKLKNADTQEERTAAN

SEQ ID NO: 1848293 - protein, 8 aa, Staphylococcus
DKLKQSKL

SEQ ID NO: 1848294 - protein, 11 aa, Staphylococcus
DKLMDSDSDTV

SEQ ID NO: 1848295 - protein, 32 aa, Staphylococcus
DKLNDIDNANATEQDKIDAKNKAEALANQTIN

SEQ ID NO: 1848296 - protein, 12 aa, Staphylococcus
DKLNKNNSSVAS

SEQ ID NO: 1848297 - protein, 6 aa, Staphylococcus
DKLNQV

SEQ ID NO: 1848298 - protein, 4 aa, Staphylococcus
DKLP

SEQ ID NO: 1848299 - protein, 8 aa, Staphylococcus
DKLPDDVT

SEQ ID NO: 1848300 - protein, 5 aa, Staphylococcus
DKLPH

SEQ ID NO: 1848301 - protein, 13 aa, Staphylococcus
DKLPSDVTTRINN

SEQ ID NO: 1848302 - protein, 15 aa, Staphylococcus
DKLPSNQGSSKEKLK

SEQ ID NO: 1848303 - protein, 14 aa, Staphylococcus
DKLPTDKSNAKAKL

SEQ ID NO: 1848304 - protein, 11 aa, Staphylococcus
DKLSGGEKQRV

SEQ ID NO: 1848305 - protein, 22 aa, Staphylococcus
DKMPSKPEAKQNQNASKEQYDR

SEQ ID NO: 1848306 - protein, 15 aa, Staphylococcus
DKMRNSSQSASSNFK

SEQ ID NO: 1848307 - protein, 19 aa, Staphylococcus
DKNASNINNEKDKESKNGI

SEQ ID NO: 1848308 - protein, 7 aa, Staphylococcus
DKNCPLG

SEQ ID NO: 1848309 - protein, 5 aa, Staphylococcus
DKNEN

SEQ ID NO: 1848310 - protein, 35 aa, Staphylococcus
DKNGNVVSKTDDITSFTDGEQKGQFTVPASAQNGD

SEQ ID NO: 1848311 - protein, 17 aa, Staphylococcus
DKNKFKKVTEEISKKQN

SEQ ID NO: 1848312 - protein, 18 aa, Staphylococcus
DKNKSAKTTVKVERNGKM

SEQ ID NO: 1848313 - protein, 17 aa, Staphylococcus
DKNKVDKNISTRGTKNK

SEQ ID NO: 1848314 - protein, 10 aa, Staphylococcus
DKNNKGNHAT

SEQ ID NO: 1848315 - protein, 14 aa, Staphylococcus
DKNNSGTQVSQTYN

SEQ ID NO: 1848316 - protein, 6 aa, Staphylococcus
DKNSDI

SEQ ID NO: 1848317 - protein, 18 aa, Staphylococcus
DKNSGDESKTYGPYDPDE

SEQ ID NO: 1848318 - protein, 7 aa, Staphylococcus
DKNSRMS

SEQ ID NO: 1848319 - protein, 6 aa, Staphylococcus
DKNSTG

SEQ ID NO: 1848320 - protein, 6 aa, Staphylococcus
DKNSTY

SEQ ID NO: 1848321 - protein, 6 aa, Staphylococcus
DKNTQL

SEQ ID NO: 1848322 - protein, 17 aa, Staphylococcus
DKPAQDDVDKVIEKGGH

SEQ ID NO: 1848323 - protein, 4 aa, Staphylococcus
DKPH

SEQ ID NO: 1848324 - protein, 13 aa, Staphylococcus
DKPHASYNNTKTQ

SEQ ID NO: 1848325 - protein, 12 aa, Staphylococcus
DKPLIKDESREL

SEQ ID NO: 1848326 - protein, 9 aa, Staphylococcus
DKPQEDTKK

SEQ ID NO: 1848327 - protein, 9 aa, Staphylococcus
DKPSDNETL

SEQ ID NO: 1848328 - protein, 16 aa, Staphylococcus
DKPTNTPKQAQKSSRL

SEQ ID NO: 1848329 - protein, 7 aa, Staphylococcus
DKQAKVT

SEQ ID NO: 1848330 - protein, 6 aa, Staphylococcus
DKQANN

SEQ ID NO: 1848331 - protein, 20 aa, Staphylococcus
DKQDGNEVTYHTQGTPISEY

SEQ ID NO: 1848332 - protein, 12 aa, Staphylococcus
DKQDYDKSKLKY

SEQ ID NO: 1848333 - protein, 5 aa, Staphylococcus
DKQES

SEQ ID NO: 1848334 - protein, 17 aa, Staphylococcus
DKQETNGKVIGKDKYSD

SEQ ID NO: 1848335 - protein, 12 aa, Staphylococcus
DKQFENKKVGNG

SEQ ID NO: 1848336 - protein, 6 aa, Staphylococcus
DKQGEL

SEQ ID NO: 1848337 - protein, 9 aa, Staphylococcus
DKQGHVSAD

SEQ ID NO: 1848338 - protein, 12 aa, Staphylococcus
DKQGQKTFYGEP

SEQ ID NO: 1848339 - protein, 8 aa, Staphylococcus
DKQKLKEK

SEQ ID NO: 1848340 - protein, 7 aa, Staphylococcus
DKQNQYY

SEQ ID NO: 1848341 - protein, 7 aa, Staphylococcus
DKQQLSA

SEQ ID NO: 1848342 - protein, 9 aa, Staphylococcus
DKQQSDYRR

SEQ ID NO: 1848343 - protein, 12 aa, Staphylococcus
DKQRQRISEKQM

SEQ ID NO: 1848344 - protein, 9 aa, Staphylococcus
DKQSNTYAP

SEQ ID NO: 1848345 - protein, 7 aa, Staphylococcus
DKQSTKS

SEQ ID NO: 1848346 - protein, 9 aa, Staphylococcus
DKQTEVSDL

SEQ ID NO: 1848347 - protein, 15 aa, Staphylococcus
DKQTFESNNYGELSS

SEQ ID NO: 1848348 - protein, 4 aa, Staphylococcus
DKQV

SEQ ID NO: 1848349 - protein, 14 aa, Staphylococcus
DKQWKEAKATSLED

SEQ ID NO: 1848350 - protein, 39 aa, Staphylococcus
DKRERDINKDIDDAEQAKENAQKLEEENQKTLKETQEEV

SEQ ID NO: 1848351 - protein, 39 aa, Staphylococcus
DKRERDINKDIDDAEQAKLNAQKLEEENKQTLKETQDEV

SEQ ID NO: 1848352 - protein, 38 aa, Staphylococcus
DKRERDINRDIDEAEEAKLNAQKLEEENKKTLKETQDE

SEQ ID NO: 1848353 - protein, 39 aa, Staphylococcus
DKRERDINRDIDEAEEAKLNAQKLEEENKKTLKQTQDEV

SEQ ID NO: 1848354 - protein, 6 aa, Staphylococcus
DKRGGW

SEQ ID NO: 1848355 - protein, 6 aa, Staphylococcus
DKRGQA

SEQ ID NO: 1848356 - protein, 6 aa, Staphylococcus
DKRIDD

SEQ ID NO: 1848357 - protein, 4 aa, Staphylococcus
DKRL

SEQ ID NO: 1848358 - protein, 16 aa, Staphylococcus
DKRRPQSTSHNDYYED

SEQ ID NO: 1848359 - protein, 8 aa, Staphylococcus
DKRSTYNT

SEQ ID NO: 1848360 - protein, 9 aa, Staphylococcus
DKSELTKQI

SEQ ID NO: 1848361 - protein, 7 aa, Staphylococcus
DKSESSA

SEQ ID NO: 1848362 - protein, 5 aa, Staphylococcus
DKSHI

SEQ ID NO: 1848363 - protein, 6 aa, Staphylococcus
DKSHYD

SEQ ID NO: 1848364 - protein, 6 aa, Staphylococcus
DKSKID

SEQ ID NO: 1848365 - protein, 9 aa, Staphylococcus
DKSKLNRHS

SEQ ID NO: 1848366 - protein, 11 aa, Staphylococcus
DKSKRQSFPSD

SEQ ID NO: 1848367 - protein, 10 aa, Staphylococcus
DKSKTKPDAA

SEQ ID NO: 1848368 - protein, 10 aa, Staphylococcus
DKSKTKQDAA

SEQ ID NO: 1848369 - protein, 6 aa, Staphylococcus
DKSLTT

SEQ ID NO: 1848370 - protein, 13 aa, Staphylococcus
DKSNLSRTLEDSS

SEQ ID NO: 1848371 - protein, 13 aa, Staphylococcus
DKSRSRKLGGNGL

SEQ ID NO: 1848372 - protein, 14 aa, Staphylococcus
DKSRSRKQGGNGLG

SEQ ID NO: 1848373 - protein, 12 aa, Staphylococcus
DKSRSRSQGGNG

SEQ ID NO: 1848374 - protein, 10 aa, Staphylococcus
DKSSDPKQTI

SEQ ID NO: 1848375 - protein, 23 aa, Staphylococcus
DKSSEYDQKPINEQDTSNHHETH

SEQ ID NO: 1848376 - protein, 17 aa, Staphylococcus
DKSSKDDEVLKTLLKKL

SEQ ID NO: 1848377 - protein, 17 aa, Staphylococcus
DKSSKPNTSFKPNSNLI

SEQ ID NO: 1848378 - protein, 4 aa, Staphylococcus
DKST

SEQ ID NO: 1848379 - protein, 7 aa, Staphylococcus
DKSTRNI

SEQ ID NO: 1848380 - protein, 7 aa, Staphylococcus
DKSTYKG

SEQ ID NO: 1848381 - protein, 7 aa, Staphylococcus
DKSYGSE

SEQ ID NO: 1848382 - protein, 4 aa, Staphylococcus
DKTF

SEQ ID NO: 1848383 - protein, 6 aa, Staphylococcus
DKTGKY

SEQ ID NO: 1848384 - protein, 9 aa, Staphylococcus
DKTGTLTKG

SEQ ID NO: 1848385 - protein, 5 aa, Staphylococcus
DKTGV

SEQ ID NO: 1848386 - protein, 4 aa, Staphylococcus
DKTH

SEQ ID NO: 1848387 - protein, 8 aa, Staphylococcus
DKTPSRYA

SEQ ID NO: 1848388 - protein, 7 aa, Staphylococcus
DKTRNSI

SEQ ID NO: 1848389 - protein, 9 aa, Staphylococcus
DKTSDKQEL

SEQ ID NO: 1848390 - protein, 10 aa, Staphylococcus
DKTSNRKQAI

SEQ ID NO: 1848391 - protein, 13 aa, Staphylococcus
DKTTRGNPKKYTR

SEQ ID NO: 1848392 - protein, 12 aa, Staphylococcus
DKTTRNNSDNYT

SEQ ID NO: 1848393 - protein, 10 aa, Staphylococcus
DKTVKEDTDL

SEQ ID NO: 1848394 - protein, 6 aa, Staphylococcus
DKTWSD

SEQ ID NO: 1848395 - protein, 15 aa, Staphylococcus
DKVAESTRVKQSSDY

SEQ ID NO: 1848396 - protein, 16 aa, Staphylococcus
DKVDRVGVAPSNVTED

SEQ ID NO: 1848397 - protein, 7 aa, Staphylococcus
DKVDTDE

SEQ ID NO: 1848398 - protein, 8 aa, Staphylococcus
DKVEQSYG

SEQ ID NO: 1848399 - protein, 7 aa, Staphylococcus
DKVETVP

SEQ ID NO: 1848400 - protein, 4 aa, Staphylococcus
DKVG

SEQ ID NO: 1848401 - protein, 15 aa, Staphylococcus
DKVGHGETANSISEK

SEQ ID NO: 1848402 - protein, 7 aa, Staphylococcus
DKVNNRK

SEQ ID NO: 1848403 - protein, 6 aa, Staphylococcus
DKVNTN

SEQ ID NO: 1848404 - protein, 8 aa, Staphylococcus
DKVTSPGT

SEQ ID NO: 1848405 - protein, 5 aa, Staphylococcus
DKWGR

SEQ ID NO: 1848406 - protein, 9 aa, Staphylococcus
DKYGPPSVN

SEQ ID NO: 1848407 - protein, 5 aa, Staphylococcus
DKYGR

SEQ ID NO: 1848408 - protein, 4 aa, Staphylococcus
DKYM

SEQ ID NO: 1848409 - protein, 12 aa, Staphylococcus
DKYNKTFTSHPG

SEQ ID NO: 1848410 - protein, 18 aa, Staphylococcus
DKYNQLKQSAVETKHQYG

SEQ ID NO: 1848411 - protein, 13 aa, Staphylococcus
DKYPAQQAGIHKG

SEQ ID NO: 1848412 - protein, 7 aa, Staphylococcus
DKYPHDN

SEQ ID NO: 1848413 - protein, 4 aa, Staphylococcus
DKYS

SEQ ID NO: 1848414 - protein, 8 aa, Staphylococcus
DLAEDPFQ

SEQ ID NO: 1848415 - protein, 7 aa, Staphylococcus
DLAGSKN

SEQ ID NO: 1848416 - protein, 6 aa, Staphylococcus
DLANRK

SEQ ID NO: 1848417 - protein, 7 aa, Staphylococcus
DLASPSM

SEQ ID NO: 1848418 - protein, 16 aa, Staphylococcus
DLDEMKEKYDLQDKDK

SEQ ID NO: 1848419 - protein, 6 aa, Staphylococcus
DLDKAT

SEQ ID NO: 1848420 - protein, 5 aa, Staphylococcus
DLDTL

SEQ ID NO: 1848421 - protein, 5 aa, Staphylococcus
DLEGS

SEQ ID NO: 1848422 - protein, 12 aa, Staphylococcus
DLELYGDNANNE

SEQ ID NO: 1848423 - protein, 70 aa, Staphylococcus
DLEQNNDAKNASSSQISEEKKRYFNNDQSHYKEDNDINNDKRKNHFEEEQEQQDSSSEQIHPEQKQTSYS

SEQ ID NO: 1848424 - protein, 5 aa, Staphylococcus
DLGAS

SEQ ID NO: 1848425 - protein, 5 aa, Staphylococcus
DLGGP

SEQ ID NO: 1848426 - protein, 7 aa, Staphylococcus
DLGPVSA

SEQ ID NO: 1848427 - protein, 4 aa, Staphylococcus
DLGR

SEQ ID NO: 1848428 - protein, 5 aa, Staphylococcus
DLHNT

SEQ ID NO: 1848429 - protein, 9 aa, Staphylococcus
DLHTDRTDG

SEQ ID NO: 1848430 - protein, 13 aa, Staphylococcus
DLKEPNTKVEKSP

SEQ ID NO: 1848431 - protein, 6 aa, Staphylococcus
DLKKGD

SEQ ID NO: 1848432 - protein, 7 aa, Staphylococcus
DLKKNLS

SEQ ID NO: 1848433 - protein, 6 aa, Staphylococcus
DLKKQA

SEQ ID NO: 1848434 - protein, 14 aa, Staphylococcus
DLKNNENKSSDNDT

SEQ ID NO: 1848435 - protein, 6 aa, Staphylococcus
DLKPTN

SEQ ID NO: 1848436 - protein, 13 aa, Staphylococcus
DLKQFKDKGGHAE

SEQ ID NO: 1848437 - protein, 4 aa, Staphylococcus
DLND

SEQ ID NO: 1848438 - protein, 12 aa, Staphylococcus
DLNEGKTCGEAL

SEQ ID NO: 1848439 - protein, 17 aa, Staphylococcus
DLNNQANKKITGIEPGA

SEQ ID NO: 1848440 - protein, 4 aa, Staphylococcus
DLNP

SEQ ID NO: 1848441 - protein, 6 aa, Staphylococcus
DLNPGL

SEQ ID NO: 1848442 - protein, 7 aa, Staphylococcus
DLNQGSK

SEQ ID NO: 1848443 - protein, 10 aa, Staphylococcus
DLNQYNTEEP

SEQ ID NO: 1848444 - protein, 5 aa, Staphylococcus
DLPSK

SEQ ID NO: 1848445 - protein, 5 aa, Staphylococcus
DLQAQ

SEQ ID NO: 1848446 - protein, 15 aa, Staphylococcus
DLQKITDTAKKQDGL

SEQ ID NO: 1848447 - protein, 25 aa, Staphylococcus
DLQLENKKHDLQDTQSLDNEQTDNQ

SEQ ID NO: 1848448 - protein, 13 aa, Staphylococcus
DLQSELNTKYTPT

SEQ ID NO: 1848449 - protein, 4 aa, Staphylococcus
DLQT

SEQ ID NO: 1848450 - protein, 20 aa, Staphylococcus
DLREGYEYSRSGNPTRTALE

SEQ ID NO: 1848451 - protein, 10 aa, Staphylococcus
DLSDKRKLSD

SEQ ID NO: 1848452 - protein, 10 aa, Staphylococcus
DLSDSRKLSD

SEQ ID NO: 1848453 - protein, 11 aa, Staphylococcus
DLSDSRKLSDE

SEQ ID NO: 1848454 - protein, 5 aa, Staphylococcus
DLSEV

SEQ ID NO: 1848455 - protein, 17 aa, Staphylococcus
DLSGLTDAEAQPTQTEL

SEQ ID NO: 1848456 - protein, 8 aa, Staphylococcus
DLSKDETL

SEQ ID NO: 1848457 - protein, 7 aa, Staphylococcus
DLSKNEV

SEQ ID NO: 1848458 - protein, 13 aa, Staphylococcus
DLSKYDTNKPERI

SEQ ID NO: 1848459 - protein, 10 aa, Staphylococcus
DLSNKTEDSV

SEQ ID NO: 1848460 - protein, 10 aa, Staphylococcus
DLSPEEQAQF

SEQ ID NO: 1848461 - protein, 25 aa, Staphylococcus
DLSQAKDNQLSDKMKSEFGNAPQIN

SEQ ID NO: 1848462 - protein, 17 aa, Staphylococcus
DLSQKELKQLQSQSHVD

SEQ ID NO: 1848463 - protein, 81 aa, Staphylococcus
DLSQYASNDASRIINGKPPVAETGDKSESNTVDNKTNNDTKVDSSENTLINNPNEAAVGEEVVSNNSNSTLIEDDKNVSHN

SEQ ID NO: 1848464 - protein, 7 aa, Staphylococcus
DLSSYDT

SEQ ID NO: 1848465 - protein, 7 aa, Staphylococcus
DLTDESK

SEQ ID NO: 1848466 - protein, 20 aa, Staphylococcus
DLVQGSAKQEFKQNTNQPAV

SEQ ID NO: 1848467 - protein, 5 aa, Staphylococcus
DLVRG

SEQ ID NO: 1848468 - protein, 7 aa, Staphylococcus
DLYSGKA

SEQ ID NO: 1848469 - protein, 5 aa, Staphylococcus
DMDAV

SEQ ID NO: 1848470 - protein, 9 aa, Staphylococcus
DMDEATHQS

SEQ ID NO: 1848471 - protein, 4 aa, Staphylococcus
DMEG

SEQ ID NO: 1848472 - protein, 6 aa, Staphylococcus
DMKEDL

SEQ ID NO: 1848473 - protein, 12 aa, Staphylococcus
DMKSSSKKGDIN

SEQ ID NO: 1848474 - protein, 7 aa, Staphylococcus
DMPPKDK

SEQ ID NO: 1848475 - protein, 5 aa, Staphylococcus
DMQSD

SEQ ID NO: 1848476 - protein, 35 aa, Staphylococcus
DMTAQAKETSSSFHTSESKDESLKDKIDDAKDDID

SEQ ID NO: 1848477 - protein, 40 aa, Staphylococcus
DMTKDIKDTLKDIKDDDKDIKNITDPYENRQISKDKTTAF

SEQ ID NO: 1848478 - protein, 7 aa, Staphylococcus
DMTLQGQ

SEQ ID NO: 1848479 - protein, 7 aa, Staphylococcus
DMYSGKE

SEQ ID NO: 1848480 - protein, 8 aa, Staphylococcus
DNAANPSN

SEQ ID NO: 1848481 - protein, 8 aa, Staphylococcus
DNAEHPNI

SEQ ID NO: 1848482 - protein, 13 aa, Staphylococcus
DNAESAPNAQNVT

SEQ ID NO: 1848483 - protein, 13 aa, Staphylococcus
DNAKPLKKEGQTF

SEQ ID NO: 1848484 - protein, 11 aa, Staphylococcus
DNANDKLEQIN

SEQ ID NO: 1848485 - protein, 14 aa, Staphylococcus
DNANEENASNQVTK

SEQ ID NO: 1848486 - protein, 6 aa, Staphylococcus
DNAPAL

SEQ ID NO: 1848487 - protein, 9 aa, Staphylococcus
DNAPGTKAI

SEQ ID NO: 1848488 - protein, 11 aa, Staphylococcus
DNAPKSALGTS

SEQ ID NO: 1848489 - protein, 6 aa, Staphylococcus
DNAPSI

SEQ ID NO: 1848490 - protein, 70 aa, Staphylococcus
DNAQEANQNANNRLQENVETEQQSSKGSDSYSNIKTSQISNSNSDNAGNNQNGTAISSEDVSAMESSLSK

SEQ ID NO: 1848491 - protein, 28 aa, Staphylococcus
DNASKKAITYARGRKTSQSEVLKTAEKL

SEQ ID NO: 1848492 - protein, 6 aa, Staphylococcus
DNATNL

SEQ ID NO: 1848493 - protein, 9 aa, Staphylococcus
DNAYQGGNV

SEQ ID NO: 1848494 - protein, 5 aa, Staphylococcus
DNDAY

SEQ ID NO: 1848495 - protein, 13 aa, Staphylococcus
DNDDKKSDSRRYG

SEQ ID NO: 1848496 - protein, 8 aa, Staphylococcus
DNDDNQKV

SEQ ID NO: 1848497 - protein, 8 aa, Staphylococcus
DNDDSQKV

SEQ ID NO: 1848498 - protein, 4 aa, Staphylococcus
DNDI

SEQ ID NO: 1848499 - protein, 16 aa, Staphylococcus
DNDKLTTSKGLSDLET

SEQ ID NO: 1848500 - protein, 6 aa, Staphylococcus
DNDLEK

SEQ ID NO: 1848501 - protein, 7 aa, Staphylococcus
DNDLGDP

SEQ ID NO: 1848502 - protein, 7 aa, Staphylococcus
DNDNNID

SEQ ID NO: 1848503 - protein, 6 aa, Staphylococcus
DNDQHQ

SEQ ID NO: 1848504 - protein, 6 aa, Staphylococcus
DNDQTE

SEQ ID NO: 1848505 - protein, 7 aa, Staphylococcus
DNDRNYS

SEQ ID NO: 1848506 - protein, 6 aa, Staphylococcus
DNDTFK

SEQ ID NO: 1848507 - protein, 5 aa, Staphylococcus
DNEAI

SEQ ID NO: 1848508 - protein, 8 aa, Staphylococcus
DNEDKDTI

SEQ ID NO: 1848509 - protein, 4 aa, Staphylococcus
DNEE

SEQ ID NO: 1848510 - protein, 6 aa, Staphylococcus
DNEESY

SEQ ID NO: 1848511 - protein, 5 aa, Staphylococcus
DNEGK

SEQ ID NO: 1848512 - protein, 11 aa, Staphylococcus
DNEGKPFSRND

SEQ ID NO: 1848513 - protein, 9 aa, Staphylococcus
DNENGDYKQ

SEQ ID NO: 1848514 - protein, 8 aa, Staphylococcus
DNENSRDN

SEQ ID NO: 1848515 - protein, 8 aa, Staphylococcus
DNEQSITR

SEQ ID NO: 1848516 - protein, 12 aa, Staphylococcus
DNETKSFDTSLE

SEQ ID NO: 1848517 - protein, 5 aa, Staphylococcus
DNEVR

SEQ ID NO: 1848518 - protein, 4 aa, Staphylococcus
DNFK

SEQ ID NO: 1848519 - protein, 12 aa, Staphylococcus
DNFKDNKKDSLG

SEQ ID NO: 1848520 - protein, 23 aa, Staphylococcus
DNFKKEGKEEVKVDGETEKANKV

SEQ ID NO: 1848521 - protein, 13 aa, Staphylococcus
DNFNKNSAEVGQG

SEQ ID NO: 1848522 - protein, 14 aa, Staphylococcus
DNFTNRVKTDLEKM

SEQ ID NO: 1848523 - protein, 29 aa, Staphylococcus
DNGGAQVQEANNSKGGNVLDGKSDKYKSV

SEQ ID NO: 1848524 - protein, 15 aa, Staphylococcus
DNGGGGAPDENTISN

SEQ ID NO: 1848525 - protein, 7 aa, Staphylococcus
DNGGISY

SEQ ID NO: 1848526 - protein, 8 aa, Staphylococcus
DNGHGIPY

SEQ ID NO: 1848527 - protein, 10 aa, Staphylococcus
DNGKATSYKQ

SEQ ID NO: 1848528 - protein, 8 aa, Staphylococcus
DNGKGFNV

SEQ ID NO: 1848529 - protein, 17 aa, Staphylococcus
DNGKGFNVDEKVEQSYG

SEQ ID NO: 1848530 - protein, 5 aa, Staphylococcus
DNGLN

SEQ ID NO: 1848531 - protein, 12 aa, Staphylococcus
DNGQGMRQPETV

SEQ ID NO: 1848532 - protein, 12 aa, Staphylococcus
DNGSLSLPASGQ

SEQ ID NO: 1848533 - protein, 15 aa, Staphylococcus
DNGSNGSLEKATTKV

SEQ ID NO: 1848534 - protein, 9 aa, Staphylococcus
DNGVGISTA

SEQ ID NO: 1848535 - protein, 30 aa, Staphylococcus
DNGYRKSDATLTNTESQDGDKRNDKGQIEI

SEQ ID NO: 1848536 - protein, 6 aa, Staphylococcus
DNHPDT

SEQ ID NO: 1848537 - protein, 54 aa, Staphylococcus
DNHRDNRRDDYYRNNRDDYRDGEYDRPHEDSREAEYRRRSDEDGRYYNERDYRR

SEQ ID NO: 1848538 - protein, 9 aa, Staphylococcus
DNHYDDAKT

SEQ ID NO: 1848539 - protein, 6 aa, Staphylococcus
DNIGNK

SEQ ID NO: 1848540 - protein, 13 aa, Staphylococcus
DNIKDAGKGMGMT

SEQ ID NO: 1848541 - protein, 9 aa, Staphylococcus
DNIKHEKDS

SEQ ID NO: 1848542 - protein, 10 aa, Staphylococcus
DNIKQDDDDV

SEQ ID NO: 1848543 - protein, 6 aa, Staphylococcus
DNIKQS

SEQ ID NO: 1848544 - protein, 4 aa, Staphylococcus
DNIQ

SEQ ID NO: 1848545 - protein, 5 aa, Staphylococcus
DNIQD

SEQ ID NO: 1848546 - protein, 5 aa, Staphylococcus
DNIQH

SEQ ID NO: 1848547 - protein, 6 aa, Staphylococcus
DNISEI

SEQ ID NO: 1848548 - protein, 5 aa, Staphylococcus
DNISS

SEQ ID NO: 1848549 - protein, 5 aa, Staphylococcus
DNITA

SEQ ID NO: 1848550 - protein, 44 aa, Staphylococcus
DNKDDTKATAHFKPKTTKEDISESTKKQAYYETSNDDNATLKNT

SEQ ID NO: 1848551 - protein, 8 aa, Staphylococcus
DNKDELNK

SEQ ID NO: 1848552 - protein, 8 aa, Staphylococcus
DNKDISHG

SEQ ID NO: 1848553 - protein, 20 aa, Staphylococcus
DNKEPKLESSQLNQSQQNKI

SEQ ID NO: 1848554 - protein, 7 aa, Staphylococcus
DNKKISQ

SEQ ID NO: 1848555 - protein, 18 aa, Staphylococcus
DNKQAPPAFSKTNKNGVP

SEQ ID NO: 1848556 - protein, 9 aa, Staphylococcus
DNKQPQIEK

SEQ ID NO: 1848557 - protein, 6 aa, Staphylococcus
DNKSIN

SEQ ID NO: 1848558 - protein, 7 aa, Staphylococcus
DNKSQFN

SEQ ID NO: 1848559 - protein, 5 aa, Staphylococcus
DNKTI

SEQ ID NO: 1848560 - protein, 8 aa, Staphylococcus
DNKVNKDM

SEQ ID NO: 1848561 - protein, 9 aa, Staphylococcus
DNLKREKDS

SEQ ID NO: 1848562 - protein, 9 aa, Staphylococcus
DNLPGVNTS

SEQ ID NO: 1848563 - protein, 7 aa, Staphylococcus
DNLPSVK

SEQ ID NO: 1848564 - protein, 12 aa, Staphylococcus
DNLQNQAKDKNI

SEQ ID NO: 1848565 - protein, 17 aa, Staphylococcus
DNLQTSPQSTSKTSENN

SEQ ID NO: 1848566 - protein, 6 aa, Staphylococcus
DNLSDK

SEQ ID NO: 1848567 - protein, 7 aa, Staphylococcus
DNLTPSN

SEQ ID NO: 1848568 - protein, 7 aa, Staphylococcus
DNLTQSE

SEQ ID NO: 1848569 - protein, 4 aa, Staphylococcus
DNMN

SEQ ID NO: 1848570 - protein, 7 aa, Staphylococcus
DNMSGEL

SEQ ID NO: 1848571 - protein, 14 aa, Staphylococcus
DNNAATDAHLTGSS

SEQ ID NO: 1848572 - protein, 8 aa, Staphylococcus
DNNDAQKV

SEQ ID NO: 1848573 - protein, 8 aa, Staphylococcus
DNNDSQKV

SEQ ID NO: 1848574 - protein, 8 aa, Staphylococcus
DNNDTQKL

SEQ ID NO: 1848575 - protein, 8 aa, Staphylococcus
DNNDTQKV

SEQ ID NO: 1848576 - protein, 5 aa, Staphylococcus
DNNGS

SEQ ID NO: 1848577 - protein, 10 aa, Staphylococcus
DNNKQNINQD

SEQ ID NO: 1848578 - protein, 12 aa, Staphylococcus
DNNTEKDTKTVN

SEQ ID NO: 1848579 - protein, 10 aa, Staphylococcus
DNNTNTEVKG

SEQ ID NO: 1848580 - protein, 18 aa, Staphylococcus
DNNVIGSGTTDSNGRVTI

SEQ ID NO: 1848581 - protein, 39 aa, Staphylococcus
DNPIKQEDYHGEISATDTSKLETEGTTFERQEDIKSKDI

SEQ ID NO: 1848582 - protein, 6 aa, Staphylococcus
DNPINK

SEQ ID NO: 1848583 - protein, 11 aa, Staphylococcus
DNPKEAENRKE

SEQ ID NO: 1848584 - protein, 11 aa, Staphylococcus
DNPKQAENRKN

SEQ ID NO: 1848585 - protein, 14 aa, Staphylococcus
DNPNQIPNGQTPGT

SEQ ID NO: 1848586 - protein, 16 aa, Staphylococcus
DNPNTLPDGQTPGTHN

SEQ ID NO: 1848587 - protein, 9 aa, Staphylococcus
DNPQIKSTV

SEQ ID NO: 1848588 - protein, 5 aa, Staphylococcus
DNPQK

SEQ ID NO: 1848589 - protein, 4 aa, Staphylococcus
DNPS

SEQ ID NO: 1848590 - protein, 17 aa, Staphylococcus
DNPSTLPDGRTPGTYTV

SEQ ID NO: 1848591 - protein, 16 aa, Staphylococcus
DNPSTLPNGKTPGEYT

SEQ ID NO: 1848592 - protein, 16 aa, Staphylococcus
DNPSTLPNGQTPGTFT

SEQ ID NO: 1848593 - protein, 16 aa, Staphylococcus
DNPSTLPNGQTPGTHN

SEQ ID NO: 1848594 - protein, 16 aa, Staphylococcus
DNPSTLPNGQTPGTYT

SEQ ID NO: 1848595 - protein, 6 aa, Staphylococcus
DNPTNI

SEQ ID NO: 1848596 - protein, 8 aa, Staphylococcus
DNQDSDTI

SEQ ID NO: 1848597 - protein, 5 aa, Staphylococcus
DNQET

SEQ ID NO: 1848598 - protein, 5 aa, Staphylococcus
DNQGL

SEQ ID NO: 1848599 - protein, 7 aa, Staphylococcus
DNQIEHE

SEQ ID NO: 1848600 - protein, 6 aa, Staphylococcus
DNQNPQ

SEQ ID NO: 1848601 - protein, 27 aa, Staphylococcus
DNQVKGTAFKNSDIEYGGMSSKNNDLQ

SEQ ID NO: 1848602 - protein, 7 aa, Staphylococcus
DNRISTQ

SEQ ID NO: 1848603 - protein, 8 aa, Staphylococcus
DNRKATGD

SEQ ID NO: 1848604 - protein, 27 aa, Staphylococcus
DNRNRDGQNNKEVNKHPQNIEEKTENL

SEQ ID NO: 1848605 - protein, 9 aa, Staphylococcus
DNRQNSIDS

SEQ ID NO: 1848606 - protein, 11 aa, Staphylococcus
DNRQNSLDSRF

SEQ ID NO: 1848607 - protein, 13 aa, Staphylococcus
DNRQNSNDSRYKD

SEQ ID NO: 1848608 - protein, 10 aa, Staphylococcus
DNRQNSVDSR

SEQ ID NO: 1848609 - protein, 11 aa, Staphylococcus
DNRQNSVDSRY

SEQ ID NO: 1848610 - protein, 15 aa, Staphylococcus
DNRYPKLGEANYTEK

SEQ ID NO: 1848611 - protein, 7 aa, Staphylococcus
DNSEAGN

SEQ ID NO: 1848612 - protein, 5 aa, Staphylococcus
DNSEG

SEQ ID NO: 1848613 - protein, 18 aa, Staphylococcus
DNSEKANTSFKPNKNLLT

SEQ ID NO: 1848614 - protein, 19 aa, Staphylococcus
DNSGREKNGQTAEKSRTDA

SEQ ID NO: 1848615 - protein, 9 aa, Staphylococcus
DNSNGVISD

SEQ ID NO: 1848616 - protein, 29 aa, Staphylococcus
DNSNKERVKDGLSDINSDIKDTIGKSGYN

SEQ ID NO: 1848617 - protein, 6 aa, Staphylococcus
DNSNTI

SEQ ID NO: 1848618 - protein, 4 aa, Staphylococcus
DNSQ

SEQ ID NO: 1848619 - protein, 6 aa, Staphylococcus
DNSQDV

SEQ ID NO: 1848620 - protein, 47 aa, Staphylococcus
DNSTATISKGDKGDAGQTGATGAKGDKGQDAQPLTVTSTNKDGDGNT

SEQ ID NO: 1848621 - protein, 6 aa, Staphylococcus
DNSTYI

SEQ ID NO: 1848622 - protein, 4 aa, Staphylococcus
DNSY

SEQ ID NO: 1848623 - protein, 9 aa, Staphylococcus
DNTDNQQFG

SEQ ID NO: 1848624 - protein, 7 aa, Staphylococcus
DNTDSPQ

SEQ ID NO: 1848625 - protein, 4 aa, Staphylococcus
DNTG

SEQ ID NO: 1848626 - protein, 11 aa, Staphylococcus
DNTNKDLNKNA

SEQ ID NO: 1848627 - protein, 7 aa, Staphylococcus
DNTNSFV

SEQ ID NO: 1848628 - protein, 5 aa, Staphylococcus
DNTSK

SEQ ID NO: 1848629 - protein, 11 aa, Staphylococcus
DNTTVKEDTDL

SEQ ID NO: 1848630 - protein, 15 aa, Staphylococcus
DNVAAQESGTNVNNK

SEQ ID NO: 1848631 - protein, 10 aa, Staphylococcus
DNVDVEDKQR

SEQ ID NO: 1848632 - protein, 9 aa, Staphylococcus
DNVKTDLSV

SEQ ID NO: 1848633 - protein, 8 aa, Staphylococcus
DNVNSNDY

SEQ ID NO: 1848634 - protein, 17 aa, Staphylococcus
DNVQAQDLSKKVEAQTE

SEQ ID NO: 1848635 - protein, 11 aa, Staphylococcus
DNVRNAKNNLH

SEQ ID NO: 1848636 - protein, 4 aa, Staphylococcus
DNVS

SEQ ID NO: 1848637 - protein, 13 aa, Staphylococcus
DNVTHSANEHEPV

SEQ ID NO: 1848638 - protein, 7 aa, Staphylococcus
DNVTSDD

SEQ ID NO: 1848639 - protein, 8 aa, Staphylococcus
DNVTTAEL

SEQ ID NO: 1848640 - protein, 14 aa, Staphylococcus
DNVYKGKDYEMSNI

SEQ ID NO: 1848641 - protein, 10 aa, Staphylococcus
DNYEDSKSNH

SEQ ID NO: 1848642 - protein, 4 aa, Staphylococcus
DNYG

SEQ ID NO: 1848643 - protein, 14 aa, Staphylococcus
DNYQRPSYNKKPKF

SEQ ID NO: 1848644 - protein, 4 aa, Staphylococcus
DNYR

SEQ ID NO: 1848645 - protein, 12 aa, Staphylococcus
DNYRKDKVGKGY

SEQ ID NO: 1848646 - protein, 7 aa, Staphylococcus
DPAESPY

SEQ ID NO: 1848647 - protein, 8 aa, Staphylococcus
DPAKDGGF

SEQ ID NO: 1848648 - protein, 7 aa, Staphylococcus
DPAKEGG

SEQ ID NO: 1848649 - protein, 8 aa, Staphylococcus
DPASRAIS

SEQ ID NO: 1848650 - protein, 9 aa, Staphylococcus
DPDAKGNRF

SEQ ID NO: 1848651 - protein, 12 aa, Staphylococcus
DPDANNDAMSEE

SEQ ID NO: 1848652 - protein, 12 aa, Staphylococcus
DPDAQADAMSEE

SEQ ID NO: 1848653 - protein, 12 aa, Staphylococcus
DPDAQSDAMSEE

SEQ ID NO: 1848654 - protein, 12 aa, Staphylococcus
DPDAQTDAMSEE

SEQ ID NO: 1848655 - protein, 8 aa, Staphylococcus
DPDASLAN

SEQ ID NO: 1848656 - protein, 12 aa, Staphylococcus
DPDENNDAMSEE

SEQ ID NO: 1848657 - protein, 6 aa, Staphylococcus
DPDKKT

SEQ ID NO: 1848658 - protein, 12 aa, Staphylococcus
DPDNKDISPEGI

SEQ ID NO: 1848659 - protein, 6 aa, Staphylococcus
DPDNSP

SEQ ID NO: 1848660 - protein, 5 aa, Staphylococcus
DPDRE

SEQ ID NO: 1848661 - protein, 5 aa, Staphylococcus
DPEAF

SEQ ID NO: 1848662 - protein, 8 aa, Staphylococcus
DPEAHRNS

SEQ ID NO: 1848663 - protein, 29 aa, Staphylococcus
DPEDPRYKDDTYFQPTHSNQQKSNFENQR

SEQ ID NO: 1848664 - protein, 21 aa, Staphylococcus
DPEDRRYKDDNYFNGNERNNY

SEQ ID NO: 1848665 - protein, 6 aa, Staphylococcus
DPEYNN

SEQ ID NO: 1848666 - protein, 4 aa, Staphylococcus
DPFN

SEQ ID NO: 1848667 - protein, 24 aa, Staphylococcus
DPGHGGSDQGASSNTHKKSKEKVY

SEQ ID NO: 1848668 - protein, 25 aa, Staphylococcus
DPGHGGSDQGASSRTNKKSLEKNYT

SEQ ID NO: 1848669 - protein, 25 aa, Staphylococcus
DPGHGGSDQGASSSTALKSLEKNYT

SEQ ID NO: 1848670 - protein, 6 aa, Staphylococcus
DPGLDK

SEQ ID NO: 1848671 - protein, 8 aa, Staphylococcus
DPGLDKSI

SEQ ID NO: 1848672 - protein, 6 aa, Staphylococcus
DPGPLE

SEQ ID NO: 1848673 - protein, 5 aa, Staphylococcus
DPHNK

SEQ ID NO: 1848674 - protein, 8 aa, Staphylococcus
DPIGDTKA

SEQ ID NO: 1848675 - protein, 9 aa, Staphylococcus
DPKAFAKAS

SEQ ID NO: 1848676 - protein, 17 aa, Staphylococcus
DPKAHAKKEIKALPNET

SEQ ID NO: 1848677 - protein, 18 aa, Staphylococcus
DPKAHAKKQLKSLPNETI

SEQ ID NO: 1848678 - protein, 18 aa, Staphylococcus
DPKAHAKNEIKKLPNETI

SEQ ID NO: 1848679 - protein, 11 aa, Staphylococcus
DPKAHAKQEIR

SEQ ID NO: 1848680 - protein, 9 aa, Staphylococcus
DPKLDTRLS

SEQ ID NO: 1848681 - protein, 8 aa, Staphylococcus
DPKNQQHN

SEQ ID NO: 1848682 - protein, 13 aa, Staphylococcus
DPLKKNGKNQVGA

SEQ ID NO: 1848683 - protein, 8 aa, Staphylococcus
DPLPSVTQ

SEQ ID NO: 1848684 - protein, 5 aa, Staphylococcus
DPLRT

SEQ ID NO: 1848685 - protein, 5 aa, Staphylococcus
DPLTS

SEQ ID NO: 1848686 - protein, 6 aa, Staphylococcus
DPLTSV

SEQ ID NO: 1848687 - protein, 16 aa, Staphylococcus
DPMPNASDKRSEIPQA

SEQ ID NO: 1848688 - protein, 16 aa, Staphylococcus
DPMPNITDERSDVPQA

SEQ ID NO: 1848689 - protein, 13 aa, Staphylococcus
DPNDAINNDKYYQ

SEQ ID NO: 1848690 - protein, 6 aa, Staphylococcus
DPNFDG

SEQ ID NO: 1848691 - protein, 5 aa, Staphylococcus
DPNFI

SEQ ID NO: 1848692 - protein, 14 aa, Staphylococcus
DPNFNTEEERTADV

SEQ ID NO: 1848693 - protein, 25 aa, Staphylococcus
DPNFTDEKDLYKDVTDKPIKPARKV

SEQ ID NO: 1848694 - protein, 8 aa, Staphylococcus
DPNFTEEK

SEQ ID NO: 1848695 - protein, 5 aa, Staphylococcus
DPNFV

SEQ ID NO: 1848696 - protein, 7 aa, Staphylococcus
DPNGDPK

SEQ ID NO: 1848697 - protein, 7 aa, Staphylococcus
DPNGENG

SEQ ID NO: 1848698 - protein, 10 aa, Staphylococcus
DPNHPEGANR

SEQ ID NO: 1848699 - protein, 6 aa, Staphylococcus
DPNNPP

SEQ ID NO: 1848700 - protein, 6 aa, Staphylococcus
DPNQTP

SEQ ID NO: 1848701 - protein, 5 aa, Staphylococcus
DPPFQ

SEQ ID NO: 1848702 - protein, 13 aa, Staphylococcus
DPPHGGKGMTDSA

SEQ ID NO: 1848703 - protein, 6 aa, Staphylococcus
DPRIQR

SEQ ID NO: 1848704 - protein, 10 aa, Staphylococcus
DPRKNEAYNN

SEQ ID NO: 1848705 - protein, 7 aa, Staphylococcus
DPRTPQT

SEQ ID NO: 1848706 - protein, 22 aa, Staphylococcus
DPSIGKNTDRAILDSDGDHTID

SEQ ID NO: 1848707 - protein, 5 aa, Staphylococcus
DPSIN

SEQ ID NO: 1848708 - protein, 10 aa, Staphylococcus
DPSNYEDVTS

SEQ ID NO: 1848709 - protein, 7 aa, Staphylococcus
DPTEIEN

SEQ ID NO: 1848710 - protein, 4 aa, Staphylococcus
DPTI

SEQ ID NO: 1848711 - protein, 5 aa, Staphylococcus
DPTSY

SEQ ID NO: 1848712 - protein, 6 aa, Staphylococcus
DPTTGV

SEQ ID NO: 1848713 - protein, 24 aa, Staphylococcus
DPTVNTTGKDGAETTSKSKYHHTA

SEQ ID NO: 1848714 - protein, 7 aa, Staphylococcus
DPVGGQN

SEQ ID NO: 1848715 - protein, 4 aa, Staphylococcus
DPWS

SEQ ID NO: 1848716 - protein, 6 aa, Staphylococcus
DPYEQA

SEQ ID NO: 1848717 - protein, 6 aa, Staphylococcus
DPYTNN

SEQ ID NO: 1848718 - protein, 12 aa, Staphylococcus
DQANDKLESIND

SEQ ID NO: 1848719 - protein, 12 aa, Staphylococcus
DQANGGKSRTDS

SEQ ID NO: 1848720 - protein, 31 aa, Staphylococcus
DQANKGSQVNESSQSKGGNVLDGKSDKYKTV

SEQ ID NO: 1848721 - protein, 8 aa, Staphylococcus
DQAQHQAD

SEQ ID NO: 1848722 - protein, 14 aa, Staphylococcus
DQATKQTRSEKHYK

SEQ ID NO: 1848723 - protein, 9 aa, Staphylococcus
DQDGKKTFY

SEQ ID NO: 1848724 - protein, 22 aa, Staphylococcus
DQDGKSSNKKGKNTQVVSKKNK

SEQ ID NO: 1848725 - protein, 41 aa, Staphylococcus
DQDNSTTKEEKDIAKQKIDDEVNKAKRNVDQSINNSNVDHA

SEQ ID NO: 1848726 - protein, 23 aa, Staphylococcus
DQDQVRQSSDYTNADSTQQHAYD

SEQ ID NO: 1848727 - protein, 9 aa, Staphylococcus
DQEGNFSKD

SEQ ID NO: 1848728 - protein, 31 aa, Staphylococcus
DQEYTRRHGQAYDKRDAHDERHRRYDDRERY

SEQ ID NO: 1848729 - protein, 4 aa, Staphylococcus
DQGC

SEQ ID NO: 1848730 - protein, 14 aa, Staphylococcus
DQGKANTLINSGTS

SEQ ID NO: 1848731 - protein, 4 aa, Staphylococcus
DQHH

SEQ ID NO: 1848732 - protein, 10 aa, Staphylococcus
DQIKESSKQM

SEQ ID NO: 1848733 - protein, 12 aa, Staphylococcus
DQINDDPTDNLK

SEQ ID NO: 1848734 - protein, 6 aa, Staphylococcus
DQINQK

SEQ ID NO: 1848735 - protein, 4 aa, Staphylococcus
DQKD

SEQ ID NO: 1848736 - protein, 11 aa, Staphylococcus
DQKDNPQQLQK

SEQ ID NO: 1848737 - protein, 6 aa, Staphylococcus
DQKHTS

SEQ ID NO: 1848738 - protein, 6 aa, Staphylococcus
DQKTEL

SEQ ID NO: 1848739 - protein, 8 aa, Staphylococcus
DQKVSHQE

SEQ ID NO: 1848740 - protein, 14 aa, Staphylococcus
DQLERKPDKTELEA

SEQ ID NO: 1848741 - protein, 4 aa, Staphylococcus
DQLG

SEQ ID NO: 1848742 - protein, 8 aa, Staphylococcus
DQLGDNKG

SEQ ID NO: 1848743 - protein, 8 aa, Staphylococcus
DQLNAKNE

SEQ ID NO: 1848744 - protein, 17 aa, Staphylococcus
DQNEDSNNDSQEQKGSI

SEQ ID NO: 1848745 - protein, 15 aa, Staphylococcus
DQNIETSLNVIKNPF

SEQ ID NO: 1848746 - protein, 13 aa, Staphylococcus
DQNKAADNGISAS

SEQ ID NO: 1848747 - protein, 12 aa, Staphylococcus
DQNKAASYGLSA

SEQ ID NO: 1848748 - protein, 13 aa, Staphylococcus
DQNKATDKGISAA

SEQ ID NO: 1848749 - protein, 13 aa, Staphylococcus
DQNKATEKGISAG

SEQ ID NO: 1848750 - protein, 17 aa, Staphylococcus
DQNPNLSNQEKEKLKDD

SEQ ID NO: 1848751 - protein, 7 aa, Staphylococcus
DQNPVNP

SEQ ID NO: 1848752 - protein, 4 aa, Staphylococcus
DQNQ

SEQ ID NO: 1848753 - protein, 9 aa, Staphylococcus
DQNSSSEFT

SEQ ID NO: 1848754 - protein, 21 aa, Staphylococcus
DQPDTPRPYRIGRKGNGKAYT

SEQ ID NO: 1848755 - protein, 9 aa, Staphylococcus
DQPSPNTTG

SEQ ID NO: 1848756 - protein, 16 aa, Staphylococcus
DQQDLKQQKTKDKVQK

SEQ ID NO: 1848757 - protein, 12 aa, Staphylococcus
DQQPEQAKEEIE

SEQ ID NO: 1848758 - protein, 6 aa, Staphylococcus
DQQPSI

SEQ ID NO: 1848759 - protein, 7 aa, Staphylococcus
DQQSTKS

SEQ ID NO: 1848760 - protein, 4 aa, Staphylococcus
DQRK

SEQ ID NO: 1848761 - protein, 16 aa, Staphylococcus
DQRKYKKARWKYKWRN

SEQ ID NO: 1848762 - protein, 19 aa, Staphylococcus
DQRKYKRAQRKYKRQNRKK

SEQ ID NO: 1848763 - protein, 5 aa, Staphylococcus
DQSEF

SEQ ID NO: 1848764 - protein, 8 aa, Staphylococcus
DQSHNKEK

SEQ ID NO: 1848765 - protein, 10 aa, Staphylococcus
DQSIKTSIDR

SEQ ID NO: 1848766 - protein, 5 aa, Staphylococcus
DQSIN

SEQ ID NO: 1848767 - protein, 9 aa, Staphylococcus
DQSKDKQQL

SEQ ID NO: 1848768 - protein, 18 aa, Staphylococcus
DQSKVKDDFKKAASLKQQ

SEQ ID NO: 1848769 - protein, 4 aa, Staphylococcus
DQSN

SEQ ID NO: 1848770 - protein, 28 aa, Staphylococcus
DQSNKDRVKDGLNDINNDIKDTVGQDGY

SEQ ID NO: 1848771 - protein, 28 aa, Staphylococcus
DQSNKDRVKKGLQELNSEIKDTVGQGEY

SEQ ID NO: 1848772 - protein, 6 aa, Staphylococcus
DQSRIH

SEQ ID NO: 1848773 - protein, 7 aa, Staphylococcus
DQSRIND

SEQ ID NO: 1848774 - protein, 8 aa, Staphylococcus
DQSRINDS

SEQ ID NO: 1848775 - protein, 11 aa, Staphylococcus
DQSTGGSTITQ

SEQ ID NO: 1848776 - protein, 12 aa, Staphylococcus
DQSTNNDGVDEV

SEQ ID NO: 1848777 - protein, 10 aa, Staphylococcus
DQSTNQKEAI

SEQ ID NO: 1848778 - protein, 11 aa, Staphylococcus
DQSTSTSENIQ

SEQ ID NO: 1848779 - protein, 8 aa, Staphylococcus
DQTGDTIK

SEQ ID NO: 1848780 - protein, 8 aa, Staphylococcus
DQTKDKSH

SEQ ID NO: 1848781 - protein, 21 aa, Staphylococcus
DQTLTVEKTSSVEPSQRIMKV

SEQ ID NO: 1848782 - protein, 6 aa, Staphylococcus
DQTQEW

SEQ ID NO: 1848783 - protein, 7 aa, Staphylococcus
DQTQEWK

SEQ ID NO: 1848784 - protein, 15 aa, Staphylococcus
DQTSEVVDSDNQESR

SEQ ID NO: 1848785 - protein, 7 aa, Staphylococcus
DQTSTKS

SEQ ID NO: 1848786 - protein, 5 aa, Staphylococcus
DQVAP

SEQ ID NO: 1848787 - protein, 4 aa, Staphylococcus
DQVE

SEQ ID NO: 1848788 - protein, 7 aa, Staphylococcus
DQVHHSS

SEQ ID NO: 1848789 - protein, 4 aa, Staphylococcus
DQVI

SEQ ID NO: 1848790 - protein, 24 aa, Staphylococcus
DQVINNGDATAQQISAEKDKVDQA

SEQ ID NO: 1848791 - protein, 10 aa, Staphylococcus
DQVKDTASIE

SEQ ID NO: 1848792 - protein, 8 aa, Staphylococcus
DQVPPAVA

SEQ ID NO: 1848793 - protein, 11 aa, Staphylococcus
DQYGHKPTVNT

SEQ ID NO: 1848794 - protein, 8 aa, Staphylococcus
DQYLPDSN

SEQ ID NO: 1848795 - protein, 8 aa, Staphylococcus
DQYQEGAD

SEQ ID NO: 1848796 - protein, 7 aa, Staphylococcus
DRADTKK

SEQ ID NO: 1848797 - protein, 8 aa, Staphylococcus
DRAKNNKV

SEQ ID NO: 1848798 - protein, 9 aa, Staphylococcus
DRDDGYKAV

SEQ ID NO: 1848799 - protein, 23 aa, Staphylococcus
DRDGTSSGQVSSFGGSDKKQTAM

SEQ ID NO: 1848800 - protein, 18 aa, Staphylococcus
DRDKFKKVTEEISKKKEN

SEQ ID NO: 1848801 - protein, 8 aa, Staphylococcus
DRDKSQRH

SEQ ID NO: 1848802 - protein, 4 aa, Staphylococcus
DRDL

SEQ ID NO: 1848803 - protein, 6 aa, Staphylococcus
DRDQSE

SEQ ID NO: 1848804 - protein, 11 aa, Staphylococcus
DRDQSNKYAPT

SEQ ID NO: 1848805 - protein, 6 aa, Staphylococcus
DRDSDV

SEQ ID NO: 1848806 - protein, 12 aa, Staphylococcus
DRDVQGGSTITQ

SEQ ID NO: 1848807 - protein, 10 aa, Staphylococcus
DREAESTTAI

SEQ ID NO: 1848808 - protein, 6 aa, Staphylococcus
DREEQF

SEQ ID NO: 1848809 - protein, 10 aa, Staphylococcus
DRGDGYPAVK

SEQ ID NO: 1848810 - protein, 6 aa, Staphylococcus
DRGNGF

SEQ ID NO: 1848811 - protein, 9 aa, Staphylococcus
DRGQEKPTS

SEQ ID NO: 1848812 - protein, 8 aa, Staphylococcus
DRHHNPET

SEQ ID NO: 1848813 - protein, 7 aa, Staphylococcus
DRIDAVS

SEQ ID NO: 1848814 - protein, 4 aa, Staphylococcus
DRIG

SEQ ID NO: 1848815 - protein, 5 aa, Staphylococcus
DRKER

SEQ ID NO: 1848816 - protein, 4 aa, Staphylococcus
DRKN

SEQ ID NO: 1848817 - protein, 14 aa, Staphylococcus
DRKPFELKDIFTKN

SEQ ID NO: 1848818 - protein, 17 aa, Staphylococcus
DRKQAPPKFQATNRKGV

SEQ ID NO: 1848819 - protein, 14 aa, Staphylococcus
DRKTRENPNDYKQS

SEQ ID NO: 1848820 - protein, 7 aa, Staphylococcus
DRLANSE

SEQ ID NO: 1848821 - protein, 6 aa, Staphylococcus
DRLEDG

SEQ ID NO: 1848822 - protein, 7 aa, Staphylococcus
DRLENSE

SEQ ID NO: 1848823 - protein, 5 aa, Staphylococcus
DRLGR

SEQ ID NO: 1848824 - protein, 5 aa, Staphylococcus
DRLGY

SEQ ID NO: 1848825 - protein, 6 aa, Staphylococcus
DRLGYS

SEQ ID NO: 1848826 - protein, 10 aa, Staphylococcus
DRLTQQVGTT

SEQ ID NO: 1848827 - protein, 7 aa, Staphylococcus
DRNIKGD

SEQ ID NO: 1848828 - protein, 6 aa, Staphylococcus
DRNLSG

SEQ ID NO: 1848829 - protein, 15 aa, Staphylococcus
DRNQATDAHPTGSSL

SEQ ID NO: 1848830 - protein, 8 aa, Staphylococcus
DRPDGFKA

SEQ ID NO: 1848831 - protein, 15 aa, Staphylococcus
DRPDLAKQFKETLLN

SEQ ID NO: 1848832 - protein, 7 aa, Staphylococcus
DRPDLGK

SEQ ID NO: 1848833 - protein, 16 aa, Staphylococcus
DRPDLGKQFKSSLNIE

SEQ ID NO: 1848834 - protein, 6 aa, Staphylococcus
DRQAPK

SEQ ID NO: 1848835 - protein, 7 aa, Staphylococcus
DRRDATA

SEQ ID NO: 1848836 - protein, 6 aa, Staphylococcus
DRRTDN

SEQ ID NO: 1848837 - protein, 7 aa, Staphylococcus
DRSDEEV

SEQ ID NO: 1848838 - protein, 8 aa, Staphylococcus
DRSDGYKA

SEQ ID NO: 1848839 - protein, 5 aa, Staphylococcus
DRSNA

SEQ ID NO: 1848840 - protein, 4 aa, Staphylococcus
DRSY

SEQ ID NO: 1848841 - protein, 20 aa, Staphylococcus
DRTAKERQIGTDNSDSEYDS

SEQ ID NO: 1848842 - protein, 42 aa, Staphylococcus
DRTEETPEGTKVTFSDGKSITIPKGKDGKSITVKSSEPNADG

SEQ ID NO: 1848843 - protein, 9 aa, Staphylococcus
DRTKLNTGA

SEQ ID NO: 1848844 - protein, 6 aa, Staphylococcus
DRTNTR

SEQ ID NO: 1848845 - protein, 31 aa, Staphylococcus
DRTPFRAKDGHGKGAQGAAGGKTEKQSVGKT

SEQ ID NO: 1848846 - protein, 14 aa, Staphylococcus
DRTTNGSGKVSEHT

SEQ ID NO: 1848847 - protein, 7 aa, Staphylococcus
DRVDRTR

SEQ ID NO: 1848848 - protein, 12 aa, Staphylococcus
DRVESEEPFDSK

SEQ ID NO: 1848849 - protein, 10 aa, Staphylococcus
DRVNTTTGIS

SEQ ID NO: 1848850 - protein, 12 aa, Staphylococcus
DRYGNNDKEHYP

SEQ ID NO: 1848851 - protein, 5 aa, Staphylococcus
DRYNN

SEQ ID NO: 1848852 - protein, 11 aa, Staphylococcus
DSAFIDQQGKN

SEQ ID NO: 1848853 - protein, 9 aa, Staphylococcus
DSAINQGTQ

SEQ ID NO: 1848854 - protein, 14 aa, Staphylococcus
DSAKASKDITNVAN

SEQ ID NO: 1848855 - protein, 8 aa, Staphylococcus
DSASTGGS

SEQ ID NO: 1848856 - protein, 202 aa, Staphylococcus
DSDADADSDSDSDSDSDSDSDSDSDSDSDSDSDSDSDSDSDSDSDSDSDSDSDSDSDSDSDSDSDSDSDSDSDSDSDSDSDSDSDSDSDSDSDADADSDADADSDADADSDADADADSDADSDADADSDADADSDADADSDADADADSDADADSDADADADSDADADADSDADADKDHNDKADKPNNKELPDTGNDAQNNAT

SEQ ID NO: 1848857 - protein, 17 aa, Staphylococcus
DSDAERKAQGGGSRSDT

SEQ ID NO: 1848858 - protein, 16 aa, Staphylococcus
DSDAKRKQANDGQRSD

SEQ ID NO: 1848859 - protein, 8 aa, Staphylococcus
DSDDIDTI

SEQ ID NO: 1848860 - protein, 5 aa, Staphylococcus
DSDDK

SEQ ID NO: 1848861 - protein, 7 aa, Staphylococcus
DSDHSND

SEQ ID NO: 1848862 - protein, 56 aa, Staphylococcus
DSDHSRINNTSRNSDEDVSSTSSHSDSSHSHSFTTSNYKNVDSNNTQNNYHQTPKK

SEQ ID NO: 1848863 - protein, 18 aa, Staphylococcus
DSDKFKKVTEEISKKDEN

SEQ ID NO: 1848864 - protein, 12 aa, Staphylococcus
DSDNNKLQTHSP

SEQ ID NO: 1848865 - protein, 22 aa, Staphylococcus
DSDNSNTSLSTLSDMNKKTDTL

SEQ ID NO: 1848866 - protein, 14 aa, Staphylococcus
DSDQAKKGVVATGI

SEQ ID NO: 1848867 - protein, 16 aa, Staphylococcus
DSDRLYEESKNNYREM

SEQ ID NO: 1848868 - protein, 7 aa, Staphylococcus
DSDRRQA

SEQ ID NO: 1848869 - protein, 8 aa, Staphylococcus
DSDSEKAK

SEQ ID NO: 1848870 - protein, 7 aa, Staphylococcus
DSDSIYQ

SEQ ID NO: 1848871 - protein, 12 aa, Staphylococcus
DSDVTKNETSNV

SEQ ID NO: 1848872 - protein, 14 aa, Staphylococcus
DSDVTSEVDVSTKG

SEQ ID NO: 1848873 - protein, 6 aa, Staphylococcus
DSEANT

SEQ ID NO: 1848874 - protein, 10 aa, Staphylococcus
DSEATSELTG

SEQ ID NO: 1848875 - protein, 8 aa, Staphylococcus
DSEDEDTI

SEQ ID NO: 1848876 - protein, 17 aa, Staphylococcus
DSEDGSNKYGPNPKPIY

SEQ ID NO: 1848877 - protein, 8 aa, Staphylococcus
DSEIDKEI

SEQ ID NO: 1848878 - protein, 6 aa, Staphylococcus
DSEKAT

SEQ ID NO: 1848879 - protein, 15 aa, Staphylococcus
DSEKDAKQGMEDEKY

SEQ ID NO: 1848880 - protein, 15 aa, Staphylococcus
DSEKGTNEYGTNPKA

SEQ ID NO: 1848881 - protein, 19 aa, Staphylococcus
DSEKGTNQYGPNPKEHMLE

SEQ ID NO: 1848882 - protein, 23 aa, Staphylococcus
DSETKKSIKKAKHSDFDKNYKPS

SEQ ID NO: 1848883 - protein, 23 aa, Staphylococcus
DSETNKNVKDAKHNAFKQDYKPK

SEQ ID NO: 1848884 - protein, 32 aa, Staphylococcus
DSFDAKEDKDYSKGDKLAEVTGKGEDGSPQKM

SEQ ID NO: 1848885 - protein, 6 aa, Staphylococcus
DSFGIS

SEQ ID NO: 1848886 - protein, 7 aa, Staphylococcus
DSFKTKV

SEQ ID NO: 1848887 - protein, 11 aa, Staphylococcus
DSGEGGTGATF

SEQ ID NO: 1848888 - protein, 6 aa, Staphylococcus
DSGGKI

SEQ ID NO: 1848889 - protein, 8 aa, Staphylococcus
DSGIGGTI

SEQ ID NO: 1848890 - protein, 5 aa, Staphylococcus
DSGIS

SEQ ID NO: 1848891 - protein, 9 aa, Staphylococcus
DSGKILPGH

SEQ ID NO: 1848892 - protein, 17 aa, Staphylococcus
DSGLGEGTTFKIHFPNE

SEQ ID NO: 1848893 - protein, 10 aa, Staphylococcus
DSGNVLPPNR

SEQ ID NO: 1848894 - protein, 16 aa, Staphylococcus
DSGQSILDSGKKRIDR

SEQ ID NO: 1848895 - protein, 8 aa, Staphylococcus
DSGQTPEM

SEQ ID NO: 1848896 - protein, 4 aa, Staphylococcus
DSGS

SEQ ID NO: 1848897 - protein, 5 aa, Staphylococcus
DSGVG

SEQ ID NO: 1848898 - protein, 11 aa, Staphylococcus
DSHEGGEINDS

SEQ ID NO: 1848899 - protein, 27 aa, Staphylococcus
DSHVSNKSGMNPRNNDKSANTAPSWKG

SEQ ID NO: 1848900 - protein, 8 aa, Staphylococcus
DSIADNEQ

SEQ ID NO: 1848901 - protein, 9 aa, Staphylococcus
DSIESKSEL

SEQ ID NO: 1848902 - protein, 14 aa, Staphylococcus
DSIESQYEVAERKP

SEQ ID NO: 1848903 - protein, 7 aa, Staphylococcus
DSIGRKK

SEQ ID NO: 1848904 - protein, 13 aa, Staphylococcus
DSIKANTSFTQNK

SEQ ID NO: 1848905 - protein, 5 aa, Staphylococcus
DSIKS

SEQ ID NO: 1848906 - protein, 8 aa, Staphylococcus
DSINNANS

SEQ ID NO: 1848907 - protein, 4 aa, Staphylococcus
DSIP

SEQ ID NO: 1848908 - protein, 44 aa, Staphylococcus
DSIQNTNQVKQGSNYINEDPTQQRDYNNAVNNAESTINNNTHPV

SEQ ID NO: 1848909 - protein, 27 aa, Staphylococcus
DSISESTSESVEASASNSESMAISTSN

SEQ ID NO: 1848910 - protein, 7 aa, Staphylococcus
DSISNNY

SEQ ID NO: 1848911 - protein, 26 aa, Staphylococcus
DSISNYQNVKQTENYIDASNDKRLAY

SEQ ID NO: 1848912 - protein, 39 aa, Staphylococcus
DSISSSDSENATHESKQEGNSRKAGGNDKEEALQRAETY

SEQ ID NO: 1848913 - protein, 7 aa, Staphylococcus
DSITPES

SEQ ID NO: 1848914 - protein, 12 aa, Staphylococcus
DSIVPHGDTQLR

SEQ ID NO: 1848915 - protein, 13 aa, Staphylococcus
DSIYNSKKLTTAI

SEQ ID NO: 1848916 - protein, 10 aa, Staphylococcus
DSKEFAKNGK

SEQ ID NO: 1848917 - protein, 5 aa, Staphylococcus
DSKEY

SEQ ID NO: 1848918 - protein, 41 aa, Staphylococcus
DSKKESNKYGPSPKYEMNEPVNEPNYNPVDKAKLYRNTTNE

SEQ ID NO: 1848919 - protein, 17 aa, Staphylococcus
DSKKFKKVTEEISKRKD

SEQ ID NO: 1848920 - protein, 11 aa, Staphylococcus
DSKKVDDDTDL

SEQ ID NO: 1848921 - protein, 9 aa, Staphylococcus
DSKKYYKNL

SEQ ID NO: 1848922 - protein, 6 aa, Staphylococcus
DSKLGK

SEQ ID NO: 1848923 - protein, 10 aa, Staphylococcus
DSKLIDTAGK

SEQ ID NO: 1848924 - protein, 4 aa, Staphylococcus
DSKP

SEQ ID NO: 1848925 - protein, 6 aa, Staphylococcus
DSKQLT

SEQ ID NO: 1848926 - protein, 5 aa, Staphylococcus
DSKQV

SEQ ID NO: 1848927 - protein, 9 aa, Staphylococcus
DSKSAIRTI

SEQ ID NO: 1848928 - protein, 6 aa, Staphylococcus
DSKTGG

SEQ ID NO: 1848929 - protein, 8 aa, Staphylococcus
DSKVGNSY

SEQ ID NO: 1848930 - protein, 4 aa, Staphylococcus
DSLD

SEQ ID NO: 1848931 - protein, 11 aa, Staphylococcus
DSLESSVANGA

SEQ ID NO: 1848932 - protein, 12 aa, Staphylococcus
DSLKSSKANGST

SEQ ID NO: 1848933 - protein, 8 aa, Staphylococcus
DSLNDTHL

SEQ ID NO: 1848934 - protein, 9 aa, Staphylococcus
DSLNRNDID

SEQ ID NO: 1848935 - protein, 10 aa, Staphylococcus
DSLPKGFNTS

SEQ ID NO: 1848936 - protein, 5 aa, Staphylococcus
DSLPQ

SEQ ID NO: 1848937 - protein, 36 aa, Staphylococcus
DSLSSSYSASTSDSTSVSQSLSLSDETSLSNAESVQ

SEQ ID NO: 1848938 - protein, 17 aa, Staphylococcus
DSNAERNANGGGQRSDT

SEQ ID NO: 1848939 - protein, 4 aa, Staphylococcus
DSND

SEQ ID NO: 1848940 - protein, 18 aa, Staphylococcus
DSNDDATETEKLAAEEQL

SEQ ID NO: 1848941 - protein, 16 aa, Staphylococcus
DSNEAMEAKIKNGGTH

SEQ ID NO: 1848942 - protein, 10 aa, Staphylococcus
DSNEDKNAQS

SEQ ID NO: 1848943 - protein, 6 aa, Staphylococcus
DSNEDV

SEQ ID NO: 1848944 - protein, 8 aa, Staphylococcus
DSNEKNYD

SEQ ID NO: 1848945 - protein, 15 aa, Staphylococcus
DSNGLGLTGGKVGTI

SEQ ID NO: 1848946 - protein, 8 aa, Staphylococcus
DSNKDNDF

SEQ ID NO: 1848947 - protein, 6 aa, Staphylococcus
DSNLKE

SEQ ID NO: 1848948 - protein, 30 aa, Staphylococcus
DSNLNKCPNCGNKLDNKDNQINSPQINTSN

SEQ ID NO: 1848949 - protein, 12 aa, Staphylococcus
DSNNLKSPLDRE

SEQ ID NO: 1848950 - protein, 12 aa, Staphylococcus
DSNNQPSRYNKP

SEQ ID NO: 1848951 - protein, 5 aa, Staphylococcus
DSNQL

SEQ ID NO: 1848952 - protein, 11 aa, Staphylococcus
DSNRNATIEEK

SEQ ID NO: 1848953 - protein, 7 aa, Staphylococcus
DSNSSPF

SEQ ID NO: 1848954 - protein, 12 aa, Staphylococcus
DSNWKDKNVDKD

SEQ ID NO: 1848955 - protein, 6 aa, Staphylococcus
DSPERK

SEQ ID NO: 1848956 - protein, 5 aa, Staphylococcus
DSPGY

SEQ ID NO: 1848957 - protein, 19 aa, Staphylococcus
DSPVKEHQSLNQAVDQVED

SEQ ID NO: 1848958 - protein, 9 aa, Staphylococcus
DSQDKNEQS

SEQ ID NO: 1848959 - protein, 18 aa, Staphylococcus
DSQDTRTNVNQDVTAAQE

SEQ ID NO: 1848960 - protein, 25 aa, Staphylococcus
DSQITIPKGAKGDQGAAGPAGRDGV

SEQ ID NO: 1848961 - protein, 6 aa, Staphylococcus
DSQKGI

SEQ ID NO: 1848962 - protein, 12 aa, Staphylococcus
DSQLEYQPNHPH

SEQ ID NO: 1848963 - protein, 9 aa, Staphylococcus
DSQRKGTSL

SEQ ID NO: 1848964 - protein, 6 aa, Staphylococcus
DSQSKY

SEQ ID NO: 1848965 - protein, 16 aa, Staphylococcus
DSQTSTSSDKYDSSSY

SEQ ID NO: 1848966 - protein, 16 aa, Staphylococcus
DSRANEDKYQHEEETV

SEQ ID NO: 1848967 - protein, 12 aa, Staphylococcus
DSRLNKQSQSYQ

SEQ ID NO: 1848968 - protein, 7 aa, Staphylococcus
DSSDKSL

SEQ ID NO: 1848969 - protein, 7 aa, Staphylococcus
DSSFSQL

SEQ ID NO: 1848970 - protein, 9 aa, Staphylococcus
DSSFTYEDG

SEQ ID NO: 1848971 - protein, 12 aa, Staphylococcus
DSSKSEATKNNI

SEQ ID NO: 1848972 - protein, 6 aa, Staphylococcus
DSSLPF

SEQ ID NO: 1848973 - protein, 16 aa, Staphylococcus
DSSLQENTNLLKDNLN

SEQ ID NO: 1848974 - protein, 10 aa, Staphylococcus
DSSNKDRIKE

SEQ ID NO: 1848975 - protein, 12 aa, Staphylococcus
DSSQSEATKARI

SEQ ID NO: 1848976 - protein, 7 aa, Staphylococcus
DSSTSST

SEQ ID NO: 1848977 - protein, 16 aa, Staphylococcus
DSSYISKSDNGEVEMT

SEQ ID NO: 1848978 - protein, 14 aa, Staphylococcus
DSTDSVKRDKGQHG

SEQ ID NO: 1848979 - protein, 8 aa, Staphylococcus
DSTINKAQ

SEQ ID NO: 1848980 - protein, 7 aa, Staphylococcus
DSTIRKA

SEQ ID NO: 1848981 - protein, 7 aa, Staphylococcus
DSTIRQA

SEQ ID NO: 1848982 - protein, 13 aa, Staphylococcus
DSTKSEATKAKIT

SEQ ID NO: 1848983 - protein, 18 aa, Staphylococcus
DSTNTDELGPLKKKIKGN

SEQ ID NO: 1848984 - protein, 11 aa, Staphylococcus
DSTSKKIPSLT

SEQ ID NO: 1848985 - protein, 4 aa, Staphylococcus
DSTT

SEQ ID NO: 1848986 - protein, 18 aa, Staphylococcus
DSTTSEAGYTSHDDRSDL

SEQ ID NO: 1848987 - protein, 6 aa, Staphylococcus
DSTYQI

SEQ ID NO: 1848988 - protein, 12 aa, Staphylococcus
DSVDAGKRIMTI

SEQ ID NO: 1848989 - protein, 19 aa, Staphylococcus
DSVDPGISQRIEDEVISQN

SEQ ID NO: 1848990 - protein, 12 aa, Staphylococcus
DSVDPGKRIMTI

SEQ ID NO: 1848991 - protein, 20 aa, Staphylococcus
DSVEHGDNYRQADDDRITAY

SEQ ID NO: 1848992 - protein, 23 aa, Staphylococcus
DSVHSSSNYFNEDSAQKQAYDDA

SEQ ID NO: 1848993 - protein, 7 aa, Staphylococcus
DSVKSGD

SEQ ID NO: 1848994 - protein, 17 aa, Staphylococcus
DSVTSNITSQLETKHTD

SEQ ID NO: 1848995 - protein, 4 aa, Staphylococcus
DSVV

SEQ ID NO: 1848996 - protein, 22 aa, Staphylococcus
DSYKQQAENETSENLEDKADEN

SEQ ID NO: 1848997 - protein, 19 aa, Staphylococcus
DSYQHQNLTPYSNEVPKRK

SEQ ID NO: 1848998 - protein, 10 aa, Staphylococcus
DTADVQPDAE

SEQ ID NO: 1848999 - protein, 8 aa, Staphylococcus
DTAKPIED

SEQ ID NO: 1849000 - protein, 7 aa, Staphylococcus
DTANGAL

SEQ ID NO: 1849001 - protein, 6 aa, Staphylococcus
DTAQLR

SEQ ID NO: 1849002 - protein, 12 aa, Staphylococcus
DTARKRGKQGTG

SEQ ID NO: 1849003 - protein, 7 aa, Staphylococcus
DTDAAGN

SEQ ID NO: 1849004 - protein, 5 aa, Staphylococcus
DTDEH

SEQ ID NO: 1849005 - protein, 7 aa, Staphylococcus
DTDGEEV

SEQ ID NO: 1849006 - protein, 12 aa, Staphylococcus
DTDIDIADEDFD

SEQ ID NO: 1849007 - protein, 12 aa, Staphylococcus
DTDIEIQDEDFD

SEQ ID NO: 1849008 - protein, 11 aa, Staphylococcus
DTDKEAARNEM

SEQ ID NO: 1849009 - protein, 5 aa, Staphylococcus
DTDKF

SEQ ID NO: 1849010 - protein, 5 aa, Staphylococcus
DTDKS

SEQ ID NO: 1849011 - protein, 9 aa, Staphylococcus
DTDKSLPPW

SEQ ID NO: 1849012 - protein, 24 aa, Staphylococcus
DTDLGGKAGTQTPITVTTDPNTKV

SEQ ID NO: 1849013 - protein, 13 aa, Staphylococcus
DTDQADNSKINEL

SEQ ID NO: 1849014 - protein, 14 aa, Staphylococcus
DTDSLGEKSGLKTD

SEQ ID NO: 1849015 - protein, 12 aa, Staphylococcus
DTDTSEAAKSYA

SEQ ID NO: 1849016 - protein, 6 aa, Staphylococcus
DTDTVG

SEQ ID NO: 1849017 - protein, 17 aa, Staphylococcus
DTDYYKKQNSSKLSEAA

SEQ ID NO: 1849018 - protein, 11 aa, Staphylococcus
DTEGKPFSRNQ

SEQ ID NO: 1849019 - protein, 5 aa, Staphylococcus
DTEKS

SEQ ID NO: 1849020 - protein, 21 aa, Staphylococcus
DTETKKNIKGAKHNTFDQNYK

SEQ ID NO: 1849021 - protein, 21 aa, Staphylococcus
DTETKKSIKSAKHNYFNQNYK

SEQ ID NO: 1849022 - protein, 21 aa, Staphylococcus
DTETKTLDDLAKEGRISQSDF

SEQ ID NO: 1849023 - protein, 12 aa, Staphylococcus
DTETTKKEKKGY

SEQ ID NO: 1849024 - protein, 13 aa, Staphylococcus
DTFENEKANKIKR

SEQ ID NO: 1849025 - protein, 13 aa, Staphylococcus
DTFNSDKERKQKR

SEQ ID NO: 1849026 - protein, 8 aa, Staphylococcus
DTFQSPRE

SEQ ID NO: 1849027 - protein, 4 aa, Staphylococcus
DTFT

SEQ ID NO: 1849028 - protein, 10 aa, Staphylococcus
DTGGKGEENF

SEQ ID NO: 1849029 - protein, 6 aa, Staphylococcus
DTGISS

SEQ ID NO: 1849030 - protein, 12 aa, Staphylococcus
DTGNNSKSSTGI

SEQ ID NO: 1849031 - protein, 7 aa, Staphylococcus
DTGNYGH

SEQ ID NO: 1849032 - protein, 8 aa, Staphylococcus
DTGNYGHS

SEQ ID NO: 1849033 - protein, 10 aa, Staphylococcus
DTGNYGHSTG

SEQ ID NO: 1849034 - protein, 8 aa, Staphylococcus
DTGSGIAP

SEQ ID NO: 1849035 - protein, 9 aa, Staphylococcus
DTGSGISPE

SEQ ID NO: 1849036 - protein, 7 aa, Staphylococcus
DTGSNQT

SEQ ID NO: 1849037 - protein, 8 aa, Staphylococcus
DTGTGIAP

SEQ ID NO: 1849038 - protein, 9 aa, Staphylococcus
DTGTGIAPE

SEQ ID NO: 1849039 - protein, 6 aa, Staphylococcus
DTHFPD

SEQ ID NO: 1849040 - protein, 5 aa, Staphylococcus
DTHHN

SEQ ID NO: 1849041 - protein, 5 aa, Staphylococcus
DTHNI

SEQ ID NO: 1849042 - protein, 5 aa, Staphylococcus
DTHVP

SEQ ID NO: 1849043 - protein, 20 aa, Staphylococcus
DTIGQKKEELYKKSGKNPII

SEQ ID NO: 1849044 - protein, 16 aa, Staphylococcus
DTIKGTPRAKYKAYET

SEQ ID NO: 1849045 - protein, 10 aa, Staphylococcus
DTINNGSDKL

SEQ ID NO: 1849046 - protein, 17 aa, Staphylococcus
DTISIERKSDNQGSGHI

SEQ ID NO: 1849047 - protein, 20 aa, Staphylococcus
DTISQKKDELYKKSGKNPII

SEQ ID NO: 1849048 - protein, 21 aa, Staphylococcus
DTKEVPTDSQIEAQTRQANNE

SEQ ID NO: 1849049 - protein, 6 aa, Staphylococcus
DTKGIK

SEQ ID NO: 1849050 - protein, 11 aa, Staphylococcus
DTKGKTDQQIA

SEQ ID NO: 1849051 - protein, 12 aa, Staphylococcus
DTKGKTDQQITS

SEQ ID NO: 1849052 - protein, 7 aa, Staphylococcus
DTKLKAD

SEQ ID NO: 1849053 - protein, 10 aa, Staphylococcus
DTKQIKPSKY

SEQ ID NO: 1849054 - protein, 8 aa, Staphylococcus
DTKQQQPV

SEQ ID NO: 1849055 - protein, 9 aa, Staphylococcus
DTKRPEDIT

SEQ ID NO: 1849056 - protein, 7 aa, Staphylococcus
DTKSLKK

SEQ ID NO: 1849057 - protein, 8 aa, Staphylococcus
DTLANEAG

SEQ ID NO: 1849058 - protein, 10 aa, Staphylococcus
DTLEPKQEAV

SEQ ID NO: 1849059 - protein, 8 aa, Staphylococcus
DTLPDGSR

SEQ ID NO: 1849060 - protein, 7 aa, Staphylococcus
DTLPQSA

SEQ ID NO: 1849061 - protein, 8 aa, Staphylococcus
DTLPTGDQ

SEQ ID NO: 1849062 - protein, 7 aa, Staphylococcus
DTMQSKE

SEQ ID NO: 1849063 - protein, 4 aa, Staphylococcus
DTMT

SEQ ID NO: 1849064 - protein, 45 aa, Staphylococcus
DTNGKTPASIKKYQDAKAKIQNQINAAQNEAKQVLDNSNPTVSQV

SEQ ID NO: 1849065 - protein, 6 aa, Staphylococcus
DTNGRT

SEQ ID NO: 1849066 - protein, 6 aa, Staphylococcus
DTNHPT

SEQ ID NO: 1849067 - protein, 17 aa, Staphylococcus
DTNKNGIQDSDEQGIEG

SEQ ID NO: 1849068 - protein, 11 aa, Staphylococcus
DTNNNKIEQRK

SEQ ID NO: 1849069 - protein, 24 aa, Staphylococcus
DTNTLSYQEGQSYQEAPSIDGTEA

SEQ ID NO: 1849070 - protein, 16 aa, Staphylococcus
DTPADKPMQIKTDTGN

SEQ ID NO: 1849071 - protein, 4 aa, Staphylococcus
DTPE

SEQ ID NO: 1849072 - protein, 12 aa, Staphylococcus
DTPEDKDNDAYE

SEQ ID NO: 1849073 - protein, 10 aa, Staphylococcus
DTPEDKEKDA

SEQ ID NO: 1849074 - protein, 8 aa, Staphylococcus
DTPEEKLA

SEQ ID NO: 1849075 - protein, 10 aa, Staphylococcus
DTPENEDKDA

SEQ ID NO: 1849076 - protein, 11 aa, Staphylococcus
DTPESEENDSY

SEQ ID NO: 1849077 - protein, 29 aa, Staphylococcus
DTPETVKPNTPVQPYGKEASDYTKKHLTN

SEQ ID NO: 1849078 - protein, 30 aa, Staphylococcus
DTPETVKPNTPVQPYGKEASNYSKKTLTNK

SEQ ID NO: 1849079 - protein, 11 aa, Staphylococcus
DTPIKQTRTDE

SEQ ID NO: 1849080 - protein, 4 aa, Staphylococcus
DTPK

SEQ ID NO: 1849081 - protein, 6 aa, Staphylococcus
DTPKYQ

SEQ ID NO: 1849082 - protein, 10 aa, Staphylococcus
DTPQSQGLPP

SEQ ID NO: 1849083 - protein, 11 aa, Staphylococcus
DTPQSQGLPPI

SEQ ID NO: 1849084 - protein, 5 aa, Staphylococcus
DTPYD

SEQ ID NO: 1849085 - protein, 20 aa, Staphylococcus
DTQATNKKTVNGSTKAKKPA

SEQ ID NO: 1849086 - protein, 6 aa, Staphylococcus
DTQIPY

SEQ ID NO: 1849087 - protein, 8 aa, Staphylococcus
DTQKASSI

SEQ ID NO: 1849088 - protein, 6 aa, Staphylococcus
DTQQAI

SEQ ID NO: 1849089 - protein, 11 aa, Staphylococcus
DTQTKKHLKKA

SEQ ID NO: 1849090 - protein, 7 aa, Staphylococcus
DTQTREL

SEQ ID NO: 1849091 - protein, 8 aa, Staphylococcus
DTQTTAES

SEQ ID NO: 1849092 - protein, 7 aa, Staphylococcus
DTQVNGE

SEQ ID NO: 1849093 - protein, 10 aa, Staphylococcus
DTRGEEEDGR

SEQ ID NO: 1849094 - protein, 5 aa, Staphylococcus
DTRNI

SEQ ID NO: 1849095 - protein, 7 aa, Staphylococcus
DTRNISP

SEQ ID NO: 1849096 - protein, 9 aa, Staphylococcus
DTSDIDRGM

SEQ ID NO: 1849097 - protein, 18 aa, Staphylococcus
DTSDYHQIKQDNDQIKTR

SEQ ID NO: 1849098 - protein, 5 aa, Staphylococcus
DTSEY

SEQ ID NO: 1849099 - protein, 16 aa, Staphylococcus
DTSEYHQIKEDGEQLE

SEQ ID NO: 1849100 - protein, 4 aa, Staphylococcus
DTSI

SEQ ID NO: 1849101 - protein, 10 aa, Staphylococcus
DTSLTEHSKN

SEQ ID NO: 1849102 - protein, 9 aa, Staphylococcus
DTSMDNQEA

SEQ ID NO: 1849103 - protein, 15 aa, Staphylococcus
DTSNVQTTKNNLHGE

SEQ ID NO: 1849104 - protein, 9 aa, Staphylococcus
DTSNYGSSI

SEQ ID NO: 1849105 - protein, 9 aa, Staphylococcus
DTSYKETDN

SEQ ID NO: 1849106 - protein, 5 aa, Staphylococcus
DTTAA

SEQ ID NO: 1849107 - protein, 20 aa, Staphylococcus
DTTAPTVKGISDQTKEVNTA

SEQ ID NO: 1849108 - protein, 20 aa, Staphylococcus
DTTAPTVKGISDQTKEVNTS

SEQ ID NO: 1849109 - protein, 4 aa, Staphylococcus
DTTD

SEQ ID NO: 1849110 - protein, 13 aa, Staphylococcus
DTTFTNPSGANNK

SEQ ID NO: 1849111 - protein, 4 aa, Staphylococcus
DTTG

SEQ ID NO: 1849112 - protein, 5 aa, Staphylococcus
DTTIE

SEQ ID NO: 1849113 - protein, 7 aa, Staphylococcus
DTTIPSR

SEQ ID NO: 1849114 - protein, 4 aa, Staphylococcus
DTTQ

SEQ ID NO: 1849115 - protein, 6 aa, Staphylococcus
DTTSPS

SEQ ID NO: 1849116 - protein, 5 aa, Staphylococcus
DTTTP

SEQ ID NO: 1849117 - protein, 6 aa, Staphylococcus
DTTVSV

SEQ ID NO: 1849118 - protein, 10 aa, Staphylococcus
DTVSKKQSEW

SEQ ID NO: 1849119 - protein, 11 aa, Staphylococcus
DTVSTKSSLES

SEQ ID NO: 1849120 - protein, 19 aa, Staphylococcus
DTYEPQQEANNDNAIETGE

SEQ ID NO: 1849121 - protein, 7 aa, Staphylococcus
DTYEVGK

SEQ ID NO: 1849122 - protein, 5 aa, Staphylococcus
DTYSP

SEQ ID NO: 1849123 - protein, 5 aa, Staphylococcus
DTYTP

SEQ ID NO: 1849124 - protein, 8 aa, Staphylococcus
DVADKVGN

SEQ ID NO: 1849125 - protein, 5 aa, Staphylococcus
DVANA

SEQ ID NO: 1849126 - protein, 5 aa, Staphylococcus
DVAQA

SEQ ID NO: 1849127 - protein, 10 aa, Staphylococcus
DVASTPQRDN

SEQ ID NO: 1849128 - protein, 9 aa, Staphylococcus
DVATEKQEL

SEQ ID NO: 1849129 - protein, 10 aa, Staphylococcus
DVATTPKRDT

SEQ ID NO: 1849130 - protein, 9 aa, Staphylococcus
DVDDTERSR

SEQ ID NO: 1849131 - protein, 6 aa, Staphylococcus
DVDEPF

SEQ ID NO: 1849132 - protein, 6 aa, Staphylococcus
DVDGEY

SEQ ID NO: 1849133 - protein, 7 aa, Staphylococcus
DVDGNPA

SEQ ID NO: 1849134 - protein, 9 aa, Staphylococcus
DVDSGGEIG

SEQ ID NO: 1849135 - protein, 9 aa, Staphylococcus
DVDSGGTIG

SEQ ID NO: 1849136 - protein, 8 aa, Staphylococcus
DVDTTPRV

SEQ ID NO: 1849137 - protein, 5 aa, Staphylococcus
DVEEG

SEQ ID NO: 1849138 - protein, 53 aa, Staphylococcus
DVENGSQQSDQNNTNMNHQSTTTQTVANAHQQQEQSSQATALPETGQQTSNSG

SEQ ID NO: 1849139 - protein, 12 aa, Staphylococcus
DVEPEPAKHHNA

SEQ ID NO: 1849140 - protein, 13 aa, Staphylococcus
DVEPEPVKHHKGK

SEQ ID NO: 1849141 - protein, 5 aa, Staphylococcus
DVEQT

SEQ ID NO: 1849142 - protein, 8 aa, Staphylococcus
DVETPARD

SEQ ID NO: 1849143 - protein, 9 aa, Staphylococcus
DVGSKKVGL

SEQ ID NO: 1849144 - protein, 8 aa, Staphylococcus
DVHKDKKV

SEQ ID NO: 1849145 - protein, 6 aa, Staphylococcus
DVKADH

SEQ ID NO: 1849146 - protein, 8 aa, Staphylococcus
DVKDDHNV

SEQ ID NO: 1849147 - protein, 10 aa, Staphylococcus
DVKDNSRMYT

SEQ ID NO: 1849148 - protein, 6 aa, Staphylococcus
DVKDTH

SEQ ID NO: 1849149 - protein, 8 aa, Staphylococcus
DVKPDKGK

SEQ ID NO: 1849150 - protein, 10 aa, Staphylococcus
DVKPEPTKHL

SEQ ID NO: 1849151 - protein, 10 aa, Staphylococcus
DVKPEPVKHH

SEQ ID NO: 1849152 - protein, 8 aa, Staphylococcus
DVKPSSRM

SEQ ID NO: 1849153 - protein, 29 aa, Staphylococcus
DVKQGDKVKKGDKVAEVSGQSQSGESQTM

SEQ ID NO: 1849154 - protein, 15 aa, Staphylococcus
DVKQGEKLKKGDKVA

SEQ ID NO: 1849155 - protein, 13 aa, Staphylococcus
DVLSEYDKSENSL

SEQ ID NO: 1849156 - protein, 11 aa, Staphylococcus
DVLSKNDISNA

SEQ ID NO: 1849157 - protein, 14 aa, Staphylococcus
DVNDSYSHKSGDAV

SEQ ID NO: 1849158 - protein, 14 aa, Staphylococcus
DVNDTYSHKSGDAV

SEQ ID NO: 1849159 - protein, 13 aa, Staphylococcus
DVNDTYTHKAGDA

SEQ ID NO: 1849160 - protein, 12 aa, Staphylococcus
DVNDTYTHQAGD

SEQ ID NO: 1849161 - protein, 18 aa, Staphylococcus
DVNGIGAKTLEKIGSKLT

SEQ ID NO: 1849162 - protein, 7 aa, Staphylococcus
DVNPDEV

SEQ ID NO: 1849163 - protein, 21 aa, Staphylococcus
DVNSGGQKGVQIASSGPDEDW

SEQ ID NO: 1849164 - protein, 6 aa, Staphylococcus
DVNTET

SEQ ID NO: 1849165 - protein, 8 aa, Staphylococcus
DVNTTPRV

SEQ ID NO: 1849166 - protein, 20 aa, Staphylococcus
DVPDPSRYPQSGQNNNFNSE

SEQ ID NO: 1849167 - protein, 10 aa, Staphylococcus
DVPEEQFQGP

SEQ ID NO: 1849168 - protein, 23 aa, Staphylococcus
DVPEETSKEDMGSISDAGEVENA

SEQ ID NO: 1849169 - protein, 7 aa, Staphylococcus
DVPKNMK

SEQ ID NO: 1849170 - protein, 6 aa, Staphylococcus
DVPQGM

SEQ ID NO: 1849171 - protein, 12 aa, Staphylococcus
DVQAKASQKDMG

SEQ ID NO: 1849172 - protein, 17 aa, Staphylococcus
DVQDKGMASYNAKISGK

SEQ ID NO: 1849173 - protein, 26 aa, Staphylococcus
DVQKTLQDRIDNGNYYKNEDQRVGST

SEQ ID NO: 1849174 - protein, 27 aa, Staphylococcus
DVQKTLQDRVNNGGSNYYKNDDQQVGA

SEQ ID NO: 1849175 - protein, 13 aa, Staphylococcus
DVQNAGEKQSAPW

SEQ ID NO: 1849176 - protein, 5 aa, Staphylococcus
DVQQT

SEQ ID NO: 1849177 - protein, 25 aa, Staphylococcus
DVQQTLQDKINNGSFYKNDDQQVGA

SEQ ID NO: 1849178 - protein, 5 aa, Staphylococcus
DVQTE

SEQ ID NO: 1849179 - protein, 7 aa, Staphylococcus
DVQTESE

SEQ ID NO: 1849180 - protein, 5 aa, Staphylococcus
DVQTQ

SEQ ID NO: 1849181 - protein, 4 aa, Staphylococcus
DVRI

SEQ ID NO: 1849182 - protein, 13 aa, Staphylococcus
DVSDEDGKSELRR

SEQ ID NO: 1849183 - protein, 4 aa, Staphylococcus
DVSE

SEQ ID NO: 1849184 - protein, 8 aa, Staphylococcus
DVSESVKS

SEQ ID NO: 1849185 - protein, 4 aa, Staphylococcus
DVSP

SEQ ID NO: 1849186 - protein, 5 aa, Staphylococcus
DVSPE

SEQ ID NO: 1849187 - protein, 22 aa, Staphylococcus
DVSQTSIPKQQPQAEPRRQTVK

SEQ ID NO: 1849188 - protein, 13 aa, Staphylococcus
DVSRYQNKDAHLE

SEQ ID NO: 1849189 - protein, 12 aa, Staphylococcus
DVSTTQEGIPKE

SEQ ID NO: 1849190 - protein, 23 aa, Staphylococcus
DVSYQHQNRSYATHSNNYNAYDD

SEQ ID NO: 1849191 - protein, 5 aa, Staphylococcus
DVTDE

SEQ ID NO: 1849192 - protein, 13 aa, Staphylococcus
DVTPRYSSKFTDT

SEQ ID NO: 1849193 - protein, 103 aa, Staphylococcus
DVTPSTDKKQQAKSTIAQDADNKKRLINQDTNSTTEEHNAANANVDAAVTKANNDIDQAASNDDVDNAVTTNQNDINQIQQEAQVKPAAKAEIAQKVTDQEGV

SEQ ID NO: 1849194 - protein, 13 aa, Staphylococcus
DVTSDTVTYEQTY

SEQ ID NO: 1849195 - protein, 6 aa, Staphylococcus
DVTSGT

SEQ ID NO: 1849196 - protein, 9 aa, Staphylococcus
DVTSNTSSK

SEQ ID NO: 1849197 - protein, 5 aa, Staphylococcus
DVTTE

SEQ ID NO: 1849198 - protein, 5 aa, Staphylococcus
DWQTA

SEQ ID NO: 1849199 - protein, 13 aa, Staphylococcus
DYAEQDVDRRNLP

SEQ ID NO: 1849200 - protein, 4 aa, Staphylococcus
DYDH

SEQ ID NO: 1849201 - protein, 12 aa, Staphylococcus
DYEGNNITGIAS

SEQ ID NO: 1849202 - protein, 6 aa, Staphylococcus
DYEKTY

SEQ ID NO: 1849203 - protein, 4 aa, Staphylococcus
DYEM

SEQ ID NO: 1849204 - protein, 12 aa, Staphylococcus
DYEQQKAQLGSG

SEQ ID NO: 1849205 - protein, 6 aa, Staphylococcus
DYEQTY

SEQ ID NO: 1849206 - protein, 5 aa, Staphylococcus
DYERG

SEQ ID NO: 1849207 - protein, 7 aa, Staphylococcus
DYETGET

SEQ ID NO: 1849208 - protein, 15 aa, Staphylococcus
DYGAPTGTPIPSPID

SEQ ID NO: 1849209 - protein, 9 aa, Staphylococcus
DYGEGSSVP

SEQ ID NO: 1849210 - protein, 4 aa, Staphylococcus
DYGI

SEQ ID NO: 1849211 - protein, 7 aa, Staphylococcus
DYGNGKQ

SEQ ID NO: 1849212 - protein, 7 aa, Staphylococcus
DYGPATV

SEQ ID NO: 1849213 - protein, 9 aa, Staphylococcus
DYGSASTPF

SEQ ID NO: 1849214 - protein, 7 aa, Staphylococcus
DYGSGKE

SEQ ID NO: 1849215 - protein, 6 aa, Staphylococcus
DYGSNI

SEQ ID NO: 1849216 - protein, 6 aa, Staphylococcus
DYGTAS

SEQ ID NO: 1849217 - protein, 5 aa, Staphylococcus
DYGTT

SEQ ID NO: 1849218 - protein, 10 aa, Staphylococcus
DYHDDAKDKY

SEQ ID NO: 1849219 - protein, 6 aa, Staphylococcus
DYHDKR

SEQ ID NO: 1849220 - protein, 6 aa, Staphylococcus
DYHNKR

SEQ ID NO: 1849221 - protein, 32 aa, Staphylococcus
DYINEDTAQQNAYNNAIDNGEDIISGQQNPIM

SEQ ID NO: 1849222 - protein, 43 aa, Staphylococcus
DYKENALETAKHISDQSYSSKSQLEDELTSKDGRQFTKDEADY

SEQ ID NO: 1849223 - protein, 17 aa, Staphylococcus
DYKENALKTAEESSDNL

SEQ ID NO: 1849224 - protein, 6 aa, Staphylococcus
DYKSGT

SEQ ID NO: 1849225 - protein, 6 aa, Staphylococcus
DYKYPT

SEQ ID NO: 1849226 - protein, 10 aa, Staphylococcus
DYLAKEKQPF

SEQ ID NO: 1849227 - protein, 20 aa, Staphylococcus
DYNDDAKDKYGFKTEVSGQS

SEQ ID NO: 1849228 - protein, 7 aa, Staphylococcus
DYNEDQD

SEQ ID NO: 1849229 - protein, 14 aa, Staphylococcus
DYNGANISGISSAS

SEQ ID NO: 1849230 - protein, 13 aa, Staphylococcus
DYNGANITGIASA

SEQ ID NO: 1849231 - protein, 13 aa, Staphylococcus
DYNGANITGISSA

SEQ ID NO: 1849232 - protein, 16 aa, Staphylococcus
DYNKAKVYGSKTFGKG

SEQ ID NO: 1849233 - protein, 19 aa, Staphylococcus
DYNKDAKDKYGFKTEISGQ

SEQ ID NO: 1849234 - protein, 7 aa, Staphylococcus
DYNNDKQ

SEQ ID NO: 1849235 - protein, 7 aa, Staphylococcus
DYNPQTN

SEQ ID NO: 1849236 - protein, 13 aa, Staphylococcus
DYNTEDVDAHNYN

SEQ ID NO: 1849237 - protein, 5 aa, Staphylococcus
DYNTI

SEQ ID NO: 1849238 - protein, 37 aa, Staphylococcus
DYPEDNKHVSQEEIESIQSTEETVHGEKTVETEHNAH

SEQ ID NO: 1849239 - protein, 26 aa, Staphylococcus
DYPEDNKKVSEEELNDIRSTNESLNV

SEQ ID NO: 1849240 - protein, 4 aa, Staphylococcus
DYPK

SEQ ID NO: 1849241 - protein, 14 aa, Staphylococcus
DYPNASKETMETEL

SEQ ID NO: 1849242 - protein, 8 aa, Staphylococcus
DYPNTGVQ

SEQ ID NO: 1849243 - protein, 30 aa, Staphylococcus
DYPSSKGTPTVTVDNPSTLPNGQTPGTYTV

SEQ ID NO: 1849244 - protein, 5 aa, Staphylococcus
DYPTI

SEQ ID NO: 1849245 - protein, 6 aa, Staphylococcus
DYPTIT

SEQ ID NO: 1849246 - protein, 10 aa, Staphylococcus
DYPTPKNSKY

SEQ ID NO: 1849247 - protein, 13 aa, Staphylococcus
DYQGMDKKEMAGQ

SEQ ID NO: 1849248 - protein, 11 aa, Staphylococcus
DYQHSRPPKPK

SEQ ID NO: 1849249 - protein, 32 aa, Staphylococcus
DYQNNKNENPVATFSNTSSQATTNNNTRTRTL

SEQ ID NO: 1849250 - protein, 11 aa, Staphylococcus
DYQQVSSDTGI

SEQ ID NO: 1849251 - protein, 7 aa, Staphylococcus
DYQRSGK

SEQ ID NO: 1849252 - protein, 15 aa, Staphylococcus
DYQSTDDEDEAPQVL

SEQ ID NO: 1849253 - protein, 15 aa, Staphylococcus
DYQTESTPETQQSYW

SEQ ID NO: 1849254 - protein, 8 aa, Staphylococcus
DYRGKSPA

SEQ ID NO: 1849255 - protein, 13 aa, Staphylococcus
DYSEEEFNQRRDE

SEQ ID NO: 1849256 - protein, 17 aa, Staphylococcus
DYSIEQQLNQVKTIVRE

SEQ ID NO: 1849257 - protein, 10 aa, Staphylococcus
DYSKSDNRTG

SEQ ID NO: 1849258 - protein, 4 aa, Staphylococcus
DYSP

SEQ ID NO: 1849259 - protein, 5 aa, Staphylococcus
DYTQA

SEQ ID NO: 1849260 - protein, 4 aa, Staphylococcus
DYTY

SEQ ID NO: 1849261 - protein, 5 aa, Staphylococcus
DYVSS

SEQ ID NO: 1849262 - protein, 7 aa, Staphylococcus
EAAAASQ

SEQ ID NO: 1849263 - protein, 5 aa, Staphylococcus
EAAKN

SEQ ID NO: 1849264 - protein, 23 aa, Staphylococcus
EAAKSDTSNGTSNHSLNHSNQNN

SEQ ID NO: 1849265 - protein, 10 aa, Staphylococcus
EAAKTEADRV

SEQ ID NO: 1849266 - protein, 4 aa, Staphylococcus
EAAL

SEQ ID NO: 1849267 - protein, 5 aa, Staphylococcus
EAASA

SEQ ID NO: 1849268 - protein, 8 aa, Staphylococcus
EAATQAGG

SEQ ID NO: 1849269 - protein, 54 aa, Staphylococcus
EADNVQHTEHDTNDADLASLDQSMDATEETEDSQSDAVNSISEAGEVENEAYTI

SEQ ID NO: 1849270 - protein, 7 aa, Staphylococcus
EADTGMR

SEQ ID NO: 1849271 - protein, 23 aa, Staphylococcus
EADTGMRESINQRTHSDDNESPD

SEQ ID NO: 1849272 - protein, 9 aa, Staphylococcus
EADTSETMK

SEQ ID NO: 1849273 - protein, 127 aa, Staphylococcus
EAEAEEVERNLSKQQIQHNNDATGDTQDDNNYNNEISNQEATTQNKQITQSDNVNSEAQAINEISDSHRTVNKATEALDNNSTLNTSTDVSPATKQDTTTSNQTTQENNDATTQTKTNYKQDGNNNV

SEQ ID NO: 1849274 - protein, 42 aa, Staphylococcus
EAEHAEHNRKERERRESGILGGKKHDESHQKDDNQEPKEKRI

SEQ ID NO: 1849275 - protein, 6 aa, Staphylococcus
EAEKRG

SEQ ID NO: 1849276 - protein, 8 aa, Staphylococcus
EAETKTIE

SEQ ID NO: 1849277 - protein, 8 aa, Staphylococcus
EAFNDSKN

SEQ ID NO: 1849278 - protein, 12 aa, Staphylococcus
EAGANKKVNPLK

SEQ ID NO: 1849279 - protein, 15 aa, Staphylococcus
EAGEEVSSKTLKSIS

SEQ ID NO: 1849280 - protein, 4 aa, Staphylococcus
EAGG

SEQ ID NO: 1849281 - protein, 10 aa, Staphylococcus
EAGHGKVGAQ

SEQ ID NO: 1849282 - protein, 10 aa, Staphylococcus
EAGNDGWGSN

SEQ ID NO: 1849283 - protein, 10 aa, Staphylococcus
EAGNKGWGSA

SEQ ID NO: 1849284 - protein, 9 aa, Staphylococcus
EAGNNSWSS

SEQ ID NO: 1849285 - protein, 6 aa, Staphylococcus
EAGPAL

SEQ ID NO: 1849286 - protein, 9 aa, Staphylococcus
EAGQKITTI

SEQ ID NO: 1849287 - protein, 12 aa, Staphylococcus
EAGQKITTIGGL

SEQ ID NO: 1849288 - protein, 12 aa, Staphylococcus
EAGRKLESKGIE

SEQ ID NO: 1849289 - protein, 6 aa, Staphylococcus
EAGSGF

SEQ ID NO: 1849290 - protein, 6 aa, Staphylococcus
EAGSGL

SEQ ID NO: 1849291 - protein, 8 aa, Staphylococcus
EAGSGMLS

SEQ ID NO: 1849292 - protein, 8 aa, Staphylococcus
EAGTATSN

SEQ ID NO: 1849293 - protein, 6 aa, Staphylococcus
EAGTRD

SEQ ID NO: 1849294 - protein, 7 aa, Staphylococcus
EAGTSMG

SEQ ID NO: 1849295 - protein, 4 aa, Staphylococcus
EAGV

SEQ ID NO: 1849296 - protein, 9 aa, Staphylococcus
EAGYQQQVE

SEQ ID NO: 1849297 - protein, 171 aa, Staphylococcus
EAHAQSNSSAKVSDKVATEQSASTSQEADSSQQTAASNAQNVQTAPEQDKATPTTEVNSNNNQTDSKHVAPQKEQNQTATQTESKKETAQTQAKTEEKAASDSKKASEDSDDKATSKETDENKTDDSVDTNSNITTPVYDTTRARAATSVPLASSLDSDASAAENAEPPAE

SEQ ID NO: 1849298 - protein, 11 aa, Staphylococcus
EAHEKKKMSGI

SEQ ID NO: 1849299 - protein, 13 aa, Staphylococcus
EAHSKKTLDQDTF

SEQ ID NO: 1849300 - protein, 8 aa, Staphylococcus
EAIDHKNN

SEQ ID NO: 1849301 - protein, 10 aa, Staphylococcus
EAIKPNVHQG

SEQ ID NO: 1849302 - protein, 11 aa, Staphylococcus
EAIKPNVHQGD

SEQ ID NO: 1849303 - protein, 6 aa, Staphylococcus
EAIKQT

SEQ ID NO: 1849304 - protein, 16 aa, Staphylococcus
EAIKTTPEFNIGDTPS

SEQ ID NO: 1849305 - protein, 34 aa, Staphylococcus
EAINNQPSTTGMTQDSINNYNAKRADAQSAINQA

SEQ ID NO: 1849306 - protein, 4 aa, Staphylococcus
EAIR

SEQ ID NO: 1849307 - protein, 5 aa, Staphylococcus
EAIRA

SEQ ID NO: 1849308 - protein, 22 aa, Staphylococcus
EAIRAVPNSVREASYGLGGNKW

SEQ ID NO: 1849309 - protein, 56 aa, Staphylococcus
EAKAETEKEEENEPKEVKVSATELTAQQNAVKVESSNNNLSDSSIKDNASHNKHVT

SEQ ID NO: 1849310 - protein, 11 aa, Staphylococcus
EAKIPSSDQYQ

SEQ ID NO: 1849311 - protein, 57 aa, Staphylococcus
EAKKENKVTAQENTTDVSNKDNSTESSSTQDASTEEEEKATTSNDTSADNTSNISNE

SEQ ID NO: 1849312 - protein, 8 aa, Staphylococcus
EAKKRKTK

SEQ ID NO: 1849313 - protein, 69 aa, Staphylococcus
EAKNDTLKSNVDKAKIKDELEQQEPDKLKTKESAENLSEKSEALPTKPNAPEKPIKQSLENEQSNQEVE

SEQ ID NO: 1849314 - protein, 27 aa, Staphylococcus
EAKNVDNDLNADQQATDDSKNKLNTAI

SEQ ID NO: 1849315 - protein, 17 aa, Staphylococcus
EAKSASIESHPNYLKKY

SEQ ID NO: 1849316 - protein, 17 aa, Staphylococcus
EAKTKSIESHPTYLKKY

SEQ ID NO: 1849317 - protein, 9 aa, Staphylococcus
EAKTSIKRR

SEQ ID NO: 1849318 - protein, 25 aa, Staphylococcus
EALNNARKALAKSTGKDLDENQVDG

SEQ ID NO: 1849319 - protein, 6 aa, Staphylococcus
EALPSK

SEQ ID NO: 1849320 - protein, 5 aa, Staphylococcus
EAMGG

SEQ ID NO: 1849321 - protein, 5 aa, Staphylococcus
EANES

SEQ ID NO: 1849322 - protein, 8 aa, Staphylococcus
EANGDDVS

SEQ ID NO: 1849323 - protein, 13 aa, Staphylococcus
EANSDATVEEKQE

SEQ ID NO: 1849324 - protein, 45 aa, Staphylococcus
EANSSEITSNSKDINQSGNKGNVSSSNEDNDSSNAEGSISEAGEV

SEQ ID NO: 1849325 - protein, 5 aa, Staphylococcus
EAPLL

SEQ ID NO: 1849326 - protein, 75 aa, Staphylococcus
EAQAAESNNSQGTQNSTTIDQTNKNTNQSAQQAQSKPADTVATQNSNTQNNQATTQNAPTTNTNNSNSKSNELSQ

SEQ ID NO: 1849327 - protein, 7 aa, Staphylococcus
EAQEEIQ

SEQ ID NO: 1849328 - protein, 11 aa, Staphylococcus
EAQGEKPNIQR

SEQ ID NO: 1849329 - protein, 11 aa, Staphylococcus
EAQKEASSQLN

SEQ ID NO: 1849330 - protein, 10 aa, Staphylococcus
EAQKELPGQF

SEQ ID NO: 1849331 - protein, 7 aa, Staphylococcus
EAQSPFE

SEQ ID NO: 1849332 - protein, 6 aa, Staphylococcus
EAQTGY

SEQ ID NO: 1849333 - protein, 14 aa, Staphylococcus
EAQVSQKDYRGFGG

SEQ ID NO: 1849334 - protein, 13 aa, Staphylococcus
EARIKEREAVGHE

SEQ ID NO: 1849335 - protein, 13 aa, Staphylococcus
EARIKEREAVSHE

SEQ ID NO: 1849336 - protein, 13 aa, Staphylococcus
EARLIKDDGTETM

SEQ ID NO: 1849337 - protein, 15 aa, Staphylococcus
EARNYENAQNTQSLS

SEQ ID NO: 1849338 - protein, 10 aa, Staphylococcus
EARRSAYKEH

SEQ ID NO: 1849339 - protein, 7 aa, Staphylococcus
EARTYEH

SEQ ID NO: 1849340 - protein, 5 aa, Staphylococcus
EASAK

SEQ ID NO: 1849341 - protein, 7 aa, Staphylococcus
EASEELE

SEQ ID NO: 1849342 - protein, 14 aa, Staphylococcus
EASEINGKIESYDN

SEQ ID NO: 1849343 - protein, 7 aa, Staphylococcus
EASESLE

SEQ ID NO: 1849344 - protein, 4 aa, Staphylococcus
EASG

SEQ ID NO: 1849345 - protein, 7 aa, Staphylococcus
EASGVSR

SEQ ID NO: 1849346 - protein, 7 aa, Staphylococcus
EASHASQ

SEQ ID NO: 1849347 - protein, 5 aa, Staphylococcus
EASKA

SEQ ID NO: 1849348 - protein, 6 aa, Staphylococcus
EASLAN

SEQ ID NO: 1849349 - protein, 6 aa, Staphylococcus
EASMAN

SEQ ID NO: 1849350 - protein, 7 aa, Staphylococcus
EASNHTL

SEQ ID NO: 1849351 - protein, 10 aa, Staphylococcus
EASNISDTEL

SEQ ID NO: 1849352 - protein, 4 aa, Staphylococcus
EASP

SEQ ID NO: 1849353 - protein, 6 aa, Staphylococcus
EASPEY

SEQ ID NO: 1849354 - protein, 11 aa, Staphylococcus
EASPKTKSLDG

SEQ ID NO: 1849355 - protein, 8 aa, Staphylococcus
EASQDRKN

SEQ ID NO: 1849356 - protein, 13 aa, Staphylococcus
EASRTRGKQGTGL

SEQ ID NO: 1849357 - protein, 29 aa, Staphylococcus
EASSEYAAKIDDAKTNDEVEAVKNQSIKD

SEQ ID NO: 1849358 - protein, 12 aa, Staphylococcus
EATGSNDVEFTE

SEQ ID NO: 1849359 - protein, 7 aa, Staphylococcus
EATGTAM

SEQ ID NO: 1849360 - protein, 12 aa, Staphylococcus
EATGTDSVEFTE

SEQ ID NO: 1849361 - protein, 7 aa, Staphylococcus
EATHASQ

SEQ ID NO: 1849362 - protein, 15 aa, Staphylococcus
EATIEYNQQKNVYKN

SEQ ID NO: 1849363 - protein, 11 aa, Staphylococcus
EATKVGKDTAL

SEQ ID NO: 1849364 - protein, 9 aa, Staphylococcus
EATKVGLNA

SEQ ID NO: 1849365 - protein, 10 aa, Staphylococcus
EATQTAKNYF

SEQ ID NO: 1849366 - protein, 22 aa, Staphylococcus
EATQTSIPQRQPQSRPEKQTVK

SEQ ID NO: 1849367 - protein, 9 aa, Staphylococcus
EATVEEQQA

SEQ ID NO: 1849368 - protein, 11 aa, Staphylococcus
EAVKPTVRQGD

SEQ ID NO: 1849369 - protein, 15 aa, Staphylococcus
EAVPGRGIKANISGK

SEQ ID NO: 1849370 - protein, 6 aa, Staphylococcus
EAVPRG

SEQ ID NO: 1849371 - protein, 14 aa, Staphylococcus
EDALAKKKQYNQQK

SEQ ID NO: 1849372 - protein, 10 aa, Staphylococcus
EDALNTSEEL

SEQ ID NO: 1849373 - protein, 14 aa, Staphylococcus
EDAMASVPNKIREG

SEQ ID NO: 1849374 - protein, 21 aa, Staphylococcus
EDAMASVPNKIREGAYGLGST

SEQ ID NO: 1849375 - protein, 14 aa, Staphylococcus
EDAMASVPNKMREG

SEQ ID NO: 1849376 - protein, 18 aa, Staphylococcus
EDAMSSVPNKIREGAYGL

SEQ ID NO: 1849377 - protein, 11 aa, Staphylococcus
EDAQGSKAPIQ

SEQ ID NO: 1849378 - protein, 8 aa, Staphylococcus
EDATKMNM

SEQ ID NO: 1849379 - protein, 26 aa, Staphylococcus
EDDIESDSDMDSDEDDSGSGEVTRDN

SEQ ID NO: 1849380 - protein, 14 aa, Staphylococcus
EDDLKNNKNALEDK

SEQ ID NO: 1849381 - protein, 5 aa, Staphylococcus
EDDMP

SEQ ID NO: 1849382 - protein, 4 aa, Staphylococcus
EDDQ

SEQ ID NO: 1849383 - protein, 6 aa, Staphylococcus
EDDRRG

SEQ ID NO: 1849384 - protein, 4 aa, Staphylococcus
EDDS

SEQ ID NO: 1849385 - protein, 9 aa, Staphylococcus
EDEADAEDN

SEQ ID NO: 1849386 - protein, 8 aa, Staphylococcus
EDEAEAED

SEQ ID NO: 1849387 - protein, 9 aa, Staphylococcus
EDEAEAEEN

SEQ ID NO: 1849388 - protein, 4 aa, Staphylococcus
EDEL

SEQ ID NO: 1849389 - protein, 6 aa, Staphylococcus
EDEYKK

SEQ ID NO: 1849390 - protein, 9 aa, Staphylococcus
EDGHRTYYG

SEQ ID NO: 1849391 - protein, 4 aa, Staphylococcus
EDGI

SEQ ID NO: 1849392 - protein, 31 aa, Staphylococcus
EDGIGDGQSHSNNQVAESRTENNEQKDDDSV

SEQ ID NO: 1849393 - protein, 7 aa, Staphylococcus
EDGTDQV

SEQ ID NO: 1849394 - protein, 13 aa, Staphylococcus
EDGTISEKTDNYR

SEQ ID NO: 1849395 - protein, 4 aa, Staphylococcus
EDGV

SEQ ID NO: 1849396 - protein, 14 aa, Staphylococcus
EDHGEFKKANEADI

SEQ ID NO: 1849397 - protein, 9 aa, Staphylococcus
EDHKASEVA

SEQ ID NO: 1849398 - protein, 8 aa, Staphylococcus
EDIAQSGM

SEQ ID NO: 1849399 - protein, 7 aa, Staphylococcus
EDIDPTL

SEQ ID NO: 1849400 - protein, 18 aa, Staphylococcus
EDIERKTKEIISDIEGNN

SEQ ID NO: 1849401 - protein, 18 aa, Staphylococcus
EDIERRTKEIVSDIESGN

SEQ ID NO: 1849402 - protein, 17 aa, Staphylococcus
EDIESKTKEIISDIESN

SEQ ID NO: 1849403 - protein, 33 aa, Staphylococcus
EDIPHRSNTSNIKNQAQQNKREFQQKRKQSKMN

SEQ ID NO: 1849404 - protein, 6 aa, Staphylococcus
EDISRQ

SEQ ID NO: 1849405 - protein, 5 aa, Staphylococcus
EDITP

SEQ ID NO: 1849406 - protein, 8 aa, Staphylococcus
EDITPAKF

SEQ ID NO: 1849407 - protein, 8 aa, Staphylococcus
EDKAEAGI

SEQ ID NO: 1849408 - protein, 71 aa, Staphylococcus
EDKAKEQRDIKEHYSNDDVHNGSHDLSNHNDNNRYDNNNHDRSNLERNDYQESNRRDDLHRSDEDFNRRND

SEQ ID NO: 1849409 - protein, 8 aa, Staphylococcus
EDKASHVA

SEQ ID NO: 1849410 - protein, 11 aa, Staphylococcus
EDKPDKDDLYE

SEQ ID NO: 1849411 - protein, 5 aa, Staphylococcus
EDKRA

SEQ ID NO: 1849412 - protein, 9 aa, Staphylococcus
EDKSTLKAK

SEQ ID NO: 1849413 - protein, 8 aa, Staphylococcus
EDLQDNTF

SEQ ID NO: 1849414 - protein, 12 aa, Staphylococcus
EDLQGKAYRSAK

SEQ ID NO: 1849415 - protein, 6 aa, Staphylococcus
EDLRNA

SEQ ID NO: 1849416 - protein, 8 aa, Staphylococcus
EDLSGNKK

SEQ ID NO: 1849417 - protein, 7 aa, Staphylococcus
EDMAQKS

SEQ ID NO: 1849418 - protein, 11 aa, Staphylococcus
EDNDKVSYQAK

SEQ ID NO: 1849419 - protein, 12 aa, Staphylococcus
EDNDLDKADAAL

SEQ ID NO: 1849420 - protein, 10 aa, Staphylococcus
EDNEAKNFDH

SEQ ID NO: 1849421 - protein, 10 aa, Staphylococcus
EDNEAQNFDH

SEQ ID NO: 1849422 - protein, 11 aa, Staphylococcus
EDNEAQNFDKH

SEQ ID NO: 1849423 - protein, 14 aa, Staphylococcus
EDNEAQNFDNRNQN

SEQ ID NO: 1849424 - protein, 7 aa, Staphylococcus
EDNIENL

SEQ ID NO: 1849425 - protein, 7 aa, Staphylococcus
EDNNQTI

SEQ ID NO: 1849426 - protein, 11 aa, Staphylococcus
EDNPNKDALYE

SEQ ID NO: 1849427 - protein, 44 aa, Staphylococcus
EDNSKEDEFNKEINSKQINSKRYSSTNKDNNEKERQSQRGNNNE

SEQ ID NO: 1849428 - protein, 23 aa, Staphylococcus
EDPHRKAMSNVKEGFNGIKNGKK

SEQ ID NO: 1849429 - protein, 11 aa, Staphylococcus
EDPKSKNAPHP

SEQ ID NO: 1849430 - protein, 14 aa, Staphylococcus
EDPSIYQSKDGHLK

SEQ ID NO: 1849431 - protein, 6 aa, Staphylococcus
EDPSVY

SEQ ID NO: 1849432 - protein, 14 aa, Staphylococcus
EDPTIYQNKDGHLK

SEQ ID NO: 1849433 - protein, 15 aa, Staphylococcus
EDPTIYQSKDGHLKR

SEQ ID NO: 1849434 - protein, 13 aa, Staphylococcus
EDQFNAKDYKKQL

SEQ ID NO: 1849435 - protein, 15 aa, Staphylococcus
EDQSTTYNGKKITLG

SEQ ID NO: 1849436 - protein, 32 aa, Staphylococcus
EDQVNQDPAITSSSKFENEDTEQQKAYNNAIN

SEQ ID NO: 1849437 - protein, 11 aa, Staphylococcus
EDREDVDLSTE

SEQ ID NO: 1849438 - protein, 8 aa, Staphylococcus
EDRKASGD

SEQ ID NO: 1849439 - protein, 9 aa, Staphylococcus
EDRPDKDTL

SEQ ID NO: 1849440 - protein, 5 aa, Staphylococcus
EDRTV

SEQ ID NO: 1849441 - protein, 12 aa, Staphylococcus
EDSDKKRMGTGA

SEQ ID NO: 1849442 - protein, 10 aa, Staphylococcus
EDSISPEAPH

SEQ ID NO: 1849443 - protein, 6 aa, Staphylococcus
EDSNSS

SEQ ID NO: 1849444 - protein, 6 aa, Staphylococcus
EDSNST

SEQ ID NO: 1849445 - protein, 5 aa, Staphylococcus
EDSNT

SEQ ID NO: 1849446 - protein, 10 aa, Staphylococcus
EDSPFVDRAG

SEQ ID NO: 1849447 - protein, 13 aa, Staphylococcus
EDSRNTKTGGSGL

SEQ ID NO: 1849448 - protein, 6 aa, Staphylococcus
EDSTKF

SEQ ID NO: 1849449 - protein, 6 aa, Staphylococcus
EDSTTT

SEQ ID NO: 1849450 - protein, 5 aa, Staphylococcus
EDTDD

SEQ ID NO: 1849451 - protein, 7 aa, Staphylococcus
EDTDSQH

SEQ ID NO: 1849452 - protein, 6 aa, Staphylococcus
EDTEEG

SEQ ID NO: 1849453 - protein, 7 aa, Staphylococcus
EDTLNGV

SEQ ID NO: 1849454 - protein, 7 aa, Staphylococcus
EDTQTIK

SEQ ID NO: 1849455 - protein, 7 aa, Staphylococcus
EDTSFRN

SEQ ID NO: 1849456 - protein, 6 aa, Staphylococcus
EDTSQR

SEQ ID NO: 1849457 - protein, 4 aa, Staphylococcus
EDTT

SEQ ID NO: 1849458 - protein, 6 aa, Staphylococcus
EDTYQI

SEQ ID NO: 1849459 - protein, 7 aa, Staphylococcus
EDVETNT

SEQ ID NO: 1849460 - protein, 16 aa, Staphylococcus
EDVHESIDKAAELKEE

SEQ ID NO: 1849461 - protein, 17 aa, Staphylococcus
EDVHESIDKAAKMKEKH

SEQ ID NO: 1849462 - protein, 16 aa, Staphylococcus
EDVHESVDKAAQLKDD

SEQ ID NO: 1849463 - protein, 16 aa, Staphylococcus
EDVHESVDKAEQIKNE

SEQ ID NO: 1849464 - protein, 6 aa, Staphylococcus
EDVPSK

SEQ ID NO: 1849465 - protein, 13 aa, Staphylococcus
EDVTEKEYAAVSQ

SEQ ID NO: 1849466 - protein, 9 aa, Staphylococcus
EDVTEQVEG

SEQ ID NO: 1849467 - protein, 7 aa, Staphylococcus
EDVVAQN

SEQ ID NO: 1849468 - protein, 12 aa, Staphylococcus
EDYASKKFSHRP

SEQ ID NO: 1849469 - protein, 4 aa, Staphylococcus
EDYG

SEQ ID NO: 1849470 - protein, 6 aa, Staphylococcus
EDYQRL

SEQ ID NO: 1849471 - protein, 73 aa, Staphylococcus
EDYYQNEDDSYGYEDGYAYNQEPQEPQVDPRELKAQRKKEKAEIRAKKREKKKAYNKRMKERRKNQPSAVNQR

SEQ ID NO: 1849472 - protein, 6 aa, Staphylococcus
EEAANY

SEQ ID NO: 1849473 - protein, 10 aa, Staphylococcus
EEADEDYSRL

SEQ ID NO: 1849474 - protein, 15 aa, Staphylococcus
EEAGIKESNSELQDK

SEQ ID NO: 1849475 - protein, 4 aa, Staphylococcus
EEAN

SEQ ID NO: 1849476 - protein, 9 aa, Staphylococcus
EEANEDNKL

SEQ ID NO: 1849477 - protein, 9 aa, Staphylococcus
EEAQQSRVN

SEQ ID NO: 1849478 - protein, 8 aa, Staphylococcus
EEAQRGKQ

SEQ ID NO: 1849479 - protein, 11 aa, Staphylococcus
EEAQSSKAPIQ

SEQ ID NO: 1849480 - protein, 4 aa, Staphylococcus
EEAS

SEQ ID NO: 1849481 - protein, 6 aa, Staphylococcus
EEATDR

SEQ ID NO: 1849482 - protein, 9 aa, Staphylococcus
EEATQAKNE

SEQ ID NO: 1849483 - protein, 19 aa, Staphylococcus
EEDADIDKPNTGDSTVDGY

SEQ ID NO: 1849484 - protein, 7 aa, Staphylococcus
EEDDLNN

SEQ ID NO: 1849485 - protein, 5 aa, Staphylococcus
EEDED

SEQ ID NO: 1849486 - protein, 6 aa, Staphylococcus
EEDKKA

SEQ ID NO: 1849487 - protein, 6 aa, Staphylococcus
EEDKTG

SEQ ID NO: 1849488 - protein, 14 aa, Staphylococcus
EEDLKKNNNALEDK

SEQ ID NO: 1849489 - protein, 14 aa, Staphylococcus
EEDLKNNKNALEDK

SEQ ID NO: 1849490 - protein, 6 aa, Staphylococcus
EEEDDT

SEQ ID NO: 1849491 - protein, 10 aa, Staphylococcus
EEEEKQQQRY

SEQ ID NO: 1849492 - protein, 12 aa, Staphylococcus
EEENEKNKKSKR

SEQ ID NO: 1849493 - protein, 12 aa, Staphylococcus
EEENRKSNKGKK

SEQ ID NO: 1849494 - protein, 4 aa, Staphylococcus
EEER

SEQ ID NO: 1849495 - protein, 7 aa, Staphylococcus
EEGAQRQ

SEQ ID NO: 1849496 - protein, 5 aa, Staphylococcus
EEGIP

SEQ ID NO: 1849497 - protein, 5 aa, Staphylococcus
EEGIT

SEQ ID NO: 1849498 - protein, 6 aa, Staphylococcus
EEGITK

SEQ ID NO: 1849499 - protein, 4 aa, Staphylococcus
EEGK

SEQ ID NO: 1849500 - protein, 13 aa, Staphylococcus
EEGKSNEAGHANY

SEQ ID NO: 1849501 - protein, 8 aa, Staphylococcus
EEGNRSAK

SEQ ID NO: 1849502 - protein, 6 aa, Staphylococcus
EEGNYV

SEQ ID NO: 1849503 - protein, 8 aa, Staphylococcus
EEHAQSHQ

SEQ ID NO: 1849504 - protein, 8 aa, Staphylococcus
EEHGNQTH

SEQ ID NO: 1849505 - protein, 4 aa, Staphylococcus
EEHP

SEQ ID NO: 1849506 - protein, 5 aa, Staphylococcus
EEHQS

SEQ ID NO: 1849507 - protein, 9 aa, Staphylococcus
EEHVKKNQP

SEQ ID NO: 1849508 - protein, 4 aa, Staphylococcus
EEIA

SEQ ID NO: 1849509 - protein, 4 aa, Staphylococcus
EEID

SEQ ID NO: 1849510 - protein, 12 aa, Staphylococcus
EEIGNAASHGAA

SEQ ID NO: 1849511 - protein, 10 aa, Staphylococcus
EEIGNATSHG

SEQ ID NO: 1849512 - protein, 9 aa, Staphylococcus
EEIGNSVSH

SEQ ID NO: 1849513 - protein, 12 aa, Staphylococcus
EEIPSNDESLQN

SEQ ID NO: 1849514 - protein, 5 aa, Staphylococcus
EEIPT

SEQ ID NO: 1849515 - protein, 24 aa, Staphylococcus
EEIQNVNNADTNAQVDNVKSKAIT

SEQ ID NO: 1849516 - protein, 7 aa, Staphylococcus
EEITEAT

SEQ ID NO: 1849517 - protein, 9 aa, Staphylococcus
EEKALTKGQ

SEQ ID NO: 1849518 - protein, 12 aa, Staphylococcus
EEKEAEENSLKT

SEQ ID NO: 1849519 - protein, 12 aa, Staphylococcus
EEKMEDDSTVGG

SEQ ID NO: 1849520 - protein, 18 aa, Staphylococcus
EEKPDKSDIEIQRNSEFK

SEQ ID NO: 1849521 - protein, 20 aa, Staphylococcus
EEKPSRVEEGNFNTDQEMQQ

SEQ ID NO: 1849522 - protein, 13 aa, Staphylococcus
EEKSIGRKAQEAY

SEQ ID NO: 1849523 - protein, 6 aa, Staphylococcus
EEKVAN

SEQ ID NO: 1849524 - protein, 9 aa, Staphylococcus
EELDKTNPM

SEQ ID NO: 1849525 - protein, 11 aa, Staphylococcus
EELHTNRKEGV

SEQ ID NO: 1849526 - protein, 10 aa, Staphylococcus
EELKEEGNYV

SEQ ID NO: 1849527 - protein, 4 aa, Staphylococcus
EELS

SEQ ID NO: 1849528 - protein, 6 aa, Staphylococcus
EEMNQL

SEQ ID NO: 1849529 - protein, 16 aa, Staphylococcus
EEMPNVSGKTEKQAEK

SEQ ID NO: 1849530 - protein, 8 aa, Staphylococcus
EENEDTNY

SEQ ID NO: 1849531 - protein, 5 aa, Staphylococcus
EENHQ

SEQ ID NO: 1849532 - protein, 10 aa, Staphylococcus
EENKDISPEG

SEQ ID NO: 1849533 - protein, 5 aa, Staphylococcus
EENLA

SEQ ID NO: 1849534 - protein, 5 aa, Staphylococcus
EENLT

SEQ ID NO: 1849535 - protein, 9 aa, Staphylococcus
EENNRGKQM

SEQ ID NO: 1849536 - protein, 4 aa, Staphylococcus
EEPG

SEQ ID NO: 1849537 - protein, 15 aa, Staphylococcus
EEPLDTDKVKSAWST

SEQ ID NO: 1849538 - protein, 7 aa, Staphylococcus
EEPYNSR

SEQ ID NO: 1849539 - protein, 6 aa, Staphylococcus
EEQAKG

SEQ ID NO: 1849540 - protein, 8 aa, Staphylococcus
EEQDSSNV

SEQ ID NO: 1849541 - protein, 6 aa, Staphylococcus
EEQHLK

SEQ ID NO: 1849542 - protein, 7 aa, Staphylococcus
EEQHSSN

SEQ ID NO: 1849543 - protein, 28 aa, Staphylococcus
EEQKENEQETIKDAYSQSKDDNKTDLDN

SEQ ID NO: 1849544 - protein, 5 aa, Staphylococcus
EEQKI

SEQ ID NO: 1849545 - protein, 11 aa, Staphylococcus
EEQLKNGKRHQ

SEQ ID NO: 1849546 - protein, 5 aa, Staphylococcus
EEQLQ

SEQ ID NO: 1849547 - protein, 21 aa, Staphylococcus
EERAYDKRSKEEKRKNTEKNL

SEQ ID NO: 1849548 - protein, 8 aa, Staphylococcus
EERDVPKA

SEQ ID NO: 1849549 - protein, 20 aa, Staphylococcus
EEREDQQDKQHDSTNNINKK

SEQ ID NO: 1849550 - protein, 39 aa, Staphylococcus
EEREERIERERQKREHLAEKEQHQAKVNEERVKDNLRKA

SEQ ID NO: 1849551 - protein, 38 aa, Staphylococcus
EEREERIKREREALKQQVAKEKQQSKVNEERVKDNLRK

SEQ ID NO: 1849552 - protein, 38 aa, Staphylococcus
EEREERLEREREQRERLAKKEQEQAKVNEERVKDNMRK

SEQ ID NO: 1849553 - protein, 38 aa, Staphylococcus
EEREERVEKQRQKERIQAKKEEYQAKVNEERVKDNLRK

SEQ ID NO: 1849554 - protein, 6 aa, Staphylococcus
EERPLT

SEQ ID NO: 1849555 - protein, 8 aa, Staphylococcus
EERTQIKR

SEQ ID NO: 1849556 - protein, 8 aa, Staphylococcus
EERVKTHQ

SEQ ID NO: 1849557 - protein, 9 aa, Staphylococcus
EESALQTEK

SEQ ID NO: 1849558 - protein, 6 aa, Staphylococcus
EESDMT

SEQ ID NO: 1849559 - protein, 12 aa, Staphylococcus
EESEVKSSSLDV

SEQ ID NO: 1849560 - protein, 11 aa, Staphylococcus
EESGGGDGGYI

SEQ ID NO: 1849561 - protein, 14 aa, Staphylococcus
EESKDDLGYKLVKV

SEQ ID NO: 1849562 - protein, 14 aa, Staphylococcus
EESKGQTNNANEKN

SEQ ID NO: 1849563 - protein, 15 aa, Staphylococcus
EESLSRYQSINGRQN

SEQ ID NO: 1849564 - protein, 17 aa, Staphylococcus
EESNINTPTINQNQQNQ

SEQ ID NO: 1849565 - protein, 6 aa, Staphylococcus
EESPIY

SEQ ID NO: 1849566 - protein, 6 aa, Staphylococcus
EESPVY

SEQ ID NO: 1849567 - protein, 7 aa, Staphylococcus
EESPVYE

SEQ ID NO: 1849568 - protein, 6 aa, Staphylococcus
EESTTF

SEQ ID NO: 1849569 - protein, 13 aa, Staphylococcus
EESTTGNGSASSL

SEQ ID NO: 1849570 - protein, 13 aa, Staphylococcus
EESVQELPNTGIT

SEQ ID NO: 1849571 - protein, 15 aa, Staphylococcus
EETDDTVDVKDGMGK

SEQ ID NO: 1849572 - protein, 15 aa, Staphylococcus
EETDDTVEVKDGMGK

SEQ ID NO: 1849573 - protein, 7 aa, Staphylococcus
EETENKQ

SEQ ID NO: 1849574 - protein, 6 aa, Staphylococcus
EETGDI

SEQ ID NO: 1849575 - protein, 7 aa, Staphylococcus
EETGDVS

SEQ ID NO: 1849576 - protein, 7 aa, Staphylococcus
EETIEDT

SEQ ID NO: 1849577 - protein, 8 aa, Staphylococcus
EETKAENY

SEQ ID NO: 1849578 - protein, 8 aa, Staphylococcus
EETQNDKM

SEQ ID NO: 1849579 - protein, 15 aa, Staphylococcus
EETSNLEKWTRNDEQ

SEQ ID NO: 1849580 - protein, 19 aa, Staphylococcus
EETTTIDKSKSGKYHQPAT

SEQ ID NO: 1849581 - protein, 6 aa, Staphylococcus
EEVADL

SEQ ID NO: 1849582 - protein, 11 aa, Staphylococcus
EEVDDGKSISE

SEQ ID NO: 1849583 - protein, 7 aa, Staphylococcus
EEVETET

SEQ ID NO: 1849584 - protein, 7 aa, Staphylococcus
EEVGNTV

SEQ ID NO: 1849585 - protein, 5 aa, Staphylococcus
EEVGT

SEQ ID NO: 1849586 - protein, 7 aa, Staphylococcus
EEVNDEA

SEQ ID NO: 1849587 - protein, 5 aa, Staphylococcus
EEVPQ

SEQ ID NO: 1849588 - protein, 14 aa, Staphylococcus
EEYDEQEDKNPNNK

SEQ ID NO: 1849589 - protein, 24 aa, Staphylococcus
EEYNKTRSKSSEKKLEKSVYQPTR

SEQ ID NO: 1849590 - protein, 60 aa, Staphylococcus
EEYRKKQDERKYEENQKPVKEKQNKKINYTKNEKVNIENNSEYNESAKEDSVDHSINEER

SEQ ID NO: 1849591 - protein, 7 aa, Staphylococcus
EEYRNAK

SEQ ID NO: 1849592 - protein, 11 aa, Staphylococcus
EEYSKTGDNDH

SEQ ID NO: 1849593 - protein, 12 aa, Staphylococcus
EEYSKTGDNDHS

SEQ ID NO: 1849594 - protein, 13 aa, Staphylococcus
EEYSKTGDNEHSI

SEQ ID NO: 1849595 - protein, 11 aa, Staphylococcus
EEYSKTRDNAY

SEQ ID NO: 1849596 - protein, 12 aa, Staphylococcus
EEYSKTRNNEHS

SEQ ID NO: 1849597 - protein, 4 aa, Staphylococcus
EFDD

SEQ ID NO: 1849598 - protein, 7 aa, Staphylococcus
EFDENEV

SEQ ID NO: 1849599 - protein, 6 aa, Staphylococcus
EFGSPK

SEQ ID NO: 1849600 - protein, 5 aa, Staphylococcus
EFGTP

SEQ ID NO: 1849601 - protein, 5 aa, Staphylococcus
EFHSG

SEQ ID NO: 1849602 - protein, 10 aa, Staphylococcus
EFIQPRTPQG

SEQ ID NO: 1849603 - protein, 16 aa, Staphylococcus
EFKNYDTKSHGKVSAY

SEQ ID NO: 1849604 - protein, 8 aa, Staphylococcus
EFKPGQHY

SEQ ID NO: 1849605 - protein, 6 aa, Staphylococcus
EFKPSQ

SEQ ID NO: 1849606 - protein, 9 aa, Staphylococcus
EFNQKSPEI

SEQ ID NO: 1849607 - protein, 20 aa, Staphylococcus
EFNSPEELKSRAKLREQRRE

SEQ ID NO: 1849608 - protein, 20 aa, Staphylococcus
EFNSPEELKTRAKLREQRRE

SEQ ID NO: 1849609 - protein, 20 aa, Staphylococcus
EFNTPEELKTRAKLREERRE

SEQ ID NO: 1849610 - protein, 21 aa, Staphylococcus
EFNTREELKSRAKKREEQREK

SEQ ID NO: 1849611 - protein, 4 aa, Staphylococcus
EFPE

SEQ ID NO: 1849612 - protein, 13 aa, Staphylococcus
EFPGDQIAKGTNT

SEQ ID NO: 1849613 - protein, 6 aa, Staphylococcus
EFPKNT

SEQ ID NO: 1849614 - protein, 4 aa, Staphylococcus
EFPT

SEQ ID NO: 1849615 - protein, 11 aa, Staphylococcus
EFQSKEPKKDN

SEQ ID NO: 1849616 - protein, 14 aa, Staphylococcus
EFSGGGGYNPYTKS

SEQ ID NO: 1849617 - protein, 10 aa, Staphylococcus
EFVQPRTPQG

SEQ ID NO: 1849618 - protein, 4 aa, Staphylococcus
EGAD

SEQ ID NO: 1849619 - protein, 10 aa, Staphylococcus
EGADEREKYI

SEQ ID NO: 1849620 - protein, 12 aa, Staphylococcus
EGAFNETEQNRL

SEQ ID NO: 1849621 - protein, 9 aa, Staphylococcus
EGAKDDVAS

SEQ ID NO: 1849622 - protein, 10 aa, Staphylococcus
EGAKNDEQSL

SEQ ID NO: 1849623 - protein, 9 aa, Staphylococcus
EGAKRAGLH

SEQ ID NO: 1849624 - protein, 4 aa, Staphylococcus
EGAQ

SEQ ID NO: 1849625 - protein, 10 aa, Staphylococcus
EGAWKDDNLA

SEQ ID NO: 1849626 - protein, 10 aa, Staphylococcus
EGAWKDEEIA

SEQ ID NO: 1849627 - protein, 11 aa, Staphylococcus
EGAWKDENLAP

SEQ ID NO: 1849628 - protein, 10 aa, Staphylococcus
EGAWQDESLA

SEQ ID NO: 1849629 - protein, 9 aa, Staphylococcus
EGAYTGEPR

SEQ ID NO: 1849630 - protein, 14 aa, Staphylococcus
EGDAQDYDGYSEEV

SEQ ID NO: 1849631 - protein, 8 aa, Staphylococcus
EGDDRQKA

SEQ ID NO: 1849632 - protein, 4 aa, Staphylococcus
EGDE

SEQ ID NO: 1849633 - protein, 19 aa, Staphylococcus
EGDSQDYEGYSEEKRVKKL

SEQ ID NO: 1849634 - protein, 7 aa, Staphylococcus
EGDTSQV

SEQ ID NO: 1849635 - protein, 5 aa, Staphylococcus
EGERL

SEQ ID NO: 1849636 - protein, 10 aa, Staphylococcus
EGEVSEKTAL

SEQ ID NO: 1849637 - protein, 7 aa, Staphylococcus
EGFPSGN

SEQ ID NO: 1849638 - protein, 9 aa, Staphylococcus
EGGEMLSGG

SEQ ID NO: 1849639 - protein, 10 aa, Staphylococcus
EGGEMLSGGQ

SEQ ID NO: 1849640 - protein, 4 aa, Staphylococcus
EGGY

SEQ ID NO: 1849641 - protein, 10 aa, Staphylococcus
EGGYINEQGN

SEQ ID NO: 1849642 - protein, 11 aa, Staphylococcus
EGGYITGTENN

SEQ ID NO: 1849643 - protein, 8 aa, Staphylococcus
EGHTIPES

SEQ ID NO: 1849644 - protein, 6 aa, Staphylococcus
EGIGGV

SEQ ID NO: 1849645 - protein, 6 aa, Staphylococcus
EGIGIQ

SEQ ID NO: 1849646 - protein, 6 aa, Staphylococcus
EGIHKP

SEQ ID NO: 1849647 - protein, 8 aa, Staphylococcus
EGIKSPAP

SEQ ID NO: 1849648 - protein, 13 aa, Staphylococcus
EGINEDVANDISK

SEQ ID NO: 1849649 - protein, 6 aa, Staphylococcus
EGINIQ

SEQ ID NO: 1849650 - protein, 5 aa, Staphylococcus
EGISK

SEQ ID NO: 1849651 - protein, 5 aa, Staphylococcus
EGITY

SEQ ID NO: 1849652 - protein, 7 aa, Staphylococcus
EGIYDNK

SEQ ID NO: 1849653 - protein, 56 aa, Staphylococcus
EGKALEEDNHHDTYSEKGHVNDKNNEYARQDKDNYVYQNDKRNHNRNYNDEDYNRS

SEQ ID NO: 1849654 - protein, 24 aa, Staphylococcus
EGKALEERHESSTSNYKHSNAPRY

SEQ ID NO: 1849655 - protein, 16 aa, Staphylococcus
EGKAYSTAKKELEEDG

SEQ ID NO: 1849656 - protein, 9 aa, Staphylococcus
EGKDGRLQS

SEQ ID NO: 1849657 - protein, 7 aa, Staphylococcus
EGKDGRV

SEQ ID NO: 1849658 - protein, 8 aa, Staphylococcus
EGKDGRVQ

SEQ ID NO: 1849659 - protein, 8 aa, Staphylococcus
EGKERQRA

SEQ ID NO: 1849660 - protein, 5 aa, Staphylococcus
EGKIN

SEQ ID NO: 1849661 - protein, 10 aa, Staphylococcus
EGKKFNKDND

SEQ ID NO: 1849662 - protein, 13 aa, Staphylococcus
EGKKIADTSTMSE

SEQ ID NO: 1849663 - protein, 28 aa, Staphylococcus
EGKLNELSQDLKDSLKNLKTSKAKTHTI

SEQ ID NO: 1849664 - protein, 8 aa, Staphylococcus
EGKLNLND

SEQ ID NO: 1849665 - protein, 9 aa, Staphylococcus
EGKNFTSDK

SEQ ID NO: 1849666 - protein, 9 aa, Staphylococcus
EGKNLDGDK

SEQ ID NO: 1849667 - protein, 12 aa, Staphylococcus
EGKRTGKENPSA

SEQ ID NO: 1849668 - protein, 15 aa, Staphylococcus
EGKVGEPHGKYAEAP

SEQ ID NO: 1849669 - protein, 8 aa, Staphylococcus
EGLGGKEN

SEQ ID NO: 1849670 - protein, 7 aa, Staphylococcus
EGLGSTL

SEQ ID NO: 1849671 - protein, 8 aa, Staphylococcus
EGLPKDTK

SEQ ID NO: 1849672 - protein, 8 aa, Staphylococcus
EGLQKQGA

SEQ ID NO: 1849673 - protein, 14 aa, Staphylococcus
EGLTVNKEKQPIKP

SEQ ID NO: 1849674 - protein, 17 aa, Staphylococcus
EGNDKHYGNDYDLPENT

SEQ ID NO: 1849675 - protein, 7 aa, Staphylococcus
EGNGSAR

SEQ ID NO: 1849676 - protein, 13 aa, Staphylococcus
EGNHNVSKSQINK

SEQ ID NO: 1849677 - protein, 9 aa, Staphylococcus
EGNNGLKEG

SEQ ID NO: 1849678 - protein, 15 aa, Staphylococcus
EGNNTIKSAAKLGDR

SEQ ID NO: 1849679 - protein, 31 aa, Staphylococcus
EGNQTKNIEKEVSKIGYSATLQSSNKNNNTK

SEQ ID NO: 1849680 - protein, 9 aa, Staphylococcus
EGNTSIDES

SEQ ID NO: 1849681 - protein, 5 aa, Staphylococcus
EGQDS

SEQ ID NO: 1849682 - protein, 19 aa, Staphylococcus
EGQGRLRANREGNVKNPHH

SEQ ID NO: 1849683 - protein, 20 aa, Staphylococcus
EGQGRLRANREGNVKNPHHF

SEQ ID NO: 1849684 - protein, 13 aa, Staphylococcus
EGQIREEEAKLTS

SEQ ID NO: 1849685 - protein, 12 aa, Staphylococcus
EGQLPTKKNQIA

SEQ ID NO: 1849686 - protein, 4 aa, Staphylococcus
EGQQ

SEQ ID NO: 1849687 - protein, 18 aa, Staphylococcus
EGQRVTTIARDKEHDTRT

SEQ ID NO: 1849688 - protein, 5 aa, Staphylococcus
EGQSF

SEQ ID NO: 1849689 - protein, 19 aa, Staphylococcus
EGQSILDDPSSASLPETIA

SEQ ID NO: 1849690 - protein, 9 aa, Staphylococcus
EGQTIEQGQ

SEQ ID NO: 1849691 - protein, 8 aa, Staphylococcus
EGRTRRKE

SEQ ID NO: 1849692 - protein, 9 aa, Staphylococcus
EGSASASEV

SEQ ID NO: 1849693 - protein, 9 aa, Staphylococcus
EGSDDFSKK

SEQ ID NO: 1849694 - protein, 20 aa, Staphylococcus
EGSDESDKYVDTVSTQSSLE

SEQ ID NO: 1849695 - protein, 21 aa, Staphylococcus
EGSEESDKYVDTVSTKSSLEK

SEQ ID NO: 1849696 - protein, 6 aa, Staphylococcus
EGSESQ

SEQ ID NO: 1849697 - protein, 15 aa, Staphylococcus
EGSIGQASGEYAQTP

SEQ ID NO: 1849698 - protein, 5 aa, Staphylococcus
EGSIR

SEQ ID NO: 1849699 - protein, 5 aa, Staphylococcus
EGSKI

SEQ ID NO: 1849700 - protein, 8 aa, Staphylococcus
EGSKLTAG

SEQ ID NO: 1849701 - protein, 4 aa, Staphylococcus
EGSM

SEQ ID NO: 1849702 - protein, 15 aa, Staphylococcus
EGSNSTKKQVISPRK

SEQ ID NO: 1849703 - protein, 5 aa, Staphylococcus
EGSQS

SEQ ID NO: 1849704 - protein, 6 aa, Staphylococcus
EGSQVG

SEQ ID NO: 1849705 - protein, 6 aa, Staphylococcus
EGSTVG

SEQ ID NO: 1849706 - protein, 10 aa, Staphylococcus
EGTKSIATKY

SEQ ID NO: 1849707 - protein, 4 aa, Staphylococcus
EGTT

SEQ ID NO: 1849708 - protein, 10 aa, Staphylococcus
EGTTGSQREL

SEQ ID NO: 1849709 - protein, 7 aa, Staphylococcus
EGTVRDK

SEQ ID NO: 1849710 - protein, 28 aa, Staphylococcus
EGTYEGKTFKSNSVNVASASDEDGGVTD

SEQ ID NO: 1849711 - protein, 8 aa, Staphylococcus
EGVGTALT

SEQ ID NO: 1849712 - protein, 17 aa, Staphylococcus
EGVLSKPDAKYPARKPH

SEQ ID NO: 1849713 - protein, 12 aa, Staphylococcus
EGVSQPELTRNS

SEQ ID NO: 1849714 - protein, 8 aa, Staphylococcus
EGVTPQIG

SEQ ID NO: 1849715 - protein, 15 aa, Staphylococcus
EGVYDKKQGEEYLKT

SEQ ID NO: 1849716 - protein, 5 aa, Staphylococcus
EGYAE

SEQ ID NO: 1849717 - protein, 22 aa, Staphylococcus
EGYDTEVGERGVKLSGGQKQRV

SEQ ID NO: 1849718 - protein, 10 aa, Staphylococcus
EGYEDREDFR

SEQ ID NO: 1849719 - protein, 12 aa, Staphylococcus
EGYEPSDELKQS

SEQ ID NO: 1849720 - protein, 5 aa, Staphylococcus
EGYGE

SEQ ID NO: 1849721 - protein, 4 aa, Staphylococcus
EGYN

SEQ ID NO: 1849722 - protein, 9 aa, Staphylococcus
EGYQSQLKE

SEQ ID NO: 1849723 - protein, 67 aa, Staphylococcus
EGYRGHYSDYDQPSEPEPQPQYYEKQQTADVEQPTNDDSLRRGGYSSEVANKVNGKNDATEEEPQVL

SEQ ID NO: 1849724 - protein, 5 aa, Staphylococcus
EHAGM

SEQ ID NO: 1849725 - protein, 19 aa, Staphylococcus
EHEKDETLTRGQSRLHEEV

SEQ ID NO: 1849726 - protein, 19 aa, Staphylococcus
EHENDRKSLETDEEKKNFD

SEQ ID NO: 1849727 - protein, 7 aa, Staphylococcus
EHERDRL

SEQ ID NO: 1849728 - protein, 17 aa, Staphylococcus
EHFTPERNKKSKTIGDK

SEQ ID NO: 1849729 - protein, 5 aa, Staphylococcus
EHGEQ

SEQ ID NO: 1849730 - protein, 6 aa, Staphylococcus
EHGKSY

SEQ ID NO: 1849731 - protein, 5 aa, Staphylococcus
EHGNK

SEQ ID NO: 1849732 - protein, 10 aa, Staphylococcus
EHGSTIKKGD

SEQ ID NO: 1849733 - protein, 6 aa, Staphylococcus
EHGTAS

SEQ ID NO: 1849734 - protein, 7 aa, Staphylococcus
EHHQTSD

SEQ ID NO: 1849735 - protein, 6 aa, Staphylococcus
EHIEGT

SEQ ID NO: 1849736 - protein, 6 aa, Staphylococcus
EHIERT

SEQ ID NO: 1849737 - protein, 9 aa, Staphylococcus
EHKEIEGGK

SEQ ID NO: 1849738 - protein, 10 aa, Staphylococcus
EHKEIEGGKE

SEQ ID NO: 1849739 - protein, 6 aa, Staphylococcus
EHKGAA

SEQ ID NO: 1849740 - protein, 7 aa, Staphylococcus
EHKNKHN

SEQ ID NO: 1849741 - protein, 9 aa, Staphylococcus
EHKNKKDQL

SEQ ID NO: 1849742 - protein, 4 aa, Staphylococcus
EHKP

SEQ ID NO: 1849743 - protein, 11 aa, Staphylococcus
EHKSAYDQALQ

SEQ ID NO: 1849744 - protein, 7 aa, Staphylococcus
EHLGSPG

SEQ ID NO: 1849745 - protein, 8 aa, Staphylococcus
EHNDDPGK

SEQ ID NO: 1849746 - protein, 8 aa, Staphylococcus
EHNNRNPK

SEQ ID NO: 1849747 - protein, 14 aa, Staphylococcus
EHNPTLNKDTIEQL

SEQ ID NO: 1849748 - protein, 6 aa, Staphylococcus
EHNTPN

SEQ ID NO: 1849749 - protein, 5 aa, Staphylococcus
EHPEI

SEQ ID NO: 1849750 - protein, 12 aa, Staphylococcus
EHPEVKKPLNKL

SEQ ID NO: 1849751 - protein, 6 aa, Staphylococcus
EHQEGI

SEQ ID NO: 1849752 - protein, 4 aa, Staphylococcus
EHQL

SEQ ID NO: 1849753 - protein, 6 aa, Staphylococcus
EHRVED

SEQ ID NO: 1849754 - protein, 13 aa, Staphylococcus
EHSQTAAKLSGMA

SEQ ID NO: 1849755 - protein, 22 aa, Staphylococcus
EHTEKEEASEKTYSQDATQYGL

SEQ ID NO: 1849756 - protein, 10 aa, Staphylococcus
EHVGQATANS

SEQ ID NO: 1849757 - protein, 23 aa, Staphylococcus
EIAINTDNSVLNKTDKIKINGTE

SEQ ID NO: 1849758 - protein, 10 aa, Staphylococcus
EIASDTKAFT

SEQ ID NO: 1849759 - protein, 10 aa, Staphylococcus
EIASQSESTF

SEQ ID NO: 1849760 - protein, 23 aa, Staphylococcus
EIDRATNKQAVADEKAKADQLMK

SEQ ID NO: 1849761 - protein, 12 aa, Staphylococcus
EIDYSESISEEI

SEQ ID NO: 1849762 - protein, 13 aa, Staphylococcus
EIEDANDNKTVDE

SEQ ID NO: 1849763 - protein, 54 aa, Staphylococcus
EIEGNNEPEEIQNRVNEPRKGETPEEKAARKREKKERKKRAKELRKQRPSAINQ

SEQ ID NO: 1849764 - protein, 11 aa, Staphylococcus
EIENKGNGFKT

SEQ ID NO: 1849765 - protein, 24 aa, Staphylococcus
EIERNDRQHEMSEKSKSEKELIKN

SEQ ID NO: 1849766 - protein, 4 aa, Staphylococcus
EIES

SEQ ID NO: 1849767 - protein, 22 aa, Staphylococcus
EIGKNDDQTTIQNQQKNPYEEK

SEQ ID NO: 1849768 - protein, 8 aa, Staphylococcus
EIGNSVSH

SEQ ID NO: 1849769 - protein, 18 aa, Staphylococcus
EIGPSKGENNQEKQVVSA

SEQ ID NO: 1849770 - protein, 5 aa, Staphylococcus
EIGVN

SEQ ID NO: 1849771 - protein, 10 aa, Staphylococcus
EIIQPRTPKG

SEQ ID NO: 1849772 - protein, 14 aa, Staphylococcus
EIKARKDLTDEQKA

SEQ ID NO: 1849773 - protein, 7 aa, Staphylococcus
EIKDKSG

SEQ ID NO: 1849774 - protein, 13 aa, Staphylococcus
EIKDTVSEDAYSS

SEQ ID NO: 1849775 - protein, 5 aa, Staphylococcus
EIKEA

SEQ ID NO: 1849776 - protein, 20 aa, Staphylococcus
EIKESDGEKYVKSGLKEGER

SEQ ID NO: 1849777 - protein, 33 aa, Staphylococcus
EIKGNSDSSPESKVTMPRKEVTPESPAIEANEE

SEQ ID NO: 1849778 - protein, 7 aa, Staphylococcus
EIKNNDS

SEQ ID NO: 1849779 - protein, 11 aa, Staphylococcus
EIKNPEKNIAR

SEQ ID NO: 1849780 - protein, 41 aa, Staphylococcus
EIKNSNVTKDTLTSSTTDVEDESDTTSSSKKNDDSNQADVG

SEQ ID NO: 1849781 - protein, 9 aa, Staphylococcus
EIKNTKDLG

SEQ ID NO: 1849782 - protein, 11 aa, Staphylococcus
EIKPDKGKVVR

SEQ ID NO: 1849783 - protein, 10 aa, Staphylococcus
EIKSPEKNIA

SEQ ID NO: 1849784 - protein, 6 aa, Staphylococcus
EINDGI

SEQ ID NO: 1849785 - protein, 9 aa, Staphylococcus
EINEDQEKL

SEQ ID NO: 1849786 - protein, 7 aa, Staphylococcus
EINGSKN

SEQ ID NO: 1849787 - protein, 26 aa, Staphylococcus
EINIPKGKDGKSVTITKAEPDADGNT

SEQ ID NO: 1849788 - protein, 10 aa, Staphylococcus
EINKSDNIKD

SEQ ID NO: 1849789 - protein, 8 aa, Staphylococcus
EINPNEKE

SEQ ID NO: 1849790 - protein, 7 aa, Staphylococcus
EINQEIE

SEQ ID NO: 1849791 - protein, 168 aa, Staphylococcus
EIPAKTANQATVENTAEPPQQNTVQTTATTDSKSNTDSTQTGTSDGQTHATPSAPSTTSSKALVATSDNNGTQSATTDTTNPTIANKDVQTEGNNALSQEKNTAATQLKAPQPNQQAVGQQTAKAQSAPSANQVQTQQLSAPASQQPAASSNQAAETPAQTQQAPQQA

SEQ ID NO: 1849792 - protein, 18 aa, Staphylococcus
EIPEQYKDQLKTSRKDGV

SEQ ID NO: 1849793 - protein, 19 aa, Staphylococcus
EIPKAQNDAKQDINRQSQD

SEQ ID NO: 1849794 - protein, 5 aa, Staphylococcus
EIPKE

SEQ ID NO: 1849795 - protein, 6 aa, Staphylococcus
EIPPHR

SEQ ID NO: 1849796 - protein, 6 aa, Staphylococcus
EIPPSK

SEQ ID NO: 1849797 - protein, 9 aa, Staphylococcus
EIPSPTGKV

SEQ ID NO: 1849798 - protein, 11 aa, Staphylococcus
EIQKPEKNIAR

SEQ ID NO: 1849799 - protein, 6 aa, Staphylococcus
EIQPEQ

SEQ ID NO: 1849800 - protein, 10 aa, Staphylococcus
EIQRPEKNIG

SEQ ID NO: 1849801 - protein, 5 aa, Staphylococcus
EIREA

SEQ ID NO: 1849802 - protein, 10 aa, Staphylococcus
EIRNPEKNIA

SEQ ID NO: 1849803 - protein, 6 aa, Staphylococcus
EIRQPN

SEQ ID NO: 1849804 - protein, 9 aa, Staphylococcus
EISEQDQKD

SEQ ID NO: 1849805 - protein, 9 aa, Staphylococcus
EISEQDQKE

SEQ ID NO: 1849806 - protein, 19 aa, Staphylococcus
EISGEDEEQLKSSGVTNQS

SEQ ID NO: 1849807 - protein, 9 aa, Staphylococcus
EISNEPNSQ

SEQ ID NO: 1849808 - protein, 7 aa, Staphylococcus
EISNPDL

SEQ ID NO: 1849809 - protein, 10 aa, Staphylococcus
EITDATPNTL

SEQ ID NO: 1849810 - protein, 7 aa, Staphylococcus
EITDNND

SEQ ID NO: 1849811 - protein, 16 aa, Staphylococcus
EITDQLNKGQNTLSTI

SEQ ID NO: 1849812 - protein, 7 aa, Staphylococcus
EITDSTE

SEQ ID NO: 1849813 - protein, 7 aa, Staphylococcus
EITDTTE

SEQ ID NO: 1849814 - protein, 5 aa, Staphylococcus
EITEQ

SEQ ID NO: 1849815 - protein, 13 aa, Staphylococcus
EITIPKGKDGISV

SEQ ID NO: 1849816 - protein, 19 aa, Staphylococcus
EITKPSETTVTEEDSEEPV

SEQ ID NO: 1849817 - protein, 19 aa, Staphylococcus
EITKPSETTVTEEISDEPV

SEQ ID NO: 1849818 - protein, 17 aa, Staphylococcus
EITPDNRAHSNNPTAKV

SEQ ID NO: 1849819 - protein, 15 aa, Staphylococcus
EITQNMNDTQKSEIN

SEQ ID NO: 1849820 - protein, 14 aa, Staphylococcus
EIVRPTEEQSLSHN

SEQ ID NO: 1849821 - protein, 9 aa, Staphylococcus
EKAATHKDI

SEQ ID NO: 1849822 - protein, 6 aa, Staphylococcus
EKAEEI

SEQ ID NO: 1849823 - protein, 18 aa, Staphylococcus
EKAGATVKLTRSDDTYVS

SEQ ID NO: 1849824 - protein, 23 aa, Staphylococcus
EKAHKDAKDKKASELEKKNDGGE

SEQ ID NO: 1849825 - protein, 6 aa, Staphylococcus
EKAHLT

SEQ ID NO: 1849826 - protein, 5 aa, Staphylococcus
EKAKR

SEQ ID NO: 1849827 - protein, 7 aa, Staphylococcus
EKALTRK

SEQ ID NO: 1849828 - protein, 8 aa, Staphylococcus
EKANDSIT

SEQ ID NO: 1849829 - protein, 17 aa, Staphylococcus
EKANKEDTVLNELLKKL

SEQ ID NO: 1849830 - protein, 9 aa, Staphylococcus
EKANYTPRD

SEQ ID NO: 1849831 - protein, 5 aa, Staphylococcus
EKAPK

SEQ ID NO: 1849832 - protein, 17 aa, Staphylococcus
EKAQGSSMNAEIGGTSE

SEQ ID NO: 1849833 - protein, 7 aa, Staphylococcus
EKAVEHK

SEQ ID NO: 1849834 - protein, 19 aa, Staphylococcus
EKDASIDKPNTGDSTVDGY

SEQ ID NO: 1849835 - protein, 18 aa, Staphylococcus
EKDASIDKPNTGDTTVDG

SEQ ID NO: 1849836 - protein, 11 aa, Staphylococcus
EKDDENSKELE

SEQ ID NO: 1849837 - protein, 12 aa, Staphylococcus
EKDDENSKELER

SEQ ID NO: 1849838 - protein, 10 aa, Staphylococcus
EKDDFSKGNH

SEQ ID NO: 1849839 - protein, 17 aa, Staphylococcus
EKDEDEDNESLKNVPTK

SEQ ID NO: 1849840 - protein, 5 aa, Staphylococcus
EKDGK

SEQ ID NO: 1849841 - protein, 8 aa, Staphylococcus
EKDGTGYA

SEQ ID NO: 1849842 - protein, 9 aa, Staphylococcus
EKDGTGYSS

SEQ ID NO: 1849843 - protein, 16 aa, Staphylococcus
EKDISDKQREQESLQN

SEQ ID NO: 1849844 - protein, 8 aa, Staphylococcus
EKDKAERR

SEQ ID NO: 1849845 - protein, 8 aa, Staphylococcus
EKDKKEKI

SEQ ID NO: 1849846 - protein, 11 aa, Staphylococcus
EKDKSSRRLDN

SEQ ID NO: 1849847 - protein, 17 aa, Staphylococcus
EKDLQKITDTAKKQDGL

SEQ ID NO: 1849848 - protein, 17 aa, Staphylococcus
EKDLQKITNEAKSQKGL

SEQ ID NO: 1849849 - protein, 16 aa, Staphylococcus
EKDLQKVTDEAHKQKD

SEQ ID NO: 1849850 - protein, 17 aa, Staphylococcus
EKDLQNITDKAKKQDGL

SEQ ID NO: 1849851 - protein, 17 aa, Staphylococcus
EKDLQQITNEARSQKGL

SEQ ID NO: 1849852 - protein, 7 aa, Staphylococcus
EKDNPIY

SEQ ID NO: 1849853 - protein, 9 aa, Staphylococcus
EKDQKVEKD

SEQ ID NO: 1849854 - protein, 9 aa, Staphylococcus
EKDQKVTGA

SEQ ID NO: 1849855 - protein, 9 aa, Staphylococcus
EKDSKGVDD

SEQ ID NO: 1849856 - protein, 11 aa, Staphylococcus
EKEDENSKELE

SEQ ID NO: 1849857 - protein, 5 aa, Staphylococcus
EKEGA

SEQ ID NO: 1849858 - protein, 16 aa, Staphylococcus
EKEGAKVKMTRTTDKY

SEQ ID NO: 1849859 - protein, 17 aa, Staphylococcus
EKEGATVSMTRESDTYV

SEQ ID NO: 1849860 - protein, 12 aa, Staphylococcus
EKEGDMGAQKYG

SEQ ID NO: 1849861 - protein, 12 aa, Staphylococcus
EKEGKIEYPNTG

SEQ ID NO: 1849862 - protein, 4 aa, Staphylococcus
EKEI

SEQ ID NO: 1849863 - protein, 52 aa, Staphylococcus
EKEKQAKEESSKEKEEAAKKKDEKIKQQEENEKKQKEQAQKDKQKRQEAERK

SEQ ID NO: 1849864 - protein, 5 aa, Staphylococcus
EKEKR

SEQ ID NO: 1849865 - protein, 9 aa, Staphylococcus
EKEKYSQEY

SEQ ID NO: 1849866 - protein, 5 aa, Staphylococcus
EKELT

SEQ ID NO: 1849867 - protein, 8 aa, Staphylococcus
EKELTDNF

SEQ ID NO: 1849868 - protein, 15 aa, Staphylococcus
EKENAKAKKNTKKQC

SEQ ID NO: 1849869 - protein, 13 aa, Staphylococcus
EKEQFAAKESVEG

SEQ ID NO: 1849870 - protein, 16 aa, Staphylococcus
EKEREAKEKVNKTAKE

SEQ ID NO: 1849871 - protein, 14 aa, Staphylococcus
EKESRKRYSPDSTY

SEQ ID NO: 1849872 - protein, 5 aa, Staphylococcus
EKETV

SEQ ID NO: 1849873 - protein, 7 aa, Staphylococcus
EKEVPKK

SEQ ID NO: 1849874 - protein, 7 aa, Staphylococcus
EKEYDKN

SEQ ID NO: 1849875 - protein, 7 aa, Staphylococcus
EKEYKHA

SEQ ID NO: 1849876 - protein, 5 aa, Staphylococcus
EKFAT

SEQ ID NO: 1849877 - protein, 13 aa, Staphylococcus
EKFNSEHYGDLTT

SEQ ID NO: 1849878 - protein, 8 aa, Staphylococcus
EKFPAKNK

SEQ ID NO: 1849879 - protein, 9 aa, Staphylococcus
EKFPSKNKL

SEQ ID NO: 1849880 - protein, 9 aa, Staphylococcus
EKFPSNDKL

SEQ ID NO: 1849881 - protein, 5 aa, Staphylococcus
EKFSK

SEQ ID NO: 1849882 - protein, 8 aa, Staphylococcus
EKFTKKSI

SEQ ID NO: 1849883 - protein, 22 aa, Staphylococcus
EKGDDTESIKTSNDASNEAKDM

SEQ ID NO: 1849884 - protein, 21 aa, Staphylococcus
EKGDTYHKEMDKKDPKYVSAA

SEQ ID NO: 1849885 - protein, 5 aa, Staphylococcus
EKGEA

SEQ ID NO: 1849886 - protein, 10 aa, Staphylococcus
EKGKETTIRQ

SEQ ID NO: 1849887 - protein, 12 aa, Staphylococcus
EKGKKTHVNGEE

SEQ ID NO: 1849888 - protein, 5 aa, Staphylococcus
EKGLY

SEQ ID NO: 1849889 - protein, 9 aa, Staphylococcus
EKGMDPNGY

SEQ ID NO: 1849890 - protein, 20 aa, Staphylococcus
EKGNDKEAIKTSNDALKDVK

SEQ ID NO: 1849891 - protein, 11 aa, Staphylococcus
EKGPNAESTND

SEQ ID NO: 1849892 - protein, 10 aa, Staphylococcus
EKGQKYHMDG

SEQ ID NO: 1849893 - protein, 11 aa, Staphylococcus
EKGSAFSSGER

SEQ ID NO: 1849894 - protein, 15 aa, Staphylococcus
EKGSISIKPNGKTDK

SEQ ID NO: 1849895 - protein, 10 aa, Staphylococcus
EKGTASYVDP

SEQ ID NO: 1849896 - protein, 6 aa, Staphylococcus
EKGYGA

SEQ ID NO: 1849897 - protein, 6 aa, Staphylococcus
EKGYKA

SEQ ID NO: 1849898 - protein, 8 aa, Staphylococcus
EKHAAEHQ

SEQ ID NO: 1849899 - protein, 11 aa, Staphylococcus
EKHKSYDEITG

SEQ ID NO: 1849900 - protein, 10 aa, Staphylococcus
EKHPSTKSNI

SEQ ID NO: 1849901 - protein, 6 aa, Staphylococcus
EKHYTE

SEQ ID NO: 1849902 - protein, 7 aa, Staphylococcus
EKIARAT

SEQ ID NO: 1849903 - protein, 4 aa, Staphylococcus
EKIE

SEQ ID NO: 1849904 - protein, 18 aa, Staphylococcus
EKIESIQGTIETKQKGSV

SEQ ID NO: 1849905 - protein, 7 aa, Staphylococcus
EKIETET

SEQ ID NO: 1849906 - protein, 16 aa, Staphylococcus
EKIKEADSQEERNAAN

SEQ ID NO: 1849907 - protein, 15 aa, Staphylococcus
EKIKEAQSPEERRAA

SEQ ID NO: 1849908 - protein, 6 aa, Staphylococcus
EKIRNT

SEQ ID NO: 1849909 - protein, 7 aa, Staphylococcus
EKIRNTM

SEQ ID NO: 1849910 - protein, 8 aa, Staphylococcus
EKKAEEGI

SEQ ID NO: 1849911 - protein, 15 aa, Staphylococcus
EKKEIEKEIKSLESE

SEQ ID NO: 1849912 - protein, 5 aa, Staphylococcus
EKKEL

SEQ ID NO: 1849913 - protein, 22 aa, Staphylococcus
EKKGDKLEVTYTNEDPSKTNAV

SEQ ID NO: 1849914 - protein, 15 aa, Staphylococcus
EKKKNRHKIKRSETL

SEQ ID NO: 1849915 - protein, 16 aa, Staphylococcus
EKKKTRYKIKRSETLS

SEQ ID NO: 1849916 - protein, 28 aa, Staphylococcus
EKKKYKEEVKKREKDYKAYLDEKSTAIN

SEQ ID NO: 1849917 - protein, 7 aa, Staphylococcus
EKKPHFT

SEQ ID NO: 1849918 - protein, 4 aa, Staphylococcus
EKKQ

SEQ ID NO: 1849919 - protein, 7 aa, Staphylococcus
EKKQNYS

SEQ ID NO: 1849920 - protein, 6 aa, Staphylococcus
EKKQTH

SEQ ID NO: 1849921 - protein, 13 aa, Staphylococcus
EKKSIGRKAQEAY

SEQ ID NO: 1849922 - protein, 9 aa, Staphylococcus
EKKTKKRTA

SEQ ID NO: 1849923 - protein, 10 aa, Staphylococcus
EKKVDKDTLY

SEQ ID NO: 1849924 - protein, 8 aa, Staphylococcus
EKKVPKKH

SEQ ID NO: 1849925 - protein, 10 aa, Staphylococcus
EKLDTNSGNY

SEQ ID NO: 1849926 - protein, 12 aa, Staphylococcus
EKLGNPKANGAV

SEQ ID NO: 1849927 - protein, 10 aa, Staphylococcus
EKLNKSETRV

SEQ ID NO: 1849928 - protein, 74 aa, Staphylococcus
EKLNKTTNEKKKKHKNKDKSVTNKNETLSNQQKIDNTHQPSKNNVEGHSNNVTNNVKQKSENAKDEVSHNFNKD

SEQ ID NO: 1849929 - protein, 10 aa, Staphylococcus
EKLPEGKTAL

SEQ ID NO: 1849930 - protein, 4 aa, Staphylococcus
EKLQ

SEQ ID NO: 1849931 - protein, 10 aa, Staphylococcus
EKLQSAEEQL

SEQ ID NO: 1849932 - protein, 11 aa, Staphylococcus
EKLSTLSNTHG

SEQ ID NO: 1849933 - protein, 142 aa, Staphylococcus
EKLTQEEIHQQHSQDIKENTPDTSIQDNNHIKQPVGKETNSIDDEKNTVEHHAKKTDEKIKQQNAIDRADNYQNDEPIQQKTSETKEKPKETELQNDSKDNKEQQRDTLEKQESRPKKTNKKHNSKFNQSTTKKVNQEEPPL

SEQ ID NO: 1849934 - protein, 9 aa, Staphylococcus
EKMKDNSYL

SEQ ID NO: 1849935 - protein, 17 aa, Staphylococcus
EKMKQSGSQDVKPESAQ

SEQ ID NO: 1849936 - protein, 19 aa, Staphylococcus
EKMPGSDKGAGIGKVDEGL

SEQ ID NO: 1849937 - protein, 5 aa, Staphylococcus
EKNAK

SEQ ID NO: 1849938 - protein, 8 aa, Staphylococcus
EKNDPRVD

SEQ ID NO: 1849939 - protein, 11 aa, Staphylococcus
EKNEAENFDKR

SEQ ID NO: 1849940 - protein, 9 aa, Staphylococcus
EKNEDVDLS

SEQ ID NO: 1849941 - protein, 4 aa, Staphylococcus
EKNF

SEQ ID NO: 1849942 - protein, 5 aa, Staphylococcus
EKNFD

SEQ ID NO: 1849943 - protein, 6 aa, Staphylococcus
EKNGHI

SEQ ID NO: 1849944 - protein, 8 aa, Staphylococcus
EKNHDDVS

SEQ ID NO: 1849945 - protein, 14 aa, Staphylococcus
EKNNAKKNGTSDKI

SEQ ID NO: 1849946 - protein, 9 aa, Staphylococcus
EKNNKQNTE

SEQ ID NO: 1849947 - protein, 9 aa, Staphylococcus
EKNQEAEAT

SEQ ID NO: 1849948 - protein, 7 aa, Staphylococcus
EKNQNKN

SEQ ID NO: 1849949 - protein, 7 aa, Staphylococcus
EKNQTHS

SEQ ID NO: 1849950 - protein, 8 aa, Staphylococcus
EKNRHTNR

SEQ ID NO: 1849951 - protein, 5 aa, Staphylococcus
EKNRL

SEQ ID NO: 1849952 - protein, 7 aa, Staphylococcus
EKNTEEV

SEQ ID NO: 1849953 - protein, 7 aa, Staphylococcus
EKPDKLQ

SEQ ID NO: 1849954 - protein, 15 aa, Staphylococcus
EKPETLKNGEKGISP

SEQ ID NO: 1849955 - protein, 15 aa, Staphylococcus
EKPETLNSGEKGISP

SEQ ID NO: 1849956 - protein, 15 aa, Staphylococcus
EKPETLSSGKKGISP

SEQ ID NO: 1849957 - protein, 6 aa, Staphylococcus
EKPFDN

SEQ ID NO: 1849958 - protein, 5 aa, Staphylococcus
EKPLT

SEQ ID NO: 1849959 - protein, 17 aa, Staphylococcus
EKPNNLENHDSMSAKKQ

SEQ ID NO: 1849960 - protein, 16 aa, Staphylococcus
EKPNNLENHNSMSAKK

SEQ ID NO: 1849961 - protein, 7 aa, Staphylococcus
EKPNYTI

SEQ ID NO: 1849962 - protein, 9 aa, Staphylococcus
EKPPFSPPA

SEQ ID NO: 1849963 - protein, 7 aa, Staphylococcus
EKPPLNF

SEQ ID NO: 1849964 - protein, 4 aa, Staphylococcus
EKPV

SEQ ID NO: 1849965 - protein, 8 aa, Staphylococcus
EKPYKKHM

SEQ ID NO: 1849966 - protein, 30 aa, Staphylococcus
EKPYKKNMATGYKVKNEKLKTMKPNTLDQY

SEQ ID NO: 1849967 - protein, 14 aa, Staphylococcus
EKQAIKDVKNEKLD

SEQ ID NO: 1849968 - protein, 7 aa, Staphylococcus
EKQDKLQ

SEQ ID NO: 1849969 - protein, 6 aa, Staphylococcus
EKQEKL

SEQ ID NO: 1849970 - protein, 7 aa, Staphylococcus
EKQEKLQ

SEQ ID NO: 1849971 - protein, 17 aa, Staphylococcus
EKQELENGTEQYLSKGA

SEQ ID NO: 1849972 - protein, 7 aa, Staphylococcus
EKQERQL

SEQ ID NO: 1849973 - protein, 14 aa, Staphylococcus
EKQGAYEHLYSIQN

SEQ ID NO: 1849974 - protein, 4 aa, Staphylococcus
EKQL

SEQ ID NO: 1849975 - protein, 5 aa, Staphylococcus
EKQRD

SEQ ID NO: 1849976 - protein, 32 aa, Staphylococcus
EKQSDWKAANKIAKSINPDIQSQKTQRQDMND

SEQ ID NO: 1849977 - protein, 6 aa, Staphylococcus
EKQSYR

SEQ ID NO: 1849978 - protein, 4 aa, Staphylococcus
EKQT

SEQ ID NO: 1849979 - protein, 5 aa, Staphylococcus
EKQTG

SEQ ID NO: 1849980 - protein, 8 aa, Staphylococcus
EKQTNVKR

SEQ ID NO: 1849981 - protein, 40 aa, Staphylococcus
EKQVGAGTLNMTEKNGRFVEASKKDVEKAMDVNSDKDNLN

SEQ ID NO: 1849982 - protein, 7 aa, Staphylococcus
EKQYSKN

SEQ ID NO: 1849983 - protein, 4 aa, Staphylococcus
EKRA

SEQ ID NO: 1849984 - protein, 9 aa, Staphylococcus
EKRATNRGY

SEQ ID NO: 1849985 - protein, 5 aa, Staphylococcus
EKREH

SEQ ID NO: 1849986 - protein, 17 aa, Staphylococcus
EKREKDSKTLNNDHSEK

SEQ ID NO: 1849987 - protein, 16 aa, Staphylococcus
EKREQQKIDKRKRQKR

SEQ ID NO: 1849988 - protein, 12 aa, Staphylococcus
EKRESRRNKEKE

SEQ ID NO: 1849989 - protein, 12 aa, Staphylococcus
EKRESRRNREKE

SEQ ID NO: 1849990 - protein, 7 aa, Staphylococcus
EKRGSQT

SEQ ID NO: 1849991 - protein, 6 aa, Staphylococcus
EKRHEL

SEQ ID NO: 1849992 - protein, 7 aa, Staphylococcus
EKRKRTT

SEQ ID NO: 1849993 - protein, 13 aa, Staphylococcus
EKRQNRRNAEKAE

SEQ ID NO: 1849994 - protein, 6 aa, Staphylococcus
EKRQQL

SEQ ID NO: 1849995 - protein, 12 aa, Staphylococcus
EKRTKKSHCIQK

SEQ ID NO: 1849996 - protein, 8 aa, Staphylococcus
EKRYGRSN

SEQ ID NO: 1849997 - protein, 5 aa, Staphylococcus
EKSAG

SEQ ID NO: 1849998 - protein, 12 aa, Staphylococcus
EKSEATDSGNLR

SEQ ID NO: 1849999 - protein, 9 aa, Staphylococcus
EKSEDVDLS

SEQ ID NO: 1850000 - protein, 11 aa, Staphylococcus
EKSEQEYSQNL

SEQ ID NO: 1850001 - protein, 8 aa, Staphylococcus
EKSGKITK

SEQ ID NO: 1850002 - protein, 7 aa, Staphylococcus
EKSGKTA

SEQ ID NO: 1850003 - protein, 9 aa, Staphylococcus
EKSGNKLPD

SEQ ID NO: 1850004 - protein, 13 aa, Staphylococcus
EKSHNKSLAIQNS

SEQ ID NO: 1850005 - protein, 8 aa, Staphylococcus
EKSKDNYV

SEQ ID NO: 1850006 - protein, 7 aa, Staphylococcus
EKSKDSY

SEQ ID NO: 1850007 - protein, 7 aa, Staphylococcus
EKSLPPW

SEQ ID NO: 1850008 - protein, 17 aa, Staphylococcus
EKSNKHDTVLDKLLKKL

SEQ ID NO: 1850009 - protein, 17 aa, Staphylococcus
EKSNKNDTVLDQLLKKL

SEQ ID NO: 1850010 - protein, 10 aa, Staphylococcus
EKSNQGQSLS

SEQ ID NO: 1850011 - protein, 12 aa, Staphylococcus
EKSNYVSKIHVK

SEQ ID NO: 1850012 - protein, 8 aa, Staphylococcus
EKSPSGIT

SEQ ID NO: 1850013 - protein, 8 aa, Staphylococcus
EKSQTDSI

SEQ ID NO: 1850014 - protein, 8 aa, Staphylococcus
EKSRGKIH

SEQ ID NO: 1850015 - protein, 8 aa, Staphylococcus
EKSYKIEN

SEQ ID NO: 1850016 - protein, 8 aa, Staphylococcus
EKTAKSQR

SEQ ID NO: 1850017 - protein, 6 aa, Staphylococcus
EKTGTY

SEQ ID NO: 1850018 - protein, 8 aa, Staphylococcus
EKTHTFDE

SEQ ID NO: 1850019 - protein, 6 aa, Staphylococcus
EKTIKT

SEQ ID NO: 1850020 - protein, 12 aa, Staphylococcus
EKTKNGKTEYAG

SEQ ID NO: 1850021 - protein, 17 aa, Staphylococcus
EKTLTDNIPSYNAEQAP

SEQ ID NO: 1850022 - protein, 8 aa, Staphylococcus
EKTNEVSG

SEQ ID NO: 1850023 - protein, 8 aa, Staphylococcus
EKTQEIEI

SEQ ID NO: 1850024 - protein, 9 aa, Staphylococcus
EKTQEIEIT

SEQ ID NO: 1850025 - protein, 8 aa, Staphylococcus
EKTQEVEG

SEQ ID NO: 1850026 - protein, 8 aa, Staphylococcus
EKTQEVSG

SEQ ID NO: 1850027 - protein, 6 aa, Staphylococcus
EKTRNL

SEQ ID NO: 1850028 - protein, 6 aa, Staphylococcus
EKTTGW

SEQ ID NO: 1850029 - protein, 13 aa, Staphylococcus
EKTTYDQNEPHYN

SEQ ID NO: 1850030 - protein, 4 aa, Staphylococcus
EKVA

SEQ ID NO: 1850031 - protein, 6 aa, Staphylococcus
EKVGRG

SEQ ID NO: 1850032 - protein, 8 aa, Staphylococcus
EKVHDSSE

SEQ ID NO: 1850033 - protein, 5 aa, Staphylococcus
EKVNP

SEQ ID NO: 1850034 - protein, 17 aa, Staphylococcus
EKVQRARTQEDKMAANQ

SEQ ID NO: 1850035 - protein, 13 aa, Staphylococcus
EKVQSRKDVSSEY

SEQ ID NO: 1850036 - protein, 7 aa, Staphylococcus
EKVRNTM

SEQ ID NO: 1850037 - protein, 101 aa, Staphylococcus
EKVTTDSKKGKKDKKDKAINNKDAKAKSTQSSQLQDKTDKSANDHTSHLKDSTQSNAQDSNKDLNDKATQHKEDLSNTASSRKDDLEKTAKDTIDKNNPNN

SEQ ID NO: 1850038 - protein, 4 aa, Staphylococcus
EKWR

SEQ ID NO: 1850039 - protein, 17 aa, Staphylococcus
EKYELYGKTGTGIVNGK

SEQ ID NO: 1850040 - protein, 4 aa, Staphylococcus
EKYG

SEQ ID NO: 1850041 - protein, 8 aa, Staphylococcus
EKYGRKRR

SEQ ID NO: 1850042 - protein, 18 aa, Staphylococcus
EKYKNLKYTQSYDANEIK

SEQ ID NO: 1850043 - protein, 5 aa, Staphylococcus
EKYKP

SEQ ID NO: 1850044 - protein, 12 aa, Staphylococcus
ELAAHDDKTKAV

SEQ ID NO: 1850045 - protein, 10 aa, Staphylococcus
ELAEKTESSW

SEQ ID NO: 1850046 - protein, 8 aa, Staphylococcus
ELAENPFQ

SEQ ID NO: 1850047 - protein, 9 aa, Staphylococcus
ELAGTENRI

SEQ ID NO: 1850048 - protein, 22 aa, Staphylococcus
ELDKEEEEKLENQTYLNKTKRN

SEQ ID NO: 1850049 - protein, 8 aa, Staphylococcus
ELDKTNPV

SEQ ID NO: 1850050 - protein, 7 aa, Staphylococcus
ELDNKNV

SEQ ID NO: 1850051 - protein, 10 aa, Staphylococcus
ELEERDSPHL

SEQ ID NO: 1850052 - protein, 18 aa, Staphylococcus
ELEETSKGNDFNLIKESN

SEQ ID NO: 1850053 - protein, 4 aa, Staphylococcus
ELER

SEQ ID NO: 1850054 - protein, 14 aa, Staphylococcus
ELGNKEANTELQEK

SEQ ID NO: 1850055 - protein, 27 aa, Staphylococcus
ELGNKEVNNELKEKVSANFDTKKADAI

SEQ ID NO: 1850056 - protein, 6 aa, Staphylococcus
ELGPIS

SEQ ID NO: 1850057 - protein, 7 aa, Staphylococcus
ELGTDNI

SEQ ID NO: 1850058 - protein, 7 aa, Staphylococcus
ELGTDNV

SEQ ID NO: 1850059 - protein, 16 aa, Staphylococcus
ELGTDNVERMKGVLDD

SEQ ID NO: 1850060 - protein, 17 aa, Staphylococcus
ELGTDNVERMKGVPEDD

SEQ ID NO: 1850061 - protein, 18 aa, Staphylococcus
ELGTDNVESMKGVLEDDR

SEQ ID NO: 1850062 - protein, 18 aa, Staphylococcus
ELGTDNVESMKGVPEDVR

SEQ ID NO: 1850063 - protein, 5 aa, Staphylococcus
ELHSN

SEQ ID NO: 1850064 - protein, 10 aa, Staphylococcus
ELHTTKDSGV

SEQ ID NO: 1850065 - protein, 8 aa, Staphylococcus
ELKENTPV

SEQ ID NO: 1850066 - protein, 9 aa, Staphylococcus
ELKGDKKGV

SEQ ID NO: 1850067 - protein, 13 aa, Staphylococcus
ELKNPLSDEHQSV

SEQ ID NO: 1850068 - protein, 23 aa, Staphylococcus
ELKSDTKEHRDWQTNAKTTNNKD

SEQ ID NO: 1850069 - protein, 9 aa, Staphylococcus
ELKSEQPDF

SEQ ID NO: 1850070 - protein, 4 aa, Staphylococcus
ELMP

SEQ ID NO: 1850071 - protein, 9 aa, Staphylococcus
ELNEKENLY

SEQ ID NO: 1850072 - protein, 8 aa, Staphylococcus
ELNETGTD

SEQ ID NO: 1850073 - protein, 32 aa, Staphylococcus
ELNIPKGAKGDKGQDAAPLTVTETTKDNDGNT

SEQ ID NO: 1850074 - protein, 37 aa, Staphylococcus
ELNNDTQEYSINDEADENELKTEQYNASTSVTESNSE

SEQ ID NO: 1850075 - protein, 8 aa, Staphylococcus
ELNPNNRK

SEQ ID NO: 1850076 - protein, 8 aa, Staphylococcus
ELNQASEE

SEQ ID NO: 1850077 - protein, 11 aa, Staphylococcus
ELNQASEQAIQ

SEQ ID NO: 1850078 - protein, 9 aa, Staphylococcus
ELNSDNRKS

SEQ ID NO: 1850079 - protein, 19 aa, Staphylococcus
ELNTATTQINNASHNSEVD

SEQ ID NO: 1850080 - protein, 7 aa, Staphylococcus
ELNTEHR

SEQ ID NO: 1850081 - protein, 14 aa, Staphylococcus
ELPETGETANKNGL

SEQ ID NO: 1850082 - protein, 7 aa, Staphylococcus
ELPNDID

SEQ ID NO: 1850083 - protein, 13 aa, Staphylococcus
ELPQPAERQYDKS

SEQ ID NO: 1850084 - protein, 8 aa, Staphylococcus
ELPREQKD

SEQ ID NO: 1850085 - protein, 12 aa, Staphylococcus
ELPRKEKDKKMY

SEQ ID NO: 1850086 - protein, 12 aa, Staphylococcus
ELPRKEKDKLMD

SEQ ID NO: 1850087 - protein, 8 aa, Staphylococcus
ELSKDTLK

SEQ ID NO: 1850088 - protein, 7 aa, Staphylococcus
ELSKGKT

SEQ ID NO: 1850089 - protein, 10 aa, Staphylococcus
ELSKQDERDK

SEQ ID NO: 1850090 - protein, 7 aa, Staphylococcus
ELSNPSM

SEQ ID NO: 1850091 - protein, 6 aa, Staphylococcus
ELSPDF

SEQ ID NO: 1850092 - protein, 6 aa, Staphylococcus
ELSPKD

SEQ ID NO: 1850093 - protein, 17 aa, Staphylococcus
ELTDEIKDNNQSYHSGR

SEQ ID NO: 1850094 - protein, 7 aa, Staphylococcus
ELTDQNE

SEQ ID NO: 1850095 - protein, 8 aa, Staphylococcus
ELTDSTTN

SEQ ID NO: 1850096 - protein, 4 aa, Staphylococcus
ELTG

SEQ ID NO: 1850097 - protein, 7 aa, Staphylococcus
ELTGGKN

SEQ ID NO: 1850098 - protein, 10 aa, Staphylococcus
ELTKSSDKMI

SEQ ID NO: 1850099 - protein, 9 aa, Staphylococcus
ELTNSYKEA

SEQ ID NO: 1850100 - protein, 15 aa, Staphylococcus
ELTSTSVGAQFGQDA

SEQ ID NO: 1850101 - protein, 8 aa, Staphylococcus
ELYEESKP

SEQ ID NO: 1850102 - protein, 19 aa, Staphylococcus
EMDEEEKEKLELQKKAYNE

SEQ ID NO: 1850103 - protein, 5 aa, Staphylococcus
EMDEH

SEQ ID NO: 1850104 - protein, 21 aa, Staphylococcus
EMDQEEEEKLKNQRLPQSMKG

SEQ ID NO: 1850105 - protein, 4 aa, Staphylococcus
EMEH

SEQ ID NO: 1850106 - protein, 20 aa, Staphylococcus
EMEPDAPVDKSEMKSEDELY

SEQ ID NO: 1850107 - protein, 8 aa, Staphylococcus
EMESSENL

SEQ ID NO: 1850108 - protein, 8 aa, Staphylococcus
EMGQASKE

SEQ ID NO: 1850109 - protein, 6 aa, Staphylococcus
EMKPTN

SEQ ID NO: 1850110 - protein, 5 aa, Staphylococcus
EMNNT

SEQ ID NO: 1850111 - protein, 5 aa, Staphylococcus
EMNPG

SEQ ID NO: 1850112 - protein, 10 aa, Staphylococcus
EMNQGNYNKA

SEQ ID NO: 1850113 - protein, 16 aa, Staphylococcus
EMQDKHEHKSDKINVD

SEQ ID NO: 1850114 - protein, 14 aa, Staphylococcus
EMQESMQTILHFFL

SEQ ID NO: 1850115 - protein, 7 aa, Staphylococcus
EMQKKDK

SEQ ID NO: 1850116 - protein, 11 aa, Staphylococcus
EMQKKGNQIQI

SEQ ID NO: 1850117 - protein, 7 aa, Staphylococcus
EMQKKNK

SEQ ID NO: 1850118 - protein, 7 aa, Staphylococcus
EMQQKNN

SEQ ID NO: 1850119 - protein, 5 aa, Staphylococcus
EMQSH

SEQ ID NO: 1850120 - protein, 4 aa, Staphylococcus
EMRG

SEQ ID NO: 1850121 - protein, 8 aa, Staphylococcus
EMSGSTGW

SEQ ID NO: 1850122 - protein, 7 aa, Staphylococcus
EMSPKAR

SEQ ID NO: 1850123 - protein, 7 aa, Staphylococcus
EMSSDNA

SEQ ID NO: 1850124 - protein, 8 aa, Staphylococcus
EMTSNRLT

SEQ ID NO: 1850125 - protein, 44 aa, Staphylococcus
ENAESSGDASKKIKELQQQVDAKDSQMQQAIKDKDETKLQSINN

SEQ ID NO: 1850126 - protein, 5 aa, Staphylococcus
ENAGK

SEQ ID NO: 1850127 - protein, 30 aa, Staphylococcus
ENALQSSYNKSDAKRHSTLRNSKMNPSKNA

SEQ ID NO: 1850128 - protein, 8 aa, Staphylococcus
ENANKDSI

SEQ ID NO: 1850129 - protein, 8 aa, Staphylococcus
ENAPDPVF

SEQ ID NO: 1850130 - protein, 6 aa, Staphylococcus
ENAPRL

SEQ ID NO: 1850131 - protein, 5 aa, Staphylococcus
ENASQ

SEQ ID NO: 1850132 - protein, 6 aa, Staphylococcus
ENATKM

SEQ ID NO: 1850133 - protein, 10 aa, Staphylococcus
ENATSDDDIQ

SEQ ID NO: 1850134 - protein, 9 aa, Staphylococcus
ENATSDEDI

SEQ ID NO: 1850135 - protein, 10 aa, Staphylococcus
ENATSDEDIN

SEQ ID NO: 1850136 - protein, 29 aa, Staphylococcus
ENAVPAKQLKKTKHNTQSESQFKHTPQVK

SEQ ID NO: 1850137 - protein, 4 aa, Staphylococcus
ENDA

SEQ ID NO: 1850138 - protein, 10 aa, Staphylococcus
ENDDKQSASF

SEQ ID NO: 1850139 - protein, 5 aa, Staphylococcus
ENDEV

SEQ ID NO: 1850140 - protein, 4 aa, Staphylococcus
ENDH

SEQ ID NO: 1850141 - protein, 10 aa, Staphylococcus
ENDKFESKDY

SEQ ID NO: 1850142 - protein, 4 aa, Staphylococcus
ENDM

SEQ ID NO: 1850143 - protein, 36 aa, Staphylococcus
ENDTNATFEEREEAKTSVNEALTNAKNAVRNATTNQ

SEQ ID NO: 1850144 - protein, 27 aa, Staphylococcus
ENDTSNNSSSAEKETQEAGKENELGSG

SEQ ID NO: 1850145 - protein, 5 aa, Staphylococcus
ENEAT

SEQ ID NO: 1850146 - protein, 11 aa, Staphylococcus
ENEDENTKELQ

SEQ ID NO: 1850147 - protein, 15 aa, Staphylococcus
ENEETVEKKRKPLGV

SEQ ID NO: 1850148 - protein, 6 aa, Staphylococcus
ENEITN

SEQ ID NO: 1850149 - protein, 5 aa, Staphylococcus
ENELT

SEQ ID NO: 1850150 - protein, 7 aa, Staphylococcus
ENENKLQ

SEQ ID NO: 1850151 - protein, 11 aa, Staphylococcus
ENENKVNINDP

SEQ ID NO: 1850152 - protein, 7 aa, Staphylococcus
ENENQEI

SEQ ID NO: 1850153 - protein, 9 aa, Staphylococcus
ENENQEIEY

SEQ ID NO: 1850154 - protein, 13 aa, Staphylococcus
ENENRKKKRHEMR

SEQ ID NO: 1850155 - protein, 6 aa, Staphylococcus
ENEQVY

SEQ ID NO: 1850156 - protein, 6 aa, Staphylococcus
ENERQR

SEQ ID NO: 1850157 - protein, 13 aa, Staphylococcus
ENESREAAGKVAN

SEQ ID NO: 1850158 - protein, 6 aa, Staphylococcus
ENFNEA

SEQ ID NO: 1850159 - protein, 19 aa, Staphylococcus
ENFRNKSNNGVTSDELSAQ

SEQ ID NO: 1850160 - protein, 4 aa, Staphylococcus
ENGI

SEQ ID NO: 1850161 - protein, 5 aa, Staphylococcus
ENGKM

SEQ ID NO: 1850162 - protein, 29 aa, Staphylococcus
ENGKSLNDNLTNNQDIENKLSTTKTNTQH

SEQ ID NO: 1850163 - protein, 6 aa, Staphylococcus
ENGKSY

SEQ ID NO: 1850164 - protein, 5 aa, Staphylococcus
ENGPK

SEQ ID NO: 1850165 - protein, 5 aa, Staphylococcus
ENGQM

SEQ ID NO: 1850166 - protein, 6 aa, Staphylococcus
ENGQVR

SEQ ID NO: 1850167 - protein, 5 aa, Staphylococcus
ENHDT

SEQ ID NO: 1850168 - protein, 9 aa, Staphylococcus
ENHGGSGLN

SEQ ID NO: 1850169 - protein, 6 aa, Staphylococcus
ENHNGT

SEQ ID NO: 1850170 - protein, 9 aa, Staphylococcus
ENHNSNPSL

SEQ ID NO: 1850171 - protein, 24 aa, Staphylococcus
ENHSEHKSNNQTKNKTEKQLPKTH

SEQ ID NO: 1850172 - protein, 12 aa, Staphylococcus
ENHSKADAERIA

SEQ ID NO: 1850173 - protein, 12 aa, Staphylococcus
ENIDNANDINEI

SEQ ID NO: 1850174 - protein, 8 aa, Staphylococcus
ENIENGEV

SEQ ID NO: 1850175 - protein, 7 aa, Staphylococcus
ENIEPEA

SEQ ID NO: 1850176 - protein, 4 aa, Staphylococcus
ENIG

SEQ ID NO: 1850177 - protein, 17 aa, Staphylococcus
ENISNDFKKSEEKKQDY

SEQ ID NO: 1850178 - protein, 12 aa, Staphylococcus
ENITKNRKKHLA

SEQ ID NO: 1850179 - protein, 10 aa, Staphylococcus
ENKADNSELV

SEQ ID NO: 1850180 - protein, 14 aa, Staphylococcus
ENKANLNSNFDAEP

SEQ ID NO: 1850181 - protein, 13 aa, Staphylococcus
ENKEKVRRHATEE

SEQ ID NO: 1850182 - protein, 20 aa, Staphylococcus
ENKETRSESNLSSEKEMQQN

SEQ ID NO: 1850183 - protein, 4 aa, Staphylococcus
ENKG

SEQ ID NO: 1850184 - protein, 13 aa, Staphylococcus
ENKGHSRSNKTQY

SEQ ID NO: 1850185 - protein, 8 aa, Staphylococcus
ENKGSFNK

SEQ ID NO: 1850186 - protein, 24 aa, Staphylococcus
ENKGSNKSSVEKEAPKSDGEIGSG

SEQ ID NO: 1850187 - protein, 9 aa, Staphylococcus
ENKGYSQEY

SEQ ID NO: 1850188 - protein, 4 aa, Staphylococcus
ENKI

SEQ ID NO: 1850189 - protein, 5 aa, Staphylococcus
ENKKA

SEQ ID NO: 1850190 - protein, 16 aa, Staphylococcus
ENKLPGVEKDLKKANK

SEQ ID NO: 1850191 - protein, 37 aa, Staphylococcus
ENKNPITQNDANNKSGHSKSLNSSSTNKVNINTASEA

SEQ ID NO: 1850192 - protein, 9 aa, Staphylococcus
ENKNQEIQY

SEQ ID NO: 1850193 - protein, 10 aa, Staphylococcus
ENKNQEIQYE

SEQ ID NO: 1850194 - protein, 10 aa, Staphylococcus
ENKPPHPHPN

SEQ ID NO: 1850195 - protein, 10 aa, Staphylococcus
ENKQNGDTPL

SEQ ID NO: 1850196 - protein, 16 aa, Staphylococcus
ENKSYSSAKKELESKG

SEQ ID NO: 1850197 - protein, 7 aa, Staphylococcus
ENLDAVE

SEQ ID NO: 1850198 - protein, 8 aa, Staphylococcus
ENLDKVEK

SEQ ID NO: 1850199 - protein, 9 aa, Staphylococcus
ENLDKVEKK

SEQ ID NO: 1850200 - protein, 7 aa, Staphylococcus
ENLDQVE

SEQ ID NO: 1850201 - protein, 7 aa, Staphylococcus
ENLEQDM

SEQ ID NO: 1850202 - protein, 19 aa, Staphylococcus
ENLPEKTISTVKENGKSID

SEQ ID NO: 1850203 - protein, 19 aa, Staphylococcus
ENLPEKTITTVKENDNKVD

SEQ ID NO: 1850204 - protein, 19 aa, Staphylococcus
ENLPEKTITTVKENGNNID

SEQ ID NO: 1850205 - protein, 19 aa, Staphylococcus
ENLPEKTVTTVKENGKKID

SEQ ID NO: 1850206 - protein, 6 aa, Staphylococcus
ENLRED

SEQ ID NO: 1850207 - protein, 18 aa, Staphylococcus
ENLRNDLKRSESKDEDYL

SEQ ID NO: 1850208 - protein, 12 aa, Staphylococcus
ENLSDPKNVIKD

SEQ ID NO: 1850209 - protein, 8 aa, Staphylococcus
ENLSPVEE

SEQ ID NO: 1850210 - protein, 12 aa, Staphylococcus
ENMNKKTYTPNI

SEQ ID NO: 1850211 - protein, 19 aa, Staphylococcus
ENMNPNQSSTQHHSEEQLN

SEQ ID NO: 1850212 - protein, 13 aa, Staphylococcus
ENMSNGKKIKADK

SEQ ID NO: 1850213 - protein, 6 aa, Staphylococcus
ENNAGT

SEQ ID NO: 1850214 - protein, 9 aa, Staphylococcus
ENNDPDTKR

SEQ ID NO: 1850215 - protein, 7 aa, Staphylococcus
ENNDTKI

SEQ ID NO: 1850216 - protein, 8 aa, Staphylococcus
ENNEGYQL

SEQ ID NO: 1850217 - protein, 7 aa, Staphylococcus
ENNFPYG

SEQ ID NO: 1850218 - protein, 8 aa, Staphylococcus
ENNGNINA

SEQ ID NO: 1850219 - protein, 8 aa, Staphylococcus
ENNISRDD

SEQ ID NO: 1850220 - protein, 8 aa, Staphylococcus
ENNKDLYD

SEQ ID NO: 1850221 - protein, 6 aa, Staphylococcus
ENNPNL

SEQ ID NO: 1850222 - protein, 12 aa, Staphylococcus
ENNTDMDKAEEV

SEQ ID NO: 1850223 - protein, 36 aa, Staphylococcus
ENNVTHTQTNESEVQDGDHHLKSSSKYAEDRRSSVV

SEQ ID NO: 1850224 - protein, 10 aa, Staphylococcus
ENNYNQQVSQ

SEQ ID NO: 1850225 - protein, 9 aa, Staphylococcus
ENPDSISKT

SEQ ID NO: 1850226 - protein, 6 aa, Staphylococcus
ENPGQP

SEQ ID NO: 1850227 - protein, 32 aa, Staphylococcus
ENPNKDSTKTTQNENINKNEESVENPMPKEGI

SEQ ID NO: 1850228 - protein, 31 aa, Staphylococcus
ENPNKKAPTKIEQTQKNNNQTENPKPKAGIG

SEQ ID NO: 1850229 - protein, 33 aa, Staphylococcus
ENPNKNHKTERTEQFKNTNKDIENPKPKKGVGT

SEQ ID NO: 1850230 - protein, 31 aa, Staphylococcus
ENPNKSNKSNHSEQFQKSNKNVENPKPKHGI

SEQ ID NO: 1850231 - protein, 33 aa, Staphylococcus
ENPNKTVSTNHSEQAPKTHNTSENPSPKEGVGT

SEQ ID NO: 1850232 - protein, 34 aa, Staphylococcus
ENPNNNNKISHSNQESHSVKKQTENPAPKNGIGT

SEQ ID NO: 1850233 - protein, 4 aa, Staphylococcus
ENPT

SEQ ID NO: 1850234 - protein, 14 aa, Staphylococcus
ENPTIYQNKDGHLK

SEQ ID NO: 1850235 - protein, 7 aa, Staphylococcus
ENQDSPE

SEQ ID NO: 1850236 - protein, 8 aa, Staphylococcus
ENQEETEK

SEQ ID NO: 1850237 - protein, 5 aa, Staphylococcus
ENQLT

SEQ ID NO: 1850238 - protein, 9 aa, Staphylococcus
ENQLTQEQF

SEQ ID NO: 1850239 - protein, 26 aa, Staphylococcus
ENQNYNYDTSSSLSAKTSAQLTNEDE

SEQ ID NO: 1850240 - protein, 10 aa, Staphylococcus
ENQPEAKQKL

SEQ ID NO: 1850241 - protein, 10 aa, Staphylococcus
ENQPRAKEAL

SEQ ID NO: 1850242 - protein, 11 aa, Staphylococcus
ENQPRAKEGLA

SEQ ID NO: 1850243 - protein, 15 aa, Staphylococcus
ENQQSSKDASGKIKE

SEQ ID NO: 1850244 - protein, 5 aa, Staphylococcus
ENRGL

SEQ ID NO: 1850245 - protein, 7 aa, Staphylococcus
ENRGNTI

SEQ ID NO: 1850246 - protein, 15 aa, Staphylococcus
ENRLPDIEKDLNKAN

SEQ ID NO: 1850247 - protein, 5 aa, Staphylococcus
ENRPY

SEQ ID NO: 1850248 - protein, 5 aa, Staphylococcus
ENRYQ

SEQ ID NO: 1850249 - protein, 13 aa, Staphylococcus
ENSGDDEELKTDG

SEQ ID NO: 1850250 - protein, 28 aa, Staphylococcus
ENSKDVYDQYSNHTDNKHRTDFSHDDDR

SEQ ID NO: 1850251 - protein, 9 aa, Staphylococcus
ENSKNYRVK

SEQ ID NO: 1850252 - protein, 9 aa, Staphylococcus
ENSLNDPDV

SEQ ID NO: 1850253 - protein, 16 aa, Staphylococcus
ENSLNEIETNVKDNLG

SEQ ID NO: 1850254 - protein, 7 aa, Staphylococcus
ENSLNNN

SEQ ID NO: 1850255 - protein, 6 aa, Staphylococcus
ENSQDV

SEQ ID NO: 1850256 - protein, 7 aa, Staphylococcus
ENSQTAS

SEQ ID NO: 1850257 - protein, 20 aa, Staphylococcus
ENSRKDYVRTARSNGISTNK

SEQ ID NO: 1850258 - protein, 33 aa, Staphylococcus
ENSSNGGAPLKRNSNAKDDLNYSQSNHQTPNYD

SEQ ID NO: 1850259 - protein, 9 aa, Staphylococcus
ENSTVSDTK

SEQ ID NO: 1850260 - protein, 12 aa, Staphylococcus
ENSYASKDLGGY

SEQ ID NO: 1850261 - protein, 7 aa, Staphylococcus
ENTLNNN

SEQ ID NO: 1850262 - protein, 6 aa, Staphylococcus
ENTLNR

SEQ ID NO: 1850263 - protein, 23 aa, Staphylococcus
ENTLQAASSVPTRALTGNELQPA

SEQ ID NO: 1850264 - protein, 15 aa, Staphylococcus
ENTPDVTTEERDDAI

SEQ ID NO: 1850265 - protein, 8 aa, Staphylococcus
ENTPLTNQ

SEQ ID NO: 1850266 - protein, 10 aa, Staphylococcus
ENTSKNATTL

SEQ ID NO: 1850267 - protein, 6 aa, Staphylococcus
ENTTKT

SEQ ID NO: 1850268 - protein, 55 aa, Staphylococcus
ENVKRPVNEKKKSKRKEKKEINHKKEALKNDPSSFNDTKNHVKEDLNHQKNLNND

SEQ ID NO: 1850269 - protein, 8 aa, Staphylococcus
ENVNSNDY

SEQ ID NO: 1850270 - protein, 7 aa, Staphylococcus
ENVPKRG

SEQ ID NO: 1850271 - protein, 6 aa, Staphylococcus
ENVTNR

SEQ ID NO: 1850272 - protein, 10 aa, Staphylococcus
ENYDQGTRTL

SEQ ID NO: 1850273 - protein, 7 aa, Staphylococcus
ENYSPVK

SEQ ID NO: 1850274 - protein, 19 aa, Staphylococcus
ENYTQASIQNQNKDPYEDK

SEQ ID NO: 1850275 - protein, 6 aa, Staphylococcus
EPAARR

SEQ ID NO: 1850276 - protein, 4 aa, Staphylococcus
EPAE

SEQ ID NO: 1850277 - protein, 9 aa, Staphylococcus
EPASGLDIE

SEQ ID NO: 1850278 - protein, 5 aa, Staphylococcus
EPATG

SEQ ID NO: 1850279 - protein, 7 aa, Staphylococcus
EPATGKV

SEQ ID NO: 1850280 - protein, 6 aa, Staphylococcus
EPATKL

SEQ ID NO: 1850281 - protein, 59 aa, Staphylococcus
EPATKPKKRQRRDVNNTPTVAGGTGPQNGNGTPQSTNGEYSRDDATIDPNINNTGNNTL

SEQ ID NO: 1850282 - protein, 14 aa, Staphylococcus
EPATQSVSQSTGIT

SEQ ID NO: 1850283 - protein, 5 aa, Staphylococcus
EPATR

SEQ ID NO: 1850284 - protein, 14 aa, Staphylococcus
EPATTSMSQTTQVS

SEQ ID NO: 1850285 - protein, 10 aa, Staphylococcus
EPDDRKSDEL

SEQ ID NO: 1850286 - protein, 11 aa, Staphylococcus
EPDNKNTKELR

SEQ ID NO: 1850287 - protein, 9 aa, Staphylococcus
EPDNQNTKE

SEQ ID NO: 1850288 - protein, 9 aa, Staphylococcus
EPDRDEADA

SEQ ID NO: 1850289 - protein, 11 aa, Staphylococcus
EPDSKNTKELR

SEQ ID NO: 1850290 - protein, 13 aa, Staphylococcus
EPEAIKKAEAKQA

SEQ ID NO: 1850291 - protein, 7 aa, Staphylococcus
EPEHKGA

SEQ ID NO: 1850292 - protein, 7 aa, Staphylococcus
EPELPRP

SEQ ID NO: 1850293 - protein, 12 aa, Staphylococcus
EPEVPKELSKLY

SEQ ID NO: 1850294 - protein, 8 aa, Staphylococcus
EPEYHKKR

SEQ ID NO: 1850295 - protein, 8 aa, Staphylococcus
EPFNENDY

SEQ ID NO: 1850296 - protein, 8 aa, Staphylococcus
EPKGYKMN

SEQ ID NO: 1850297 - protein, 16 aa, Staphylococcus
EPKIDEAIENEIHQSN

SEQ ID NO: 1850298 - protein, 11 aa, Staphylococcus
EPKIQVEDNNR

SEQ ID NO: 1850299 - protein, 11 aa, Staphylococcus
EPKIQVEDPNR

SEQ ID NO: 1850300 - protein, 11 aa, Staphylococcus
EPKIQVENNNR

SEQ ID NO: 1850301 - protein, 8 aa, Staphylococcus
EPLDANNE

SEQ ID NO: 1850302 - protein, 9 aa, Staphylococcus
EPLQPGQGG

SEQ ID NO: 1850303 - protein, 11 aa, Staphylococcus
EPLSEQGNDKV

SEQ ID NO: 1850304 - protein, 9 aa, Staphylococcus
EPLSKTSTH

SEQ ID NO: 1850305 - protein, 10 aa, Staphylococcus
EPLTNNPGNY

SEQ ID NO: 1850306 - protein, 10 aa, Staphylococcus
EPLTNNSGNY

SEQ ID NO: 1850307 - protein, 16 aa, Staphylococcus
EPLTQVEQSSDVPNDA

SEQ ID NO: 1850308 - protein, 5 aa, Staphylococcus
EPMGD

SEQ ID NO: 1850309 - protein, 4 aa, Staphylococcus
EPNM

SEQ ID NO: 1850310 - protein, 9 aa, Staphylococcus
EPPFSGETA

SEQ ID NO: 1850311 - protein, 8 aa, Staphylococcus
EPPFTGET

SEQ ID NO: 1850312 - protein, 13 aa, Staphylococcus
EPPKKIGKEINAR

SEQ ID NO: 1850313 - protein, 14 aa, Staphylococcus
EPQEFQSKEPKKDN

SEQ ID NO: 1850314 - protein, 14 aa, Staphylococcus
EPQLEKSSLNSKQQ

SEQ ID NO: 1850315 - protein, 4 aa, Staphylococcus
EPQN

SEQ ID NO: 1850316 - protein, 8 aa, Staphylococcus
EPQPFEQD

SEQ ID NO: 1850317 - protein, 5 aa, Staphylococcus
EPRIQ

SEQ ID NO: 1850318 - protein, 11 aa, Staphylococcus
EPRIQVEDPDR

SEQ ID NO: 1850319 - protein, 8 aa, Staphylococcus
EPSFLSND

SEQ ID NO: 1850320 - protein, 5 aa, Staphylococcus
EPSSI

SEQ ID NO: 1850321 - protein, 5 aa, Staphylococcus
EPSTF

SEQ ID NO: 1850322 - protein, 16 aa, Staphylococcus
EPTAKASIKKGYKRLP

SEQ ID NO: 1850323 - protein, 15 aa, Staphylococcus
EPTAKASIKKGYRRL

SEQ ID NO: 1850324 - protein, 15 aa, Staphylococcus
EPTAKASLKKGYKRL

SEQ ID NO: 1850325 - protein, 12 aa, Staphylococcus
EPTAKASLRKGY

SEQ ID NO: 1850326 - protein, 16 aa, Staphylococcus
EPTEALSESKDEIVED

SEQ ID NO: 1850327 - protein, 9 aa, Staphylococcus
EPTEEESDE

SEQ ID NO: 1850328 - protein, 12 aa, Staphylococcus
EPTEQTEITDEE

SEQ ID NO: 1850329 - protein, 8 aa, Staphylococcus
EPTFSKSE

SEQ ID NO: 1850330 - protein, 10 aa, Staphylococcus
EPTNSIKPAA

SEQ ID NO: 1850331 - protein, 11 aa, Staphylococcus
EPTSGHGKKAL

SEQ ID NO: 1850332 - protein, 7 aa, Staphylococcus
EPTTGLD

SEQ ID NO: 1850333 - protein, 4 aa, Staphylococcus
EPVE

SEQ ID NO: 1850334 - protein, 8 aa, Staphylococcus
EPVTQGQP

SEQ ID NO: 1850335 - protein, 19 aa, Staphylococcus
EPVTSPNASWNEMNRKATK

SEQ ID NO: 1850336 - protein, 13 aa, Staphylococcus
EPYNQKENGKTIK

SEQ ID NO: 1850337 - protein, 7 aa, Staphylococcus
EQAPEAE

SEQ ID NO: 1850338 - protein, 10 aa, Staphylococcus
EQAPLTNDLT

SEQ ID NO: 1850339 - protein, 7 aa, Staphylococcus
EQAPNAE

SEQ ID NO: 1850340 - protein, 17 aa, Staphylococcus
EQAQGGSGGSEPGGNSE

SEQ ID NO: 1850341 - protein, 8 aa, Staphylococcus
EQATNKED

SEQ ID NO: 1850342 - protein, 10 aa, Staphylococcus
EQDGKKQTTL

SEQ ID NO: 1850343 - protein, 55 aa, Staphylococcus
EQDKEYQNQQQRQQHARYQQQRYTNQQQAQYQNNGDRYRQQQARYDENGNRYYND

SEQ ID NO: 1850344 - protein, 6 aa, Staphylococcus
EQDLSR

SEQ ID NO: 1850345 - protein, 8 aa, Staphylococcus
EQDNTPMY

SEQ ID NO: 1850346 - protein, 9 aa, Staphylococcus
EQDQAPPIF

SEQ ID NO: 1850347 - protein, 17 aa, Staphylococcus
EQEGAKVKMTRDKDEYV

SEQ ID NO: 1850348 - protein, 6 aa, Staphylococcus
EQEGYV

SEQ ID NO: 1850349 - protein, 11 aa, Staphylococcus
EQEQLESEQIK

SEQ ID NO: 1850350 - protein, 12 aa, Staphylococcus
EQESKGKSEKDI

SEQ ID NO: 1850351 - protein, 16 aa, Staphylococcus
EQETAKQMKAYGEDRF

SEQ ID NO: 1850352 - protein, 7 aa, Staphylococcus
EQEYSKD

SEQ ID NO: 1850353 - protein, 12 aa, Staphylococcus
EQFESISKSTTD

SEQ ID NO: 1850354 - protein, 6 aa, Staphylococcus
EQFNER

SEQ ID NO: 1850355 - protein, 8 aa, Staphylococcus
EQFPTQDE

SEQ ID NO: 1850356 - protein, 6 aa, Staphylococcus
EQFSQR

SEQ ID NO: 1850357 - protein, 4 aa, Staphylococcus
EQGD

SEQ ID NO: 1850358 - protein, 10 aa, Staphylococcus
EQGDSAGYTI

SEQ ID NO: 1850359 - protein, 8 aa, Staphylococcus
EQGDSAQG

SEQ ID NO: 1850360 - protein, 9 aa, Staphylococcus
EQGDSAQGM

SEQ ID NO: 1850361 - protein, 14 aa, Staphylococcus
EQGENSISNLTEAE

SEQ ID NO: 1850362 - protein, 8 aa, Staphylococcus
EQGESAQG

SEQ ID NO: 1850363 - protein, 19 aa, Staphylococcus
EQGIERYESSKQQNNQLKK

SEQ ID NO: 1850364 - protein, 7 aa, Staphylococcus
EQGNSHP

SEQ ID NO: 1850365 - protein, 14 aa, Staphylococcus
EQGQNVSNEDVNNA

SEQ ID NO: 1850366 - protein, 10 aa, Staphylococcus
EQGSDAGYTI

SEQ ID NO: 1850367 - protein, 11 aa, Staphylococcus
EQGYKVDTTSL

SEQ ID NO: 1850368 - protein, 5 aa, Staphylococcus
EQHGQ

SEQ ID NO: 1850369 - protein, 34 aa, Staphylococcus
EQHKTNKAYHKVRNEKGRYQLPNTGINNDTSSPL

SEQ ID NO: 1850370 - protein, 6 aa, Staphylococcus
EQHNNQ

SEQ ID NO: 1850371 - protein, 8 aa, Staphylococcus
EQIAGEGN

SEQ ID NO: 1850372 - protein, 5 aa, Staphylococcus
EQIAR

SEQ ID NO: 1850373 - protein, 19 aa, Staphylococcus
EQIEDKSHQLDHATDQLQQ

SEQ ID NO: 1850374 - protein, 13 aa, Staphylococcus
EQIPNDAPQETPV

SEQ ID NO: 1850375 - protein, 13 aa, Staphylococcus
EQITQKNPNADMD

SEQ ID NO: 1850376 - protein, 14 aa, Staphylococcus
EQIVGQNGQSYGKG

SEQ ID NO: 1850377 - protein, 14 aa, Staphylococcus
EQIVGQNGQSYSQG

SEQ ID NO: 1850378 - protein, 9 aa, Staphylococcus
EQKDHTEKI

SEQ ID NO: 1850379 - protein, 9 aa, Staphylococcus
EQKDHTKKV

SEQ ID NO: 1850380 - protein, 8 aa, Staphylococcus
EQKEGAIN

SEQ ID NO: 1850381 - protein, 4 aa, Staphylococcus
EQKH

SEQ ID NO: 1850382 - protein, 8 aa, Staphylococcus
EQKHWSQD

SEQ ID NO: 1850383 - protein, 15 aa, Staphylococcus
EQKLEQAKQEANDQL

SEQ ID NO: 1850384 - protein, 18 aa, Staphylococcus
EQKQAPSIFKSTNKQGVP

SEQ ID NO: 1850385 - protein, 4 aa, Staphylococcus
EQKS

SEQ ID NO: 1850386 - protein, 8 aa, Staphylococcus
EQKTAKKF

SEQ ID NO: 1850387 - protein, 4 aa, Staphylococcus
EQLE

SEQ ID NO: 1850388 - protein, 4 aa, Staphylococcus
EQLG

SEQ ID NO: 1850389 - protein, 5 aa, Staphylococcus
EQLNK

SEQ ID NO: 1850390 - protein, 9 aa, Staphylococcus
EQLPYDESL

SEQ ID NO: 1850391 - protein, 16 aa, Staphylococcus
EQLQEHEQLQEQQPPA

SEQ ID NO: 1850392 - protein, 10 aa, Staphylococcus
EQLSKDKSFK

SEQ ID NO: 1850393 - protein, 6 aa, Staphylococcus
EQLSTT

SEQ ID NO: 1850394 - protein, 8 aa, Staphylococcus
EQNGGFKN

SEQ ID NO: 1850395 - protein, 4 aa, Staphylococcus
EQNN

SEQ ID NO: 1850396 - protein, 8 aa, Staphylococcus
EQNSDTIH

SEQ ID NO: 1850397 - protein, 6 aa, Staphylococcus
EQNTSI

SEQ ID NO: 1850398 - protein, 7 aa, Staphylococcus
EQNVNQN

SEQ ID NO: 1850399 - protein, 13 aa, Staphylococcus
EQPFNPSQHNELN

SEQ ID NO: 1850400 - protein, 5 aa, Staphylococcus
EQPHF

SEQ ID NO: 1850401 - protein, 7 aa, Staphylococcus
EQPYPDN

SEQ ID NO: 1850402 - protein, 9 aa, Staphylococcus
EQQERDRKQ

SEQ ID NO: 1850403 - protein, 9 aa, Staphylococcus
EQQGKDVSD

SEQ ID NO: 1850404 - protein, 10 aa, Staphylococcus
EQQGKTEQQI

SEQ ID NO: 1850405 - protein, 6 aa, Staphylococcus
EQQKDG

SEQ ID NO: 1850406 - protein, 4 aa, Staphylococcus
EQQP

SEQ ID NO: 1850407 - protein, 6 aa, Staphylococcus
EQQQST

SEQ ID NO: 1850408 - protein, 7 aa, Staphylococcus
EQQRELE

SEQ ID NO: 1850409 - protein, 16 aa, Staphylococcus
EQQSDTRKTVKNASIG

SEQ ID NO: 1850410 - protein, 5 aa, Staphylococcus
EQQTE

SEQ ID NO: 1850411 - protein, 6 aa, Staphylococcus
EQQTEI

SEQ ID NO: 1850412 - protein, 6 aa, Staphylococcus
EQQYNK

SEQ ID NO: 1850413 - protein, 7 aa, Staphylococcus
EQRETSG

SEQ ID NO: 1850414 - protein, 5 aa, Staphylococcus
EQRNQ

SEQ ID NO: 1850415 - protein, 4 aa, Staphylococcus
EQRT

SEQ ID NO: 1850416 - protein, 5 aa, Staphylococcus
EQRTP

SEQ ID NO: 1850417 - protein, 6 aa, Staphylococcus
EQRTQL

SEQ ID NO: 1850418 - protein, 7 aa, Staphylococcus
EQRTQLK

SEQ ID NO: 1850419 - protein, 8 aa, Staphylococcus
EQRTQLKR

SEQ ID NO: 1850420 - protein, 38 aa, Staphylococcus
EQSELERQEADDKVNEIKSTIDDAQNKNTEVTDAELSA

SEQ ID NO: 1850421 - protein, 22 aa, Staphylococcus
EQSPVDVAKQEHQDIDKQYNPK

SEQ ID NO: 1850422 - protein, 9 aa, Staphylococcus
EQSTNTYTN

SEQ ID NO: 1850423 - protein, 13 aa, Staphylococcus
EQTFNTKETQFQE

SEQ ID NO: 1850424 - protein, 6 aa, Staphylococcus
EQTMKV

SEQ ID NO: 1850425 - protein, 6 aa, Staphylococcus
EQTPSL

SEQ ID NO: 1850426 - protein, 9 aa, Staphylococcus
EQTQEWKEL

SEQ ID NO: 1850427 - protein, 6 aa, Staphylococcus
EQTRNS

SEQ ID NO: 1850428 - protein, 7 aa, Staphylococcus
EQTSHKP

SEQ ID NO: 1850429 - protein, 13 aa, Staphylococcus
EQTYNANTPKGYI

SEQ ID NO: 1850430 - protein, 4 aa, Staphylococcus
EQVE

SEQ ID NO: 1850431 - protein, 4 aa, Staphylococcus
EQVG

SEQ ID NO: 1850432 - protein, 8 aa, Staphylococcus
EQVPSSVA

SEQ ID NO: 1850433 - protein, 20 aa, Staphylococcus
EQVSSNDTKDNGAPPTYSAV

SEQ ID NO: 1850434 - protein, 4 aa, Staphylococcus
EQVY

SEQ ID NO: 1850435 - protein, 8 aa, Staphylococcus
EQYNNKKE

SEQ ID NO: 1850436 - protein, 6 aa, Staphylococcus
EQYRRK

SEQ ID NO: 1850437 - protein, 15 aa, Staphylococcus
ERAEQLSDSKGPGTF

SEQ ID NO: 1850438 - protein, 8 aa, Staphylococcus
ERAKTHKQ

SEQ ID NO: 1850439 - protein, 7 aa, Staphylococcus
ERATEQQ

SEQ ID NO: 1850440 - protein, 6 aa, Staphylococcus
ERATKE

SEQ ID NO: 1850441 - protein, 8 aa, Staphylococcus
ERDEYSQE

SEQ ID NO: 1850442 - protein, 7 aa, Staphylococcus
ERDKDND

SEQ ID NO: 1850443 - protein, 9 aa, Staphylococcus
ERDKSSRRL

SEQ ID NO: 1850444 - protein, 28 aa, Staphylococcus
ERDNKTKNIEIKPKEFKQKTTKTKTQST

SEQ ID NO: 1850445 - protein, 16 aa, Staphylococcus
ERDNQTKTVDITPKKQ

SEQ ID NO: 1850446 - protein, 5 aa, Staphylococcus
ERDRL

SEQ ID NO: 1850447 - protein, 8 aa, Staphylococcus
EREAGHSK

SEQ ID NO: 1850448 - protein, 38 aa, Staphylococcus
EREARIQQEQQEKLKQAKKEAQQSKVNEERVKDNLRKA

SEQ ID NO: 1850449 - protein, 9 aa, Staphylococcus
EREGKMDEK

SEQ ID NO: 1850450 - protein, 6 aa, Staphylococcus
EREGYV

SEQ ID NO: 1850451 - protein, 9 aa, Staphylococcus
EREKMSSTY

SEQ ID NO: 1850452 - protein, 8 aa, Staphylococcus
EREKRRSQ

SEQ ID NO: 1850453 - protein, 8 aa, Staphylococcus
ERGGQAHD

SEQ ID NO: 1850454 - protein, 14 aa, Staphylococcus
ERGILPTSKGNSYK

SEQ ID NO: 1850455 - protein, 7 aa, Staphylococcus
ERGINGA

SEQ ID NO: 1850456 - protein, 13 aa, Staphylococcus
ERGKEDSTINEIE

SEQ ID NO: 1850457 - protein, 20 aa, Staphylococcus
ERGSKLEEAEYYTPKTAQNL

SEQ ID NO: 1850458 - protein, 5 aa, Staphylococcus
ERGTN

SEQ ID NO: 1850459 - protein, 8 aa, Staphylococcus
ERHQPNDD

SEQ ID NO: 1850460 - protein, 12 aa, Staphylococcus
ERHSQYRNEPHY

SEQ ID NO: 1850461 - protein, 6 aa, Staphylococcus
ERIEGD

SEQ ID NO: 1850462 - protein, 7 aa, Staphylococcus
ERISRTS

SEQ ID NO: 1850463 - protein, 11 aa, Staphylococcus
ERITKKDLSDY

SEQ ID NO: 1850464 - protein, 11 aa, Staphylococcus
ERITKKDLTDY

SEQ ID NO: 1850465 - protein, 29 aa, Staphylococcus
ERKARKQRAEKAEKLAKNNEERVKENLRK

SEQ ID NO: 1850466 - protein, 16 aa, Staphylococcus
ERKDISDAEDGSATQQ

SEQ ID NO: 1850467 - protein, 9 aa, Staphylococcus
ERKVNSTTL

SEQ ID NO: 1850468 - protein, 7 aa, Staphylococcus
ERKVPDG

SEQ ID NO: 1850469 - protein, 12 aa, Staphylococcus
ERLDQNPAGLDQ

SEQ ID NO: 1850470 - protein, 14 aa, Staphylococcus
ERLDQNPAGPGEIT

SEQ ID NO: 1850471 - protein, 7 aa, Staphylococcus
ERLNQVN

SEQ ID NO: 1850472 - protein, 5 aa, Staphylococcus
ERLSN

SEQ ID NO: 1850473 - protein, 4 aa, Staphylococcus
ERLT

SEQ ID NO: 1850474 - protein, 4 aa, Staphylococcus
ERMK

SEQ ID NO: 1850475 - protein, 6 aa, Staphylococcus
ERNAGK

SEQ ID NO: 1850476 - protein, 6 aa, Staphylococcus
ERNAKD

SEQ ID NO: 1850477 - protein, 10 aa, Staphylococcus
ERNARPLPTE

SEQ ID NO: 1850478 - protein, 4 aa, Staphylococcus
ERNG

SEQ ID NO: 1850479 - protein, 5 aa, Staphylococcus
ERNND

SEQ ID NO: 1850480 - protein, 15 aa, Staphylococcus
ERNQATDAHPTGSSL

SEQ ID NO: 1850481 - protein, 6 aa, Staphylococcus
ERPKGW

SEQ ID NO: 1850482 - protein, 7 aa, Staphylococcus
ERPKGWQ

SEQ ID NO: 1850483 - protein, 14 aa, Staphylococcus
ERPLTKKQTYAQNR

SEQ ID NO: 1850484 - protein, 7 aa, Staphylococcus
ERPQGDI

SEQ ID NO: 1850485 - protein, 10 aa, Staphylococcus
ERPRKEIKHD

SEQ ID NO: 1850486 - protein, 4 aa, Staphylococcus
ERQA

SEQ ID NO: 1850487 - protein, 5 aa, Staphylococcus
ERQAK

SEQ ID NO: 1850488 - protein, 4 aa, Staphylococcus
ERQF

SEQ ID NO: 1850489 - protein, 23 aa, Staphylococcus
ERQMTSQQGYAITQSTSKLGHGI

SEQ ID NO: 1850490 - protein, 5 aa, Staphylococcus
ERQRA

SEQ ID NO: 1850491 - protein, 14 aa, Staphylococcus
ERRNSENLNQNDVK

SEQ ID NO: 1850492 - protein, 6 aa, Staphylococcus
ERRQPV

SEQ ID NO: 1850493 - protein, 33 aa, Staphylococcus
ERRRNKKRKEQQDKTVSKFEQGPPPKDGEFASR

SEQ ID NO: 1850494 - protein, 5 aa, Staphylococcus
ERSEE

SEQ ID NO: 1850495 - protein, 11 aa, Staphylococcus
ERSGGSGNASS

SEQ ID NO: 1850496 - protein, 12 aa, Staphylococcus
ERSIEGETVGIN

SEQ ID NO: 1850497 - protein, 13 aa, Staphylococcus
ERSIEGQTVGIND

SEQ ID NO: 1850498 - protein, 18 aa, Staphylococcus
ERSPSENESIDISGPETM

SEQ ID NO: 1850499 - protein, 8 aa, Staphylococcus
ERSTREPV

SEQ ID NO: 1850500 - protein, 13 aa, Staphylococcus
ERSYKDDSVNMQK

SEQ ID NO: 1850501 - protein, 5 aa, Staphylococcus
ERTFT

SEQ ID NO: 1850502 - protein, 7 aa, Staphylococcus
ERTKGTL

SEQ ID NO: 1850503 - protein, 7 aa, Staphylococcus
ERTNGTL

SEQ ID NO: 1850504 - protein, 7 aa, Staphylococcus
ERTQEFT

SEQ ID NO: 1850505 - protein, 6 aa, Staphylococcus
ERTQVY

SEQ ID NO: 1850506 - protein, 7 aa, Staphylococcus
ERTSGTL

SEQ ID NO: 1850507 - protein, 7 aa, Staphylococcus
ERTTGTI

SEQ ID NO: 1850508 - protein, 7 aa, Staphylococcus
ERTTGTL

SEQ ID NO: 1850509 - protein, 16 aa, Staphylococcus
ERVEPGITKQIESKVI

SEQ ID NO: 1850510 - protein, 6 aa, Staphylococcus
ESANQF

SEQ ID NO: 1850511 - protein, 8 aa, Staphylococcus
ESASNHPL

SEQ ID NO: 1850512 - protein, 4 aa, Staphylococcus
ESAV

SEQ ID NO: 1850513 - protein, 23 aa, Staphylococcus
ESDAPKNTSVQKTNSKSDNELGS

SEQ ID NO: 1850514 - protein, 9 aa, Staphylococcus
ESDAQSVRQ

SEQ ID NO: 1850515 - protein, 18 aa, Staphylococcus
ESDIKQSELKSKALKKEI

SEQ ID NO: 1850516 - protein, 10 aa, Staphylococcus
ESDNFSKGNH

SEQ ID NO: 1850517 - protein, 7 aa, Staphylococcus
ESDRPEL

SEQ ID NO: 1850518 - protein, 8 aa, Staphylococcus
ESDRTGLD

SEQ ID NO: 1850519 - protein, 6 aa, Staphylococcus
ESDTAN

SEQ ID NO: 1850520 - protein, 22 aa, Staphylococcus
ESELAHANRSNHSSDNDSEIPS

SEQ ID NO: 1850521 - protein, 6 aa, Staphylococcus
ESELAK

SEQ ID NO: 1850522 - protein, 11 aa, Staphylococcus
ESENKINMNDS

SEQ ID NO: 1850523 - protein, 8 aa, Staphylococcus
ESETVRDT

SEQ ID NO: 1850524 - protein, 4 aa, Staphylococcus
ESFA

SEQ ID NO: 1850525 - protein, 14 aa, Staphylococcus
ESFEEEQIRKNQRQ

SEQ ID NO: 1850526 - protein, 5 aa, Staphylococcus
ESFGR

SEQ ID NO: 1850527 - protein, 10 aa, Staphylococcus
ESFKNDKSAL

SEQ ID NO: 1850528 - protein, 13 aa, Staphylococcus
ESGESETKTESRK

SEQ ID NO: 1850529 - protein, 8 aa, Staphylococcus
ESGNLVRG

SEQ ID NO: 1850530 - protein, 5 aa, Staphylococcus
ESGPV

SEQ ID NO: 1850531 - protein, 8 aa, Staphylococcus
ESGQRITT

SEQ ID NO: 1850532 - protein, 12 aa, Staphylococcus
ESHEGGEISENE

SEQ ID NO: 1850533 - protein, 5 aa, Staphylococcus
ESHHH

SEQ ID NO: 1850534 - protein, 14 aa, Staphylococcus
ESHSTKYSESVSMS

SEQ ID NO: 1850535 - protein, 11 aa, Staphylococcus
ESHSTYENLAN

SEQ ID NO: 1850536 - protein, 4 aa, Staphylococcus
ESIK

SEQ ID NO: 1850537 - protein, 9 aa, Staphylococcus
ESIKDNATI

SEQ ID NO: 1850538 - protein, 9 aa, Staphylococcus
ESINETKEY

SEQ ID NO: 1850539 - protein, 14 aa, Staphylococcus
ESIPVDKEKDDEVI

SEQ ID NO: 1850540 - protein, 9 aa, Staphylococcus
ESIRGGVEQ

SEQ ID NO: 1850541 - protein, 8 aa, Staphylococcus
ESISGEVY

SEQ ID NO: 1850542 - protein, 6 aa, Staphylococcus
ESISNS

SEQ ID NO: 1850543 - protein, 14 aa, Staphylococcus
ESITPTQAANQYGY

SEQ ID NO: 1850544 - protein, 12 aa, Staphylococcus
ESIVPHGDTQLR

SEQ ID NO: 1850545 - protein, 12 aa, Staphylococcus
ESIVPHGDTTLR

SEQ ID NO: 1850546 - protein, 8 aa, Staphylococcus
ESKDGNLQ

SEQ ID NO: 1850547 - protein, 6 aa, Staphylococcus
ESKFSR

SEQ ID NO: 1850548 - protein, 7 aa, Staphylococcus
ESKGDAL

SEQ ID NO: 1850549 - protein, 7 aa, Staphylococcus
ESKGDEL

SEQ ID NO: 1850550 - protein, 5 aa, Staphylococcus
ESKGP

SEQ ID NO: 1850551 - protein, 14 aa, Staphylococcus
ESKMSTKDATWKNQ

SEQ ID NO: 1850552 - protein, 6 aa, Staphylococcus
ESKNAK

SEQ ID NO: 1850553 - protein, 13 aa, Staphylococcus
ESKNKKDSEKIAN

SEQ ID NO: 1850554 - protein, 17 aa, Staphylococcus
ESKNLDLKKENGGYVYE

SEQ ID NO: 1850555 - protein, 18 aa, Staphylococcus
ESKSNGLSGAISGGAEQL

SEQ ID NO: 1850556 - protein, 28 aa, Staphylococcus
ESKSNGLSGAISGGAEQLFGGKQKQRGV

SEQ ID NO: 1850557 - protein, 11 aa, Staphylococcus
ESKTSKYPQPY

SEQ ID NO: 1850558 - protein, 9 aa, Staphylococcus
ESKVDEEAL

SEQ ID NO: 1850559 - protein, 10 aa, Staphylococcus
ESKVDEETLN

SEQ ID NO: 1850560 - protein, 25 aa, Staphylococcus
ESKVKEDNHLSDDNKQKLKREIDRA

SEQ ID NO: 1850561 - protein, 18 aa, Staphylococcus
ESKVNKGTTFIIKLPKPK

SEQ ID NO: 1850562 - protein, 10 aa, Staphylococcus
ESKVQARKQH

SEQ ID NO: 1850563 - protein, 12 aa, Staphylococcus
ESLENEHRVNSN

SEQ ID NO: 1850564 - protein, 5 aa, Staphylococcus
ESLQE

SEQ ID NO: 1850565 - protein, 16 aa, Staphylococcus
ESLSRSDSGDLKTDGY

SEQ ID NO: 1850566 - protein, 15 aa, Staphylococcus
ESLSRYQSTNARQNI

SEQ ID NO: 1850567 - protein, 5 aa, Staphylococcus
ESLYS

SEQ ID NO: 1850568 - protein, 13 aa, Staphylococcus
ESMGPTAVSEVTE

SEQ ID NO: 1850569 - protein, 8 aa, Staphylococcus
ESMQRDNA

SEQ ID NO: 1850570 - protein, 6 aa, Staphylococcus
ESNDVV

SEQ ID NO: 1850571 - protein, 6 aa, Staphylococcus
ESNISE

SEQ ID NO: 1850572 - protein, 6 aa, Staphylococcus
ESNLSN

SEQ ID NO: 1850573 - protein, 14 aa, Staphylococcus
ESNNPGQQNEDNRI

SEQ ID NO: 1850574 - protein, 185 aa, Staphylococcus
ESNNPSKNQATQSKDKQSKEDKSSKDKKKKDKKMDDKDDNNVTQEEQNRSEETSTNEELNTQEQQSSQQEQPTTEESNNEAPSTQQDTTQDNTVNNQNNTSSNNNQNANQANDTNQNYNQSNRNSNNNGDNSGSNGNVSTEDSSSTENQSNENQTQTYSENSSAEQSENGEAITETNTDESNNSA

SEQ ID NO: 1850575 - protein, 180 aa, Staphylococcus
ESNNPSKSDITPIKKEKPKDNKTNKENNNKKENNSKKNNKDTSHESIQDTPSTQENTPATEENSIQSSESPTTQQSIQQENPTTEQNNATTNNQNSTQRQQEPSTQQQDTSQYQTNSANNDSKQTHSTHNQNSQNSTQYNHTNESNTTKDNTNNVNQNSTLNTTQNTQSNNTNNNINQIN

SEQ ID NO: 1850576 - protein, 8 aa, Staphylococcus
ESNPGPGF

SEQ ID NO: 1850577 - protein, 8 aa, Staphylococcus
ESNPGPGI

SEQ ID NO: 1850578 - protein, 8 aa, Staphylococcus
ESNPGPGL

SEQ ID NO: 1850579 - protein, 4 aa, Staphylococcus
ESNQ

SEQ ID NO: 1850580 - protein, 7 aa, Staphylococcus
ESNSFDG

SEQ ID NO: 1850581 - protein, 15 aa, Staphylococcus
ESNTESKKQTTQSKK

SEQ ID NO: 1850582 - protein, 8 aa, Staphylococcus
ESNVKGGW

SEQ ID NO: 1850583 - protein, 5 aa, Staphylococcus
ESNYS

SEQ ID NO: 1850584 - protein, 7 aa, Staphylococcus
ESPGPAI

SEQ ID NO: 1850585 - protein, 6 aa, Staphylococcus
ESPKFN

SEQ ID NO: 1850586 - protein, 5 aa, Staphylococcus
ESPLD

SEQ ID NO: 1850587 - protein, 8 aa, Staphylococcus
ESPVKNPQ

SEQ ID NO: 1850588 - protein, 11 aa, Staphylococcus
ESQHSKLSEEV

SEQ ID NO: 1850589 - protein, 7 aa, Staphylococcus
ESQKHSP

SEQ ID NO: 1850590 - protein, 6 aa, Staphylococcus
ESQNRD

SEQ ID NO: 1850591 - protein, 9 aa, Staphylococcus
ESRDGSEKS

SEQ ID NO: 1850592 - protein, 11 aa, Staphylococcus
ESRGKRRNGWT

SEQ ID NO: 1850593 - protein, 8 aa, Staphylococcus
ESRSRLPE

SEQ ID NO: 1850594 - protein, 12 aa, Staphylococcus
ESRTGGSGNASS

SEQ ID NO: 1850595 - protein, 8 aa, Staphylococcus
ESRTQIKR

SEQ ID NO: 1850596 - protein, 4 aa, Staphylococcus
ESSA

SEQ ID NO: 1850597 - protein, 5 aa, Staphylococcus
ESSGV

SEQ ID NO: 1850598 - protein, 10 aa, Staphylococcus
ESSKISDREL

SEQ ID NO: 1850599 - protein, 6 aa, Staphylococcus
ESSNAA

SEQ ID NO: 1850600 - protein, 12 aa, Staphylococcus
ESSNEDAEIKAQ

SEQ ID NO: 1850601 - protein, 11 aa, Staphylococcus
ESSPDRKRNTL

SEQ ID NO: 1850602 - protein, 15 aa, Staphylococcus
ESSSETVEASEDFDQ

SEQ ID NO: 1850603 - protein, 8 aa, Staphylococcus
ESSSNINP

SEQ ID NO: 1850604 - protein, 11 aa, Staphylococcus
ESSSSDETLQK

SEQ ID NO: 1850605 - protein, 10 aa, Staphylococcus
ESSVNDPSNL

SEQ ID NO: 1850606 - protein, 11 aa, Staphylococcus
ESTADKKQAVK

SEQ ID NO: 1850607 - protein, 20 aa, Staphylococcus
ESTEAAMEETGDLKIPEQEG

SEQ ID NO: 1850608 - protein, 9 aa, Staphylococcus
ESTKKAKHK

SEQ ID NO: 1850609 - protein, 10 aa, Staphylococcus
ESTKQSSNKR

SEQ ID NO: 1850610 - protein, 17 aa, Staphylococcus
ESTLGEGSTFIITLSKK

SEQ ID NO: 1850611 - protein, 4 aa, Staphylococcus
ESTM

SEQ ID NO: 1850612 - protein, 12 aa, Staphylococcus
ESTNKDDLGPLK

SEQ ID NO: 1850613 - protein, 5 aa, Staphylococcus
ESTPR

SEQ ID NO: 1850614 - protein, 7 aa, Staphylococcus
ESTPRTG

SEQ ID NO: 1850615 - protein, 10 aa, Staphylococcus
ESTSESKDRQ

SEQ ID NO: 1850616 - protein, 62 aa, Staphylococcus
ESTTIPPAEKVAESKLTSNVENVDSNSTVKSTVKQNHTVTKEVNHKAENSKEKVLPKTGENL

SEQ ID NO: 1850617 - protein, 8 aa, Staphylococcus
ESTVGEGT

SEQ ID NO: 1850618 - protein, 4 aa, Staphylococcus
ESTY

SEQ ID NO: 1850619 - protein, 6 aa, Staphylococcus
ESTYGY

SEQ ID NO: 1850620 - protein, 15 aa, Staphylococcus
ESTYGYRQKVRYEKN

SEQ ID NO: 1850621 - protein, 14 aa, Staphylococcus
ESTYKDAKDVEPVN

SEQ ID NO: 1850622 - protein, 6 aa, Staphylococcus
ESVANQ

SEQ ID NO: 1850623 - protein, 7 aa, Staphylococcus
ESVAQSP

SEQ ID NO: 1850624 - protein, 17 aa, Staphylococcus
ESVEPGITKYIEDEVAK

SEQ ID NO: 1850625 - protein, 27 aa, Staphylococcus
ESVEVKQGQLYRDDRQIKASYAKNIKT

SEQ ID NO: 1850626 - protein, 8 aa, Staphylococcus
ESVGTALT

SEQ ID NO: 1850627 - protein, 7 aa, Staphylococcus
ESVPRSV

SEQ ID NO: 1850628 - protein, 6 aa, Staphylococcus
ESVQPN

SEQ ID NO: 1850629 - protein, 7 aa, Staphylococcus
ESVSDGI

SEQ ID NO: 1850630 - protein, 26 aa, Staphylococcus
ESYEGHKLDTDTYTYKEPEKTDDGKW

SEQ ID NO: 1850631 - protein, 26 aa, Staphylococcus
ESYEGHKLDTSEYTYKEPEKTDDGNW

SEQ ID NO: 1850632 - protein, 24 aa, Staphylococcus
ESYEGHTLDTDTYTYKEPEITADG

SEQ ID NO: 1850633 - protein, 26 aa, Staphylococcus
ESYEGHTLDTDTYTYKEPEKTDDGKW

SEQ ID NO: 1850634 - protein, 22 aa, Staphylococcus
ESYEPARQTPEVNPSPSPTRKV

SEQ ID NO: 1850635 - protein, 10 aa, Staphylococcus
ESYKGVNVKG

SEQ ID NO: 1850636 - protein, 11 aa, Staphylococcus
ESYKGVNVKGD

SEQ ID NO: 1850637 - protein, 15 aa, Staphylococcus
ESYKKTHQGKKYKSI

SEQ ID NO: 1850638 - protein, 24 aa, Staphylococcus
ETAEKDLYKPQATLPRKEDESPKF

SEQ ID NO: 1850639 - protein, 14 aa, Staphylococcus
ETAKNQGKTDGNYI

SEQ ID NO: 1850640 - protein, 9 aa, Staphylococcus
ETAKRVADT

SEQ ID NO: 1850641 - protein, 23 aa, Staphylococcus
ETANGAPAGSISSEGEPRKYEKM

SEQ ID NO: 1850642 - protein, 4 aa, Staphylococcus
ETAP

SEQ ID NO: 1850643 - protein, 15 aa, Staphylococcus
ETAPDKTRGKLGSGL

SEQ ID NO: 1850644 - protein, 16 aa, Staphylococcus
ETAQSEIKSEKERALA

SEQ ID NO: 1850645 - protein, 12 aa, Staphylococcus
ETARLSEENNQS

SEQ ID NO: 1850646 - protein, 7 aa, Staphylococcus
ETDDTLT

SEQ ID NO: 1850647 - protein, 8 aa, Staphylococcus
ETDKTLSQ

SEQ ID NO: 1850648 - protein, 4 aa, Staphylococcus
ETDM

SEQ ID NO: 1850649 - protein, 35 aa, Staphylococcus
ETDNNGNWKLETNDKLSNGSTIEAAAKDLAGNVSE

SEQ ID NO: 1850650 - protein, 6 aa, Staphylococcus
ETDSTL

SEQ ID NO: 1850651 - protein, 8 aa, Staphylococcus
ETDSTLSD

SEQ ID NO: 1850652 - protein, 4 aa, Staphylococcus
ETEL

SEQ ID NO: 1850653 - protein, 10 aa, Staphylococcus
ETELAPPLNQ

SEQ ID NO: 1850654 - protein, 9 aa, Staphylococcus
ETELEPPLD

SEQ ID NO: 1850655 - protein, 10 aa, Staphylococcus
ETELKAPLDQ

SEQ ID NO: 1850656 - protein, 35 aa, Staphylococcus
ETELRERRSELQRQEARNLQKEENLDRKSELLDKK

SEQ ID NO: 1850657 - protein, 5 aa, Staphylococcus
ETETT

SEQ ID NO: 1850658 - protein, 4 aa, Staphylococcus
ETFA

SEQ ID NO: 1850659 - protein, 15 aa, Staphylococcus
ETFDKEQRENEKKQN

SEQ ID NO: 1850660 - protein, 10 aa, Staphylococcus
ETFDNSEYSL

SEQ ID NO: 1850661 - protein, 64 aa, Staphylococcus
ETFDQTHPDGQNDTDNAQQSNNSDEHDDTDETKGEYNTDVETQDDEEDTVATQDNDSVTSVTNI

SEQ ID NO: 1850662 - protein, 7 aa, Staphylococcus
ETFHQSS

SEQ ID NO: 1850663 - protein, 22 aa, Staphylococcus
ETGAEEASKDDAKQAAAKKGIP

SEQ ID NO: 1850664 - protein, 18 aa, Staphylococcus
ETGASKSQLANGVEIDGK

SEQ ID NO: 1850665 - protein, 4 aa, Staphylococcus
ETGD

SEQ ID NO: 1850666 - protein, 6 aa, Staphylococcus
ETGKKH

SEQ ID NO: 1850667 - protein, 9 aa, Staphylococcus
ETGKKNPEL

SEQ ID NO: 1850668 - protein, 10 aa, Staphylococcus
ETGNGDSELA

SEQ ID NO: 1850669 - protein, 17 aa, Staphylococcus
ETGNGKSELAKGIEVDG

SEQ ID NO: 1850670 - protein, 19 aa, Staphylococcus
ETGNGKSELAKGVKDGSHR

SEQ ID NO: 1850671 - protein, 17 aa, Staphylococcus
ETGNGQSDLAKGIPYKG

SEQ ID NO: 1850672 - protein, 7 aa, Staphylococcus
ETGNNLA

SEQ ID NO: 1850673 - protein, 13 aa, Staphylococcus
ETGREAERQRETA

SEQ ID NO: 1850674 - protein, 17 aa, Staphylococcus
ETGSAKSELSKGVEIDG

SEQ ID NO: 1850675 - protein, 18 aa, Staphylococcus
ETGSAKSELSSGVEIDGK

SEQ ID NO: 1850676 - protein, 4 aa, Staphylococcus
ETGT

SEQ ID NO: 1850677 - protein, 5 aa, Staphylococcus
ETGVD

SEQ ID NO: 1850678 - protein, 24 aa, Staphylococcus
ETGVETASKDEAKTAAAKKGNPLQ

SEQ ID NO: 1850679 - protein, 24 aa, Staphylococcus
ETGVSEASKDDAKAAAAKKGNPIQ

SEQ ID NO: 1850680 - protein, 7 aa, Staphylococcus
ETHDTVN

SEQ ID NO: 1850681 - protein, 5 aa, Staphylococcus
ETHEH

SEQ ID NO: 1850682 - protein, 64 aa, Staphylococcus
ETHHTSQNNHSSHNIKTEKQSTSKKIQHTGSSVKTVSQQRTSQSRLTKQAVQHQSQKQNVEKHS

SEQ ID NO: 1850683 - protein, 18 aa, Staphylococcus
ETHIDEDEADSYDKKANL

SEQ ID NO: 1850684 - protein, 5 aa, Staphylococcus
ETIKS

SEQ ID NO: 1850685 - protein, 12 aa, Staphylococcus
ETIPGEGAAGAR

SEQ ID NO: 1850686 - protein, 13 aa, Staphylococcus
ETIPGEGAAGGRI

SEQ ID NO: 1850687 - protein, 13 aa, Staphylococcus
ETIPGEGASGARI

SEQ ID NO: 1850688 - protein, 13 aa, Staphylococcus
ETIPGEGASGGRI

SEQ ID NO: 1850689 - protein, 6 aa, Staphylococcus
ETIQTS

SEQ ID NO: 1850690 - protein, 12 aa, Staphylococcus
ETKAQAETHSES

SEQ ID NO: 1850691 - protein, 9 aa, Staphylococcus
ETKDAQGNT

SEQ ID NO: 1850692 - protein, 4 aa, Staphylococcus
ETKE

SEQ ID NO: 1850693 - protein, 35 aa, Staphylococcus
ETKGNSDVSTESKINMPRKEATPDAPIVEKDESKV

SEQ ID NO: 1850694 - protein, 9 aa, Staphylococcus
ETKITSENK

SEQ ID NO: 1850695 - protein, 9 aa, Staphylococcus
ETKQSGKEF

SEQ ID NO: 1850696 - protein, 4 aa, Staphylococcus
ETLG

SEQ ID NO: 1850697 - protein, 12 aa, Staphylococcus
ETLKSEGNFNQA

SEQ ID NO: 1850698 - protein, 11 aa, Staphylococcus
ETLLTQSSQNY

SEQ ID NO: 1850699 - protein, 10 aa, Staphylococcus
ETLPKGFNTS

SEQ ID NO: 1850700 - protein, 8 aa, Staphylococcus
ETLSGGEI

SEQ ID NO: 1850701 - protein, 6 aa, Staphylococcus
ETMGSF

SEQ ID NO: 1850702 - protein, 21 aa, Staphylococcus
ETNATMDPQSVNQATQALENA

SEQ ID NO: 1850703 - protein, 6 aa, Staphylococcus
ETNIKS

SEQ ID NO: 1850704 - protein, 6 aa, Staphylococcus
ETNKEQ

SEQ ID NO: 1850705 - protein, 7 aa, Staphylococcus
ETNPTLS

SEQ ID NO: 1850706 - protein, 4 aa, Staphylococcus
ETNY

SEQ ID NO: 1850707 - protein, 15 aa, Staphylococcus
ETPDLSGKTEKEAEH

SEQ ID NO: 1850708 - protein, 17 aa, Staphylococcus
ETPDPIKQEGGLSTTKQ

SEQ ID NO: 1850709 - protein, 5 aa, Staphylococcus
ETPGY

SEQ ID NO: 1850710 - protein, 5 aa, Staphylococcus
ETPIS

SEQ ID NO: 1850711 - protein, 10 aa, Staphylococcus
ETPSESKIQD

SEQ ID NO: 1850712 - protein, 15 aa, Staphylococcus
ETQDKLTKLGESQGK

SEQ ID NO: 1850713 - protein, 9 aa, Staphylococcus
ETQGGVGAE

SEQ ID NO: 1850714 - protein, 20 aa, Staphylococcus
ETQGGVGTENALTAKEIREA

SEQ ID NO: 1850715 - protein, 11 aa, Staphylococcus
ETQGKNNANFN

SEQ ID NO: 1850716 - protein, 9 aa, Staphylococcus
ETQKASSVA

SEQ ID NO: 1850717 - protein, 5 aa, Staphylococcus
ETQNK

SEQ ID NO: 1850718 - protein, 22 aa, Staphylococcus
ETRPVISDEEEEDNHDHKHESD

SEQ ID NO: 1850719 - protein, 6 aa, Staphylococcus
ETRSRH

SEQ ID NO: 1850720 - protein, 8 aa, Staphylococcus
ETRTQIKR

SEQ ID NO: 1850721 - protein, 11 aa, Staphylococcus
ETSKNKKLAIE

SEQ ID NO: 1850722 - protein, 15 aa, Staphylococcus
ETSPDNRRNSLGSGL

SEQ ID NO: 1850723 - protein, 11 aa, Staphylococcus
ETSSIKTDSIT

SEQ ID NO: 1850724 - protein, 4 aa, Staphylococcus
ETSV

SEQ ID NO: 1850725 - protein, 4 aa, Staphylococcus
ETTG

SEQ ID NO: 1850726 - protein, 8 aa, Staphylococcus
ETTGQQIA

SEQ ID NO: 1850727 - protein, 19 aa, Staphylococcus
ETTHKPKVKTNDDDDSQYA

SEQ ID NO: 1850728 - protein, 14 aa, Staphylococcus
ETTIRNYDENKYGQ

SEQ ID NO: 1850729 - protein, 8 aa, Staphylococcus
ETTKSVAP

SEQ ID NO: 1850730 - protein, 7 aa, Staphylococcus
ETTLNGN

SEQ ID NO: 1850731 - protein, 5 aa, Staphylococcus
ETTML

SEQ ID NO: 1850732 - protein, 7 aa, Staphylococcus
ETTSHSV

SEQ ID NO: 1850733 - protein, 8 aa, Staphylococcus
ETVGTTLT

SEQ ID NO: 1850734 - protein, 19 aa, Staphylococcus
ETVKTKLGYETQTITSQWE

SEQ ID NO: 1850735 - protein, 4 aa, Staphylococcus
ETVT

SEQ ID NO: 1850736 - protein, 5 aa, Staphylococcus
ETWRN

SEQ ID NO: 1850737 - protein, 4 aa, Staphylococcus
ETYE

SEQ ID NO: 1850738 - protein, 8 aa, Staphylococcus
EVAARGAS

SEQ ID NO: 1850739 - protein, 22 aa, Staphylococcus
EVAATEAKLREAREKEREAASH

SEQ ID NO: 1850740 - protein, 5 aa, Staphylococcus
EVADG

SEQ ID NO: 1850741 - protein, 10 aa, Staphylococcus
EVAENEARLR

SEQ ID NO: 1850742 - protein, 23 aa, Staphylococcus
EVAENEARLREARIKEREAVGHE

SEQ ID NO: 1850743 - protein, 9 aa, Staphylococcus
EVAETEARL

SEQ ID NO: 1850744 - protein, 23 aa, Staphylococcus
EVAETEKRLREARIKEREAVSHE

SEQ ID NO: 1850745 - protein, 7 aa, Staphylococcus
EVAKREP

SEQ ID NO: 1850746 - protein, 5 aa, Staphylococcus
EVDEK

SEQ ID NO: 1850747 - protein, 11 aa, Staphylococcus
EVDYSETITQE

SEQ ID NO: 1850748 - protein, 8 aa, Staphylococcus
EVEEEPEE

SEQ ID NO: 1850749 - protein, 18 aa, Staphylococcus
EVEGNEGDIQSKKYRKPI

SEQ ID NO: 1850750 - protein, 14 aa, Staphylococcus
EVEPSLTEAAKGIG

SEQ ID NO: 1850751 - protein, 13 aa, Staphylococcus
EVEYADDKENQNQ

SEQ ID NO: 1850752 - protein, 15 aa, Staphylococcus
EVGHSESFSKEIEDL

SEQ ID NO: 1850753 - protein, 4 aa, Staphylococcus
EVGT

SEQ ID NO: 1850754 - protein, 10 aa, Staphylococcus
EVKAPSKKIG

SEQ ID NO: 1850755 - protein, 9 aa, Staphylococcus
EVKPQPPVV

SEQ ID NO: 1850756 - protein, 76 aa, Staphylococcus
EVKPSPSTSEQSKSTQVEPTKESTSTKVKQTPQEPTQQQQKRNVPESQQSTPASKQVSKNSNTTSEQAAPKSQHVT

SEQ ID NO: 1850757 - protein, 14 aa, Staphylococcus
EVKQSDIPTKAKEK

SEQ ID NO: 1850758 - protein, 12 aa, Staphylococcus
EVKSNEDVSENG

SEQ ID NO: 1850759 - protein, 5 aa, Staphylococcus
EVNNA

SEQ ID NO: 1850760 - protein, 9 aa, Staphylococcus
EVNNATQLS

SEQ ID NO: 1850761 - protein, 8 aa, Staphylococcus
EVNNSTQL

SEQ ID NO: 1850762 - protein, 13 aa, Staphylococcus
EVNPDKGRVNRTG

SEQ ID NO: 1850763 - protein, 5 aa, Staphylococcus
EVNQY

SEQ ID NO: 1850764 - protein, 12 aa, Staphylococcus
EVNQYTTFKIIF

SEQ ID NO: 1850765 - protein, 51 aa, Staphylococcus
EVPADTETQSSTPKETQTPQQTQGQSEGSVPSSGGTSQSTSGTASESYPNC

SEQ ID NO: 1850766 - protein, 31 aa, Staphylococcus
EVPGGTELNNGDKITAVETDDAGNVSDEGSA

SEQ ID NO: 1850767 - protein, 13 aa, Staphylococcus
EVPSNLPNINSDS

SEQ ID NO: 1850768 - protein, 8 aa, Staphylococcus
EVQPAQGV

SEQ ID NO: 1850769 - protein, 8 aa, Staphylococcus
EVQSNEGT

SEQ ID NO: 1850770 - protein, 12 aa, Staphylococcus
EVQTNELYEESK

SEQ ID NO: 1850771 - protein, 13 aa, Staphylococcus
EVQTNQLYEDSKP

SEQ ID NO: 1850772 - protein, 8 aa, Staphylococcus
EVRETSKN

SEQ ID NO: 1850773 - protein, 12 aa, Staphylococcus
EVRGGHHRKKDI

SEQ ID NO: 1850774 - protein, 6 aa, Staphylococcus
EVSDEE

SEQ ID NO: 1850775 - protein, 5 aa, Staphylococcus
EVSDL

SEQ ID NO: 1850776 - protein, 5 aa, Staphylococcus
EVTDE

SEQ ID NO: 1850777 - protein, 8 aa, Staphylococcus
EVTDIERS

SEQ ID NO: 1850778 - protein, 7 aa, Staphylococcus
EVTGSTS

SEQ ID NO: 1850779 - protein, 9 aa, Staphylococcus
EVTPKGEAT

SEQ ID NO: 1850780 - protein, 7 aa, Staphylococcus
EVTQTTV

SEQ ID NO: 1850781 - protein, 66 aa, Staphylococcus
EVVKETNSEFDEGKYGKSYEDVRKEQSLDHKGDDNHHEDESEDEPTGHEQSPNIDKPYNPNDPNHR

SEQ ID NO: 1850782 - protein, 18 aa, Staphylococcus
EWKDGFDDSYTPTKSEHD

SEQ ID NO: 1850783 - protein, 21 aa, Staphylococcus
EWNPVGNKGAHSSYSTESVPV

SEQ ID NO: 1850784 - protein, 18 aa, Staphylococcus
EWQTEKSYNERKKDDPYI

SEQ ID NO: 1850785 - protein, 6 aa, Staphylococcus
EYAQNR

SEQ ID NO: 1850786 - protein, 10 aa, Staphylococcus
EYAQNRNELT

SEQ ID NO: 1850787 - protein, 7 aa, Staphylococcus
EYASEHP

SEQ ID NO: 1850788 - protein, 24 aa, Staphylococcus
EYDASQANYDEEEETSSHITPTEK

SEQ ID NO: 1850789 - protein, 15 aa, Staphylococcus
EYDKSDGLNTEKPDL

SEQ ID NO: 1850790 - protein, 7 aa, Staphylococcus
EYDPNQY

SEQ ID NO: 1850791 - protein, 6 aa, Staphylococcus
EYEAST

SEQ ID NO: 1850792 - protein, 8 aa, Staphylococcus
EYEKKDNV

SEQ ID NO: 1850793 - protein, 8 aa, Staphylococcus
EYEKKGNV

SEQ ID NO: 1850794 - protein, 7 aa, Staphylococcus
EYEPKTY

SEQ ID NO: 1850795 - protein, 4 aa, Staphylococcus
EYET

SEQ ID NO: 1850796 - protein, 27 aa, Staphylococcus
EYETKSHEKEIKNLQGTVEAEAKGNRE

SEQ ID NO: 1850797 - protein, 4 aa, Staphylococcus
EYGI

SEQ ID NO: 1850798 - protein, 9 aa, Staphylococcus
EYIDETGKH

SEQ ID NO: 1850799 - protein, 4 aa, Staphylococcus
EYIP

SEQ ID NO: 1850800 - protein, 4 aa, Staphylococcus
EYKE

SEQ ID NO: 1850801 - protein, 6 aa, Staphylococcus
EYKEDE

SEQ ID NO: 1850802 - protein, 8 aa, Staphylococcus
EYKKEGNV

SEQ ID NO: 1850803 - protein, 8 aa, Staphylococcus
EYKKKDNI

SEQ ID NO: 1850804 - protein, 8 aa, Staphylococcus
EYKKKGNI

SEQ ID NO: 1850805 - protein, 8 aa, Staphylococcus
EYKKKGQI

SEQ ID NO: 1850806 - protein, 22 aa, Staphylococcus
EYKRQAGTSTPPSRRRKKKRVR

SEQ ID NO: 1850807 - protein, 9 aa, Staphylococcus
EYKTNPSQR

SEQ ID NO: 1850808 - protein, 6 aa, Staphylococcus
EYLGKD

SEQ ID NO: 1850809 - protein, 6 aa, Staphylococcus
EYLGKS

SEQ ID NO: 1850810 - protein, 9 aa, Staphylococcus
EYLGKSKKF

SEQ ID NO: 1850811 - protein, 11 aa, Staphylococcus
EYNAENHDSEL

SEQ ID NO: 1850812 - protein, 10 aa, Staphylococcus
EYNDDYPENK

SEQ ID NO: 1850813 - protein, 8 aa, Staphylococcus
EYNSQMPK

SEQ ID NO: 1850814 - protein, 4 aa, Staphylococcus
EYPA

SEQ ID NO: 1850815 - protein, 6 aa, Staphylococcus
EYPEEE

SEQ ID NO: 1850816 - protein, 5 aa, Staphylococcus
EYPKD

SEQ ID NO: 1850817 - protein, 8 aa, Staphylococcus
EYPKEEKQ

SEQ ID NO: 1850818 - protein, 8 aa, Staphylococcus
EYPNEEQQ

SEQ ID NO: 1850819 - protein, 5 aa, Staphylococcus
EYPNI

SEQ ID NO: 1850820 - protein, 5 aa, Staphylococcus
EYPQI

SEQ ID NO: 1850821 - protein, 12 aa, Staphylococcus
EYPQIKNEQIPT

SEQ ID NO: 1850822 - protein, 6 aa, Staphylococcus
EYQHSE

SEQ ID NO: 1850823 - protein, 9 aa, Staphylococcus
EYQQKRNRL

SEQ ID NO: 1850824 - protein, 9 aa, Staphylococcus
EYRGKSPAQ

SEQ ID NO: 1850825 - protein, 8 aa, Staphylococcus
EYRGYDSA

SEQ ID NO: 1850826 - protein, 9 aa, Staphylococcus
EYRGYDSAG

SEQ ID NO: 1850827 - protein, 9 aa, Staphylococcus
EYSAPVNGK

SEQ ID NO: 1850828 - protein, 43 aa, Staphylococcus
EYSDDASSKAQEEDATSLENVSTDINTRNTENESVDAQSTDNC

SEQ ID NO: 1850829 - protein, 10 aa, Staphylococcus
EYSQERNPLT

SEQ ID NO: 1850830 - protein, 9 aa, Staphylococcus
EYSQNRNAL

SEQ ID NO: 1850831 - protein, 10 aa, Staphylococcus
EYSRTHDNKH

SEQ ID NO: 1850832 - protein, 9 aa, Staphylococcus
EYTSGSVAV

SEQ ID NO: 1850833 - protein, 5 aa, Staphylococcus
EYVER

SEQ ID NO: 1850834 - protein, 6 aa, Staphylococcus
EYVTSE

SEQ ID NO: 1850835 - protein, 5 aa, Staphylococcus
EYYKN

SEQ ID NO: 1850836 - protein, 10 aa, Staphylococcus
FAARTTPNQI

SEQ ID NO: 1850837 - protein, 19 aa, Staphylococcus
FAATQDAETATSETTTHVQ

SEQ ID NO: 1850838 - protein, 7 aa, Staphylococcus
FADPEKE

SEQ ID NO: 1850839 - protein, 12 aa, Staphylococcus
FADSSKVKTGDS

SEQ ID NO: 1850840 - protein, 5 aa, Staphylococcus
FAEQN

SEQ ID NO: 1850841 - protein, 9 aa, Staphylococcus
FAGKNVTVT

SEQ ID NO: 1850842 - protein, 6 aa, Staphylococcus
FAGTNE

SEQ ID NO: 1850843 - protein, 7 aa, Staphylococcus
FAGTNEG

SEQ ID NO: 1850844 - protein, 5 aa, Staphylococcus
FAHTS

SEQ ID NO: 1850845 - protein, 4 aa, Staphylococcus
FAKE

SEQ ID NO: 1850846 - protein, 10 aa, Staphylococcus
FAKENNIKTI

SEQ ID NO: 1850847 - protein, 10 aa, Staphylococcus
FAKKNNIKTI

SEQ ID NO: 1850848 - protein, 12 aa, Staphylococcus
FANSSKVKTGDS

SEQ ID NO: 1850849 - protein, 15 aa, Staphylococcus
FAPENPEKGKKTITG

SEQ ID NO: 1850850 - protein, 15 aa, Staphylococcus
FAPKNPEKGKSTISG

SEQ ID NO: 1850851 - protein, 8 aa, Staphylococcus
FAPNGKYR

SEQ ID NO: 1850852 - protein, 5 aa, Staphylococcus
FAPSA

SEQ ID NO: 1850853 - protein, 18 aa, Staphylococcus
FAPSKYKQQHFSKTTAKD

SEQ ID NO: 1850854 - protein, 5 aa, Staphylococcus
FASGQ

SEQ ID NO: 1850855 - protein, 10 aa, Staphylococcus
FASSAGTGYH

SEQ ID NO: 1850856 - protein, 5 aa, Staphylococcus
FASSW

SEQ ID NO: 1850857 - protein, 5 aa, Staphylococcus
FATGQ

SEQ ID NO: 1850858 - protein, 10 aa, Staphylococcus
FATPQQVNNA

SEQ ID NO: 1850859 - protein, 23 aa, Staphylococcus
FDDDDISDYIEKKEKEDNSLKNK

SEQ ID NO: 1850860 - protein, 12 aa, Staphylococcus
FDDEGGSASNNL

SEQ ID NO: 1850861 - protein, 6 aa, Staphylococcus
FDEDED

SEQ ID NO: 1850862 - protein, 14 aa, Staphylococcus
FDEEGQEKKVGPKA

SEQ ID NO: 1850863 - protein, 9 aa, Staphylococcus
FDEQEAKAI

SEQ ID NO: 1850864 - protein, 19 aa, Staphylococcus
FDEQGSDFNTQRIDNTSTT

SEQ ID NO: 1850865 - protein, 6 aa, Staphylococcus
FDGDTH

SEQ ID NO: 1850866 - protein, 5 aa, Staphylococcus
FDGQN

SEQ ID NO: 1850867 - protein, 8 aa, Staphylococcus
FDKDGVGH

SEQ ID NO: 1850868 - protein, 5 aa, Staphylococcus
FDKEY

SEQ ID NO: 1850869 - protein, 6 aa, Staphylococcus
FDKTTN

SEQ ID NO: 1850870 - protein, 17 aa, Staphylococcus
FDPSTNTISGVATKVGT

SEQ ID NO: 1850871 - protein, 4 aa, Staphylococcus
FDPT

SEQ ID NO: 1850872 - protein, 8 aa, Staphylococcus
FDRERPSK

SEQ ID NO: 1850873 - protein, 18 aa, Staphylococcus
FDSETNTISGTPTQTGTS

SEQ ID NO: 1850874 - protein, 18 aa, Staphylococcus
FDSISNQQRAANNAYKQD

SEQ ID NO: 1850875 - protein, 9 aa, Staphylococcus
FDSNGTSSQ

SEQ ID NO: 1850876 - protein, 22 aa, Staphylococcus
FDTETKKSIKDAKHNYFNQNFK

SEQ ID NO: 1850877 - protein, 24 aa, Staphylococcus
FDTETKKSLKSAKHNYFNKNYKPS

SEQ ID NO: 1850878 - protein, 11 aa, Staphylococcus
FDTRQGVPIPT

SEQ ID NO: 1850879 - protein, 6 aa, Staphylococcus
FEDDEE

SEQ ID NO: 1850880 - protein, 58 aa, Staphylococcus
FEDDSDEVISDKEDNNDTSAQSHEKVENKGTSHNMNQGAHANHQEESRDKQTINSNTH

SEQ ID NO: 1850881 - protein, 5 aa, Staphylococcus
FEDSG

SEQ ID NO: 1850882 - protein, 10 aa, Staphylococcus
FEDTDEEKRQ

SEQ ID NO: 1850883 - protein, 6 aa, Staphylococcus
FEEDEE

SEQ ID NO: 1850884 - protein, 18 aa, Staphylococcus
FEEHDTSEPFSDDSDEIE

SEQ ID NO: 1850885 - protein, 7 aa, Staphylococcus
FEESQNQ

SEQ ID NO: 1850886 - protein, 18 aa, Staphylococcus
FEGERDDVRSHETNLGDA

SEQ ID NO: 1850887 - protein, 25 aa, Staphylococcus
FEGKTTTITHEYTESQADSEAFSKN

SEQ ID NO: 1850888 - protein, 11 aa, Staphylococcus
FEKDKKGNITK

SEQ ID NO: 1850889 - protein, 17 aa, Staphylococcus
FEKDKNHAKRHSDHQQI

SEQ ID NO: 1850890 - protein, 7 aa, Staphylococcus
FEKEGKT

SEQ ID NO: 1850891 - protein, 106 aa, Staphylococcus
FEKNRQSIDPKEHQENTQDSVNDSVDNIKEEVSDKSDEQFPPRNAQRRQRRRDTATNQREDEQSNQEHHNENNEVGDRDNGLQHEDNSSRDSNADKESNDPSQNNN

SEQ ID NO: 1850892 - protein, 260 aa, Staphylococcus
FEKNRQSIDTNQHEDKSEHHTEEHTTNEKEQVQENLDNNQQFPPRNAQRRQRKRQRNIKSNQDKQVHNYNEKDNQNHQTEDERQPSHDSTKPQQEAKPTEHKNANSQNRKGAASASVGAASHDNKESVSNRHDTRNTGEQQSNKQNNQSTQNETKQAIADDDQAQNNPEKKSSKLDKTTAAGVGAAGAAGIGAAANHNNKNNNDDSTQQENKQRSTQNDKKKAAGSGTAGAAGAASQNNHYNNTNRPEHHDDKESNKRGI

SEQ ID NO: 1850893 - protein, 8 aa, Staphylococcus
FEKQGSTF

SEQ ID NO: 1850894 - protein, 11 aa, Staphylococcus
FENGEKNSANT

SEQ ID NO: 1850895 - protein, 15 aa, Staphylococcus
FEPHRSSASTLKSSV

SEQ ID NO: 1850896 - protein, 4 aa, Staphylococcus
FEPK

SEQ ID NO: 1850897 - protein, 11 aa, Staphylococcus
FEQARTNEKDF

SEQ ID NO: 1850898 - protein, 5 aa, Staphylococcus
FEQSY

SEQ ID NO: 1850899 - protein, 9 aa, Staphylococcus
FERKKQHAS

SEQ ID NO: 1850900 - protein, 539 aa, Staphylococcus
FESTSDSESQSDSESTSDSESTSDSESQSDSESTSDSESQSDSESTSDSESTSDSESQSDSESTSDSESTSDSESTSDSESTSDSESQSDSESTSDSESQSDSESTSDSESQSDSESTSDSESTSDSESQSDSESTSDSESTSDSESQSDSESTSDSESTSDSESQSDSESTSDSESQSDSESQSDSESQSDSESTSDSESTSDSESQSDSESTSDSESTSDSESTSDSESQSDSESTSDSESQSDSESQSDSESTSDSESTSDSESQSDSESQSDSESTSDSESQSDSESTSDSESTSDSESQSDSESQSDSESQSDSESTSDSESTSDSESQSDSESTSDSESTSDSESQSDSESTSDSESQSDSESTSDSESQSDSESTSDSESQSDSESTSDSESTSDSESQSDSESTSDSESQSDSESTSDSESQSDSESTSDSESQSDSESTSDSESTSDSESQSDSESTSDSESQSDSESTSDSESTSDSESQSDSESTSDSESTSDSESQSDSESTSDSESHSDSHLPDTGEEESNKSGLI

SEQ ID NO: 1850901 - protein, 7 aa, Staphylococcus
FETQGSE

SEQ ID NO: 1850902 - protein, 7 aa, Staphylococcus
FETSNDI

SEQ ID NO: 1850903 - protein, 12 aa, Staphylococcus
FETTDDGKVKKT

SEQ ID NO: 1850904 - protein, 5 aa, Staphylococcus
FFPNG

SEQ ID NO: 1850905 - protein, 9 aa, Staphylococcus
FGAANPNVS

SEQ ID NO: 1850906 - protein, 11 aa, Staphylococcus
FGAKDSGRILP

SEQ ID NO: 1850907 - protein, 10 aa, Staphylococcus
FGDAASPLEK

SEQ ID NO: 1850908 - protein, 4 aa, Staphylococcus
FGDN

SEQ ID NO: 1850909 - protein, 11 aa, Staphylococcus
FGEAADPLEKE

SEQ ID NO: 1850910 - protein, 5 aa, Staphylococcus
FGEGT

SEQ ID NO: 1850911 - protein, 6 aa, Staphylococcus
FGEGYN

SEQ ID NO: 1850912 - protein, 12 aa, Staphylococcus
FGENASQGVAVT

SEQ ID NO: 1850913 - protein, 14 aa, Staphylococcus
FGGDTVAGFSASQR

SEQ ID NO: 1850914 - protein, 10 aa, Staphylococcus
FGGNTNTAQV

SEQ ID NO: 1850915 - protein, 9 aa, Staphylococcus
FGGSKAGEL

SEQ ID NO: 1850916 - protein, 6 aa, Staphylococcus
FGGTGL

SEQ ID NO: 1850917 - protein, 6 aa, Staphylococcus
FGKESA

SEQ ID NO: 1850918 - protein, 9 aa, Staphylococcus
FGKTNKHGV

SEQ ID NO: 1850919 - protein, 9 aa, Staphylococcus
FGKTSKSGV

SEQ ID NO: 1850920 - protein, 12 aa, Staphylococcus
FGLNGKANADDI

SEQ ID NO: 1850921 - protein, 9 aa, Staphylococcus
FGMSEAQTG

SEQ ID NO: 1850922 - protein, 16 aa, Staphylococcus
FGNARGGIKGAVAGAA

SEQ ID NO: 1850923 - protein, 7 aa, Staphylococcus
FGNGSDS

SEQ ID NO: 1850924 - protein, 4 aa, Staphylococcus
FGNT

SEQ ID NO: 1850925 - protein, 5 aa, Staphylococcus
FGPKK

SEQ ID NO: 1850926 - protein, 5 aa, Staphylococcus
FGQAD

SEQ ID NO: 1850927 - protein, 11 aa, Staphylococcus
FGQRNESIITS

SEQ ID NO: 1850928 - protein, 12 aa, Staphylococcus
FGQRNESVITST

SEQ ID NO: 1850929 - protein, 10 aa, Staphylococcus
FGRAAKKQGV

SEQ ID NO: 1850930 - protein, 5 aa, Staphylococcus
FGSRA

SEQ ID NO: 1850931 - protein, 7 aa, Staphylococcus
FGTIGSK

SEQ ID NO: 1850932 - protein, 4 aa, Staphylococcus
FGTP

SEQ ID NO: 1850933 - protein, 9 aa, Staphylococcus
FGTPQRQFE

SEQ ID NO: 1850934 - protein, 11 aa, Staphylococcus
FGYEPSDQADF

SEQ ID NO: 1850935 - protein, 13 aa, Staphylococcus
FHGQEGVKKAKQI

SEQ ID NO: 1850936 - protein, 14 aa, Staphylococcus
FHGQEGVKKAKQIS

SEQ ID NO: 1850937 - protein, 11 aa, Staphylococcus
FHGQQGVERAK

SEQ ID NO: 1850938 - protein, 23 aa, Staphylococcus
FHNTEENNELHKKESFNEEPKKR

SEQ ID NO: 1850939 - protein, 11 aa, Staphylococcus
FHQDQLGGSPL

SEQ ID NO: 1850940 - protein, 12 aa, Staphylococcus
FHTGKQSEGASD

SEQ ID NO: 1850941 - protein, 9 aa, Staphylococcus
FHTTASNAQ

SEQ ID NO: 1850942 - protein, 9 aa, Staphylococcus
FHTTTSNAQ

SEQ ID NO: 1850943 - protein, 8 aa, Staphylococcus
FIESDTQK

SEQ ID NO: 1850944 - protein, 20 aa, Staphylococcus
FKADKGAEKAPKVDFGTDSS

SEQ ID NO: 1850945 - protein, 8 aa, Staphylococcus
FKAGGKRR

SEQ ID NO: 1850946 - protein, 5 aa, Staphylococcus
FKASL

SEQ ID NO: 1850947 - protein, 9 aa, Staphylococcus
FKDADGKYN

SEQ ID NO: 1850948 - protein, 8 aa, Staphylococcus
FKDDPKYT

SEQ ID NO: 1850949 - protein, 12 aa, Staphylococcus
FKDLSQASVESL

SEQ ID NO: 1850950 - protein, 10 aa, Staphylococcus
FKDNKKDSLG

SEQ ID NO: 1850951 - protein, 6 aa, Staphylococcus
FKDPGQ

SEQ ID NO: 1850952 - protein, 35 aa, Staphylococcus
FKDTSNTKSNQMQQSDEIKKDIDKVTTNHSKVKDN

SEQ ID NO: 1850953 - protein, 7 aa, Staphylococcus
FKEASED

SEQ ID NO: 1850954 - protein, 49 aa, Staphylococcus
FKEDNEDNKEMNTSNNNENNAIENQVDNSLSNDSQSNDTEQSTSNVETF

SEQ ID NO: 1850955 - protein, 17 aa, Staphylococcus
FKEKAPKETDHSGSGGF

SEQ ID NO: 1850956 - protein, 12 aa, Staphylococcus
FKEKSTSQPDID

SEQ ID NO: 1850957 - protein, 8 aa, Staphylococcus
FKEQDLEE

SEQ ID NO: 1850958 - protein, 10 aa, Staphylococcus
FKESGGTGNM

SEQ ID NO: 1850959 - protein, 9 aa, Staphylococcus
FKETNSKEH

SEQ ID NO: 1850960 - protein, 8 aa, Staphylococcus
FKGASTQT

SEQ ID NO: 1850961 - protein, 9 aa, Staphylococcus
FKGEEKSNM

SEQ ID NO: 1850962 - protein, 5 aa, Staphylococcus
FKGGF

SEQ ID NO: 1850963 - protein, 9 aa, Staphylococcus
FKGIKNGQK

SEQ ID NO: 1850964 - protein, 7 aa, Staphylococcus
FKGQSLR

SEQ ID NO: 1850965 - protein, 8 aa, Staphylococcus
FKGRRGPA

SEQ ID NO: 1850966 - protein, 14 aa, Staphylococcus
FKGTNTTERIAASE

SEQ ID NO: 1850967 - protein, 9 aa, Staphylococcus
FKKAQAAFS

SEQ ID NO: 1850968 - protein, 10 aa, Staphylococcus
FKKDTDQTKW

SEQ ID NO: 1850969 - protein, 9 aa, Staphylococcus
FKKDTEYHK

SEQ ID NO: 1850970 - protein, 20 aa, Staphylococcus
FKKINPSKYEYKTGPKGNEK

SEQ ID NO: 1850971 - protein, 20 aa, Staphylococcus
FKKINPSKYQYKTGPKGSEQ

SEQ ID NO: 1850972 - protein, 12 aa, Staphylococcus
FKKNALKNAQRY

SEQ ID NO: 1850973 - protein, 7 aa, Staphylococcus
FKKPNKP

SEQ ID NO: 1850974 - protein, 7 aa, Staphylococcus
FKKTFTT

SEQ ID NO: 1850975 - protein, 36 aa, Staphylococcus
FKKTNSKNKHEAVGYEQSGGAIKKSAPSFNIGDTPS

SEQ ID NO: 1850976 - protein, 19 aa, Staphylococcus
FKKVNPAKYEYKTGPKGNQ

SEQ ID NO: 1850977 - protein, 6 aa, Staphylococcus
FKLPGG

SEQ ID NO: 1850978 - protein, 7 aa, Staphylococcus
FKLPGGK

SEQ ID NO: 1850979 - protein, 8 aa, Staphylococcus
FKLPGGPY

SEQ ID NO: 1850980 - protein, 6 aa, Staphylococcus
FKMPGG

SEQ ID NO: 1850981 - protein, 88 aa, Staphylococcus
FKNTTETTNQQAAQIQSTTQKSTSAQTTLKQSRKLVQEKSQQDTTVTSKNNSNNSDQNTTLSGVTPFTNSNGDKTNEEKVVTTQPITV

SEQ ID NO: 1850982 - protein, 7 aa, Staphylococcus
FKPDENF

SEQ ID NO: 1850983 - protein, 10 aa, Staphylococcus
FKPDMQELPT

SEQ ID NO: 1850984 - protein, 6 aa, Staphylococcus
FKPSQI

SEQ ID NO: 1850985 - protein, 12 aa, Staphylococcus
FKPTLSDYQGMA

SEQ ID NO: 1850986 - protein, 12 aa, Staphylococcus
FKPYGSAYGHGV

SEQ ID NO: 1850987 - protein, 4 aa, Staphylococcus
FKQT

SEQ ID NO: 1850988 - protein, 18 aa, Staphylococcus
FKSDYESKSTPESQQAYW

SEQ ID NO: 1850989 - protein, 8 aa, Staphylococcus
FKSETDTE

SEQ ID NO: 1850990 - protein, 10 aa, Staphylococcus
FKSKGTIEDY

SEQ ID NO: 1850991 - protein, 14 aa, Staphylococcus
FKSQVPKATIDGKV

SEQ ID NO: 1850992 - protein, 17 aa, Staphylococcus
FKSQVPKATIDGKVGRH

SEQ ID NO: 1850993 - protein, 14 aa, Staphylococcus
FKSVESHPNYLKKY

SEQ ID NO: 1850994 - protein, 14 aa, Staphylococcus
FKSVESHPNYLKNY

SEQ ID NO: 1850995 - protein, 14 aa, Staphylococcus
FKSVESHPNYLQKY

SEQ ID NO: 1850996 - protein, 4 aa, Staphylococcus
FKTN

SEQ ID NO: 1850997 - protein, 21 aa, Staphylococcus
FKTPGREDKMASAKQTAASEL

SEQ ID NO: 1850998 - protein, 6 aa, Staphylococcus
FKTPSE

SEQ ID NO: 1850999 - protein, 6 aa, Staphylococcus
FKTPTH

SEQ ID NO: 1851000 - protein, 18 aa, Staphylococcus
FKTSQVNGANGKNKIPKD

SEQ ID NO: 1851001 - protein, 15 aa, Staphylococcus
FKTTSKKGKNEATGY

SEQ ID NO: 1851002 - protein, 8 aa, Staphylococcus
FKTYGPSL

SEQ ID NO: 1851003 - protein, 5 aa, Staphylococcus
FLGSE

SEQ ID NO: 1851004 - protein, 5 aa, Staphylococcus
FLGSQ

SEQ ID NO: 1851005 - protein, 12 aa, Staphylococcus
FLNKTAKEVGPM

SEQ ID NO: 1851006 - protein, 16 aa, Staphylococcus
FLSGGKDEIAAKKPGM

SEQ ID NO: 1851007 - protein, 20 aa, Staphylococcus
FLSGGKDEIAAKKPGMMTLG

SEQ ID NO: 1851008 - protein, 20 aa, Staphylococcus
FNDPSNNKNWGKLNLKKVIE

SEQ ID NO: 1851009 - protein, 9 aa, Staphylococcus
FNEDKKSTV

SEQ ID NO: 1851010 - protein, 14 aa, Staphylococcus
FNEDQQPKNNYDAA

SEQ ID NO: 1851011 - protein, 9 aa, Staphylococcus
FNEEKKDNV

SEQ ID NO: 1851012 - protein, 9 aa, Staphylococcus
FNEEKKPTC

SEQ ID NO: 1851013 - protein, 19 aa, Staphylococcus
FNEGTKSTAIAAPKHSPKL

SEQ ID NO: 1851014 - protein, 7 aa, Staphylococcus
FNENAKD

SEQ ID NO: 1851015 - protein, 9 aa, Staphylococcus
FNERDLEDY

SEQ ID NO: 1851016 - protein, 6 aa, Staphylococcus
FNETKD

SEQ ID NO: 1851017 - protein, 12 aa, Staphylococcus
FNETYNNKSIKG

SEQ ID NO: 1851018 - protein, 4 aa, Staphylococcus
FNGE

SEQ ID NO: 1851019 - protein, 9 aa, Staphylococcus
FNKDNTTEI

SEQ ID NO: 1851020 - protein, 10 aa, Staphylococcus
FNKNDTPETM

SEQ ID NO: 1851021 - protein, 16 aa, Staphylococcus
FNKNKYGESPKFKGHY

SEQ ID NO: 1851022 - protein, 11 aa, Staphylococcus
FNNTENNKQIE

SEQ ID NO: 1851023 - protein, 11 aa, Staphylococcus
FNPTTNTISGI

SEQ ID NO: 1851024 - protein, 17 aa, Staphylococcus
FNPTTNTISGVATKVGT

SEQ ID NO: 1851025 - protein, 14 aa, Staphylococcus
FNPTYSTDANGGEV

SEQ ID NO: 1851026 - protein, 14 aa, Staphylococcus
FNQHANDIKHEGST

SEQ ID NO: 1851027 - protein, 13 aa, Staphylococcus
FNQKHSEISSQST

SEQ ID NO: 1851028 - protein, 11 aa, Staphylococcus
FNQSEQEMGKA

SEQ ID NO: 1851029 - protein, 14 aa, Staphylococcus
FNRNGASSTARYYG

SEQ ID NO: 1851030 - protein, 4 aa, Staphylococcus
FNRT

SEQ ID NO: 1851031 - protein, 7 aa, Staphylococcus
FNSNDTS

SEQ ID NO: 1851032 - protein, 40 aa, Staphylococcus
FNTHNPQPNFNEAQVGNPDNSHATITTTNGSNKKVTDITP

SEQ ID NO: 1851033 - protein, 8 aa, Staphylococcus
FNTSTAIS

SEQ ID NO: 1851034 - protein, 7 aa, Staphylococcus
FNTTREG

SEQ ID NO: 1851035 - protein, 7 aa, Staphylococcus
FNTTRTG

SEQ ID NO: 1851036 - protein, 4 aa, Staphylococcus
FNYQ

SEQ ID NO: 1851037 - protein, 15 aa, Staphylococcus
FPGKITSESASSARL

SEQ ID NO: 1851038 - protein, 14 aa, Staphylococcus
FPGKVPDHSAESAR

SEQ ID NO: 1851039 - protein, 14 aa, Staphylococcus
FPGKVPDQSPESAR

SEQ ID NO: 1851040 - protein, 4 aa, Staphylococcus
FPGQ

SEQ ID NO: 1851041 - protein, 5 aa, Staphylococcus
FPKGA

SEQ ID NO: 1851042 - protein, 6 aa, Staphylococcus
FPKTRR

SEQ ID NO: 1851043 - protein, 5 aa, Staphylococcus
FPNGA

SEQ ID NO: 1851044 - protein, 5 aa, Staphylococcus
FPNGP

SEQ ID NO: 1851045 - protein, 9 aa, Staphylococcus
FPPQEGPTA

SEQ ID NO: 1851046 - protein, 6 aa, Staphylococcus
FPSGHA

SEQ ID NO: 1851047 - protein, 14 aa, Staphylococcus
FPSKEKNEETSQIG

SEQ ID NO: 1851048 - protein, 14 aa, Staphylococcus
FPSKEKNEETSRIG

SEQ ID NO: 1851049 - protein, 8 aa, Staphylococcus
FPSNKSAK

SEQ ID NO: 1851050 - protein, 15 aa, Staphylococcus
FPTEEQNEKTRLKEE

SEQ ID NO: 1851051 - protein, 20 aa, Staphylococcus
FPTNQAAKTVGMTSPSTDKG

SEQ ID NO: 1851052 - protein, 15 aa, Staphylococcus
FPTTSTFNSDAPAKY

SEQ ID NO: 1851053 - protein, 4 aa, Staphylococcus
FQDI

SEQ ID NO: 1851054 - protein, 4 aa, Staphylococcus
FQFT

SEQ ID NO: 1851055 - protein, 5 aa, Staphylococcus
FQGDA

SEQ ID NO: 1851056 - protein, 15 aa, Staphylococcus
FQNQAKQQHATEHTQ

SEQ ID NO: 1851057 - protein, 9 aa, Staphylococcus
FQNTTTQIG

SEQ ID NO: 1851058 - protein, 7 aa, Staphylococcus
FQQSSGA

SEQ ID NO: 1851059 - protein, 8 aa, Staphylococcus
FQSETDTE

SEQ ID NO: 1851060 - protein, 7 aa, Staphylococcus
FQSNSGE

SEQ ID NO: 1851061 - protein, 9 aa, Staphylococcus
FQTANNNAT

SEQ ID NO: 1851062 - protein, 12 aa, Staphylococcus
FQTGDGAVHGVT

SEQ ID NO: 1851063 - protein, 13 aa, Staphylococcus
FQTGHDAVKGITG

SEQ ID NO: 1851064 - protein, 14 aa, Staphylococcus
FQTGQDAIKGITGR

SEQ ID NO: 1851065 - protein, 6 aa, Staphylococcus
FQYDNQ

SEQ ID NO: 1851066 - protein, 4 aa, Staphylococcus
FREQ

SEQ ID NO: 1851067 - protein, 8 aa, Staphylococcus
FRKGENGL

SEQ ID NO: 1851068 - protein, 9 aa, Staphylococcus
FRKKGGQVE

SEQ ID NO: 1851069 - protein, 11 aa, Staphylococcus
FRNKGGKAEAF

SEQ ID NO: 1851070 - protein, 5 aa, Staphylococcus
FSANE

SEQ ID NO: 1851071 - protein, 5 aa, Staphylococcus
FSAPQ

SEQ ID NO: 1851072 - protein, 21 aa, Staphylococcus
FSATQEEKDKASQFVNEEAQK

SEQ ID NO: 1851073 - protein, 12 aa, Staphylococcus
FSAYGSAYGHGV

SEQ ID NO: 1851074 - protein, 12 aa, Staphylococcus
FSDDRKTNISKN

SEQ ID NO: 1851075 - protein, 29 aa, Staphylococcus
FSDGSSVTIPKGDKGDKGDDGTSVTITGT

SEQ ID NO: 1851076 - protein, 10 aa, Staphylococcus
FSEGKTETPL

SEQ ID NO: 1851077 - protein, 7 aa, Staphylococcus
FSEPDKD

SEQ ID NO: 1851078 - protein, 6 aa, Staphylococcus
FSETEL

SEQ ID NO: 1851079 - protein, 4 aa, Staphylococcus
FSGD

SEQ ID NO: 1851080 - protein, 6 aa, Staphylococcus
FSGDQA

SEQ ID NO: 1851081 - protein, 7 aa, Staphylococcus
FSGETLR

SEQ ID NO: 1851082 - protein, 8 aa, Staphylococcus
FSGGSRYM

SEQ ID NO: 1851083 - protein, 8 aa, Staphylococcus
FSGQATTA

SEQ ID NO: 1851084 - protein, 11 aa, Staphylococcus
FSGSKSKQKLE

SEQ ID NO: 1851085 - protein, 7 aa, Staphylococcus
FSGTELP

SEQ ID NO: 1851086 - protein, 8 aa, Staphylococcus
FSGTNEAN

SEQ ID NO: 1851087 - protein, 15 aa, Staphylococcus
FSKASSAQKFEEQLK

SEQ ID NO: 1851088 - protein, 17 aa, Staphylococcus
FSKEDKPTYRTKNKEPL

SEQ ID NO: 1851089 - protein, 10 aa, Staphylococcus
FSKTNKNGVP

SEQ ID NO: 1851090 - protein, 9 aa, Staphylococcus
FSNANENTL

SEQ ID NO: 1851091 - protein, 4 aa, Staphylococcus
FSNE

SEQ ID NO: 1851092 - protein, 4 aa, Staphylococcus
FSNI

SEQ ID NO: 1851093 - protein, 6 aa, Staphylococcus
FSNPKA

SEQ ID NO: 1851094 - protein, 15 aa, Staphylococcus
FSNTDKSLGGPQQIY

SEQ ID NO: 1851095 - protein, 5 aa, Staphylococcus
FSPAT

SEQ ID NO: 1851096 - protein, 10 aa, Staphylococcus
FSPEKQASHI

SEQ ID NO: 1851097 - protein, 10 aa, Staphylococcus
FSPESQADNI

SEQ ID NO: 1851098 - protein, 10 aa, Staphylococcus
FSPQSSIESA

SEQ ID NO: 1851099 - protein, 9 aa, Staphylococcus
FSPTGSPVN

SEQ ID NO: 1851100 - protein, 24 aa, Staphylococcus
FSPYAKKAIEADSKAESKQYYSQG

SEQ ID NO: 1851101 - protein, 55 aa, Staphylococcus
FSQAASAKIKQQRIKAQEKKQQRSEEKQQQLLENGQQDSEVKDVSDLPEITGNND

SEQ ID NO: 1851102 - protein, 5 aa, Staphylococcus
FSQSD

SEQ ID NO: 1851103 - protein, 8 aa, Staphylococcus
FSQSKRAK

SEQ ID NO: 1851104 - protein, 15 aa, Staphylococcus
FSQTTEDMGGVKSTV

SEQ ID NO: 1851105 - protein, 10 aa, Staphylococcus
FSSEAGTGYH

SEQ ID NO: 1851106 - protein, 8 aa, Staphylococcus
FSSGGDSF

SEQ ID NO: 1851107 - protein, 26 aa, Staphylococcus
FSSGSRVDVESNHSLSQAKVEKTMKD

SEQ ID NO: 1851108 - protein, 8 aa, Staphylococcus
FSSHPSRK

SEQ ID NO: 1851109 - protein, 6 aa, Staphylococcus
FSSKGI

SEQ ID NO: 1851110 - protein, 14 aa, Staphylococcus
FSSNLKSGKDTPGL

SEQ ID NO: 1851111 - protein, 8 aa, Staphylococcus
FSSSEAGR

SEQ ID NO: 1851112 - protein, 7 aa, Staphylococcus
FSSTPKY

SEQ ID NO: 1851113 - protein, 8 aa, Staphylococcus
FSSTTSEI

SEQ ID NO: 1851114 - protein, 9 aa, Staphylococcus
FSTETKKAI

SEQ ID NO: 1851115 - protein, 8 aa, Staphylococcus
FSTGGEYA

SEQ ID NO: 1851116 - protein, 11 aa, Staphylococcus
FSTKGENRGLG

SEQ ID NO: 1851117 - protein, 7 aa, Staphylococcus
FSTNEPV

SEQ ID NO: 1851118 - protein, 5 aa, Staphylococcus
FSTPE

SEQ ID NO: 1851119 - protein, 5 aa, Staphylococcus
FSTQE

SEQ ID NO: 1851120 - protein, 7 aa, Staphylococcus
FSTSEPV

SEQ ID NO: 1851121 - protein, 14 aa, Staphylococcus
FSTTTEKMGGVAST

SEQ ID NO: 1851122 - protein, 14 aa, Staphylococcus
FSTTTEKMGGVEST

SEQ ID NO: 1851123 - protein, 14 aa, Staphylococcus
FSTTTEKMGGVTST

SEQ ID NO: 1851124 - protein, 21 aa, Staphylococcus
FSYEDSSNLSEKTTAQLEEED

SEQ ID NO: 1851125 - protein, 21 aa, Staphylococcus
FSYEDSSVLSEKTTAQLEEED

SEQ ID NO: 1851126 - protein, 11 aa, Staphylococcus
FSYPSGHSNAS

SEQ ID NO: 1851127 - protein, 9 aa, Staphylococcus
FTAHQGDGY

SEQ ID NO: 1851128 - protein, 25 aa, Staphylococcus
FTDTSNGAVIPTNQTVSEMNQAGKI

SEQ ID NO: 1851129 - protein, 13 aa, Staphylococcus
FTEQKQAEAFENK

SEQ ID NO: 1851130 - protein, 5 aa, Staphylococcus
FTETQ

SEQ ID NO: 1851131 - protein, 4 aa, Staphylococcus
FTFT

SEQ ID NO: 1851132 - protein, 4 aa, Staphylococcus
FTGD

SEQ ID NO: 1851133 - protein, 5 aa, Staphylococcus
FTGDT

SEQ ID NO: 1851134 - protein, 7 aa, Staphylococcus
FTHRSGD

SEQ ID NO: 1851135 - protein, 13 aa, Staphylococcus
FTIKSSPKGIEAM

SEQ ID NO: 1851136 - protein, 11 aa, Staphylococcus
FTKNDNRKRKP

SEQ ID NO: 1851137 - protein, 11 aa, Staphylococcus
FTKNDNSKRKS

SEQ ID NO: 1851138 - protein, 11 aa, Staphylococcus
FTKNDNTKRKA

SEQ ID NO: 1851139 - protein, 11 aa, Staphylococcus
FTKNDNTKRQP

SEQ ID NO: 1851140 - protein, 10 aa, Staphylococcus
FTKPKGTSGY

SEQ ID NO: 1851141 - protein, 6 aa, Staphylococcus
FTKPNH

SEQ ID NO: 1851142 - protein, 5 aa, Staphylococcus
FTKQD

SEQ ID NO: 1851143 - protein, 4 aa, Staphylococcus
FTNK

SEQ ID NO: 1851144 - protein, 8 aa, Staphylococcus
FTNPSGAN

SEQ ID NO: 1851145 - protein, 4 aa, Staphylococcus
FTPA

SEQ ID NO: 1851146 - protein, 6 aa, Staphylococcus
FTPPNT

SEQ ID NO: 1851147 - protein, 40 aa, Staphylococcus
FTPPTKEVTVKPKEDTKYEFKDDGRNKKVVAEADKETTIG

SEQ ID NO: 1851148 - protein, 42 aa, Staphylococcus
FTPQLQTPEISGISQGIKGLKDSIQGDLNASYNVKAEPTTNT

SEQ ID NO: 1851149 - protein, 6 aa, Staphylococcus
FTPSQI

SEQ ID NO: 1851150 - protein, 13 aa, Staphylococcus
FTQDRNKTAIASL

SEQ ID NO: 1851151 - protein, 29 aa, Staphylococcus
FTQHAHKGQKEINKSKAGVTGGTGSPLGD

SEQ ID NO: 1851152 - protein, 22 aa, Staphylococcus
FTQNNAKIDGVKTMDTAKPIQD

SEQ ID NO: 1851153 - protein, 6 aa, Staphylococcus
FTSGKQ

SEQ ID NO: 1851154 - protein, 7 aa, Staphylococcus
FTSGKQM

SEQ ID NO: 1851155 - protein, 6 aa, Staphylococcus
FTSGQA

SEQ ID NO: 1851156 - protein, 10 aa, Staphylococcus
FTSKTAQRQA

SEQ ID NO: 1851157 - protein, 7 aa, Staphylococcus
FTSNQSG

SEQ ID NO: 1851158 - protein, 15 aa, Staphylococcus
FTSSENKKKQKQKMR

SEQ ID NO: 1851159 - protein, 7 aa, Staphylococcus
FTSSQHI

SEQ ID NO: 1851160 - protein, 14 aa, Staphylococcus
FTSTSNRNNTISSG

SEQ ID NO: 1851161 - protein, 8 aa, Staphylococcus
FTTGSVNN

SEQ ID NO: 1851162 - protein, 6 aa, Staphylococcus
FTTGTV

SEQ ID NO: 1851163 - protein, 28 aa, Staphylococcus
FTVKESPKEINAQSDDNFVNKNDTDSGV

SEQ ID NO: 1851164 - protein, 4 aa, Staphylococcus
FVDT

SEQ ID NO: 1851165 - protein, 10 aa, Staphylococcus
FVPQSRPGQN

SEQ ID NO: 1851166 - protein, 14 aa, Staphylococcus
FVTTDNAKVDGEQI

SEQ ID NO: 1851167 - protein, 11 aa, Staphylococcus
FYPTQKEQKRL

SEQ ID NO: 1851168 - protein, 4 aa, Staphylococcus
GAAF

SEQ ID NO: 1851169 - protein, 8 aa, Staphylococcus
GAAGDREP

SEQ ID NO: 1851170 - protein, 10 aa, Staphylococcus
GAANKTDPTR

SEQ ID NO: 1851171 - protein, 8 aa, Staphylococcus
GAASEREP

SEQ ID NO: 1851172 - protein, 9 aa, Staphylococcus
GAASSSEEL

SEQ ID NO: 1851173 - protein, 5 aa, Staphylococcus
GAATS

SEQ ID NO: 1851174 - protein, 7 aa, Staphylococcus
GADADYR

SEQ ID NO: 1851175 - protein, 6 aa, Staphylococcus
GADKSN

SEQ ID NO: 1851176 - protein, 8 aa, Staphylococcus
GADNEEPE

SEQ ID NO: 1851177 - protein, 6 aa, Staphylococcus
GADPNN

SEQ ID NO: 1851178 - protein, 5 aa, Staphylococcus
GADVA

SEQ ID NO: 1851179 - protein, 7 aa, Staphylococcus
GAEISRI

SEQ ID NO: 1851180 - protein, 7 aa, Staphylococcus
GAETQSA

SEQ ID NO: 1851181 - protein, 7 aa, Staphylococcus
GAETQTA

SEQ ID NO: 1851182 - protein, 11 aa, Staphylococcus
GAFNPDDNSLT

SEQ ID NO: 1851183 - protein, 5 aa, Staphylococcus
GAGAT

SEQ ID NO: 1851184 - protein, 7 aa, Staphylococcus
GAGATLI

SEQ ID NO: 1851185 - protein, 4 aa, Staphylococcus
GAGG

SEQ ID NO: 1851186 - protein, 5 aa, Staphylococcus
GAGGL

SEQ ID NO: 1851187 - protein, 9 aa, Staphylococcus
GAGGSIGSE

SEQ ID NO: 1851188 - protein, 5 aa, Staphylococcus
GAGHS

SEQ ID NO: 1851189 - protein, 5 aa, Staphylococcus
GAGIK

SEQ ID NO: 1851190 - protein, 10 aa, Staphylococcus
GAGLNNDSQI

SEQ ID NO: 1851191 - protein, 9 aa, Staphylococcus
GAGTTDSSG

SEQ ID NO: 1851192 - protein, 5 aa, Staphylococcus
GAGYN

SEQ ID NO: 1851193 - protein, 6 aa, Staphylococcus
GAGYNG

SEQ ID NO: 1851194 - protein, 6 aa, Staphylococcus
GAHLPE

SEQ ID NO: 1851195 - protein, 9 aa, Staphylococcus
GAIHDAGPL

SEQ ID NO: 1851196 - protein, 9 aa, Staphylococcus
GAINGSGTI

SEQ ID NO: 1851197 - protein, 4 aa, Staphylococcus
GAIS

SEQ ID NO: 1851198 - protein, 5 aa, Staphylococcus
GAISG

SEQ ID NO: 1851199 - protein, 6 aa, Staphylococcus
GAISGV

SEQ ID NO: 1851200 - protein, 8 aa, Staphylococcus
GAITAEEK

SEQ ID NO: 1851201 - protein, 6 aa, Staphylococcus
GAITAG

SEQ ID NO: 1851202 - protein, 8 aa, Staphylococcus
GAKATVPH

SEQ ID NO: 1851203 - protein, 10 aa, Staphylococcus
GAKDSSGEYV

SEQ ID NO: 1851204 - protein, 14 aa, Staphylococcus
GAKELSQAAKQPEY

SEQ ID NO: 1851205 - protein, 6 aa, Staphylococcus
GAKGRD

SEQ ID NO: 1851206 - protein, 32 aa, Staphylococcus
GAKKGNSKFKNNPNLLSDTTSHLNQAKQLDKN

SEQ ID NO: 1851207 - protein, 9 aa, Staphylococcus
GAKNDENSL

SEQ ID NO: 1851208 - protein, 9 aa, Staphylococcus
GAKNDEQSL

SEQ ID NO: 1851209 - protein, 7 aa, Staphylococcus
GAKSPLE

SEQ ID NO: 1851210 - protein, 25 aa, Staphylococcus
GAKTGTSTYGTEVNNQYNLPDNAAK

SEQ ID NO: 1851211 - protein, 15 aa, Staphylococcus
GAKTSQSASEVAKGM

SEQ ID NO: 1851212 - protein, 6 aa, Staphylococcus
GAMPPK

SEQ ID NO: 1851213 - protein, 11 aa, Staphylococcus
GANASTPFENP

SEQ ID NO: 1851214 - protein, 5 aa, Staphylococcus
GANKK

SEQ ID NO: 1851215 - protein, 6 aa, Staphylococcus
GANQKK

SEQ ID NO: 1851216 - protein, 7 aa, Staphylococcus
GANQKKL

SEQ ID NO: 1851217 - protein, 8 aa, Staphylococcus
GANQKKLT

SEQ ID NO: 1851218 - protein, 6 aa, Staphylococcus
GANQSK

SEQ ID NO: 1851219 - protein, 8 aa, Staphylococcus
GANQTEPK

SEQ ID NO: 1851220 - protein, 11 aa, Staphylococcus
GANSSTPFENP

SEQ ID NO: 1851221 - protein, 6 aa, Staphylococcus
GAPIPE

SEQ ID NO: 1851222 - protein, 4 aa, Staphylococcus
GAPP

SEQ ID NO: 1851223 - protein, 4 aa, Staphylococcus
GAPQ

SEQ ID NO: 1851224 - protein, 5 aa, Staphylococcus
GAPVK

SEQ ID NO: 1851225 - protein, 4 aa, Staphylococcus
GAQS

SEQ ID NO: 1851226 - protein, 8 aa, Staphylococcus
GAQTEIDD

SEQ ID NO: 1851227 - protein, 4 aa, Staphylococcus
GASA

SEQ ID NO: 1851228 - protein, 8 aa, Staphylococcus
GASEEEVT

SEQ ID NO: 1851229 - protein, 5 aa, Staphylococcus
GASEI

SEQ ID NO: 1851230 - protein, 8 aa, Staphylococcus
GASGAGSV

SEQ ID NO: 1851231 - protein, 9 aa, Staphylococcus
GASGDGNDF

SEQ ID NO: 1851232 - protein, 7 aa, Staphylococcus
GASGETV

SEQ ID NO: 1851233 - protein, 9 aa, Staphylococcus
GASGFGTPA

SEQ ID NO: 1851234 - protein, 67 aa, Staphylococcus
GASKLSDSSEKVKINDREMSYSNSKEYGPYPKTKDITISATGKAKGRKFSSETKTISADDLKNNTTV

SEQ ID NO: 1851235 - protein, 10 aa, Staphylococcus
GASKLTDKSK

SEQ ID NO: 1851236 - protein, 6 aa, Staphylococcus
GASKYR

SEQ ID NO: 1851237 - protein, 21 aa, Staphylococcus
GASLSLPGTDGLKTGSSDIAN

SEQ ID NO: 1851238 - protein, 7 aa, Staphylococcus
GASNQTI

SEQ ID NO: 1851239 - protein, 13 aa, Staphylococcus
GASNRAKGVKWST

SEQ ID NO: 1851240 - protein, 11 aa, Staphylococcus
GASNRAKGVRW

SEQ ID NO: 1851241 - protein, 15 aa, Staphylococcus
GASPAMSEAPEEAKE

SEQ ID NO: 1851242 - protein, 15 aa, Staphylococcus
GASPKLASKSAVQES

SEQ ID NO: 1851243 - protein, 15 aa, Staphylococcus
GASPTMSEAPQEAED

SEQ ID NO: 1851244 - protein, 14 aa, Staphylococcus
GASSGVIDLLKFAM

SEQ ID NO: 1851245 - protein, 10 aa, Staphylococcus
GASSLNPTKQ

SEQ ID NO: 1851246 - protein, 5 aa, Staphylococcus
GASSS

SEQ ID NO: 1851247 - protein, 7 aa, Staphylococcus
GASSTQP

SEQ ID NO: 1851248 - protein, 6 aa, Staphylococcus
GASTYR

SEQ ID NO: 1851249 - protein, 10 aa, Staphylococcus
GASVENEDKI

SEQ ID NO: 1851250 - protein, 5 aa, Staphylococcus
GASVG

SEQ ID NO: 1851251 - protein, 4 aa, Staphylococcus
GATA

SEQ ID NO: 1851252 - protein, 9 aa, Staphylococcus
GATATSPKV

SEQ ID NO: 1851253 - protein, 8 aa, Staphylococcus
GATDNISN

SEQ ID NO: 1851254 - protein, 7 aa, Staphylococcus
GATGGVG

SEQ ID NO: 1851255 - protein, 6 aa, Staphylococcus
GATGKN

SEQ ID NO: 1851256 - protein, 4 aa, Staphylococcus
GATI

SEQ ID NO: 1851257 - protein, 15 aa, Staphylococcus
GATKLGTSYISTGED

SEQ ID NO: 1851258 - protein, 7 aa, Staphylococcus
GATKWES

SEQ ID NO: 1851259 - protein, 5 aa, Staphylococcus
GATLS

SEQ ID NO: 1851260 - protein, 4 aa, Staphylococcus
GATM

SEQ ID NO: 1851261 - protein, 9 aa, Staphylococcus
GATPGIGSS

SEQ ID NO: 1851262 - protein, 10 aa, Staphylococcus
GATPYRNDPH

SEQ ID NO: 1851263 - protein, 10 aa, Staphylococcus
GATRKKTPNE

SEQ ID NO: 1851264 - protein, 15 aa, Staphylococcus
GATTLGTSYISSGDN

SEQ ID NO: 1851265 - protein, 8 aa, Staphylococcus
GAVKNDGK

SEQ ID NO: 1851266 - protein, 15 aa, Staphylococcus
GAVKSDLSKGVEIDG

SEQ ID NO: 1851267 - protein, 12 aa, Staphylococcus
GAVTSVGDNNPY

SEQ ID NO: 1851268 - protein, 8 aa, Staphylococcus
GAYGNSAS

SEQ ID NO: 1851269 - protein, 8 aa, Staphylococcus
GAYGNTSS

SEQ ID NO: 1851270 - protein, 9 aa, Staphylococcus
GDAANTKRP

SEQ ID NO: 1851271 - protein, 12 aa, Staphylococcus
GDASGQDANGMP

SEQ ID NO: 1851272 - protein, 7 aa, Staphylococcus
GDATFGS

SEQ ID NO: 1851273 - protein, 6 aa, Staphylococcus
GDDARW

SEQ ID NO: 1851274 - protein, 99 aa, Staphylococcus
GDDDTEETATVSTPSEDSEKGTTSSEMKNDIEQTPTSTPTSENQSEANYQPEQHEADNNLETATEVQETPSEQTADSDNTKPEQHNNDTDSKNNRQSSV

SEQ ID NO: 1851275 - protein, 4 aa, Staphylococcus
GDDI

SEQ ID NO: 1851276 - protein, 8 aa, Staphylococcus
GDDNEEPE

SEQ ID NO: 1851277 - protein, 8 aa, Staphylococcus
GDDTPELK

SEQ ID NO: 1851278 - protein, 23 aa, Staphylococcus
GDDVKAGDTIALSGNTGEQTTGA

SEQ ID NO: 1851279 - protein, 5 aa, Staphylococcus
GDEAD

SEQ ID NO: 1851280 - protein, 8 aa, Staphylococcus
GDEDDKAL

SEQ ID NO: 1851281 - protein, 10 aa, Staphylococcus
GDEDEKGFQE

SEQ ID NO: 1851282 - protein, 9 aa, Staphylococcus
GDEDTGQIT

SEQ ID NO: 1851283 - protein, 4 aa, Staphylococcus
GDEV

SEQ ID NO: 1851284 - protein, 4 aa, Staphylococcus
GDFG

SEQ ID NO: 1851285 - protein, 32 aa, Staphylococcus
GDFHQDKKVAQKVKAVTKDIKQNVHSDTPKIY

SEQ ID NO: 1851286 - protein, 4 aa, Staphylococcus
GDFN

SEQ ID NO: 1851287 - protein, 5 aa, Staphylococcus
GDFNE

SEQ ID NO: 1851288 - protein, 22 aa, Staphylococcus
GDFSKESTSPNYGEPHKAPRSF

SEQ ID NO: 1851289 - protein, 22 aa, Staphylococcus
GDFSKSPSSPNYGDKHKAPRSF

SEQ ID NO: 1851290 - protein, 6 aa, Staphylococcus
GDGDQI

SEQ ID NO: 1851291 - protein, 5 aa, Staphylococcus
GDGFF

SEQ ID NO: 1851292 - protein, 6 aa, Staphylococcus
GDGGGK

SEQ ID NO: 1851293 - protein, 4 aa, Staphylococcus
GDGM

SEQ ID NO: 1851294 - protein, 9 aa, Staphylococcus
GDGTLQEAV

SEQ ID NO: 1851295 - protein, 17 aa, Staphylococcus
GDGTLQESIDKPRFYND

SEQ ID NO: 1851296 - protein, 19 aa, Staphylococcus
GDGTLQESIDKPRFYNDGG

SEQ ID NO: 1851297 - protein, 12 aa, Staphylococcus
GDGTNDAPALAE

SEQ ID NO: 1851298 - protein, 7 aa, Staphylococcus
GDGTNYA

SEQ ID NO: 1851299 - protein, 6 aa, Staphylococcus
GDHQKE

SEQ ID NO: 1851300 - protein, 4 aa, Staphylococcus
GDIE

SEQ ID NO: 1851301 - protein, 16 aa, Staphylococcus
GDIKNASASANANITH

SEQ ID NO: 1851302 - protein, 9 aa, Staphylococcus
GDIKYGTQS

SEQ ID NO: 1851303 - protein, 7 aa, Staphylococcus
GDIQPHM

SEQ ID NO: 1851304 - protein, 5 aa, Staphylococcus
GDITI

SEQ ID NO: 1851305 - protein, 9 aa, Staphylococcus
GDITYGGNS

SEQ ID NO: 1851306 - protein, 8 aa, Staphylococcus
GDITYGNK

SEQ ID NO: 1851307 - protein, 7 aa, Staphylococcus
GDITYNG

SEQ ID NO: 1851308 - protein, 8 aa, Staphylococcus
GDKDETCL

SEQ ID NO: 1851309 - protein, 8 aa, Staphylococcus
GDKDQKDI

SEQ ID NO: 1851310 - protein, 6 aa, Staphylococcus
GDKDTL

SEQ ID NO: 1851311 - protein, 19 aa, Staphylococcus
GDKEGTYRGRNSNFNGEGF

SEQ ID NO: 1851312 - protein, 7 aa, Staphylococcus
GDKGGTL

SEQ ID NO: 1851313 - protein, 12 aa, Staphylococcus
GDKNDYYEKNLF

SEQ ID NO: 1851314 - protein, 7 aa, Staphylococcus
GDKRQRA

SEQ ID NO: 1851315 - protein, 16 aa, Staphylococcus
GDKSHYREGVKTSLNK

SEQ ID NO: 1851316 - protein, 17 aa, Staphylococcus
GDKSQYREGVKTSLSKN

SEQ ID NO: 1851317 - protein, 26 aa, Staphylococcus
GDKVKGLAPSRAQLSQVTGTLKNHEV

SEQ ID NO: 1851318 - protein, 16 aa, Staphylococcus
GDLGTSFSNGEPVTDR

SEQ ID NO: 1851319 - protein, 21 aa, Staphylococcus
GDLHGEQKLQKAQQDANNEID

SEQ ID NO: 1851320 - protein, 8 aa, Staphylococcus
GDLKQNLS

SEQ ID NO: 1851321 - protein, 5 aa, Staphylococcus
GDLLD

SEQ ID NO: 1851322 - protein, 10 aa, Staphylococcus
GDLNDTERKA

SEQ ID NO: 1851323 - protein, 13 aa, Staphylococcus
GDLNSNKQESIKR

SEQ ID NO: 1851324 - protein, 14 aa, Staphylococcus
GDLQSKLNTKYTPT

SEQ ID NO: 1851325 - protein, 20 aa, Staphylococcus
GDLSDSERQQFDLPSSVKQG

SEQ ID NO: 1851326 - protein, 9 aa, Staphylococcus
GDNAPQGVA

SEQ ID NO: 1851327 - protein, 10 aa, Staphylococcus
GDNDEAPEFS

SEQ ID NO: 1851328 - protein, 7 aa, Staphylococcus
GDNDEVA

SEQ ID NO: 1851329 - protein, 12 aa, Staphylococcus
GDNEGKPFSRTD

SEQ ID NO: 1851330 - protein, 9 aa, Staphylococcus
GDNEHTAKA

SEQ ID NO: 1851331 - protein, 8 aa, Staphylococcus
GDNELTAA

SEQ ID NO: 1851332 - protein, 10 aa, Staphylococcus
GDNERTAKAI

SEQ ID NO: 1851333 - protein, 10 aa, Staphylococcus
GDNERTAQAI

SEQ ID NO: 1851334 - protein, 17 aa, Staphylococcus
GDNGMQTTPSKHDTANY

SEQ ID NO: 1851335 - protein, 8 aa, Staphylococcus
GDNGSNIY

SEQ ID NO: 1851336 - protein, 10 aa, Staphylococcus
GDNHSTAQAI

SEQ ID NO: 1851337 - protein, 10 aa, Staphylococcus
GDNKEVAENV

SEQ ID NO: 1851338 - protein, 9 aa, Staphylococcus
GDNKEVAKA

SEQ ID NO: 1851339 - protein, 9 aa, Staphylococcus
GDNKGTAHK

SEQ ID NO: 1851340 - protein, 10 aa, Staphylococcus
GDNKQTAQAI

SEQ ID NO: 1851341 - protein, 10 aa, Staphylococcus
GDNKRTAQAI

SEQ ID NO: 1851342 - protein, 15 aa, Staphylococcus
GDNKSSKSKSSDDDD

SEQ ID NO: 1851343 - protein, 8 aa, Staphylococcus
GDNLNSIT

SEQ ID NO: 1851344 - protein, 9 aa, Staphylococcus
GDNNNTARA

SEQ ID NO: 1851345 - protein, 11 aa, Staphylococcus
GDNQGTANAIG

SEQ ID NO: 1851346 - protein, 27 aa, Staphylococcus
GDNSIKVNTQKDSLNVKESRSSKRGYS

SEQ ID NO: 1851347 - protein, 7 aa, Staphylococcus
GDNYNRK

SEQ ID NO: 1851348 - protein, 6 aa, Staphylococcus
GDPDVT

SEQ ID NO: 1851349 - protein, 4 aa, Staphylococcus
GDPK

SEQ ID NO: 1851350 - protein, 6 aa, Staphylococcus
GDPSQI

SEQ ID NO: 1851351 - protein, 5 aa, Staphylococcus
GDPSV

SEQ ID NO: 1851352 - protein, 8 aa, Staphylococcus
GDPTENTY

SEQ ID NO: 1851353 - protein, 4 aa, Staphylococcus
GDPV

SEQ ID NO: 1851354 - protein, 6 aa, Staphylococcus
GDPVKI

SEQ ID NO: 1851355 - protein, 6 aa, Staphylococcus
GDQAQG

SEQ ID NO: 1851356 - protein, 16 aa, Staphylococcus
GDQSGQSHKSETKNYE

SEQ ID NO: 1851357 - protein, 5 aa, Staphylococcus
GDQTD

SEQ ID NO: 1851358 - protein, 15 aa, Staphylococcus
GDRDVQGGSTITQQT

SEQ ID NO: 1851359 - protein, 7 aa, Staphylococcus
GDRKTTI

SEQ ID NO: 1851360 - protein, 7 aa, Staphylococcus
GDRLGYS

SEQ ID NO: 1851361 - protein, 6 aa, Staphylococcus
GDRVPL

SEQ ID NO: 1851362 - protein, 25 aa, Staphylococcus
GDSAGAQLSSQYTAMQTNKSLRDNM

SEQ ID NO: 1851363 - protein, 9 aa, Staphylococcus
GDSAGAQLT

SEQ ID NO: 1851364 - protein, 10 aa, Staphylococcus
GDSAPQGVAV

SEQ ID NO: 1851365 - protein, 9 aa, Staphylococcus
GDSAYQDED

SEQ ID NO: 1851366 - protein, 18 aa, Staphylococcus
GDSDGEERAKKELNEKGL

SEQ ID NO: 1851367 - protein, 5 aa, Staphylococcus
GDSPY

SEQ ID NO: 1851368 - protein, 5 aa, Staphylococcus
GDSRT

SEQ ID NO: 1851369 - protein, 4 aa, Staphylococcus
GDSV

SEQ ID NO: 1851370 - protein, 24 aa, Staphylococcus
GDTEKDMRDQVKQDHQKIDENDNQ

SEQ ID NO: 1851371 - protein, 9 aa, Staphylococcus
GDTGAIDTD

SEQ ID NO: 1851372 - protein, 8 aa, Staphylococcus
GDTGLNSL

SEQ ID NO: 1851373 - protein, 8 aa, Staphylococcus
GDTGLSAL

SEQ ID NO: 1851374 - protein, 10 aa, Staphylococcus
GDTHANTSLT

SEQ ID NO: 1851375 - protein, 6 aa, Staphylococcus
GDTHHN

SEQ ID NO: 1851376 - protein, 14 aa, Staphylococcus
GDTIAKNANHVLSK

SEQ ID NO: 1851377 - protein, 8 aa, Staphylococcus
GDTKLKED

SEQ ID NO: 1851378 - protein, 11 aa, Staphylococcus
GDTNEKTGALE

SEQ ID NO: 1851379 - protein, 7 aa, Staphylococcus
GDTNHNL

SEQ ID NO: 1851380 - protein, 8 aa, Staphylococcus
GDTQYRPP

SEQ ID NO: 1851381 - protein, 7 aa, Staphylococcus
GDTSHNI

SEQ ID NO: 1851382 - protein, 7 aa, Staphylococcus
GDTSHNL

SEQ ID NO: 1851383 - protein, 9 aa, Staphylococcus
GDTSKIKDY

SEQ ID NO: 1851384 - protein, 13 aa, Staphylococcus
GDTSQLNSTIKDA

SEQ ID NO: 1851385 - protein, 6 aa, Staphylococcus
GDTSSL

SEQ ID NO: 1851386 - protein, 6 aa, Staphylococcus
GDVKAS

SEQ ID NO: 1851387 - protein, 15 aa, Staphylococcus
GDYHDGAYKRRPTTM

SEQ ID NO: 1851388 - protein, 7 aa, Staphylococcus
GDYIEEH

SEQ ID NO: 1851389 - protein, 5 aa, Staphylococcus
GDYKA

SEQ ID NO: 1851390 - protein, 12 aa, Staphylococcus
GDYKHEPHPTRR

SEQ ID NO: 1851391 - protein, 5 aa, Staphylococcus
GDYNV

SEQ ID NO: 1851392 - protein, 7 aa, Staphylococcus
GDYYQGN

SEQ ID NO: 1851393 - protein, 10 aa, Staphylococcus
GEAAGGLGGV

SEQ ID NO: 1851394 - protein, 9 aa, Staphylococcus
GEAAQPLEK

SEQ ID NO: 1851395 - protein, 7 aa, Staphylococcus
GEAIQAK

SEQ ID NO: 1851396 - protein, 9 aa, Staphylococcus
GEAKSKSLG

SEQ ID NO: 1851397 - protein, 17 aa, Staphylococcus
GEASITNMAEDKAGVSA

SEQ ID NO: 1851398 - protein, 9 aa, Staphylococcus
GEAYKVENN

SEQ ID NO: 1851399 - protein, 10 aa, Staphylococcus
GEDAAKKREK

SEQ ID NO: 1851400 - protein, 7 aa, Staphylococcus
GEDGTTR

SEQ ID NO: 1851401 - protein, 9 aa, Staphylococcus
GEDKAAAHQ

SEQ ID NO: 1851402 - protein, 10 aa, Staphylococcus
GEDKAKAHEK

SEQ ID NO: 1851403 - protein, 11 aa, Staphylococcus
GEDKHTGETLS

SEQ ID NO: 1851404 - protein, 26 aa, Staphylococcus
GEDLREKGHLGAGPNEYEDPDRQQRD

SEQ ID NO: 1851405 - protein, 11 aa, Staphylococcus
GEDPNKVQVTK

SEQ ID NO: 1851406 - protein, 21 aa, Staphylococcus
GEDTTDKVQDADINNNVTDVN

SEQ ID NO: 1851407 - protein, 5 aa, Staphylococcus
GEDVS

SEQ ID NO: 1851408 - protein, 5 aa, Staphylococcus
GEDYT

SEQ ID NO: 1851409 - protein, 10 aa, Staphylococcus
GEEAAKEHEK

SEQ ID NO: 1851410 - protein, 9 aa, Staphylococcus
GEEAAKKHK

SEQ ID NO: 1851411 - protein, 10 aa, Staphylococcus
GEEAAKKHKK

SEQ ID NO: 1851412 - protein, 9 aa, Staphylococcus
GEEDEDESS

SEQ ID NO: 1851413 - protein, 9 aa, Staphylococcus
GEEKAATHQ

SEQ ID NO: 1851414 - protein, 5 aa, Staphylococcus
GEEKK

SEQ ID NO: 1851415 - protein, 10 aa, Staphylococcus
GEEKPRPSNK

SEQ ID NO: 1851416 - protein, 6 aa, Staphylococcus
GEENLA

SEQ ID NO: 1851417 - protein, 17 aa, Staphylococcus
GEENQQSSDEDSEKGTI

SEQ ID NO: 1851418 - protein, 6 aa, Staphylococcus
GEERQK

SEQ ID NO: 1851419 - protein, 7 aa, Staphylococcus
GEFETQN

SEQ ID NO: 1851420 - protein, 4 aa, Staphylococcus
GEFT

SEQ ID NO: 1851421 - protein, 15 aa, Staphylococcus
GEGAQGVDAYKEAGV

SEQ ID NO: 1851422 - protein, 9 aa, Staphylococcus
GEGDSSKSL

SEQ ID NO: 1851423 - protein, 7 aa, Staphylococcus
GEGLPNS

SEQ ID NO: 1851424 - protein, 12 aa, Staphylococcus
GEGNLNAPQKED

SEQ ID NO: 1851425 - protein, 11 aa, Staphylococcus
GEGTPENVEKI

SEQ ID NO: 1851426 - protein, 10 aa, Staphylococcus
GEGTQANVDK

SEQ ID NO: 1851427 - protein, 10 aa, Staphylococcus
GEGTQQNVDK

SEQ ID NO: 1851428 - protein, 5 aa, Staphylococcus
GEHAD

SEQ ID NO: 1851429 - protein, 12 aa, Staphylococcus
GEHADKVITPGT

SEQ ID NO: 1851430 - protein, 11 aa, Staphylococcus
GEHANNVITSG

SEQ ID NO: 1851431 - protein, 5 aa, Staphylococcus
GEHDM

SEQ ID NO: 1851432 - protein, 7 aa, Staphylococcus
GEHYGTN

SEQ ID NO: 1851433 - protein, 14 aa, Staphylococcus
GEIVTGASQHEVTE

SEQ ID NO: 1851434 - protein, 6 aa, Staphylococcus
GEKAAR

SEQ ID NO: 1851435 - protein, 11 aa, Staphylococcus
GEKAPQGVEVT

SEQ ID NO: 1851436 - protein, 17 aa, Staphylococcus
GEKFTDSEAKYAVDHLD

SEQ ID NO: 1851437 - protein, 4 aa, Staphylococcus
GEKI

SEQ ID NO: 1851438 - protein, 6 aa, Staphylococcus
GEKIPV

SEQ ID NO: 1851439 - protein, 7 aa, Staphylococcus
GEKKGRL

SEQ ID NO: 1851440 - protein, 10 aa, Staphylococcus
GEKPEQGQGL

SEQ ID NO: 1851441 - protein, 16 aa, Staphylococcus
GEKPETLDNGKKGISP

SEQ ID NO: 1851442 - protein, 10 aa, Staphylococcus
GEKPKMKYKK

SEQ ID NO: 1851443 - protein, 5 aa, Staphylococcus
GEKPN

SEQ ID NO: 1851444 - protein, 9 aa, Staphylococcus
GEKPSIKYN

SEQ ID NO: 1851445 - protein, 23 aa, Staphylococcus
GEKVDTGATGATGQNGQDGKSIT

SEQ ID NO: 1851446 - protein, 12 aa, Staphylococcus
GELKNPKRDLPG

SEQ ID NO: 1851447 - protein, 12 aa, Staphylococcus
GELKNPRKDLPG

SEQ ID NO: 1851448 - protein, 11 aa, Staphylococcus
GELRATAEVRN

SEQ ID NO: 1851449 - protein, 5 aa, Staphylococcus
GENAK

SEQ ID NO: 1851450 - protein, 10 aa, Staphylococcus
GENAPQGVAV

SEQ ID NO: 1851451 - protein, 11 aa, Staphylococcus
GENAPQGVQVT

SEQ ID NO: 1851452 - protein, 4 aa, Staphylococcus
GEND

SEQ ID NO: 1851453 - protein, 10 aa, Staphylococcus
GENETGKSTI

SEQ ID NO: 1851454 - protein, 14 aa, Staphylococcus
GENGQTLSGGERQR

SEQ ID NO: 1851455 - protein, 10 aa, Staphylococcus
GENKKTEMER

SEQ ID NO: 1851456 - protein, 11 aa, Staphylococcus
GENKYKDTRAI

SEQ ID NO: 1851457 - protein, 4 aa, Staphylococcus
GENL

SEQ ID NO: 1851458 - protein, 6 aa, Staphylococcus
GENNIS

SEQ ID NO: 1851459 - protein, 7 aa, Staphylococcus
GENTYQI

SEQ ID NO: 1851460 - protein, 13 aa, Staphylococcus
GENVEEPELTRSS

SEQ ID NO: 1851461 - protein, 7 aa, Staphylococcus
GENYDKL

SEQ ID NO: 1851462 - protein, 11 aa, Staphylococcus
GEPEKKKMSGI

SEQ ID NO: 1851463 - protein, 9 aa, Staphylococcus
GEPERKYGD

SEQ ID NO: 1851464 - protein, 8 aa, Staphylococcus
GEPGASKT

SEQ ID NO: 1851465 - protein, 9 aa, Staphylococcus
GEPGQSIEI

SEQ ID NO: 1851466 - protein, 9 aa, Staphylococcus
GEPGSSKSL

SEQ ID NO: 1851467 - protein, 9 aa, Staphylococcus
GEPGSSKTL

SEQ ID NO: 1851468 - protein, 5 aa, Staphylococcus
GEPHL

SEQ ID NO: 1851469 - protein, 16 aa, Staphylococcus
GEPKGYDVTNKANTLG

SEQ ID NO: 1851470 - protein, 60 aa, Staphylococcus
GEPVNVSQSKKDKKSSKKHKSESLNSQDDNDLASNNTTSTETRTTKPTDEQIHTSIDERQ

SEQ ID NO: 1851471 - protein, 6 aa, Staphylococcus
GEQAEG

SEQ ID NO: 1851472 - protein, 14 aa, Staphylococcus
GEQEPDTSSKIDAL

SEQ ID NO: 1851473 - protein, 24 aa, Staphylococcus
GEQNSKIYENTSINPEPTIKSKGK

SEQ ID NO: 1851474 - protein, 21 aa, Staphylococcus
GEQPQEDNQENQVEHKDDTEN

SEQ ID NO: 1851475 - protein, 5 aa, Staphylococcus
GEQRS

SEQ ID NO: 1851476 - protein, 15 aa, Staphylococcus
GERDVQGGSTITQQT

SEQ ID NO: 1851477 - protein, 9 aa, Staphylococcus
GERNATTEM

SEQ ID NO: 1851478 - protein, 10 aa, Staphylococcus
GERNGRSEAE

SEQ ID NO: 1851479 - protein, 7 aa, Staphylococcus
GERQPSL

SEQ ID NO: 1851480 - protein, 7 aa, Staphylococcus
GERTTST

SEQ ID NO: 1851481 - protein, 10 aa, Staphylococcus
GESAPQGVAV

SEQ ID NO: 1851482 - protein, 4 aa, Staphylococcus
GESI

SEQ ID NO: 1851483 - protein, 9 aa, Staphylococcus
GESLPIDKT

SEQ ID NO: 1851484 - protein, 11 aa, Staphylococcus
GESLPVDKNIN

SEQ ID NO: 1851485 - protein, 5 aa, Staphylococcus
GESMP

SEQ ID NO: 1851486 - protein, 8 aa, Staphylococcus
GESMPIDK

SEQ ID NO: 1851487 - protein, 5 aa, Staphylococcus
GESMT

SEQ ID NO: 1851488 - protein, 4 aa, Staphylococcus
GEST

SEQ ID NO: 1851489 - protein, 12 aa, Staphylococcus
GESTPIRKSTSY

SEQ ID NO: 1851490 - protein, 6 aa, Staphylococcus
GETAID

SEQ ID NO: 1851491 - protein, 10 aa, Staphylococcus
GETEGGAKGV

SEQ ID NO: 1851492 - protein, 7 aa, Staphylococcus
GETLNYT

SEQ ID NO: 1851493 - protein, 18 aa, Staphylococcus
GETNEHDVVDDENKKSGV

SEQ ID NO: 1851494 - protein, 6 aa, Staphylococcus
GETNKF

SEQ ID NO: 1851495 - protein, 7 aa, Staphylococcus
GETNTVV

SEQ ID NO: 1851496 - protein, 6 aa, Staphylococcus
GETQTE

SEQ ID NO: 1851497 - protein, 6 aa, Staphylococcus
GETTTK

SEQ ID NO: 1851498 - protein, 4 aa, Staphylococcus
GEVK

SEQ ID NO: 1851499 - protein, 17 aa, Staphylococcus
GEVKEKLNNTSVNSKPF

SEQ ID NO: 1851500 - protein, 12 aa, Staphylococcus
GEVKQGDKVILV

SEQ ID NO: 1851501 - protein, 13 aa, Staphylococcus
GEYAREKKDGQTL

SEQ ID NO: 1851502 - protein, 13 aa, Staphylococcus
GEYAREKKGDQTL

SEQ ID NO: 1851503 - protein, 13 aa, Staphylococcus
GEYAREKKSGQTV

SEQ ID NO: 1851504 - protein, 13 aa, Staphylococcus
GEYERHKKGGQTL

SEQ ID NO: 1851505 - protein, 4 aa, Staphylococcus
GEYK

SEQ ID NO: 1851506 - protein, 13 aa, Staphylococcus
GEYKREEKGGQTL

SEQ ID NO: 1851507 - protein, 4 aa, Staphylococcus
GEYN

SEQ ID NO: 1851508 - protein, 5 aa, Staphylococcus
GEYNS

SEQ ID NO: 1851509 - protein, 6 aa, Staphylococcus
GEYNST

SEQ ID NO: 1851510 - protein, 7 aa, Staphylococcus
GEYNSTP

SEQ ID NO: 1851511 - protein, 5 aa, Staphylococcus
GFEKI

SEQ ID NO: 1851512 - protein, 5 aa, Staphylococcus
GFGDA

SEQ ID NO: 1851513 - protein, 5 aa, Staphylococcus
GFGSP

SEQ ID NO: 1851514 - protein, 4 aa, Staphylococcus
GFGT

SEQ ID NO: 1851515 - protein, 5 aa, Staphylococcus
GFIDS

SEQ ID NO: 1851516 - protein, 22 aa, Staphylococcus
GFKKAQAAFSKLNDKTQESVAG

SEQ ID NO: 1851517 - protein, 22 aa, Staphylococcus
GFKKSTTEQFDDAGAGKNQASI

SEQ ID NO: 1851518 - protein, 20 aa, Staphylococcus
GFKKTAAEQFSDSGASKDSA

SEQ ID NO: 1851519 - protein, 19 aa, Staphylococcus
GFKQSTNEQFDDAGAGKNQ

SEQ ID NO: 1851520 - protein, 8 aa, Staphylococcus
GFKTDTGD

SEQ ID NO: 1851521 - protein, 10 aa, Staphylococcus
GFNEEELQQY

SEQ ID NO: 1851522 - protein, 11 aa, Staphylococcus
GFNEKDLEEYR

SEQ ID NO: 1851523 - protein, 9 aa, Staphylococcus
GFNEQDLEE

SEQ ID NO: 1851524 - protein, 8 aa, Staphylococcus
GFNEQELD

SEQ ID NO: 1851525 - protein, 5 aa, Staphylococcus
GFNER

SEQ ID NO: 1851526 - protein, 13 aa, Staphylococcus
GFNTLNKQASTIY

SEQ ID NO: 1851527 - protein, 5 aa, Staphylococcus
GFPER

SEQ ID NO: 1851528 - protein, 6 aa, Staphylococcus
GFSKGQ

SEQ ID NO: 1851529 - protein, 6 aa, Staphylococcus
GFSSNE

SEQ ID NO: 1851530 - protein, 4 aa, Staphylococcus
GFTN

SEQ ID NO: 1851531 - protein, 15 aa, Staphylococcus
GFVSTDNAKVDGEQI

SEQ ID NO: 1851532 - protein, 7 aa, Staphylococcus
GGAAYEA

SEQ ID NO: 1851533 - protein, 9 aa, Staphylococcus
GGAENVETA

SEQ ID NO: 1851534 - protein, 11 aa, Staphylococcus
GGAGTDTAIET

SEQ ID NO: 1851535 - protein, 15 aa, Staphylococcus
GGAKLGTSYISTGDD

SEQ ID NO: 1851536 - protein, 7 aa, Staphylococcus
GGAQNIT

SEQ ID NO: 1851537 - protein, 9 aa, Staphylococcus
GGASITGKI

SEQ ID NO: 1851538 - protein, 8 aa, Staphylococcus
GGASTINE

SEQ ID NO: 1851539 - protein, 7 aa, Staphylococcus
GGASTIQ

SEQ ID NO: 1851540 - protein, 7 aa, Staphylococcus
GGATNIE

SEQ ID NO: 1851541 - protein, 12 aa, Staphylococcus
GGDASKRHVSGA

SEQ ID NO: 1851542 - protein, 16 aa, Staphylococcus
GGDASKRKISGGGATF

SEQ ID NO: 1851543 - protein, 13 aa, Staphylococcus
GGDASKRQVSGAG

SEQ ID NO: 1851544 - protein, 14 aa, Staphylococcus
GGDASRRKVSGAGA

SEQ ID NO: 1851545 - protein, 13 aa, Staphylococcus
GGDASRRRVSGAG

SEQ ID NO: 1851546 - protein, 6 aa, Staphylococcus
GGDGST

SEQ ID NO: 1851547 - protein, 5 aa, Staphylococcus
GGDIK

SEQ ID NO: 1851548 - protein, 6 aa, Staphylococcus
GGDLGR

SEQ ID NO: 1851549 - protein, 6 aa, Staphylococcus
GGDPIA

SEQ ID NO: 1851550 - protein, 6 aa, Staphylococcus
GGDPIV

SEQ ID NO: 1851551 - protein, 10 aa, Staphylococcus
GGDSAGAQLT

SEQ ID NO: 1851552 - protein, 11 aa, Staphylococcus
GGDSAGAQLTS

SEQ ID NO: 1851553 - protein, 52 aa, Staphylococcus
GGDSNSDKVSNDPNVSQNYQKQVKDKDDSITSQIEAAKNDIKDKVNTDNTIQ

SEQ ID NO: 1851554 - protein, 5 aa, Staphylococcus
GGDYA

SEQ ID NO: 1851555 - protein, 7 aa, Staphylococcus
GGDYSNK

SEQ ID NO: 1851556 - protein, 8 aa, Staphylococcus
GGEATSKG

SEQ ID NO: 1851557 - protein, 6 aa, Staphylococcus
GGEDNL

SEQ ID NO: 1851558 - protein, 4 aa, Staphylococcus
GGEE

SEQ ID NO: 1851559 - protein, 7 aa, Staphylococcus
GGEENLD

SEQ ID NO: 1851560 - protein, 11 aa, Staphylococcus
GGEIKIDGTNI

SEQ ID NO: 1851561 - protein, 7 aa, Staphylococcus
GGEITID

SEQ ID NO: 1851562 - protein, 19 aa, Staphylococcus
GGEKHSISVDENEEKELGT

SEQ ID NO: 1851563 - protein, 10 aa, Staphylococcus
GGEMKNPKRD

SEQ ID NO: 1851564 - protein, 8 aa, Staphylococcus
GGEPSAKG

SEQ ID NO: 1851565 - protein, 8 aa, Staphylococcus
GGETNSLS

SEQ ID NO: 1851566 - protein, 9 aa, Staphylococcus
GGETSSKGL

SEQ ID NO: 1851567 - protein, 13 aa, Staphylococcus
GGETTSLFKATFG

SEQ ID NO: 1851568 - protein, 13 aa, Staphylococcus
GGETTSLLKATFG

SEQ ID NO: 1851569 - protein, 5 aa, Staphylococcus
GGEYY

SEQ ID NO: 1851570 - protein, 4 aa, Staphylococcus
GGFG

SEQ ID NO: 1851571 - protein, 5 aa, Staphylococcus
GGFGG

SEQ ID NO: 1851572 - protein, 5 aa, Staphylococcus
GGFGL

SEQ ID NO: 1851573 - protein, 10 aa, Staphylococcus
GGFGLSQATG

SEQ ID NO: 1851574 - protein, 12 aa, Staphylococcus
GGGAAKKSPLKF

SEQ ID NO: 1851575 - protein, 11 aa, Staphylococcus
GGGDGAAALSA

SEQ ID NO: 1851576 - protein, 11 aa, Staphylococcus
GGGDGAEALGA

SEQ ID NO: 1851577 - protein, 12 aa, Staphylococcus
GGGDGSKALNAI

SEQ ID NO: 1851578 - protein, 12 aa, Staphylococcus
GGGDGTKALNAI

SEQ ID NO: 1851579 - protein, 6 aa, Staphylococcus
GGGGEF

SEQ ID NO: 1851580 - protein, 15 aa, Staphylococcus
GGGGHLTNAATQIKG

SEQ ID NO: 1851581 - protein, 14 aa, Staphylococcus
GGGGHLTNAATQLK

SEQ ID NO: 1851582 - protein, 15 aa, Staphylococcus
GGGGHLTNAATQLKD

SEQ ID NO: 1851583 - protein, 16 aa, Staphylococcus
GGGGHLTNAATQLKGV

SEQ ID NO: 1851584 - protein, 6 aa, Staphylococcus
GGGGLI

SEQ ID NO: 1851585 - protein, 6 aa, Staphylococcus
GGGGTF

SEQ ID NO: 1851586 - protein, 9 aa, Staphylococcus
GGGGTFPIQ

SEQ ID NO: 1851587 - protein, 10 aa, Staphylococcus
GGGGTFPIQT

SEQ ID NO: 1851588 - protein, 4 aa, Staphylococcus
GGGI

SEQ ID NO: 1851589 - protein, 15 aa, Staphylococcus
GGGKKPKKHKHGENV

SEQ ID NO: 1851590 - protein, 6 aa, Staphylococcus
GGGKKY

SEQ ID NO: 1851591 - protein, 7 aa, Staphylococcus
GGGLRTI

SEQ ID NO: 1851592 - protein, 4 aa, Staphylococcus
GGGM

SEQ ID NO: 1851593 - protein, 11 aa, Staphylococcus
GGGNGADALNA

SEQ ID NO: 1851594 - protein, 10 aa, Staphylococcus
GGGNGAEALN

SEQ ID NO: 1851595 - protein, 6 aa, Staphylococcus
GGGNSP

SEQ ID NO: 1851596 - protein, 6 aa, Staphylococcus
GGGSTI

SEQ ID NO: 1851597 - protein, 7 aa, Staphylococcus
GGGSTLN

SEQ ID NO: 1851598 - protein, 7 aa, Staphylococcus
GGGTSGI

SEQ ID NO: 1851599 - protein, 8 aa, Staphylococcus
GGGWGPVN

SEQ ID NO: 1851600 - protein, 17 aa, Staphylococcus
GGHGGWSGQSVDRALEG

SEQ ID NO: 1851601 - protein, 5 aa, Staphylococcus
GGHPI

SEQ ID NO: 1851602 - protein, 5 aa, Staphylococcus
GGHPL

SEQ ID NO: 1851603 - protein, 12 aa, Staphylococcus
GGHPWQESQPGT

SEQ ID NO: 1851604 - protein, 11 aa, Staphylococcus
GGIEPGSTEIA

SEQ ID NO: 1851605 - protein, 9 aa, Staphylococcus
GGIEPGTSE

SEQ ID NO: 1851606 - protein, 13 aa, Staphylococcus
GGIGNDYAEDPQP

SEQ ID NO: 1851607 - protein, 18 aa, Staphylococcus
GGIKANPAAAVHSGTDAL

SEQ ID NO: 1851608 - protein, 9 aa, Staphylococcus
GGIKNATQT

SEQ ID NO: 1851609 - protein, 4 aa, Staphylococcus
GGIQ

SEQ ID NO: 1851610 - protein, 6 aa, Staphylococcus
GGIRDE

SEQ ID NO: 1851611 - protein, 4 aa, Staphylococcus
GGIS

SEQ ID NO: 1851612 - protein, 4 aa, Staphylococcus
GGIT

SEQ ID NO: 1851613 - protein, 5 aa, Staphylococcus
GGKAN

SEQ ID NO: 1851614 - protein, 8 aa, Staphylococcus
GGKDVGAD

SEQ ID NO: 1851615 - protein, 5 aa, Staphylococcus
GGKEN

SEQ ID NO: 1851616 - protein, 6 aa, Staphylococcus
GGKENI

SEQ ID NO: 1851617 - protein, 8 aa, Staphylococcus
GGKENIDA

SEQ ID NO: 1851618 - protein, 9 aa, Staphylococcus
GGKENIDTA

SEQ ID NO: 1851619 - protein, 9 aa, Staphylococcus
GGKENLDTA

SEQ ID NO: 1851620 - protein, 9 aa, Staphylococcus
GGKENVDTA

SEQ ID NO: 1851621 - protein, 13 aa, Staphylococcus
GGKGEGEHVSEAE

SEQ ID NO: 1851622 - protein, 7 aa, Staphylococcus
GGKGGTI

SEQ ID NO: 1851623 - protein, 8 aa, Staphylococcus
GGKKETYY

SEQ ID NO: 1851624 - protein, 10 aa, Staphylococcus
GGKKHRKAWE

SEQ ID NO: 1851625 - protein, 8 aa, Staphylococcus
GGKPTAQG

SEQ ID NO: 1851626 - protein, 6 aa, Staphylococcus
GGKSKA

SEQ ID NO: 1851627 - protein, 8 aa, Staphylococcus
GGKVVQTK

SEQ ID NO: 1851628 - protein, 7 aa, Staphylococcus
GGLADKL

SEQ ID NO: 1851629 - protein, 14 aa, Staphylococcus
GGLDHSRVNSKAEY

SEQ ID NO: 1851630 - protein, 6 aa, Staphylococcus
GGLEKA

SEQ ID NO: 1851631 - protein, 6 aa, Staphylococcus
GGLGID

SEQ ID NO: 1851632 - protein, 5 aa, Staphylococcus
GGLGM

SEQ ID NO: 1851633 - protein, 12 aa, Staphylococcus
GGLGMDKGTAQS

SEQ ID NO: 1851634 - protein, 9 aa, Staphylococcus
GGMQSKKYK

SEQ ID NO: 1851635 - protein, 6 aa, Staphylococcus
GGNEFE

SEQ ID NO: 1851636 - protein, 6 aa, Staphylococcus
GGNEVA

SEQ ID NO: 1851637 - protein, 11 aa, Staphylococcus
GGNIEKGTTEL

SEQ ID NO: 1851638 - protein, 11 aa, Staphylococcus
GGNMEGKETRF

SEQ ID NO: 1851639 - protein, 12 aa, Staphylococcus
GGNMEGKETRFG

SEQ ID NO: 1851640 - protein, 15 aa, Staphylococcus
GGNPSSPGSEAYTSN

SEQ ID NO: 1851641 - protein, 5 aa, Staphylococcus
GGNRS

SEQ ID NO: 1851642 - protein, 5 aa, Staphylococcus
GGNTD

SEQ ID NO: 1851643 - protein, 5 aa, Staphylococcus
GGNVD

SEQ ID NO: 1851644 - protein, 5 aa, Staphylococcus
GGNVS

SEQ ID NO: 1851645 - protein, 8 aa, Staphylococcus
GGPAARAI

SEQ ID NO: 1851646 - protein, 6 aa, Staphylococcus
GGPDKI

SEQ ID NO: 1851647 - protein, 4 aa, Staphylococcus
GGPI

SEQ ID NO: 1851648 - protein, 5 aa, Staphylococcus
GGPIV

SEQ ID NO: 1851649 - protein, 4 aa, Staphylococcus
GGPL

SEQ ID NO: 1851650 - protein, 9 aa, Staphylococcus
GGPREEGVS

SEQ ID NO: 1851651 - protein, 8 aa, Staphylococcus
GGPSNNPV

SEQ ID NO: 1851652 - protein, 12 aa, Staphylococcus
GGPYNQIRGTTL

SEQ ID NO: 1851653 - protein, 6 aa, Staphylococcus
GGQAGG

SEQ ID NO: 1851654 - protein, 75 aa, Staphylococcus
GGQASAAESNETNTSEKVSTEQAQSTQEQPSHETSTHSVEQPQNKAIATQETKTNEDASSEETQSNEADTESNEV

SEQ ID NO: 1851655 - protein, 6 aa, Staphylococcus
GGQDGA

SEQ ID NO: 1851656 - protein, 12 aa, Staphylococcus
GGQGDDELRPES

SEQ ID NO: 1851657 - protein, 11 aa, Staphylococcus
GGQGKDEPISE

SEQ ID NO: 1851658 - protein, 11 aa, Staphylococcus
GGQGPDEPISE

SEQ ID NO: 1851659 - protein, 10 aa, Staphylococcus
GGQGPDEPIT

SEQ ID NO: 1851660 - protein, 6 aa, Staphylococcus
GGRDIN

SEQ ID NO: 1851661 - protein, 7 aa, Staphylococcus
GGRNYRD

SEQ ID NO: 1851662 - protein, 5 aa, Staphylococcus
GGRTA

SEQ ID NO: 1851663 - protein, 7 aa, Staphylococcus
GGSAGTA

SEQ ID NO: 1851664 - protein, 7 aa, Staphylococcus
GGSFEPS

SEQ ID NO: 1851665 - protein, 5 aa, Staphylococcus
GGSGS

SEQ ID NO: 1851666 - protein, 5 aa, Staphylococcus
GGSGT

SEQ ID NO: 1851667 - protein, 7 aa, Staphylococcus
GGSIQTR

SEQ ID NO: 1851668 - protein, 8 aa, Staphylococcus
GGSIQVES

SEQ ID NO: 1851669 - protein, 5 aa, Staphylococcus
GGSKL

SEQ ID NO: 1851670 - protein, 8 aa, Staphylococcus
GGSKSQIL

SEQ ID NO: 1851671 - protein, 4 aa, Staphylococcus
GGSP

SEQ ID NO: 1851672 - protein, 4 aa, Staphylococcus
GGSR

SEQ ID NO: 1851673 - protein, 4 aa, Staphylococcus
GGSS

SEQ ID NO: 1851674 - protein, 9 aa, Staphylococcus
GGSSSNAAL

SEQ ID NO: 1851675 - protein, 5 aa, Staphylococcus
GGSTA

SEQ ID NO: 1851676 - protein, 9 aa, Staphylococcus
GGSTGLDAL

SEQ ID NO: 1851677 - protein, 8 aa, Staphylococcus
GGSVKSEQ

SEQ ID NO: 1851678 - protein, 4 aa, Staphylococcus
GGSY

SEQ ID NO: 1851679 - protein, 6 aa, Staphylococcus
GGTAYE

SEQ ID NO: 1851680 - protein, 7 aa, Staphylococcus
GGTAYEA

SEQ ID NO: 1851681 - protein, 4 aa, Staphylococcus
GGTD

SEQ ID NO: 1851682 - protein, 5 aa, Staphylococcus
GGTGA

SEQ ID NO: 1851683 - protein, 4 aa, Staphylococcus
GGTI

SEQ ID NO: 1851684 - protein, 5 aa, Staphylococcus
GGTID

SEQ ID NO: 1851685 - protein, 21 aa, Staphylococcus
GGTIEVESQVGKGTTFIIKLP

SEQ ID NO: 1851686 - protein, 6 aa, Staphylococcus
GGTIKV

SEQ ID NO: 1851687 - protein, 5 aa, Staphylococcus
GGTIT

SEQ ID NO: 1851688 - protein, 9 aa, Staphylococcus
GGTKESAGF

SEQ ID NO: 1851689 - protein, 10 aa, Staphylococcus
GGTLAAGQTG

SEQ ID NO: 1851690 - protein, 9 aa, Staphylococcus
GGTLQSTGG

SEQ ID NO: 1851691 - protein, 7 aa, Staphylococcus
GGTMDGT

SEQ ID NO: 1851692 - protein, 7 aa, Staphylococcus
GGTTAGT

SEQ ID NO: 1851693 - protein, 7 aa, Staphylococcus
GGTTGIP

SEQ ID NO: 1851694 - protein, 6 aa, Staphylococcus
GGTTPL

SEQ ID NO: 1851695 - protein, 6 aa, Staphylococcus
GGTTSI

SEQ ID NO: 1851696 - protein, 7 aa, Staphylococcus
GGVAKKN

SEQ ID NO: 1851697 - protein, 11 aa, Staphylococcus
GGVGDRVAHGG

SEQ ID NO: 1851698 - protein, 12 aa, Staphylococcus
GGVGDRVAHGGP

SEQ ID NO: 1851699 - protein, 13 aa, Staphylococcus
GGVGNDYAIDPKD

SEQ ID NO: 1851700 - protein, 7 aa, Staphylococcus
GGVKASQ

SEQ ID NO: 1851701 - protein, 6 aa, Staphylococcus
GGVTGQ

SEQ ID NO: 1851702 - protein, 11 aa, Staphylococcus
GGYAQHPSDSL

SEQ ID NO: 1851703 - protein, 10 aa, Staphylococcus
GGYAQHTSDH

SEQ ID NO: 1851704 - protein, 5 aa, Staphylococcus
GGYHG

SEQ ID NO: 1851705 - protein, 9 aa, Staphylococcus
GGYITERGS

SEQ ID NO: 1851706 - protein, 11 aa, Staphylococcus
GGYITKKGGHV

SEQ ID NO: 1851707 - protein, 6 aa, Staphylococcus
GGYSYT

SEQ ID NO: 1851708 - protein, 4 aa, Staphylococcus
GHAM

SEQ ID NO: 1851709 - protein, 9 aa, Staphylococcus
GHAMGSTSY

SEQ ID NO: 1851710 - protein, 8 aa, Staphylococcus
GHDPDKEH

SEQ ID NO: 1851711 - protein, 8 aa, Staphylococcus
GHDPNFDG

SEQ ID NO: 1851712 - protein, 10 aa, Staphylococcus
GHDSGKGTNF

SEQ ID NO: 1851713 - protein, 9 aa, Staphylococcus
GHDSPKNAF

SEQ ID NO: 1851714 - protein, 7 aa, Staphylococcus
GHENAEN

SEQ ID NO: 1851715 - protein, 7 aa, Staphylococcus
GHENPTN

SEQ ID NO: 1851716 - protein, 9 aa, Staphylococcus
GHESATNGF

SEQ ID NO: 1851717 - protein, 5 aa, Staphylococcus
GHGGS

SEQ ID NO: 1851718 - protein, 81 aa, Staphylococcus
GHGLQEDTENESGQPASNSNEKARGRTMTNDEVNNESHLTRSENNASFDKHSNNQSYDQNEEDTDESYISEYSSPNSTYSY

SEQ ID NO: 1851719 - protein, 8 aa, Staphylococcus
GHGTTEKI

SEQ ID NO: 1851720 - protein, 12 aa, Staphylococcus
GHISAGNNKAIK

SEQ ID NO: 1851721 - protein, 11 aa, Staphylococcus
GHISAGSNRAI

SEQ ID NO: 1851722 - protein, 11 aa, Staphylococcus
GHISASSNKAI

SEQ ID NO: 1851723 - protein, 8 aa, Staphylococcus
GHISEGSN

SEQ ID NO: 1851724 - protein, 11 aa, Staphylococcus
GHITTSSNKAI

SEQ ID NO: 1851725 - protein, 10 aa, Staphylococcus
GHKIEKDGIT

SEQ ID NO: 1851726 - protein, 7 aa, Staphylococcus
GHKNAAS

SEQ ID NO: 1851727 - protein, 9 aa, Staphylococcus
GHMDNQSAG

SEQ ID NO: 1851728 - protein, 9 aa, Staphylococcus
GHMPKETQY

SEQ ID NO: 1851729 - protein, 4 aa, Staphylococcus
GHNI

SEQ ID NO: 1851730 - protein, 8 aa, Staphylococcus
GHNSTEKI

SEQ ID NO: 1851731 - protein, 9 aa, Staphylococcus
GHNYSYPVP

SEQ ID NO: 1851732 - protein, 5 aa, Staphylococcus
GHQDK

SEQ ID NO: 1851733 - protein, 10 aa, Staphylococcus
GHQLPTDGDF

SEQ ID NO: 1851734 - protein, 14 aa, Staphylococcus
GHQLSTDGDFTLTP

SEQ ID NO: 1851735 - protein, 6 aa, Staphylococcus
GHRPEI

SEQ ID NO: 1851736 - protein, 8 aa, Staphylococcus
GHSEQEYA

SEQ ID NO: 1851737 - protein, 6 aa, Staphylococcus
GHSNHE

SEQ ID NO: 1851738 - protein, 6 aa, Staphylococcus
GHSQDL

SEQ ID NO: 1851739 - protein, 10 aa, Staphylococcus
GHTNTSGDYQ

SEQ ID NO: 1851740 - protein, 7 aa, Staphylococcus
GHTPEEA

SEQ ID NO: 1851741 - protein, 10 aa, Staphylococcus
GHTSSHGNTE

SEQ ID NO: 1851742 - protein, 5 aa, Staphylococcus
GHYGK

SEQ ID NO: 1851743 - protein, 4 aa, Staphylococcus
GIAK

SEQ ID NO: 1851744 - protein, 8 aa, Staphylococcus
GIAPEEQK

SEQ ID NO: 1851745 - protein, 10 aa, Staphylococcus
GIAQHPSGPM

SEQ ID NO: 1851746 - protein, 12 aa, Staphylococcus
GIAQHSSGPMAE

SEQ ID NO: 1851747 - protein, 10 aa, Staphylococcus
GIAQQTTGKM

SEQ ID NO: 1851748 - protein, 17 aa, Staphylococcus
GIASYRAARTLKKNGYK

SEQ ID NO: 1851749 - protein, 5 aa, Staphylococcus
GIATG

SEQ ID NO: 1851750 - protein, 6 aa, Staphylococcus
GIDKTT

SEQ ID NO: 1851751 - protein, 4 aa, Staphylococcus
GIDN

SEQ ID NO: 1851752 - protein, 26 aa, Staphylococcus
GIDNVNKKQSSDEKGQYKATQLNDEL

SEQ ID NO: 1851753 - protein, 4 aa, Staphylococcus
GIDT

SEQ ID NO: 1851754 - protein, 5 aa, Staphylococcus
GIESL

SEQ ID NO: 1851755 - protein, 4 aa, Staphylococcus
GIEV

SEQ ID NO: 1851756 - protein, 7 aa, Staphylococcus
GIGASGG

SEQ ID NO: 1851757 - protein, 5 aa, Staphylococcus
GIGDN

SEQ ID NO: 1851758 - protein, 11 aa, Staphylococcus
GIGGRKETNFP

SEQ ID NO: 1851759 - protein, 6 aa, Staphylococcus
GIGISQ

SEQ ID NO: 1851760 - protein, 10 aa, Staphylococcus
GIGMKPGRRL

SEQ ID NO: 1851761 - protein, 15 aa, Staphylococcus
GIGMNNKDKEKLGSI

SEQ ID NO: 1851762 - protein, 10 aa, Staphylococcus
GIGPSKAKEI

SEQ ID NO: 1851763 - protein, 8 aa, Staphylococcus
GIGPTKAK

SEQ ID NO: 1851764 - protein, 7 aa, Staphylococcus
GIGPTKV

SEQ ID NO: 1851765 - protein, 4 aa, Staphylococcus
GIGS

SEQ ID NO: 1851766 - protein, 7 aa, Staphylococcus
GIGSSTP

SEQ ID NO: 1851767 - protein, 4 aa, Staphylococcus
GIKG

SEQ ID NO: 1851768 - protein, 5 aa, Staphylococcus
GIKGK

SEQ ID NO: 1851769 - protein, 10 aa, Staphylococcus
GIKHDAKEKN

SEQ ID NO: 1851770 - protein, 18 aa, Staphylococcus
GIKKGDKVKFTKEGKPYK

SEQ ID NO: 1851771 - protein, 6 aa, Staphylococcus
GIKRPE

SEQ ID NO: 1851772 - protein, 7 aa, Staphylococcus
GIKRPGE

SEQ ID NO: 1851773 - protein, 10 aa, Staphylococcus
GILKNKGQAF

SEQ ID NO: 1851774 - protein, 12 aa, Staphylococcus
GINAKKGSIYQD

SEQ ID NO: 1851775 - protein, 7 aa, Staphylococcus
GINDAPA

SEQ ID NO: 1851776 - protein, 12 aa, Staphylococcus
GINDAPALAQSE

SEQ ID NO: 1851777 - protein, 9 aa, Staphylococcus
GINGQPSSF

SEQ ID NO: 1851778 - protein, 5 aa, Staphylococcus
GINNE

SEQ ID NO: 1851779 - protein, 5 aa, Staphylococcus
GINTS

SEQ ID NO: 1851780 - protein, 9 aa, Staphylococcus
GIPKEPGRY

SEQ ID NO: 1851781 - protein, 6 aa, Staphylococcus
GIPPLS

SEQ ID NO: 1851782 - protein, 7 aa, Staphylococcus
GIPPLSG

SEQ ID NO: 1851783 - protein, 9 aa, Staphylococcus
GIPSAGEQI

SEQ ID NO: 1851784 - protein, 13 aa, Staphylococcus
GIPYTKKTYENAN

SEQ ID NO: 1851785 - protein, 6 aa, Staphylococcus
GIQPDI

SEQ ID NO: 1851786 - protein, 75 aa, Staphylococcus
GIQPDTIKKSSAKQAIDDSANAKKAAIDNNSDATQEEKDVAKAKVDVEAAKAKTAIDQATTNDGVDQTRDLGNNS

SEQ ID NO: 1851787 - protein, 14 aa, Staphylococcus
GIQPDTKIATPKYQ

SEQ ID NO: 1851788 - protein, 6 aa, Staphylococcus
GIQPDV

SEQ ID NO: 1851789 - protein, 4 aa, Staphylococcus
GIQV

SEQ ID NO: 1851790 - protein, 11 aa, Staphylococcus
GIRGDKNVESL

SEQ ID NO: 1851791 - protein, 7 aa, Staphylococcus
GIRPDVT

SEQ ID NO: 1851792 - protein, 9 aa, Staphylococcus
GIRSATSAL

SEQ ID NO: 1851793 - protein, 5 aa, Staphylococcus
GISDQ

SEQ ID NO: 1851794 - protein, 7 aa, Staphylococcus
GISDSKK

SEQ ID NO: 1851795 - protein, 9 aa, Staphylococcus
GISENHNKA

SEQ ID NO: 1851796 - protein, 6 aa, Staphylococcus
GISESG

SEQ ID NO: 1851797 - protein, 7 aa, Staphylococcus
GISGNQF

SEQ ID NO: 1851798 - protein, 6 aa, Staphylococcus
GISGTT

SEQ ID NO: 1851799 - protein, 5 aa, Staphylococcus
GISHS

SEQ ID NO: 1851800 - protein, 11 aa, Staphylococcus
GISKETKDIYN

SEQ ID NO: 1851801 - protein, 17 aa, Staphylococcus
GISNPNTIAKETFKSGT

SEQ ID NO: 1851802 - protein, 4 aa, Staphylococcus
GISR

SEQ ID NO: 1851803 - protein, 10 aa, Staphylococcus
GISSEQGNKV

SEQ ID NO: 1851804 - protein, 7 aa, Staphylococcus
GISTTEF

SEQ ID NO: 1851805 - protein, 7 aa, Staphylococcus
GITGQDV

SEQ ID NO: 1851806 - protein, 17 aa, Staphylococcus
GITNPNDIAKETVKSGA

SEQ ID NO: 1851807 - protein, 16 aa, Staphylococcus
GITNPNSIAKETFKSG

SEQ ID NO: 1851808 - protein, 10 aa, Staphylococcus
GITSNDNAYP

SEQ ID NO: 1851809 - protein, 7 aa, Staphylococcus
GITSPEG

SEQ ID NO: 1851810 - protein, 9 aa, Staphylococcus
GITTPTQKN

SEQ ID NO: 1851811 - protein, 4 aa, Staphylococcus
GITY

SEQ ID NO: 1851812 - protein, 17 aa, Staphylococcus
GKAAPQSVKTYQYNSQV

SEQ ID NO: 1851813 - protein, 4 aa, Staphylococcus
GKAG

SEQ ID NO: 1851814 - protein, 9 aa, Staphylococcus
GKAIKDDAA

SEQ ID NO: 1851815 - protein, 55 aa, Staphylococcus
GKALEEDNHHDTSSEKGHVNDKNNEYARQDKDNYVYQNDKRNHNRNYNDEDYNRS

SEQ ID NO: 1851816 - protein, 46 aa, Staphylococcus
GKALEQDSHQAESHASNNEDRHGAYATDRHERDDRNFESEHPSRLD

SEQ ID NO: 1851817 - protein, 7 aa, Staphylococcus
GKASKNY

SEQ ID NO: 1851818 - protein, 4 aa, Staphylococcus
GKAT

SEQ ID NO: 1851819 - protein, 9 aa, Staphylococcus
GKATDRPEF

SEQ ID NO: 1851820 - protein, 7 aa, Staphylococcus
GKATTTT

SEQ ID NO: 1851821 - protein, 8 aa, Staphylococcus
GKAVATSA

SEQ ID NO: 1851822 - protein, 18 aa, Staphylococcus
GKAVKDNPKYNVGDGPAA

SEQ ID NO: 1851823 - protein, 17 aa, Staphylococcus
GKAYADSPEFNLGDNPA

SEQ ID NO: 1851824 - protein, 7 aa, Staphylococcus
GKAYDKY

SEQ ID NO: 1851825 - protein, 5 aa, Staphylococcus
GKDAV

SEQ ID NO: 1851826 - protein, 6 aa, Staphylococcus
GKDAVS

SEQ ID NO: 1851827 - protein, 8 aa, Staphylococcus
GKDIARAG

SEQ ID NO: 1851828 - protein, 7 aa, Staphylococcus
GKDIKRA

SEQ ID NO: 1851829 - protein, 47 aa, Staphylococcus
GKDKAMAKSITKELEKEGFNVEKSPNYVNGDSSKNIINKNDTGSGVQ

SEQ ID NO: 1851830 - protein, 8 aa, Staphylococcus
GKDKGINY

SEQ ID NO: 1851831 - protein, 47 aa, Staphylococcus
GKDKKLAKSITKSLKNKGFTVQKSPKGIEATSSSNIINRSDNDSGVQ

SEQ ID NO: 1851832 - protein, 7 aa, Staphylococcus
GKDKKLV

SEQ ID NO: 1851833 - protein, 5 aa, Staphylococcus
GKDKW

SEQ ID NO: 1851834 - protein, 5 aa, Staphylococcus
GKDMD

SEQ ID NO: 1851835 - protein, 10 aa, Staphylococcus
GKDPNEVHSS

SEQ ID NO: 1851836 - protein, 14 aa, Staphylococcus
GKDPNEVKSSEKRN

SEQ ID NO: 1851837 - protein, 10 aa, Staphylococcus
GKDPNEVNVS

SEQ ID NO: 1851838 - protein, 16 aa, Staphylococcus
GKDQINNKSTSYNTAE

SEQ ID NO: 1851839 - protein, 7 aa, Staphylococcus
GKDSKGK

SEQ ID NO: 1851840 - protein, 8 aa, Staphylococcus
GKDTKMAK

SEQ ID NO: 1851841 - protein, 6 aa, Staphylococcus
GKDTVS

SEQ ID NO: 1851842 - protein, 4 aa, Staphylococcus
GKDV

SEQ ID NO: 1851843 - protein, 8 aa, Staphylococcus
GKDVARAN

SEQ ID NO: 1851844 - protein, 7 aa, Staphylococcus
GKDVRRA

SEQ ID NO: 1851845 - protein, 5 aa, Staphylococcus
GKDVT

SEQ ID NO: 1851846 - protein, 4 aa, Staphylococcus
GKDY

SEQ ID NO: 1851847 - protein, 44 aa, Staphylococcus
GKEAGKTEEEISKELGNPKSIGREMSATSAMDKVEDSKNPNNVT

SEQ ID NO: 1851848 - protein, 8 aa, Staphylococcus
GKEDSVKF

SEQ ID NO: 1851849 - protein, 15 aa, Staphylococcus
GKEGTVDKTYAGQAD

SEQ ID NO: 1851850 - protein, 12 aa, Staphylococcus
GKELKDYKGDIS

SEQ ID NO: 1851851 - protein, 15 aa, Staphylococcus
GKELKDYSDDVSHDR

SEQ ID NO: 1851852 - protein, 5 aa, Staphylococcus
GKENQ

SEQ ID NO: 1851853 - protein, 9 aa, Staphylococcus
GKERSKAIS

SEQ ID NO: 1851854 - protein, 9 aa, Staphylococcus
GKESGQAVG

SEQ ID NO: 1851855 - protein, 9 aa, Staphylococcus
GKETTENNK

SEQ ID NO: 1851856 - protein, 8 aa, Staphylococcus
GKEVEDNL

SEQ ID NO: 1851857 - protein, 43 aa, Staphylococcus
GKEVNIPKGAKGDKGDTGSTGANGQDAAPLTVTSTNKDGDGNT

SEQ ID NO: 1851858 - protein, 34 aa, Staphylococcus
GKEVNIPKGAKGDKGQDAAPLTVTETTKDNDGNT

SEQ ID NO: 1851859 - protein, 11 aa, Staphylococcus
GKFDKKTNEKF

SEQ ID NO: 1851860 - protein, 8 aa, Staphylococcus
GKGDKVTI

SEQ ID NO: 1851861 - protein, 4 aa, Staphylococcus
GKGE

SEQ ID NO: 1851862 - protein, 13 aa, Staphylococcus
GKGEDEVNEIDDE

SEQ ID NO: 1851863 - protein, 24 aa, Staphylococcus
GKGGQHSQLHENPKVAQQLIDFLW

SEQ ID NO: 1851864 - protein, 7 aa, Staphylococcus
GKGIGPD

SEQ ID NO: 1851865 - protein, 16 aa, Staphylococcus
GKGIQPDTKIASPQYQ

SEQ ID NO: 1851866 - protein, 10 aa, Staphylococcus
GKGKDAKSEV

SEQ ID NO: 1851867 - protein, 10 aa, Staphylococcus
GKGKEKDEVT

SEQ ID NO: 1851868 - protein, 5 aa, Staphylococcus
GKGNA

SEQ ID NO: 1851869 - protein, 12 aa, Staphylococcus
GKGNAEAIKNSN

SEQ ID NO: 1851870 - protein, 11 aa, Staphylococcus
GKGNKYKLPNQ

SEQ ID NO: 1851871 - protein, 9 aa, Staphylococcus
GKGSHLGKN

SEQ ID NO: 1851872 - protein, 5 aa, Staphylococcus
GKGTL

SEQ ID NO: 1851873 - protein, 13 aa, Staphylococcus
GKHGWKTERSDNQ

SEQ ID NO: 1851874 - protein, 22 aa, Staphylococcus
GKHTVKTNSERVGLPEGTEEYK

SEQ ID NO: 1851875 - protein, 8 aa, Staphylococcus
GKIEGEKL

SEQ ID NO: 1851876 - protein, 6 aa, Staphylococcus
GKINQN

SEQ ID NO: 1851877 - protein, 11 aa, Staphylococcus
GKINSQELNNY

SEQ ID NO: 1851878 - protein, 9 aa, Staphylococcus
GKIPKNEKH

SEQ ID NO: 1851879 - protein, 9 aa, Staphylococcus
GKISDEDMQ

SEQ ID NO: 1851880 - protein, 9 aa, Staphylococcus
GKISDEEMQ

SEQ ID NO: 1851881 - protein, 9 aa, Staphylococcus
GKITDEEMQ

SEQ ID NO: 1851882 - protein, 9 aa, Staphylococcus
GKITDEQMQ

SEQ ID NO: 1851883 - protein, 11 aa, Staphylococcus
GKKADPKKHEK

SEQ ID NO: 1851884 - protein, 8 aa, Staphylococcus
GKKDPAVL

SEQ ID NO: 1851885 - protein, 8 aa, Staphylococcus
GKKDPDIL

SEQ ID NO: 1851886 - protein, 8 aa, Staphylococcus
GKKDPEIL

SEQ ID NO: 1851887 - protein, 7 aa, Staphylococcus
GKKDTYY

SEQ ID NO: 1851888 - protein, 8 aa, Staphylococcus
GKKDYKGL

SEQ ID NO: 1851889 - protein, 9 aa, Staphylococcus
GKKGADAEH

SEQ ID NO: 1851890 - protein, 19 aa, Staphylococcus
GKKGAEAEHERLMSKESNK

SEQ ID NO: 1851891 - protein, 8 aa, Staphylococcus
GKKIEKIQ

SEQ ID NO: 1851892 - protein, 94 aa, Staphylococcus
GKKKDSYANGYYDNNNHNNSRNHDHDNNRHDDQNDDRRDYDRDNRHDDRYNDRHNNEFNDNRHNHNAHREHDRDNDYNNRRDNHHDDKDVNAQN

SEQ ID NO: 1851893 - protein, 19 aa, Staphylococcus
GKKKEMKYTTDKSGAITNT

SEQ ID NO: 1851894 - protein, 17 aa, Staphylococcus
GKKKEMKYTTDKSGKVI

SEQ ID NO: 1851895 - protein, 17 aa, Staphylococcus
GKKKQLKYTTDKSGKVI

SEQ ID NO: 1851896 - protein, 9 aa, Staphylococcus
GKKMQETMQ

SEQ ID NO: 1851897 - protein, 5 aa, Staphylococcus
GKKPI

SEQ ID NO: 1851898 - protein, 9 aa, Staphylococcus
GKKVEKIKP

SEQ ID NO: 1851899 - protein, 4 aa, Staphylococcus
GKLG

SEQ ID NO: 1851900 - protein, 9 aa, Staphylococcus
GKLGSEPSI

SEQ ID NO: 1851901 - protein, 7 aa, Staphylococcus
GKLHNKE

SEQ ID NO: 1851902 - protein, 10 aa, Staphylococcus
GKLPKTRRLT

SEQ ID NO: 1851903 - protein, 7 aa, Staphylococcus
GKMATSE

SEQ ID NO: 1851904 - protein, 12 aa, Staphylococcus
GKNGTVDETYAG

SEQ ID NO: 1851905 - protein, 29 aa, Staphylococcus
GKNIGADLQTEQALADKNIAQAKAEERRA

SEQ ID NO: 1851906 - protein, 8 aa, Staphylococcus
GKNITTSK

SEQ ID NO: 1851907 - protein, 9 aa, Staphylococcus
GKNKSDKHI

SEQ ID NO: 1851908 - protein, 5 aa, Staphylococcus
GKNLA

SEQ ID NO: 1851909 - protein, 12 aa, Staphylococcus
GKPGDKVEYKGD

SEQ ID NO: 1851910 - protein, 10 aa, Staphylococcus
GKPGDTVEYK

SEQ ID NO: 1851911 - protein, 10 aa, Staphylococcus
GKPGDTVKYK

SEQ ID NO: 1851912 - protein, 8 aa, Staphylococcus
GKPGESIE

SEQ ID NO: 1851913 - protein, 6 aa, Staphylococcus
GKPGKL

SEQ ID NO: 1851914 - protein, 9 aa, Staphylococcus
GKPGQSIAF

SEQ ID NO: 1851915 - protein, 9 aa, Staphylococcus
GKPKKSAAI

SEQ ID NO: 1851916 - protein, 9 aa, Staphylococcus
GKPPSEVNI

SEQ ID NO: 1851917 - protein, 6 aa, Staphylococcus
GKPSST

SEQ ID NO: 1851918 - protein, 14 aa, Staphylococcus
GKPTGYSEQSMSRN

SEQ ID NO: 1851919 - protein, 58 aa, Staphylococcus
GKPVQQSKPNHSNTQQDYHNQSRQDKHEQHQYQGYNNHNQNGYADRHDQQPRKGDNKK

SEQ ID NO: 1851920 - protein, 13 aa, Staphylococcus
GKQEMATALPRKS

SEQ ID NO: 1851921 - protein, 8 aa, Staphylococcus
GKQFSYDN

SEQ ID NO: 1851922 - protein, 8 aa, Staphylococcus
GKQFTEDE

SEQ ID NO: 1851923 - protein, 35 aa, Staphylococcus
GKQNDEKIEQYDKKQADNKGKHKTAPQVPKDKSQL

SEQ ID NO: 1851924 - protein, 7 aa, Staphylococcus
GKQPTPF

SEQ ID NO: 1851925 - protein, 14 aa, Staphylococcus
GKQTEQTTTTTAHL

SEQ ID NO: 1851926 - protein, 8 aa, Staphylococcus
GKREEGIS

SEQ ID NO: 1851927 - protein, 8 aa, Staphylococcus
GKREEGVS

SEQ ID NO: 1851928 - protein, 8 aa, Staphylococcus
GKRGQEVA

SEQ ID NO: 1851929 - protein, 7 aa, Staphylococcus
GKRGTTV

SEQ ID NO: 1851930 - protein, 14 aa, Staphylococcus
GKRSYTDGPPPSNK

SEQ ID NO: 1851931 - protein, 10 aa, Staphylococcus
GKSGAGKSTL

SEQ ID NO: 1851932 - protein, 9 aa, Staphylococcus
GKSGSSLNG

SEQ ID NO: 1851933 - protein, 8 aa, Staphylococcus
GKSGTAEL

SEQ ID NO: 1851934 - protein, 17 aa, Staphylococcus
GKSISKQLKNKLTEKDF

SEQ ID NO: 1851935 - protein, 9 aa, Staphylococcus
GKSKAGVDY

SEQ ID NO: 1851936 - protein, 9 aa, Staphylococcus
GKSKEGVDY

SEQ ID NO: 1851937 - protein, 8 aa, Staphylococcus
GKSKPRLS

SEQ ID NO: 1851938 - protein, 10 aa, Staphylococcus
GKSLDEYGNK

SEQ ID NO: 1851939 - protein, 5 aa, Staphylococcus
GKSLT

SEQ ID NO: 1851940 - protein, 8 aa, Staphylococcus
GKSSNLQL

SEQ ID NO: 1851941 - protein, 14 aa, Staphylococcus
GKSSSESEEAGIGS

SEQ ID NO: 1851942 - protein, 5 aa, Staphylococcus
GKSTF

SEQ ID NO: 1851943 - protein, 12 aa, Staphylococcus
GKSTFLKKRNLN

SEQ ID NO: 1851944 - protein, 20 aa, Staphylococcus
GKSTKNSLLPPEDTGEAVGL

SEQ ID NO: 1851945 - protein, 8 aa, Staphylococcus
GKSTRQWT

SEQ ID NO: 1851946 - protein, 5 aa, Staphylococcus
GKSVE

SEQ ID NO: 1851947 - protein, 17 aa, Staphylococcus
GKSVSKQLDNKLTEKDF

SEQ ID NO: 1851948 - protein, 32 aa, Staphylococcus
GKSVSKQVDDEINEKDFESYKTEKKEPVGTDY

SEQ ID NO: 1851949 - protein, 15 aa, Staphylococcus
GKSVTIPKGQNGTSI

SEQ ID NO: 1851950 - protein, 5 aa, Staphylococcus
GKSYG

SEQ ID NO: 1851951 - protein, 12 aa, Staphylococcus
GKTATTSTDLRP

SEQ ID NO: 1851952 - protein, 11 aa, Staphylococcus
GKTDPMEKRTR

SEQ ID NO: 1851953 - protein, 5 aa, Staphylococcus
GKTET

SEQ ID NO: 1851954 - protein, 18 aa, Staphylococcus
GKTITIPKGDKGQDGKSI

SEQ ID NO: 1851955 - protein, 12 aa, Staphylococcus
GKTKDDKEYSST

SEQ ID NO: 1851956 - protein, 11 aa, Staphylococcus
GKTKKDEDYSS

SEQ ID NO: 1851957 - protein, 11 aa, Staphylococcus
GKTKNGEDYSS

SEQ ID NO: 1851958 - protein, 7 aa, Staphylococcus
GKTKRTP

SEQ ID NO: 1851959 - protein, 11 aa, Staphylococcus
GKTKSGEDYSS

SEQ ID NO: 1851960 - protein, 7 aa, Staphylococcus
GKTLKDN

SEQ ID NO: 1851961 - protein, 25 aa, Staphylococcus
GKTMTIPKGAKGDKGDNGRDGTSIG

SEQ ID NO: 1851962 - protein, 40 aa, Staphylococcus
GKTMTIPKGAKGDKGDVGAKGADGRSITITSNTEEPNGDR

SEQ ID NO: 1851963 - protein, 40 aa, Staphylococcus
GKTMTIPKGAKGDKGDVGARGADGRSITITSNTEEPNGDR

SEQ ID NO: 1851964 - protein, 40 aa, Staphylococcus
GKTMTIPKGAKGDKGDVGARGADGRSITITSNTEQPNGDR

SEQ ID NO: 1851965 - protein, 28 aa, Staphylococcus
GKTMTIPKGAKGDRGEAGPKGADGHSIT

SEQ ID NO: 1851966 - protein, 7 aa, Staphylococcus
GKTNHDY

SEQ ID NO: 1851967 - protein, 5 aa, Staphylococcus
GKTSK

SEQ ID NO: 1851968 - protein, 6 aa, Staphylococcus
GKTSKT

SEQ ID NO: 1851969 - protein, 8 aa, Staphylococcus
GKTTKKDK

SEQ ID NO: 1851970 - protein, 7 aa, Staphylococcus
GKTVEDN

SEQ ID NO: 1851971 - protein, 22 aa, Staphylococcus
GKTVTVPKGAKGDKGQDGTSIT

SEQ ID NO: 1851972 - protein, 34 aa, Staphylococcus
GKTVTVPKGAKGDKGQDGTSITVTNTTTDGAGNT

SEQ ID NO: 1851973 - protein, 34 aa, Staphylococcus
GKTVTVPKGAKGDKGQDGTSVTITRTETDQAGNT

SEQ ID NO: 1851974 - protein, 34 aa, Staphylococcus
GKTVTVPKGAKGDKGQDGTSVTVTDTTTDGAGNT

SEQ ID NO: 1851975 - protein, 34 aa, Staphylococcus
GKTVTVPKGHDGQNGHDGTSVTVTNTTTDGDGNT

SEQ ID NO: 1851976 - protein, 19 aa, Staphylococcus
GKVDYGAAHAAKTGHDRYG

SEQ ID NO: 1851977 - protein, 13 aa, Staphylococcus
GKVEQGEKLLLVN

SEQ ID NO: 1851978 - protein, 8 aa, Staphylococcus
GKVIKKDD

SEQ ID NO: 1851979 - protein, 7 aa, Staphylococcus
GKVLPKG

SEQ ID NO: 1851980 - protein, 7 aa, Staphylococcus
GKVNEGD

SEQ ID NO: 1851981 - protein, 7 aa, Staphylococcus
GKVTIND

SEQ ID NO: 1851982 - protein, 9 aa, Staphylococcus
GKVVSTTNT

SEQ ID NO: 1851983 - protein, 7 aa, Staphylococcus
GKYKSRM

SEQ ID NO: 1851984 - protein, 4 aa, Staphylococcus
GKYL

SEQ ID NO: 1851985 - protein, 7 aa, Staphylococcus
GKYLPNY

SEQ ID NO: 1851986 - protein, 4 aa, Staphylococcus
GKYY

SEQ ID NO: 1851987 - protein, 6 aa, Staphylococcus
GLADRY

SEQ ID NO: 1851988 - protein, 7 aa, Staphylococcus
GLADTYG

SEQ ID NO: 1851989 - protein, 8 aa, Staphylococcus
GLAESPFQ

SEQ ID NO: 1851990 - protein, 9 aa, Staphylococcus
GLAHTSSDN

SEQ ID NO: 1851991 - protein, 33 aa, Staphylococcus
GLAREKYYSPNGKYREAFEKSEDIAKEKKLNIW

SEQ ID NO: 1851992 - protein, 6 aa, Staphylococcus
GLASGV

SEQ ID NO: 1851993 - protein, 9 aa, Staphylococcus
GLASTEPPG

SEQ ID NO: 1851994 - protein, 20 aa, Staphylococcus
GLDADQRKSFKKVESAYGTL

SEQ ID NO: 1851995 - protein, 9 aa, Staphylococcus
GLDDHNSVG

SEQ ID NO: 1851996 - protein, 10 aa, Staphylococcus
GLDDHNSVGI

SEQ ID NO: 1851997 - protein, 10 aa, Staphylococcus
GLDGSTAGTV

SEQ ID NO: 1851998 - protein, 6 aa, Staphylococcus
GLDPDQ

SEQ ID NO: 1851999 - protein, 7 aa, Staphylococcus
GLDQSSA

SEQ ID NO: 1852000 - protein, 6 aa, Staphylococcus
GLDSNY

SEQ ID NO: 1852001 - protein, 15 aa, Staphylococcus
GLDTHTGPLGNENPN

SEQ ID NO: 1852002 - protein, 18 aa, Staphylococcus
GLEDNKIERNSNSNELDQ

SEQ ID NO: 1852003 - protein, 12 aa, Staphylococcus
GLEERLSKNQTK

SEQ ID NO: 1852004 - protein, 8 aa, Staphylococcus
GLEGKLSD

SEQ ID NO: 1852005 - protein, 5 aa, Staphylococcus
GLESY

SEQ ID NO: 1852006 - protein, 21 aa, Staphylococcus
GLETNQKEKINEQIGKAQNFK

SEQ ID NO: 1852007 - protein, 8 aa, Staphylococcus
GLGEKGTV

SEQ ID NO: 1852008 - protein, 9 aa, Staphylococcus
GLGGGLSHP

SEQ ID NO: 1852009 - protein, 8 aa, Staphylococcus
GLGGKENI

SEQ ID NO: 1852010 - protein, 11 aa, Staphylococcus
GLGGSDNISSL

SEQ ID NO: 1852011 - protein, 10 aa, Staphylococcus
GLGGSENITT

SEQ ID NO: 1852012 - protein, 7 aa, Staphylococcus
GLGNGVS

SEQ ID NO: 1852013 - protein, 5 aa, Staphylococcus
GLGRY

SEQ ID NO: 1852014 - protein, 9 aa, Staphylococcus
GLGSSGLTA

SEQ ID NO: 1852015 - protein, 12 aa, Staphylococcus
GLGVPSKNYGYL

SEQ ID NO: 1852016 - protein, 25 aa, Staphylococcus
GLKAGDKVIKNPKGNLNDGEKVEVS

SEQ ID NO: 1852017 - protein, 25 aa, Staphylococcus
GLKAGDKVIKNPQVNLNDGEKIEVS

SEQ ID NO: 1852018 - protein, 6 aa, Staphylococcus
GLKDGN

SEQ ID NO: 1852019 - protein, 10 aa, Staphylococcus
GLKDKENPDL

SEQ ID NO: 1852020 - protein, 9 aa, Staphylococcus
GLKDKYNPD

SEQ ID NO: 1852021 - protein, 7 aa, Staphylococcus
GLKDQIQ

SEQ ID NO: 1852022 - protein, 17 aa, Staphylococcus
GLKGTDGLKTGSSDIAD

SEQ ID NO: 1852023 - protein, 9 aa, Staphylococcus
GLKQPSEVK

SEQ ID NO: 1852024 - protein, 4 aa, Staphylococcus
GLND

SEQ ID NO: 1852025 - protein, 7 aa, Staphylococcus
GLNEHNA

SEQ ID NO: 1852026 - protein, 10 aa, Staphylococcus
GLNKDQRADL

SEQ ID NO: 1852027 - protein, 9 aa, Staphylococcus
GLNKEQRAN

SEQ ID NO: 1852028 - protein, 14 aa, Staphylococcus
GLNNKDTKKDIEDA

SEQ ID NO: 1852029 - protein, 5 aa, Staphylococcus
GLNPQ

SEQ ID NO: 1852030 - protein, 19 aa, Staphylococcus
GLNRTGDTNNKKPNSIESY

SEQ ID NO: 1852031 - protein, 12 aa, Staphylococcus
GLNSDQRDEMKK

SEQ ID NO: 1852032 - protein, 8 aa, Staphylococcus
GLNSGGSL

SEQ ID NO: 1852033 - protein, 8 aa, Staphylococcus
GLNSKDSI

SEQ ID NO: 1852034 - protein, 4 aa, Staphylococcus
GLPA

SEQ ID NO: 1852035 - protein, 11 aa, Staphylococcus
GLPDTVPGQTV

SEQ ID NO: 1852036 - protein, 11 aa, Staphylococcus
GLPGNDGRSIT

SEQ ID NO: 1852037 - protein, 23 aa, Staphylococcus
GLPKDKNETPIPRRRKRRKSKAS

SEQ ID NO: 1852038 - protein, 6 aa, Staphylococcus
GLPKGL

SEQ ID NO: 1852039 - protein, 18 aa, Staphylococcus
GLPQGSAFSLKGDNTYQS

SEQ ID NO: 1852040 - protein, 18 aa, Staphylococcus
GLPQGSAYSLKGSNTYQS

SEQ ID NO: 1852041 - protein, 6 aa, Staphylococcus
GLPSGW

SEQ ID NO: 1852042 - protein, 11 aa, Staphylococcus
GLRNQWGSPEV

SEQ ID NO: 1852043 - protein, 5 aa, Staphylococcus
GLRSP

SEQ ID NO: 1852044 - protein, 15 aa, Staphylococcus
GLSPSALNTSSLATA

SEQ ID NO: 1852045 - protein, 6 aa, Staphylococcus
GLSPSH

SEQ ID NO: 1852046 - protein, 5 aa, Staphylococcus
GLSVS

SEQ ID NO: 1852047 - protein, 13 aa, Staphylococcus
GLTEAQKDKEREL

SEQ ID NO: 1852048 - protein, 7 aa, Staphylococcus
GLTGAQA

SEQ ID NO: 1852049 - protein, 38 aa, Staphylococcus
GLTIPKGAKGDKGDAGAKGADATPLTVTGSEKDADGNT

SEQ ID NO: 1852050 - protein, 36 aa, Staphylococcus
GLTNAQKSNENNTISSAKTRDQVSSTLSAAQALDQS

SEQ ID NO: 1852051 - protein, 8 aa, Staphylococcus
GLTNGNSL

SEQ ID NO: 1852052 - protein, 8 aa, Staphylococcus
GLTNGSGI

SEQ ID NO: 1852053 - protein, 6 aa, Staphylococcus
GLTPDQ

SEQ ID NO: 1852054 - protein, 9 aa, Staphylococcus
GLTQEEAVN

SEQ ID NO: 1852055 - protein, 9 aa, Staphylococcus
GLTSTTSDD

SEQ ID NO: 1852056 - protein, 13 aa, Staphylococcus
GLTYGNASHAFGT

SEQ ID NO: 1852057 - protein, 7 aa, Staphylococcus
GMAGVPG

SEQ ID NO: 1852058 - protein, 12 aa, Staphylococcus
GMENTEIGGSSE

SEQ ID NO: 1852059 - protein, 38 aa, Staphylococcus
GMGDNINKQITKQSLQTLEKQNVKVDAKDIDSVTNPVK

SEQ ID NO: 1852060 - protein, 14 aa, Staphylococcus
GMGDNLNKQITNQS

SEQ ID NO: 1852061 - protein, 13 aa, Staphylococcus
GMGDNNIKNPYFK

SEQ ID NO: 1852062 - protein, 5 aa, Staphylococcus
GMGGT

SEQ ID NO: 1852063 - protein, 4 aa, Staphylococcus
GMGN

SEQ ID NO: 1852064 - protein, 9 aa, Staphylococcus
GMGPYPTGK

SEQ ID NO: 1852065 - protein, 8 aa, Staphylococcus
GMGSSAMG

SEQ ID NO: 1852066 - protein, 18 aa, Staphylococcus
GMKPDQVSLSGNNDSASV

SEQ ID NO: 1852067 - protein, 13 aa, Staphylococcus
GMNTAQSGLNDAD

SEQ ID NO: 1852068 - protein, 5 aa, Staphylococcus
GMPPK

SEQ ID NO: 1852069 - protein, 19 aa, Staphylococcus
GMQARANGKPLDVKKGNGI

SEQ ID NO: 1852070 - protein, 12 aa, Staphylococcus
GMSQDDSVNRSG

SEQ ID NO: 1852071 - protein, 9 aa, Staphylococcus
GMTAEDVEN

SEQ ID NO: 1852072 - protein, 18 aa, Staphylococcus
GMTPTNPLSPAEKKKYGA

SEQ ID NO: 1852073 - protein, 7 aa, Staphylococcus
GMTQQSV

SEQ ID NO: 1852074 - protein, 6 aa, Staphylococcus
GMTRAE

SEQ ID NO: 1852075 - protein, 4 aa, Staphylococcus
GMTT

SEQ ID NO: 1852076 - protein, 5 aa, Staphylococcus
GMTTK

SEQ ID NO: 1852077 - protein, 5 aa, Staphylococcus
GMTTT

SEQ ID NO: 1852078 - protein, 8 aa, Staphylococcus
GNAAKKGV

SEQ ID NO: 1852079 - protein, 8 aa, Staphylococcus
GNADEQWT

SEQ ID NO: 1852080 - protein, 13 aa, Staphylococcus
GNAEKVTKKSISK

SEQ ID NO: 1852081 - protein, 20 aa, Staphylococcus
GNAKKTAGNVGKQASAITGK

SEQ ID NO: 1852082 - protein, 17 aa, Staphylococcus
GNAQYDYARSGNPNRTL

SEQ ID NO: 1852083 - protein, 9 aa, Staphylococcus
GNASKPEMG

SEQ ID NO: 1852084 - protein, 8 aa, Staphylococcus
GNASTNTE

SEQ ID NO: 1852085 - protein, 7 aa, Staphylococcus
GNASYER

SEQ ID NO: 1852086 - protein, 5 aa, Staphylococcus
GNDGQ

SEQ ID NO: 1852087 - protein, 5 aa, Staphylococcus
GNDKT

SEQ ID NO: 1852088 - protein, 8 aa, Staphylococcus
GNDVKRAN

SEQ ID NO: 1852089 - protein, 6 aa, Staphylococcus
GNEAIA

SEQ ID NO: 1852090 - protein, 4 aa, Staphylococcus
GNED

SEQ ID NO: 1852091 - protein, 7 aa, Staphylococcus
GNEDQGI

SEQ ID NO: 1852092 - protein, 5 aa, Staphylococcus
GNEKT

SEQ ID NO: 1852093 - protein, 4 aa, Staphylococcus
GNES

SEQ ID NO: 1852094 - protein, 15 aa, Staphylococcus
GNEVQETEEGTHQPR

SEQ ID NO: 1852095 - protein, 6 aa, Staphylococcus
GNEYHG

SEQ ID NO: 1852096 - protein, 6 aa, Staphylococcus
GNFNGE

SEQ ID NO: 1852097 - protein, 11 aa, Staphylococcus
GNGDSTKTRIQ

SEQ ID NO: 1852098 - protein, 11 aa, Staphylococcus
GNGESSQTRVQ

SEQ ID NO: 1852099 - protein, 4 aa, Staphylococcus
GNGG

SEQ ID NO: 1852100 - protein, 15 aa, Staphylococcus
GNGGGTESEENTDVY

SEQ ID NO: 1852101 - protein, 5 aa, Staphylococcus
GNGGI

SEQ ID NO: 1852102 - protein, 10 aa, Staphylococcus
GNGKTPKQLT

SEQ ID NO: 1852103 - protein, 10 aa, Staphylococcus
GNGSPENVNK

SEQ ID NO: 1852104 - protein, 7 aa, Staphylococcus
GNGTHLG

SEQ ID NO: 1852105 - protein, 17 aa, Staphylococcus
GNGTLQESINKPRFYND

SEQ ID NO: 1852106 - protein, 18 aa, Staphylococcus
GNGTLQESINKPRFYNDG

SEQ ID NO: 1852107 - protein, 18 aa, Staphylococcus
GNGTLQESVDKPRFYNDG

SEQ ID NO: 1852108 - protein, 14 aa, Staphylococcus
GNHNVSDSQVEKEL

SEQ ID NO: 1852109 - protein, 9 aa, Staphylococcus
GNIAGSGPI

SEQ ID NO: 1852110 - protein, 6 aa, Staphylococcus
GNISGD

SEQ ID NO: 1852111 - protein, 8 aa, Staphylococcus
GNITNSIQ

SEQ ID NO: 1852112 - protein, 11 aa, Staphylococcus
GNITQDEYDDA

SEQ ID NO: 1852113 - protein, 6 aa, Staphylococcus
GNKDNI

SEQ ID NO: 1852114 - protein, 7 aa, Staphylococcus
GNKLPDP

SEQ ID NO: 1852115 - protein, 9 aa, Staphylococcus
GNKRKVKRD

SEQ ID NO: 1852116 - protein, 6 aa, Staphylococcus
GNKTKN

SEQ ID NO: 1852117 - protein, 6 aa, Staphylococcus
GNLEDA

SEQ ID NO: 1852118 - protein, 5 aa, Staphylococcus
GNLGW

SEQ ID NO: 1852119 - protein, 11 aa, Staphylococcus
GNLPEKKTGIA

SEQ ID NO: 1852120 - protein, 5 aa, Staphylococcus
GNLPP

SEQ ID NO: 1852121 - protein, 6 aa, Staphylococcus
GNLQSL

SEQ ID NO: 1852122 - protein, 10 aa, Staphylococcus
GNNDNPESKQ

SEQ ID NO: 1852123 - protein, 8 aa, Staphylococcus
GNNQNVSS

SEQ ID NO: 1852124 - protein, 24 aa, Staphylococcus
GNNRYGATTSWKDNRQPDKNVAGI

SEQ ID NO: 1852125 - protein, 9 aa, Staphylococcus
GNNSITDDK

SEQ ID NO: 1852126 - protein, 9 aa, Staphylococcus
GNNVPANEN

SEQ ID NO: 1852127 - protein, 5 aa, Staphylococcus
GNPEI

SEQ ID NO: 1852128 - protein, 12 aa, Staphylococcus
GNPIAQSLAEKT

SEQ ID NO: 1852129 - protein, 7 aa, Staphylococcus
GNPITNL

SEQ ID NO: 1852130 - protein, 4 aa, Staphylococcus
GNPK

SEQ ID NO: 1852131 - protein, 15 aa, Staphylococcus
GNPKNKKKKKHDDDN

SEQ ID NO: 1852132 - protein, 12 aa, Staphylococcus
GNPLAQNLAEKT

SEQ ID NO: 1852133 - protein, 7 aa, Staphylococcus
GNPLAQS

SEQ ID NO: 1852134 - protein, 5 aa, Staphylococcus
GNPSN

SEQ ID NO: 1852135 - protein, 32 aa, Staphylococcus
GNQADNDAYEPKTEEVTKDYGTPTTEDDVTGA

SEQ ID NO: 1852136 - protein, 32 aa, Staphylococcus
GNQADNDAYEPKTEGVDKQYGEPTTEDDVTGA

SEQ ID NO: 1852137 - protein, 6 aa, Staphylococcus
GNQAGG

SEQ ID NO: 1852138 - protein, 8 aa, Staphylococcus
GNQDVKVT

SEQ ID NO: 1852139 - protein, 4 aa, Staphylococcus
GNQE

SEQ ID NO: 1852140 - protein, 4 aa, Staphylococcus
GNQL

SEQ ID NO: 1852141 - protein, 8 aa, Staphylococcus
GNQQAQYT

SEQ ID NO: 1852142 - protein, 4 aa, Staphylococcus
GNQS

SEQ ID NO: 1852143 - protein, 5 aa, Staphylococcus
GNQYG

SEQ ID NO: 1852144 - protein, 19 aa, Staphylococcus
GNRYRKDSSNIDKSLNEAE

SEQ ID NO: 1852145 - protein, 5 aa, Staphylococcus
GNRYT

SEQ ID NO: 1852146 - protein, 8 aa, Staphylococcus
GNSESLGG

SEQ ID NO: 1852147 - protein, 5 aa, Staphylococcus
GNSKT

SEQ ID NO: 1852148 - protein, 4 aa, Staphylococcus
GNSN

SEQ ID NO: 1852149 - protein, 7 aa, Staphylococcus
GNTAPIT

SEQ ID NO: 1852150 - protein, 10 aa, Staphylococcus
GNTDESGKMH

SEQ ID NO: 1852151 - protein, 21 aa, Staphylococcus
GNTDVDESLVTGESKKVPKHI

SEQ ID NO: 1852152 - protein, 6 aa, Staphylococcus
GNTISN

SEQ ID NO: 1852153 - protein, 7 aa, Staphylococcus
GNTKSYK

SEQ ID NO: 1852154 - protein, 44 aa, Staphylococcus
GNTLKKENKQAETSSQGKQATQSKQTYPDRNKYTPQQKNKNKKP

SEQ ID NO: 1852155 - protein, 9 aa, Staphylococcus
GNTSSASIP

SEQ ID NO: 1852156 - protein, 8 aa, Staphylococcus
GNTTSDEF

SEQ ID NO: 1852157 - protein, 9 aa, Staphylococcus
GNTTSEDFL

SEQ ID NO: 1852158 - protein, 9 aa, Staphylococcus
GNTYHPKAN

SEQ ID NO: 1852159 - protein, 4 aa, Staphylococcus
GNVD

SEQ ID NO: 1852160 - protein, 13 aa, Staphylococcus
GNVIGSGITDGTG

SEQ ID NO: 1852161 - protein, 6 aa, Staphylococcus
GNVPEH

SEQ ID NO: 1852162 - protein, 4 aa, Staphylococcus
GNYR

SEQ ID NO: 1852163 - protein, 5 aa, Staphylococcus
GNYSM

SEQ ID NO: 1852164 - protein, 12 aa, Staphylococcus
GNYSNYNKPSDK

SEQ ID NO: 1852165 - protein, 7 aa, Staphylococcus
GPAEERV

SEQ ID NO: 1852166 - protein, 8 aa, Staphylococcus
GPALGPTL

SEQ ID NO: 1852167 - protein, 6 aa, Staphylococcus
GPDEDM

SEQ ID NO: 1852168 - protein, 4 aa, Staphylococcus
GPDK

SEQ ID NO: 1852169 - protein, 6 aa, Staphylococcus
GPENSN

SEQ ID NO: 1852170 - protein, 22 aa, Staphylococcus
GPFGAHQSTEENQSADLKGKDK

SEQ ID NO: 1852171 - protein, 21 aa, Staphylococcus
GPFSGSKSENTSTELKGKEKV

SEQ ID NO: 1852172 - protein, 20 aa, Staphylococcus
GPGASVSDFTQNAVSTKAQV

SEQ ID NO: 1852173 - protein, 9 aa, Staphylococcus
GPGEGDVVT

SEQ ID NO: 1852174 - protein, 15 aa, Staphylococcus
GPGTVTTMTQGGAGF

SEQ ID NO: 1852175 - protein, 5 aa, Staphylococcus
GPIGG

SEQ ID NO: 1852176 - protein, 8 aa, Staphylococcus
GPIKNDGK

SEQ ID NO: 1852177 - protein, 13 aa, Staphylococcus
GPIQFSSSSNGQV

SEQ ID NO: 1852178 - protein, 10 aa, Staphylococcus
GPISGMDNPM

SEQ ID NO: 1852179 - protein, 7 aa, Staphylococcus
GPKAYAA

SEQ ID NO: 1852180 - protein, 7 aa, Staphylococcus
GPKMTRP

SEQ ID NO: 1852181 - protein, 6 aa, Staphylococcus
GPKNNV

SEQ ID NO: 1852182 - protein, 8 aa, Staphylococcus
GPKPLTEQ

SEQ ID NO: 1852183 - protein, 6 aa, Staphylococcus
GPKRSK

SEQ ID NO: 1852184 - protein, 9 aa, Staphylococcus
GPKSDQIKH

SEQ ID NO: 1852185 - protein, 12 aa, Staphylococcus
GPLQFSSSGGGQ

SEQ ID NO: 1852186 - protein, 7 aa, Staphylococcus
GPNDGIE

SEQ ID NO: 1852187 - protein, 16 aa, Staphylococcus
GPNKERPTPAYDQRDD

SEQ ID NO: 1852188 - protein, 8 aa, Staphylococcus
GPNNFGGG

SEQ ID NO: 1852189 - protein, 23 aa, Staphylococcus
GPNSPAIPETSQSKTNAADGSVT

SEQ ID NO: 1852190 - protein, 6 aa, Staphylococcus
GPRPAL

SEQ ID NO: 1852191 - protein, 5 aa, Staphylococcus
GPRQP

SEQ ID NO: 1852192 - protein, 18 aa, Staphylococcus
GPSEILGGGASEFSPTQL

SEQ ID NO: 1852193 - protein, 11 aa, Staphylococcus
GPSGCGKSTLS

SEQ ID NO: 1852194 - protein, 9 aa, Staphylococcus
GPSGSGKSS

SEQ ID NO: 1852195 - protein, 9 aa, Staphylococcus
GPSGSGKST

SEQ ID NO: 1852196 - protein, 10 aa, Staphylococcus
GPSGTGKSTI

SEQ ID NO: 1852197 - protein, 5 aa, Staphylococcus
GPSMK

SEQ ID NO: 1852198 - protein, 6 aa, Staphylococcus
GPSSGI

SEQ ID NO: 1852199 - protein, 6 aa, Staphylococcus
GPSVGG

SEQ ID NO: 1852200 - protein, 5 aa, Staphylococcus
GPTGF

SEQ ID NO: 1852201 - protein, 6 aa, Staphylococcus
GPTLPD

SEQ ID NO: 1852202 - protein, 6 aa, Staphylococcus
GPTSLV

SEQ ID NO: 1852203 - protein, 17 aa, Staphylococcus
GPTSQLSITSTNKGTRV

SEQ ID NO: 1852204 - protein, 4 aa, Staphylococcus
GPVA

SEQ ID NO: 1852205 - protein, 8 aa, Staphylococcus
GQADRTYP

SEQ ID NO: 1852206 - protein, 5 aa, Staphylococcus
GQAEM

SEQ ID NO: 1852207 - protein, 9 aa, Staphylococcus
GQAHAAEQL

SEQ ID NO: 1852208 - protein, 14 aa, Staphylococcus
GQAQANESDQPATI

SEQ ID NO: 1852209 - protein, 10 aa, Staphylococcus
GQAQKQTLTT

SEQ ID NO: 1852210 - protein, 10 aa, Staphylococcus
GQAQTENDKA

SEQ ID NO: 1852211 - protein, 9 aa, Staphylococcus
GQDDKGDDG

SEQ ID NO: 1852212 - protein, 6 aa, Staphylococcus
GQDDTS

SEQ ID NO: 1852213 - protein, 20 aa, Staphylococcus
GQDGRDGLNGRDGRDAQPYT

SEQ ID NO: 1852214 - protein, 5 aa, Staphylococcus
GQDKI

SEQ ID NO: 1852215 - protein, 4 aa, Staphylococcus
GQDN

SEQ ID NO: 1852216 - protein, 14 aa, Staphylococcus
GQDPNEVQTSKTRN

SEQ ID NO: 1852217 - protein, 4 aa, Staphylococcus
GQDT

SEQ ID NO: 1852218 - protein, 10 aa, Staphylococcus
GQEANNDNKL

SEQ ID NO: 1852219 - protein, 4 aa, Staphylococcus
GQFE

SEQ ID NO: 1852220 - protein, 8 aa, Staphylococcus
GQFKADNQ

SEQ ID NO: 1852221 - protein, 6 aa, Staphylococcus
GQFSPR

SEQ ID NO: 1852222 - protein, 15 aa, Staphylococcus
GQGADGTNAYKDAGV

SEQ ID NO: 1852223 - protein, 8 aa, Staphylococcus
GQGDDTDS

SEQ ID NO: 1852224 - protein, 7 aa, Staphylococcus
GQGDYTD

SEQ ID NO: 1852225 - protein, 7 aa, Staphylococcus
GQGIPNS

SEQ ID NO: 1852226 - protein, 5 aa, Staphylococcus
GQGRF

SEQ ID NO: 1852227 - protein, 26 aa, Staphylococcus
GQGSANVYQAANKQSVDSNKNDGINT

SEQ ID NO: 1852228 - protein, 15 aa, Staphylococcus
GQGSSSMKSKEQADL

SEQ ID NO: 1852229 - protein, 73 aa, Staphylococcus
GQIIGTGTTDSSGRVNITPTRPIPEGNVTAKAIDNAEHPNSSTSDPVKATDTTPPTKPRVTTPLGGKATTLTP

SEQ ID NO: 1852230 - protein, 10 aa, Staphylococcus
GQIKSNDQYI

SEQ ID NO: 1852231 - protein, 5 aa, Staphylococcus
GQISG

SEQ ID NO: 1852232 - protein, 8 aa, Staphylococcus
GQKAQPVK

SEQ ID NO: 1852233 - protein, 9 aa, Staphylococcus
GQKEDKYNR

SEQ ID NO: 1852234 - protein, 10 aa, Staphylococcus
GQKEGKGGWT

SEQ ID NO: 1852235 - protein, 19 aa, Staphylococcus
GQKGDKVTLAGKLGSEPSV

SEQ ID NO: 1852236 - protein, 8 aa, Staphylococcus
GQKPQFKY

SEQ ID NO: 1852237 - protein, 11 aa, Staphylococcus
GQKSNRDTDVY

SEQ ID NO: 1852238 - protein, 19 aa, Staphylococcus
GQKTLSEYNESFLNFKMNL

SEQ ID NO: 1852239 - protein, 8 aa, Staphylococcus
GQKTSDAV

SEQ ID NO: 1852240 - protein, 6 aa, Staphylococcus
GQLDPN

SEQ ID NO: 1852241 - protein, 5 aa, Staphylococcus
GQMDG

SEQ ID NO: 1852242 - protein, 8 aa, Staphylococcus
GQNALGDD

SEQ ID NO: 1852243 - protein, 15 aa, Staphylococcus
GQNFPEGKGANPKDF

SEQ ID NO: 1852244 - protein, 19 aa, Staphylococcus
GQNGSTDPFSDPYTKPENY

SEQ ID NO: 1852245 - protein, 12 aa, Staphylococcus
GQNNRYKLPSTE

SEQ ID NO: 1852246 - protein, 5 aa, Staphylococcus
GQNPT

SEQ ID NO: 1852247 - protein, 4 aa, Staphylococcus
GQNV

SEQ ID NO: 1852248 - protein, 15 aa, Staphylococcus
GQPATITATKVGNGW

SEQ ID NO: 1852249 - protein, 52 aa, Staphylococcus
GQPEIDEQTDDATTTKPHDQTTSSQSNTHLEGAQPKHPGKVSQPNKKDNDHK

SEQ ID NO: 1852250 - protein, 10 aa, Staphylococcus
GQPNSSPIGS

SEQ ID NO: 1852251 - protein, 4 aa, Staphylococcus
GQPS

SEQ ID NO: 1852252 - protein, 4 aa, Staphylococcus
GQQI

SEQ ID NO: 1852253 - protein, 5 aa, Staphylococcus
GQQQQ

SEQ ID NO: 1852254 - protein, 15 aa, Staphylococcus
GQQSGSKKEAAAAGI

SEQ ID NO: 1852255 - protein, 6 aa, Staphylococcus
GQQTTR

SEQ ID NO: 1852256 - protein, 8 aa, Staphylococcus
GQREEGIS

SEQ ID NO: 1852257 - protein, 8 aa, Staphylococcus
GQSATTGL

SEQ ID NO: 1852258 - protein, 6 aa, Staphylococcus
GQSDTT

SEQ ID NO: 1852259 - protein, 13 aa, Staphylococcus
GQSEHKQQQSLND

SEQ ID NO: 1852260 - protein, 8 aa, Staphylococcus
GQSENPKW

SEQ ID NO: 1852261 - protein, 15 aa, Staphylococcus
GQSFHTGKQSEGSSD

SEQ ID NO: 1852262 - protein, 6 aa, Staphylococcus
GQSFQT

SEQ ID NO: 1852263 - protein, 10 aa, Staphylococcus
GQSGMSYGAL

SEQ ID NO: 1852264 - protein, 14 aa, Staphylococcus
GQSGMSYGALGGRA

SEQ ID NO: 1852265 - protein, 15 aa, Staphylococcus
GQSGMSYGSLGGRAI

SEQ ID NO: 1852266 - protein, 8 aa, Staphylococcus
GQSGVSHS

SEQ ID NO: 1852267 - protein, 6 aa, Staphylococcus
GQSNVT

SEQ ID NO: 1852268 - protein, 4 aa, Staphylococcus
GQSP

SEQ ID NO: 1852269 - protein, 8 aa, Staphylococcus
GQSQTTSI

SEQ ID NO: 1852270 - protein, 7 aa, Staphylococcus
GQSRNYT

SEQ ID NO: 1852271 - protein, 6 aa, Staphylococcus
GQTATI

SEQ ID NO: 1852272 - protein, 6 aa, Staphylococcus
GQTDGL

SEQ ID NO: 1852273 - protein, 9 aa, Staphylococcus
GQTDKLPGK

SEQ ID NO: 1852274 - protein, 4 aa, Staphylococcus
GQTG

SEQ ID NO: 1852275 - protein, 4 aa, Staphylococcus
GQTI

SEQ ID NO: 1852276 - protein, 7 aa, Staphylococcus
GQTLPEN

SEQ ID NO: 1852277 - protein, 9 aa, Staphylococcus
GQTLSGGEV

SEQ ID NO: 1852278 - protein, 7 aa, Staphylococcus
GQTSIDE

SEQ ID NO: 1852279 - protein, 8 aa, Staphylococcus
GQTSIDES

SEQ ID NO: 1852280 - protein, 36 aa, Staphylococcus
GQTSVDESLVTGESKKVQKNQNDNVIGGSINGSGTI

SEQ ID NO: 1852281 - protein, 5 aa, Staphylococcus
GQVPQ

SEQ ID NO: 1852282 - protein, 5 aa, Staphylococcus
GQVQT

SEQ ID NO: 1852283 - protein, 6 aa, Staphylococcus
GQYDAT

SEQ ID NO: 1852284 - protein, 12 aa, Staphylococcus
GRAKPGYPKGYA

SEQ ID NO: 1852285 - protein, 12 aa, Staphylococcus
GRAKSKKDVGTA

SEQ ID NO: 1852286 - protein, 12 aa, Staphylococcus
GRAKTKKDVGTA

SEQ ID NO: 1852287 - protein, 8 aa, Staphylococcus
GRAREHGS

SEQ ID NO: 1852288 - protein, 5 aa, Staphylococcus
GRARR

SEQ ID NO: 1852289 - protein, 6 aa, Staphylococcus
GRATRP

SEQ ID NO: 1852290 - protein, 16 aa, Staphylococcus
GRDDNVNVRKNDGIVP

SEQ ID NO: 1852291 - protein, 25 aa, Staphylococcus
GRDGKDGVDGKSITVTGQKVDPNGN

SEQ ID NO: 1852292 - protein, 5 aa, Staphylococcus
GRDGS

SEQ ID NO: 1852293 - protein, 10 aa, Staphylococcus
GRDNNTDDQK

SEQ ID NO: 1852294 - protein, 9 aa, Staphylococcus
GREGAFNEV

SEQ ID NO: 1852295 - protein, 8 aa, Staphylococcus
GREGRNIR

SEQ ID NO: 1852296 - protein, 5 aa, Staphylococcus
GREKG

SEQ ID NO: 1852297 - protein, 8 aa, Staphylococcus
GREKGWST

SEQ ID NO: 1852298 - protein, 5 aa, Staphylococcus
GRENQ

SEQ ID NO: 1852299 - protein, 10 aa, Staphylococcus
GRESTPQVVR

SEQ ID NO: 1852300 - protein, 5 aa, Staphylococcus
GRFGD

SEQ ID NO: 1852301 - protein, 6 aa, Staphylococcus
GRFSPE

SEQ ID NO: 1852302 - protein, 7 aa, Staphylococcus
GRGEDRV

SEQ ID NO: 1852303 - protein, 5 aa, Staphylococcus
GRGEK

SEQ ID NO: 1852304 - protein, 7 aa, Staphylococcus
GRGENRV

SEQ ID NO: 1852305 - protein, 6 aa, Staphylococcus
GRGEQR

SEQ ID NO: 1852306 - protein, 5 aa, Staphylococcus
GRGIS

SEQ ID NO: 1852307 - protein, 7 aa, Staphylococcus
GRGLPHD

SEQ ID NO: 1852308 - protein, 5 aa, Staphylococcus
GRHKL

SEQ ID NO: 1852309 - protein, 7 aa, Staphylococcus
GRHNPST

SEQ ID NO: 1852310 - protein, 5 aa, Staphylococcus
GRIHP

SEQ ID NO: 1852311 - protein, 6 aa, Staphylococcus
GRISTH

SEQ ID NO: 1852312 - protein, 10 aa, Staphylococcus
GRKEGKGGWT

SEQ ID NO: 1852313 - protein, 8 aa, Staphylococcus
GRKETHFP

SEQ ID NO: 1852314 - protein, 10 aa, Staphylococcus
GRKKEQAQRF

SEQ ID NO: 1852315 - protein, 8 aa, Staphylococcus
GRKQAPPF

SEQ ID NO: 1852316 - protein, 11 aa, Staphylococcus
GRKQGRTDEKE

SEQ ID NO: 1852317 - protein, 11 aa, Staphylococcus
GRLENTSKYNQ

SEQ ID NO: 1852318 - protein, 6 aa, Staphylococcus
GRLNPS

SEQ ID NO: 1852319 - protein, 15 aa, Staphylococcus
GRNKENNVKNNTNFT

SEQ ID NO: 1852320 - protein, 4 aa, Staphylococcus
GRNL

SEQ ID NO: 1852321 - protein, 13 aa, Staphylococcus
GRNLDAKPGNQFE

SEQ ID NO: 1852322 - protein, 8 aa, Staphylococcus
GRNQGPPF

SEQ ID NO: 1852323 - protein, 14 aa, Staphylococcus
GRNYQTTSDNSGRF

SEQ ID NO: 1852324 - protein, 6 aa, Staphylococcus
GRPLNN

SEQ ID NO: 1852325 - protein, 6 aa, Staphylococcus
GRPLTS

SEQ ID NO: 1852326 - protein, 9 aa, Staphylococcus
GRPNTASKS

SEQ ID NO: 1852327 - protein, 5 aa, Staphylococcus
GRPTP

SEQ ID NO: 1852328 - protein, 8 aa, Staphylococcus
GRRDAEAG

SEQ ID NO: 1852329 - protein, 5 aa, Staphylococcus
GRRIG

SEQ ID NO: 1852330 - protein, 9 aa, Staphylococcus
GRRSEAPLE

SEQ ID NO: 1852331 - protein, 6 aa, Staphylococcus
GRSAVD

SEQ ID NO: 1852332 - protein, 6 aa, Staphylococcus
GRTEKR

SEQ ID NO: 1852333 - protein, 9 aa, Staphylococcus
GRTGSGKSA

SEQ ID NO: 1852334 - protein, 5 aa, Staphylococcus
GRTRR

SEQ ID NO: 1852335 - protein, 6 aa, Staphylococcus
GRTRRR

SEQ ID NO: 1852336 - protein, 9 aa, Staphylococcus
GRTSSGKST

SEQ ID NO: 1852337 - protein, 73 aa, Staphylococcus
GRVIGSGTTGANGRVTITPTRPIPEGNVTAKATDNAEHPNSSTSDPVKATDTTPPTKPRVTTPLGGKATTLTP

SEQ ID NO: 1852338 - protein, 59 aa, Staphylococcus
GRVIGSGTTGANGRVTITPTRPIPEGNVTAKATDNAERPNSSTSDPVKATDTTPPTEPV

SEQ ID NO: 1852339 - protein, 6 aa, Staphylococcus
GRVTIN

SEQ ID NO: 1852340 - protein, 7 aa, Staphylococcus
GRVTIND

SEQ ID NO: 1852341 - protein, 5 aa, Staphylococcus
GRYAT

SEQ ID NO: 1852342 - protein, 14 aa, Staphylococcus
GRYSPPPKKKHSKM

SEQ ID NO: 1852343 - protein, 7 aa, Staphylococcus
GSAAKGY

SEQ ID NO: 1852344 - protein, 6 aa, Staphylococcus
GSAFQE

SEQ ID NO: 1852345 - protein, 11 aa, Staphylococcus
GSAGKSQEVGI

SEQ ID NO: 1852346 - protein, 40 aa, Staphylococcus
GSAITIPKGAKGDAGKDGIDGKDAKPLTVTSTEKDADGNT

SEQ ID NO: 1852347 - protein, 25 aa, Staphylococcus
GSAITIPKGAKGDKGETGTPGTSVT

SEQ ID NO: 1852348 - protein, 14 aa, Staphylococcus
GSALSGPASDKLGR

SEQ ID NO: 1852349 - protein, 7 aa, Staphylococcus
GSALTKN

SEQ ID NO: 1852350 - protein, 8 aa, Staphylococcus
GSAQTSND

SEQ ID NO: 1852351 - protein, 7 aa, Staphylococcus
GSASAKW

SEQ ID NO: 1852352 - protein, 7 aa, Staphylococcus
GSATVST

SEQ ID NO: 1852353 - protein, 13 aa, Staphylococcus
GSAVTSVGDNNPY

SEQ ID NO: 1852354 - protein, 8 aa, Staphylococcus
GSDDEEPE

SEQ ID NO: 1852355 - protein, 8 aa, Staphylococcus
GSDGHPRQ

SEQ ID NO: 1852356 - protein, 8 aa, Staphylococcus
GSDHKTEQ

SEQ ID NO: 1852357 - protein, 6 aa, Staphylococcus
GSDIEQ

SEQ ID NO: 1852358 - protein, 6 aa, Staphylococcus
GSDKSK

SEQ ID NO: 1852359 - protein, 5 aa, Staphylococcus
GSDTM

SEQ ID NO: 1852360 - protein, 7 aa, Staphylococcus
GSEGAFN

SEQ ID NO: 1852361 - protein, 9 aa, Staphylococcus
GSEKNTKVA

SEQ ID NO: 1852362 - protein, 7 aa, Staphylococcus
GSETDIN

SEQ ID NO: 1852363 - protein, 7 aa, Staphylococcus
GSETFTD

SEQ ID NO: 1852364 - protein, 8 aa, Staphylococcus
GSFENGVN

SEQ ID NO: 1852365 - protein, 5 aa, Staphylococcus
GSFET

SEQ ID NO: 1852366 - protein, 4 aa, Staphylococcus
GSFS

SEQ ID NO: 1852367 - protein, 11 aa, Staphylococcus
GSFSDLGTNPT

SEQ ID NO: 1852368 - protein, 7 aa, Staphylococcus
GSFSSYS

SEQ ID NO: 1852369 - protein, 8 aa, Staphylococcus
GSFSSYST

SEQ ID NO: 1852370 - protein, 14 aa, Staphylococcus
GSFVKRDNENSPLD

SEQ ID NO: 1852371 - protein, 8 aa, Staphylococcus
GSGATTIT

SEQ ID NO: 1852372 - protein, 6 aa, Staphylococcus
GSGDGF

SEQ ID NO: 1852373 - protein, 13 aa, Staphylococcus
GSGDTQNNFIYNE

SEQ ID NO: 1852374 - protein, 117 aa, Staphylococcus
GSGEAIGDDTDADADADADADADADADADSDADADSDADADADSDADADSDADADADSDADADADSDADADSDADADADADGDHPGEPHHDTDGDNGHHGSGDKELPDTGNDNKQAG

SEQ ID NO: 1852375 - protein, 33 aa, Staphylococcus
GSGGFGNGSSGGGYSGGSFGGGGGFSGGGAGRG

SEQ ID NO: 1852376 - protein, 10 aa, Staphylococcus
GSGSPANVEK

SEQ ID NO: 1852377 - protein, 7 aa, Staphylococcus
GSGSTFN

SEQ ID NO: 1852378 - protein, 8 aa, Staphylococcus
GSGSTFQE

SEQ ID NO: 1852379 - protein, 5 aa, Staphylococcus
GSGTL

SEQ ID NO: 1852380 - protein, 7 aa, Staphylococcus
GSHAPSV

SEQ ID NO: 1852381 - protein, 8 aa, Staphylococcus
GSHSGTEV

SEQ ID NO: 1852382 - protein, 23 aa, Staphylococcus
GSHYKQEIKDNENITVNESVPRG

SEQ ID NO: 1852383 - protein, 9 aa, Staphylococcus
GSIAGGATL

SEQ ID NO: 1852384 - protein, 5 aa, Staphylococcus
GSIAS

SEQ ID NO: 1852385 - protein, 7 aa, Staphylococcus
GSIDKTG

SEQ ID NO: 1852386 - protein, 9 aa, Staphylococcus
GSIEPDKGK

SEQ ID NO: 1852387 - protein, 10 aa, Staphylococcus
GSIEPGTTEL

SEQ ID NO: 1852388 - protein, 5 aa, Staphylococcus
GSIGT

SEQ ID NO: 1852389 - protein, 6 aa, Staphylococcus
GSIKEV

SEQ ID NO: 1852390 - protein, 4 aa, Staphylococcus
GSIN

SEQ ID NO: 1852391 - protein, 8 aa, Staphylococcus
GSIPGTNS

SEQ ID NO: 1852392 - protein, 4 aa, Staphylococcus
GSIQ

SEQ ID NO: 1852393 - protein, 4 aa, Staphylococcus
GSIS

SEQ ID NO: 1852394 - protein, 7 aa, Staphylococcus
GSISTSG

SEQ ID NO: 1852395 - protein, 6 aa, Staphylococcus
GSISTT

SEQ ID NO: 1852396 - protein, 25 aa, Staphylococcus
GSITESSTYGDNETPAPPTKVTGGS

SEQ ID NO: 1852397 - protein, 24 aa, Staphylococcus
GSITESSTYGDNNTPAPPTKEIGG

SEQ ID NO: 1852398 - protein, 11 aa, Staphylococcus
GSITKQDISNY

SEQ ID NO: 1852399 - protein, 6 aa, Staphylococcus
GSKAQI

SEQ ID NO: 1852400 - protein, 16 aa, Staphylococcus
GSKEYVDELKRELEFY

SEQ ID NO: 1852401 - protein, 6 aa, Staphylococcus
GSKIGR

SEQ ID NO: 1852402 - protein, 6 aa, Staphylococcus
GSKLGE

SEQ ID NO: 1852403 - protein, 5 aa, Staphylococcus
GSKNL

SEQ ID NO: 1852404 - protein, 7 aa, Staphylococcus
GSKNLPY

SEQ ID NO: 1852405 - protein, 5 aa, Staphylococcus
GSKPI

SEQ ID NO: 1852406 - protein, 6 aa, Staphylococcus
GSKSNF

SEQ ID NO: 1852407 - protein, 9 aa, Staphylococcus
GSKSVHKSK

SEQ ID NO: 1852408 - protein, 8 aa, Staphylococcus
GSKTFGKG

SEQ ID NO: 1852409 - protein, 10 aa, Staphylococcus
GSKTVREGDV

SEQ ID NO: 1852410 - protein, 7 aa, Staphylococcus
GSKVGEY

SEQ ID NO: 1852411 - protein, 7 aa, Staphylococcus
GSLADKL

SEQ ID NO: 1852412 - protein, 12 aa, Staphylococcus
GSLDQEKTDDSG

SEQ ID NO: 1852413 - protein, 7 aa, Staphylococcus
GSLEPSS

SEQ ID NO: 1852414 - protein, 8 aa, Staphylococcus
GSLEPSSA

SEQ ID NO: 1852415 - protein, 7 aa, Staphylococcus
GSLEPTG

SEQ ID NO: 1852416 - protein, 5 aa, Staphylococcus
GSLLS

SEQ ID NO: 1852417 - protein, 7 aa, Staphylococcus
GSLNPSR

SEQ ID NO: 1852418 - protein, 7 aa, Staphylococcus
GSLNPSS

SEQ ID NO: 1852419 - protein, 5 aa, Staphylococcus
GSLTD

SEQ ID NO: 1852420 - protein, 45 aa, Staphylococcus
GSMPDLKKPEDKESSDKSSFENHSDDKISTSNQQKESYQKEQKTN

SEQ ID NO: 1852421 - protein, 45 aa, Staphylococcus
GSMPDLKKPNDKDKGSRSAFKNHSADEITTNDNEQSDDYNKNKKL

SEQ ID NO: 1852422 - protein, 53 aa, Staphylococcus
GSMPDLKQTKKSADFEVGSTNHAKDYTEKIDKREKDSKTTETESDDSSKSHPR

SEQ ID NO: 1852423 - protein, 45 aa, Staphylococcus
GSMPELKKPSDREKKEDADIQSHDDDKIIDTNEKSKEAENKAKYK

SEQ ID NO: 1852424 - protein, 6 aa, Staphylococcus
GSMSQT

SEQ ID NO: 1852425 - protein, 6 aa, Staphylococcus
GSNAGG

SEQ ID NO: 1852426 - protein, 9 aa, Staphylococcus
GSNEYDRNS

SEQ ID NO: 1852427 - protein, 19 aa, Staphylococcus
GSNKTNKYYNDSKATNTLA

SEQ ID NO: 1852428 - protein, 9 aa, Staphylococcus
GSNPPSHGN

SEQ ID NO: 1852429 - protein, 5 aa, Staphylococcus
GSNSD

SEQ ID NO: 1852430 - protein, 14 aa, Staphylococcus
GSNSPESVSKSQGL

SEQ ID NO: 1852431 - protein, 11 aa, Staphylococcus
GSNSPGEGNTK

SEQ ID NO: 1852432 - protein, 7 aa, Staphylococcus
GSNTNYV

SEQ ID NO: 1852433 - protein, 7 aa, Staphylococcus
GSNYSEK

SEQ ID NO: 1852434 - protein, 7 aa, Staphylococcus
GSPAALS

SEQ ID NO: 1852435 - protein, 13 aa, Staphylococcus
GSPAMATGGMGDT

SEQ ID NO: 1852436 - protein, 10 aa, Staphylococcus
GSPASLPGPS

SEQ ID NO: 1852437 - protein, 10 aa, Staphylococcus
GSPASLSAPS

SEQ ID NO: 1852438 - protein, 9 aa, Staphylococcus
GSPASLSLP

SEQ ID NO: 1852439 - protein, 15 aa, Staphylococcus
GSPFNDAKLNADQKA

SEQ ID NO: 1852440 - protein, 15 aa, Staphylococcus
GSPFNDAKLNAEQKA

SEQ ID NO: 1852441 - protein, 15 aa, Staphylococcus
GSPFNDAKLSADQKE

SEQ ID NO: 1852442 - protein, 15 aa, Staphylococcus
GSPFNDEKLNEEQKQ

SEQ ID NO: 1852443 - protein, 8 aa, Staphylococcus
GSPGYGRT

SEQ ID NO: 1852444 - protein, 9 aa, Staphylococcus
GSPKNKITA

SEQ ID NO: 1852445 - protein, 6 aa, Staphylococcus
GSPQSM

SEQ ID NO: 1852446 - protein, 4 aa, Staphylococcus
GSQA

SEQ ID NO: 1852447 - protein, 5 aa, Staphylococcus
GSQIG

SEQ ID NO: 1852448 - protein, 21 aa, Staphylococcus
GSQSEYSKNSSIKEKEHTNSL

SEQ ID NO: 1852449 - protein, 9 aa, Staphylococcus
GSQYENLRG

SEQ ID NO: 1852450 - protein, 6 aa, Staphylococcus
GSRAIT

SEQ ID NO: 1852451 - protein, 4 aa, Staphylococcus
GSRG

SEQ ID NO: 1852452 - protein, 5 aa, Staphylococcus
GSRGL

SEQ ID NO: 1852453 - protein, 5 aa, Staphylococcus
GSRGS

SEQ ID NO: 1852454 - protein, 8 aa, Staphylococcus
GSRSGQLQ

SEQ ID NO: 1852455 - protein, 7 aa, Staphylococcus
GSRYEIG

SEQ ID NO: 1852456 - protein, 8 aa, Staphylococcus
GSSARKYF

SEQ ID NO: 1852457 - protein, 7 aa, Staphylococcus
GSSDQSI

SEQ ID NO: 1852458 - protein, 7 aa, Staphylococcus
GSSENKM

SEQ ID NO: 1852459 - protein, 8 aa, Staphylococcus
GSSGLSAT

SEQ ID NO: 1852460 - protein, 13 aa, Staphylococcus
GSSKLSGSSNLTL

SEQ ID NO: 1852461 - protein, 5 aa, Staphylococcus
GSSLG

SEQ ID NO: 1852462 - protein, 4 aa, Staphylococcus
GSSP

SEQ ID NO: 1852463 - protein, 4 aa, Staphylococcus
GSST

SEQ ID NO: 1852464 - protein, 6 aa, Staphylococcus
GSSTPY

SEQ ID NO: 1852465 - protein, 7 aa, Staphylococcus
GSSTSEV

SEQ ID NO: 1852466 - protein, 8 aa, Staphylococcus
GSSVKGAT

SEQ ID NO: 1852467 - protein, 9 aa, Staphylococcus
GSSVKGGTL

SEQ ID NO: 1852468 - protein, 24 aa, Staphylococcus
GSSYQMSKGKHGYKTLTYSDKEDH

SEQ ID NO: 1852469 - protein, 5 aa, Staphylococcus
GSTFS

SEQ ID NO: 1852470 - protein, 5 aa, Staphylococcus
GSTFY

SEQ ID NO: 1852471 - protein, 8 aa, Staphylococcus
GSTKKITP

SEQ ID NO: 1852472 - protein, 9 aa, Staphylococcus
GSTKYPESY

SEQ ID NO: 1852473 - protein, 4 aa, Staphylococcus
GSTM

SEQ ID NO: 1852474 - protein, 12 aa, Staphylococcus
GSTMNKNGAITV

SEQ ID NO: 1852475 - protein, 6 aa, Staphylococcus
GSTMNQ

SEQ ID NO: 1852476 - protein, 10 aa, Staphylococcus
GSTQTQQKDL

SEQ ID NO: 1852477 - protein, 12 aa, Staphylococcus
GSTQVDPASTTK

SEQ ID NO: 1852478 - protein, 7 aa, Staphylococcus
GSTRQIT

SEQ ID NO: 1852479 - protein, 9 aa, Staphylococcus
GSTSTGKTF

SEQ ID NO: 1852480 - protein, 16 aa, Staphylococcus
GSTTLSGTQDSTLPKY

SEQ ID NO: 1852481 - protein, 14 aa, Staphylococcus
GSTVENADKIKRAT

SEQ ID NO: 1852482 - protein, 4 aa, Staphylococcus
GSVL

SEQ ID NO: 1852483 - protein, 6 aa, Staphylococcus
GSVPEH

SEQ ID NO: 1852484 - protein, 7 aa, Staphylococcus
GSVSEGI

SEQ ID NO: 1852485 - protein, 24 aa, Staphylococcus
GSYDDSNSDIQVDDENTGLTTEEN

SEQ ID NO: 1852486 - protein, 4 aa, Staphylococcus
GSYL

SEQ ID NO: 1852487 - protein, 5 aa, Staphylococcus
GTAGG

SEQ ID NO: 1852488 - protein, 5 aa, Staphylococcus
GTAGL

SEQ ID NO: 1852489 - protein, 10 aa, Staphylococcus
GTAKATSYGA

SEQ ID NO: 1852490 - protein, 6 aa, Staphylococcus
GTASLA

SEQ ID NO: 1852491 - protein, 5 aa, Staphylococcus
GTDAV

SEQ ID NO: 1852492 - protein, 15 aa, Staphylococcus
GTDDEVGDTNDIQGA

SEQ ID NO: 1852493 - protein, 6 aa, Staphylococcus
GTDTSM

SEQ ID NO: 1852494 - protein, 33 aa, Staphylococcus
GTDTVAPDAPTVDAPEVGADTVTGTGSEPGNTI

SEQ ID NO: 1852495 - protein, 4 aa, Staphylococcus
GTDY

SEQ ID NO: 1852496 - protein, 17 aa, Staphylococcus
GTEAEVERIKGSAQGDV

SEQ ID NO: 1852497 - protein, 7 aa, Staphylococcus
GTEEESL

SEQ ID NO: 1852498 - protein, 7 aa, Staphylococcus
GTEEIKQ

SEQ ID NO: 1852499 - protein, 11 aa, Staphylococcus
GTEGDNVEYKK

SEQ ID NO: 1852500 - protein, 9 aa, Staphylococcus
GTEQMQRDL

SEQ ID NO: 1852501 - protein, 5 aa, Staphylococcus
GTEVE

SEQ ID NO: 1852502 - protein, 17 aa, Staphylococcus
GTFRGRNSNFNGDGFAR

SEQ ID NO: 1852503 - protein, 18 aa, Staphylococcus
GTFRGRNSNFNGEGFSRQ

SEQ ID NO: 1852504 - protein, 8 aa, Staphylococcus
GTFSTGGQ

SEQ ID NO: 1852505 - protein, 15 aa, Staphylococcus
GTGADGKSAYKEAGV

SEQ ID NO: 1852506 - protein, 5 aa, Staphylococcus
GTGAT

SEQ ID NO: 1852507 - protein, 5 aa, Staphylococcus
GTGDI

SEQ ID NO: 1852508 - protein, 13 aa, Staphylococcus
GTGDTQNNFIYNE

SEQ ID NO: 1852509 - protein, 6 aa, Staphylococcus
GTGGGT

SEQ ID NO: 1852510 - protein, 8 aa, Staphylococcus
GTGGSTDL

SEQ ID NO: 1852511 - protein, 7 aa, Staphylococcus
GTGGVSA

SEQ ID NO: 1852512 - protein, 8 aa, Staphylococcus
GTGKVEGD

SEQ ID NO: 1852513 - protein, 6 aa, Staphylococcus
GTGSDI

SEQ ID NO: 1852514 - protein, 7 aa, Staphylococcus
GTGSPIS

SEQ ID NO: 1852515 - protein, 6 aa, Staphylococcus
GTGTGL

SEQ ID NO: 1852516 - protein, 25 aa, Staphylococcus
GTGVDLANSASGPNLSGNDKVAPGY

SEQ ID NO: 1852517 - protein, 4 aa, Staphylococcus
GTHA

SEQ ID NO: 1852518 - protein, 10 aa, Staphylococcus
GTHSATSNGL

SEQ ID NO: 1852519 - protein, 5 aa, Staphylococcus
GTIDQ

SEQ ID NO: 1852520 - protein, 6 aa, Staphylococcus
GTIGNQ

SEQ ID NO: 1852521 - protein, 6 aa, Staphylococcus
GTIKDE

SEQ ID NO: 1852522 - protein, 5 aa, Staphylococcus
GTINN

SEQ ID NO: 1852523 - protein, 4 aa, Staphylococcus
GTIS

SEQ ID NO: 1852524 - protein, 22 aa, Staphylococcus
GTISASSATNNYKSALDGVKST

SEQ ID NO: 1852525 - protein, 8 aa, Staphylococcus
GTISHSQA

SEQ ID NO: 1852526 - protein, 6 aa, Staphylococcus
GTISPE

SEQ ID NO: 1852527 - protein, 5 aa, Staphylococcus
GTITE

SEQ ID NO: 1852528 - protein, 6 aa, Staphylococcus
GTITYG

SEQ ID NO: 1852529 - protein, 4 aa, Staphylococcus
GTKA

SEQ ID NO: 1852530 - protein, 5 aa, Staphylococcus
GTKAY

SEQ ID NO: 1852531 - protein, 7 aa, Staphylococcus
GTKGYFQ

SEQ ID NO: 1852532 - protein, 7 aa, Staphylococcus
GTKKGLL

SEQ ID NO: 1852533 - protein, 14 aa, Staphylococcus
GTKLGTSYISTGED

SEQ ID NO: 1852534 - protein, 5 aa, Staphylococcus
GTKPI

SEQ ID NO: 1852535 - protein, 9 aa, Staphylococcus
GTLAAGQTG

SEQ ID NO: 1852536 - protein, 27 aa, Staphylococcus
GTLDGQSFKSSSVNVSSASNEDDGVSE

SEQ ID NO: 1852537 - protein, 19 aa, Staphylococcus
GTLEATAETRRYQSSLDSL

SEQ ID NO: 1852538 - protein, 4 aa, Staphylococcus
GTLG

SEQ ID NO: 1852539 - protein, 6 aa, Staphylococcus
GTLGTS

SEQ ID NO: 1852540 - protein, 5 aa, Staphylococcus
GTLPN

SEQ ID NO: 1852541 - protein, 8 aa, Staphylococcus
GTLPTGTY

SEQ ID NO: 1852542 - protein, 15 aa, Staphylococcus
GTLQATAETRRYQAS

SEQ ID NO: 1852543 - protein, 8 aa, Staphylococcus
GTLQATGG

SEQ ID NO: 1852544 - protein, 4 aa, Staphylococcus
GTLS

SEQ ID NO: 1852545 - protein, 6 aa, Staphylococcus
GTMPGT

SEQ ID NO: 1852546 - protein, 9 aa, Staphylococcus
GTNATDGTT

SEQ ID NO: 1852547 - protein, 7 aa, Staphylococcus
GTNIEDS

SEQ ID NO: 1852548 - protein, 12 aa, Staphylococcus
GTNKLASSFGSL

SEQ ID NO: 1852549 - protein, 10 aa, Staphylococcus
GTNSNERRYN

SEQ ID NO: 1852550 - protein, 9 aa, Staphylococcus
GTNSTDGTA

SEQ ID NO: 1852551 - protein, 5 aa, Staphylococcus
GTNTI

SEQ ID NO: 1852552 - protein, 11 aa, Staphylococcus
GTNTTERIAAS

SEQ ID NO: 1852553 - protein, 12 aa, Staphylococcus
GTNTTERIAASQ

SEQ ID NO: 1852554 - protein, 8 aa, Staphylococcus
GTPANAAN

SEQ ID NO: 1852555 - protein, 8 aa, Staphylococcus
GTPASLSL

SEQ ID NO: 1852556 - protein, 6 aa, Staphylococcus
GTPDSF

SEQ ID NO: 1852557 - protein, 8 aa, Staphylococcus
GTPERGFE

SEQ ID NO: 1852558 - protein, 14 aa, Staphylococcus
GTPESKDRSSDGKR

SEQ ID NO: 1852559 - protein, 14 aa, Staphylococcus
GTPESKNRHASSRR

SEQ ID NO: 1852560 - protein, 14 aa, Staphylococcus
GTPETKANQTTNTK

SEQ ID NO: 1852561 - protein, 13 aa, Staphylococcus
GTPETKSESTLKQ

SEQ ID NO: 1852562 - protein, 15 aa, Staphylococcus
GTPETTAHQGNEKKR

SEQ ID NO: 1852563 - protein, 12 aa, Staphylococcus
GTPGDKVEYEGD

SEQ ID NO: 1852564 - protein, 11 aa, Staphylococcus
GTPGDTVEYKG

SEQ ID NO: 1852565 - protein, 7 aa, Staphylococcus
GTPGLGE

SEQ ID NO: 1852566 - protein, 32 aa, Staphylococcus
GTPKDNNVYEPTTEGVDKQYGEPTTEDDVTGA

SEQ ID NO: 1852567 - protein, 4 aa, Staphylococcus
GTPM

SEQ ID NO: 1852568 - protein, 6 aa, Staphylococcus
GTPNDV

SEQ ID NO: 1852569 - protein, 6 aa, Staphylococcus
GTPPLE

SEQ ID NO: 1852570 - protein, 7 aa, Staphylococcus
GTPQNRI

SEQ ID NO: 1852571 - protein, 7 aa, Staphylococcus
GTPSDID

SEQ ID NO: 1852572 - protein, 7 aa, Staphylococcus
GTPSDVD

SEQ ID NO: 1852573 - protein, 7 aa, Staphylococcus
GTPSDVN

SEQ ID NO: 1852574 - protein, 8 aa, Staphylococcus
GTPSTSLN

SEQ ID NO: 1852575 - protein, 6 aa, Staphylococcus
GTPTDV

SEQ ID NO: 1852576 - protein, 9 aa, Staphylococcus
GTPTTTVGD

SEQ ID NO: 1852577 - protein, 5 aa, Staphylococcus
GTQAI

SEQ ID NO: 1852578 - protein, 4 aa, Staphylococcus
GTQF

SEQ ID NO: 1852579 - protein, 12 aa, Staphylococcus
GTQGAFNEYERN

SEQ ID NO: 1852580 - protein, 11 aa, Staphylococcus
GTQHVDNSEVK

SEQ ID NO: 1852581 - protein, 4 aa, Staphylococcus
GTQI

SEQ ID NO: 1852582 - protein, 4 aa, Staphylococcus
GTQL

SEQ ID NO: 1852583 - protein, 5 aa, Staphylococcus
GTQLQ

SEQ ID NO: 1852584 - protein, 5 aa, Staphylococcus
GTQSI

SEQ ID NO: 1852585 - protein, 11 aa, Staphylococcus
GTREEATTAKN

SEQ ID NO: 1852586 - protein, 6 aa, Staphylococcus
GTRILN

SEQ ID NO: 1852587 - protein, 6 aa, Staphylococcus
GTRNAI

SEQ ID NO: 1852588 - protein, 6 aa, Staphylococcus
GTRQEN

SEQ ID NO: 1852589 - protein, 7 aa, Staphylococcus
GTRSSLS

SEQ ID NO: 1852590 - protein, 29 aa, Staphylococcus
GTSEVQKEIKRQAKEQAASNPAVDSSSHM

SEQ ID NO: 1852591 - protein, 5 aa, Staphylococcus
GTSGA

SEQ ID NO: 1852592 - protein, 11 aa, Staphylococcus
GTSGSYLSGGE

SEQ ID NO: 1852593 - protein, 7 aa, Staphylococcus
GTSIGTT

SEQ ID NO: 1852594 - protein, 8 aa, Staphylococcus
GTSNTNYV

SEQ ID NO: 1852595 - protein, 8 aa, Staphylococcus
GTSPATIT

SEQ ID NO: 1852596 - protein, 9 aa, Staphylococcus
GTSPATITR

SEQ ID NO: 1852597 - protein, 4 aa, Staphylococcus
GTSR

SEQ ID NO: 1852598 - protein, 6 aa, Staphylococcus
GTSSVG

SEQ ID NO: 1852599 - protein, 5 aa, Staphylococcus
GTSTG

SEQ ID NO: 1852600 - protein, 4 aa, Staphylococcus
GTSV

SEQ ID NO: 1852601 - protein, 7 aa, Staphylococcus
GTTAGTT

SEQ ID NO: 1852602 - protein, 4 aa, Staphylococcus
GTTF

SEQ ID NO: 1852603 - protein, 4 aa, Staphylococcus
GTTK

SEQ ID NO: 1852604 - protein, 4 aa, Staphylococcus
GTTL

SEQ ID NO: 1852605 - protein, 5 aa, Staphylococcus
GTTPI

SEQ ID NO: 1852606 - protein, 5 aa, Staphylococcus
GTTSM

SEQ ID NO: 1852607 - protein, 23 aa, Staphylococcus
GTTTTTSYIESSSGVAVGARTGF

SEQ ID NO: 1852608 - protein, 6 aa, Staphylococcus
GTTVKT

SEQ ID NO: 1852609 - protein, 25 aa, Staphylococcus
GTVDNPSNAATTNSSLTPNDQQAPL

SEQ ID NO: 1852610 - protein, 10 aa, Staphylococcus
GTVDSNGNFS

SEQ ID NO: 1852611 - protein, 4 aa, Staphylococcus
GTVE

SEQ ID NO: 1852612 - protein, 9 aa, Staphylococcus
GTVKAVDET

SEQ ID NO: 1852613 - protein, 11 aa, Staphylococcus
GTVNPRHTDEY

SEQ ID NO: 1852614 - protein, 11 aa, Staphylococcus
GTVNPRKNDEL

SEQ ID NO: 1852615 - protein, 12 aa, Staphylococcus
GTVNPRKSDEYK

SEQ ID NO: 1852616 - protein, 12 aa, Staphylococcus
GTVNPRKTNEYK

SEQ ID NO: 1852617 - protein, 11 aa, Staphylococcus
GTVNPRNNNDL

SEQ ID NO: 1852618 - protein, 11 aa, Staphylococcus
GTVNPRSNDEF

SEQ ID NO: 1852619 - protein, 625 aa, Staphylococcus
GTVNTAGQPSTTSQDQNNQAGTGTPAATQTGQDGAKTNTADHQGQGTAEATGTQTNQADATQTNPSPNTTGQDNQATSTPQGTQTAGTGQTAPTTSTGDTQAKPHAETADQGNGATVTPSPQNDATSPAASTKPEATTGQDATSKPGTTENNSTGQGAQAGTVGAGTPTPSQPETQPNTDTTGSAKPSTSTTDQEKPNTEDHGEQTGTSAGNAQNAAGTPGETKPNQATPAPNNQDTQPGNTNNDAATTPQPGTTGQDTQGTQSKPGTTETGTAQNTGTTDTQAKPEAGNQNAGTTVTPPADKDNQAGQGTAGTTGTPAPETNNGATGTPGTTAPENNNQAGQGTAGTAGTPAPVTNNGATGTPGTTAPENNNQAGQGTASTTGTPTPESNNGATGTPGQTTPNGQDNQEKPSAPGNDQQGQDTPQIGTPGQGTQTGENGTGTTVTPSPNQNQAGNENQTKPGTDNNAGVTTPDQGTAPKPSTDQNPGTDTPEQNNQAGQGTTGTTGTPAPDTNNGATGTPGQTTPSGQDNQEKPNTNNTEQTTPTTPEQNGQLGAGVKPGTANPDQNTEVKPDDNGNPKPDTVQKPGTNQTGGDTGRNTGEDKGGQTGGDTGNTDSDNKQTVVN

SEQ ID NO: 1852620 - protein, 26 aa, Staphylococcus
GTYEGKTFKSDSVNVTSSSDDEDVTD

SEQ ID NO: 1852621 - protein, 4 aa, Staphylococcus
GTYR

SEQ ID NO: 1852622 - protein, 6 aa, Staphylococcus
GTYSDV

SEQ ID NO: 1852623 - protein, 6 aa, Staphylococcus
GTYSEI

SEQ ID NO: 1852624 - protein, 5 aa, Staphylococcus
GVAGY

SEQ ID NO: 1852625 - protein, 28 aa, Staphylococcus
GVASAHKKEDKKQSFNAKMTNSQHSGDI

SEQ ID NO: 1852626 - protein, 5 aa, Staphylococcus
GVASY

SEQ ID NO: 1852627 - protein, 8 aa, Staphylococcus
GVDAQKGG

SEQ ID NO: 1852628 - protein, 8 aa, Staphylococcus
GVDKETAL

SEQ ID NO: 1852629 - protein, 9 aa, Staphylococcus
GVDSPTKIT

SEQ ID NO: 1852630 - protein, 5 aa, Staphylococcus
GVEDR

SEQ ID NO: 1852631 - protein, 7 aa, Staphylococcus
GVELKDP

SEQ ID NO: 1852632 - protein, 8 aa, Staphylococcus
GVEPGKPT

SEQ ID NO: 1852633 - protein, 6 aa, Staphylococcus
GVESIG

SEQ ID NO: 1852634 - protein, 9 aa, Staphylococcus
GVESPTEIT

SEQ ID NO: 1852635 - protein, 10 aa, Staphylococcus
GVGDRVAHGG

SEQ ID NO: 1852636 - protein, 4 aa, Staphylococcus
GVGG

SEQ ID NO: 1852637 - protein, 6 aa, Staphylococcus
GVGISK

SEQ ID NO: 1852638 - protein, 6 aa, Staphylococcus
GVGISQ

SEQ ID NO: 1852639 - protein, 6 aa, Staphylococcus
GVGPAK

SEQ ID NO: 1852640 - protein, 4 aa, Staphylococcus
GVGS

SEQ ID NO: 1852641 - protein, 6 aa, Staphylococcus
GVGSHT

SEQ ID NO: 1852642 - protein, 6 aa, Staphylococcus
GVIGGT

SEQ ID NO: 1852643 - protein, 13 aa, Staphylococcus
GVKEKRNDPNFGS

SEQ ID NO: 1852644 - protein, 5 aa, Staphylococcus
GVKET

SEQ ID NO: 1852645 - protein, 7 aa, Staphylococcus
GVKETFP

SEQ ID NO: 1852646 - protein, 4 aa, Staphylococcus
GVKK

SEQ ID NO: 1852647 - protein, 29 aa, Staphylococcus
GVKSAKIKESEDSTYSAKVTNTHGSGEIS

SEQ ID NO: 1852648 - protein, 10 aa, Staphylococcus
GVKSPNEITE

SEQ ID NO: 1852649 - protein, 10 aa, Staphylococcus
GVLENQGQSF

SEQ ID NO: 1852650 - protein, 8 aa, Staphylococcus
GVNDAPAL

SEQ ID NO: 1852651 - protein, 11 aa, Staphylococcus
GVNDAPALAAS

SEQ ID NO: 1852652 - protein, 7 aa, Staphylococcus
GVNDSDG

SEQ ID NO: 1852653 - protein, 24 aa, Staphylococcus
GVNKATVNLTTESATVEYNPDMTS

SEQ ID NO: 1852654 - protein, 13 aa, Staphylococcus
GVNKMESENASGE

SEQ ID NO: 1852655 - protein, 13 aa, Staphylococcus
GVNNNSVTYEQTY

SEQ ID NO: 1852656 - protein, 9 aa, Staphylococcus
GVNNPTNIT

SEQ ID NO: 1852657 - protein, 9 aa, Staphylococcus
GVNSPTEIT

SEQ ID NO: 1852658 - protein, 24 aa, Staphylococcus
GVNTITRPTGTPIKQLSATNQLNE

SEQ ID NO: 1852659 - protein, 4 aa, Staphylococcus
GVPE

SEQ ID NO: 1852660 - protein, 4 aa, Staphylococcus
GVPG

SEQ ID NO: 1852661 - protein, 5 aa, Staphylococcus
GVPND

SEQ ID NO: 1852662 - protein, 17 aa, Staphylococcus
GVPNYENSHPHQSTTER

SEQ ID NO: 1852663 - protein, 17 aa, Staphylococcus
GVPNYENSHPHQSTTGR

SEQ ID NO: 1852664 - protein, 17 aa, Staphylococcus
GVPNYQNSHPHQSTSGR

SEQ ID NO: 1852665 - protein, 4 aa, Staphylococcus
GVPQ

SEQ ID NO: 1852666 - protein, 5 aa, Staphylococcus
GVPSN

SEQ ID NO: 1852667 - protein, 5 aa, Staphylococcus
GVPTE

SEQ ID NO: 1852668 - protein, 7 aa, Staphylococcus
GVQEGMK

SEQ ID NO: 1852669 - protein, 13 aa, Staphylococcus
GVQEKRNDPNFGS

SEQ ID NO: 1852670 - protein, 9 aa, Staphylococcus
GVQNGSEVV

SEQ ID NO: 1852671 - protein, 17 aa, Staphylococcus
GVRSKKLKQYDTDEVES

SEQ ID NO: 1852672 - protein, 26 aa, Staphylococcus
GVSENNNDNLDNSSDVSANGDAVENV

SEQ ID NO: 1852673 - protein, 13 aa, Staphylococcus
GVSLSGGQKQRVS

SEQ ID NO: 1852674 - protein, 8 aa, Staphylococcus
GVSSEREP

SEQ ID NO: 1852675 - protein, 9 aa, Staphylococcus
GVSSPTEIT

SEQ ID NO: 1852676 - protein, 9 aa, Staphylococcus
GVSTSTSQL

SEQ ID NO: 1852677 - protein, 12 aa, Staphylococcus
GVTATAKAPNIM

SEQ ID NO: 1852678 - protein, 21 aa, Staphylococcus
GVTDEKGNAIITPTKPIPEGN

SEQ ID NO: 1852679 - protein, 7 aa, Staphylococcus
GVTPQIG

SEQ ID NO: 1852680 - protein, 11 aa, Staphylococcus
GVTTENHGKVS

SEQ ID NO: 1852681 - protein, 5 aa, Staphylococcus
GVTTG

SEQ ID NO: 1852682 - protein, 4 aa, Staphylococcus
GVVR

SEQ ID NO: 1852683 - protein, 5 aa, Staphylococcus
GVYEK

SEQ ID NO: 1852684 - protein, 5 aa, Staphylococcus
GWAKN

SEQ ID NO: 1852685 - protein, 7 aa, Staphylococcus
GYAGSKY

SEQ ID NO: 1852686 - protein, 4 aa, Staphylococcus
GYAN

SEQ ID NO: 1852687 - protein, 5 aa, Staphylococcus
GYANI

SEQ ID NO: 1852688 - protein, 5 aa, Staphylococcus
GYANV

SEQ ID NO: 1852689 - protein, 10 aa, Staphylococcus
GYDTEVGERG

SEQ ID NO: 1852690 - protein, 15 aa, Staphylococcus
GYDTGEENNDFDGTL

SEQ ID NO: 1852691 - protein, 11 aa, Staphylococcus
GYDTQKIRTSY

SEQ ID NO: 1852692 - protein, 22 aa, Staphylococcus
GYEAQPKKEASEKSSQKEKQLK

SEQ ID NO: 1852693 - protein, 9 aa, Staphylococcus
GYEPQEGPG

SEQ ID NO: 1852694 - protein, 11 aa, Staphylococcus
GYEPSDELKED

SEQ ID NO: 1852695 - protein, 4 aa, Staphylococcus
GYER

SEQ ID NO: 1852696 - protein, 5 aa, Staphylococcus
GYGAI

SEQ ID NO: 1852697 - protein, 4 aa, Staphylococcus
GYGS

SEQ ID NO: 1852698 - protein, 10 aa, Staphylococcus
GYGSSGLVGQ

SEQ ID NO: 1852699 - protein, 10 aa, Staphylococcus
GYHKLNGDEA

SEQ ID NO: 1852700 - protein, 8 aa, Staphylococcus
GYKDNGWS

SEQ ID NO: 1852701 - protein, 9 aa, Staphylococcus
GYKESNSFV

SEQ ID NO: 1852702 - protein, 5 aa, Staphylococcus
GYKGN

SEQ ID NO: 1852703 - protein, 15 aa, Staphylococcus
GYKKDGKSGKPLQQY

SEQ ID NO: 1852704 - protein, 10 aa, Staphylococcus
GYKPSDELKA

SEQ ID NO: 1852705 - protein, 7 aa, Staphylococcus
GYNVPER

SEQ ID NO: 1852706 - protein, 7 aa, Staphylococcus
GYPGYDD

SEQ ID NO: 1852707 - protein, 21 aa, Staphylococcus
GYPNVTDAYQPEGSINVSQTG

SEQ ID NO: 1852708 - protein, 10 aa, Staphylococcus
GYQKLNGDEA

SEQ ID NO: 1852709 - protein, 15 aa, Staphylococcus
GYQNISSKKKSNANT

SEQ ID NO: 1852710 - protein, 9 aa, Staphylococcus
GYQPQEGPG

SEQ ID NO: 1852711 - protein, 8 aa, Staphylococcus
GYSEESKE

SEQ ID NO: 1852712 - protein, 8 aa, Staphylococcus
GYSESNSF

SEQ ID NO: 1852713 - protein, 9 aa, Staphylococcus
GYSGDNPTS

SEQ ID NO: 1852714 - protein, 8 aa, Staphylococcus
GYSGYNGR

SEQ ID NO: 1852715 - protein, 15 aa, Staphylococcus
GYSGYNGRLNANSSG

SEQ ID NO: 1852716 - protein, 15 aa, Staphylococcus
GYSGYNGRLNEESSG

SEQ ID NO: 1852717 - protein, 15 aa, Staphylococcus
GYSGYNGRLNEQSTG

SEQ ID NO: 1852718 - protein, 16 aa, Staphylococcus
GYSGYNGSLNDSSSGI

SEQ ID NO: 1852719 - protein, 7 aa, Staphylococcus
GYSPDNI

SEQ ID NO: 1852720 - protein, 5 aa, Staphylococcus
GYSTR

SEQ ID NO: 1852721 - protein, 9 aa, Staphylococcus
GYTIDSGNK

SEQ ID NO: 1852722 - protein, 9 aa, Staphylococcus
GYTMESGNK

SEQ ID NO: 1852723 - protein, 16 aa, Staphylococcus
GYTSTANRDETASSGM

SEQ ID NO: 1852724 - protein, 4 aa, Staphylococcus
GYYG

SEQ ID NO: 1852725 - protein, 8 aa, Staphylococcus
GYYSKEDK

SEQ ID NO: 1852726 - protein, 8 aa, Staphylococcus
GYYSREEK

SEQ ID NO: 1852727 - protein, 19 aa, Staphylococcus
HADELPKAKIDANNDIDQK

SEQ ID NO: 1852728 - protein, 13 aa, Staphylococcus
HADKKDNDGNNET

SEQ ID NO: 1852729 - protein, 18 aa, Staphylococcus
HADQDAKWEKIKESGELR

SEQ ID NO: 1852730 - protein, 10 aa, Staphylococcus
HADQKGDKTY

SEQ ID NO: 1852731 - protein, 8 aa, Staphylococcus
HADSEHLE

SEQ ID NO: 1852732 - protein, 6 aa, Staphylococcus
HADSTI

SEQ ID NO: 1852733 - protein, 8 aa, Staphylococcus
HADTNQDV

SEQ ID NO: 1852734 - protein, 13 aa, Staphylococcus
HAEEGTEGNTWQR

SEQ ID NO: 1852735 - protein, 18 aa, Staphylococcus
HAEQDKNWEKIKESGELK

SEQ ID NO: 1852736 - protein, 22 aa, Staphylococcus
HAESGIAKAAKTTSSNHKQVNS

SEQ ID NO: 1852737 - protein, 7 aa, Staphylococcus
HAESHSE

SEQ ID NO: 1852738 - protein, 14 aa, Staphylococcus
HAETAENQSIDENH

SEQ ID NO: 1852739 - protein, 5 aa, Staphylococcus
HAFGT

SEQ ID NO: 1852740 - protein, 6 aa, Staphylococcus
HAFGTA

SEQ ID NO: 1852741 - protein, 4 aa, Staphylococcus
HAGN

SEQ ID NO: 1852742 - protein, 79 aa, Staphylococcus
HAHHNETESEPVEEPQQRRRPSRRSMERKEQAFDTTTGSTDQIQNEQESYDDKYEQFPKRAVESEYRSDDNEHDEEPTI

SEQ ID NO: 1852743 - protein, 102 aa, Staphylococcus
HAINSNSNASYAQSQSMNQGAPSNSMNQQNASTENSSNSNFNHSQHQQAQNNTNQQQFQNQQYQQQNQQFQNQQFQQQPHGYQKQPNQFSEQAKEVTAESKG

SEQ ID NO: 1852744 - protein, 6 aa, Staphylococcus
HAKNGG

SEQ ID NO: 1852745 - protein, 6 aa, Staphylococcus
HAKPPV

SEQ ID NO: 1852746 - protein, 7 aa, Staphylococcus
HAKPTKA

SEQ ID NO: 1852747 - protein, 6 aa, Staphylococcus
HAKPTP

SEQ ID NO: 1852748 - protein, 19 aa, Staphylococcus
HAKQAQKYLQSKDKVKTVQ

SEQ ID NO: 1852749 - protein, 10 aa, Staphylococcus
HAKSAAVKEP

SEQ ID NO: 1852750 - protein, 10 aa, Staphylococcus
HAKSDAVKQP

SEQ ID NO: 1852751 - protein, 10 aa, Staphylococcus
HAKSSAVNQP

SEQ ID NO: 1852752 - protein, 10 aa, Staphylococcus
HALSKTQASV

SEQ ID NO: 1852753 - protein, 6 aa, Staphylococcus
HAMSKT

SEQ ID NO: 1852754 - protein, 34 aa, Staphylococcus
HANATDESKAQAIKSVENAAKHANADIDHASSNI

SEQ ID NO: 1852755 - protein, 5 aa, Staphylococcus
HAPDI

SEQ ID NO: 1852756 - protein, 5 aa, Staphylococcus
HAPEE

SEQ ID NO: 1852757 - protein, 10 aa, Staphylococcus
HAPISPDYNK

SEQ ID NO: 1852758 - protein, 6 aa, Staphylococcus
HAPSTV

SEQ ID NO: 1852759 - protein, 5 aa, Staphylococcus
HAPSV

SEQ ID NO: 1852760 - protein, 11 aa, Staphylococcus
HAPVSAQYKEG

SEQ ID NO: 1852761 - protein, 11 aa, Staphylococcus
HASAMSDNELK

SEQ ID NO: 1852762 - protein, 8 aa, Staphylococcus
HASTKSAT

SEQ ID NO: 1852763 - protein, 19 aa, Staphylococcus
HATGTKNYKIGDTIKNGDL

SEQ ID NO: 1852764 - protein, 4 aa, Staphylococcus
HATK

SEQ ID NO: 1852765 - protein, 14 aa, Staphylococcus
HATLEKTTPPQNGV

SEQ ID NO: 1852766 - protein, 8 aa, Staphylococcus
HATPETSF

SEQ ID NO: 1852767 - protein, 14 aa, Staphylococcus
HATRAQIESAAGQV

SEQ ID NO: 1852768 - protein, 5 aa, Staphylococcus
HATRD

SEQ ID NO: 1852769 - protein, 15 aa, Staphylococcus
HATSVTGSLTETQND

SEQ ID NO: 1852770 - protein, 24 aa, Staphylococcus
HAYEQKKQAINDSNQSTTEEKNDA

SEQ ID NO: 1852771 - protein, 4 aa, Staphylococcus
HDAE

SEQ ID NO: 1852772 - protein, 20 aa, Staphylococcus
HDAKDELPDTGDSDSNSTGL

SEQ ID NO: 1852773 - protein, 10 aa, Staphylococcus
HDAKRTVDTI

SEQ ID NO: 1852774 - protein, 46 aa, Staphylococcus
HDDNNQNHYNEDTTYEYNNNTPVNKDENYDVDKNPNNEQPEDHETF

SEQ ID NO: 1852775 - protein, 10 aa, Staphylococcus
HDEEGDFGRV

SEQ ID NO: 1852776 - protein, 4 aa, Staphylococcus
HDEI

SEQ ID NO: 1852777 - protein, 7 aa, Staphylococcus
HDFTGDT

SEQ ID NO: 1852778 - protein, 10 aa, Staphylococcus
HDGDTIEYDH

SEQ ID NO: 1852779 - protein, 14 aa, Staphylococcus
HDHDETTLCTGVHH

SEQ ID NO: 1852780 - protein, 8 aa, Staphylococcus
HDIESGAF

SEQ ID NO: 1852781 - protein, 5 aa, Staphylococcus
HDINE

SEQ ID NO: 1852782 - protein, 17 aa, Staphylococcus
HDKATANHATEGKNVAG

SEQ ID NO: 1852783 - protein, 5 aa, Staphylococcus
HDLKS

SEQ ID NO: 1852784 - protein, 5 aa, Staphylococcus
HDLVP

SEQ ID NO: 1852785 - protein, 10 aa, Staphylococcus
HDNANFDTSY

SEQ ID NO: 1852786 - protein, 22 aa, Staphylococcus
HDNGPNQKNGKSRQGLNTEHYN

SEQ ID NO: 1852787 - protein, 8 aa, Staphylococcus
HDNPGGGF

SEQ ID NO: 1852788 - protein, 8 aa, Staphylococcus
HDNSAETQ

SEQ ID NO: 1852789 - protein, 8 aa, Staphylococcus
HDNSEIDQ

SEQ ID NO: 1852790 - protein, 4 aa, Staphylococcus
HDNT

SEQ ID NO: 1852791 - protein, 7 aa, Staphylococcus
HDNVTGS

SEQ ID NO: 1852792 - protein, 9 aa, Staphylococcus
HDPQKAKYG

SEQ ID NO: 1852793 - protein, 5 aa, Staphylococcus
HDPVM

SEQ ID NO: 1852794 - protein, 5 aa, Staphylococcus
HDQIN

SEQ ID NO: 1852795 - protein, 12 aa, Staphylococcus
HDRNSGGNEAQG

SEQ ID NO: 1852796 - protein, 14 aa, Staphylococcus
HDSELDEAERSSDD

SEQ ID NO: 1852797 - protein, 47 aa, Staphylococcus
HDTKSNNEKSTGNSKQSQNEPKAKNKTPKQQQRAEKAKSKIDKRTFN

SEQ ID NO: 1852798 - protein, 23 aa, Staphylococcus
HDTPANNRLPAQPQNGKSYSLKE

SEQ ID NO: 1852799 - protein, 9 aa, Staphylococcus
HDTTQQSFT

SEQ ID NO: 1852800 - protein, 28 aa, Staphylococcus
HDTTQSNNDKKQQELPATGAVDDNGYQA

SEQ ID NO: 1852801 - protein, 6 aa, Staphylococcus
HDTYSG

SEQ ID NO: 1852802 - protein, 13 aa, Staphylococcus
HDVDDNNDTDPGF

SEQ ID NO: 1852803 - protein, 10 aa, Staphylococcus
HDVDSSEAMK

SEQ ID NO: 1852804 - protein, 13 aa, Staphylococcus
HDVQGGSTITQQT

SEQ ID NO: 1852805 - protein, 12 aa, Staphylococcus
HDVTNSTKQLAR

SEQ ID NO: 1852806 - protein, 14 aa, Staphylococcus
HDYAEQDVERRNLP

SEQ ID NO: 1852807 - protein, 13 aa, Staphylococcus
HDYAEQDVTRRNL

SEQ ID NO: 1852808 - protein, 25 aa, Staphylococcus
HDYGTPTTADEVKNSVKVPGYPTSV

SEQ ID NO: 1852809 - protein, 6 aa, Staphylococcus
HEAGAD

SEQ ID NO: 1852810 - protein, 7 aa, Staphylococcus
HEAKQKE

SEQ ID NO: 1852811 - protein, 8 aa, Staphylococcus
HEAKQKEV

SEQ ID NO: 1852812 - protein, 10 aa, Staphylococcus
HEAKTSIKRR

SEQ ID NO: 1852813 - protein, 6 aa, Staphylococcus
HEDNHS

SEQ ID NO: 1852814 - protein, 22 aa, Staphylococcus
HEDQPEGDDHHFDESGVEKKVG

SEQ ID NO: 1852815 - protein, 5 aa, Staphylococcus
HEEAK

SEQ ID NO: 1852816 - protein, 8 aa, Staphylococcus
HEEKQKEV

SEQ ID NO: 1852817 - protein, 39 aa, Staphylococcus
HEEKSIQQDNSTKNERKSTPKQAQRVEKAKSKIDKRTFN

SEQ ID NO: 1852818 - protein, 15 aa, Staphylococcus
HEELADQLTKRQEYL

SEQ ID NO: 1852819 - protein, 6 aa, Staphylococcus
HEGGDI

SEQ ID NO: 1852820 - protein, 5 aa, Staphylococcus
HEGNL

SEQ ID NO: 1852821 - protein, 6 aa, Staphylococcus
HEGSVG

SEQ ID NO: 1852822 - protein, 17 aa, Staphylococcus
HEHRQQQNKEKVQINNK

SEQ ID NO: 1852823 - protein, 15 aa, Staphylococcus
HEKDRKSLDSKSQLE

SEQ ID NO: 1852824 - protein, 18 aa, Staphylococcus
HEKDRLSLTSEEEKSNFD

SEQ ID NO: 1852825 - protein, 5 aa, Staphylococcus
HENEK

SEQ ID NO: 1852826 - protein, 6 aa, Staphylococcus
HENQKI

SEQ ID NO: 1852827 - protein, 40 aa, Staphylococcus
HENRANEEKYELDKTKTVPLTKDELNKKINDTHNDDDLNK

SEQ ID NO: 1852828 - protein, 16 aa, Staphylococcus
HENSAKDQQESHLDDS

SEQ ID NO: 1852829 - protein, 13 aa, Staphylococcus
HEPIDGIGQKPKR

SEQ ID NO: 1852830 - protein, 17 aa, Staphylococcus
HEQDRMSIGNDEEQQNF

SEQ ID NO: 1852831 - protein, 6 aa, Staphylococcus
HEQRAN

SEQ ID NO: 1852832 - protein, 6 aa, Staphylococcus
HERKQK

SEQ ID NO: 1852833 - protein, 9 aa, Staphylococcus
HESGTRDIR

SEQ ID NO: 1852834 - protein, 5 aa, Staphylococcus
HESGV

SEQ ID NO: 1852835 - protein, 207 aa, Staphylococcus
HESSNNQQSENRHDINNEKDQSDKDSNNKKGAVIASSGAAGVGAYAASKHNDAASSSKDHNDKAHQQNQDWEQSNQTNDSTETQDENTNNHDSKKKGAAVAGGAAAAGAGAYAAGKHKGKKDKNDNEPEQNESKSDVKNEEKHGSKKKGAAVAGGAAAAGTGAAAASHSKSSTGNGGNGNGGNGGNGNNGDNNHDSEDNNKKKGGLL

SEQ ID NO: 1852836 - protein, 8 aa, Staphylococcus
HETGTRDI

SEQ ID NO: 1852837 - protein, 8 aa, Staphylococcus
HETGTRDV

SEQ ID NO: 1852838 - protein, 8 aa, Staphylococcus
HETGTRNL

SEQ ID NO: 1852839 - protein, 4 aa, Staphylococcus
HETN

SEQ ID NO: 1852840 - protein, 14 aa, Staphylococcus
HETPQTEGVSSAMN

SEQ ID NO: 1852841 - protein, 5 aa, Staphylococcus
HETQG

SEQ ID NO: 1852842 - protein, 11 aa, Staphylococcus
HEVDSSEAMKS

SEQ ID NO: 1852843 - protein, 13 aa, Staphylococcus
HEVRETNDQFSER

SEQ ID NO: 1852844 - protein, 5 aa, Staphylococcus
HEYSK

SEQ ID NO: 1852845 - protein, 12 aa, Staphylococcus
HFEEKNQPYDTD

SEQ ID NO: 1852846 - protein, 28 aa, Staphylococcus
HFNEEQDNDEDNDQNPEPNVPLGKNLKE

SEQ ID NO: 1852847 - protein, 10 aa, Staphylococcus
HFNQDSEKAS

SEQ ID NO: 1852848 - protein, 14 aa, Staphylococcus
HFPNDQLDDEYSDG

SEQ ID NO: 1852849 - protein, 5 aa, Staphylococcus
HGDKI

SEQ ID NO: 1852850 - protein, 6 aa, Staphylococcus
HGDLGE

SEQ ID NO: 1852851 - protein, 7 aa, Staphylococcus
HGDVEPT

SEQ ID NO: 1852852 - protein, 6 aa, Staphylococcus
HGGDMY

SEQ ID NO: 1852853 - protein, 10 aa, Staphylococcus
HGGDYAGKLT

SEQ ID NO: 1852854 - protein, 10 aa, Staphylococcus
HGGDYAGKMT

SEQ ID NO: 1852855 - protein, 6 aa, Staphylococcus
HGGFTD

SEQ ID NO: 1852856 - protein, 6 aa, Staphylococcus
HGGQID

SEQ ID NO: 1852857 - protein, 10 aa, Staphylococcus
HGGSYGGKMT

SEQ ID NO: 1852858 - protein, 5 aa, Staphylococcus
HGHEA

SEQ ID NO: 1852859 - protein, 9 aa, Staphylococcus
HGHEKTEKG

SEQ ID NO: 1852860 - protein, 17 aa, Staphylococcus
HGHSYAKQQKWTSPEKA

SEQ ID NO: 1852861 - protein, 9 aa, Staphylococcus
HGIKDGKHN

SEQ ID NO: 1852862 - protein, 8 aa, Staphylococcus
HGKDRQRA

SEQ ID NO: 1852863 - protein, 4 aa, Staphylococcus
HGKG

SEQ ID NO: 1852864 - protein, 8 aa, Staphylococcus
HGKTNSSK

SEQ ID NO: 1852865 - protein, 4 aa, Staphylococcus
HGLP

SEQ ID NO: 1852866 - protein, 21 aa, Staphylococcus
HGNDSETHSHNSEEDNEHKSG

SEQ ID NO: 1852867 - protein, 14 aa, Staphylococcus
HGPGGRIAEFIEGI

SEQ ID NO: 1852868 - protein, 5 aa, Staphylococcus
HGPSN

SEQ ID NO: 1852869 - protein, 4 aa, Staphylococcus
HGQV

SEQ ID NO: 1852870 - protein, 10 aa, Staphylococcus
HGSKTSSSHN

SEQ ID NO: 1852871 - protein, 6 aa, Staphylococcus
HGSNEK

SEQ ID NO: 1852872 - protein, 9 aa, Staphylococcus
HGSSMTNTV

SEQ ID NO: 1852873 - protein, 10 aa, Staphylococcus
HGTDSNTHHD

SEQ ID NO: 1852874 - protein, 4 aa, Staphylococcus
HGTE

SEQ ID NO: 1852875 - protein, 5 aa, Staphylococcus
HGTEA

SEQ ID NO: 1852876 - protein, 5 aa, Staphylococcus
HGTIN

SEQ ID NO: 1852877 - protein, 18 aa, Staphylococcus
HGVPSTVNSHPHQSNNER

SEQ ID NO: 1852878 - protein, 18 aa, Staphylococcus
HGVPSTVNSHPHQSNNGR

SEQ ID NO: 1852879 - protein, 6 aa, Staphylococcus
HGVTQL

SEQ ID NO: 1852880 - protein, 11 aa, Staphylococcus
HHATPEQNKMD

SEQ ID NO: 1852881 - protein, 19 aa, Staphylococcus
HHDTNSRNPEYPSHPTRSR

SEQ ID NO: 1852882 - protein, 21 aa, Staphylococcus
HHEKGASDNDSYEEEEKKSGV

SEQ ID NO: 1852883 - protein, 7 aa, Staphylococcus
HHGKDNI

SEQ ID NO: 1852884 - protein, 9 aa, Staphylococcus
HHGSKTSSS

SEQ ID NO: 1852885 - protein, 11 aa, Staphylococcus
HHGSKTSSSES

SEQ ID NO: 1852886 - protein, 10 aa, Staphylococcus
HHGSKTSSSK

SEQ ID NO: 1852887 - protein, 11 aa, Staphylococcus
HHGSKTSSSSN

SEQ ID NO: 1852888 - protein, 119 aa, Staphylococcus
HHHDEKNKNHEDKHASHDQHHDTNDKRNNQHDKDFDHERRNNDNKDYDKKSGKGKKAAAVGTGAAGAAGAAGLAKHEHDKHKDNRNQHDHGRRDDRNNNRDDRNYDRRNDNRDNKKKGG

SEQ ID NO: 1852889 - protein, 154 aa, Staphylococcus
HHHDKKDDHTDDNELKNDRNQNHRDDKHNDKDVKDKHQSDDEKSGKGKKAAAAGAGVAGAAGAAGLAKNHHDKKESHHNDKDIKDDHKHDDHDKHDNKDKHKSNKGKKAAAVGAGAAGVAGAAGAKHHHDKKEANQHDDNNNHRDNHDGKKKGG

SEQ ID NO: 1852890 - protein, 4 aa, Staphylococcus
HHHH

SEQ ID NO: 1852891 - protein, 5 aa, Staphylococcus
HHKTN

SEQ ID NO: 1852892 - protein, 21 aa, Staphylococcus
HHQNSENTNRPKSDKERVEEE

SEQ ID NO: 1852893 - protein, 9 aa, Staphylococcus
HHRGATSYY

SEQ ID NO: 1852894 - protein, 8 aa, Staphylococcus
HHTGGNDE

SEQ ID NO: 1852895 - protein, 6 aa, Staphylococcus
HHTPSA

SEQ ID NO: 1852896 - protein, 11 aa, Staphylococcus
HHTTQNKDWKI

SEQ ID NO: 1852897 - protein, 7 aa, Staphylococcus
HHTVKNK

SEQ ID NO: 1852898 - protein, 11 aa, Staphylococcus
HHVEKSAPNMF

SEQ ID NO: 1852899 - protein, 10 aa, Staphylococcus
HISAGSNRAI

SEQ ID NO: 1852900 - protein, 8 aa, Staphylococcus
HITTRDKQ

SEQ ID NO: 1852901 - protein, 10 aa, Staphylococcus
HKAGTQTAIN

SEQ ID NO: 1852902 - protein, 6 aa, Staphylococcus
HKAMED

SEQ ID NO: 1852903 - protein, 12 aa, Staphylococcus
HKAPTVEVKPTT

SEQ ID NO: 1852904 - protein, 17 aa, Staphylococcus
HKDAEDKYHYDTEISGQ

SEQ ID NO: 1852905 - protein, 11 aa, Staphylococcus
HKDDKITNYAS

SEQ ID NO: 1852906 - protein, 7 aa, Staphylococcus
HKDDRMK

SEQ ID NO: 1852907 - protein, 31 aa, Staphylococcus
HKDLSKAETLAQKVSPNVELKNDTKKMLDES

SEQ ID NO: 1852908 - protein, 6 aa, Staphylococcus
HKEAYK

SEQ ID NO: 1852909 - protein, 23 aa, Staphylococcus
HKENNSNKKGKNTQVVSKNNKKK

SEQ ID NO: 1852910 - protein, 8 aa, Staphylococcus
HKESNSFV

SEQ ID NO: 1852911 - protein, 5 aa, Staphylococcus
HKGAA

SEQ ID NO: 1852912 - protein, 20 aa, Staphylococcus
HKGDKIDKNALQSTAQTLEN

SEQ ID NO: 1852913 - protein, 8 aa, Staphylococcus
HKGKEDVK

SEQ ID NO: 1852914 - protein, 10 aa, Staphylococcus
HKGKEETKKY

SEQ ID NO: 1852915 - protein, 4 aa, Staphylococcus
HKGQ

SEQ ID NO: 1852916 - protein, 12 aa, Staphylococcus
HKITQQSVTNTL

SEQ ID NO: 1852917 - protein, 25 aa, Staphylococcus
HKKDVAQQVEKELNKKGSGLSEGKY

SEQ ID NO: 1852918 - protein, 56 aa, Staphylococcus
HKKEAKNGHSKENENHNSRKSKNTIRDEKGNKINTSTKKKVKDLPSTGKKELTNNS

SEQ ID NO: 1852919 - protein, 5 aa, Staphylococcus
HKKKK

SEQ ID NO: 1852920 - protein, 9 aa, Staphylococcus
HKKSDAKSY

SEQ ID NO: 1852921 - protein, 6 aa, Staphylococcus
HKNDAG

SEQ ID NO: 1852922 - protein, 8 aa, Staphylococcus
HKNIKNGY

SEQ ID NO: 1852923 - protein, 8 aa, Staphylococcus
HKNKDTVK

SEQ ID NO: 1852924 - protein, 9 aa, Staphylococcus
HKNNEDKWK

SEQ ID NO: 1852925 - protein, 28 aa, Staphylococcus
HKNNGNSTSHSNRNQNQSIMSGSNTNQW

SEQ ID NO: 1852926 - protein, 7 aa, Staphylococcus
HKNNLDR

SEQ ID NO: 1852927 - protein, 7 aa, Staphylococcus
HKNNNPL

SEQ ID NO: 1852928 - protein, 7 aa, Staphylococcus
HKNTPLG

SEQ ID NO: 1852929 - protein, 8 aa, Staphylococcus
HKNYTGTH

SEQ ID NO: 1852930 - protein, 16 aa, Staphylococcus
HKPDNLELENKDQKRR

SEQ ID NO: 1852931 - protein, 17 aa, Staphylococcus
HKPENEGSVQRRSQPKR

SEQ ID NO: 1852932 - protein, 17 aa, Staphylococcus
HKPEQHATAGRRSKPQR

SEQ ID NO: 1852933 - protein, 7 aa, Staphylococcus
HKPESVY

SEQ ID NO: 1852934 - protein, 5 aa, Staphylococcus
HKPNN

SEQ ID NO: 1852935 - protein, 7 aa, Staphylococcus
HKPYAQN

SEQ ID NO: 1852936 - protein, 7 aa, Staphylococcus
HKREKPL

SEQ ID NO: 1852937 - protein, 8 aa, Staphylococcus
HKRGTYSA

SEQ ID NO: 1852938 - protein, 4 aa, Staphylococcus
HKRK

SEQ ID NO: 1852939 - protein, 5 aa, Staphylococcus
HKRSQ

SEQ ID NO: 1852940 - protein, 8 aa, Staphylococcus
HKSATSGK

SEQ ID NO: 1852941 - protein, 9 aa, Staphylococcus
HKSDKRGYS

SEQ ID NO: 1852942 - protein, 10 aa, Staphylococcus
HKSGADKSQI

SEQ ID NO: 1852943 - protein, 18 aa, Staphylococcus
HKSPKNITKGHNKVAEEH

SEQ ID NO: 1852944 - protein, 9 aa, Staphylococcus
HKTKNSPNT

SEQ ID NO: 1852945 - protein, 5 aa, Staphylococcus
HKTLS

SEQ ID NO: 1852946 - protein, 14 aa, Staphylococcus
HKTTTVPGTQDQLD

SEQ ID NO: 1852947 - protein, 13 aa, Staphylococcus
HLATEEEKAKAKQ

SEQ ID NO: 1852948 - protein, 4 aa, Staphylococcus
HLDS

SEQ ID NO: 1852949 - protein, 5 aa, Staphylococcus
HLGDK

SEQ ID NO: 1852950 - protein, 5 aa, Staphylococcus
HLNEN

SEQ ID NO: 1852951 - protein, 5 aa, Staphylococcus
HLPGS

SEQ ID NO: 1852952 - protein, 7 aa, Staphylococcus
HLPKGHR

SEQ ID NO: 1852953 - protein, 4 aa, Staphylococcus
HLPN

SEQ ID NO: 1852954 - protein, 7 aa, Staphylococcus
HLPRRKH

SEQ ID NO: 1852955 - protein, 11 aa, Staphylococcus
HLSSNAGKGHK

SEQ ID NO: 1852956 - protein, 4 aa, Staphylococcus
HLST

SEQ ID NO: 1852957 - protein, 7 aa, Staphylococcus
HLTPENK

SEQ ID NO: 1852958 - protein, 9 aa, Staphylococcus
HLTSTHTQQ

SEQ ID NO: 1852959 - protein, 4 aa, Staphylococcus
HMDN

SEQ ID NO: 1852960 - protein, 6 aa, Staphylococcus
HNAEEN

SEQ ID NO: 1852961 - protein, 7 aa, Staphylococcus
HNANQSI

SEQ ID NO: 1852962 - protein, 4 aa, Staphylococcus
HNDA

SEQ ID NO: 1852963 - protein, 6 aa, Staphylococcus
HNDHSR

SEQ ID NO: 1852964 - protein, 16 aa, Staphylococcus
HNEDDQKTAETPPKRG

SEQ ID NO: 1852965 - protein, 6 aa, Staphylococcus
HNEINP

SEQ ID NO: 1852966 - protein, 8 aa, Staphylococcus
HNEKANNV

SEQ ID NO: 1852967 - protein, 18 aa, Staphylococcus
HNGGGGGQNKAASQWRGD

SEQ ID NO: 1852968 - protein, 10 aa, Staphylococcus
HNGKDSTQTY

SEQ ID NO: 1852969 - protein, 9 aa, Staphylococcus
HNGNAIASS

SEQ ID NO: 1852970 - protein, 10 aa, Staphylococcus
HNGSPKSIDD

SEQ ID NO: 1852971 - protein, 14 aa, Staphylococcus
HNHAPREILNPFSR

SEQ ID NO: 1852972 - protein, 8 aa, Staphylococcus
HNHDSTSE

SEQ ID NO: 1852973 - protein, 6 aa, Staphylococcus
HNHTGP

SEQ ID NO: 1852974 - protein, 8 aa, Staphylococcus
HNKEISSE

SEQ ID NO: 1852975 - protein, 14 aa, Staphylococcus
HNKSKTVPGTQEQL

SEQ ID NO: 1852976 - protein, 4 aa, Staphylococcus
HNKT

SEQ ID NO: 1852977 - protein, 6 aa, Staphylococcus
HNMENA

SEQ ID NO: 1852978 - protein, 39 aa, Staphylococcus
HNNKDNNQNQSNVDGIQSNNSHLSKSHRLPDTGSESTSI

SEQ ID NO: 1852979 - protein, 49 aa, Staphylococcus
HNNNKVNNDPNVSQNYKKEVENQNDDINKQVDTAKNEIKQNKNSQTQIN

SEQ ID NO: 1852980 - protein, 10 aa, Staphylococcus
HNNSPKQQDI

SEQ ID NO: 1852981 - protein, 8 aa, Staphylococcus
HNNSTDGI

SEQ ID NO: 1852982 - protein, 13 aa, Staphylococcus
HNNTDAKIAKASG

SEQ ID NO: 1852983 - protein, 9 aa, Staphylococcus
HNPAPKNAV

SEQ ID NO: 1852984 - protein, 15 aa, Staphylococcus
HNPDLSNAEKEALKD

SEQ ID NO: 1852985 - protein, 4 aa, Staphylococcus
HNPL

SEQ ID NO: 1852986 - protein, 24 aa, Staphylococcus
HNPLDRDKSSLRDKSVNLDDGDPF

SEQ ID NO: 1852987 - protein, 24 aa, Staphylococcus
HNPLDRSHSALRSKNVNLSKGEPF

SEQ ID NO: 1852988 - protein, 35 aa, Staphylococcus
HNQQQYNQSYSNHQQPQQTSQFSDHAKEVTEESKG

SEQ ID NO: 1852989 - protein, 13 aa, Staphylococcus
HNREAQSTTGIGE

SEQ ID NO: 1852990 - protein, 8 aa, Staphylococcus
HNRNPNNI

SEQ ID NO: 1852991 - protein, 8 aa, Staphylococcus
HNRNPNTI

SEQ ID NO: 1852992 - protein, 8 aa, Staphylococcus
HNRTPSNI

SEQ ID NO: 1852993 - protein, 5 aa, Staphylococcus
HNSES

SEQ ID NO: 1852994 - protein, 19 aa, Staphylococcus
HNSIPKQQPQSEPQTRTVT

SEQ ID NO: 1852995 - protein, 5 aa, Staphylococcus
HNSSM

SEQ ID NO: 1852996 - protein, 6 aa, Staphylococcus
HNSSQL

SEQ ID NO: 1852997 - protein, 12 aa, Staphylococcus
HNTPNEKRGDTW

SEQ ID NO: 1852998 - protein, 7 aa, Staphylococcus
HNTSRLS

SEQ ID NO: 1852999 - protein, 11 aa, Staphylococcus
HNVQGGSTISQ

SEQ ID NO: 1853000 - protein, 34 aa, Staphylococcus
HNVSDKTSQLASGISNKSSQAASAVSNKSSEFAQ

SEQ ID NO: 1853001 - protein, 11 aa, Staphylococcus
HNVSQNEDKIS

SEQ ID NO: 1853002 - protein, 13 aa, Staphylococcus
HNYQTDNQQVTKH

SEQ ID NO: 1853003 - protein, 5 aa, Staphylococcus
HPDIS

SEQ ID NO: 1853004 - protein, 10 aa, Staphylococcus
HPDPKKLPNA

SEQ ID NO: 1853005 - protein, 11 aa, Staphylococcus
HPEETKNHPFK

SEQ ID NO: 1853006 - protein, 27 aa, Staphylococcus
HPGGVPQGHPAYQAKMDRDKDGYACEI

SEQ ID NO: 1853007 - protein, 8 aa, Staphylococcus
HPGKDGAI

SEQ ID NO: 1853008 - protein, 23 aa, Staphylococcus
HPGRGEKVVNNNNFKDGKVGKSK

SEQ ID NO: 1853009 - protein, 8 aa, Staphylococcus
HPGTGDTI

SEQ ID NO: 1853010 - protein, 24 aa, Staphylococcus
HPGTGEAKVENKAFNKGKVGNSNN

SEQ ID NO: 1853011 - protein, 11 aa, Staphylococcus
HPGTSRKPYRV

SEQ ID NO: 1853012 - protein, 17 aa, Staphylococcus
HPIEEGPHVETKAPSML

SEQ ID NO: 1853013 - protein, 5 aa, Staphylococcus
HPKAR

SEQ ID NO: 1853014 - protein, 10 aa, Staphylococcus
HPKEAENRKD

SEQ ID NO: 1853015 - protein, 10 aa, Staphylococcus
HPKEAESRKD

SEQ ID NO: 1853016 - protein, 5 aa, Staphylococcus
HPKEL

SEQ ID NO: 1853017 - protein, 11 aa, Staphylococcus
HPKIKKGITTG

SEQ ID NO: 1853018 - protein, 15 aa, Staphylococcus
HPKSSLKDGDKIEVK

SEQ ID NO: 1853019 - protein, 15 aa, Staphylococcus
HPLNDEQVQDISESF

SEQ ID NO: 1853020 - protein, 27 aa, Staphylococcus
HPNGVPSNHPAYTSKFDRDGDNYACEV

SEQ ID NO: 1853021 - protein, 7 aa, Staphylococcus
HPQEGPG

SEQ ID NO: 1853022 - protein, 6 aa, Staphylococcus
HPRVSK

SEQ ID NO: 1853023 - protein, 4 aa, Staphylococcus
HPSD

SEQ ID NO: 1853024 - protein, 4 aa, Staphylococcus
HPSI

SEQ ID NO: 1853025 - protein, 4 aa, Staphylococcus
HPSS

SEQ ID NO: 1853026 - protein, 17 aa, Staphylococcus
HPSTFKNSGPLQWPGKK

SEQ ID NO: 1853027 - protein, 8 aa, Staphylococcus
HPTSDALA

SEQ ID NO: 1853028 - protein, 18 aa, Staphylococcus
HQATKGASAFNKASQNME

SEQ ID NO: 1853029 - protein, 6 aa, Staphylococcus
HQDAIK

SEQ ID NO: 1853030 - protein, 5 aa, Staphylococcus
HQDAV

SEQ ID NO: 1853031 - protein, 8 aa, Staphylococcus
HQDDLDKY

SEQ ID NO: 1853032 - protein, 12 aa, Staphylococcus
HQDDVSELTPEI

SEQ ID NO: 1853033 - protein, 10 aa, Staphylococcus
HQDFNGGYNN

SEQ ID NO: 1853034 - protein, 35 aa, Staphylococcus
HQDKEPTHVSSSNSMKKDKIKHVSNDNDTNNSSII

SEQ ID NO: 1853035 - protein, 20 aa, Staphylococcus
HQEIQDAQKASPTATDKEQD

SEQ ID NO: 1853036 - protein, 6 aa, Staphylococcus
HQERAN

SEQ ID NO: 1853037 - protein, 8 aa, Staphylococcus
HQESTQRD

SEQ ID NO: 1853038 - protein, 10 aa, Staphylococcus
HQFRSSTSEI

SEQ ID NO: 1853039 - protein, 9 aa, Staphylococcus
HQGNAGHQH

SEQ ID NO: 1853040 - protein, 30 aa, Staphylococcus
HQHYDSNNTTQKNTDKSLPKTGEQSEQTGF

SEQ ID NO: 1853041 - protein, 7 aa, Staphylococcus
HQKESYY

SEQ ID NO: 1853042 - protein, 17 aa, Staphylococcus
HQKISETENQSDDDGYA

SEQ ID NO: 1853043 - protein, 4 aa, Staphylococcus
HQLS

SEQ ID NO: 1853044 - protein, 10 aa, Staphylococcus
HQLSETEKIN

SEQ ID NO: 1853045 - protein, 29 aa, Staphylococcus
HQNANQNEHQVPNNDGNSEHKSGSMFALA

SEQ ID NO: 1853046 - protein, 9 aa, Staphylococcus
HQNKADDWK

SEQ ID NO: 1853047 - protein, 4 aa, Staphylococcus
HQNL

SEQ ID NO: 1853048 - protein, 18 aa, Staphylococcus
HQNTTNDAKNEKSNANII

SEQ ID NO: 1853049 - protein, 9 aa, Staphylococcus
HQPENNKIP

SEQ ID NO: 1853050 - protein, 7 aa, Staphylococcus
HQPQISK

SEQ ID NO: 1853051 - protein, 29 aa, Staphylococcus
HQQDNNKSNYKVEDKQNSEQNDTSVFALV

SEQ ID NO: 1853052 - protein, 9 aa, Staphylococcus
HQQEDYEDD

SEQ ID NO: 1853053 - protein, 5 aa, Staphylococcus
HQQGY

SEQ ID NO: 1853054 - protein, 5 aa, Staphylococcus
HQQTY

SEQ ID NO: 1853055 - protein, 5 aa, Staphylococcus
HQQVN

SEQ ID NO: 1853056 - protein, 8 aa, Staphylococcus
HQRPETNA

SEQ ID NO: 1853057 - protein, 9 aa, Staphylococcus
HQRPETNAL

SEQ ID NO: 1853058 - protein, 11 aa, Staphylococcus
HQRQRISDQQM

SEQ ID NO: 1853059 - protein, 6 aa, Staphylococcus
HQSKRT

SEQ ID NO: 1853060 - protein, 15 aa, Staphylococcus
HQSNHDTTNQSIGTP

SEQ ID NO: 1853061 - protein, 15 aa, Staphylococcus
HQSVRSKDNTRQNHA

SEQ ID NO: 1853062 - protein, 5 aa, Staphylococcus
HQSYE

SEQ ID NO: 1853063 - protein, 5 aa, Staphylococcus
HQSYQ

SEQ ID NO: 1853064 - protein, 5 aa, Staphylococcus
HQTAT

SEQ ID NO: 1853065 - protein, 8 aa, Staphylococcus
HQTEQQAL

SEQ ID NO: 1853066 - protein, 28 aa, Staphylococcus
HQTSTYQNNQYQSSSNQQHTQNNQQQFD

SEQ ID NO: 1853067 - protein, 8 aa, Staphylococcus
HQVKKTNE

SEQ ID NO: 1853068 - protein, 13 aa, Staphylococcus
HQYGEAAGPLESE

SEQ ID NO: 1853069 - protein, 10 aa, Staphylococcus
HQYSAKKKRS

SEQ ID NO: 1853070 - protein, 18 aa, Staphylococcus
HRAEERKQQGDKNIEDLE

SEQ ID NO: 1853071 - protein, 6 aa, Staphylococcus
HRAGRL

SEQ ID NO: 1853072 - protein, 4 aa, Staphylococcus
HRDL

SEQ ID NO: 1853073 - protein, 4 aa, Staphylococcus
HRDV

SEQ ID NO: 1853074 - protein, 29 aa, Staphylococcus
HREIGKDEDYNIDKDAKDKYQEDQSTMKD

SEQ ID NO: 1853075 - protein, 18 aa, Staphylococcus
HRGHGKDINEDERGQIDD

SEQ ID NO: 1853076 - protein, 5 aa, Staphylococcus
HRKDN

SEQ ID NO: 1853077 - protein, 6 aa, Staphylococcus
HRKNTK

SEQ ID NO: 1853078 - protein, 17 aa, Staphylococcus
HRLREQNHNIKKANEVL

SEQ ID NO: 1853079 - protein, 4 aa, Staphylococcus
HRNE

SEQ ID NO: 1853080 - protein, 7 aa, Staphylococcus
HRNNGAA

SEQ ID NO: 1853081 - protein, 7 aa, Staphylococcus
HRPHGTT

SEQ ID NO: 1853082 - protein, 4 aa, Staphylococcus
HRQA

SEQ ID NO: 1853083 - protein, 21 aa, Staphylococcus
HSDDGSTTLNDINADKAQLNT

SEQ ID NO: 1853084 - protein, 9 aa, Staphylococcus
HSDEQEETW

SEQ ID NO: 1853085 - protein, 8 aa, Staphylococcus
HSDNSNKV

SEQ ID NO: 1853086 - protein, 17 aa, Staphylococcus
HSDQEDKSNSAPKTRKK

SEQ ID NO: 1853087 - protein, 66 aa, Staphylococcus
HSDSEQEPTPSRRKKRSFSNDSEQMSSMTNGTPNTSQPSTVDEPENHQQSSDEDNENSISEAGEEM

SEQ ID NO: 1853088 - protein, 21 aa, Staphylococcus
HSDSNLDSHYHKKDEHYPKGN

SEQ ID NO: 1853089 - protein, 22 aa, Staphylococcus
HSDSRDDIKQELEQAKQLNNTM

SEQ ID NO: 1853090 - protein, 11 aa, Staphylococcus
HSDTGGTGSAL

SEQ ID NO: 1853091 - protein, 17 aa, Staphylococcus
HSEAEKNDYDDNDNVTY

SEQ ID NO: 1853092 - protein, 8 aa, Staphylococcus
HSEDERHS

SEQ ID NO: 1853093 - protein, 5 aa, Staphylococcus
HSEEE

SEQ ID NO: 1853094 - protein, 23 aa, Staphylococcus
HSENDEESTNQSPNTKKQRTKRM

SEQ ID NO: 1853095 - protein, 111 aa, Staphylococcus
HSESASNSINASESESTAYSDSQSTSVSASTSLSEVASENVSTSQSASTSESTGHSVSISDSTSMSTSLSEDTSTLLSSSTAFSDSASTSLSTSLSSSLSDSTASDSVSMS

SEQ ID NO: 1853096 - protein, 4 aa, Staphylococcus
HSET

SEQ ID NO: 1853097 - protein, 4 aa, Staphylococcus
HSEY

SEQ ID NO: 1853098 - protein, 4 aa, Staphylococcus
HSFT

SEQ ID NO: 1853099 - protein, 14 aa, Staphylococcus
HSGAPLGKKKEFDE

SEQ ID NO: 1853100 - protein, 4 aa, Staphylococcus
HSGI

SEQ ID NO: 1853101 - protein, 8 aa, Staphylococcus
HSGKLNGS

SEQ ID NO: 1853102 - protein, 17 aa, Staphylococcus
HSGLNNDTELTASRNTF

SEQ ID NO: 1853103 - protein, 7 aa, Staphylococcus
HSGMSRV

SEQ ID NO: 1853104 - protein, 9 aa, Staphylococcus
HSINNSGSM

SEQ ID NO: 1853105 - protein, 8 aa, Staphylococcus
HSKATNGF

SEQ ID NO: 1853106 - protein, 5 aa, Staphylococcus
HSKDC

SEQ ID NO: 1853107 - protein, 7 aa, Staphylococcus
HSKDGIV

SEQ ID NO: 1853108 - protein, 9 aa, Staphylococcus
HSKGDKKGV

SEQ ID NO: 1853109 - protein, 8 aa, Staphylococcus
HSKGTEFN

SEQ ID NO: 1853110 - protein, 9 aa, Staphylococcus
HSKKDQKAV

SEQ ID NO: 1853111 - protein, 15 aa, Staphylococcus
HSKKDRDDAYKSPKK

SEQ ID NO: 1853112 - protein, 14 aa, Staphylococcus
HSKKNDEDDYVVPK

SEQ ID NO: 1853113 - protein, 13 aa, Staphylococcus
HSKKNDEEEYHTP

SEQ ID NO: 1853114 - protein, 14 aa, Staphylococcus
HSKKNEEEDYVVPK

SEQ ID NO: 1853115 - protein, 15 aa, Staphylococcus
HSKKNEEPEYIVPKQ

SEQ ID NO: 1853116 - protein, 6 aa, Staphylococcus
HSKQYD

SEQ ID NO: 1853117 - protein, 6 aa, Staphylococcus
HSKSLN

SEQ ID NO: 1853118 - protein, 4 aa, Staphylococcus
HSLT

SEQ ID NO: 1853119 - protein, 9 aa, Staphylococcus
HSMQENNRP

SEQ ID NO: 1853120 - protein, 15 aa, Staphylococcus
HSNAAMSHTSEGAVG

SEQ ID NO: 1853121 - protein, 5 aa, Staphylococcus
HSNAP

SEQ ID NO: 1853122 - protein, 26 aa, Staphylococcus
HSNDQDAVERKHKEAQFQKQQDEEIA

SEQ ID NO: 1853123 - protein, 26 aa, Staphylococcus
HSNEKDAVERKHKEEQFQKQQDEEIA

SEQ ID NO: 1853124 - protein, 12 aa, Staphylococcus
HSPADQAGLHKG

SEQ ID NO: 1853125 - protein, 4 aa, Staphylococcus
HSPK

SEQ ID NO: 1853126 - protein, 5 aa, Staphylococcus
HSPNF

SEQ ID NO: 1853127 - protein, 6 aa, Staphylococcus
HSPYSS

SEQ ID NO: 1853128 - protein, 10 aa, Staphylococcus
HSQETKKNKH

SEQ ID NO: 1853129 - protein, 10 aa, Staphylococcus
HSQFDSNRNE

SEQ ID NO: 1853130 - protein, 10 aa, Staphylococcus
HSQQQSDGKF

SEQ ID NO: 1853131 - protein, 9 aa, Staphylococcus
HSQQTLKDD

SEQ ID NO: 1853132 - protein, 7 aa, Staphylococcus
HSQSEQY

SEQ ID NO: 1853133 - protein, 46 aa, Staphylococcus
HSQSVTSDQASTNTVQPDNQNSEQAASQDKVNQLPDTGNNENNRRG

SEQ ID NO: 1853134 - protein, 6 aa, Staphylococcus
HSQSVV

SEQ ID NO: 1853135 - protein, 7 aa, Staphylococcus
HSREELK

SEQ ID NO: 1853136 - protein, 14 aa, Staphylococcus
HSRIGEGGEMLSGG

SEQ ID NO: 1853137 - protein, 4 aa, Staphylococcus
HSRK

SEQ ID NO: 1853138 - protein, 12 aa, Staphylococcus
HSRNNETGGSGL

SEQ ID NO: 1853139 - protein, 6 aa, Staphylococcus
HSSNKI

SEQ ID NO: 1853140 - protein, 10 aa, Staphylococcus
HSSPKDTALD

SEQ ID NO: 1853141 - protein, 6 aa, Staphylococcus
HSTEAT

SEQ ID NO: 1853142 - protein, 10 aa, Staphylococcus
HSTEFDSELE

SEQ ID NO: 1853143 - protein, 8 aa, Staphylococcus
HSTNTAEN

SEQ ID NO: 1853144 - protein, 10 aa, Staphylococcus
HSTQSNKKLE

SEQ ID NO: 1853145 - protein, 4 aa, Staphylococcus
HSTS

SEQ ID NO: 1853146 - protein, 8 aa, Staphylococcus
HSTSPIEE

SEQ ID NO: 1853147 - protein, 8 aa, Staphylococcus
HTDKNTNE

SEQ ID NO: 1853148 - protein, 7 aa, Staphylococcus
HTDSSLA

SEQ ID NO: 1853149 - protein, 6 aa, Staphylococcus
HTDTKQ

SEQ ID NO: 1853150 - protein, 5 aa, Staphylococcus
HTEDL

SEQ ID NO: 1853151 - protein, 7 aa, Staphylococcus
HTEQEYP

SEQ ID NO: 1853152 - protein, 10 aa, Staphylococcus
HTGKQSEGAA

SEQ ID NO: 1853153 - protein, 11 aa, Staphylococcus
HTGKQSEGSSD

SEQ ID NO: 1853154 - protein, 5 aa, Staphylococcus
HTGKV

SEQ ID NO: 1853155 - protein, 6 aa, Staphylococcus
HTGKVT

SEQ ID NO: 1853156 - protein, 8 aa, Staphylococcus
HTGSGKSS

SEQ ID NO: 1853157 - protein, 8 aa, Staphylococcus
HTGSGKST

SEQ ID NO: 1853158 - protein, 5 aa, Staphylococcus
HTGTG

SEQ ID NO: 1853159 - protein, 6 aa, Staphylococcus
HTHAGV

SEQ ID NO: 1853160 - protein, 5 aa, Staphylococcus
HTHSD

SEQ ID NO: 1853161 - protein, 12 aa, Staphylococcus
HTHTSEAAGYNY

SEQ ID NO: 1853162 - protein, 7 aa, Staphylococcus
HTINKAD

SEQ ID NO: 1853163 - protein, 9 aa, Staphylococcus
HTITTKRNN

SEQ ID NO: 1853164 - protein, 7 aa, Staphylococcus
HTKKEYR

SEQ ID NO: 1853165 - protein, 11 aa, Staphylococcus
HTNEEVDKAKA

SEQ ID NO: 1853166 - protein, 4 aa, Staphylococcus
HTNG

SEQ ID NO: 1853167 - protein, 4 aa, Staphylococcus
HTNN

SEQ ID NO: 1853168 - protein, 4 aa, Staphylococcus
HTPF

SEQ ID NO: 1853169 - protein, 14 aa, Staphylococcus
HTPKPTLVKLEDEE

SEQ ID NO: 1853170 - protein, 7 aa, Staphylococcus
HTPKTRK

SEQ ID NO: 1853171 - protein, 4 aa, Staphylococcus
HTPS

SEQ ID NO: 1853172 - protein, 5 aa, Staphylococcus
HTPSG

SEQ ID NO: 1853173 - protein, 5 aa, Staphylococcus
HTPTG

SEQ ID NO: 1853174 - protein, 4 aa, Staphylococcus
HTPY

SEQ ID NO: 1853175 - protein, 10 aa, Staphylococcus
HTQNNKIKRT

SEQ ID NO: 1853176 - protein, 5 aa, Staphylococcus
HTQTM

SEQ ID NO: 1853177 - protein, 4 aa, Staphylococcus
HTRL

SEQ ID NO: 1853178 - protein, 7 aa, Staphylococcus
HTSKLGA

SEQ ID NO: 1853179 - protein, 15 aa, Staphylococcus
HTTDDYTGAVTTPIY

SEQ ID NO: 1853180 - protein, 24 aa, Staphylococcus
HTTDKLNKSNHDSAYIQTKTDKNV

SEQ ID NO: 1853181 - protein, 19 aa, Staphylococcus
HTTRQTVSKWEQGSIEPNA

SEQ ID NO: 1853182 - protein, 17 aa, Staphylococcus
HTTRQTVSKWEQGTIEP

SEQ ID NO: 1853183 - protein, 13 aa, Staphylococcus
HTTSSNQNPGKAL

SEQ ID NO: 1853184 - protein, 8 aa, Staphylococcus
HTTTSAAQ

SEQ ID NO: 1853185 - protein, 13 aa, Staphylococcus
HTYEKPKKFTGKD

SEQ ID NO: 1853186 - protein, 13 aa, Staphylococcus
HTYNMTDKDYEPY

SEQ ID NO: 1853187 - protein, 14 aa, Staphylococcus
HVEDSEPDDINHHR

SEQ ID NO: 1853188 - protein, 15 aa, Staphylococcus
HVEQTAKDVKDKHYK

SEQ ID NO: 1853189 - protein, 13 aa, Staphylococcus
HVIGSGKTDKNGH

SEQ ID NO: 1853190 - protein, 5 aa, Staphylococcus
HVKLT

SEQ ID NO: 1853191 - protein, 6 aa, Staphylococcus
HVNEDV

SEQ ID NO: 1853192 - protein, 4 aa, Staphylococcus
HVNP

SEQ ID NO: 1853193 - protein, 5 aa, Staphylococcus
HVPSP

SEQ ID NO: 1853194 - protein, 5 aa, Staphylococcus
HVSNS

SEQ ID NO: 1853195 - protein, 8 aa, Staphylococcus
HVTGTRDV

SEQ ID NO: 1853196 - protein, 5 aa, Staphylococcus
HYDEA

SEQ ID NO: 1853197 - protein, 5 aa, Staphylococcus
HYDPR

SEQ ID NO: 1853198 - protein, 5 aa, Staphylococcus
HYNDP

SEQ ID NO: 1853199 - protein, 15 aa, Staphylococcus
HYPAQQAGLKSGDKI

SEQ ID NO: 1853200 - protein, 12 aa, Staphylococcus
HYQDDLRERDES

SEQ ID NO: 1853201 - protein, 8 aa, Staphylococcus
HYSGETGL

SEQ ID NO: 1853202 - protein, 5 aa, Staphylococcus
HYSGY

SEQ ID NO: 1853203 - protein, 48 aa, Staphylococcus
HYSNKDQAADNNNEREHDTHVNDSKDDDYRDQRYSNHKTNKRSNDFIQ

SEQ ID NO: 1853204 - protein, 6 aa, Staphylococcus
HYSPVS

SEQ ID NO: 1853205 - protein, 13 aa, Staphylococcus
IAANALKEQADKV

SEQ ID NO: 1853206 - protein, 12 aa, Staphylococcus
IAATNGVGAKMK

SEQ ID NO: 1853207 - protein, 11 aa, Staphylococcus
IADEQEQTSDL

SEQ ID NO: 1853208 - protein, 4 aa, Staphylococcus
IADK

SEQ ID NO: 1853209 - protein, 9 aa, Staphylococcus
IADKGNSKV

SEQ ID NO: 1853210 - protein, 5 aa, Staphylococcus
IADKL

SEQ ID NO: 1853211 - protein, 5 aa, Staphylococcus
IADKV

SEQ ID NO: 1853212 - protein, 4 aa, Staphylococcus
IADR

SEQ ID NO: 1853213 - protein, 11 aa, Staphylococcus
IADTANPSSNI

SEQ ID NO: 1853214 - protein, 8 aa, Staphylococcus
IAEDKNES

SEQ ID NO: 1853215 - protein, 8 aa, Staphylococcus
IAEEKNQS

SEQ ID NO: 1853216 - protein, 18 aa, Staphylococcus
IAEELEKKGEIQYPNTGI

SEQ ID NO: 1853217 - protein, 9 aa, Staphylococcus
IAEENDKKT

SEQ ID NO: 1853218 - protein, 13 aa, Staphylococcus
IAEKDQQVNGPGT

SEQ ID NO: 1853219 - protein, 13 aa, Staphylococcus
IAEKSEKVNGPGT

SEQ ID NO: 1853220 - protein, 10 aa, Staphylococcus
IAENGLKDGK

SEQ ID NO: 1853221 - protein, 8 aa, Staphylococcus
IAEQGTHE

SEQ ID NO: 1853222 - protein, 6 aa, Staphylococcus
IAESTI

SEQ ID NO: 1853223 - protein, 7 aa, Staphylococcus
IAGGATF

SEQ ID NO: 1853224 - protein, 4 aa, Staphylococcus
IAGK

SEQ ID NO: 1853225 - protein, 21 aa, Staphylococcus
IAGKAGTQTPITVTTDPNTTV

SEQ ID NO: 1853226 - protein, 11 aa, Staphylococcus
IAGNRQGFAGG

SEQ ID NO: 1853227 - protein, 16 aa, Staphylococcus
IAGQGIDAANDQLTDA

SEQ ID NO: 1853228 - protein, 5 aa, Staphylococcus
IAGQR

SEQ ID NO: 1853229 - protein, 6 aa, Staphylococcus
IAGQRN

SEQ ID NO: 1853230 - protein, 5 aa, Staphylococcus
IAGVE

SEQ ID NO: 1853231 - protein, 16 aa, Staphylococcus
IAHRDTDGGLSWSPDH

SEQ ID NO: 1853232 - protein, 6 aa, Staphylococcus
IAKDNG

SEQ ID NO: 1853233 - protein, 6 aa, Staphylococcus
IAKDNH

SEQ ID NO: 1853234 - protein, 7 aa, Staphylococcus
IAKGLGQ

SEQ ID NO: 1853235 - protein, 4 aa, Staphylococcus
IAKT

SEQ ID NO: 1853236 - protein, 5 aa, Staphylococcus
IAKTP

SEQ ID NO: 1853237 - protein, 5 aa, Staphylococcus
IALAG

SEQ ID NO: 1853238 - protein, 10 aa, Staphylococcus
IANEEESETL

SEQ ID NO: 1853239 - protein, 8 aa, Staphylococcus
IANETETP

SEQ ID NO: 1853240 - protein, 42 aa, Staphylococcus
IANGDASASEISNEKTKVEEATTALNKAKNDLRADKSQLQAA

SEQ ID NO: 1853241 - protein, 67 aa, Staphylococcus
IANQRQKNRHEETNQTDALKPSSMSKKSSNSKELSDHTQTHLTSEDRPRSEVEDEQVNHNHKETRVP

SEQ ID NO: 1853242 - protein, 5 aa, Staphylococcus
IANTA

SEQ ID NO: 1853243 - protein, 11 aa, Staphylococcus
IANTANPSSNI

SEQ ID NO: 1853244 - protein, 7 aa, Staphylococcus
IANTNGN

SEQ ID NO: 1853245 - protein, 6 aa, Staphylococcus
IANTNS

SEQ ID NO: 1853246 - protein, 9 aa, Staphylococcus
IAPDRGKVV

SEQ ID NO: 1853247 - protein, 16 aa, Staphylococcus
IAPKHHSNDMANTNHK

SEQ ID NO: 1853248 - protein, 4 aa, Staphylococcus
IAPN

SEQ ID NO: 1853249 - protein, 9 aa, Staphylococcus
IAPSKQNSE

SEQ ID NO: 1853250 - protein, 6 aa, Staphylococcus
IAQART

SEQ ID NO: 1853251 - protein, 6 aa, Staphylococcus
IAQGAA

SEQ ID NO: 1853252 - protein, 6 aa, Staphylococcus
IARNQG

SEQ ID NO: 1853253 - protein, 6 aa, Staphylococcus
IASAAS

SEQ ID NO: 1853254 - protein, 5 aa, Staphylococcus
IASEG

SEQ ID NO: 1853255 - protein, 12 aa, Staphylococcus
IASLTANDQNIG

SEQ ID NO: 1853256 - protein, 18 aa, Staphylococcus
IASNGVDKGLQGMNDARG

SEQ ID NO: 1853257 - protein, 10 aa, Staphylococcus
IASPASGEIK

SEQ ID NO: 1853258 - protein, 68 aa, Staphylococcus
IASPASGQIKSFDAKQGDKLKKGDTVAEVTAQGQDGQTQDQKIKMPQDGTIAKTDGMEGSIAQAGSPI

SEQ ID NO: 1853259 - protein, 5 aa, Staphylococcus
IASQG

SEQ ID NO: 1853260 - protein, 10 aa, Staphylococcus
IASSGPDEDW

SEQ ID NO: 1853261 - protein, 8 aa, Staphylococcus
IASSNEHA

SEQ ID NO: 1853262 - protein, 10 aa, Staphylococcus
IASYQAEQAP

SEQ ID NO: 1853263 - protein, 7 aa, Staphylococcus
IATDGWN

SEQ ID NO: 1853264 - protein, 6 aa, Staphylococcus
IATGDT

SEQ ID NO: 1853265 - protein, 9 aa, Staphylococcus
IATGNGQAT

SEQ ID NO: 1853266 - protein, 9 aa, Staphylococcus
IATGNSQAT

SEQ ID NO: 1853267 - protein, 11 aa, Staphylococcus
IATKKNQSWSL

SEQ ID NO: 1853268 - protein, 4 aa, Staphylococcus
IATN

SEQ ID NO: 1853269 - protein, 21 aa, Staphylococcus
IATNINSQLSEQFSNQTTGTV

SEQ ID NO: 1853270 - protein, 65 aa, Staphylococcus
IATQELDNAADLKQEELDKTPNATQEDIAEAKQAVQNALTSAKDQVAQAQTDQDVDNAKANGVSE

SEQ ID NO: 1853271 - protein, 23 aa, Staphylococcus
IATSNDNRDNKNVITTDAQTKAL

SEQ ID NO: 1853272 - protein, 5 aa, Staphylococcus
IATTA

SEQ ID NO: 1853273 - protein, 8 aa, Staphylococcus
IDAEGKTY

SEQ ID NO: 1853274 - protein, 33 aa, Staphylococcus
IDAGTNTDGMTSDSVEDFNDSLSEALSEKTKIN

SEQ ID NO: 1853275 - protein, 9 aa, Staphylococcus
IDAGTTRDV

SEQ ID NO: 1853276 - protein, 11 aa, Staphylococcus
IDAKAAGEQLP

SEQ ID NO: 1853277 - protein, 8 aa, Staphylococcus
IDAPHART

SEQ ID NO: 1853278 - protein, 34 aa, Staphylococcus
IDASDNSGQAVTNTVNGLPEGVTFDPKTNTISGV

SEQ ID NO: 1853279 - protein, 12 aa, Staphylococcus
IDATKETKNGVF

SEQ ID NO: 1853280 - protein, 12 aa, Staphylococcus
IDDDTQRKNHRD

SEQ ID NO: 1853281 - protein, 17 aa, Staphylococcus
IDDFKNRDNSEVSNDEL

SEQ ID NO: 1853282 - protein, 10 aa, Staphylococcus
IDDKKEVAGT

SEQ ID NO: 1853283 - protein, 22 aa, Staphylococcus
IDDKKKSVANIAGGLGSSAVKA

SEQ ID NO: 1853284 - protein, 11 aa, Staphylococcus
IDDPSYRGKAL

SEQ ID NO: 1853285 - protein, 6 aa, Staphylococcus
IDEGRR

SEQ ID NO: 1853286 - protein, 17 aa, Staphylococcus
IDEKRSQKARKQKLGIT

SEQ ID NO: 1853287 - protein, 4 aa, Staphylococcus
IDEL

SEQ ID NO: 1853288 - protein, 17 aa, Staphylococcus
IDEPDSDKEASTKQSEI

SEQ ID NO: 1853289 - protein, 7 aa, Staphylococcus
IDEQVGR

SEQ ID NO: 1853290 - protein, 8 aa, Staphylococcus
IDETTSEM

SEQ ID NO: 1853291 - protein, 6 aa, Staphylococcus
IDEVGQ

SEQ ID NO: 1853292 - protein, 5 aa, Staphylococcus
IDGAN

SEQ ID NO: 1853293 - protein, 11 aa, Staphylococcus
IDGDGNRTDTK

SEQ ID NO: 1853294 - protein, 5 aa, Staphylococcus
IDGDT

SEQ ID NO: 1853295 - protein, 9 aa, Staphylococcus
IDGDTNPIK

SEQ ID NO: 1853296 - protein, 8 aa, Staphylococcus
IDGENSGA

SEQ ID NO: 1853297 - protein, 11 aa, Staphylococcus
IDGENSKNYRI

SEQ ID NO: 1853298 - protein, 12 aa, Staphylococcus
IDGGKAKAYEQT

SEQ ID NO: 1853299 - protein, 4 aa, Staphylococcus
IDGN

SEQ ID NO: 1853300 - protein, 22 aa, Staphylococcus
IDGQNSKVKGKVDEVGKATAAS

SEQ ID NO: 1853301 - protein, 20 aa, Staphylococcus
IDGSKEKIISKDASKDMRTS

SEQ ID NO: 1853302 - protein, 22 aa, Staphylococcus
IDGSSSKFTDRMNQKAKDLGMK

SEQ ID NO: 1853303 - protein, 19 aa, Staphylococcus
IDGTPNEDPDEDEDSGTYE

SEQ ID NO: 1853304 - protein, 20 aa, Staphylococcus
IDIEPKKTEIKQTKNKSETV

SEQ ID NO: 1853305 - protein, 13 aa, Staphylococcus
IDIGKANTKTNKF

SEQ ID NO: 1853306 - protein, 16 aa, Staphylococcus
IDKAKNKAEVKKFLEE

SEQ ID NO: 1853307 - protein, 21 aa, Staphylococcus
IDKDEDSHKSNKIDSKEGHVD

SEQ ID NO: 1853308 - protein, 4 aa, Staphylococcus
IDKG

SEQ ID NO: 1853309 - protein, 4 aa, Staphylococcus
IDKH

SEQ ID NO: 1853310 - protein, 8 aa, Staphylococcus
IDKKDQKH

SEQ ID NO: 1853311 - protein, 18 aa, Staphylococcus
IDKKNKDAGYIKTPDGNN

SEQ ID NO: 1853312 - protein, 7 aa, Staphylococcus
IDKNEED

SEQ ID NO: 1853313 - protein, 8 aa, Staphylococcus
IDKPLNQL

SEQ ID NO: 1853314 - protein, 7 aa, Staphylococcus
IDKPNNV

SEQ ID NO: 1853315 - protein, 8 aa, Staphylococcus
IDKPSQHI

SEQ ID NO: 1853316 - protein, 7 aa, Staphylococcus
IDKSDQK

SEQ ID NO: 1853317 - protein, 5 aa, Staphylococcus
IDKTG

SEQ ID NO: 1853318 - protein, 10 aa, Staphylococcus
IDKTSDPILN

SEQ ID NO: 1853319 - protein, 11 aa, Staphylococcus
IDKTTSEMKEF

SEQ ID NO: 1853320 - protein, 10 aa, Staphylococcus
IDLEEAKKKL

SEQ ID NO: 1853321 - protein, 21 aa, Staphylococcus
IDLPNETAGQTAPLTNNPGNY

SEQ ID NO: 1853322 - protein, 21 aa, Staphylococcus
IDLPNETNGQIEPLTDNPGNY

SEQ ID NO: 1853323 - protein, 21 aa, Staphylococcus
IDLPNETNGQIEPLTNNPGNY

SEQ ID NO: 1853324 - protein, 10 aa, Staphylococcus
IDLPNEVAGQ

SEQ ID NO: 1853325 - protein, 10 aa, Staphylococcus
IDNAANPSNI

SEQ ID NO: 1853326 - protein, 19 aa, Staphylococcus
IDNADTNQQVADAKNNGLH

SEQ ID NO: 1853327 - protein, 9 aa, Staphylococcus
IDNAPTRAE

SEQ ID NO: 1853328 - protein, 11 aa, Staphylococcus
IDNAQSHQAVD

SEQ ID NO: 1853329 - protein, 51 aa, Staphylococcus
IDNETEDTANNTENINYDDSSTDKEINDKYQKDDNTTNKENDATSVEGTRL

SEQ ID NO: 1853330 - protein, 8 aa, Staphylococcus
IDNGAAQD

SEQ ID NO: 1853331 - protein, 21 aa, Staphylococcus
IDNGDATAQQIADEKSKVNQA

SEQ ID NO: 1853332 - protein, 13 aa, Staphylococcus
IDNNRDKVDKWTE

SEQ ID NO: 1853333 - protein, 5 aa, Staphylococcus
IDNPQ

SEQ ID NO: 1853334 - protein, 11 aa, Staphylococcus
IDNPTSTVDEI

SEQ ID NO: 1853335 - protein, 32 aa, Staphylococcus
IDNSKSGKKVKDEVKALDQTPSDKKKAADMSD

SEQ ID NO: 1853336 - protein, 9 aa, Staphylococcus
IDPAEQEET

SEQ ID NO: 1853337 - protein, 9 aa, Staphylococcus
IDPENKLEG

SEQ ID NO: 1853338 - protein, 7 aa, Staphylococcus
IDPGPME

SEQ ID NO: 1853339 - protein, 77 aa, Staphylococcus
IDPNAEPSESEINAQQNAIKEETETSDANIDGENSNSNAVTAGTAAGGAVAASGLAKAAHDKNEALNEDNQVAENTA

SEQ ID NO: 1853340 - protein, 19 aa, Staphylococcus
IDPNIQSQNEIKKDLDATN

SEQ ID NO: 1853341 - protein, 7 aa, Staphylococcus
IDPNNSP

SEQ ID NO: 1853342 - protein, 6 aa, Staphylococcus
IDPNTA

SEQ ID NO: 1853343 - protein, 10 aa, Staphylococcus
IDPSEQEETW

SEQ ID NO: 1853344 - protein, 4 aa, Staphylococcus
IDQA

SEQ ID NO: 1853345 - protein, 21 aa, Staphylococcus
IDQAQTNQDVNNAVTNGNQEI

SEQ ID NO: 1853346 - protein, 18 aa, Staphylococcus
IDQASTNDAVHETRDNEI

SEQ ID NO: 1853347 - protein, 17 aa, Staphylococcus
IDQATSNNDVDQAQTNG

SEQ ID NO: 1853348 - protein, 56 aa, Staphylococcus
IDQTPDATEEEKEVAKQKVDEEATKAKDNIDQATTNDEVDQAKTTGNTEINNIQPE

SEQ ID NO: 1853349 - protein, 21 aa, Staphylococcus
IDQVDQKQSNQSSDKYNVTQL

SEQ ID NO: 1853350 - protein, 8 aa, Staphylococcus
IDQYKEGV

SEQ ID NO: 1853351 - protein, 11 aa, Staphylococcus
IDRGGAEKLLG

SEQ ID NO: 1853352 - protein, 7 aa, Staphylococcus
IDRNEQD

SEQ ID NO: 1853353 - protein, 7 aa, Staphylococcus
IDRNNGQ

SEQ ID NO: 1853354 - protein, 13 aa, Staphylococcus
IDRQDKDKTKNKM

SEQ ID NO: 1853355 - protein, 95 aa, Staphylococcus
IDRQSQTINSAEKDISNAEANGRRQDSNESLGEGNETTSHQSNHLSRTNESKHDKHSYEEGKVPDHQHVPEQTTSTQQHQMHQPQSNQHQQPHNN

SEQ ID NO: 1853356 - protein, 13 aa, Staphylococcus
IDRYEAANAQRQS

SEQ ID NO: 1853357 - protein, 14 aa, Staphylococcus
IDRYESAKLQTQNL

SEQ ID NO: 1853358 - protein, 14 aa, Staphylococcus
IDSDNSNMQLTKGD

SEQ ID NO: 1853359 - protein, 8 aa, Staphylococcus
IDSEPGET

SEQ ID NO: 1853360 - protein, 6 aa, Staphylococcus
IDSETG

SEQ ID NO: 1853361 - protein, 8 aa, Staphylococcus
IDSGSDSV

SEQ ID NO: 1853362 - protein, 9 aa, Staphylococcus
IDSPDKEAE

SEQ ID NO: 1853363 - protein, 8 aa, Staphylococcus
IDSPKYQS

SEQ ID NO: 1853364 - protein, 17 aa, Staphylococcus
IDSSNFNKNQVDNTSTT

SEQ ID NO: 1853365 - protein, 8 aa, Staphylococcus
IDSTKNYD

SEQ ID NO: 1853366 - protein, 15 aa, Staphylococcus
IDSYSSDITITQGSS

SEQ ID NO: 1853367 - protein, 9 aa, Staphylococcus
IDTDSAGNK

SEQ ID NO: 1853368 - protein, 9 aa, Staphylococcus
IDTDTTGNK

SEQ ID NO: 1853369 - protein, 9 aa, Staphylococcus
IDTGESTGI

SEQ ID NO: 1853370 - protein, 18 aa, Staphylococcus
IDTKEINKVKDHQGGGNA

SEQ ID NO: 1853371 - protein, 6 aa, Staphylococcus
IDTPSF

SEQ ID NO: 1853372 - protein, 7 aa, Staphylococcus
IDTPSNV

SEQ ID NO: 1853373 - protein, 18 aa, Staphylococcus
IDTSGDINIDKDGTVKSK

SEQ ID NO: 1853374 - protein, 18 aa, Staphylococcus
IDTVDQKQSDSDSDKYKV

SEQ ID NO: 1853375 - protein, 18 aa, Staphylococcus
IDTVDQKQSSSDNGKYKV

SEQ ID NO: 1853376 - protein, 6 aa, Staphylococcus
IDTYQT

SEQ ID NO: 1853377 - protein, 18 aa, Staphylococcus
IEAAANPNISQTKVNETV

SEQ ID NO: 1853378 - protein, 21 aa, Staphylococcus
IEAAKAVNKADYTPNTVTPLD

SEQ ID NO: 1853379 - protein, 20 aa, Staphylococcus
IEAAKAVTKSDYTPNTVTPL

SEQ ID NO: 1853380 - protein, 7 aa, Staphylococcus
IEAAQSV

SEQ ID NO: 1853381 - protein, 8 aa, Staphylococcus
IEAGGPIT

SEQ ID NO: 1853382 - protein, 11 aa, Staphylococcus
IEAGGPVTVTH

SEQ ID NO: 1853383 - protein, 6 aa, Staphylococcus
IEAKAN

SEQ ID NO: 1853384 - protein, 27 aa, Staphylococcus
IEAKDKESSKDDDDDSSSSHDEVTRDN

SEQ ID NO: 1853385 - protein, 41 aa, Staphylococcus
IEANAKKFKSAIQAAKKVAQSFKKTQESIKDTKLDGDSSGV

SEQ ID NO: 1853386 - protein, 11 aa, Staphylococcus
IEASEKIEDDP

SEQ ID NO: 1853387 - protein, 8 aa, Staphylococcus
IEASESLE

SEQ ID NO: 1853388 - protein, 8 aa, Staphylococcus
IEASETLE

SEQ ID NO: 1853389 - protein, 7 aa, Staphylococcus
IEDDDAV

SEQ ID NO: 1853390 - protein, 8 aa, Staphylococcus
IEDDDAVD

SEQ ID NO: 1853391 - protein, 8 aa, Staphylococcus
IEDERQRL

SEQ ID NO: 1853392 - protein, 116 aa, Staphylococcus
IEDFKQQDSISPDEIAAQQQAIKEEVNDTLKDDSPEAQEIQQAKAEAQEENKKEASATEIAAQQQAIKHETNDTLKAPSNKTKKMMANNQAQRLAQAAKGKAQKMEQDSSVTAKTK

SEQ ID NO: 1853393 - protein, 10 aa, Staphylococcus
IEDGGNAVDA

SEQ ID NO: 1853394 - protein, 14 aa, Staphylococcus
IEDGGNAVDAAEGV

SEQ ID NO: 1853395 - protein, 5 aa, Staphylococcus
IEDGM

SEQ ID NO: 1853396 - protein, 16 aa, Staphylococcus
IEDNEAKNFDKKNKNF

SEQ ID NO: 1853397 - protein, 14 aa, Staphylococcus
IEDNEAKNFDKKNT

SEQ ID NO: 1853398 - protein, 13 aa, Staphylococcus
IEDTFTSKGTEFR

SEQ ID NO: 1853399 - protein, 6 aa, Staphylococcus
IEDTSA

SEQ ID NO: 1853400 - protein, 15 aa, Staphylococcus
IEEDKDNGILQIINI

SEQ ID NO: 1853401 - protein, 13 aa, Staphylococcus
IEEDNSDKVHNNI

SEQ ID NO: 1853402 - protein, 4 aa, Staphylococcus
IEEK

SEQ ID NO: 1853403 - protein, 17 aa, Staphylococcus
IEEKAKTGKLNKQDGKI

SEQ ID NO: 1853404 - protein, 5 aa, Staphylococcus
IEENE

SEQ ID NO: 1853405 - protein, 15 aa, Staphylococcus
IEEQTYERNREAVDK

SEQ ID NO: 1853406 - protein, 11 aa, Staphylococcus
IEESRQHHPNM

SEQ ID NO: 1853407 - protein, 15 aa, Staphylococcus
IEGEGYANTFSTGNL

SEQ ID NO: 1853408 - protein, 10 aa, Staphylococcus
IEGETVGIND

SEQ ID NO: 1853409 - protein, 17 aa, Staphylococcus
IEGFTEEQAQYAIDNLD

SEQ ID NO: 1853410 - protein, 4 aa, Staphylococcus
IEGG

SEQ ID NO: 1853411 - protein, 7 aa, Staphylococcus
IEGKDGE

SEQ ID NO: 1853412 - protein, 13 aa, Staphylococcus
IEGPGDQPITESF

SEQ ID NO: 1853413 - protein, 11 aa, Staphylococcus
IEGTTSHTQSI

SEQ ID NO: 1853414 - protein, 38 aa, Staphylococcus
IEHNRNTSIADNQDSENENTDITSSNKAVNDVDTSKNK

SEQ ID NO: 1853415 - protein, 12 aa, Staphylococcus
IEHRDKNHKTVD

SEQ ID NO: 1853416 - protein, 14 aa, Staphylococcus
IEKAERLAKQTKDL

SEQ ID NO: 1853417 - protein, 10 aa, Staphylococcus
IEKAKTSYEV

SEQ ID NO: 1853418 - protein, 7 aa, Staphylococcus
IEKEHPG

SEQ ID NO: 1853419 - protein, 5 aa, Staphylococcus
IEKGD

SEQ ID NO: 1853420 - protein, 17 aa, Staphylococcus
IEKKQLKKRYPDVPDFE

SEQ ID NO: 1853421 - protein, 4 aa, Staphylococcus
IEKN

SEQ ID NO: 1853422 - protein, 5 aa, Staphylococcus
IEKNG

SEQ ID NO: 1853423 - protein, 9 aa, Staphylococcus
IEKPRPSNK

SEQ ID NO: 1853424 - protein, 18 aa, Staphylococcus
IEKTQGGAMNAEPGGTSE

SEQ ID NO: 1853425 - protein, 18 aa, Staphylococcus
IELPNTGKKQTNEKGNTS

SEQ ID NO: 1853426 - protein, 10 aa, Staphylococcus
IENDQSGQDE

SEQ ID NO: 1853427 - protein, 6 aa, Staphylococcus
IENDTL

SEQ ID NO: 1853428 - protein, 28 aa, Staphylococcus
IENDTPKNITTQTIDKTNINSNNEVGSG

SEQ ID NO: 1853429 - protein, 8 aa, Staphylococcus
IENNKATI

SEQ ID NO: 1853430 - protein, 7 aa, Staphylococcus
IENPHKE

SEQ ID NO: 1853431 - protein, 5 aa, Staphylococcus
IENQE

SEQ ID NO: 1853432 - protein, 7 aa, Staphylococcus
IENSHNP

SEQ ID NO: 1853433 - protein, 10 aa, Staphylococcus
IENSKDDASH

SEQ ID NO: 1853434 - protein, 19 aa, Staphylococcus
IEPAKGDNNPKKQVITPRK

SEQ ID NO: 1853435 - protein, 18 aa, Staphylococcus
IEPAKSDNNDKKQIITPR

SEQ ID NO: 1853436 - protein, 19 aa, Staphylococcus
IEPAKSDNNPKKQVITPRK

SEQ ID NO: 1853437 - protein, 6 aa, Staphylococcus
IEPGPM

SEQ ID NO: 1853438 - protein, 5 aa, Staphylococcus
IEPGT

SEQ ID NO: 1853439 - protein, 5 aa, Staphylococcus
IEPIK

SEQ ID NO: 1853440 - protein, 8 aa, Staphylococcus
IEPPTQHV

SEQ ID NO: 1853441 - protein, 4 aa, Staphylococcus
IEPQ

SEQ ID NO: 1853442 - protein, 80 aa, Staphylococcus
IEPQDNGDTKVTFSDGQSINVPKGKDGKSVTITNTETLPNGNKQVTFSDGKTLEIPKGDKGEQGEDGAKGDKGENGASIT

SEQ ID NO: 1853443 - protein, 17 aa, Staphylococcus
IEPTESLEDSKDVEVQD

SEQ ID NO: 1853444 - protein, 13 aa, Staphylococcus
IEQDADDKKTFKF

SEQ ID NO: 1853445 - protein, 13 aa, Staphylococcus
IEQDADDKKTFRF

SEQ ID NO: 1853446 - protein, 11 aa, Staphylococcus
IEQDAGDKKTF

SEQ ID NO: 1853447 - protein, 4 aa, Staphylococcus
IEQE

SEQ ID NO: 1853448 - protein, 11 aa, Staphylococcus
IEQERKNKRQK

SEQ ID NO: 1853449 - protein, 20 aa, Staphylococcus
IEQFSGPNPPMYKTQNKDSR

SEQ ID NO: 1853450 - protein, 6 aa, Staphylococcus
IEQGKA

SEQ ID NO: 1853451 - protein, 6 aa, Staphylococcus
IEQKGQ

SEQ ID NO: 1853452 - protein, 11 aa, Staphylococcus
IEQKKRKRTTL

SEQ ID NO: 1853453 - protein, 6 aa, Staphylococcus
IEQPNY

SEQ ID NO: 1853454 - protein, 24 aa, Staphylococcus
IEQQSSENSALKSEIKKNSSYERI

SEQ ID NO: 1853455 - protein, 18 aa, Staphylococcus
IEQTQGGSMNSEVGGSSE

SEQ ID NO: 1853456 - protein, 12 aa, Staphylococcus
IEREPEIQRESK

SEQ ID NO: 1853457 - protein, 13 aa, Staphylococcus
IERGEAVPETKSK

SEQ ID NO: 1853458 - protein, 11 aa, Staphylococcus
IERPPQPIQKN

SEQ ID NO: 1853459 - protein, 7 aa, Staphylococcus
IERTAYD

SEQ ID NO: 1853460 - protein, 10 aa, Staphylococcus
IESDKSQKTA

SEQ ID NO: 1853461 - protein, 9 aa, Staphylococcus
IESEPDVGT

SEQ ID NO: 1853462 - protein, 24 aa, Staphylococcus
IESFQKDNQLEVNGTFDKETNHKF

SEQ ID NO: 1853463 - protein, 7 aa, Staphylococcus
IESGTHQ

SEQ ID NO: 1853464 - protein, 4 aa, Staphylococcus
IESH

SEQ ID NO: 1853465 - protein, 8 aa, Staphylococcus
IESLTQPV

SEQ ID NO: 1853466 - protein, 11 aa, Staphylococcus
IESNDTPIPYP

SEQ ID NO: 1853467 - protein, 10 aa, Staphylococcus
IESSKGSSVP

SEQ ID NO: 1853468 - protein, 9 aa, Staphylococcus
IETAPQRDN

SEQ ID NO: 1853469 - protein, 8 aa, Staphylococcus
IETATADA

SEQ ID NO: 1853470 - protein, 6 aa, Staphylococcus
IETGTH

SEQ ID NO: 1853471 - protein, 14 aa, Staphylococcus
IETNEETEHALEWS

SEQ ID NO: 1853472 - protein, 26 aa, Staphylococcus
IETVPAYGSTYDYPPYYNQRDDYDDR

SEQ ID NO: 1853473 - protein, 11 aa, Staphylococcus
IEYGKDGSLPA

SEQ ID NO: 1853474 - protein, 5 aa, Staphylococcus
IGASG

SEQ ID NO: 1853475 - protein, 10 aa, Staphylococcus
IGASQNEVAE

SEQ ID NO: 1853476 - protein, 17 aa, Staphylococcus
IGDERQSISKTNGKDAV

SEQ ID NO: 1853477 - protein, 4 aa, Staphylococcus
IGDK

SEQ ID NO: 1853478 - protein, 17 aa, Staphylococcus
IGDKSQYREGVKTSLSK

SEQ ID NO: 1853479 - protein, 8 aa, Staphylococcus
IGDTNKTL

SEQ ID NO: 1853480 - protein, 9 aa, Staphylococcus
IGEKADPVK

SEQ ID NO: 1853481 - protein, 9 aa, Staphylococcus
IGEKGEPVK

SEQ ID NO: 1853482 - protein, 9 aa, Staphylococcus
IGEKGKPVK

SEQ ID NO: 1853483 - protein, 9 aa, Staphylococcus
IGEPGASKT

SEQ ID NO: 1853484 - protein, 9 aa, Staphylococcus
IGEPGSSKR

SEQ ID NO: 1853485 - protein, 10 aa, Staphylococcus
IGEPGSSKTL

SEQ ID NO: 1853486 - protein, 7 aa, Staphylococcus
IGGEDNL

SEQ ID NO: 1853487 - protein, 7 aa, Staphylococcus
IGGGNSP

SEQ ID NO: 1853488 - protein, 8 aa, Staphylococcus
IGGGNSPF

SEQ ID NO: 1853489 - protein, 8 aa, Staphylococcus
IGGISSQA

SEQ ID NO: 1853490 - protein, 10 aa, Staphylococcus
IGGKDNLDTA

SEQ ID NO: 1853491 - protein, 8 aa, Staphylococcus
IGGSKSKA

SEQ ID NO: 1853492 - protein, 5 aa, Staphylococcus
IGGTT

SEQ ID NO: 1853493 - protein, 8 aa, Staphylococcus
IGITSNNG

SEQ ID NO: 1853494 - protein, 8 aa, Staphylococcus
IGKAPNEI

SEQ ID NO: 1853495 - protein, 23 aa, Staphylococcus
IGKEGASKDDVKAAAAKKGNPIQ

SEQ ID NO: 1853496 - protein, 4 aa, Staphylococcus
IGKG

SEQ ID NO: 1853497 - protein, 7 aa, Staphylococcus
IGKGGTL

SEQ ID NO: 1853498 - protein, 5 aa, Staphylococcus
IGKQS

SEQ ID NO: 1853499 - protein, 23 aa, Staphylococcus
IGKSPAINQTTDIDNSDNLNSEN

SEQ ID NO: 1853500 - protein, 6 aa, Staphylococcus
IGKTGK

SEQ ID NO: 1853501 - protein, 29 aa, Staphylococcus
IGLDPDKLPKGDITKYQSTASAAEQSTYG

SEQ ID NO: 1853502 - protein, 4 aa, Staphylococcus
IGLK

SEQ ID NO: 1853503 - protein, 6 aa, Staphylococcus
IGNAVS

SEQ ID NO: 1853504 - protein, 18 aa, Staphylococcus
IGNGTHSDGRVTNVSSKS

SEQ ID NO: 1853505 - protein, 7 aa, Staphylococcus
IGNNSNN

SEQ ID NO: 1853506 - protein, 12 aa, Staphylococcus
IGNTPREDYAYE

SEQ ID NO: 1853507 - protein, 4 aa, Staphylococcus
IGPA

SEQ ID NO: 1853508 - protein, 5 aa, Staphylococcus
IGPSG

SEQ ID NO: 1853509 - protein, 12 aa, Staphylococcus
IGPSSSAHASKE

SEQ ID NO: 1853510 - protein, 5 aa, Staphylococcus
IGPTA

SEQ ID NO: 1853511 - protein, 4 aa, Staphylococcus
IGQA

SEQ ID NO: 1853512 - protein, 7 aa, Staphylococcus
IGQKAEP

SEQ ID NO: 1853513 - protein, 5 aa, Staphylococcus
IGQTI

SEQ ID NO: 1853514 - protein, 9 aa, Staphylococcus
IGQTTNSTA

SEQ ID NO: 1853515 - protein, 16 aa, Staphylococcus
IGQTYAKEENESGKRN

SEQ ID NO: 1853516 - protein, 5 aa, Staphylococcus
IGRES

SEQ ID NO: 1853517 - protein, 34 aa, Staphylococcus
IGRGDNELADPTANATSENNSATYSESKGKYYHT

SEQ ID NO: 1853518 - protein, 39 aa, Staphylococcus
IGRGDNELVDPTDEDAIEKESADTKQSNGSKYSKSASQI

SEQ ID NO: 1853519 - protein, 9 aa, Staphylococcus
IGSAAKKGV

SEQ ID NO: 1853520 - protein, 9 aa, Staphylococcus
IGSDTAMET

SEQ ID NO: 1853521 - protein, 6 aa, Staphylococcus
IGSGQT

SEQ ID NO: 1853522 - protein, 41 aa, Staphylococcus
IGSMPDLKKPENKNTTGKYEYHTSSDEEMTHTKDKEASDTI

SEQ ID NO: 1853523 - protein, 24 aa, Staphylococcus
IGSMPDLKKPKTIHKDEVEEEQHK

SEQ ID NO: 1853524 - protein, 40 aa, Staphylococcus
IGSMPDLKKPVDKKGEDNHTQRSEDKIISAEGEDHKQGMT

SEQ ID NO: 1853525 - protein, 6 aa, Staphylococcus
IGSPFT

SEQ ID NO: 1853526 - protein, 5 aa, Staphylococcus
IGSSA

SEQ ID NO: 1853527 - protein, 10 aa, Staphylococcus
IGTGTTDGNG

SEQ ID NO: 1853528 - protein, 10 aa, Staphylococcus
IGTGTTGANG

SEQ ID NO: 1853529 - protein, 7 aa, Staphylococcus
IGTNSSP

SEQ ID NO: 1853530 - protein, 10 aa, Staphylococcus
IGTPGDKVYY

SEQ ID NO: 1853531 - protein, 13 aa, Staphylococcus
IGTPGGNKIPTTL

SEQ ID NO: 1853532 - protein, 4 aa, Staphylococcus
IGVD

SEQ ID NO: 1853533 - protein, 22 aa, Staphylococcus
IGYDAQPKKEVAEKSSQKELEL

SEQ ID NO: 1853534 - protein, 5 aa, Staphylococcus
IHAPH

SEQ ID NO: 1853535 - protein, 19 aa, Staphylococcus
IHKPDNVKINSGGATDDIQ

SEQ ID NO: 1853536 - protein, 9 aa, Staphylococcus
IHSKENKKR

SEQ ID NO: 1853537 - protein, 6 aa, Staphylococcus
IHSSKQ

SEQ ID NO: 1853538 - protein, 4 aa, Staphylococcus
IHTK

SEQ ID NO: 1853539 - protein, 15 aa, Staphylococcus
IIEDGGNATDAAEGV

SEQ ID NO: 1853540 - protein, 10 aa, Staphylococcus
IIGTAEANTK

SEQ ID NO: 1853541 - protein, 18 aa, Staphylococcus
IKAKSAISYAKSKPTIQN

SEQ ID NO: 1853542 - protein, 6 aa, Staphylococcus
IKAPGV

SEQ ID NO: 1853543 - protein, 5 aa, Staphylococcus
IKAPL

SEQ ID NO: 1853544 - protein, 9 aa, Staphylococcus
IKASGGVHI

SEQ ID NO: 1853545 - protein, 9 aa, Staphylococcus
IKASKATIR

SEQ ID NO: 1853546 - protein, 10 aa, Staphylococcus
IKASKATIRN

SEQ ID NO: 1853547 - protein, 10 aa, Staphylococcus
IKASKSTIRN

SEQ ID NO: 1853548 - protein, 10 aa, Staphylococcus
IKDDKSTTIS

SEQ ID NO: 1853549 - protein, 24 aa, Staphylococcus
IKDDNKNVNTTNGEQNNYKVFAFV

SEQ ID NO: 1853550 - protein, 13 aa, Staphylococcus
IKDEQEKNQDKIN

SEQ ID NO: 1853551 - protein, 4 aa, Staphylococcus
IKDG

SEQ ID NO: 1853552 - protein, 16 aa, Staphylococcus
IKDGDQKINIGTKKVA

SEQ ID NO: 1853553 - protein, 10 aa, Staphylococcus
IKDGQHNQNL

SEQ ID NO: 1853554 - protein, 25 aa, Staphylococcus
IKDHPDVKKASDATVSASKTVADKS

SEQ ID NO: 1853555 - protein, 18 aa, Staphylococcus
IKDHPDVQKVNDKTADLR

SEQ ID NO: 1853556 - protein, 32 aa, Staphylococcus
IKDKAEIKNSSKYINEDQPEQQAYDNAVTNAQ

SEQ ID NO: 1853557 - protein, 9 aa, Staphylococcus
IKDLQSKGY

SEQ ID NO: 1853558 - protein, 8 aa, Staphylococcus
IKDNAIES

SEQ ID NO: 1853559 - protein, 6 aa, Staphylococcus
IKDNHN

SEQ ID NO: 1853560 - protein, 20 aa, Staphylococcus
IKDNKTEVTVERDGKTHTMD

SEQ ID NO: 1853561 - protein, 12 aa, Staphylococcus
IKDSDGDTVPPG

SEQ ID NO: 1853562 - protein, 8 aa, Staphylococcus
IKDSGELR

SEQ ID NO: 1853563 - protein, 22 aa, Staphylococcus
IKDSNEKLKADEVIRDGSAQLT

SEQ ID NO: 1853564 - protein, 9 aa, Staphylococcus
IKEAKDKLN

SEQ ID NO: 1853565 - protein, 14 aa, Staphylococcus
IKEAYKNNTPTSKF

SEQ ID NO: 1853566 - protein, 8 aa, Staphylococcus
IKEGDKVD

SEQ ID NO: 1853567 - protein, 7 aa, Staphylococcus
IKEGDNV

SEQ ID NO: 1853568 - protein, 48 aa, Staphylococcus
IKEHPDVKKATDATSRAASKTTSAISNKSSDVKAYVGDKKQEFDNKRE

SEQ ID NO: 1853569 - protein, 48 aa, Staphylococcus
IKEHPDVRKATDATTKATSKATSTISNKASDVKEYVGDKKQEFDNKRE

SEQ ID NO: 1853570 - protein, 13 aa, Staphylococcus
IKEKETENKEKIK

SEQ ID NO: 1853571 - protein, 11 aa, Staphylococcus
IKELESANNRI

SEQ ID NO: 1853572 - protein, 23 aa, Staphylococcus
IKENQKSCKSGAAITINNGEAVA

SEQ ID NO: 1853573 - protein, 8 aa, Staphylococcus
IKENRSTS

SEQ ID NO: 1853574 - protein, 8 aa, Staphylococcus
IKEQGTYE

SEQ ID NO: 1853575 - protein, 4 aa, Staphylococcus
IKES

SEQ ID NO: 1853576 - protein, 7 aa, Staphylococcus
IKESGPV

SEQ ID NO: 1853577 - protein, 9 aa, Staphylococcus
IKESGSYES

SEQ ID NO: 1853578 - protein, 6 aa, Staphylococcus
IKESYS

SEQ ID NO: 1853579 - protein, 4 aa, Staphylococcus
IKET

SEQ ID NO: 1853580 - protein, 4 aa, Staphylococcus
IKEV

SEQ ID NO: 1853581 - protein, 15 aa, Staphylococcus
IKGIEDNNLDQTDAA

SEQ ID NO: 1853582 - protein, 7 aa, Staphylococcus
IKGIENN

SEQ ID NO: 1853583 - protein, 17 aa, Staphylococcus
IKGIGDKTFERIKEYIT

SEQ ID NO: 1853584 - protein, 6 aa, Staphylococcus
IKGKID

SEQ ID NO: 1853585 - protein, 15 aa, Staphylococcus
IKGKNEASGGNNKFG

SEQ ID NO: 1853586 - protein, 15 aa, Staphylococcus
IKGKSYRKSYNMNNR

SEQ ID NO: 1853587 - protein, 4 aa, Staphylococcus
IKGN

SEQ ID NO: 1853588 - protein, 34 aa, Staphylococcus
IKGNSDSSPESKVTMPRKETTPDSPTIEASEEQV

SEQ ID NO: 1853589 - protein, 32 aa, Staphylococcus
IKGNSDSSPESKVTMPRKEVTPESPAIEANEE

SEQ ID NO: 1853590 - protein, 12 aa, Staphylococcus
IKGQSDKDIANQ

SEQ ID NO: 1853591 - protein, 10 aa, Staphylococcus
IKGRKETNFP

SEQ ID NO: 1853592 - protein, 11 aa, Staphylococcus
IKGRKETNFPQ

SEQ ID NO: 1853593 - protein, 4 aa, Staphylococcus
IKGS

SEQ ID NO: 1853594 - protein, 8 aa, Staphylococcus
IKHAREKQ

SEQ ID NO: 1853595 - protein, 5 aa, Staphylococcus
IKIST

SEQ ID NO: 1853596 - protein, 12 aa, Staphylococcus
IKKDDVRKNFYA

SEQ ID NO: 1853597 - protein, 16 aa, Staphylococcus
IKKDPKASYSYEDKAS

SEQ ID NO: 1853598 - protein, 19 aa, Staphylococcus
IKKDPKASYTYEDKTKFEN

SEQ ID NO: 1853599 - protein, 19 aa, Staphylococcus
IKKDPTASYSYEDKDEFDQ

SEQ ID NO: 1853600 - protein, 19 aa, Staphylococcus
IKKEDKLRKQRQKSMPKRI

SEQ ID NO: 1853601 - protein, 12 aa, Staphylococcus
IKKNPKRSYTYD

SEQ ID NO: 1853602 - protein, 9 aa, Staphylococcus
IKKNQAKQI

SEQ ID NO: 1853603 - protein, 9 aa, Staphylococcus
IKKQGKDIS

SEQ ID NO: 1853604 - protein, 6 aa, Staphylococcus
IKKQKF

SEQ ID NO: 1853605 - protein, 12 aa, Staphylococcus
IKKQNKDPNEVL

SEQ ID NO: 1853606 - protein, 11 aa, Staphylococcus
IKKSGTATVEA

SEQ ID NO: 1853607 - protein, 9 aa, Staphylococcus
IKKSNDYNQ

SEQ ID NO: 1853608 - protein, 16 aa, Staphylococcus
IKLETRADKLKEVERR

SEQ ID NO: 1853609 - protein, 12 aa, Staphylococcus
IKNEVEELLEND

SEQ ID NO: 1853610 - protein, 4 aa, Staphylococcus
IKNG

SEQ ID NO: 1853611 - protein, 28 aa, Staphylococcus
IKNHSEVKKVTAATSRASKTVANKATDV

SEQ ID NO: 1853612 - protein, 7 aa, Staphylococcus
IKNKDDQ

SEQ ID NO: 1853613 - protein, 11 aa, Staphylococcus
IKNKGDKALTI

SEQ ID NO: 1853614 - protein, 6 aa, Staphylococcus
IKNKPT

SEQ ID NO: 1853615 - protein, 15 aa, Staphylococcus
IKNKPTKNKDPKHHP

SEQ ID NO: 1853616 - protein, 4 aa, Staphylococcus
IKNL

SEQ ID NO: 1853617 - protein, 4 aa, Staphylococcus
IKNN

SEQ ID NO: 1853618 - protein, 9 aa, Staphylococcus
IKNNGNTQS

SEQ ID NO: 1853619 - protein, 6 aa, Staphylococcus
IKNNQQ

SEQ ID NO: 1853620 - protein, 10 aa, Staphylococcus
IKNNTQKEID

SEQ ID NO: 1853621 - protein, 5 aa, Staphylococcus
IKNPQ

SEQ ID NO: 1853622 - protein, 6 aa, Staphylococcus
IKNPYG

SEQ ID NO: 1853623 - protein, 11 aa, Staphylococcus
IKNSESDIIPP

SEQ ID NO: 1853624 - protein, 5 aa, Staphylococcus
IKNSK

SEQ ID NO: 1853625 - protein, 8 aa, Staphylococcus
IKNTKDLG

SEQ ID NO: 1853626 - protein, 5 aa, Staphylococcus
IKPDI

SEQ ID NO: 1853627 - protein, 20 aa, Staphylococcus
IKPEQQNKIEDITGQEPLKM

SEQ ID NO: 1853628 - protein, 7 aa, Staphylococcus
IKPETGE

SEQ ID NO: 1853629 - protein, 8 aa, Staphylococcus
IKPETGEV

SEQ ID NO: 1853630 - protein, 9 aa, Staphylococcus
IKPGGEDSF

SEQ ID NO: 1853631 - protein, 17 aa, Staphylococcus
IKPKKTKSEFDNDVDTK

SEQ ID NO: 1853632 - protein, 12 aa, Staphylococcus
IKPKTTKSEFKN

SEQ ID NO: 1853633 - protein, 12 aa, Staphylococcus
IKPTDTKEESLL

SEQ ID NO: 1853634 - protein, 5 aa, Staphylococcus
IKPTF

SEQ ID NO: 1853635 - protein, 6 aa, Staphylococcus
IKQDRK

SEQ ID NO: 1853636 - protein, 10 aa, Staphylococcus
IKQDTTLDED

SEQ ID NO: 1853637 - protein, 7 aa, Staphylococcus
IKQEHNP

SEQ ID NO: 1853638 - protein, 28 aa, Staphylococcus
IKQGDKLDKGDKVAEVSAQGEGGQSKDM

SEQ ID NO: 1853639 - protein, 19 aa, Staphylococcus
IKQGGENGVKQAENRENTQ

SEQ ID NO: 1853640 - protein, 14 aa, Staphylococcus
IKQGQKEADNIKKE

SEQ ID NO: 1853641 - protein, 12 aa, Staphylococcus
IKQQTESNIENV

SEQ ID NO: 1853642 - protein, 11 aa, Staphylococcus
IKQTKLNSKTS

SEQ ID NO: 1853643 - protein, 20 aa, Staphylococcus
IKQVESANNRISDSLRSTNQ

SEQ ID NO: 1853644 - protein, 8 aa, Staphylococcus
IKRQGKDI

SEQ ID NO: 1853645 - protein, 8 aa, Staphylococcus
IKRQGQDI

SEQ ID NO: 1853646 - protein, 4 aa, Staphylococcus
IKRT

SEQ ID NO: 1853647 - protein, 7 aa, Staphylococcus
IKSDMQP

SEQ ID NO: 1853648 - protein, 16 aa, Staphylococcus
IKSDSNGTIITIENNR

SEQ ID NO: 1853649 - protein, 4 aa, Staphylococcus
IKSE

SEQ ID NO: 1853650 - protein, 8 aa, Staphylococcus
IKSEETEK

SEQ ID NO: 1853651 - protein, 5 aa, Staphylococcus
IKSEG

SEQ ID NO: 1853652 - protein, 6 aa, Staphylococcus
IKSEGN

SEQ ID NO: 1853653 - protein, 8 aa, Staphylococcus
IKSEGNII

SEQ ID NO: 1853654 - protein, 7 aa, Staphylococcus
IKSELSQ

SEQ ID NO: 1853655 - protein, 4 aa, Staphylococcus
IKSG

SEQ ID NO: 1853656 - protein, 7 aa, Staphylococcus
IKSGGNC

SEQ ID NO: 1853657 - protein, 44 aa, Staphylococcus
IKSHPEVQKATHATSNAGQAIANKATGAKEYLGDKKQEFDNKRE

SEQ ID NO: 1853658 - protein, 15 aa, Staphylococcus
IKSKETSKYGNVDTP

SEQ ID NO: 1853659 - protein, 9 aa, Staphylococcus
IKSKKHKQK

SEQ ID NO: 1853660 - protein, 5 aa, Staphylococcus
IKSPT

SEQ ID NO: 1853661 - protein, 16 aa, Staphylococcus
IKSQTDATNAANTLSG

SEQ ID NO: 1853662 - protein, 10 aa, Staphylococcus
IKSSDGKITR

SEQ ID NO: 1853663 - protein, 7 aa, Staphylococcus
IKSSPNT

SEQ ID NO: 1853664 - protein, 12 aa, Staphylococcus
IKSSQLEGDDDY

SEQ ID NO: 1853665 - protein, 6 aa, Staphylococcus
IKSTDD

SEQ ID NO: 1853666 - protein, 25 aa, Staphylococcus
IKTATDNLHGEQRLQNEKDTSNNSI

SEQ ID NO: 1853667 - protein, 8 aa, Staphylococcus
IKTEDPNV

SEQ ID NO: 1853668 - protein, 6 aa, Staphylococcus
IKTEED

SEQ ID NO: 1853669 - protein, 8 aa, Staphylococcus
IKTEEDVE

SEQ ID NO: 1853670 - protein, 9 aa, Staphylococcus
IKTEEDVER

SEQ ID NO: 1853671 - protein, 9 aa, Staphylococcus
IKTEEEAEE

SEQ ID NO: 1853672 - protein, 7 aa, Staphylococcus
IKTIESD

SEQ ID NO: 1853673 - protein, 9 aa, Staphylococcus
IKTKQDQQR

SEQ ID NO: 1853674 - protein, 6 aa, Staphylococcus
IKTLNP

SEQ ID NO: 1853675 - protein, 4 aa, Staphylococcus
IKTN

SEQ ID NO: 1853676 - protein, 16 aa, Staphylococcus
IKTPQPTMVQYDANQQ

SEQ ID NO: 1853677 - protein, 8 aa, Staphylococcus
IKTPSDGI

SEQ ID NO: 1853678 - protein, 10 aa, Staphylococcus
IKTPSDGIDL

SEQ ID NO: 1853679 - protein, 10 aa, Staphylococcus
IKTPSDGVEL

SEQ ID NO: 1853680 - protein, 5 aa, Staphylococcus
IKTPT

SEQ ID NO: 1853681 - protein, 22 aa, Staphylococcus
IKTPYSKNTKQDEIKDDLKDKK

SEQ ID NO: 1853682 - protein, 26 aa, Staphylococcus
IKTPYTKKTKLDEINEPKEEKPKAAS

SEQ ID NO: 1853683 - protein, 22 aa, Staphylococcus
IKTPYTKNTKIDEINDDLKDKK

SEQ ID NO: 1853684 - protein, 7 aa, Staphylococcus
IKTSQDV

SEQ ID NO: 1853685 - protein, 8 aa, Staphylococcus
IKTYGGNP

SEQ ID NO: 1853686 - protein, 4 aa, Staphylococcus
IKYG

SEQ ID NO: 1853687 - protein, 8 aa, Staphylococcus
IKYSAKNK

SEQ ID NO: 1853688 - protein, 9 aa, Staphylococcus
IKYSRESKD

SEQ ID NO: 1853689 - protein, 5 aa, Staphylococcus
ILEDQ

SEQ ID NO: 1853690 - protein, 5 aa, Staphylococcus
ILGTN

SEQ ID NO: 1853691 - protein, 7 aa, Staphylococcus
ILPSRSK

SEQ ID NO: 1853692 - protein, 12 aa, Staphylococcus
ILSPKGARQENY

SEQ ID NO: 1853693 - protein, 5 aa, Staphylococcus
ILTDQ

SEQ ID NO: 1853694 - protein, 43 aa, Staphylococcus
ILTEQQKEQAKAEVQKLKDQAIDKINNSTNVKDVENNQNKDLN

SEQ ID NO: 1853695 - protein, 5 aa, Staphylococcus
IMPTY

SEQ ID NO: 1853696 - protein, 18 aa, Staphylococcus
INAANTENEINGIQTQNV

SEQ ID NO: 1853697 - protein, 11 aa, Staphylococcus
INAEPTKKQAY

SEQ ID NO: 1853698 - protein, 4 aa, Staphylococcus
INAL

SEQ ID NO: 1853699 - protein, 7 aa, Staphylococcus
INANNDI

SEQ ID NO: 1853700 - protein, 5 aa, Staphylococcus
INAPS

SEQ ID NO: 1853701 - protein, 6 aa, Staphylococcus
INAPSV

SEQ ID NO: 1853702 - protein, 12 aa, Staphylococcus
INATDNSGDPIK

SEQ ID NO: 1853703 - protein, 18 aa, Staphylococcus
INATPGATREEKQEAVGR

SEQ ID NO: 1853704 - protein, 5 aa, Staphylococcus
INDAK

SEQ ID NO: 1853705 - protein, 10 aa, Staphylococcus
INDAKNPIID

SEQ ID NO: 1853706 - protein, 11 aa, Staphylococcus
INDAPALAKSN

SEQ ID NO: 1853707 - protein, 8 aa, Staphylococcus
INDAQRTA

SEQ ID NO: 1853708 - protein, 8 aa, Staphylococcus
INDATESQ

SEQ ID NO: 1853709 - protein, 6 aa, Staphylococcus
INDDSQ

SEQ ID NO: 1853710 - protein, 8 aa, Staphylococcus
INDEDYSQ

SEQ ID NO: 1853711 - protein, 6 aa, Staphylococcus
INDKNI

SEQ ID NO: 1853712 - protein, 4 aa, Staphylococcus
INDP

SEQ ID NO: 1853713 - protein, 5 aa, Staphylococcus
INDPV

SEQ ID NO: 1853714 - protein, 4 aa, Staphylococcus
INDQ

SEQ ID NO: 1853715 - protein, 9 aa, Staphylococcus
INDQTPQRK

SEQ ID NO: 1853716 - protein, 9 aa, Staphylococcus
INDSSYRSK

SEQ ID NO: 1853717 - protein, 19 aa, Staphylococcus
INDTNEATQEEKNDAINQL

SEQ ID NO: 1853718 - protein, 7 aa, Staphylococcus
INEDDYE

SEQ ID NO: 1853719 - protein, 18 aa, Staphylococcus
INEDPEQQAAYNQAVTKA

SEQ ID NO: 1853720 - protein, 7 aa, Staphylococcus
INEEDKY

SEQ ID NO: 1853721 - protein, 16 aa, Staphylococcus
INEKRKRSLGAVGRGY

SEQ ID NO: 1853722 - protein, 8 aa, Staphylococcus
INENDRKH

SEQ ID NO: 1853723 - protein, 26 aa, Staphylococcus
INEPNTNDTGKIKVKKGYQNLNGDEA

SEQ ID NO: 1853724 - protein, 5 aa, Staphylococcus
INERD

SEQ ID NO: 1853725 - protein, 32 aa, Staphylococcus
INESDDSIKNEQGTLRRSEDTSHKSDVENEVD

SEQ ID NO: 1853726 - protein, 19 aa, Staphylococcus
INESNKNNAQLNPSEISKI

SEQ ID NO: 1853727 - protein, 18 aa, Staphylococcus
INESQKKVQNQDTDPFEN

SEQ ID NO: 1853728 - protein, 11 aa, Staphylococcus
INESSKPTLDK

SEQ ID NO: 1853729 - protein, 7 aa, Staphylococcus
INESYNN

SEQ ID NO: 1853730 - protein, 9 aa, Staphylococcus
INETNSGQI

SEQ ID NO: 1853731 - protein, 8 aa, Staphylococcus
INGEGGGS

SEQ ID NO: 1853732 - protein, 11 aa, Staphylococcus
INGQDEDYDEY

SEQ ID NO: 1853733 - protein, 7 aa, Staphylococcus
INGRNTI

SEQ ID NO: 1853734 - protein, 13 aa, Staphylococcus
INGRSLNHRPGEQ

SEQ ID NO: 1853735 - protein, 8 aa, Staphylococcus
INGSGNGS

SEQ ID NO: 1853736 - protein, 6 aa, Staphylococcus
INGTDK

SEQ ID NO: 1853737 - protein, 7 aa, Staphylococcus
INGTDNL

SEQ ID NO: 1853738 - protein, 6 aa, Staphylococcus
INGTEN

SEQ ID NO: 1853739 - protein, 27 aa, Staphylococcus
INGTNQPTINKDDVSRATQTVNNTKVA

SEQ ID NO: 1853740 - protein, 4 aa, Staphylococcus
INGV

SEQ ID NO: 1853741 - protein, 24 aa, Staphylococcus
INHAKDALNGNQRLNDSKSDALNK

SEQ ID NO: 1853742 - protein, 8 aa, Staphylococcus
INHPSSAL

SEQ ID NO: 1853743 - protein, 9 aa, Staphylococcus
INHQQDDPL

SEQ ID NO: 1853744 - protein, 24 aa, Staphylococcus
INHRSNSQNFNKDEQSKDSEENSL

SEQ ID NO: 1853745 - protein, 5 aa, Staphylococcus
INHTS

SEQ ID NO: 1853746 - protein, 5 aa, Staphylococcus
INKDE

SEQ ID NO: 1853747 - protein, 11 aa, Staphylococcus
INKDNKESLKQ

SEQ ID NO: 1853748 - protein, 9 aa, Staphylococcus
INKKAETGI

SEQ ID NO: 1853749 - protein, 12 aa, Staphylococcus
INKKEKKSSLDY

SEQ ID NO: 1853750 - protein, 13 aa, Staphylococcus
INKRTEQNEDESP

SEQ ID NO: 1853751 - protein, 7 aa, Staphylococcus
INKTKRK

SEQ ID NO: 1853752 - protein, 7 aa, Staphylococcus
INKTTQT

SEQ ID NO: 1853753 - protein, 234 aa, Staphylococcus
INKVDGAQSYSQQNEQQSSKEDNKKMPKSTQAEQVEKQEQPASNQTPNHSSKEPSINNQQSHNKQQPSDDKIPNTEPEKIEKVDNHKRIQDQYQDKNKKVDNKQSNNSQLNQKENPDSSNNKQQKQRLDVKPQNDNQQLQSRNDVKEKLDNQPIEQTDTKQQSNNKSKDNTTSVKSHSQQHKPHSLKTQSHSTPGQKVNTNISTNPTQQQTTNQNIKPKNTDEATVKSNQYKNK

SEQ ID NO: 1853754 - protein, 13 aa, Staphylococcus
INKVDTKAAKKTV

SEQ ID NO: 1853755 - protein, 65 aa, Staphylococcus
INKYEDESNESDDSSGSDKDDKEKKDRDDGDKGTSEDHKSKDDEDKEDKEDNTEKRVKADLTQTE

SEQ ID NO: 1853756 - protein, 4 aa, Staphylococcus
INNA

SEQ ID NO: 1853757 - protein, 11 aa, Staphylococcus
INNAKQEKIDR

SEQ ID NO: 1853758 - protein, 31 aa, Staphylococcus
INNASNVKQSSDYINEDPTQKDAYDKAIQAA

SEQ ID NO: 1853759 - protein, 15 aa, Staphylococcus
INNDSKEGKQVNSKL

SEQ ID NO: 1853760 - protein, 25 aa, Staphylococcus
INNEQLNNLPNNLDRPHNISTNGKR

SEQ ID NO: 1853761 - protein, 41 aa, Staphylococcus
INNGDATAQQITEAKNRVDQAEREYTEAKNNLRADKTQLEN

SEQ ID NO: 1853762 - protein, 41 aa, Staphylococcus
INNGDATAQQITEAKNRVDQAEREYTEAKNNLRADKTQLET

SEQ ID NO: 1853763 - protein, 15 aa, Staphylococcus
INNGGSPKVIQEGAK

SEQ ID NO: 1853764 - protein, 15 aa, Staphylococcus
INNIEADNSAKSKAI

SEQ ID NO: 1853765 - protein, 5 aa, Staphylococcus
INNPK

SEQ ID NO: 1853766 - protein, 9 aa, Staphylococcus
INNSNDVND

SEQ ID NO: 1853767 - protein, 22 aa, Staphylococcus
INNTQSTQVSDEHHNKDTKHKE

SEQ ID NO: 1853768 - protein, 6 aa, Staphylococcus
INNYTG

SEQ ID NO: 1853769 - protein, 4 aa, Staphylococcus
INPD

SEQ ID NO: 1853770 - protein, 6 aa, Staphylococcus
INPDAS

SEQ ID NO: 1853771 - protein, 9 aa, Staphylococcus
INPEEQEET

SEQ ID NO: 1853772 - protein, 5 aa, Staphylococcus
INPEG

SEQ ID NO: 1853773 - protein, 15 aa, Staphylococcus
INPEPTIKVDGKEYE

SEQ ID NO: 1853774 - protein, 4 aa, Staphylococcus
INPF

SEQ ID NO: 1853775 - protein, 9 aa, Staphylococcus
INPGARGHD

SEQ ID NO: 1853776 - protein, 5 aa, Staphylococcus
INPGE

SEQ ID NO: 1853777 - protein, 10 aa, Staphylococcus
INPGSRGDDL

SEQ ID NO: 1853778 - protein, 10 aa, Staphylococcus
INPGSRGNDL

SEQ ID NO: 1853779 - protein, 7 aa, Staphylococcus
INPNDIK

SEQ ID NO: 1853780 - protein, 8 aa, Staphylococcus
INPNESVK

SEQ ID NO: 1853781 - protein, 15 aa, Staphylococcus
INPPISASSDQVTSL

SEQ ID NO: 1853782 - protein, 5 aa, Staphylococcus
INPQK

SEQ ID NO: 1853783 - protein, 19 aa, Staphylococcus
INQASTNDEVQAAENTGVA

SEQ ID NO: 1853784 - protein, 21 aa, Staphylococcus
INQDKTTNQVNLTEQQGVQSI

SEQ ID NO: 1853785 - protein, 6 aa, Staphylococcus
INQQDQ

SEQ ID NO: 1853786 - protein, 5 aa, Staphylococcus
INQSS

SEQ ID NO: 1853787 - protein, 16 aa, Staphylococcus
INQTSNPTLDKNKIDD

SEQ ID NO: 1853788 - protein, 12 aa, Staphylococcus
INQTTNPTLEPN

SEQ ID NO: 1853789 - protein, 14 aa, Staphylococcus
INRDRASNQKIHTI

SEQ ID NO: 1853790 - protein, 5 aa, Staphylococcus
INRGE

SEQ ID NO: 1853791 - protein, 9 aa, Staphylococcus
INSDQVTKL

SEQ ID NO: 1853792 - protein, 24 aa, Staphylococcus
INSEELKQKEYKGYKDDAVIGKKG

SEQ ID NO: 1853793 - protein, 24 aa, Staphylococcus
INSESKQQSISNSEQNHTSVFAYA

SEQ ID NO: 1853794 - protein, 9 aa, Staphylococcus
INSGSTANA

SEQ ID NO: 1853795 - protein, 11 aa, Staphylococcus
INSNGKSGTGK

SEQ ID NO: 1853796 - protein, 16 aa, Staphylococcus
INSNPKAGERVNQQEK

SEQ ID NO: 1853797 - protein, 7 aa, Staphylococcus
INSNPNL

SEQ ID NO: 1853798 - protein, 8 aa, Staphylococcus
INSQTGTV

SEQ ID NO: 1853799 - protein, 5 aa, Staphylococcus
INSQY

SEQ ID NO: 1853800 - protein, 21 aa, Staphylococcus
INSSDTNAQVNQIQSKSDDII

SEQ ID NO: 1853801 - protein, 6 aa, Staphylococcus
INSSKM

SEQ ID NO: 1853802 - protein, 4 aa, Staphylococcus
INTD

SEQ ID NO: 1853803 - protein, 6 aa, Staphylococcus
INTEGK

SEQ ID NO: 1853804 - protein, 27 aa, Staphylococcus
INTKKSELHGEQKLEADKTSANNSLNK

SEQ ID NO: 1853805 - protein, 5 aa, Staphylococcus
INTKM

SEQ ID NO: 1853806 - protein, 5 aa, Staphylococcus
INTPI

SEQ ID NO: 1853807 - protein, 5 aa, Staphylococcus
INTQD

SEQ ID NO: 1853808 - protein, 9 aa, Staphylococcus
INTTKPIQE

SEQ ID NO: 1853809 - protein, 10 aa, Staphylococcus
INTTKPVQEF

SEQ ID NO: 1853810 - protein, 11 aa, Staphylococcus
IPAGEKEETIK

SEQ ID NO: 1853811 - protein, 21 aa, Staphylococcus
IPAPGVNPAAFDSQQGSQGVT

SEQ ID NO: 1853812 - protein, 20 aa, Staphylococcus
IPAPGVNPEPFAHQGSDQGV

SEQ ID NO: 1853813 - protein, 20 aa, Staphylococcus
IPAPGVNPEPFEQQGSDQGV

SEQ ID NO: 1853814 - protein, 7 aa, Staphylococcus
IPASQTK

SEQ ID NO: 1853815 - protein, 7 aa, Staphylococcus
IPASQTR

SEQ ID NO: 1853816 - protein, 11 aa, Staphylococcus
IPATKETDNGK

SEQ ID NO: 1853817 - protein, 18 aa, Staphylococcus
IPDDGMKPADSTQKKAYD

SEQ ID NO: 1853818 - protein, 15 aa, Staphylococcus
IPDDSLKANNTSAHK

SEQ ID NO: 1853819 - protein, 16 aa, Staphylococcus
IPDDSLKPNDSSEHKA

SEQ ID NO: 1853820 - protein, 8 aa, Staphylococcus
IPDEANRK

SEQ ID NO: 1853821 - protein, 29 aa, Staphylococcus
IPDEYAKDTNGSIHDEDLPEGKSALGYGL

SEQ ID NO: 1853822 - protein, 26 aa, Staphylococcus
IPDEYAKDVSEDARTEQLPEGKTALR

SEQ ID NO: 1853823 - protein, 6 aa, Staphylococcus
IPDGDT

SEQ ID NO: 1853824 - protein, 45 aa, Staphylococcus
IPDGQKGDKGDKGDTGDQGETGPAGRAGLDGRDGRDGKNGSDGKS

SEQ ID NO: 1853825 - protein, 5 aa, Staphylococcus
IPDKY

SEQ ID NO: 1853826 - protein, 6 aa, Staphylococcus
IPDRYK

SEQ ID NO: 1853827 - protein, 6 aa, Staphylococcus
IPDSDT

SEQ ID NO: 1853828 - protein, 6 aa, Staphylococcus
IPDSYR

SEQ ID NO: 1853829 - protein, 4 aa, Staphylococcus
IPEG

SEQ ID NO: 1853830 - protein, 11 aa, Staphylococcus
IPENRQGSALG

SEQ ID NO: 1853831 - protein, 11 aa, Staphylococcus
IPESEKADSAI

SEQ ID NO: 1853832 - protein, 14 aa, Staphylococcus
IPESLSKEAREPAD

SEQ ID NO: 1853833 - protein, 5 aa, Staphylococcus
IPESY

SEQ ID NO: 1853834 - protein, 5 aa, Staphylococcus
IPETE

SEQ ID NO: 1853835 - protein, 5 aa, Staphylococcus
IPETT

SEQ ID NO: 1853836 - protein, 5 aa, Staphylococcus
IPGKF

SEQ ID NO: 1853837 - protein, 18 aa, Staphylococcus
IPGNGQHKINSAYSIGGP

SEQ ID NO: 1853838 - protein, 6 aa, Staphylococcus
IPGPSS

SEQ ID NO: 1853839 - protein, 11 aa, Staphylococcus
IPGRGINATID

SEQ ID NO: 1853840 - protein, 6 aa, Staphylococcus
IPGYNS

SEQ ID NO: 1853841 - protein, 7 aa, Staphylococcus
IPKDRPV

SEQ ID NO: 1853842 - protein, 12 aa, Staphylococcus
IPKDVREKEGIA

SEQ ID NO: 1853843 - protein, 19 aa, Staphylococcus
IPKEKNKATSSSQSEQSNL

SEQ ID NO: 1853844 - protein, 26 aa, Staphylococcus
IPKGEKGDRGDNGHDGQNGRDGASIT

SEQ ID NO: 1853845 - protein, 19 aa, Staphylococcus
IPKGEKGDRGDNGQDGHSI

SEQ ID NO: 1853846 - protein, 11 aa, Staphylococcus
IPKGQNGTSVG

SEQ ID NO: 1853847 - protein, 15 aa, Staphylococcus
IPKNSKQKNWRRINY

SEQ ID NO: 1853848 - protein, 5 aa, Staphylococcus
IPKNV

SEQ ID NO: 1853849 - protein, 6 aa, Staphylococcus
IPKRVD

SEQ ID NO: 1853850 - protein, 5 aa, Staphylococcus
IPKSP

SEQ ID NO: 1853851 - protein, 6 aa, Staphylococcus
IPKSQI

SEQ ID NO: 1853852 - protein, 15 aa, Staphylococcus
IPNITTDKREEVPQA

SEQ ID NO: 1853853 - protein, 10 aa, Staphylococcus
IPNSNDKNEH

SEQ ID NO: 1853854 - protein, 4 aa, Staphylococcus
IPNT

SEQ ID NO: 1853855 - protein, 28 aa, Staphylococcus
IPPAPPTVNPLKSTDTELSGTAEPNSKI

SEQ ID NO: 1853856 - protein, 13 aa, Staphylococcus
IPPDNDPNAKPLK

SEQ ID NO: 1853857 - protein, 21 aa, Staphylococcus
IPPKGKPFITPAKDTTMPLSK

SEQ ID NO: 1853858 - protein, 11 aa, Staphylococcus
IPPREKEETLK

SEQ ID NO: 1853859 - protein, 11 aa, Staphylococcus
IPPREKEETLR

SEQ ID NO: 1853860 - protein, 11 aa, Staphylococcus
IPQNEKEETMK

SEQ ID NO: 1853861 - protein, 10 aa, Staphylococcus
IPQSEKDETM

SEQ ID NO: 1853862 - protein, 18 aa, Staphylococcus
IPRDTKADIVGRGTTEKI

SEQ ID NO: 1853863 - protein, 5 aa, Staphylococcus
IPSAT

SEQ ID NO: 1853864 - protein, 9 aa, Staphylococcus
IPSDRKKIK

SEQ ID NO: 1853865 - protein, 4 aa, Staphylococcus
IPSE

SEQ ID NO: 1853866 - protein, 6 aa, Staphylococcus
IPSGGE

SEQ ID NO: 1853867 - protein, 6 aa, Staphylococcus
IPSLNE

SEQ ID NO: 1853868 - protein, 6 aa, Staphylococcus
IPSLNQ

SEQ ID NO: 1853869 - protein, 6 aa, Staphylococcus
IPSNGK

SEQ ID NO: 1853870 - protein, 16 aa, Staphylococcus
IPSNLKQGNSAQGEQI

SEQ ID NO: 1853871 - protein, 6 aa, Staphylococcus
IPSSQQ

SEQ ID NO: 1853872 - protein, 8 aa, Staphylococcus
IPSWDGRT

SEQ ID NO: 1853873 - protein, 4 aa, Staphylococcus
IPSY

SEQ ID NO: 1853874 - protein, 6 aa, Staphylococcus
IPTLDN

SEQ ID NO: 1853875 - protein, 9 aa, Staphylococcus
IPTPPNVKR

SEQ ID NO: 1853876 - protein, 10 aa, Staphylococcus
IPTPPNVQRS

SEQ ID NO: 1853877 - protein, 11 aa, Staphylococcus
IPTPPSAKRSY

SEQ ID NO: 1853878 - protein, 16 aa, Staphylococcus
IPTQANSTVDDKDSDV

SEQ ID NO: 1853879 - protein, 10 aa, Staphylococcus
IQAAKRVSEK

SEQ ID NO: 1853880 - protein, 9 aa, Staphylococcus
IQARKQHEE

SEQ ID NO: 1853881 - protein, 10 aa, Staphylococcus
IQARQTANDI

SEQ ID NO: 1853882 - protein, 8 aa, Staphylococcus
IQEDGRSG

SEQ ID NO: 1853883 - protein, 4 aa, Staphylococcus
IQEG

SEQ ID NO: 1853884 - protein, 17 aa, Staphylococcus
IQEGDGSLTYEDAAASA

SEQ ID NO: 1853885 - protein, 34 aa, Staphylococcus
IQETQSPNNELNTTIESKTPIDNNTTVNHVKPAS

SEQ ID NO: 1853886 - protein, 4 aa, Staphylococcus
IQGL

SEQ ID NO: 1853887 - protein, 7 aa, Staphylococcus
IQGPSPY

SEQ ID NO: 1853888 - protein, 12 aa, Staphylococcus
IQINGDGKKQAT

SEQ ID NO: 1853889 - protein, 7 aa, Staphylococcus
IQKASSI

SEQ ID NO: 1853890 - protein, 5 aa, Staphylococcus
IQKDK

SEQ ID NO: 1853891 - protein, 6 aa, Staphylococcus
IQKGNG

SEQ ID NO: 1853892 - protein, 12 aa, Staphylococcus
IQKGTQSLYGDE

SEQ ID NO: 1853893 - protein, 11 aa, Staphylococcus
IQKQQKAEQYR

SEQ ID NO: 1853894 - protein, 17 aa, Staphylococcus
IQKQTAQSTQISKQTQT

SEQ ID NO: 1853895 - protein, 10 aa, Staphylococcus
IQKQTDSSVL

SEQ ID NO: 1853896 - protein, 7 aa, Staphylococcus
IQKYGGK

SEQ ID NO: 1853897 - protein, 9 aa, Staphylococcus
IQNAYDNAV

SEQ ID NO: 1853898 - protein, 14 aa, Staphylococcus
IQNDQTSDQTVEIN

SEQ ID NO: 1853899 - protein, 4 aa, Staphylococcus
IQNN

SEQ ID NO: 1853900 - protein, 11 aa, Staphylococcus
IQNNSTKNQVK

SEQ ID NO: 1853901 - protein, 9 aa, Staphylococcus
IQNSDDLNE

SEQ ID NO: 1853902 - protein, 47 aa, Staphylococcus
IQNTRGTTTEEQNEAQQALQNAKTEADQAIDAAQSNADVENVKNEQI

SEQ ID NO: 1853903 - protein, 7 aa, Staphylococcus
IQPAQGV

SEQ ID NO: 1853904 - protein, 8 aa, Staphylococcus
IQPDGRSG

SEQ ID NO: 1853905 - protein, 10 aa, Staphylococcus
IQPDTTKKTV

SEQ ID NO: 1853906 - protein, 4 aa, Staphylococcus
IQPE

SEQ ID NO: 1853907 - protein, 74 aa, Staphylococcus
IQPEAIKKAESKQAIDDAATAKKAAIDQVSDATQEEKDAAKAKVDEEVTKAKSAIDKANTNNDVDQAKTNGTTI

SEQ ID NO: 1853908 - protein, 7 aa, Staphylococcus
IQPESIE

SEQ ID NO: 1853909 - protein, 11 aa, Staphylococcus
IQPESYEVTAP

SEQ ID NO: 1853910 - protein, 76 aa, Staphylococcus
IQPETIKKPEAKQAIDEVAKAKKDLIDQTPNATKEEKDAAKSKVDEEVTKEKKEIDQASTNSDVDQVKDKGTNGIN

SEQ ID NO: 1853911 - protein, 6 aa, Staphylococcus
IQPEVT

SEQ ID NO: 1853912 - protein, 8 aa, Staphylococcus
IQPKKRDM

SEQ ID NO: 1853913 - protein, 7 aa, Staphylococcus
IQPNGRS

SEQ ID NO: 1853914 - protein, 7 aa, Staphylococcus
IQPSDIQ

SEQ ID NO: 1853915 - protein, 6 aa, Staphylococcus
IQPVEG

SEQ ID NO: 1853916 - protein, 7 aa, Staphylococcus
IQQDGRS

SEQ ID NO: 1853917 - protein, 36 aa, Staphylococcus
IQQETSDNNLANMSPDAQEQREVTTSEDANQSDDSL

SEQ ID NO: 1853918 - protein, 8 aa, Staphylococcus
IQQGYSQE

SEQ ID NO: 1853919 - protein, 6 aa, Staphylococcus
IQQNKM

SEQ ID NO: 1853920 - protein, 18 aa, Staphylococcus
IQQTDKKANKTVSQTQLS

SEQ ID NO: 1853921 - protein, 6 aa, Staphylococcus
IQREGI

SEQ ID NO: 1853922 - protein, 6 aa, Staphylococcus
IQSAQT

SEQ ID NO: 1853923 - protein, 9 aa, Staphylococcus
IQSDKESAL

SEQ ID NO: 1853924 - protein, 78 aa, Staphylococcus
IQSNKQANDSSEETKSNNKQQNNLHGQTTEEQQNISTITETSVDNSKALNTADSSTSEQQDNDITTDATTKSIQSNEN

SEQ ID NO: 1853925 - protein, 7 aa, Staphylococcus
IQSPSQL

SEQ ID NO: 1853926 - protein, 4 aa, Staphylococcus
IQSQ

SEQ ID NO: 1853927 - protein, 12 aa, Staphylococcus
IQTKGKTDHQIA

SEQ ID NO: 1853928 - protein, 15 aa, Staphylococcus
IQTKPEKQAQGVINS

SEQ ID NO: 1853929 - protein, 22 aa, Staphylococcus
IQTPYSKDTKVDEIKEDMNDTK

SEQ ID NO: 1853930 - protein, 9 aa, Staphylococcus
IQTTPENNV

SEQ ID NO: 1853931 - protein, 99 aa, Staphylococcus
IQVDTTSNQQQTSKQSQKRDIRSQFGAGAQQHKKRPDQQQEASHDSDVKEQVGASSTTDEANTHSTESQEQFGAHSGDHASHVSKNDFGASSTDSVSTG

SEQ ID NO: 1853932 - protein, 12 aa, Staphylococcus
IQYRDPEKITKE

SEQ ID NO: 1853933 - protein, 11 aa, Staphylococcus
IRAKRDKFKEK

SEQ ID NO: 1853934 - protein, 10 aa, Staphylococcus
IRAVPGSVRE

SEQ ID NO: 1853935 - protein, 19 aa, Staphylococcus
IRAVPNSVREASYGLGGNK

SEQ ID NO: 1853936 - protein, 16 aa, Staphylococcus
IRDDRQVDEPFTQNSI

SEQ ID NO: 1853937 - protein, 4 aa, Staphylococcus
IRDK

SEQ ID NO: 1853938 - protein, 4 aa, Staphylococcus
IREE

SEQ ID NO: 1853939 - protein, 12 aa, Staphylococcus
IREQGSYDELSH

SEQ ID NO: 1853940 - protein, 4 aa, Staphylococcus
IRER

SEQ ID NO: 1853941 - protein, 7 aa, Staphylococcus
IRESKVG

SEQ ID NO: 1853942 - protein, 10 aa, Staphylococcus
IRGDKDVKSL

SEQ ID NO: 1853943 - protein, 10 aa, Staphylococcus
IRGDKDVQSL

SEQ ID NO: 1853944 - protein, 10 aa, Staphylococcus
IRGDKNVETL

SEQ ID NO: 1853945 - protein, 7 aa, Staphylococcus
IRGKSTI

SEQ ID NO: 1853946 - protein, 8 aa, Staphylococcus
IRHDAKNK

SEQ ID NO: 1853947 - protein, 4 aa, Staphylococcus
IRKK

SEQ ID NO: 1853948 - protein, 11 aa, Staphylococcus
IRKKRDKFKNK

SEQ ID NO: 1853949 - protein, 15 aa, Staphylococcus
IRKYEDDDETIRRLR

SEQ ID NO: 1853950 - protein, 11 aa, Staphylococcus
IRPDTNKETLA

SEQ ID NO: 1853951 - protein, 8 aa, Staphylococcus
IRPETNEE

SEQ ID NO: 1853952 - protein, 6 aa, Staphylococcus
IRPGEK

SEQ ID NO: 1853953 - protein, 12 aa, Staphylococcus
IRPGRETERYLN

SEQ ID NO: 1853954 - protein, 5 aa, Staphylococcus
IRPIP

SEQ ID NO: 1853955 - protein, 4 aa, Staphylococcus
IRQP

SEQ ID NO: 1853956 - protein, 6 aa, Staphylococcus
IRRPDD

SEQ ID NO: 1853957 - protein, 9 aa, Staphylococcus
IRSARQSMN

SEQ ID NO: 1853958 - protein, 17 aa, Staphylococcus
IRSGQLKEAESKEGIGC

SEQ ID NO: 1853959 - protein, 4 aa, Staphylococcus
IRSI

SEQ ID NO: 1853960 - protein, 6 aa, Staphylococcus
IRSKQH

SEQ ID NO: 1853961 - protein, 10 aa, Staphylococcus
IRSKRDKFKN

SEQ ID NO: 1853962 - protein, 5 aa, Staphylococcus
IRSSG

SEQ ID NO: 1853963 - protein, 12 aa, Staphylococcus
IRTEGKTPASIH

SEQ ID NO: 1853964 - protein, 23 aa, Staphylococcus
IRTGQLKEANSKEDIGCNNPNCP

SEQ ID NO: 1853965 - protein, 7 aa, Staphylococcus
IRTPDSL

SEQ ID NO: 1853966 - protein, 16 aa, Staphylococcus
IRTTINEQTTTKSTEM

SEQ ID NO: 1853967 - protein, 4 aa, Staphylococcus
ISAD

SEQ ID NO: 1853968 - protein, 6 aa, Staphylococcus
ISAETS

SEQ ID NO: 1853969 - protein, 15 aa, Staphylococcus
ISAKAEQKAEREGYI

SEQ ID NO: 1853970 - protein, 23 aa, Staphylococcus
ISAKDNSGQPVTTKVSGLPNGVT

SEQ ID NO: 1853971 - protein, 11 aa, Staphylococcus
ISAKPNTLQEY

SEQ ID NO: 1853972 - protein, 6 aa, Staphylococcus
ISANTG

SEQ ID NO: 1853973 - protein, 20 aa, Staphylococcus
ISATDNSGQPVTNTVRGLPE

SEQ ID NO: 1853974 - protein, 22 aa, Staphylococcus
ISATDNSGQPVTNTVSGLPEGV

SEQ ID NO: 1853975 - protein, 9 aa, Staphylococcus
ISDATGRKK

SEQ ID NO: 1853976 - protein, 4 aa, Staphylococcus
ISDE

SEQ ID NO: 1853977 - protein, 6 aa, Staphylococcus
ISDKNP

SEQ ID NO: 1853978 - protein, 7 aa, Staphylococcus
ISDRTGV

SEQ ID NO: 1853979 - protein, 9 aa, Staphylococcus
ISDSANGGV

SEQ ID NO: 1853980 - protein, 9 aa, Staphylococcus
ISEAGPGGA

SEQ ID NO: 1853981 - protein, 8 aa, Staphylococcus
ISEAKNGK

SEQ ID NO: 1853982 - protein, 6 aa, Staphylococcus
ISEDTY

SEQ ID NO: 1853983 - protein, 12 aa, Staphylococcus
ISEFSRKTTEVQ

SEQ ID NO: 1853984 - protein, 8 aa, Staphylococcus
ISENHNKA

SEQ ID NO: 1853985 - protein, 8 aa, Staphylococcus
ISEQATGN

SEQ ID NO: 1853986 - protein, 9 aa, Staphylococcus
ISEQATGNV

SEQ ID NO: 1853987 - protein, 12 aa, Staphylococcus
ISEQSVEANSEV

SEQ ID NO: 1853988 - protein, 5 aa, Staphylococcus
ISERE

SEQ ID NO: 1853989 - protein, 4 aa, Staphylococcus
ISES

SEQ ID NO: 1853990 - protein, 18 aa, Staphylococcus
ISESQKQGNSVSTSELNQ

SEQ ID NO: 1853991 - protein, 5 aa, Staphylococcus
ISEST

SEQ ID NO: 1853992 - protein, 4 aa, Staphylococcus
ISET

SEQ ID NO: 1853993 - protein, 9 aa, Staphylococcus
ISETSLTQT

SEQ ID NO: 1853994 - protein, 11 aa, Staphylococcus
ISEYNRNKAYK

SEQ ID NO: 1853995 - protein, 32 aa, Staphylococcus
ISFDTDKAKDIGELSSKELDKLDKEISKNGEK

SEQ ID NO: 1853996 - protein, 4 aa, Staphylococcus
ISGA

SEQ ID NO: 1853997 - protein, 14 aa, Staphylococcus
ISGAPLTGKKEFDE

SEQ ID NO: 1853998 - protein, 5 aa, Staphylococcus
ISGDD

SEQ ID NO: 1853999 - protein, 11 aa, Staphylococcus
ISGDGDSTENV

SEQ ID NO: 1854000 - protein, 4 aa, Staphylococcus
ISGF

SEQ ID NO: 1854001 - protein, 12 aa, Staphylococcus
ISGKKKRGLRAT

SEQ ID NO: 1854002 - protein, 10 aa, Staphylococcus
ISGKKRRGFR

SEQ ID NO: 1854003 - protein, 6 aa, Staphylococcus
ISGKQF

SEQ ID NO: 1854004 - protein, 14 aa, Staphylococcus
ISGNNNVSNSQVEK

SEQ ID NO: 1854005 - protein, 11 aa, Staphylococcus
ISGNQQVTDGL

SEQ ID NO: 1854006 - protein, 28 aa, Staphylococcus
ISGRDSENLKNDAERVNESYQAHQDNAI

SEQ ID NO: 1854007 - protein, 5 aa, Staphylococcus
ISKDG

SEQ ID NO: 1854008 - protein, 6 aa, Staphylococcus
ISKDGK

SEQ ID NO: 1854009 - protein, 7 aa, Staphylococcus
ISKEEQK

SEQ ID NO: 1854010 - protein, 8 aa, Staphylococcus
ISKESLNK

SEQ ID NO: 1854011 - protein, 8 aa, Staphylococcus
ISKKEYKE

SEQ ID NO: 1854012 - protein, 11 aa, Staphylococcus
ISKKQSVSIES

SEQ ID NO: 1854013 - protein, 10 aa, Staphylococcus
ISKKTQSEIA

SEQ ID NO: 1854014 - protein, 6 aa, Staphylococcus
ISKNGT

SEQ ID NO: 1854015 - protein, 8 aa, Staphylococcus
ISKQQSEL

SEQ ID NO: 1854016 - protein, 4 aa, Staphylococcus
ISKR

SEQ ID NO: 1854017 - protein, 8 aa, Staphylococcus
ISKRERAS

SEQ ID NO: 1854018 - protein, 7 aa, Staphylococcus
ISKSDGF

SEQ ID NO: 1854019 - protein, 5 aa, Staphylococcus
ISKSK

SEQ ID NO: 1854020 - protein, 5 aa, Staphylococcus
ISKTI

SEQ ID NO: 1854021 - protein, 6 aa, Staphylococcus
ISKTTQ

SEQ ID NO: 1854022 - protein, 7 aa, Staphylococcus
ISNKEGS

SEQ ID NO: 1854023 - protein, 16 aa, Staphylococcus
ISNKKEEDEKLATPRA

SEQ ID NO: 1854024 - protein, 5 aa, Staphylococcus
ISNKP

SEQ ID NO: 1854025 - protein, 5 aa, Staphylococcus
ISNKS

SEQ ID NO: 1854026 - protein, 8 aa, Staphylococcus
ISNNGNSH

SEQ ID NO: 1854027 - protein, 6 aa, Staphylococcus
ISNNKR

SEQ ID NO: 1854028 - protein, 11 aa, Staphylococcus
ISNNTKGADMA

SEQ ID NO: 1854029 - protein, 47 aa, Staphylococcus
ISNNVDNYQPNNGVNEDHPNKDAIHKEDTQNTEAKDNDTKAQANDTT

SEQ ID NO: 1854030 - protein, 5 aa, Staphylococcus
ISNRS

SEQ ID NO: 1854031 - protein, 14 aa, Staphylococcus
ISNSGSPVAEGTVK

SEQ ID NO: 1854032 - protein, 5 aa, Staphylococcus
ISNSI

SEQ ID NO: 1854033 - protein, 11 aa, Staphylococcus
ISNSPEDKVGV

SEQ ID NO: 1854034 - protein, 13 aa, Staphylococcus
ISNTLRHSNGTKV

SEQ ID NO: 1854035 - protein, 12 aa, Staphylococcus
ISNWENDKSYPD

SEQ ID NO: 1854036 - protein, 12 aa, Staphylococcus
ISNWENEKSYPD

SEQ ID NO: 1854037 - protein, 12 aa, Staphylococcus
ISNWENNKSLPD

SEQ ID NO: 1854038 - protein, 11 aa, Staphylococcus
ISNYNDPKDIT

SEQ ID NO: 1854039 - protein, 11 aa, Staphylococcus
ISPAKDKAKNF

SEQ ID NO: 1854040 - protein, 7 aa, Staphylococcus
ISPAPVN

SEQ ID NO: 1854041 - protein, 14 aa, Staphylococcus
ISPDKKRNSLGSGL

SEQ ID NO: 1854042 - protein, 8 aa, Staphylococcus
ISPGSQQR

SEQ ID NO: 1854043 - protein, 4 aa, Staphylococcus
ISPH

SEQ ID NO: 1854044 - protein, 12 aa, Staphylococcus
ISPIPKAYHTKN

SEQ ID NO: 1854045 - protein, 4 aa, Staphylococcus
ISPL

SEQ ID NO: 1854046 - protein, 12 aa, Staphylococcus
ISPLSDTTNLAA

SEQ ID NO: 1854047 - protein, 78 aa, Staphylococcus
ISPRDGSDFSKPDSVSGSNKESLSVANHPDNNTTGRKVYGSSGSSDSTSSSNRSSNSNTSSGARNNSSSTGGLSSVFG

SEQ ID NO: 1854048 - protein, 4 aa, Staphylococcus
ISPS

SEQ ID NO: 1854049 - protein, 5 aa, Staphylococcus
ISPSI

SEQ ID NO: 1854050 - protein, 11 aa, Staphylococcus
ISPSKDKARNF

SEQ ID NO: 1854051 - protein, 11 aa, Staphylococcus
ISPSQDKAKNF

SEQ ID NO: 1854052 - protein, 5 aa, Staphylococcus
ISPST

SEQ ID NO: 1854053 - protein, 5 aa, Staphylococcus
ISQGP

SEQ ID NO: 1854054 - protein, 9 aa, Staphylococcus
ISQKAEIEH

SEQ ID NO: 1854055 - protein, 8 aa, Staphylococcus
ISQKGWND

SEQ ID NO: 1854056 - protein, 8 aa, Staphylococcus
ISQNEDKI

SEQ ID NO: 1854057 - protein, 6 aa, Staphylococcus
ISQPKH

SEQ ID NO: 1854058 - protein, 15 aa, Staphylococcus
ISQSPTSKSVDENST

SEQ ID NO: 1854059 - protein, 4 aa, Staphylococcus
ISQY

SEQ ID NO: 1854060 - protein, 5 aa, Staphylococcus
ISRAS

SEQ ID NO: 1854061 - protein, 13 aa, Staphylococcus
ISRDYSNKYPENQ

SEQ ID NO: 1854062 - protein, 5 aa, Staphylococcus
ISRSD

SEQ ID NO: 1854063 - protein, 13 aa, Staphylococcus
ISRSYSDKYAENQ

SEQ ID NO: 1854064 - protein, 7 aa, Staphylococcus
ISSDQVE

SEQ ID NO: 1854065 - protein, 4 aa, Staphylococcus
ISSE

SEQ ID NO: 1854066 - protein, 73 aa, Staphylococcus
ISSKDGEDFKKPNDVNGSDAENLSVKGHPDNDTTNRSVHGDSDSSSGNSSSSNSGNSSSNNSSSSQSSSGNAL

SEQ ID NO: 1854067 - protein, 7 aa, Staphylococcus
ISSKPDR

SEQ ID NO: 1854068 - protein, 91 aa, Staphylococcus
ISSPQTNSTSSTTVTSQTSSEVPTQEKASQTTQTSSAQLQTSKENITAPKAVSQKTSSTSSVQTSRPSTNVSTQKATLTQTSKSQDTTTLN

SEQ ID NO: 1854069 - protein, 81 aa, Staphylococcus
ISSRDGKDFEKPSSVEGSDPDSLSVSGHPDNDTTNKSTHGDGDSSSSNSSNTNGSNGSSNSSNGSSQQQGTSSQQQSGNAL

SEQ ID NO: 1854070 - protein, 7 aa, Staphylococcus
ISTANNT

SEQ ID NO: 1854071 - protein, 4 aa, Staphylococcus
ISTD

SEQ ID NO: 1854072 - protein, 6 aa, Staphylococcus
ISTDKQ

SEQ ID NO: 1854073 - protein, 11 aa, Staphylococcus
ISTGDIDEQSK

SEQ ID NO: 1854074 - protein, 7 aa, Staphylococcus
ISTGEDK

SEQ ID NO: 1854075 - protein, 10 aa, Staphylococcus
ISTGEINEQS

SEQ ID NO: 1854076 - protein, 9 aa, Staphylococcus
ISTGEIYEQ

SEQ ID NO: 1854077 - protein, 6 aa, Staphylococcus
ISTGID

SEQ ID NO: 1854078 - protein, 9 aa, Staphylococcus
ISTNTQSEI

SEQ ID NO: 1854079 - protein, 4 aa, Staphylococcus
ISTQ

SEQ ID NO: 1854080 - protein, 4 aa, Staphylococcus
ISTR

SEQ ID NO: 1854081 - protein, 16 aa, Staphylococcus
ISTSESNRQRKAELNK

SEQ ID NO: 1854082 - protein, 9 aa, Staphylococcus
ISTSTQTEI

SEQ ID NO: 1854083 - protein, 19 aa, Staphylococcus
ISVGDERTSISKTNGKDAV

SEQ ID NO: 1854084 - protein, 8 aa, Staphylococcus
ISVQSNDA

SEQ ID NO: 1854085 - protein, 33 aa, Staphylococcus
ISYSDNQSYQSQAKALAKENKKHYQKSRKQSKW

SEQ ID NO: 1854086 - protein, 5 aa, Staphylococcus
ITAAY

SEQ ID NO: 1854087 - protein, 10 aa, Staphylococcus
ITADGDKDHV

SEQ ID NO: 1854088 - protein, 56 aa, Staphylococcus
ITADTGIKTDLQNQANDKKQQIANNNGSTEEEKQAANTKVDDALQQGLTDVTNAQS

SEQ ID NO: 1854089 - protein, 5 aa, Staphylococcus
ITAGA

SEQ ID NO: 1854090 - protein, 10 aa, Staphylococcus
ITDDYDETSV

SEQ ID NO: 1854091 - protein, 4 aa, Staphylococcus
ITDE

SEQ ID NO: 1854092 - protein, 11 aa, Staphylococcus
ITDMETDKTLA

SEQ ID NO: 1854093 - protein, 45 aa, Staphylococcus
ITDNANVTTQSNYINAEPDKQQAYTDAINTAKGIIDEKQATLDPN

SEQ ID NO: 1854094 - protein, 18 aa, Staphylococcus
ITDNNGQNWYTPASNANL

SEQ ID NO: 1854095 - protein, 5 aa, Staphylococcus
ITDRE

SEQ ID NO: 1854096 - protein, 10 aa, Staphylococcus
ITDSTDDSAN

SEQ ID NO: 1854097 - protein, 7 aa, Staphylococcus
ITDYTDR

SEQ ID NO: 1854098 - protein, 4 aa, Staphylococcus
ITED

SEQ ID NO: 1854099 - protein, 5 aa, Staphylococcus
ITEDD

SEQ ID NO: 1854100 - protein, 9 aa, Staphylococcus
ITEDGDKDH

SEQ ID NO: 1854101 - protein, 13 aa, Staphylococcus
ITEKEERAAERRK

SEQ ID NO: 1854102 - protein, 5 aa, Staphylococcus
ITENN

SEQ ID NO: 1854103 - protein, 6 aa, Staphylococcus
ITENNR

SEQ ID NO: 1854104 - protein, 4 aa, Staphylococcus
ITGD

SEQ ID NO: 1854105 - protein, 10 aa, Staphylococcus
ITGDPVASRI

SEQ ID NO: 1854106 - protein, 5 aa, Staphylococcus
ITGDS

SEQ ID NO: 1854107 - protein, 7 aa, Staphylococcus
ITGEEKK

SEQ ID NO: 1854108 - protein, 19 aa, Staphylococcus
ITGETSSVEGTNNGITNDS

SEQ ID NO: 1854109 - protein, 7 aa, Staphylococcus
ITGGGAA

SEQ ID NO: 1854110 - protein, 21 aa, Staphylococcus
ITGKEASTTADVKDKSARNMN

SEQ ID NO: 1854111 - protein, 22 aa, Staphylococcus
ITGKEASTTSDVKDKSTKNMNP

SEQ ID NO: 1854112 - protein, 22 aa, Staphylococcus
ITGKEASTTSEVKEKSAKNLNP

SEQ ID NO: 1854113 - protein, 10 aa, Staphylococcus
ITGKENNEIL

SEQ ID NO: 1854114 - protein, 11 aa, Staphylococcus
ITGKNNDFYTG

SEQ ID NO: 1854115 - protein, 18 aa, Staphylococcus
ITGKQLERKDFRKGYTAE

SEQ ID NO: 1854116 - protein, 6 aa, Staphylococcus
ITGNDQ

SEQ ID NO: 1854117 - protein, 19 aa, Staphylococcus
ITGNTQEANGDRKLTFSDN

SEQ ID NO: 1854118 - protein, 18 aa, Staphylococcus
ITGRKLERKDFRKGYTAE

SEQ ID NO: 1854119 - protein, 26 aa, Staphylococcus
ITGRSKDFKDYAKSKSDVKSEDDGNL

SEQ ID NO: 1854120 - protein, 18 aa, Staphylococcus
ITGRTLERKDYRKGYTAE

SEQ ID NO: 1854121 - protein, 4 aa, Staphylococcus
ITGT

SEQ ID NO: 1854122 - protein, 5 aa, Staphylococcus
ITGTQ

SEQ ID NO: 1854123 - protein, 6 aa, Staphylococcus
ITGTQN

SEQ ID NO: 1854124 - protein, 7 aa, Staphylococcus
ITGTRAA

SEQ ID NO: 1854125 - protein, 5 aa, Staphylococcus
ITGVP

SEQ ID NO: 1854126 - protein, 4 aa, Staphylococcus
ITIP

SEQ ID NO: 1854127 - protein, 12 aa, Staphylococcus
ITIPGGQNGHSV

SEQ ID NO: 1854128 - protein, 21 aa, Staphylococcus
ITIPKGDKGDRGEKGQDGQSI

SEQ ID NO: 1854129 - protein, 31 aa, Staphylococcus
ITIPKGEKGDKGQDGTSVTVTNTTTDGAGNT

SEQ ID NO: 1854130 - protein, 10 aa, Staphylococcus
ITKDAQGGTI

SEQ ID NO: 1854131 - protein, 15 aa, Staphylococcus
ITKDLDGNVQTRSEV

SEQ ID NO: 1854132 - protein, 7 aa, Staphylococcus
ITKNGTF

SEQ ID NO: 1854133 - protein, 16 aa, Staphylococcus
ITKPQETTVTEEESEE

SEQ ID NO: 1854134 - protein, 8 aa, Staphylococcus
ITKQDKKI

SEQ ID NO: 1854135 - protein, 4 aa, Staphylococcus
ITKS

SEQ ID NO: 1854136 - protein, 5 aa, Staphylococcus
ITKTG

SEQ ID NO: 1854137 - protein, 21 aa, Staphylococcus
ITNAQQALDHPTGSNLTTDQI

SEQ ID NO: 1854138 - protein, 7 aa, Staphylococcus
ITNGGYG

SEQ ID NO: 1854139 - protein, 7 aa, Staphylococcus
ITNKSKR

SEQ ID NO: 1854140 - protein, 12 aa, Staphylococcus
ITNPNGIAKETF

SEQ ID NO: 1854141 - protein, 5 aa, Staphylococcus
ITNQD

SEQ ID NO: 1854142 - protein, 85 aa, Staphylococcus
ITNQPKDLEGEDKTAKTAKENDDNVQQEQSSINETTDKKEVSTKDSDYENNNQIETSNDITDKRKNNDERHLDSEQNKEKPYSSI

SEQ ID NO: 1854143 - protein, 7 aa, Staphylococcus
ITNRKDI

SEQ ID NO: 1854144 - protein, 5 aa, Staphylococcus
ITNSY

SEQ ID NO: 1854145 - protein, 19 aa, Staphylococcus
ITNTPNATQEEKQDAITEV

SEQ ID NO: 1854146 - protein, 4 aa, Staphylococcus
ITPE

SEQ ID NO: 1854147 - protein, 14 aa, Staphylococcus
ITPETKKGEGISFL

SEQ ID NO: 1854148 - protein, 8 aa, Staphylococcus
ITPNQDGD

SEQ ID NO: 1854149 - protein, 8 aa, Staphylococcus
ITPNSNKD

SEQ ID NO: 1854150 - protein, 11 aa, Staphylococcus
ITPPERKSEGI

SEQ ID NO: 1854151 - protein, 78 aa, Staphylococcus
ITPPTDSDGLNGDTYIDTNTGDTYKKENGKWVPSGNIKGPKGDKGENGQNGRDGKDVLNGKVDPQSSQGKDGDKYINT

SEQ ID NO: 1854152 - protein, 7 aa, Staphylococcus
ITPQANG

SEQ ID NO: 1854153 - protein, 9 aa, Staphylococcus
ITPQANGDK

SEQ ID NO: 1854154 - protein, 9 aa, Staphylococcus
ITPQTNGDT

SEQ ID NO: 1854155 - protein, 12 aa, Staphylococcus
ITPSKDYKNNAI

SEQ ID NO: 1854156 - protein, 6 aa, Staphylococcus
ITPTQK

SEQ ID NO: 1854157 - protein, 5 aa, Staphylococcus
ITQAG

SEQ ID NO: 1854158 - protein, 14 aa, Staphylococcus
ITQANSQCSSCTKE

SEQ ID NO: 1854159 - protein, 14 aa, Staphylococcus
ITQDKALHSEKVTN

SEQ ID NO: 1854160 - protein, 11 aa, Staphylococcus
ITQEETSPKNM

SEQ ID NO: 1854161 - protein, 16 aa, Staphylococcus
ITQELSKGQNTLSDVQ

SEQ ID NO: 1854162 - protein, 17 aa, Staphylococcus
ITQEPNANLKSLAKKSN

SEQ ID NO: 1854163 - protein, 4 aa, Staphylococcus
ITQN

SEQ ID NO: 1854164 - protein, 4 aa, Staphylococcus
ITRE

SEQ ID NO: 1854165 - protein, 7 aa, Staphylococcus
ITRGKGE

SEQ ID NO: 1854166 - protein, 10 aa, Staphylococcus
ITRKQPIPNH

SEQ ID NO: 1854167 - protein, 11 aa, Staphylococcus
ITRLSKEGKPF

SEQ ID NO: 1854168 - protein, 11 aa, Staphylococcus
ITRTETDAAGN

SEQ ID NO: 1854169 - protein, 12 aa, Staphylococcus
ITRTETDGNGNT

SEQ ID NO: 1854170 - protein, 12 aa, Staphylococcus
ITRTETDQAGNT

SEQ ID NO: 1854171 - protein, 6 aa, Staphylococcus
ITSAVD

SEQ ID NO: 1854172 - protein, 4 aa, Staphylococcus
ITSE

SEQ ID NO: 1854173 - protein, 15 aa, Staphylococcus
ITSLPNAGLKDGSLE

SEQ ID NO: 1854174 - protein, 9 aa, Staphylococcus
ITSNSSGSL

SEQ ID NO: 1854175 - protein, 12 aa, Staphylococcus
ITSNTEEPNGDR

SEQ ID NO: 1854176 - protein, 18 aa, Staphylococcus
ITSPAETTVTEDGDVETA

SEQ ID NO: 1854177 - protein, 5 aa, Staphylococcus
ITSPI

SEQ ID NO: 1854178 - protein, 8 aa, Staphylococcus
ITSQKDKV

SEQ ID NO: 1854179 - protein, 5 aa, Staphylococcus
ITSRY

SEQ ID NO: 1854180 - protein, 7 aa, Staphylococcus
ITSSYSS

SEQ ID NO: 1854181 - protein, 15 aa, Staphylococcus
ITSTPNASSQELNQS

SEQ ID NO: 1854182 - protein, 12 aa, Staphylococcus
ITSTTVDADGNT

SEQ ID NO: 1854183 - protein, 5 aa, Staphylococcus
ITTAT

SEQ ID NO: 1854184 - protein, 9 aa, Staphylococcus
ITTATNGDT

SEQ ID NO: 1854185 - protein, 26 aa, Staphylococcus
ITTESKDFSSYAKERSSLSASESGKL

SEQ ID NO: 1854186 - protein, 4 aa, Staphylococcus
ITTG

SEQ ID NO: 1854187 - protein, 11 aa, Staphylococcus
ITTGEVENQSK

SEQ ID NO: 1854188 - protein, 10 aa, Staphylococcus
ITTKEKVARE

SEQ ID NO: 1854189 - protein, 5 aa, Staphylococcus
ITTNM

SEQ ID NO: 1854190 - protein, 15 aa, Staphylococcus
ITTPKLTVQTKQEPV

SEQ ID NO: 1854191 - protein, 7 aa, Staphylococcus
ITTPSAN

SEQ ID NO: 1854192 - protein, 7 aa, Staphylococcus
ITTRNHN

SEQ ID NO: 1854193 - protein, 4 aa, Staphylococcus
ITTS

SEQ ID NO: 1854194 - protein, 10 aa, Staphylococcus
ITTSSTGDKV

SEQ ID NO: 1854195 - protein, 10 aa, Staphylococcus
ITTSTKQLAR

SEQ ID NO: 1854196 - protein, 4 aa, Staphylococcus
ITVG

SEQ ID NO: 1854197 - protein, 4 aa, Staphylococcus
ITVP

SEQ ID NO: 1854198 - protein, 25 aa, Staphylococcus
ITVPRGQDGHSVTVKESHKDQSGNT

SEQ ID NO: 1854199 - protein, 14 aa, Staphylococcus
ITVTSDASNPVNVT

SEQ ID NO: 1854200 - protein, 11 aa, Staphylococcus
ITVTSNATFSY

SEQ ID NO: 1854201 - protein, 14 aa, Staphylococcus
ITYDNTNEIGDEYD

SEQ ID NO: 1854202 - protein, 14 aa, Staphylococcus
ITYDNTNEISNHYG

SEQ ID NO: 1854203 - protein, 19 aa, Staphylococcus
ITYGENNSIKGDVVGKDKW

SEQ ID NO: 1854204 - protein, 4 aa, Staphylococcus
ITYK

SEQ ID NO: 1854205 - protein, 9 aa, Staphylococcus
ITYTDRQNK

SEQ ID NO: 1854206 - protein, 11 aa, Staphylococcus
IVADQNAKHTY

SEQ ID NO: 1854207 - protein, 19 aa, Staphylococcus
IVDQQDNPNMSPENINEVT

SEQ ID NO: 1854208 - protein, 6 aa, Staphylococcus
IVERGT

SEQ ID NO: 1854209 - protein, 9 aa, Staphylococcus
IVERGTHEE

SEQ ID NO: 1854210 - protein, 7 aa, Staphylococcus
IVETGTH

SEQ ID NO: 1854211 - protein, 17 aa, Staphylococcus
IVNQTRDEDKGKNIKET

SEQ ID NO: 1854212 - protein, 23 aa, Staphylococcus
IYEPINPDSQEGRVNERIKDQTQ

SEQ ID NO: 1854213 - protein, 13 aa, Staphylococcus
IYEPPRKKSSKKK

SEQ ID NO: 1854214 - protein, 24 aa, Staphylococcus
IYGPSESQESKQTTTNKRKKRRFG

SEQ ID NO: 1854215 - protein, 18 aa, Staphylococcus
IYGPYPQNKDISVSATGM

SEQ ID NO: 1854216 - protein, 5 aa, Staphylococcus
IYKNG

SEQ ID NO: 1854217 - protein, 17 aa, Staphylococcus
IYNKNSKKVEVGSDVGN

SEQ ID NO: 1854218 - protein, 28 aa, Staphylococcus
IYSNKDNKLLEKKPKDFDKNKQQVEKDL

SEQ ID NO: 1854219 - protein, 9 aa, Staphylococcus
IYTDGKEKF

SEQ ID NO: 1854220 - protein, 48 aa, Staphylococcus
KAAAKQIDNYTSQQVSNKNNNAWRDASASEIKAAMDSSKFIDDDKQRY

SEQ ID NO: 1854221 - protein, 68 aa, Staphylococcus
KAAARKAIDDAATAKKQEIDQHPTATQEEKDAAKAKVDAEVQKAKDAITQANSNNDVDQVQNSETATI

SEQ ID NO: 1854222 - protein, 15 aa, Staphylococcus
KAAATQQLKNEAYQE

SEQ ID NO: 1854223 - protein, 37 aa, Staphylococcus
KAADKQIDNYTSQQVSNKNNTAWRDASDNEIKAAMDS

SEQ ID NO: 1854224 - protein, 6 aa, Staphylococcus
KAAEHP

SEQ ID NO: 1854225 - protein, 34 aa, Staphylococcus
KAAKDAVKGFDNTHADAELDADISDVREKVAQAK

SEQ ID NO: 1854226 - protein, 19 aa, Staphylococcus
KAAKKQIDNYTSQQVSDKN

SEQ ID NO: 1854227 - protein, 13 aa, Staphylococcus
KAALEKAKTYSKD

SEQ ID NO: 1854228 - protein, 20 aa, Staphylococcus
KAANGLTSNNISNGQHLVIP

SEQ ID NO: 1854229 - protein, 8 aa, Staphylococcus
KAATETAT

SEQ ID NO: 1854230 - protein, 9 aa, Staphylococcus
KAATTRTEV

SEQ ID NO: 1854231 - protein, 6 aa, Staphylococcus
KAAVGK

SEQ ID NO: 1854232 - protein, 8 aa, Staphylococcus
KAAYDKDN

SEQ ID NO: 1854233 - protein, 6 aa, Staphylococcus
KADADV

SEQ ID NO: 1854234 - protein, 6 aa, Staphylococcus
KADDQW

SEQ ID NO: 1854235 - protein, 15 aa, Staphylococcus
KADFNNKYKDIKNGV

SEQ ID NO: 1854236 - protein, 6 aa, Staphylococcus
KADGTV

SEQ ID NO: 1854237 - protein, 6 aa, Staphylococcus
KADKQL

SEQ ID NO: 1854238 - protein, 29 aa, Staphylococcus
KADLNIETHSNSENTLEKRIQEGKEKIDK

SEQ ID NO: 1854239 - protein, 8 aa, Staphylococcus
KADNKSLA

SEQ ID NO: 1854240 - protein, 6 aa, Staphylococcus
KADNPL

SEQ ID NO: 1854241 - protein, 8 aa, Staphylococcus
KADNSELV

SEQ ID NO: 1854242 - protein, 12 aa, Staphylococcus
KADNSNNVKKGD

SEQ ID NO: 1854243 - protein, 4 aa, Staphylococcus
KADQ

SEQ ID NO: 1854244 - protein, 6 aa, Staphylococcus
KADQNG

SEQ ID NO: 1854245 - protein, 15 aa, Staphylococcus
KADSEQESKPLIAVL

SEQ ID NO: 1854246 - protein, 23 aa, Staphylococcus
KADSIEQNNTTINQKVSDSTSHQ

SEQ ID NO: 1854247 - protein, 9 aa, Staphylococcus
KADTDQALD

SEQ ID NO: 1854248 - protein, 9 aa, Staphylococcus
KADTDQALT

SEQ ID NO: 1854249 - protein, 8 aa, Staphylococcus
KADTDQSL

SEQ ID NO: 1854250 - protein, 9 aa, Staphylococcus
KADTNHIST

SEQ ID NO: 1854251 - protein, 24 aa, Staphylococcus
KADYKNNALEKAKDYANTQNMSND

SEQ ID NO: 1854252 - protein, 74 aa, Staphylococcus
KAEAKQAIDDAVTAKKAEIDQNQEATKEEKDAAKAKVDEEATKAKNNIDQSTTNNDVDQAKTDGASAITKIQPD

SEQ ID NO: 1854253 - protein, 6 aa, Staphylococcus
KAEAQR

SEQ ID NO: 1854254 - protein, 6 aa, Staphylococcus
KAEEGL

SEQ ID NO: 1854255 - protein, 19 aa, Staphylococcus
KAEEKIDGAKTKEKELRNR

SEQ ID NO: 1854256 - protein, 7 aa, Staphylococcus
KAEGNYV

SEQ ID NO: 1854257 - protein, 52 aa, Staphylococcus
KAEIDQNQEATKEEKDAAKAKVDEEATKAKQSIDNATTNEAVDQAKTQGVTT

SEQ ID NO: 1854258 - protein, 26 aa, Staphylococcus
KAELGEEMEYSRTDKNGAMSQTKEQF

SEQ ID NO: 1854259 - protein, 8 aa, Staphylococcus
KAENFSGY

SEQ ID NO: 1854260 - protein, 10 aa, Staphylococcus
KAEPGSHTEY

SEQ ID NO: 1854261 - protein, 6 aa, Staphylococcus
KAEPPK

SEQ ID NO: 1854262 - protein, 10 aa, Staphylococcus
KAEQDNIPYS

SEQ ID NO: 1854263 - protein, 5 aa, Staphylococcus
KAESF

SEQ ID NO: 1854264 - protein, 8 aa, Staphylococcus
KAESKGPI

SEQ ID NO: 1854265 - protein, 4 aa, Staphylococcus
KAFN

SEQ ID NO: 1854266 - protein, 11 aa, Staphylococcus
KAFREKGGHAE

SEQ ID NO: 1854267 - protein, 7 aa, Staphylococcus
KAGAFKD

SEQ ID NO: 1854268 - protein, 7 aa, Staphylococcus
KAGESIE

SEQ ID NO: 1854269 - protein, 9 aa, Staphylococcus
KAGESIPTD

SEQ ID NO: 1854270 - protein, 4 aa, Staphylococcus
KAGH

SEQ ID NO: 1854271 - protein, 6 aa, Staphylococcus
KAGIQD

SEQ ID NO: 1854272 - protein, 9 aa, Staphylococcus
KAGIQPRRP

SEQ ID NO: 1854273 - protein, 6 aa, Staphylococcus
KAGITD

SEQ ID NO: 1854274 - protein, 10 aa, Staphylococcus
KAGKLSDVPS

SEQ ID NO: 1854275 - protein, 9 aa, Staphylococcus
KAGLGDATS

SEQ ID NO: 1854276 - protein, 5 aa, Staphylococcus
KAGPI

SEQ ID NO: 1854277 - protein, 13 aa, Staphylococcus
KAGSQTTIEQTKA

SEQ ID NO: 1854278 - protein, 9 aa, Staphylococcus
KAGTPEHVK

SEQ ID NO: 1854279 - protein, 9 aa, Staphylococcus
KAGTQTAIN

SEQ ID NO: 1854280 - protein, 65 aa, Staphylococcus
KAGVTAKADTNKTPEELKQAAKAINDAKDALKAKAEQDTKDAAEKVNQENKVDKTELSKSIAKAE

SEQ ID NO: 1854281 - protein, 5 aa, Staphylococcus
KAHFG

SEQ ID NO: 1854282 - protein, 7 aa, Staphylococcus
KAHGPHG

SEQ ID NO: 1854283 - protein, 5 aa, Staphylococcus
KAHID

SEQ ID NO: 1854284 - protein, 28 aa, Staphylococcus
KAHNDKADKSNSNELPDTGNNNQNNGTL

SEQ ID NO: 1854285 - protein, 6 aa, Staphylococcus
KAHYSP

SEQ ID NO: 1854286 - protein, 8 aa, Staphylococcus
KAHYTPKD

SEQ ID NO: 1854287 - protein, 5 aa, Staphylococcus
KAIAK

SEQ ID NO: 1854288 - protein, 7 aa, Staphylococcus
KAIDNSA

SEQ ID NO: 1854289 - protein, 5 aa, Staphylococcus
KAIGG

SEQ ID NO: 1854290 - protein, 6 aa, Staphylococcus
KAIGRA

SEQ ID NO: 1854291 - protein, 8 aa, Staphylococcus
KAIKDNQS

SEQ ID NO: 1854292 - protein, 6 aa, Staphylococcus
KAINNL

SEQ ID NO: 1854293 - protein, 7 aa, Staphylococcus
KAISEKQ

SEQ ID NO: 1854294 - protein, 14 aa, Staphylococcus
KAKAEISNAQTNAV

SEQ ID NO: 1854295 - protein, 9 aa, Staphylococcus
KAKAQEKLK

SEQ ID NO: 1854296 - protein, 12 aa, Staphylococcus
KAKAQGMSLKND

SEQ ID NO: 1854297 - protein, 12 aa, Staphylococcus
KAKAQGMSLNND

SEQ ID NO: 1854298 - protein, 9 aa, Staphylococcus
KAKDDKELQ

SEQ ID NO: 1854299 - protein, 9 aa, Staphylococcus
KAKDGVDGH

SEQ ID NO: 1854300 - protein, 70 aa, Staphylococcus
KAKDGVNGQDGQSITVQGTETTPEGNTKVTFSDGTSITIAKGEKGDKGEAGKDAAPLTVTGTSQDPDGNT

SEQ ID NO: 1854301 - protein, 7 aa, Staphylococcus
KAKDQPA

SEQ ID NO: 1854302 - protein, 12 aa, Staphylococcus
KAKDSAGQPVIP

SEQ ID NO: 1854303 - protein, 9 aa, Staphylococcus
KAKDSRGEY

SEQ ID NO: 1854304 - protein, 6 aa, Staphylococcus
KAKDVA

SEQ ID NO: 1854305 - protein, 8 aa, Staphylococcus
KAKEAISH

SEQ ID NO: 1854306 - protein, 19 aa, Staphylococcus
KAKEANKAEVNKLTQEGVQ

SEQ ID NO: 1854307 - protein, 6 aa, Staphylococcus
KAKELG

SEQ ID NO: 1854308 - protein, 7 aa, Staphylococcus
KAKELGM

SEQ ID NO: 1854309 - protein, 7 aa, Staphylococcus
KAKFDNQ

SEQ ID NO: 1854310 - protein, 29 aa, Staphylococcus
KAKFDVDKAAKARENVINSNTEATTEEKQ

SEQ ID NO: 1854311 - protein, 9 aa, Staphylococcus
KAKGHASDA

SEQ ID NO: 1854312 - protein, 8 aa, Staphylococcus
KAKGTNEL

SEQ ID NO: 1854313 - protein, 7 aa, Staphylococcus
KAKGTNT

SEQ ID NO: 1854314 - protein, 9 aa, Staphylococcus
KAKIQPKRP

SEQ ID NO: 1854315 - protein, 10 aa, Staphylococcus
KAKKDKDIKA

SEQ ID NO: 1854316 - protein, 13 aa, Staphylococcus
KAKKKEVLKQDTF

SEQ ID NO: 1854317 - protein, 12 aa, Staphylococcus
KAKKQGMSLEND

SEQ ID NO: 1854318 - protein, 11 aa, Staphylococcus
KAKKQGMSLQN

SEQ ID NO: 1854319 - protein, 7 aa, Staphylococcus
KAKKTTI

SEQ ID NO: 1854320 - protein, 12 aa, Staphylococcus
KAKMYDSNKRRV

SEQ ID NO: 1854321 - protein, 14 aa, Staphylococcus
KAKNEGTSNNPEFK

SEQ ID NO: 1854322 - protein, 15 aa, Staphylococcus
KAKNEVEETKEDITN

SEQ ID NO: 1854323 - protein, 12 aa, Staphylococcus
KAKNKVDETKEV

SEQ ID NO: 1854324 - protein, 7 aa, Staphylococcus
KAKNNEL

SEQ ID NO: 1854325 - protein, 9 aa, Staphylococcus
KAKNNKGKY

SEQ ID NO: 1854326 - protein, 10 aa, Staphylococcus
KAKNPADGKI

SEQ ID NO: 1854327 - protein, 8 aa, Staphylococcus
KAKPLDTA

SEQ ID NO: 1854328 - protein, 10 aa, Staphylococcus
KAKPYKDADL

SEQ ID NO: 1854329 - protein, 7 aa, Staphylococcus
KAKQSPF

SEQ ID NO: 1854330 - protein, 28 aa, Staphylococcus
KAKREEYKAERQKVKDEKKAQREECANS

SEQ ID NO: 1854331 - protein, 8 aa, Staphylococcus
KAKRTSYR

SEQ ID NO: 1854332 - protein, 13 aa, Staphylococcus
KAKSKKTLDQDTF

SEQ ID NO: 1854333 - protein, 5 aa, Staphylococcus
KAKSQ

SEQ ID NO: 1854334 - protein, 6 aa, Staphylococcus
KAKTAG

SEQ ID NO: 1854335 - protein, 13 aa, Staphylococcus
KAKVYGSKTFGKG

SEQ ID NO: 1854336 - protein, 41 aa, Staphylococcus
KALDSNKDKPVKVTYERDGKNKTVELTPKKVKEGTKVSPKI

SEQ ID NO: 1854337 - protein, 17 aa, Staphylococcus
KALEEGHSNTNTSMNEA

SEQ ID NO: 1854338 - protein, 10 aa, Staphylococcus
KALEELENEV

SEQ ID NO: 1854339 - protein, 32 aa, Staphylococcus
KALKEEQDEQQTITTKQSKPKSKQDKKNEVKD

SEQ ID NO: 1854340 - protein, 7 aa, Staphylococcus
KALQGGS

SEQ ID NO: 1854341 - protein, 8 aa, Staphylococcus
KALTDNIA

SEQ ID NO: 1854342 - protein, 7 aa, Staphylococcus
KAMGASP

SEQ ID NO: 1854343 - protein, 6 aa, Staphylococcus
KAMQSL

SEQ ID NO: 1854344 - protein, 9 aa, Staphylococcus
KAMTGSGTL

SEQ ID NO: 1854345 - protein, 6 aa, Staphylococcus
KAMTSS

SEQ ID NO: 1854346 - protein, 6 aa, Staphylococcus
KANADF

SEQ ID NO: 1854347 - protein, 10 aa, Staphylococcus
KANDKFNETV

SEQ ID NO: 1854348 - protein, 9 aa, Staphylococcus
KANEQFNET

SEQ ID NO: 1854349 - protein, 4 aa, Staphylococcus
KANG

SEQ ID NO: 1854350 - protein, 5 aa, Staphylococcus
KANGL

SEQ ID NO: 1854351 - protein, 18 aa, Staphylococcus
KANGLNGNNIHNGQTLVI

SEQ ID NO: 1854352 - protein, 9 aa, Staphylococcus
KANGSNNGV

SEQ ID NO: 1854353 - protein, 15 aa, Staphylococcus
KANITDAQDKLNAVN

SEQ ID NO: 1854354 - protein, 16 aa, Staphylococcus
KANKAIDNANSNDDVD

SEQ ID NO: 1854355 - protein, 16 aa, Staphylococcus
KANKEDKVLDELINKL

SEQ ID NO: 1854356 - protein, 16 aa, Staphylococcus
KANKEDKVLNELLKKL

SEQ ID NO: 1854357 - protein, 18 aa, Staphylococcus
KANKKALNDIEDVDQNNI

SEQ ID NO: 1854358 - protein, 8 aa, Staphylococcus
KANKLSFS

SEQ ID NO: 1854359 - protein, 14 aa, Staphylococcus
KANNQINDSLRTTN

SEQ ID NO: 1854360 - protein, 8 aa, Staphylococcus
KANPPKVL

SEQ ID NO: 1854361 - protein, 5 aa, Staphylococcus
KANSA

SEQ ID NO: 1854362 - protein, 17 aa, Staphylococcus
KANSDYNIESSTPQDFD

SEQ ID NO: 1854363 - protein, 5 aa, Staphylococcus
KANTD

SEQ ID NO: 1854364 - protein, 8 aa, Staphylococcus
KANTNNDV

SEQ ID NO: 1854365 - protein, 4 aa, Staphylococcus
KANV

SEQ ID NO: 1854366 - protein, 4 aa, Staphylococcus
KAPG

SEQ ID NO: 1854367 - protein, 6 aa, Staphylococcus
KAPGSR

SEQ ID NO: 1854368 - protein, 9 aa, Staphylococcus
KAPGVKDAT

SEQ ID NO: 1854369 - protein, 10 aa, Staphylococcus
KAPKEDPSRI

SEQ ID NO: 1854370 - protein, 18 aa, Staphylococcus
KAPNLNHHQDQTKNKDNL

SEQ ID NO: 1854371 - protein, 6 aa, Staphylococcus
KAPRTD

SEQ ID NO: 1854372 - protein, 6 aa, Staphylococcus
KAPTAE

SEQ ID NO: 1854373 - protein, 8 aa, Staphylococcus
KAPTKNYT

SEQ ID NO: 1854374 - protein, 7 aa, Staphylococcus
KAPTNRF

SEQ ID NO: 1854375 - protein, 9 aa, Staphylococcus
KAQDANTVQ

SEQ ID NO: 1854376 - protein, 10 aa, Staphylococcus
KAQENANSKY

SEQ ID NO: 1854377 - protein, 7 aa, Staphylococcus
KAQGLDA

SEQ ID NO: 1854378 - protein, 5 aa, Staphylococcus
KAQHN

SEQ ID NO: 1854379 - protein, 15 aa, Staphylococcus
KAQINDAESGNNVNF

SEQ ID NO: 1854380 - protein, 10 aa, Staphylococcus
KAQKADSFNK

SEQ ID NO: 1854381 - protein, 10 aa, Staphylococcus
KAQKGSHSHY

SEQ ID NO: 1854382 - protein, 11 aa, Staphylococcus
KAQKQGMSLKN

SEQ ID NO: 1854383 - protein, 14 aa, Staphylococcus
KAQNEAKKNKVNIW

SEQ ID NO: 1854384 - protein, 7 aa, Staphylococcus
KAQQQDA

SEQ ID NO: 1854385 - protein, 13 aa, Staphylococcus
KAQRDKQHKKLGN

SEQ ID NO: 1854386 - protein, 17 aa, Staphylococcus
KAQSQTSNTKVSSQTQT

SEQ ID NO: 1854387 - protein, 5 aa, Staphylococcus
KAQTG

SEQ ID NO: 1854388 - protein, 7 aa, Staphylococcus
KARKEVD

SEQ ID NO: 1854389 - protein, 17 aa, Staphylococcus
KARPDLHKQSRYKMPGG

SEQ ID NO: 1854390 - protein, 6 aa, Staphylococcus
KARYDY

SEQ ID NO: 1854391 - protein, 11 aa, Staphylococcus
KASAGDKLHGN

SEQ ID NO: 1854392 - protein, 8 aa, Staphylococcus
KASDSSHV

SEQ ID NO: 1854393 - protein, 6 aa, Staphylococcus
KASEQR

SEQ ID NO: 1854394 - protein, 4 aa, Staphylococcus
KASF

SEQ ID NO: 1854395 - protein, 9 aa, Staphylococcus
KASGANKTK

SEQ ID NO: 1854396 - protein, 7 aa, Staphylococcus
KASGHNK

SEQ ID NO: 1854397 - protein, 6 aa, Staphylococcus
KASGKL

SEQ ID NO: 1854398 - protein, 8 aa, Staphylococcus
KASGKVNG

SEQ ID NO: 1854399 - protein, 7 aa, Staphylococcus
KASGQRI

SEQ ID NO: 1854400 - protein, 4 aa, Staphylococcus
KASI

SEQ ID NO: 1854401 - protein, 12 aa, Staphylococcus
KASKKMGGKTFN

SEQ ID NO: 1854402 - protein, 8 aa, Staphylococcus
KASNTYAP

SEQ ID NO: 1854403 - protein, 4 aa, Staphylococcus
KASP

SEQ ID NO: 1854404 - protein, 8 aa, Staphylococcus
KASPNTER

SEQ ID NO: 1854405 - protein, 9 aa, Staphylococcus
KASPNYKNL

SEQ ID NO: 1854406 - protein, 5 aa, Staphylococcus
KASQA

SEQ ID NO: 1854407 - protein, 8 aa, Staphylococcus
KASQNGAL

SEQ ID NO: 1854408 - protein, 9 aa, Staphylococcus
KASQRSQTM

SEQ ID NO: 1854409 - protein, 8 aa, Staphylococcus
KASSNHQQ

SEQ ID NO: 1854410 - protein, 21 aa, Staphylococcus
KATAVTAVDEGDGYSTEDNDM

SEQ ID NO: 1854411 - protein, 11 aa, Staphylococcus
KATEEANKAKA

SEQ ID NO: 1854412 - protein, 12 aa, Staphylococcus
KATEKAEESDVM

SEQ ID NO: 1854413 - protein, 6 aa, Staphylococcus
KATFTR

SEQ ID NO: 1854414 - protein, 7 aa, Staphylococcus
KATGIKQ

SEQ ID NO: 1854415 - protein, 7 aa, Staphylococcus
KATGNVS

SEQ ID NO: 1854416 - protein, 14 aa, Staphylococcus
KATGTAHKVSPKVP

SEQ ID NO: 1854417 - protein, 7 aa, Staphylococcus
KATIDDN

SEQ ID NO: 1854418 - protein, 6 aa, Staphylococcus
KATIDG

SEQ ID NO: 1854419 - protein, 50 aa, Staphylococcus
KATIDLTQEATEEEKEAAKSKVDQALTEAKTHINEAENDDGVDNAKTKGI

SEQ ID NO: 1854420 - protein, 11 aa, Staphylococcus
KATKDIDGKKF

SEQ ID NO: 1854421 - protein, 6 aa, Staphylococcus
KATKLP

SEQ ID NO: 1854422 - protein, 5 aa, Staphylococcus
KATLS

SEQ ID NO: 1854423 - protein, 9 aa, Staphylococcus
KATMDNTTN

SEQ ID NO: 1854424 - protein, 11 aa, Staphylococcus
KATNKDNLGPV

SEQ ID NO: 1854425 - protein, 19 aa, Staphylococcus
KATNKETLGPVKEKVKGQV

SEQ ID NO: 1854426 - protein, 6 aa, Staphylococcus
KATPIH

SEQ ID NO: 1854427 - protein, 7 aa, Staphylococcus
KATQRGS

SEQ ID NO: 1854428 - protein, 5 aa, Staphylococcus
KATSF

SEQ ID NO: 1854429 - protein, 8 aa, Staphylococcus
KATSLSEI

SEQ ID NO: 1854430 - protein, 23 aa, Staphylococcus
KATTDGNGNATIKPTTPIPEGEV

SEQ ID NO: 1854431 - protein, 20 aa, Staphylococcus
KATTTQTKYTVTSPSTSTSL

SEQ ID NO: 1854432 - protein, 11 aa, Staphylococcus
KATVNGRHEDV

SEQ ID NO: 1854433 - protein, 7 aa, Staphylococcus
KAVANNR

SEQ ID NO: 1854434 - protein, 7 aa, Staphylococcus
KAVATSA

SEQ ID NO: 1854435 - protein, 15 aa, Staphylococcus
KAVDPREDESSKRRY

SEQ ID NO: 1854436 - protein, 8 aa, Staphylococcus
KAVEAGKA

SEQ ID NO: 1854437 - protein, 6 aa, Staphylococcus
KAVGAS

SEQ ID NO: 1854438 - protein, 7 aa, Staphylococcus
KAVGASN

SEQ ID NO: 1854439 - protein, 7 aa, Staphylococcus
KAVGASQ

SEQ ID NO: 1854440 - protein, 8 aa, Staphylococcus
KAVGASSR

SEQ ID NO: 1854441 - protein, 7 aa, Staphylococcus
KAVGPSG

SEQ ID NO: 1854442 - protein, 8 aa, Staphylococcus
KAVGTAGS

SEQ ID NO: 1854443 - protein, 8 aa, Staphylococcus
KAVKKNAP

SEQ ID NO: 1854444 - protein, 16 aa, Staphylococcus
KAVKNGKSIVENSDGF

SEQ ID NO: 1854445 - protein, 11 aa, Staphylococcus
KAVKQSTTLKS

SEQ ID NO: 1854446 - protein, 6 aa, Staphylococcus
KAVNAQ

SEQ ID NO: 1854447 - protein, 11 aa, Staphylococcus
KAVNNSEVDNA

SEQ ID NO: 1854448 - protein, 9 aa, Staphylococcus
KAVNPPNVM

SEQ ID NO: 1854449 - protein, 16 aa, Staphylococcus
KAVNPPNVMGASKRAA

SEQ ID NO: 1854450 - protein, 13 aa, Staphylococcus
KAVSTANNSVPEI

SEQ ID NO: 1854451 - protein, 6 aa, Staphylococcus
KAYEKY

SEQ ID NO: 1854452 - protein, 5 aa, Staphylococcus
KAYGP

SEQ ID NO: 1854453 - protein, 10 aa, Staphylococcus
KAYGSAYGHG

SEQ ID NO: 1854454 - protein, 11 aa, Staphylococcus
KAYGSAYGHGV

SEQ ID NO: 1854455 - protein, 6 aa, Staphylococcus
KAYKEY

SEQ ID NO: 1854456 - protein, 8 aa, Staphylococcus
KAYPNEQF

SEQ ID NO: 1854457 - protein, 8 aa, Staphylococcus
KAYQEDIK

SEQ ID NO: 1854458 - protein, 14 aa, Staphylococcus
KAYQSTHNATWKDK

SEQ ID NO: 1854459 - protein, 7 aa, Staphylococcus
KAYTGAT

SEQ ID NO: 1854460 - protein, 7 aa, Staphylococcus
KAYTSAT

SEQ ID NO: 1854461 - protein, 9 aa, Staphylococcus
KDAAKKAID

SEQ ID NO: 1854462 - protein, 5 aa, Staphylococcus
KDADQ

SEQ ID NO: 1854463 - protein, 8 aa, Staphylococcus
KDAKPLKI

SEQ ID NO: 1854464 - protein, 4 aa, Staphylococcus
KDAL

SEQ ID NO: 1854465 - protein, 21 aa, Staphylococcus
KDALNGEQRLAKAKAKAQEYV

SEQ ID NO: 1854466 - protein, 15 aa, Staphylococcus
KDAPDSYEGTVAPTK

SEQ ID NO: 1854467 - protein, 14 aa, Staphylococcus
KDAPSSYEGSIAPK

SEQ ID NO: 1854468 - protein, 9 aa, Staphylococcus
KDAQKYQEK

SEQ ID NO: 1854469 - protein, 19 aa, Staphylococcus
KDARPRQGESKEEKKVPGH

SEQ ID NO: 1854470 - protein, 9 aa, Staphylococcus
KDASSISDH

SEQ ID NO: 1854471 - protein, 10 aa, Staphylococcus
KDASSNATTL

SEQ ID NO: 1854472 - protein, 10 aa, Staphylococcus
KDAVTSATYT

SEQ ID NO: 1854473 - protein, 7 aa, Staphylococcus
KDDAKEI

SEQ ID NO: 1854474 - protein, 7 aa, Staphylococcus
KDDANEI

SEQ ID NO: 1854475 - protein, 9 aa, Staphylococcus
KDDAPRQSS

SEQ ID NO: 1854476 - protein, 9 aa, Staphylococcus
KDDAPSRSS

SEQ ID NO: 1854477 - protein, 9 aa, Staphylococcus
KDDASGLAA

SEQ ID NO: 1854478 - protein, 9 aa, Staphylococcus
KDDASGLSA

SEQ ID NO: 1854479 - protein, 6 aa, Staphylococcus
KDDAVD

SEQ ID NO: 1854480 - protein, 32 aa, Staphylococcus
KDDDKTSESVQSSPSNTNDSKSEKDSTSKGPH

SEQ ID NO: 1854481 - protein, 10 aa, Staphylococcus
KDDGKGISNI

SEQ ID NO: 1854482 - protein, 13 aa, Staphylococcus
KDDGLGKKSGLKI

SEQ ID NO: 1854483 - protein, 9 aa, Staphylococcus
KDDGPPKVE

SEQ ID NO: 1854484 - protein, 10 aa, Staphylococcus
KDDHKSQRKV

SEQ ID NO: 1854485 - protein, 18 aa, Staphylococcus
KDDIESEKDVNNQEEDNK

SEQ ID NO: 1854486 - protein, 12 aa, Staphylococcus
KDDKNQENVGDD

SEQ ID NO: 1854487 - protein, 28 aa, Staphylococcus
KDDKPQGTVSTGDALDSITKPLKNQEVK

SEQ ID NO: 1854488 - protein, 5 aa, Staphylococcus
KDDKR

SEQ ID NO: 1854489 - protein, 12 aa, Staphylococcus
KDDPKSKEGELA

SEQ ID NO: 1854490 - protein, 12 aa, Staphylococcus
KDDPLGDYGKGI

SEQ ID NO: 1854491 - protein, 10 aa, Staphylococcus
KDDQRHESYT

SEQ ID NO: 1854492 - protein, 14 aa, Staphylococcus
KDDSEIEIDDEDLD

SEQ ID NO: 1854493 - protein, 68 aa, Staphylococcus
KDEAKTAIDKAAEAKKAEIDQTPNATDEEKATAKAKVDEAVTTAKNAIDQATNNDGVDTAKSEGSDAI

SEQ ID NO: 1854494 - protein, 67 aa, Staphylococcus
KDEAKTAIDKAAEAKKAEIDQTPNATDEEKIAAKAKVDEAVTTAKNAIDQATNNAGVDTAKTNGVDA

SEQ ID NO: 1854495 - protein, 68 aa, Staphylococcus
KDEAKTAIDKAAEAKKAEINQTPNATDEEKVAAKAKVDEAVTTAKNAIDQATNNAGVDTAKSNGLDSI

SEQ ID NO: 1854496 - protein, 7 aa, Staphylococcus
KDEAKVA

SEQ ID NO: 1854497 - protein, 7 aa, Staphylococcus
KDEANEI

SEQ ID NO: 1854498 - protein, 7 aa, Staphylococcus
KDEDEVH

SEQ ID NO: 1854499 - protein, 25 aa, Staphylococcus
KDEEEQVGDEHHYDETGAEKKVSAG

SEQ ID NO: 1854500 - protein, 14 aa, Staphylococcus
KDEEPPKISKHQPK

SEQ ID NO: 1854501 - protein, 5 aa, Staphylococcus
KDEFG

SEQ ID NO: 1854502 - protein, 6 aa, Staphylococcus
KDEFGT

SEQ ID NO: 1854503 - protein, 9 aa, Staphylococcus
KDEHDSSEE

SEQ ID NO: 1854504 - protein, 6 aa, Staphylococcus
KDEHEV

SEQ ID NO: 1854505 - protein, 17 aa, Staphylococcus
KDEIANKANSFNTSTAD

SEQ ID NO: 1854506 - protein, 17 aa, Staphylococcus
KDEIDNKANSFNTNDQD

SEQ ID NO: 1854507 - protein, 21 aa, Staphylococcus
KDEIDNNPNLSKEDKEKLKSK

SEQ ID NO: 1854508 - protein, 8 aa, Staphylococcus
KDEIGTPG

SEQ ID NO: 1854509 - protein, 11 aa, Staphylococcus
KDEKADAVPKH

SEQ ID NO: 1854510 - protein, 9 aa, Staphylococcus
KDEKGRASS

SEQ ID NO: 1854511 - protein, 11 aa, Staphylococcus
KDEKGRASSAL

SEQ ID NO: 1854512 - protein, 6 aa, Staphylococcus
KDEKTL

SEQ ID NO: 1854513 - protein, 5 aa, Staphylococcus
KDELS

SEQ ID NO: 1854514 - protein, 5 aa, Staphylococcus
KDENL

SEQ ID NO: 1854515 - protein, 11 aa, Staphylococcus
KDENRTPLDSY

SEQ ID NO: 1854516 - protein, 7 aa, Staphylococcus
KDEPDKT

SEQ ID NO: 1854517 - protein, 7 aa, Staphylococcus
KDEPKNT

SEQ ID NO: 1854518 - protein, 21 aa, Staphylococcus
KDEPQPEGDDHHYDEHGVEKK

SEQ ID NO: 1854519 - protein, 12 aa, Staphylococcus
KDERDKREDYHN

SEQ ID NO: 1854520 - protein, 11 aa, Staphylococcus
KDESRYASSKP

SEQ ID NO: 1854521 - protein, 7 aa, Staphylococcus
KDESVEV

SEQ ID NO: 1854522 - protein, 25 aa, Staphylococcus
KDEYAKEVSEEMRTEQLPENKTPLR

SEQ ID NO: 1854523 - protein, 20 aa, Staphylococcus
KDFDNETNQMKNDKESFPIQ

SEQ ID NO: 1854524 - protein, 15 aa, Staphylococcus
KDFGTPTTADDVTKA

SEQ ID NO: 1854525 - protein, 9 aa, Staphylococcus
KDFQKSGNY

SEQ ID NO: 1854526 - protein, 6 aa, Staphylococcus
KDFSAR

SEQ ID NO: 1854527 - protein, 7 aa, Staphylococcus
KDFSNNL

SEQ ID NO: 1854528 - protein, 16 aa, Staphylococcus
KDFSPNMSDYKGMDKK

SEQ ID NO: 1854529 - protein, 16 aa, Staphylococcus
KDGATMGTGRTNETGH

SEQ ID NO: 1854530 - protein, 18 aa, Staphylococcus
KDGGIQSIQDYKLKLIEH

SEQ ID NO: 1854531 - protein, 4 aa, Staphylococcus
KDGI

SEQ ID NO: 1854532 - protein, 6 aa, Staphylococcus
KDGLGE

SEQ ID NO: 1854533 - protein, 9 aa, Staphylococcus
KDGLRFPEV

SEQ ID NO: 1854534 - protein, 16 aa, Staphylococcus
KDGNSLGKGTTDTDGH

SEQ ID NO: 1854535 - protein, 22 aa, Staphylococcus
KDGQKNCKSGETISISNGEAVA

SEQ ID NO: 1854536 - protein, 6 aa, Staphylococcus
KDGQKV

SEQ ID NO: 1854537 - protein, 9 aa, Staphylococcus
KDGQNRIET

SEQ ID NO: 1854538 - protein, 9 aa, Staphylococcus
KDGRTPTVD

SEQ ID NO: 1854539 - protein, 14 aa, Staphylococcus
KDGSIAEKAGLKPD

SEQ ID NO: 1854540 - protein, 4 aa, Staphylococcus
KDGV

SEQ ID NO: 1854541 - protein, 13 aa, Staphylococcus
KDGVGDPELTRNS

SEQ ID NO: 1854542 - protein, 13 aa, Staphylococcus
KDGVSDPELTRNS

SEQ ID NO: 1854543 - protein, 9 aa, Staphylococcus
KDGVSEPEL

SEQ ID NO: 1854544 - protein, 13 aa, Staphylococcus
KDGVSEPELTRNS

SEQ ID NO: 1854545 - protein, 19 aa, Staphylococcus
KDHEAESVVTQNKNEDNNK

SEQ ID NO: 1854546 - protein, 100 aa, Staphylococcus
KDHGDNQADDNQKVAQQDKKDKTSNNDKSNKEKSDSKDKKDDNSSNNASNDDNNSEANSDNASANNSNGVNNQANNQNAQQQQNGASQSNSAQGQQTHTV

SEQ ID NO: 1854547 - protein, 6 aa, Staphylococcus
KDHKGY

SEQ ID NO: 1854548 - protein, 14 aa, Staphylococcus
KDHPGSYEGSIAPQ

SEQ ID NO: 1854549 - protein, 20 aa, Staphylococcus
KDHPGTSSSQTYNITSSRSV

SEQ ID NO: 1854550 - protein, 9 aa, Staphylococcus
KDHQGGGNA

SEQ ID NO: 1854551 - protein, 9 aa, Staphylococcus
KDHQGNGNA

SEQ ID NO: 1854552 - protein, 9 aa, Staphylococcus
KDHSKQLET

SEQ ID NO: 1854553 - protein, 9 aa, Staphylococcus
KDHTNQSYS

SEQ ID NO: 1854554 - protein, 5 aa, Staphylococcus
KDIDR

SEQ ID NO: 1854555 - protein, 17 aa, Staphylococcus
KDIDYSETISEEISDLE

SEQ ID NO: 1854556 - protein, 15 aa, Staphylococcus
KDIETRSEAASEISS

SEQ ID NO: 1854557 - protein, 7 aa, Staphylococcus
KDIPKLE

SEQ ID NO: 1854558 - protein, 30 aa, Staphylococcus
KDIQGSKTKGNKRPSAFSSKSVQTNNNDTE

SEQ ID NO: 1854559 - protein, 5 aa, Staphylococcus
KDISD

SEQ ID NO: 1854560 - protein, 10 aa, Staphylococcus
KDISEKDQKE

SEQ ID NO: 1854561 - protein, 6 aa, Staphylococcus
KDISHG

SEQ ID NO: 1854562 - protein, 15 aa, Staphylococcus
KDISNSKANKDLEHN

SEQ ID NO: 1854563 - protein, 41 aa, Staphylococcus
KDITDTPKASEAQRGTKDNEQYDSSKVQDKERQNDQKSTTV

SEQ ID NO: 1854564 - protein, 21 aa, Staphylococcus
KDIVQGSAKQEFKQGTNEPAV

SEQ ID NO: 1854565 - protein, 10 aa, Staphylococcus
KDKADVKKGD

SEQ ID NO: 1854566 - protein, 8 aa, Staphylococcus
KDKEINNT

SEQ ID NO: 1854567 - protein, 11 aa, Staphylococcus
KDKEKNSNSIS

SEQ ID NO: 1854568 - protein, 6 aa, Staphylococcus
KDKEKV

SEQ ID NO: 1854569 - protein, 8 aa, Staphylococcus
KDKEKYGH

SEQ ID NO: 1854570 - protein, 10 aa, Staphylococcus
KDKESYETID

SEQ ID NO: 1854571 - protein, 12 aa, Staphylococcus
KDKFTNNDDDNK

SEQ ID NO: 1854572 - protein, 4 aa, Staphylococcus
KDKG

SEQ ID NO: 1854573 - protein, 7 aa, Staphylococcus
KDKGATL

SEQ ID NO: 1854574 - protein, 7 aa, Staphylococcus
KDKGFKV

SEQ ID NO: 1854575 - protein, 8 aa, Staphylococcus
KDKGFKVG

SEQ ID NO: 1854576 - protein, 8 aa, Staphylococcus
KDKGIGPN

SEQ ID NO: 1854577 - protein, 8 aa, Staphylococcus
KDKHRSHA

SEQ ID NO: 1854578 - protein, 5 aa, Staphylococcus
KDKHV

SEQ ID NO: 1854579 - protein, 17 aa, Staphylococcus
KDKIKSEKTLYSAKRGV

SEQ ID NO: 1854580 - protein, 6 aa, Staphylococcus
KDKINQ

SEQ ID NO: 1854581 - protein, 12 aa, Staphylococcus
KDKIRRNYYISN

SEQ ID NO: 1854582 - protein, 9 aa, Staphylococcus
KDKKMAKSI

SEQ ID NO: 1854583 - protein, 11 aa, Staphylococcus
KDKNDNPQALQ

SEQ ID NO: 1854584 - protein, 10 aa, Staphylococcus
KDKNFSKGNH

SEQ ID NO: 1854585 - protein, 7 aa, Staphylococcus
KDKPDFN

SEQ ID NO: 1854586 - protein, 14 aa, Staphylococcus
KDKPEKNKDPKNHP

SEQ ID NO: 1854587 - protein, 14 aa, Staphylococcus
KDKPEKSKDPKNHP

SEQ ID NO: 1854588 - protein, 20 aa, Staphylococcus
KDKPKNSQIEYSSDTGNLNI

SEQ ID NO: 1854589 - protein, 8 aa, Staphylococcus
KDKPKPAQ

SEQ ID NO: 1854590 - protein, 8 aa, Staphylococcus
KDKPRPAQ

SEQ ID NO: 1854591 - protein, 14 aa, Staphylococcus
KDKPSSYVSKVATR

SEQ ID NO: 1854592 - protein, 14 aa, Staphylococcus
KDKPSTYISKVVEK

SEQ ID NO: 1854593 - protein, 6 aa, Staphylococcus
KDKQNK

SEQ ID NO: 1854594 - protein, 6 aa, Staphylococcus
KDKQTH

SEQ ID NO: 1854595 - protein, 17 aa, Staphylococcus
KDKRDSEGKLLPNKDRA

SEQ ID NO: 1854596 - protein, 7 aa, Staphylococcus
KDKSRQI

SEQ ID NO: 1854597 - protein, 6 aa, Staphylococcus
KDKTIS

SEQ ID NO: 1854598 - protein, 7 aa, Staphylococcus
KDKTLKE

SEQ ID NO: 1854599 - protein, 4 aa, Staphylococcus
KDKV

SEQ ID NO: 1854600 - protein, 6 aa, Staphylococcus
KDKVDY

SEQ ID NO: 1854601 - protein, 11 aa, Staphylococcus
KDKVSSDQTFT

SEQ ID NO: 1854602 - protein, 5 aa, Staphylococcus
KDLDE

SEQ ID NO: 1854603 - protein, 7 aa, Staphylococcus
KDLDNDM

SEQ ID NO: 1854604 - protein, 7 aa, Staphylococcus
KDLDTSD

SEQ ID NO: 1854605 - protein, 6 aa, Staphylococcus
KDLPEL

SEQ ID NO: 1854606 - protein, 7 aa, Staphylococcus
KDLPPAG

SEQ ID NO: 1854607 - protein, 9 aa, Staphylococcus
KDLQGSDKI

SEQ ID NO: 1854608 - protein, 5 aa, Staphylococcus
KDLSG

SEQ ID NO: 1854609 - protein, 10 aa, Staphylococcus
KDLSKDIQDM

SEQ ID NO: 1854610 - protein, 6 aa, Staphylococcus
KDLSSN

SEQ ID NO: 1854611 - protein, 4 aa, Staphylococcus
KDLT

SEQ ID NO: 1854612 - protein, 15 aa, Staphylococcus
KDLTDDENDAYRGQI

SEQ ID NO: 1854613 - protein, 18 aa, Staphylococcus
KDMDNVDTVEKPQLNDNN

SEQ ID NO: 1854614 - protein, 7 aa, Staphylococcus
KDMPEDL

SEQ ID NO: 1854615 - protein, 11 aa, Staphylococcus
KDMPSELKERY

SEQ ID NO: 1854616 - protein, 8 aa, Staphylococcus
KDMSEHAK

SEQ ID NO: 1854617 - protein, 7 aa, Staphylococcus
KDMSENI

SEQ ID NO: 1854618 - protein, 13 aa, Staphylococcus
KDMSKDKGMGKSG

SEQ ID NO: 1854619 - protein, 7 aa, Staphylococcus
KDMSKNI

SEQ ID NO: 1854620 - protein, 8 aa, Staphylococcus
KDMSKNIG

SEQ ID NO: 1854621 - protein, 6 aa, Staphylococcus
KDMSNR

SEQ ID NO: 1854622 - protein, 13 aa, Staphylococcus
KDMTAPQEADEAD

SEQ ID NO: 1854623 - protein, 5 aa, Staphylococcus
KDNAF

SEQ ID NO: 1854624 - protein, 6 aa, Staphylococcus
KDNAIQ

SEQ ID NO: 1854625 - protein, 39 aa, Staphylococcus
KDNDSDNQTTETQNKSKDDSQSKESSSSESNSSEKAPTI

SEQ ID NO: 1854626 - protein, 37 aa, Staphylococcus
KDNDVDADTSNFDKKIDKAKVKAKELDKTKIDPDVTA

SEQ ID NO: 1854627 - protein, 9 aa, Staphylococcus
KDNENNVTK

SEQ ID NO: 1854628 - protein, 118 aa, Staphylococcus
KDNFDTSTEQEDNTQSNIDNHDSSNHINTATQHENNEEIQNTEDEINNSALENNLHEQQNEPSEEDLSSTAQDDTAIQHNTDDGDVTEDNEDIEKPPPLTPEELREQKRRQRRKRQKT

SEQ ID NO: 1854629 - protein, 7 aa, Staphylococcus
KDNGGVT

SEQ ID NO: 1854630 - protein, 6 aa, Staphylococcus
KDNHDR

SEQ ID NO: 1854631 - protein, 7 aa, Staphylococcus
KDNIKTN

SEQ ID NO: 1854632 - protein, 7 aa, Staphylococcus
KDNLSQR

SEQ ID NO: 1854633 - protein, 13 aa, Staphylococcus
KDNNNSRDGEIEN

SEQ ID NO: 1854634 - protein, 16 aa, Staphylococcus
KDNNTTSHLNSARGSL

SEQ ID NO: 1854635 - protein, 5 aa, Staphylococcus
KDNPN

SEQ ID NO: 1854636 - protein, 21 aa, Staphylococcus
KDNPSISKHSTSSNQNQGKAL

SEQ ID NO: 1854637 - protein, 12 aa, Staphylococcus
KDNPSNAQKEVQ

SEQ ID NO: 1854638 - protein, 7 aa, Staphylococcus
KDNQIKN

SEQ ID NO: 1854639 - protein, 5 aa, Staphylococcus
KDNQT

SEQ ID NO: 1854640 - protein, 13 aa, Staphylococcus
KDNSGNSASQTFK

SEQ ID NO: 1854641 - protein, 14 aa, Staphylococcus
KDNSLGEKSGLQKN

SEQ ID NO: 1854642 - protein, 13 aa, Staphylococcus
KDNTMSPNLKEND

SEQ ID NO: 1854643 - protein, 12 aa, Staphylococcus
KDNYDKDDLYEN

SEQ ID NO: 1854644 - protein, 6 aa, Staphylococcus
KDPGLD

SEQ ID NO: 1854645 - protein, 7 aa, Staphylococcus
KDPIAAK

SEQ ID NO: 1854646 - protein, 63 aa, Staphylococcus
KDPKQDLAEATAQMEATKGKKSSVASKLSAKDDNKAADNKTAETTTATAASNKAEDKDSDELL

SEQ ID NO: 1854647 - protein, 16 aa, Staphylococcus
KDPNQPKQKPKSTKVK

SEQ ID NO: 1854648 - protein, 7 aa, Staphylococcus
KDPSHTI

SEQ ID NO: 1854649 - protein, 12 aa, Staphylococcus
KDPSKSVMNTSE

SEQ ID NO: 1854650 - protein, 4 aa, Staphylococcus
KDPY

SEQ ID NO: 1854651 - protein, 5 aa, Staphylococcus
KDPYD

SEQ ID NO: 1854652 - protein, 6 aa, Staphylococcus
KDPYDI

SEQ ID NO: 1854653 - protein, 7 aa, Staphylococcus
KDPYSEY

SEQ ID NO: 1854654 - protein, 21 aa, Staphylococcus
KDPYSEYMTKDETKSFNEDVS

SEQ ID NO: 1854655 - protein, 21 aa, Staphylococcus
KDPYSEYMTKEKTESFNEGVS

SEQ ID NO: 1854656 - protein, 21 aa, Staphylococcus
KDPYSEYMTKSETKSFNEDVS

SEQ ID NO: 1854657 - protein, 21 aa, Staphylococcus
KDPYSEYMTSEETKQFNEGVS

SEQ ID NO: 1854658 - protein, 7 aa, Staphylococcus
KDPYSQY

SEQ ID NO: 1854659 - protein, 8 aa, Staphylococcus
KDQAQARK

SEQ ID NO: 1854660 - protein, 5 aa, Staphylococcus
KDQFQ

SEQ ID NO: 1854661 - protein, 5 aa, Staphylococcus
KDQIA

SEQ ID NO: 1854662 - protein, 19 aa, Staphylococcus
KDQKLKLKNTTSNVEENED

SEQ ID NO: 1854663 - protein, 6 aa, Staphylococcus
KDQLQA

SEQ ID NO: 1854664 - protein, 8 aa, Staphylococcus
KDQPSAIE

SEQ ID NO: 1854665 - protein, 23 aa, Staphylococcus
KDQQEHDGTDDHHFDDDGEEIHA

SEQ ID NO: 1854666 - protein, 7 aa, Staphylococcus
KDRANTY

SEQ ID NO: 1854667 - protein, 6 aa, Staphylococcus
KDRGEL

SEQ ID NO: 1854668 - protein, 6 aa, Staphylococcus
KDRHDA

SEQ ID NO: 1854669 - protein, 7 aa, Staphylococcus
KDRHDIN

SEQ ID NO: 1854670 - protein, 13 aa, Staphylococcus
KDRHDINEGKDVH

SEQ ID NO: 1854671 - protein, 12 aa, Staphylococcus
KDRKSIESKEAL

SEQ ID NO: 1854672 - protein, 5 aa, Staphylococcus
KDRPS

SEQ ID NO: 1854673 - protein, 6 aa, Staphylococcus
KDRQRA

SEQ ID NO: 1854674 - protein, 14 aa, Staphylococcus
KDRRVRKELEEKNK

SEQ ID NO: 1854675 - protein, 15 aa, Staphylococcus
KDRVPKAKIDGKVGR

SEQ ID NO: 1854676 - protein, 10 aa, Staphylococcus
KDSDDKNEQS

SEQ ID NO: 1854677 - protein, 18 aa, Staphylococcus
KDSDEGTNKYGPNPKIAA

SEQ ID NO: 1854678 - protein, 7 aa, Staphylococcus
KDSFKEN

SEQ ID NO: 1854679 - protein, 20 aa, Staphylococcus
KDSKQDKEIASWKQNGDYAY

SEQ ID NO: 1854680 - protein, 17 aa, Staphylococcus
KDSLNEVKQKIKDNLEM

SEQ ID NO: 1854681 - protein, 53 aa, Staphylococcus
KDSNGPKPKKDQKHDKDSKEAKGKDSVVKDNSKSKTSKELPETGSKQESNSNS

SEQ ID NO: 1854682 - protein, 16 aa, Staphylococcus
KDSPAQQAGLKSGDKI

SEQ ID NO: 1854683 - protein, 21 aa, Staphylococcus
KDSQWKKKNQLKVDKNNGGVQ

SEQ ID NO: 1854684 - protein, 6 aa, Staphylococcus
KDSQYH

SEQ ID NO: 1854685 - protein, 6 aa, Staphylococcus
KDSRKI

SEQ ID NO: 1854686 - protein, 18 aa, Staphylococcus
KDSTNAEAGYRSHDDRSH

SEQ ID NO: 1854687 - protein, 18 aa, Staphylococcus
KDSTNAEAGYTSHEDRSH

SEQ ID NO: 1854688 - protein, 18 aa, Staphylococcus
KDSTNAESGYTSHDDRSH

SEQ ID NO: 1854689 - protein, 17 aa, Staphylococcus
KDSTNSEAGYRSHDDRS

SEQ ID NO: 1854690 - protein, 18 aa, Staphylococcus
KDSTNSEAGYRSHDDRSH

SEQ ID NO: 1854691 - protein, 7 aa, Staphylococcus
KDTDRVK

SEQ ID NO: 1854692 - protein, 7 aa, Staphylococcus
KDTEFQE

SEQ ID NO: 1854693 - protein, 6 aa, Staphylococcus
KDTIDK

SEQ ID NO: 1854694 - protein, 8 aa, Staphylococcus
KDTISDSA

SEQ ID NO: 1854695 - protein, 13 aa, Staphylococcus
KDTKEALNGDQRL

SEQ ID NO: 1854696 - protein, 8 aa, Staphylococcus
KDTLSATN

SEQ ID NO: 1854697 - protein, 4 aa, Staphylococcus
KDTM

SEQ ID NO: 1854698 - protein, 4 aa, Staphylococcus
KDTN

SEQ ID NO: 1854699 - protein, 12 aa, Staphylococcus
KDTPHFDEEPDK

SEQ ID NO: 1854700 - protein, 4 aa, Staphylococcus
KDTT

SEQ ID NO: 1854701 - protein, 16 aa, Staphylococcus
KDVADTYKKQTTLKQS

SEQ ID NO: 1854702 - protein, 6 aa, Staphylococcus
KDVAKA

SEQ ID NO: 1854703 - protein, 5 aa, Staphylococcus
KDVDY

SEQ ID NO: 1854704 - protein, 10 aa, Staphylococcus
KDVKGTSSVV

SEQ ID NO: 1854705 - protein, 12 aa, Staphylococcus
KDVLDEKSNYMN

SEQ ID NO: 1854706 - protein, 12 aa, Staphylococcus
KDVNNLKGRYHG

SEQ ID NO: 1854707 - protein, 30 aa, Staphylococcus
KDVNQRSDFNKQRKQALKQDIRQTEQRMNQ

SEQ ID NO: 1854708 - protein, 10 aa, Staphylococcus
KDVPVDDEEA

SEQ ID NO: 1854709 - protein, 7 aa, Staphylococcus
KDVQGSN

SEQ ID NO: 1854710 - protein, 18 aa, Staphylococcus
KDVQKKVDEFEKNNSEMK

SEQ ID NO: 1854711 - protein, 36 aa, Staphylococcus
KDVQKTLQNRIDNGNFYKNDDQQVGSSIVDSKTGGL

SEQ ID NO: 1854712 - protein, 13 aa, Staphylococcus
KDVSQSQEPLKGK

SEQ ID NO: 1854713 - protein, 15 aa, Staphylococcus
KDVTAEQLIIKVIDD

SEQ ID NO: 1854714 - protein, 10 aa, Staphylococcus
KDVTDDERSR

SEQ ID NO: 1854715 - protein, 11 aa, Staphylococcus
KDVTDGERSRV

SEQ ID NO: 1854716 - protein, 14 aa, Staphylococcus
KDVTDKPQKPARKV

SEQ ID NO: 1854717 - protein, 15 aa, Staphylococcus
KDVTDKPQKPARKVT

SEQ ID NO: 1854718 - protein, 11 aa, Staphylococcus
KDVTKDERSRV

SEQ ID NO: 1854719 - protein, 7 aa, Staphylococcus
KDVTSPH

SEQ ID NO: 1854720 - protein, 8 aa, Staphylococcus
KDWQSKDL

SEQ ID NO: 1854721 - protein, 6 aa, Staphylococcus
KDYAEG

SEQ ID NO: 1854722 - protein, 6 aa, Staphylococcus
KDYERG

SEQ ID NO: 1854723 - protein, 7 aa, Staphylococcus
KDYESQM

SEQ ID NO: 1854724 - protein, 14 aa, Staphylococcus
KDYGKAKIYGEKTF

SEQ ID NO: 1854725 - protein, 4 aa, Staphylococcus
KDYK

SEQ ID NO: 1854726 - protein, 11 aa, Staphylococcus
KDYSDKLKNNQ

SEQ ID NO: 1854727 - protein, 7 aa, Staphylococcus
KDYSPTF

SEQ ID NO: 1854728 - protein, 8 aa, Staphylococcus
KDYSRTVA

SEQ ID NO: 1854729 - protein, 6 aa, Staphylococcus
KDYTEG

SEQ ID NO: 1854730 - protein, 17 aa, Staphylococcus
KDYYKKQDSDKLTQSAI

SEQ ID NO: 1854731 - protein, 16 aa, Staphylococcus
KDYYKNEKSDKLSQAA

SEQ ID NO: 1854732 - protein, 8 aa, Staphylococcus
KEAATKKI

SEQ ID NO: 1854733 - protein, 58 aa, Staphylococcus
KEADAAEQQPTSEVYGQTDNNYKSESNKSNSVQHDEERTNIINDNDEANYSNHSEIPI

SEQ ID NO: 1854734 - protein, 46 aa, Staphylococcus
KEAEEEQKEQQQSQDVSHQKVEQQASSNDQQDEQYEGKKQGHREED

SEQ ID NO: 1854735 - protein, 52 aa, Staphylococcus
KEAEQEKKEKEQAQSSSHDASNQQVEESASNKQNNDNQQDEHKKQDHREEET

SEQ ID NO: 1854736 - protein, 6 aa, Staphylococcus
KEAEYI

SEQ ID NO: 1854737 - protein, 7 aa, Staphylococcus
KEAGGHI

SEQ ID NO: 1854738 - protein, 16 aa, Staphylococcus
KEAGPLTWNSSKAKVK

SEQ ID NO: 1854739 - protein, 8 aa, Staphylococcus
KEAGSANG

SEQ ID NO: 1854740 - protein, 7 aa, Staphylococcus
KEAGSGL

SEQ ID NO: 1854741 - protein, 17 aa, Staphylococcus
KEAHSKEEIGCNNPNCS

SEQ ID NO: 1854742 - protein, 9 aa, Staphylococcus
KEAHSRNEI

SEQ ID NO: 1854743 - protein, 4 aa, Staphylococcus
KEAI

SEQ ID NO: 1854744 - protein, 5 aa, Staphylococcus
KEAIS

SEQ ID NO: 1854745 - protein, 14 aa, Staphylococcus
KEAKGKKTLNQDTF

SEQ ID NO: 1854746 - protein, 4 aa, Staphylococcus
KEAL

SEQ ID NO: 1854747 - protein, 46 aa, Staphylococcus
KEAQEEKEEQEQQHDPSQQEVERQSTSDDNDDDVYEEKKQDHREEG

SEQ ID NO: 1854748 - protein, 22 aa, Staphylococcus
KEAQKKCKSGESITIKNGEASI

SEQ ID NO: 1854749 - protein, 49 aa, Staphylococcus
KEAQQEEKEKKEQQSQDVSQHDVEQSSSNKESNVEQYEGKKQDHREEDE

SEQ ID NO: 1854750 - protein, 6 aa, Staphylococcus
KEAREN

SEQ ID NO: 1854751 - protein, 5 aa, Staphylococcus
KEARI

SEQ ID NO: 1854752 - protein, 6 aa, Staphylococcus
KEARVL

SEQ ID NO: 1854753 - protein, 6 aa, Staphylococcus
KEASFK

SEQ ID NO: 1854754 - protein, 5 aa, Staphylococcus
KEASS

SEQ ID NO: 1854755 - protein, 12 aa, Staphylococcus
KEASSISDKELK

SEQ ID NO: 1854756 - protein, 8 aa, Staphylococcus
KEATETAT

SEQ ID NO: 1854757 - protein, 8 aa, Staphylococcus
KEATKYVR

SEQ ID NO: 1854758 - protein, 11 aa, Staphylococcus
KEATPEEKSRV

SEQ ID NO: 1854759 - protein, 4 aa, Staphylococcus
KEDA

SEQ ID NO: 1854760 - protein, 5 aa, Staphylococcus
KEDAI

SEQ ID NO: 1854761 - protein, 14 aa, Staphylococcus
KEDDKPDKDDIEVQ

SEQ ID NO: 1854762 - protein, 16 aa, Staphylococcus
KEDDQPDKDDIEVQRN

SEQ ID NO: 1854763 - protein, 7 aa, Staphylococcus
KEDDSQV

SEQ ID NO: 1854764 - protein, 8 aa, Staphylococcus
KEDKELIK

SEQ ID NO: 1854765 - protein, 32 aa, Staphylococcus
KEDKLNSMESTHQTEQNNKCDNVNGSNNNQHT

SEQ ID NO: 1854766 - protein, 12 aa, Staphylococcus
KEDKLPKKAHEV

SEQ ID NO: 1854767 - protein, 27 aa, Staphylococcus
KEDKQTDWSKDKLENTELQSPTGQSVE

SEQ ID NO: 1854768 - protein, 5 aa, Staphylococcus
KEDKV

SEQ ID NO: 1854769 - protein, 4 aa, Staphylococcus
KEDM

SEQ ID NO: 1854770 - protein, 5 aa, Staphylococcus
KEDMP

SEQ ID NO: 1854771 - protein, 6 aa, Staphylococcus
KEDNIN

SEQ ID NO: 1854772 - protein, 7 aa, Staphylococcus
KEDNRNK

SEQ ID NO: 1854773 - protein, 7 aa, Staphylococcus
KEDNVNI

SEQ ID NO: 1854774 - protein, 10 aa, Staphylococcus
KEDSRQDYHK

SEQ ID NO: 1854775 - protein, 10 aa, Staphylococcus
KEDSTANDQA

SEQ ID NO: 1854776 - protein, 5 aa, Staphylococcus
KEDTE

SEQ ID NO: 1854777 - protein, 7 aa, Staphylococcus
KEDYPVK

SEQ ID NO: 1854778 - protein, 7 aa, Staphylococcus
KEEAIKK

SEQ ID NO: 1854779 - protein, 5 aa, Staphylococcus
KEEAL

SEQ ID NO: 1854780 - protein, 32 aa, Staphylococcus
KEEAPANTNTNNKTPNLVTQSDETDDSKQGAI

SEQ ID NO: 1854781 - protein, 13 aa, Staphylococcus
KEEATYARAVDGD

SEQ ID NO: 1854782 - protein, 7 aa, Staphylococcus
KEEDAIQ

SEQ ID NO: 1854783 - protein, 13 aa, Staphylococcus
KEEDSVANDESAP

SEQ ID NO: 1854784 - protein, 7 aa, Staphylococcus
KEEEEQS

SEQ ID NO: 1854785 - protein, 17 aa, Staphylococcus
KEEERHRKNEKEDDPFK

SEQ ID NO: 1854786 - protein, 7 aa, Staphylococcus
KEEGHIT

SEQ ID NO: 1854787 - protein, 9 aa, Staphylococcus
KEEGNSHKE

SEQ ID NO: 1854788 - protein, 8 aa, Staphylococcus
KEEGQLNT

SEQ ID NO: 1854789 - protein, 6 aa, Staphylococcus
KEEIDE

SEQ ID NO: 1854790 - protein, 5 aa, Staphylococcus
KEEKG

SEQ ID NO: 1854791 - protein, 11 aa, Staphylococcus
KEELGKDQSNF

SEQ ID NO: 1854792 - protein, 26 aa, Staphylococcus
KEERAKHQNKVDDTNTQSNGNNRNDL

SEQ ID NO: 1854793 - protein, 6 aa, Staphylococcus
KEERLK

SEQ ID NO: 1854794 - protein, 9 aa, Staphylococcus
KEETKAENY

SEQ ID NO: 1854795 - protein, 12 aa, Staphylococcus
KEETKYSAKKGV

SEQ ID NO: 1854796 - protein, 50 aa, Staphylococcus
KEEVTQPSTSVENERAVTGSKEAIENNKTSQSDVSDSVGSFSVPETPVQS

SEQ ID NO: 1854797 - protein, 4 aa, Staphylococcus
KEEW

SEQ ID NO: 1854798 - protein, 6 aa, Staphylococcus
KEEYRH

SEQ ID NO: 1854799 - protein, 20 aa, Staphylococcus
KEFAPSKYKNQDNTTSTAKD

SEQ ID NO: 1854800 - protein, 11 aa, Staphylococcus
KEFGATPGLGG

SEQ ID NO: 1854801 - protein, 11 aa, Staphylococcus
KEFHQDSEKAS

SEQ ID NO: 1854802 - protein, 8 aa, Staphylococcus
KEFKNKNL

SEQ ID NO: 1854803 - protein, 18 aa, Staphylococcus
KEFNDNRKRKKHAKSTQF

SEQ ID NO: 1854804 - protein, 4 aa, Staphylococcus
KEGA

SEQ ID NO: 1854805 - protein, 8 aa, Staphylococcus
KEGDDELR

SEQ ID NO: 1854806 - protein, 5 aa, Staphylococcus
KEGGV

SEQ ID NO: 1854807 - protein, 4 aa, Staphylococcus
KEGH

SEQ ID NO: 1854808 - protein, 5 aa, Staphylococcus
KEGHF

SEQ ID NO: 1854809 - protein, 7 aa, Staphylococcus
KEGITKK

SEQ ID NO: 1854810 - protein, 8 aa, Staphylococcus
KEGKKEKM

SEQ ID NO: 1854811 - protein, 22 aa, Staphylococcus
KEGQKNCKSGQTISISNGEAVA

SEQ ID NO: 1854812 - protein, 22 aa, Staphylococcus
KEGQKQCRSGETITISNGEAIA

SEQ ID NO: 1854813 - protein, 5 aa, Staphylococcus
KEGRN

SEQ ID NO: 1854814 - protein, 5 aa, Staphylococcus
KEGTT

SEQ ID NO: 1854815 - protein, 6 aa, Staphylococcus
KEGTTV

SEQ ID NO: 1854816 - protein, 6 aa, Staphylococcus
KEGVEW

SEQ ID NO: 1854817 - protein, 5 aa, Staphylococcus
KEGYI

SEQ ID NO: 1854818 - protein, 5 aa, Staphylococcus
KEHAI

SEQ ID NO: 1854819 - protein, 24 aa, Staphylococcus
KEHAYKDHVSTSKSNQTEEAQLDR

SEQ ID NO: 1854820 - protein, 6 aa, Staphylococcus
KEHDNL

SEQ ID NO: 1854821 - protein, 4 aa, Staphylococcus
KEHG

SEQ ID NO: 1854822 - protein, 22 aa, Staphylococcus
KEHGGSGNSKGAKVVSKKNKKK

SEQ ID NO: 1854823 - protein, 7 aa, Staphylococcus
KEHGKNV

SEQ ID NO: 1854824 - protein, 22 aa, Staphylococcus
KEHNPSSNKKGKNTQVVSKKNK

SEQ ID NO: 1854825 - protein, 13 aa, Staphylococcus
KEHPEIKKPLNKL

SEQ ID NO: 1854826 - protein, 23 aa, Staphylococcus
KEHPEIKKPLNKLEGKISDEDMQ

SEQ ID NO: 1854827 - protein, 31 aa, Staphylococcus
KEHPKASDKTIKAIAEKEQKRYITQQIKDMM

SEQ ID NO: 1854828 - protein, 7 aa, Staphylococcus
KEHSSVK

SEQ ID NO: 1854829 - protein, 5 aa, Staphylococcus
KEIEA

SEQ ID NO: 1854830 - protein, 14 aa, Staphylococcus
KEIGDEYKVPPKRM

SEQ ID NO: 1854831 - protein, 6 aa, Staphylococcus
KEIGEA

SEQ ID NO: 1854832 - protein, 14 aa, Staphylococcus
KEIGLASDNAGVDD

SEQ ID NO: 1854833 - protein, 27 aa, Staphylococcus
KEINEEGKLDKDKDTKIKSVGETTEID

SEQ ID NO: 1854834 - protein, 17 aa, Staphylococcus
KEINQVEEQDMSDSTKK

SEQ ID NO: 1854835 - protein, 6 aa, Staphylococcus
KEIPET

SEQ ID NO: 1854836 - protein, 11 aa, Staphylococcus
KEIQKKNNNDL

SEQ ID NO: 1854837 - protein, 6 aa, Staphylococcus
KEIREA

SEQ ID NO: 1854838 - protein, 10 aa, Staphylococcus
KEISDKDQKA

SEQ ID NO: 1854839 - protein, 16 aa, Staphylococcus
KEISDKQRDKESMQSN

SEQ ID NO: 1854840 - protein, 9 aa, Staphylococcus
KEISEQDQK

SEQ ID NO: 1854841 - protein, 10 aa, Staphylococcus
KEISEQDQKE

SEQ ID NO: 1854842 - protein, 10 aa, Staphylococcus
KEISEQDQKG

SEQ ID NO: 1854843 - protein, 4 aa, Staphylococcus
KEIT

SEQ ID NO: 1854844 - protein, 11 aa, Staphylococcus
KEKADKTELEK

SEQ ID NO: 1854845 - protein, 8 aa, Staphylococcus
KEKDVPAE

SEQ ID NO: 1854846 - protein, 8 aa, Staphylococcus
KEKEQLNK

SEQ ID NO: 1854847 - protein, 8 aa, Staphylococcus
KEKFNPNW

SEQ ID NO: 1854848 - protein, 8 aa, Staphylococcus
KEKGITPA

SEQ ID NO: 1854849 - protein, 7 aa, Staphylococcus
KEKGYRS

SEQ ID NO: 1854850 - protein, 5 aa, Staphylococcus
KEKHV

SEQ ID NO: 1854851 - protein, 5 aa, Staphylococcus
KEKHY

SEQ ID NO: 1854852 - protein, 4 aa, Staphylococcus
KEKL

SEQ ID NO: 1854853 - protein, 8 aa, Staphylococcus
KEKLTEQN

SEQ ID NO: 1854854 - protein, 9 aa, Staphylococcus
KEKNDRYGR

SEQ ID NO: 1854855 - protein, 6 aa, Staphylococcus
KEKNFD

SEQ ID NO: 1854856 - protein, 6 aa, Staphylococcus
KEKNFN

SEQ ID NO: 1854857 - protein, 5 aa, Staphylococcus
KEKNY

SEQ ID NO: 1854858 - protein, 9 aa, Staphylococcus
KEKPEDQAI

SEQ ID NO: 1854859 - protein, 7 aa, Staphylococcus
KEKQGLE

SEQ ID NO: 1854860 - protein, 5 aa, Staphylococcus
KEKQH

SEQ ID NO: 1854861 - protein, 45 aa, Staphylococcus
KEKQHELSTSEAQAVDPVSTQEIDDSELTNDDINVTTNETNAKDE

SEQ ID NO: 1854862 - protein, 42 aa, Staphylococcus
KEKQMQESHDEALEKERIENKKTVTKQKENYEATVNSKEREI

SEQ ID NO: 1854863 - protein, 14 aa, Staphylococcus
KEKRAKRRKRQKQI

SEQ ID NO: 1854864 - protein, 7 aa, Staphylococcus
KEKRGTA

SEQ ID NO: 1854865 - protein, 5 aa, Staphylococcus
KEKSI

SEQ ID NO: 1854866 - protein, 8 aa, Staphylococcus
KEKSKLDS

SEQ ID NO: 1854867 - protein, 8 aa, Staphylococcus
KEKYGPNW

SEQ ID NO: 1854868 - protein, 6 aa, Staphylococcus
KEKYGV

SEQ ID NO: 1854869 - protein, 8 aa, Staphylococcus
KEKYSPNW

SEQ ID NO: 1854870 - protein, 9 aa, Staphylococcus
KEKYSPNWE

SEQ ID NO: 1854871 - protein, 8 aa, Staphylococcus
KEKYSPQW

SEQ ID NO: 1854872 - protein, 6 aa, Staphylococcus
KELDNR

SEQ ID NO: 1854873 - protein, 37 aa, Staphylococcus
KELEGSDKIDQAISSQLASNKMNDDQYINNKRDTLKA

SEQ ID NO: 1854874 - protein, 6 aa, Staphylococcus
KELEKN

SEQ ID NO: 1854875 - protein, 6 aa, Staphylococcus
KELGAT

SEQ ID NO: 1854876 - protein, 19 aa, Staphylococcus
KELGTDNVERMKGAPEDAR

SEQ ID NO: 1854877 - protein, 8 aa, Staphylococcus
KELHPKNL

SEQ ID NO: 1854878 - protein, 43 aa, Staphylococcus
KELKAQRKQEKAEIKARKREKRKAYNQRMKEKRKNQPSAVNQR

SEQ ID NO: 1854879 - protein, 6 aa, Staphylococcus
KELNDT

SEQ ID NO: 1854880 - protein, 6 aa, Staphylococcus
KELNSN

SEQ ID NO: 1854881 - protein, 17 aa, Staphylococcus
KELQESTSFIFNLLFLI

SEQ ID NO: 1854882 - protein, 4 aa, Staphylococcus
KELT

SEQ ID NO: 1854883 - protein, 10 aa, Staphylococcus
KELTANDQNI

SEQ ID NO: 1854884 - protein, 11 aa, Staphylococcus
KELTDADQNIG

SEQ ID NO: 1854885 - protein, 8 aa, Staphylococcus
KELTGGKN

SEQ ID NO: 1854886 - protein, 6 aa, Staphylococcus
KELTQT

SEQ ID NO: 1854887 - protein, 7 aa, Staphylococcus
KEMKYDA

SEQ ID NO: 1854888 - protein, 7 aa, Staphylococcus
KENAARR

SEQ ID NO: 1854889 - protein, 9 aa, Staphylococcus
KENAPEPPI

SEQ ID NO: 1854890 - protein, 8 aa, Staphylococcus
KENDDRRY

SEQ ID NO: 1854891 - protein, 5 aa, Staphylococcus
KENDY

SEQ ID NO: 1854892 - protein, 9 aa, Staphylococcus
KENENGAPV

SEQ ID NO: 1854893 - protein, 6 aa, Staphylococcus
KENFGK

SEQ ID NO: 1854894 - protein, 15 aa, Staphylococcus
KENGEYEDLDPNRTY

SEQ ID NO: 1854895 - protein, 13 aa, Staphylococcus
KENGLGKKSGLKI

SEQ ID NO: 1854896 - protein, 7 aa, Staphylococcus
KENHTTI

SEQ ID NO: 1854897 - protein, 37 aa, Staphylococcus
KENIAEKDKVKASINYTDGDKDKKDTYDDALKEAEKL

SEQ ID NO: 1854898 - protein, 6 aa, Staphylococcus
KENKIK

SEQ ID NO: 1854899 - protein, 9 aa, Staphylococcus
KENKNKAPI

SEQ ID NO: 1854900 - protein, 10 aa, Staphylococcus
KENKNKAPVN

SEQ ID NO: 1854901 - protein, 5 aa, Staphylococcus
KENLY

SEQ ID NO: 1854902 - protein, 24 aa, Staphylococcus
KENMNETFTTQNQDADQGESEDSF

SEQ ID NO: 1854903 - protein, 5 aa, Staphylococcus
KENND

SEQ ID NO: 1854904 - protein, 7 aa, Staphylococcus
KENNDAK

SEQ ID NO: 1854905 - protein, 10 aa, Staphylococcus
KENNLTQDQL

SEQ ID NO: 1854906 - protein, 24 aa, Staphylococcus
KENNSNSNKKGKNTQVVSKNNKKK

SEQ ID NO: 1854907 - protein, 19 aa, Staphylococcus
KENQNEDLSKNQSDVLPKG

SEQ ID NO: 1854908 - protein, 22 aa, Staphylococcus
KENQRSCKTGETISISNGEAVA

SEQ ID NO: 1854909 - protein, 14 aa, Staphylococcus
KENREAAQKSKNPF

SEQ ID NO: 1854910 - protein, 14 aa, Staphylococcus
KENSLGEKSGLKKD

SEQ ID NO: 1854911 - protein, 7 aa, Staphylococcus
KENTDVS

SEQ ID NO: 1854912 - protein, 8 aa, Staphylococcus
KENTHTQE

SEQ ID NO: 1854913 - protein, 9 aa, Staphylococcus
KENTITEPK

SEQ ID NO: 1854914 - protein, 6 aa, Staphylococcus
KENTKA

SEQ ID NO: 1854915 - protein, 8 aa, Staphylococcus
KENTSTVN

SEQ ID NO: 1854916 - protein, 6 aa, Staphylococcus
KENVGH

SEQ ID NO: 1854917 - protein, 6 aa, Staphylococcus
KEPDFN

SEQ ID NO: 1854918 - protein, 10 aa, Staphylococcus
KEPDNRYDTN

SEQ ID NO: 1854919 - protein, 56 aa, Staphylococcus
KEPEEDLEAATEKMEASKGKKSSVSSKLKGNEDNNATSTTASTSTSENNEEQSEEA

SEQ ID NO: 1854920 - protein, 5 aa, Staphylococcus
KEPKD

SEQ ID NO: 1854921 - protein, 18 aa, Staphylococcus
KEPKIEKSQLDSNQQNKI

SEQ ID NO: 1854922 - protein, 62 aa, Staphylococcus
KEPKQDLEAATAKMESTKGKKSSVSSKLTGATTGTGAAGVAANKANGEDQNEASSEDEEEDL

SEQ ID NO: 1854923 - protein, 70 aa, Staphylococcus
KEPKQDLESATAQMEATKGKKSNVSSKLTHSDKEATRSNVQNASAAGTTGVTTSSTENEKENDEDNTEQL

SEQ ID NO: 1854924 - protein, 58 aa, Staphylococcus
KEPKQDLESATAQMEATKGKKSSVSSKLSSKENNQEASATAGATSTEESNNTEDDADQ

SEQ ID NO: 1854925 - protein, 5 aa, Staphylococcus
KEPLD

SEQ ID NO: 1854926 - protein, 6 aa, Staphylococcus
KEPLDI

SEQ ID NO: 1854927 - protein, 13 aa, Staphylococcus
KEPLDTKKVDNAW

SEQ ID NO: 1854928 - protein, 25 aa, Staphylococcus
KEPLESAKQQLQNNIDSAPSTVGMT

SEQ ID NO: 1854929 - protein, 10 aa, Staphylococcus
KEPLKTQKVE

SEQ ID NO: 1854930 - protein, 9 aa, Staphylococcus
KEPNDIAKQ

SEQ ID NO: 1854931 - protein, 7 aa, Staphylococcus
KEPNQHI

SEQ ID NO: 1854932 - protein, 5 aa, Staphylococcus
KEPQH

SEQ ID NO: 1854933 - protein, 16 aa, Staphylococcus
KEPQIEKSHLSSKQQM

SEQ ID NO: 1854934 - protein, 10 aa, Staphylococcus
KEPSDGAWSS

SEQ ID NO: 1854935 - protein, 6 aa, Staphylococcus
KEPTLI

SEQ ID NO: 1854936 - protein, 4 aa, Staphylococcus
KEPW

SEQ ID NO: 1854937 - protein, 12 aa, Staphylococcus
KEQAENTVNSVR

SEQ ID NO: 1854938 - protein, 9 aa, Staphylococcus
KEQAETNFN

SEQ ID NO: 1854939 - protein, 11 aa, Staphylococcus
KEQEMKASVQE

SEQ ID NO: 1854940 - protein, 10 aa, Staphylococcus
KEQGGSKDIQ

SEQ ID NO: 1854941 - protein, 9 aa, Staphylococcus
KEQGLTQDQ

SEQ ID NO: 1854942 - protein, 20 aa, Staphylococcus
KEQKSSNNNDSSESESSSPF

SEQ ID NO: 1854943 - protein, 5 aa, Staphylococcus
KEQLA

SEQ ID NO: 1854944 - protein, 11 aa, Staphylococcus
KEQLEENEKTI

SEQ ID NO: 1854945 - protein, 5 aa, Staphylococcus
KEQMA

SEQ ID NO: 1854946 - protein, 7 aa, Staphylococcus
KEQNERF

SEQ ID NO: 1854947 - protein, 8 aa, Staphylococcus
KEQNPSNV

SEQ ID NO: 1854948 - protein, 7 aa, Staphylococcus
KEQPEKL

SEQ ID NO: 1854949 - protein, 6 aa, Staphylococcus
KEQQES

SEQ ID NO: 1854950 - protein, 9 aa, Staphylococcus
KEQQKQFKY

SEQ ID NO: 1854951 - protein, 13 aa, Staphylococcus
KEQRSIEKSEHTD

SEQ ID NO: 1854952 - protein, 16 aa, Staphylococcus
KEQTRTSSSQSQSQFA

SEQ ID NO: 1854953 - protein, 33 aa, Staphylococcus
KERAKLDVDQAAKSRKEVINNNNDATREEKDTA

SEQ ID NO: 1854954 - protein, 7 aa, Staphylococcus
KERATTK

SEQ ID NO: 1854955 - protein, 38 aa, Staphylococcus
KEREERVQREHEAKKLEKEREAKLAKNNEERVKDNLRK

SEQ ID NO: 1854956 - protein, 6 aa, Staphylococcus
KERKEL

SEQ ID NO: 1854957 - protein, 7 aa, Staphylococcus
KERKKLD

SEQ ID NO: 1854958 - protein, 8 aa, Staphylococcus
KERNRIGQ

SEQ ID NO: 1854959 - protein, 5 aa, Staphylococcus
KERQR

SEQ ID NO: 1854960 - protein, 6 aa, Staphylococcus
KERQRA

SEQ ID NO: 1854961 - protein, 11 aa, Staphylococcus
KERTEDSAINS

SEQ ID NO: 1854962 - protein, 7 aa, Staphylococcus
KERTSKE

SEQ ID NO: 1854963 - protein, 13 aa, Staphylococcus
KESAEYQSKMKGP

SEQ ID NO: 1854964 - protein, 9 aa, Staphylococcus
KESAGYQKK

SEQ ID NO: 1854965 - protein, 6 aa, Staphylococcus
KESAVR

SEQ ID NO: 1854966 - protein, 13 aa, Staphylococcus
KESDIKKGINDHE

SEQ ID NO: 1854967 - protein, 6 aa, Staphylococcus
KESDRI

SEQ ID NO: 1854968 - protein, 9 aa, Staphylococcus
KESEHISDN

SEQ ID NO: 1854969 - protein, 8 aa, Staphylococcus
KESETYGP

SEQ ID NO: 1854970 - protein, 6 aa, Staphylococcus
KESFQK

SEQ ID NO: 1854971 - protein, 4 aa, Staphylococcus
KESG

SEQ ID NO: 1854972 - protein, 8 aa, Staphylococcus
KESGNTEY

SEQ ID NO: 1854973 - protein, 7 aa, Staphylococcus
KESGQRV

SEQ ID NO: 1854974 - protein, 7 aa, Staphylococcus
KESIEQQ

SEQ ID NO: 1854975 - protein, 8 aa, Staphylococcus
KESNTYGP

SEQ ID NO: 1854976 - protein, 8 aa, Staphylococcus
KESQRLAQ

SEQ ID NO: 1854977 - protein, 5 aa, Staphylococcus
KESQY

SEQ ID NO: 1854978 - protein, 5 aa, Staphylococcus
KESRF

SEQ ID NO: 1854979 - protein, 9 aa, Staphylococcus
KESRQDYKN

SEQ ID NO: 1854980 - protein, 8 aa, Staphylococcus
KESTEIKA

SEQ ID NO: 1854981 - protein, 6 aa, Staphylococcus
KESTRF

SEQ ID NO: 1854982 - protein, 8 aa, Staphylococcus
KESTTSSP

SEQ ID NO: 1854983 - protein, 4 aa, Staphylococcus
KESV

SEQ ID NO: 1854984 - protein, 20 aa, Staphylococcus
KESVKDVKESVNDLKDSFKD

SEQ ID NO: 1854985 - protein, 13 aa, Staphylococcus
KESVSQEKEQKVN

SEQ ID NO: 1854986 - protein, 4 aa, Staphylococcus
KETA

SEQ ID NO: 1854987 - protein, 9 aa, Staphylococcus
KETAAGAFG

SEQ ID NO: 1854988 - protein, 6 aa, Staphylococcus
KETAVR

SEQ ID NO: 1854989 - protein, 7 aa, Staphylococcus
KETGNNH

SEQ ID NO: 1854990 - protein, 34 aa, Staphylococcus
KETHQTTNSDKNASTEKNNENVKDTKDNDDVTKD

SEQ ID NO: 1854991 - protein, 4 aa, Staphylococcus
KETI

SEQ ID NO: 1854992 - protein, 6 aa, Staphylococcus
KETIDK

SEQ ID NO: 1854993 - protein, 21 aa, Staphylococcus
KETKHEREDMREIPKSSIKDE

SEQ ID NO: 1854994 - protein, 14 aa, Staphylococcus
KETKNQEYNPNKVK

SEQ ID NO: 1854995 - protein, 6 aa, Staphylococcus
KETKRM

SEQ ID NO: 1854996 - protein, 8 aa, Staphylococcus
KETQNEES

SEQ ID NO: 1854997 - protein, 6 aa, Staphylococcus
KETSML

SEQ ID NO: 1854998 - protein, 22 aa, Staphylococcus
KETVGDKNAINRKGQMPPSSNA

SEQ ID NO: 1854999 - protein, 24 aa, Staphylococcus
KETVGDKNAINRKGQMPPSSNAYV

SEQ ID NO: 1855000 - protein, 12 aa, Staphylococcus
KEVAASRARGMS

SEQ ID NO: 1855001 - protein, 6 aa, Staphylococcus
KEVASS

SEQ ID NO: 1855002 - protein, 6 aa, Staphylococcus
KEVDKA

SEQ ID NO: 1855003 - protein, 6 aa, Staphylococcus
KEVEAA

SEQ ID NO: 1855004 - protein, 19 aa, Staphylococcus
KEVEHASSDDAKADKLGEL

SEQ ID NO: 1855005 - protein, 6 aa, Staphylococcus
KEVKTL

SEQ ID NO: 1855006 - protein, 18 aa, Staphylococcus
KEVPETSTSTTETRQGIE

SEQ ID NO: 1855007 - protein, 12 aa, Staphylococcus
KEVPRQERDHQP

SEQ ID NO: 1855008 - protein, 4 aa, Staphylococcus
KEVQ

SEQ ID NO: 1855009 - protein, 6 aa, Staphylococcus
KEVQKK

SEQ ID NO: 1855010 - protein, 5 aa, Staphylococcus
KEVQP

SEQ ID NO: 1855011 - protein, 6 aa, Staphylococcus
KEVQPI

SEQ ID NO: 1855012 - protein, 4 aa, Staphylococcus
KEVR

SEQ ID NO: 1855013 - protein, 8 aa, Staphylococcus
KEVSASEW

SEQ ID NO: 1855014 - protein, 10 aa, Staphylococcus
KEVSDDERSR

SEQ ID NO: 1855015 - protein, 16 aa, Staphylococcus
KEVTFKRSNRELPEHD

SEQ ID NO: 1855016 - protein, 11 aa, Staphylococcus
KEYDSPSSIKK

SEQ ID NO: 1855017 - protein, 5 aa, Staphylococcus
KEYFT

SEQ ID NO: 1855018 - protein, 7 aa, Staphylococcus
KEYGTNS

SEQ ID NO: 1855019 - protein, 20 aa, Staphylococcus
KEYNSTEELKNRARIREERR

SEQ ID NO: 1855020 - protein, 5 aa, Staphylococcus
KEYRH

SEQ ID NO: 1855021 - protein, 5 aa, Staphylococcus
KFDEI

SEQ ID NO: 1855022 - protein, 11 aa, Staphylococcus
KFDKTTNDKFT

SEQ ID NO: 1855023 - protein, 4 aa, Staphylococcus
KFDR

SEQ ID NO: 1855024 - protein, 5 aa, Staphylococcus
KFDSD

SEQ ID NO: 1855025 - protein, 5 aa, Staphylococcus
KFDSN

SEQ ID NO: 1855026 - protein, 10 aa, Staphylococcus
KFEAGKQNLQ

SEQ ID NO: 1855027 - protein, 11 aa, Staphylococcus
KFEGKSTTITN

SEQ ID NO: 1855028 - protein, 8 aa, Staphylococcus
KFGAPRDV

SEQ ID NO: 1855029 - protein, 8 aa, Staphylococcus
KFGEGYNG

SEQ ID NO: 1855030 - protein, 6 aa, Staphylococcus
KFGGGA

SEQ ID NO: 1855031 - protein, 7 aa, Staphylococcus
KFGGKPV

SEQ ID NO: 1855032 - protein, 7 aa, Staphylococcus
KFGGRPV

SEQ ID NO: 1855033 - protein, 6 aa, Staphylococcus
KFGSFN

SEQ ID NO: 1855034 - protein, 8 aa, Staphylococcus
KFGSPKEI

SEQ ID NO: 1855035 - protein, 8 aa, Staphylococcus
KFGSPKEV

SEQ ID NO: 1855036 - protein, 10 aa, Staphylococcus
KFIEDNKQKY

SEQ ID NO: 1855037 - protein, 16 aa, Staphylococcus
KFKESAKTAVTQFKNS

SEQ ID NO: 1855038 - protein, 12 aa, Staphylococcus
KFKGESTTIDNT

SEQ ID NO: 1855039 - protein, 12 aa, Staphylococcus
KFKKDNDNSGKN

SEQ ID NO: 1855040 - protein, 7 aa, Staphylococcus
KFKMPGG

SEQ ID NO: 1855041 - protein, 8 aa, Staphylococcus
KFKTPSDM

SEQ ID NO: 1855042 - protein, 16 aa, Staphylococcus
KFNDISQDTVTKFKNS

SEQ ID NO: 1855043 - protein, 6 aa, Staphylococcus
KFNEKG

SEQ ID NO: 1855044 - protein, 8 aa, Staphylococcus
KFNNKSKF

SEQ ID NO: 1855045 - protein, 12 aa, Staphylococcus
KFNNSEQEMGKA

SEQ ID NO: 1855046 - protein, 6 aa, Staphylococcus
KFPPLE

SEQ ID NO: 1855047 - protein, 6 aa, Staphylococcus
KFPSQH

SEQ ID NO: 1855048 - protein, 4 aa, Staphylococcus
KFPT

SEQ ID NO: 1855049 - protein, 9 aa, Staphylococcus
KFQNSSKTT

SEQ ID NO: 1855050 - protein, 10 aa, Staphylococcus
KFQSSSKATL

SEQ ID NO: 1855051 - protein, 14 aa, Staphylococcus
KFQTEGEQGDKKAY

SEQ ID NO: 1855052 - protein, 14 aa, Staphylococcus
KFQTGKDAVHGITG

SEQ ID NO: 1855053 - protein, 9 aa, Staphylococcus
KFRENGGQV

SEQ ID NO: 1855054 - protein, 17 aa, Staphylococcus
KFRSDIKKSEEKDQDYI

SEQ ID NO: 1855055 - protein, 7 aa, Staphylococcus
KFTSPDE

SEQ ID NO: 1855056 - protein, 7 aa, Staphylococcus
KGAAQGD

SEQ ID NO: 1855057 - protein, 9 aa, Staphylococcus
KGADKSEVN

SEQ ID NO: 1855058 - protein, 5 aa, Staphylococcus
KGAGI

SEQ ID NO: 1855059 - protein, 6 aa, Staphylococcus
KGAGSL

SEQ ID NO: 1855060 - protein, 7 aa, Staphylococcus
KGAHLPE

SEQ ID NO: 1855061 - protein, 18 aa, Staphylococcus
KGAKGDKGDKGDNGTSIG

SEQ ID NO: 1855062 - protein, 70 aa, Staphylococcus
KGAKGDKGDTGAQGAAGQDGTSVTITSTETTPEGATKVNFSDGKSITIPKGQDGTSVTVQSSAPDADGNT

SEQ ID NO: 1855063 - protein, 21 aa, Staphylococcus
KGAKGDKGDVGAKGADGHSIT

SEQ ID NO: 1855064 - protein, 10 aa, Staphylococcus
KGANMQAATI

SEQ ID NO: 1855065 - protein, 7 aa, Staphylococcus
KGAPNSM

SEQ ID NO: 1855066 - protein, 5 aa, Staphylococcus
KGARN

SEQ ID NO: 1855067 - protein, 9 aa, Staphylococcus
KGASGKTPL

SEQ ID NO: 1855068 - protein, 5 aa, Staphylococcus
KGASL

SEQ ID NO: 1855069 - protein, 6 aa, Staphylococcus
KGASLS

SEQ ID NO: 1855070 - protein, 10 aa, Staphylococcus
KGASMQAATI

SEQ ID NO: 1855071 - protein, 9 aa, Staphylococcus
KGATANNTM

SEQ ID NO: 1855072 - protein, 11 aa, Staphylococcus
KGAYDQSFGLG

SEQ ID NO: 1855073 - protein, 8 aa, Staphylococcus
KGDKKQEI

SEQ ID NO: 1855074 - protein, 7 aa, Staphylococcus
KGDKLDG

SEQ ID NO: 1855075 - protein, 7 aa, Staphylococcus
KGDKQFK

SEQ ID NO: 1855076 - protein, 15 aa, Staphylococcus
KGDKVKGLTPSRSQL

SEQ ID NO: 1855077 - protein, 5 aa, Staphylococcus
KGDPV

SEQ ID NO: 1855078 - protein, 13 aa, Staphylococcus
KGDSFKKLKTTGK

SEQ ID NO: 1855079 - protein, 13 aa, Staphylococcus
KGDSFKKVDKQGK

SEQ ID NO: 1855080 - protein, 7 aa, Staphylococcus
KGDSQFG

SEQ ID NO: 1855081 - protein, 38 aa, Staphylococcus
KGDSYHKELEKPEDKRKYVSAASVDQPINSDSVEISGG

SEQ ID NO: 1855082 - protein, 49 aa, Staphylococcus
KGDSYHKELEKPEDKRKYVSAASVDQPINSDSVEISGGFQGQQGVERAK

SEQ ID NO: 1855083 - protein, 39 aa, Staphylococcus
KGDSYHKELQKKNENDRKYVSAASVNQPINSDSVEISGG

SEQ ID NO: 1855084 - protein, 17 aa, Staphylococcus
KGDSYKKEADKKDPKFV

SEQ ID NO: 1855085 - protein, 23 aa, Staphylococcus
KGDSYKKEAKKQQEGKDPKYVSA

SEQ ID NO: 1855086 - protein, 20 aa, Staphylococcus
KGDSYQKEKDKKDPKYVSAA

SEQ ID NO: 1855087 - protein, 14 aa, Staphylococcus
KGDTFEKIDKSGKW

SEQ ID NO: 1855088 - protein, 13 aa, Staphylococcus
KGDTFTRLSKSGK

SEQ ID NO: 1855089 - protein, 6 aa, Staphylococcus
KGDTIT

SEQ ID NO: 1855090 - protein, 30 aa, Staphylococcus
KGDVSAKATRGSESVTSDPVEALNTDPQHR

SEQ ID NO: 1855091 - protein, 5 aa, Staphylococcus
KGDYI

SEQ ID NO: 1855092 - protein, 6 aa, Staphylococcus
KGEAGL

SEQ ID NO: 1855093 - protein, 14 aa, Staphylococcus
KGEDYVVPFSLPII

SEQ ID NO: 1855094 - protein, 8 aa, Staphylococcus
KGEEVETN

SEQ ID NO: 1855095 - protein, 4 aa, Staphylococcus
KGEF

SEQ ID NO: 1855096 - protein, 14 aa, Staphylococcus
KGEHEIDGKKYEVK

SEQ ID NO: 1855097 - protein, 14 aa, Staphylococcus
KGEHELDGKTYDVK

SEQ ID NO: 1855098 - protein, 30 aa, Staphylococcus
KGEKGDKGDAGQNGQSITVESSNPDADGNT

SEQ ID NO: 1855099 - protein, 11 aa, Staphylococcus
KGEKGRASSAL

SEQ ID NO: 1855100 - protein, 8 aa, Staphylococcus
KGENDPTP

SEQ ID NO: 1855101 - protein, 6 aa, Staphylococcus
KGEPIN

SEQ ID NO: 1855102 - protein, 6 aa, Staphylococcus
KGEQIK

SEQ ID NO: 1855103 - protein, 10 aa, Staphylococcus
KGEQKINGKK

SEQ ID NO: 1855104 - protein, 6 aa, Staphylococcus
KGETIN

SEQ ID NO: 1855105 - protein, 22 aa, Staphylococcus
KGETPEEAALKHDDNNQNHYNE

SEQ ID NO: 1855106 - protein, 4 aa, Staphylococcus
KGEV

SEQ ID NO: 1855107 - protein, 5 aa, Staphylococcus
KGEYD

SEQ ID NO: 1855108 - protein, 11 aa, Staphylococcus
KGFERTSNQQS

SEQ ID NO: 1855109 - protein, 16 aa, Staphylococcus
KGFGDKTYEKLKDYLT

SEQ ID NO: 1855110 - protein, 16 aa, Staphylococcus
KGFGEKTFEKLKEHLV

SEQ ID NO: 1855111 - protein, 16 aa, Staphylococcus
KGFGSKTFEKLKEYFT

SEQ ID NO: 1855112 - protein, 6 aa, Staphylococcus
KGFNTS

SEQ ID NO: 1855113 - protein, 5 aa, Staphylococcus
KGFTE

SEQ ID NO: 1855114 - protein, 5 aa, Staphylococcus
KGGED

SEQ ID NO: 1855115 - protein, 10 aa, Staphylococcus
KGGFGLPQGT

SEQ ID NO: 1855116 - protein, 13 aa, Staphylococcus
KGGREWEEKGDLE

SEQ ID NO: 1855117 - protein, 6 aa, Staphylococcus
KGGTNV

SEQ ID NO: 1855118 - protein, 11 aa, Staphylococcus
KGGYSPKELSE

SEQ ID NO: 1855119 - protein, 5 aa, Staphylococcus
KGHAT

SEQ ID NO: 1855120 - protein, 18 aa, Staphylococcus
KGHGSSHGNPETYSSNIE

SEQ ID NO: 1855121 - protein, 39 aa, Staphylococcus
KGHTDEESEKSEAPHHQTEDKAHHSVDNEKFEERFKDKD

SEQ ID NO: 1855122 - protein, 8 aa, Staphylococcus
KGHVDGGW

SEQ ID NO: 1855123 - protein, 8 aa, Staphylococcus
KGIANGQK

SEQ ID NO: 1855124 - protein, 6 aa, Staphylococcus
KGIATT

SEQ ID NO: 1855125 - protein, 15 aa, Staphylococcus
KGIESHQLKQSDEAL

SEQ ID NO: 1855126 - protein, 5 aa, Staphylococcus
KGIGD

SEQ ID NO: 1855127 - protein, 18 aa, Staphylococcus
KGIGDSIQDLDGSVDRVT

SEQ ID NO: 1855128 - protein, 21 aa, Staphylococcus
KGIGDSVQNLNGSIDKVTNSI

SEQ ID NO: 1855129 - protein, 11 aa, Staphylococcus
KGIGDSVQTLN

SEQ ID NO: 1855130 - protein, 11 aa, Staphylococcus
KGIGMKPGRRL

SEQ ID NO: 1855131 - protein, 6 aa, Staphylococcus
KGIGST

SEQ ID NO: 1855132 - protein, 10 aa, Staphylococcus
KGIGTNASLE

SEQ ID NO: 1855133 - protein, 4 aa, Staphylococcus
KGIH

SEQ ID NO: 1855134 - protein, 8 aa, Staphylococcus
KGIKNGRK

SEQ ID NO: 1855135 - protein, 16 aa, Staphylococcus
KGINNVKSDLSETYQQ

SEQ ID NO: 1855136 - protein, 6 aa, Staphylococcus
KGIPES

SEQ ID NO: 1855137 - protein, 10 aa, Staphylococcus
KGIRDKGPDY

SEQ ID NO: 1855138 - protein, 10 aa, Staphylococcus
KGIRDKGPKY

SEQ ID NO: 1855139 - protein, 7 aa, Staphylococcus
KGISESG

SEQ ID NO: 1855140 - protein, 8 aa, Staphylococcus
KGISGDMK

SEQ ID NO: 1855141 - protein, 8 aa, Staphylococcus
KGISPAKQ

SEQ ID NO: 1855142 - protein, 7 aa, Staphylococcus
KGITGRY

SEQ ID NO: 1855143 - protein, 14 aa, Staphylococcus
KGITPDKKIEEPAY

SEQ ID NO: 1855144 - protein, 6 aa, Staphylococcus
KGIYDR

SEQ ID NO: 1855145 - protein, 6 aa, Staphylococcus
KGKDFK

SEQ ID NO: 1855146 - protein, 32 aa, Staphylococcus
KGKDKKEDSKKDSDSSDDKKDNHTTSVKNYTE

SEQ ID NO: 1855147 - protein, 14 aa, Staphylococcus
KGKELNHKPGDTFE

SEQ ID NO: 1855148 - protein, 14 aa, Staphylococcus
KGKELNNAPGDSFE

SEQ ID NO: 1855149 - protein, 31 aa, Staphylococcus
KGKESDSDDDKSKEDDSEDSSAKGIKNYNES

SEQ ID NO: 1855150 - protein, 8 aa, Staphylococcus
KGKETPRN

SEQ ID NO: 1855151 - protein, 15 aa, Staphylococcus
KGKGYLNNHPDSVNP

SEQ ID NO: 1855152 - protein, 21 aa, Staphylococcus
KGKHKEAIKASNDASKEAKDM

SEQ ID NO: 1855153 - protein, 9 aa, Staphylococcus
KGKHQINGK

SEQ ID NO: 1855154 - protein, 7 aa, Staphylococcus
KGKKFNA

SEQ ID NO: 1855155 - protein, 18 aa, Staphylococcus
KGKKKEMKYTTDKSGEVI

SEQ ID NO: 1855156 - protein, 9 aa, Staphylococcus
KGKMENSEN

SEQ ID NO: 1855157 - protein, 17 aa, Staphylococcus
KGKNGKSKSKKNKNVKR

SEQ ID NO: 1855158 - protein, 9 aa, Staphylococcus
KGKQVEGEI

SEQ ID NO: 1855159 - protein, 4 aa, Staphylococcus
KGKS

SEQ ID NO: 1855160 - protein, 10 aa, Staphylococcus
KGKSDLDKDS

SEQ ID NO: 1855161 - protein, 11 aa, Staphylococcus
KGKSKSTEEIK

SEQ ID NO: 1855162 - protein, 14 aa, Staphylococcus
KGKSNKSQEAGVGS

SEQ ID NO: 1855163 - protein, 6 aa, Staphylococcus
KGKSNR

SEQ ID NO: 1855164 - protein, 13 aa, Staphylococcus
KGKSSKPEEAGIG

SEQ ID NO: 1855165 - protein, 14 aa, Staphylococcus
KGKSYKKSYNMNNR

SEQ ID NO: 1855166 - protein, 4 aa, Staphylococcus
KGKT

SEQ ID NO: 1855167 - protein, 8 aa, Staphylococcus
KGKTAGYT

SEQ ID NO: 1855168 - protein, 9 aa, Staphylococcus
KGKTAGYTV

SEQ ID NO: 1855169 - protein, 58 aa, Staphylococcus
KGKTPEEAALEHDDNNQNHYNENTTYEYNDETSTAEETNYEVDKNAEALEDEDKESIK

SEQ ID NO: 1855170 - protein, 9 aa, Staphylococcus
KGKTSIDES

SEQ ID NO: 1855171 - protein, 35 aa, Staphylococcus
KGKTSSKDEDKDSEKSKSSSEDKSDDTQKVKNYTE

SEQ ID NO: 1855172 - protein, 12 aa, Staphylococcus
KGKVIERDNEHH

SEQ ID NO: 1855173 - protein, 6 aa, Staphylococcus
KGKYGK

SEQ ID NO: 1855174 - protein, 7 aa, Staphylococcus
KGLEKTS

SEQ ID NO: 1855175 - protein, 9 aa, Staphylococcus
KGLETEDAF

SEQ ID NO: 1855176 - protein, 7 aa, Staphylococcus
KGLRKDQ

SEQ ID NO: 1855177 - protein, 7 aa, Staphylococcus
KGLSSGV

SEQ ID NO: 1855178 - protein, 13 aa, Staphylococcus
KGLTRSGKITLLR

SEQ ID NO: 1855179 - protein, 11 aa, Staphylococcus
KGMAPKEIKAT

SEQ ID NO: 1855180 - protein, 7 aa, Staphylococcus
KGMEQAS

SEQ ID NO: 1855181 - protein, 9 aa, Staphylococcus
KGMEQASKS

SEQ ID NO: 1855182 - protein, 6 aa, Staphylococcus
KGMGGT

SEQ ID NO: 1855183 - protein, 6 aa, Staphylococcus
KGMNKK

SEQ ID NO: 1855184 - protein, 11 aa, Staphylococcus
KGMTKEQKLAN

SEQ ID NO: 1855185 - protein, 8 aa, Staphylococcus
KGMTYGNA

SEQ ID NO: 1855186 - protein, 5 aa, Staphylococcus
KGNAS

SEQ ID NO: 1855187 - protein, 7 aa, Staphylococcus
KGNFQSS

SEQ ID NO: 1855188 - protein, 5 aa, Staphylococcus
KGNGF

SEQ ID NO: 1855189 - protein, 6 aa, Staphylococcus
KGNHKL

SEQ ID NO: 1855190 - protein, 22 aa, Staphylococcus
KGNHNVSTSEINKQLNANSGER

SEQ ID NO: 1855191 - protein, 5 aa, Staphylococcus
KGNHR

SEQ ID NO: 1855192 - protein, 7 aa, Staphylococcus
KGNIPPN

SEQ ID NO: 1855193 - protein, 11 aa, Staphylococcus
KGNKEGKDVKS

SEQ ID NO: 1855194 - protein, 7 aa, Staphylococcus
KGNKKTR

SEQ ID NO: 1855195 - protein, 9 aa, Staphylococcus
KGNKPTYRI

SEQ ID NO: 1855196 - protein, 17 aa, Staphylococcus
KGNNGKSKQKQNKSVKR

SEQ ID NO: 1855197 - protein, 7 aa, Staphylococcus
KGNPFTN

SEQ ID NO: 1855198 - protein, 4 aa, Staphylococcus
KGNS

SEQ ID NO: 1855199 - protein, 8 aa, Staphylococcus
KGNTVEVN

SEQ ID NO: 1855200 - protein, 12 aa, Staphylococcus
KGNVDPQQLQEQ

SEQ ID NO: 1855201 - protein, 7 aa, Staphylococcus
KGPEKVT

SEQ ID NO: 1855202 - protein, 7 aa, Staphylococcus
KGPELTE

SEQ ID NO: 1855203 - protein, 8 aa, Staphylococcus
KGPERAKM

SEQ ID NO: 1855204 - protein, 7 aa, Staphylococcus
KGPETVK

SEQ ID NO: 1855205 - protein, 8 aa, Staphylococcus
KGPKKAHM

SEQ ID NO: 1855206 - protein, 7 aa, Staphylococcus
KGPQKVK

SEQ ID NO: 1855207 - protein, 7 aa, Staphylococcus
KGQDQHS

SEQ ID NO: 1855208 - protein, 6 aa, Staphylococcus
KGQDRK

SEQ ID NO: 1855209 - protein, 4 aa, Staphylococcus
KGQE

SEQ ID NO: 1855210 - protein, 14 aa, Staphylococcus
KGQHDFNGQHSHHG

SEQ ID NO: 1855211 - protein, 6 aa, Staphylococcus
KGQHRI

SEQ ID NO: 1855212 - protein, 5 aa, Staphylococcus
KGQIP

SEQ ID NO: 1855213 - protein, 5 aa, Staphylococcus
KGQLP

SEQ ID NO: 1855214 - protein, 7 aa, Staphylococcus
KGQNQHS

SEQ ID NO: 1855215 - protein, 8 aa, Staphylococcus
KGQPESHP

SEQ ID NO: 1855216 - protein, 9 aa, Staphylococcus
KGQSATQNV

SEQ ID NO: 1855217 - protein, 5 aa, Staphylococcus
KGQSL

SEQ ID NO: 1855218 - protein, 7 aa, Staphylococcus
KGQTSNN

SEQ ID NO: 1855219 - protein, 14 aa, Staphylococcus
KGQVSLDGQNISQL

SEQ ID NO: 1855220 - protein, 8 aa, Staphylococcus
KGQYRTND

SEQ ID NO: 1855221 - protein, 7 aa, Staphylococcus
KGRAQGD

SEQ ID NO: 1855222 - protein, 8 aa, Staphylococcus
KGRARNNP

SEQ ID NO: 1855223 - protein, 9 aa, Staphylococcus
KGRDKDEVN

SEQ ID NO: 1855224 - protein, 14 aa, Staphylococcus
KGRELNNKPGDQFE

SEQ ID NO: 1855225 - protein, 5 aa, Staphylococcus
KGRIA

SEQ ID NO: 1855226 - protein, 6 aa, Staphylococcus
KGRKNL

SEQ ID NO: 1855227 - protein, 9 aa, Staphylococcus
KGRKYHMNG

SEQ ID NO: 1855228 - protein, 7 aa, Staphylococcus
KGRRGPA

SEQ ID NO: 1855229 - protein, 21 aa, Staphylococcus
KGRRITPPRSPKNPELHLNIH

SEQ ID NO: 1855230 - protein, 5 aa, Staphylococcus
KGRSI

SEQ ID NO: 1855231 - protein, 5 aa, Staphylococcus
KGRTT

SEQ ID NO: 1855232 - protein, 16 aa, Staphylococcus
KGRYTSGADFGNGGTE

SEQ ID NO: 1855233 - protein, 10 aa, Staphylococcus
KGSAFSSGER

SEQ ID NO: 1855234 - protein, 8 aa, Staphylococcus
KGSAQGDV

SEQ ID NO: 1855235 - protein, 10 aa, Staphylococcus
KGSASASEVF

SEQ ID NO: 1855236 - protein, 8 aa, Staphylococcus
KGSATGDV

SEQ ID NO: 1855237 - protein, 9 aa, Staphylococcus
KGSDKFSRV

SEQ ID NO: 1855238 - protein, 8 aa, Staphylococcus
KGSDSFSR

SEQ ID NO: 1855239 - protein, 8 aa, Staphylococcus
KGSDVEKA

SEQ ID NO: 1855240 - protein, 10 aa, Staphylococcus
KGSDYSTASL

SEQ ID NO: 1855241 - protein, 10 aa, Staphylococcus
KGSLTGGISV

SEQ ID NO: 1855242 - protein, 9 aa, Staphylococcus
KGSNSETVD

SEQ ID NO: 1855243 - protein, 4 aa, Staphylococcus
KGSS

SEQ ID NO: 1855244 - protein, 9 aa, Staphylococcus
KGSSSYDKV

SEQ ID NO: 1855245 - protein, 6 aa, Staphylococcus
KGSSYP

SEQ ID NO: 1855246 - protein, 69 aa, Staphylococcus
KGSTPEEAALKHDDNNENHYNENTKYEYDSTASSKYEKNYDVDPTPNDKHSEQESFADKIKDKFDKDNN

SEQ ID NO: 1855247 - protein, 9 aa, Staphylococcus
KGSTSIDES

SEQ ID NO: 1855248 - protein, 7 aa, Staphylococcus
KGTDMQG

SEQ ID NO: 1855249 - protein, 8 aa, Staphylococcus
KGTGAKKP

SEQ ID NO: 1855250 - protein, 11 aa, Staphylococcus
KGTKGDAGDSV

SEQ ID NO: 1855251 - protein, 18 aa, Staphylococcus
KGTKKQMKYTTDKSGKVI

SEQ ID NO: 1855252 - protein, 7 aa, Staphylococcus
KGTKTQM

SEQ ID NO: 1855253 - protein, 5 aa, Staphylococcus
KGTNV

SEQ ID NO: 1855254 - protein, 8 aa, Staphylococcus
KGTPEVNT

SEQ ID NO: 1855255 - protein, 6 aa, Staphylococcus
KGTPFE

SEQ ID NO: 1855256 - protein, 11 aa, Staphylococcus
KGTPKTSSQPF

SEQ ID NO: 1855257 - protein, 6 aa, Staphylococcus
KGTPMA

SEQ ID NO: 1855258 - protein, 8 aa, Staphylococcus
KGTTEHKI

SEQ ID NO: 1855259 - protein, 7 aa, Staphylococcus
KGTTQGK

SEQ ID NO: 1855260 - protein, 9 aa, Staphylococcus
KGTTTVDES

SEQ ID NO: 1855261 - protein, 9 aa, Staphylococcus
KGTVKAVDE

SEQ ID NO: 1855262 - protein, 10 aa, Staphylococcus
KGTVKSVDET

SEQ ID NO: 1855263 - protein, 10 aa, Staphylococcus
KGTVRSVDET

SEQ ID NO: 1855264 - protein, 15 aa, Staphylococcus
KGTYQDIQTPMDGSA

SEQ ID NO: 1855265 - protein, 15 aa, Staphylococcus
KGVKGDKGENGTSIS

SEQ ID NO: 1855266 - protein, 6 aa, Staphylococcus
KGVKSV

SEQ ID NO: 1855267 - protein, 5 aa, Staphylococcus
KGVPR

SEQ ID NO: 1855268 - protein, 8 aa, Staphylococcus
KGVSEDMK

SEQ ID NO: 1855269 - protein, 8 aa, Staphylococcus
KGVSGDMK

SEQ ID NO: 1855270 - protein, 12 aa, Staphylococcus
KGVSQNQLSEAG

SEQ ID NO: 1855271 - protein, 9 aa, Staphylococcus
KGVSSDMKM

SEQ ID NO: 1855272 - protein, 6 aa, Staphylococcus
KGVTEI

SEQ ID NO: 1855273 - protein, 8 aa, Staphylococcus
KGVTPDMK

SEQ ID NO: 1855274 - protein, 6 aa, Staphylococcus
KGYDMT

SEQ ID NO: 1855275 - protein, 5 aa, Staphylococcus
KGYPN

SEQ ID NO: 1855276 - protein, 7 aa, Staphylococcus
KGYSGAT

SEQ ID NO: 1855277 - protein, 8 aa, Staphylococcus
KGYSGATV

SEQ ID NO: 1855278 - protein, 10 aa, Staphylococcus
KGYSRNDRVG

SEQ ID NO: 1855279 - protein, 8 aa, Staphylococcus
KGYTKHEE

SEQ ID NO: 1855280 - protein, 5 aa, Staphylococcus
KGYVK

SEQ ID NO: 1855281 - protein, 9 aa, Staphylococcus
KHADTSQIK

SEQ ID NO: 1855282 - protein, 5 aa, Staphylococcus
KHAGD

SEQ ID NO: 1855283 - protein, 23 aa, Staphylococcus
KHALNGAQKLQDDKNNAKQEIGN

SEQ ID NO: 1855284 - protein, 4 aa, Staphylococcus
KHAP

SEQ ID NO: 1855285 - protein, 5 aa, Staphylococcus
KHDDI

SEQ ID NO: 1855286 - protein, 7 aa, Staphylococcus
KHDGDVT

SEQ ID NO: 1855287 - protein, 16 aa, Staphylococcus
KHDKDVTISNYAQSSS

SEQ ID NO: 1855288 - protein, 6 aa, Staphylococcus
KHDKGI

SEQ ID NO: 1855289 - protein, 20 aa, Staphylococcus
KHDLNGDEKVTEAKANAAQH

SEQ ID NO: 1855290 - protein, 25 aa, Staphylococcus
KHDMYGNADYNDHYKRDHHDVNANN

SEQ ID NO: 1855291 - protein, 7 aa, Staphylococcus
KHDNEHL

SEQ ID NO: 1855292 - protein, 6 aa, Staphylococcus
KHDRVK

SEQ ID NO: 1855293 - protein, 6 aa, Staphylococcus
KHDTKA

SEQ ID NO: 1855294 - protein, 23 aa, Staphylococcus
KHDYKDKKGETKTTASTGNEYED

SEQ ID NO: 1855295 - protein, 7 aa, Staphylococcus
KHEGNSK

SEQ ID NO: 1855296 - protein, 5 aa, Staphylococcus
KHELP

SEQ ID NO: 1855297 - protein, 18 aa, Staphylococcus
KHEMDSSEEYGPYPPDEK

SEQ ID NO: 1855298 - protein, 19 aa, Staphylococcus
KHESPLTMQGKASPDSVKS

SEQ ID NO: 1855299 - protein, 7 aa, Staphylococcus
KHETSVK

SEQ ID NO: 1855300 - protein, 13 aa, Staphylococcus
KHFEEAAYSPNEY

SEQ ID NO: 1855301 - protein, 17 aa, Staphylococcus
KHGNLVKNKTKKFDSVS

SEQ ID NO: 1855302 - protein, 6 aa, Staphylococcus
KHGNQL

SEQ ID NO: 1855303 - protein, 4 aa, Staphylococcus
KHGV

SEQ ID NO: 1855304 - protein, 4 aa, Staphylococcus
KHHK

SEQ ID NO: 1855305 - protein, 6 aa, Staphylococcus
KHHSDK

SEQ ID NO: 1855306 - protein, 11 aa, Staphylococcus
KHIGGEKQRNM

SEQ ID NO: 1855307 - protein, 8 aa, Staphylococcus
KHKAERRL

SEQ ID NO: 1855308 - protein, 17 aa, Staphylococcus
KHKHDSDELLDDKTWSD

SEQ ID NO: 1855309 - protein, 5 aa, Staphylococcus
KHKTI

SEQ ID NO: 1855310 - protein, 6 aa, Staphylococcus
KHKVGK

SEQ ID NO: 1855311 - protein, 4 aa, Staphylococcus
KHLP

SEQ ID NO: 1855312 - protein, 4 aa, Staphylococcus
KHLS

SEQ ID NO: 1855313 - protein, 21 aa, Staphylococcus
KHNKVNQQVEQTKHESHVSNE

SEQ ID NO: 1855314 - protein, 6 aa, Staphylococcus
KHNKVT

SEQ ID NO: 1855315 - protein, 6 aa, Staphylococcus
KHNNDQ

SEQ ID NO: 1855316 - protein, 7 aa, Staphylococcus
KHNPPTV

SEQ ID NO: 1855317 - protein, 7 aa, Staphylococcus
KHNPSTV

SEQ ID NO: 1855318 - protein, 7 aa, Staphylococcus
KHNSPRQ

SEQ ID NO: 1855319 - protein, 7 aa, Staphylococcus
KHNSSKQ

SEQ ID NO: 1855320 - protein, 10 aa, Staphylococcus
KHNYGTSNEL

SEQ ID NO: 1855321 - protein, 6 aa, Staphylococcus
KHPARW

SEQ ID NO: 1855322 - protein, 10 aa, Staphylococcus
KHPDQDHGNY

SEQ ID NO: 1855323 - protein, 7 aa, Staphylococcus
KHPGDGK

SEQ ID NO: 1855324 - protein, 20 aa, Staphylococcus
KHPGEWSNQDMGTGGSNNAL

SEQ ID NO: 1855325 - protein, 8 aa, Staphylococcus
KHPGNGHT

SEQ ID NO: 1855326 - protein, 21 aa, Staphylococcus
KHPGQWKNQDLGTGAGNDSIE

SEQ ID NO: 1855327 - protein, 6 aa, Staphylococcus
KHPGTW

SEQ ID NO: 1855328 - protein, 6 aa, Staphylococcus
KHPKDL

SEQ ID NO: 1855329 - protein, 17 aa, Staphylococcus
KHPLSETQVNTIVENFH

SEQ ID NO: 1855330 - protein, 16 aa, Staphylococcus
KHPLTKDQVEQVTQQF

SEQ ID NO: 1855331 - protein, 7 aa, Staphylococcus
KHPPRFQ

SEQ ID NO: 1855332 - protein, 6 aa, Staphylococcus
KHPPRW

SEQ ID NO: 1855333 - protein, 8 aa, Staphylococcus
KHPSDANI

SEQ ID NO: 1855334 - protein, 5 aa, Staphylococcus
KHPST

SEQ ID NO: 1855335 - protein, 5 aa, Staphylococcus
KHQAE

SEQ ID NO: 1855336 - protein, 5 aa, Staphylococcus
KHQEI

SEQ ID NO: 1855337 - protein, 9 aa, Staphylococcus
KHQKKKPTL

SEQ ID NO: 1855338 - protein, 7 aa, Staphylococcus
KHQKQHS

SEQ ID NO: 1855339 - protein, 16 aa, Staphylococcus
KHQQDKLSSSHQQLDR

SEQ ID NO: 1855340 - protein, 14 aa, Staphylococcus
KHQSSEVKSDEQAE

SEQ ID NO: 1855341 - protein, 8 aa, Staphylococcus
KHSEGDIV

SEQ ID NO: 1855342 - protein, 8 aa, Staphylococcus
KHSGTTSE

SEQ ID NO: 1855343 - protein, 6 aa, Staphylococcus
KHSNKI

SEQ ID NO: 1855344 - protein, 7 aa, Staphylococcus
KHSNSSR

SEQ ID NO: 1855345 - protein, 8 aa, Staphylococcus
KHSTVTDS

SEQ ID NO: 1855346 - protein, 30 aa, Staphylococcus
KHTATGKDEDYKVDKDPEDKHEEDASLTEK

SEQ ID NO: 1855347 - protein, 14 aa, Staphylococcus
KHTPHGTASIGTKK

SEQ ID NO: 1855348 - protein, 29 aa, Staphylococcus
KHVNSEENAFSEEVNTSDENATKKDDNFK

SEQ ID NO: 1855349 - protein, 6 aa, Staphylococcus
KHVSPD

SEQ ID NO: 1855350 - protein, 9 aa, Staphylococcus
KHYNQPSDQ

SEQ ID NO: 1855351 - protein, 12 aa, Staphylococcus
KIAEPNSNVDED

SEQ ID NO: 1855352 - protein, 15 aa, Staphylococcus
KIAGNDNVSKSTIDK

SEQ ID NO: 1855353 - protein, 6 aa, Staphylococcus
KIAKDN

SEQ ID NO: 1855354 - protein, 149 aa, Staphylococcus
KIAKENDPAYIEKKGEKLAKQNRKEAEKMDKKLQKNIEKRHKEEDKLREDNQKQRIKDMKKTQKYEEKVGLTPGKLDEKTEKKGEKLEKENRKEAKKMDKKLQKNIEKRHKKEDKLRDEAEKARKKEFKKYKDYTAKSVVKQNKEADQE

SEQ ID NO: 1855355 - protein, 131 aa, Staphylococcus
KIAKENDPAYIEKKGEKLAKQNRKEAEKMNKKLQKNIEKRHKEEEKQREENKKQRIKDMKKSQKYEEKVGLTPGKLDDKTEKKGEKLEKDNRKDVKKLDKKLQKNIEKRHKQEEKQQETEKKARKKEFKKY

SEQ ID NO: 1855356 - protein, 96 aa, Staphylococcus
KIAKENDPEYIEKKGEKLAKKNRKEADKMDKKLQKNIEQRHKEEAKAREKNEKQRIKDLKKTQKYQEKVGLTPGALDDETEKKGEKLAKDNKHDIK

SEQ ID NO: 1855357 - protein, 126 aa, Staphylococcus
KIAKENDPEYIQKKGEKLAKKNYKEADKMNKKLQKNIEQRHKEEEKEREKNEKQRIKDMKKTQKYQEKVGLTPGKLDDETEKKGEKLEKDNKKDVNKLDKKLQKNIDKRHKEEEKLQKQEEKARIK

SEQ ID NO: 1855358 - protein, 58 aa, Staphylococcus
KIAKESDPKYIKKKGSKLAKKNHKQSSKLEKKLQKNIDKRHKEEEKIQKHNEKQRIKE

SEQ ID NO: 1855359 - protein, 30 aa, Staphylococcus
KIASPTSGQIKSFDAKEGDKLSKGDKVATV

SEQ ID NO: 1855360 - protein, 6 aa, Staphylococcus
KIDEPY

SEQ ID NO: 1855361 - protein, 6 aa, Staphylococcus
KIDGLN

SEQ ID NO: 1855362 - protein, 23 aa, Staphylococcus
KIDGNNQSYKNLEKELKDSNESK

SEQ ID NO: 1855363 - protein, 17 aa, Staphylococcus
KIDGNSIKKIPKTELKE

SEQ ID NO: 1855364 - protein, 17 aa, Staphylococcus
KIDGSSSNSKSKKQVYT

SEQ ID NO: 1855365 - protein, 8 aa, Staphylococcus
KIDKPNHV

SEQ ID NO: 1855366 - protein, 7 aa, Staphylococcus
KIDLEDA

SEQ ID NO: 1855367 - protein, 6 aa, Staphylococcus
KIDTKY

SEQ ID NO: 1855368 - protein, 4 aa, Staphylococcus
KIEA

SEQ ID NO: 1855369 - protein, 6 aa, Staphylococcus
KIEESN

SEQ ID NO: 1855370 - protein, 17 aa, Staphylococcus
KIEGEGYNNTFSTGNLK

SEQ ID NO: 1855371 - protein, 5 aa, Staphylococcus
KIENE

SEQ ID NO: 1855372 - protein, 5 aa, Staphylococcus
KIENR

SEQ ID NO: 1855373 - protein, 48 aa, Staphylococcus
KIESAKNNIQNGQNSQNAIDSAQSEVNQLKDKATNNGDNNLTDQYQNA

SEQ ID NO: 1855374 - protein, 10 aa, Staphylococcus
KIEYEERSRI

SEQ ID NO: 1855375 - protein, 15 aa, Staphylococcus
KIEYGGVTSQNADLD

SEQ ID NO: 1855376 - protein, 6 aa, Staphylococcus
KIGGKL

SEQ ID NO: 1855377 - protein, 19 aa, Staphylococcus
KIGKTSVHSESGTGSALEN

SEQ ID NO: 1855378 - protein, 7 aa, Staphylococcus
KIGPTMG

SEQ ID NO: 1855379 - protein, 31 aa, Staphylococcus
KIGTSKSKIEKKFGKSEGVREVNGNDAQQYG

SEQ ID NO: 1855380 - protein, 23 aa, Staphylococcus
KIGVQKQTQQEKIAQSEIDNAQV

SEQ ID NO: 1855381 - protein, 6 aa, Staphylococcus
KIKENI

SEQ ID NO: 1855382 - protein, 4 aa, Staphylococcus
KIKH

SEQ ID NO: 1855383 - protein, 11 aa, Staphylococcus
KIKKEETLYSA

SEQ ID NO: 1855384 - protein, 5 aa, Staphylococcus
KIKKN

SEQ ID NO: 1855385 - protein, 14 aa, Staphylococcus
KIKKQDNLYSAKKG

SEQ ID NO: 1855386 - protein, 19 aa, Staphylococcus
KIKNAGAVGVTKSGKHSTQ

SEQ ID NO: 1855387 - protein, 18 aa, Staphylococcus
KIKNAGAVGVTKSGNHSA

SEQ ID NO: 1855388 - protein, 5 aa, Staphylococcus
KIKNN

SEQ ID NO: 1855389 - protein, 5 aa, Staphylococcus
KIKPL

SEQ ID NO: 1855390 - protein, 10 aa, Staphylococcus
KIKPNGEMTD

SEQ ID NO: 1855391 - protein, 18 aa, Staphylococcus
KIKSGSDVKSIKMGDSST

SEQ ID NO: 1855392 - protein, 47 aa, Staphylococcus
KIKSHPDVQKASHATSHATHTVANKASSVKDYFGDKKQEFDNKRELK

SEQ ID NO: 1855393 - protein, 10 aa, Staphylococcus
KIKSPDSIKD

SEQ ID NO: 1855394 - protein, 10 aa, Staphylococcus
KIKTDSADGY

SEQ ID NO: 1855395 - protein, 7 aa, Staphylococcus
KINDTAK

SEQ ID NO: 1855396 - protein, 7 aa, Staphylococcus
KINEEKA

SEQ ID NO: 1855397 - protein, 14 aa, Staphylococcus
KINENDKKNIKEIG

SEQ ID NO: 1855398 - protein, 6 aa, Staphylococcus
KINEPY

SEQ ID NO: 1855399 - protein, 20 aa, Staphylococcus
KINEQSKDSSKDKLKANSTN

SEQ ID NO: 1855400 - protein, 6 aa, Staphylococcus
KINPGQ

SEQ ID NO: 1855401 - protein, 17 aa, Staphylococcus
KINQTPKATKEEKEAAI

SEQ ID NO: 1855402 - protein, 18 aa, Staphylococcus
KINSYVEKKEKEENSLKN

SEQ ID NO: 1855403 - protein, 7 aa, Staphylococcus
KIPDSIQ

SEQ ID NO: 1855404 - protein, 5 aa, Staphylococcus
KIPES

SEQ ID NO: 1855405 - protein, 11 aa, Staphylococcus
KIPGYSENMTN

SEQ ID NO: 1855406 - protein, 9 aa, Staphylococcus
KIPKSRRTS

SEQ ID NO: 1855407 - protein, 8 aa, Staphylococcus
KIPKTRRS

SEQ ID NO: 1855408 - protein, 9 aa, Staphylococcus
KIPKTRRTV

SEQ ID NO: 1855409 - protein, 10 aa, Staphylococcus
KIPQDRDYHK

SEQ ID NO: 1855410 - protein, 5 aa, Staphylococcus
KIPRW

SEQ ID NO: 1855411 - protein, 12 aa, Staphylococcus
KIQTKNASLYTT

SEQ ID NO: 1855412 - protein, 12 aa, Staphylococcus
KIQTKNGSLYTT

SEQ ID NO: 1855413 - protein, 11 aa, Staphylococcus
KIQTKNSSLYT

SEQ ID NO: 1855414 - protein, 12 aa, Staphylococcus
KIQTKNSSLYTK

SEQ ID NO: 1855415 - protein, 12 aa, Staphylococcus
KIQTKNSSLYTT

SEQ ID NO: 1855416 - protein, 18 aa, Staphylococcus
KIRNAGAVGVTKNGHHST

SEQ ID NO: 1855417 - protein, 18 aa, Staphylococcus
KIRNAGAVGVTKNGQHSA

SEQ ID NO: 1855418 - protein, 5 aa, Staphylococcus
KIRNN

SEQ ID NO: 1855419 - protein, 12 aa, Staphylococcus
KIRSKRDKFKSK

SEQ ID NO: 1855420 - protein, 10 aa, Staphylococcus
KISDTPTVPA

SEQ ID NO: 1855421 - protein, 14 aa, Staphylococcus
KISDYVSKKTEEEN

SEQ ID NO: 1855422 - protein, 24 aa, Staphylococcus
KISEGAKDEKASKIEKKDHENGGG

SEQ ID NO: 1855423 - protein, 14 aa, Staphylococcus
KISGDKAREQSQVE

SEQ ID NO: 1855424 - protein, 13 aa, Staphylococcus
KISKKQLNSFSKD

SEQ ID NO: 1855425 - protein, 18 aa, Staphylococcus
KISNKSKRNERNANEAEK

SEQ ID NO: 1855426 - protein, 10 aa, Staphylococcus
KISTSESDKY

SEQ ID NO: 1855427 - protein, 14 aa, Staphylococcus
KITDEQHNKDIKYK

SEQ ID NO: 1855428 - protein, 7 aa, Staphylococcus
KITEDDY

SEQ ID NO: 1855429 - protein, 5 aa, Staphylococcus
KITEG

SEQ ID NO: 1855430 - protein, 7 aa, Staphylococcus
KITIEPY

SEQ ID NO: 1855431 - protein, 7 aa, Staphylococcus
KITKEQR

SEQ ID NO: 1855432 - protein, 4 aa, Staphylococcus
KITP

SEQ ID NO: 1855433 - protein, 28 aa, Staphylococcus
KITPSAYGREGDISALGAQKEFTEEEMP

SEQ ID NO: 1855434 - protein, 5 aa, Staphylococcus
KITPT

SEQ ID NO: 1855435 - protein, 27 aa, Staphylococcus
KITSPEETTVTEEGDKETAEIAAAGGG

SEQ ID NO: 1855436 - protein, 5 aa, Staphylococcus
KITTG

SEQ ID NO: 1855437 - protein, 8 aa, Staphylococcus
KITTRDKQ

SEQ ID NO: 1855438 - protein, 4 aa, Staphylococcus
KITY

SEQ ID NO: 1855439 - protein, 12 aa, Staphylococcus
KIVEKGKHQELM

SEQ ID NO: 1855440 - protein, 10 aa, Staphylococcus
KIVNPSTAAV

SEQ ID NO: 1855441 - protein, 7 aa, Staphylococcus
KKADHDL

SEQ ID NO: 1855442 - protein, 13 aa, Staphylococcus
KKADTQEERNAAN

SEQ ID NO: 1855443 - protein, 14 aa, Staphylococcus
KKAEARKAIDEAAT

SEQ ID NO: 1855444 - protein, 7 aa, Staphylococcus
KKAEELL

SEQ ID NO: 1855445 - protein, 111 aa, Staphylococcus
KKAEKELKNSNKATTTQLKRASEAVEKQSQKHKELDERYKKEETQVEKLRGENKKLSDSNEKVKSTYDKTNKELKQTEKEYNDVNKTIKDHNKNLAAAENQVNNEKASLNN

SEQ ID NO: 1855446 - protein, 32 aa, Staphylococcus
KKAEMKEKVASGEIPPAAIQQTKQKMGNQNVD

SEQ ID NO: 1855447 - protein, 19 aa, Staphylococcus
KKAEMKEKVASGEIPPQAV

SEQ ID NO: 1855448 - protein, 9 aa, Staphylococcus
KKAGQAGYL

SEQ ID NO: 1855449 - protein, 6 aa, Staphylococcus
KKAHEA

SEQ ID NO: 1855450 - protein, 8 aa, Staphylococcus
KKAHENAN

SEQ ID NO: 1855451 - protein, 8 aa, Staphylococcus
KKAHKQGV

SEQ ID NO: 1855452 - protein, 14 aa, Staphylococcus
KKAKVYGSKTFGKG

SEQ ID NO: 1855453 - protein, 9 aa, Staphylococcus
KKAKYDVGQ

SEQ ID NO: 1855454 - protein, 37 aa, Staphylococcus
KKANAKKAIEQAAEAKKALINQNSDATQEEKDAAIQR

SEQ ID NO: 1855455 - protein, 68 aa, Staphylococcus
KKANAKQAIDDAAAKKNEIDQHPTATQEEKDAAKAKVDEEVAKAKRAIDSSTTNDAVDQAKDSGVTTI

SEQ ID NO: 1855456 - protein, 16 aa, Staphylococcus
KKANAQDLNTMSDSDF

SEQ ID NO: 1855457 - protein, 7 aa, Staphylococcus
KKANDQN

SEQ ID NO: 1855458 - protein, 9 aa, Staphylococcus
KKANQITTN

SEQ ID NO: 1855459 - protein, 14 aa, Staphylococcus
KKARQIKKQVNQVQ

SEQ ID NO: 1855460 - protein, 7 aa, Staphylococcus
KKARTLK

SEQ ID NO: 1855461 - protein, 6 aa, Staphylococcus
KKARYN

SEQ ID NO: 1855462 - protein, 14 aa, Staphylococcus
KKASKFKDAQECKK

SEQ ID NO: 1855463 - protein, 9 aa, Staphylococcus
KKATDQTKW

SEQ ID NO: 1855464 - protein, 4 aa, Staphylococcus
KKDA

SEQ ID NO: 1855465 - protein, 6 aa, Staphylococcus
KKDAAI

SEQ ID NO: 1855466 - protein, 27 aa, Staphylococcus
KKDDAKALSKEVTSGANSSHLSEEEAR

SEQ ID NO: 1855467 - protein, 9 aa, Staphylococcus
KKDDDSAVK

SEQ ID NO: 1855468 - protein, 26 aa, Staphylococcus
KKDDEKALSKEVTSGDENLNKEEARA

SEQ ID NO: 1855469 - protein, 5 aa, Staphylococcus
KKDDY

SEQ ID NO: 1855470 - protein, 20 aa, Staphylococcus
KKDEAKAAIDKAAEAKKAEI

SEQ ID NO: 1855471 - protein, 69 aa, Staphylococcus
KKDEAKTAIDKAAEAKKAEIDQTPNATDEEKAAAKAKVDEAVTTAKNAIDQATNNAGVDTAKTNGVDTI

SEQ ID NO: 1855472 - protein, 69 aa, Staphylococcus
KKDEAKTAIDKAAEAKKAEIDQTPNATDEEKAAAKAKVDEAVTTAKNAIDQATNNDGVDTAKSNGLDSI

SEQ ID NO: 1855473 - protein, 68 aa, Staphylococcus
KKDEAKTAIDKAAEAKKAEIDQTPNATDEEKAAAKAKVDEAVTTAKNAIDQATNNNGVDTTKTNGVDA

SEQ ID NO: 1855474 - protein, 69 aa, Staphylococcus
KKDEAKTAIDKAAEAKKTEIDQTPNATDEEKAAAKAKVDEAVTTAKNAIDQATNNAGVDTAKTNGVDSI

SEQ ID NO: 1855475 - protein, 7 aa, Staphylococcus
KKDGERI

SEQ ID NO: 1855476 - protein, 6 aa, Staphylococcus
KKDGIS

SEQ ID NO: 1855477 - protein, 8 aa, Staphylococcus
KKDGITPS

SEQ ID NO: 1855478 - protein, 8 aa, Staphylococcus
KKDIAKLN

SEQ ID NO: 1855479 - protein, 42 aa, Staphylococcus
KKDKETTDDDKVSNDPIKAEKQKAKQSEDEKDKDAIHSQAPK

SEQ ID NO: 1855480 - protein, 9 aa, Staphylococcus
KKDKKGNIT

SEQ ID NO: 1855481 - protein, 7 aa, Staphylococcus
KKDKKLP

SEQ ID NO: 1855482 - protein, 19 aa, Staphylococcus
KKDKRNRQGTNKHEKDVPS

SEQ ID NO: 1855483 - protein, 7 aa, Staphylococcus
KKDPEIL

SEQ ID NO: 1855484 - protein, 6 aa, Staphylococcus
KKDPKY

SEQ ID NO: 1855485 - protein, 47 aa, Staphylococcus
KKDQAKAEIDNVAQAKKAEIDRNSNATEEEKVAAKSKVDEAATTIKQ

SEQ ID NO: 1855486 - protein, 19 aa, Staphylococcus
KKDQQAKKAALTQKNQKGL

SEQ ID NO: 1855487 - protein, 13 aa, Staphylococcus
KKDQQSAETEISG

SEQ ID NO: 1855488 - protein, 50 aa, Staphylococcus
KKDRNNQAHYNQSHNREQFNDNYHENKQSHNKEWDPDKELKNHKKDDPYI

SEQ ID NO: 1855489 - protein, 9 aa, Staphylococcus
KKDRPELQS

SEQ ID NO: 1855490 - protein, 9 aa, Staphylococcus
KKDSDQTKW

SEQ ID NO: 1855491 - protein, 10 aa, Staphylococcus
KKDSKTTAYY

SEQ ID NO: 1855492 - protein, 8 aa, Staphylococcus
KKDSRQMT

SEQ ID NO: 1855493 - protein, 19 aa, Staphylococcus
KKDSRSRQGKNKQEKNLPS

SEQ ID NO: 1855494 - protein, 9 aa, Staphylococcus
KKDTDQTKW

SEQ ID NO: 1855495 - protein, 19 aa, Staphylococcus
KKDTRKRQGINKNEKNLPS

SEQ ID NO: 1855496 - protein, 19 aa, Staphylococcus
KKDTRNRQGQSQEDKNVPS

SEQ ID NO: 1855497 - protein, 6 aa, Staphylococcus
KKDTYY

SEQ ID NO: 1855498 - protein, 4 aa, Staphylococcus
KKDY

SEQ ID NO: 1855499 - protein, 9 aa, Staphylococcus
KKDYADDQT

SEQ ID NO: 1855500 - protein, 26 aa, Staphylococcus
KKDYKDKKGDNTTNSKQTVAGNEYEE

SEQ ID NO: 1855501 - protein, 26 aa, Staphylococcus
KKDYKEKKGDGSTDNSGFQPSNEYEA

SEQ ID NO: 1855502 - protein, 27 aa, Staphylococcus
KKDYKEKKGEDSTDTSGFEPSNEYEEK

SEQ ID NO: 1855503 - protein, 7 aa, Staphylococcus
KKEALTQ

SEQ ID NO: 1855504 - protein, 25 aa, Staphylococcus
KKEDALPSHKNTINTQYKETDTNSR

SEQ ID NO: 1855505 - protein, 7 aa, Staphylococcus
KKEDLTS

SEQ ID NO: 1855506 - protein, 8 aa, Staphylococcus
KKEDNINI

SEQ ID NO: 1855507 - protein, 5 aa, Staphylococcus
KKEDY

SEQ ID NO: 1855508 - protein, 11 aa, Staphylococcus
KKEEEEEEVEE

SEQ ID NO: 1855509 - protein, 10 aa, Staphylococcus
KKEEEEEIEE

SEQ ID NO: 1855510 - protein, 11 aa, Staphylococcus
KKEEPEEEIEE

SEQ ID NO: 1855511 - protein, 11 aa, Staphylococcus
KKEEPEETIEE

SEQ ID NO: 1855512 - protein, 9 aa, Staphylococcus
KKEERKESY

SEQ ID NO: 1855513 - protein, 7 aa, Staphylococcus
KKEGLYD

SEQ ID NO: 1855514 - protein, 15 aa, Staphylococcus
KKEGRNQVMFNPIIK

SEQ ID NO: 1855515 - protein, 17 aa, Staphylococcus
KKEIKNINEKLIKFNSN

SEQ ID NO: 1855516 - protein, 11 aa, Staphylococcus
KKEKEKQSHTS

SEQ ID NO: 1855517 - protein, 7 aa, Staphylococcus
KKEKKLS

SEQ ID NO: 1855518 - protein, 10 aa, Staphylococcus
KKEKSNKGYK

SEQ ID NO: 1855519 - protein, 9 aa, Staphylococcus
KKENKSYNV

SEQ ID NO: 1855520 - protein, 63 aa, Staphylococcus
KKENTQRKNDTETVNSKDEQKQQAANITSAKKNHKQTHQEKPKKTQTEPNKATKENKQDNINN

SEQ ID NO: 1855521 - protein, 44 aa, Staphylococcus
KKEQKAQRKREKAELRAKKKEKRKAYNQRMKEKRKNQPSAVNQR

SEQ ID NO: 1855522 - protein, 8 aa, Staphylococcus
KKEQRGSI

SEQ ID NO: 1855523 - protein, 7 aa, Staphylococcus
KKERNGY

SEQ ID NO: 1855524 - protein, 19 aa, Staphylococcus
KKESRKAEIPTEDDAETTE

SEQ ID NO: 1855525 - protein, 45 aa, Staphylococcus
KKETPISLEGKASPKSVKTYNNNSQIGTFQSPAVDDGQKVKQGDR

SEQ ID NO: 1855526 - protein, 7 aa, Staphylococcus
KKETQNY

SEQ ID NO: 1855527 - protein, 5 aa, Staphylococcus
KKEVE

SEQ ID NO: 1855528 - protein, 9 aa, Staphylococcus
KKEVNDTKI

SEQ ID NO: 1855529 - protein, 5 aa, Staphylococcus
KKEVQ

SEQ ID NO: 1855530 - protein, 15 aa, Staphylococcus
KKEWEQAKKTSLKDN

SEQ ID NO: 1855531 - protein, 7 aa, Staphylococcus
KKFAKDN

SEQ ID NO: 1855532 - protein, 4 aa, Staphylococcus
KKFE

SEQ ID NO: 1855533 - protein, 7 aa, Staphylococcus
KKFEKGM

SEQ ID NO: 1855534 - protein, 11 aa, Staphylococcus
KKFKDMGSRIP

SEQ ID NO: 1855535 - protein, 8 aa, Staphylococcus
KKFNADNE

SEQ ID NO: 1855536 - protein, 4 aa, Staphylococcus
KKFS

SEQ ID NO: 1855537 - protein, 21 aa, Staphylococcus
KKGAIARKSTKKKQQKKDSSI

SEQ ID NO: 1855538 - protein, 6 aa, Staphylococcus
KKGAKV

SEQ ID NO: 1855539 - protein, 21 aa, Staphylococcus
KKGANPNGSHSDQSSTTSGST

SEQ ID NO: 1855540 - protein, 6 aa, Staphylococcus
KKGAVS

SEQ ID NO: 1855541 - protein, 5 aa, Staphylococcus
KKGAY

SEQ ID NO: 1855542 - protein, 23 aa, Staphylococcus
KKGDKLDVTYKNEDPSNTGTTKQ

SEQ ID NO: 1855543 - protein, 8 aa, Staphylococcus
KKGDLSLD

SEQ ID NO: 1855544 - protein, 17 aa, Staphylococcus
KKGDPPHPQHQYEEEDN

SEQ ID NO: 1855545 - protein, 8 aa, Staphylococcus
KKGDTITL

SEQ ID NO: 1855546 - protein, 10 aa, Staphylococcus
KKGDVKPDAE

SEQ ID NO: 1855547 - protein, 13 aa, Staphylococcus
KKGEDVEAQSMTK

SEQ ID NO: 1855548 - protein, 14 aa, Staphylococcus
KKGEEIDNLADNQQ

SEQ ID NO: 1855549 - protein, 10 aa, Staphylococcus
KKGEHSQYNT

SEQ ID NO: 1855550 - protein, 7 aa, Staphylococcus
KKGEVPI

SEQ ID NO: 1855551 - protein, 10 aa, Staphylococcus
KKGFKDGPRT

SEQ ID NO: 1855552 - protein, 11 aa, Staphylococcus
KKGFKDGPRTY

SEQ ID NO: 1855553 - protein, 5 aa, Staphylococcus
KKGIP

SEQ ID NO: 1855554 - protein, 10 aa, Staphylococcus
KKGKANTRNA

SEQ ID NO: 1855555 - protein, 11 aa, Staphylococcus
KKGPNTEATND

SEQ ID NO: 1855556 - protein, 7 aa, Staphylococcus
KKGPQIP

SEQ ID NO: 1855557 - protein, 4 aa, Staphylococcus
KKGQ

SEQ ID NO: 1855558 - protein, 6 aa, Staphylococcus
KKGQAD

SEQ ID NO: 1855559 - protein, 9 aa, Staphylococcus
KKGTTAGYT

SEQ ID NO: 1855560 - protein, 4 aa, Staphylococcus
KKGV

SEQ ID NO: 1855561 - protein, 8 aa, Staphylococcus
KKGVENVT

SEQ ID NO: 1855562 - protein, 7 aa, Staphylococcus
KKHESTQ

SEQ ID NO: 1855563 - protein, 5 aa, Staphylococcus
KKHIG

SEQ ID NO: 1855564 - protein, 9 aa, Staphylococcus
KKHKQGKYL

SEQ ID NO: 1855565 - protein, 10 aa, Staphylococcus
KKHKQGQYLT

SEQ ID NO: 1855566 - protein, 7 aa, Staphylococcus
KKHKQYN

SEQ ID NO: 1855567 - protein, 17 aa, Staphylococcus
KKHPPINKSLNNKDFKA

SEQ ID NO: 1855568 - protein, 9 aa, Staphylococcus
KKHPPKWSN

SEQ ID NO: 1855569 - protein, 8 aa, Staphylococcus
KKHPPRWQ

SEQ ID NO: 1855570 - protein, 19 aa, Staphylococcus
KKHSPTNINSDNDKDFKDG

SEQ ID NO: 1855571 - protein, 5 aa, Staphylococcus
KKIGE

SEQ ID NO: 1855572 - protein, 13 aa, Staphylococcus
KKIKAKPTTRYEI

SEQ ID NO: 1855573 - protein, 15 aa, Staphylococcus
KKIKTNGQSDKQITD

SEQ ID NO: 1855574 - protein, 8 aa, Staphylococcus
KKINKDMR

SEQ ID NO: 1855575 - protein, 22 aa, Staphylococcus
KKINKKMKDGSPEEAEAAAKGN

SEQ ID NO: 1855576 - protein, 29 aa, Staphylococcus
KKINKQMKEDTLEAEQQEPERKEAIQQHN

SEQ ID NO: 1855577 - protein, 18 aa, Staphylococcus
KKINPSKYDYKIGPYGNQ

SEQ ID NO: 1855578 - protein, 4 aa, Staphylococcus
KKIP

SEQ ID NO: 1855579 - protein, 8 aa, Staphylococcus
KKIPGVQD

SEQ ID NO: 1855580 - protein, 22 aa, Staphylococcus
KKIQQNDISEMNKKIDHSNLPS

SEQ ID NO: 1855581 - protein, 13 aa, Staphylococcus
KKIQSDMKDTKGL

SEQ ID NO: 1855582 - protein, 4 aa, Staphylococcus
KKIS

SEQ ID NO: 1855583 - protein, 19 aa, Staphylococcus
KKISEYDYEQYKQKYEKPT

SEQ ID NO: 1855584 - protein, 7 aa, Staphylococcus
KKISPYS

SEQ ID NO: 1855585 - protein, 4 aa, Staphylococcus
KKIT

SEQ ID NO: 1855586 - protein, 12 aa, Staphylococcus
KKKAAKYAKEHS

SEQ ID NO: 1855587 - protein, 16 aa, Staphylococcus
KKKADAEHDKMMSKEH

SEQ ID NO: 1855588 - protein, 14 aa, Staphylococcus
KKKADASAAKSRAE

SEQ ID NO: 1855589 - protein, 8 aa, Staphylococcus
KKKADEFL

SEQ ID NO: 1855590 - protein, 20 aa, Staphylococcus
KKKAEASAKKANAEDKTAHQ

SEQ ID NO: 1855591 - protein, 13 aa, Staphylococcus
KKKAKQSASIEHN

SEQ ID NO: 1855592 - protein, 8 aa, Staphylococcus
KKKAKTTY

SEQ ID NO: 1855593 - protein, 25 aa, Staphylococcus
KKKATQTTDVDKKKVTQSKHTPNYN

SEQ ID NO: 1855594 - protein, 5 aa, Staphylococcus
KKKDI

SEQ ID NO: 1855595 - protein, 8 aa, Staphylococcus
KKKDNYPF

SEQ ID NO: 1855596 - protein, 8 aa, Staphylococcus
KKKDYSAT

SEQ ID NO: 1855597 - protein, 5 aa, Staphylococcus
KKKEA

SEQ ID NO: 1855598 - protein, 5 aa, Staphylococcus
KKKEE

SEQ ID NO: 1855599 - protein, 19 aa, Staphylococcus
KKKEQTNQVQISEKAEASI

SEQ ID NO: 1855600 - protein, 9 aa, Staphylococcus
KKKIDLNAP

SEQ ID NO: 1855601 - protein, 56 aa, Staphylococcus
KKKIKQQTEEEYQQKEQSIKASHEEALEKERIENKKTVTKQKEDYEATVNSKEREI

SEQ ID NO: 1855602 - protein, 10 aa, Staphylococcus
KKKKDGKDIQ

SEQ ID NO: 1855603 - protein, 7 aa, Staphylococcus
KKKKRNA

SEQ ID NO: 1855604 - protein, 5 aa, Staphylococcus
KKKKS

SEQ ID NO: 1855605 - protein, 7 aa, Staphylococcus
KKKKSFI

SEQ ID NO: 1855606 - protein, 9 aa, Staphylococcus
KKKNKPYNL

SEQ ID NO: 1855607 - protein, 30 aa, Staphylococcus
KKKNNEEESNKKVTESSKKKHILKGDDSHV

SEQ ID NO: 1855608 - protein, 11 aa, Staphylococcus
KKKNSEEKSMD

SEQ ID NO: 1855609 - protein, 8 aa, Staphylococcus
KKKRSKKK

SEQ ID NO: 1855610 - protein, 59 aa, Staphylococcus
KKKSKNQKVEQRSTKGSESQSYQSKFKASDLEKSESQTSSPNDFSSTSNHIEDDKRKHH

SEQ ID NO: 1855611 - protein, 5 aa, Staphylococcus
KKKST

SEQ ID NO: 1855612 - protein, 19 aa, Staphylococcus
KKKTTAKKKSSKKQQNEAP

SEQ ID NO: 1855613 - protein, 21 aa, Staphylococcus
KKKTTARRSSRNRKNSSDNSV

SEQ ID NO: 1855614 - protein, 25 aa, Staphylococcus
KKKTVKSKNNLDFGDDTFGGGFGFF

SEQ ID NO: 1855615 - protein, 12 aa, Staphylococcus
KKKVKAEAKLQN

SEQ ID NO: 1855616 - protein, 16 aa, Staphylococcus
KKLDNYNGDIANSAPV

SEQ ID NO: 1855617 - protein, 7 aa, Staphylococcus
KKLGYDQ

SEQ ID NO: 1855618 - protein, 12 aa, Staphylococcus
KKLIQTSNDNIV

SEQ ID NO: 1855619 - protein, 12 aa, Staphylococcus
KKLKGVASAAGV

SEQ ID NO: 1855620 - protein, 6 aa, Staphylococcus
KKLKNS

SEQ ID NO: 1855621 - protein, 4 aa, Staphylococcus
KKLL

SEQ ID NO: 1855622 - protein, 13 aa, Staphylococcus
KKLNESETKEADF

SEQ ID NO: 1855623 - protein, 13 aa, Staphylococcus
KKLNGKYSSKEIS

SEQ ID NO: 1855624 - protein, 28 aa, Staphylococcus
KKLQKNIEQRHHDEEKNRDKNKKARIKE

SEQ ID NO: 1855625 - protein, 26 aa, Staphylococcus
KKLQSQSKVDSQVLSDKKNQQLNEGQ

SEQ ID NO: 1855626 - protein, 8 aa, Staphylococcus
KKLSAKEQ

SEQ ID NO: 1855627 - protein, 20 aa, Staphylococcus
KKLSASQINKINKNSNNGAF

SEQ ID NO: 1855628 - protein, 22 aa, Staphylococcus
KKLSEKGTAQSSGTYQYSDTEQ

SEQ ID NO: 1855629 - protein, 16 aa, Staphylococcus
KKLSEPITKTNYSQRK

SEQ ID NO: 1855630 - protein, 9 aa, Staphylococcus
KKMGNQKVD

SEQ ID NO: 1855631 - protein, 13 aa, Staphylococcus
KKMGNQKVDVKQA

SEQ ID NO: 1855632 - protein, 16 aa, Staphylococcus
KKMKQSVDQYSKGDGK

SEQ ID NO: 1855633 - protein, 6 aa, Staphylococcus
KKMQPY

SEQ ID NO: 1855634 - protein, 18 aa, Staphylococcus
KKMSEQLRTTKKEQFTEQ

SEQ ID NO: 1855635 - protein, 13 aa, Staphylococcus
KKMTTAGFPQYDP

SEQ ID NO: 1855636 - protein, 20 aa, Staphylococcus
KKNAEYLAEKTRQQPRESIN

SEQ ID NO: 1855637 - protein, 27 aa, Staphylococcus
KKNANAADVKDEKSKDTASEQTSSGGS

SEQ ID NO: 1855638 - protein, 13 aa, Staphylococcus
KKNDDASRHKTNY

SEQ ID NO: 1855639 - protein, 7 aa, Staphylococcus
KKNDGAV

SEQ ID NO: 1855640 - protein, 8 aa, Staphylococcus
KKNDGAVA

SEQ ID NO: 1855641 - protein, 8 aa, Staphylococcus
KKNDRVKD

SEQ ID NO: 1855642 - protein, 6 aa, Staphylococcus
KKNDSF

SEQ ID NO: 1855643 - protein, 6 aa, Staphylococcus
KKNDTH

SEQ ID NO: 1855644 - protein, 9 aa, Staphylococcus
KKNDTPAEM

SEQ ID NO: 1855645 - protein, 9 aa, Staphylococcus
KKNDTPQTM

SEQ ID NO: 1855646 - protein, 9 aa, Staphylococcus
KKNFGGSGL

SEQ ID NO: 1855647 - protein, 17 aa, Staphylococcus
KKNGITDKDTKKDIEKA

SEQ ID NO: 1855648 - protein, 6 aa, Staphylococcus
KKNGKF

SEQ ID NO: 1855649 - protein, 4 aa, Staphylococcus
KKNI

SEQ ID NO: 1855650 - protein, 7 aa, Staphylococcus
KKNLPNR

SEQ ID NO: 1855651 - protein, 5 aa, Staphylococcus
KKNNL

SEQ ID NO: 1855652 - protein, 5 aa, Staphylococcus
KKNNT

SEQ ID NO: 1855653 - protein, 6 aa, Staphylococcus
KKNPFT

SEQ ID NO: 1855654 - protein, 17 aa, Staphylococcus
KKNPKLSYSYEDRKSFE

SEQ ID NO: 1855655 - protein, 7 aa, Staphylococcus
KKNPVYK

SEQ ID NO: 1855656 - protein, 6 aa, Staphylococcus
KKNPYV

SEQ ID NO: 1855657 - protein, 16 aa, Staphylococcus
KKNTDNYKSTKSDVNS

SEQ ID NO: 1855658 - protein, 9 aa, Staphylococcus
KKNTDQTKW

SEQ ID NO: 1855659 - protein, 9 aa, Staphylococcus
KKNTTKNKD

SEQ ID NO: 1855660 - protein, 9 aa, Staphylococcus
KKPASNDVI

SEQ ID NO: 1855661 - protein, 7 aa, Staphylococcus
KKPDQLP

SEQ ID NO: 1855662 - protein, 20 aa, Staphylococcus
KKPDRDVEKELEEVKKLVKE

SEQ ID NO: 1855663 - protein, 7 aa, Staphylococcus
KKPGETI

SEQ ID NO: 1855664 - protein, 8 aa, Staphylococcus
KKPKAQET

SEQ ID NO: 1855665 - protein, 5 aa, Staphylococcus
KKPKQ

SEQ ID NO: 1855666 - protein, 7 aa, Staphylococcus
KKPLQND

SEQ ID NO: 1855667 - protein, 4 aa, Staphylococcus
KKPM

SEQ ID NO: 1855668 - protein, 8 aa, Staphylococcus
KKPNHESF

SEQ ID NO: 1855669 - protein, 36 aa, Staphylococcus
KKPQAKLEVQQKAEEIQTTINSNKDATTEEKNAALK

SEQ ID NO: 1855670 - protein, 7 aa, Staphylococcus
KKPREKV

SEQ ID NO: 1855671 - protein, 7 aa, Staphylococcus
KKPSALT

SEQ ID NO: 1855672 - protein, 9 aa, Staphylococcus
KKPSDANII

SEQ ID NO: 1855673 - protein, 9 aa, Staphylococcus
KKPTGGSIK

SEQ ID NO: 1855674 - protein, 11 aa, Staphylococcus
KKQAAQAELQK

SEQ ID NO: 1855675 - protein, 5 aa, Staphylococcus
KKQAG

SEQ ID NO: 1855676 - protein, 15 aa, Staphylococcus
KKQAGNDAPKKFASK

SEQ ID NO: 1855677 - protein, 14 aa, Staphylococcus
KKQAPESSGGGHHG

SEQ ID NO: 1855678 - protein, 19 aa, Staphylococcus
KKQDPYKVAKDYLKKEGLI

SEQ ID NO: 1855679 - protein, 8 aa, Staphylococcus
KKQDPYQV

SEQ ID NO: 1855680 - protein, 9 aa, Staphylococcus
KKQEKHTPH

SEQ ID NO: 1855681 - protein, 36 aa, Staphylococcus
KKQEMQDKVKSGEIPPEQAKQMQSQMAKSGASQDIK

SEQ ID NO: 1855682 - protein, 10 aa, Staphylococcus
KKQGKDANEL

SEQ ID NO: 1855683 - protein, 5 aa, Staphylococcus
KKQKA

SEQ ID NO: 1855684 - protein, 21 aa, Staphylococcus
KKQLGSGKKAIYKPDPKKVPN

SEQ ID NO: 1855685 - protein, 7 aa, Staphylococcus
KKQNHKK

SEQ ID NO: 1855686 - protein, 6 aa, Staphylococcus
KKQPSL

SEQ ID NO: 1855687 - protein, 8 aa, Staphylococcus
KKQQRLTS

SEQ ID NO: 1855688 - protein, 9 aa, Staphylococcus
KKQQYNQQS

SEQ ID NO: 1855689 - protein, 7 aa, Staphylococcus
KKQRKRT

SEQ ID NO: 1855690 - protein, 13 aa, Staphylococcus
KKQSTQRLGSNAT

SEQ ID NO: 1855691 - protein, 12 aa, Staphylococcus
KKQSTQRLGTQA

SEQ ID NO: 1855692 - protein, 13 aa, Staphylococcus
KKQTAQRLGSQAT

SEQ ID NO: 1855693 - protein, 5 aa, Staphylococcus
KKQVH

SEQ ID NO: 1855694 - protein, 4 aa, Staphylococcus
KKRD

SEQ ID NO: 1855695 - protein, 5 aa, Staphylococcus
KKRDA

SEQ ID NO: 1855696 - protein, 6 aa, Staphylococcus
KKRDGL

SEQ ID NO: 1855697 - protein, 7 aa, Staphylococcus
KKRDSLT

SEQ ID NO: 1855698 - protein, 10 aa, Staphylococcus
KKREGETTQS

SEQ ID NO: 1855699 - protein, 40 aa, Staphylococcus
KKRESKETSTNTKGKAPTKNKKVVASKKKKKKSKKSSKRK

SEQ ID NO: 1855700 - protein, 5 aa, Staphylococcus
KKRHV

SEQ ID NO: 1855701 - protein, 9 aa, Staphylococcus
KKRKGGNVN

SEQ ID NO: 1855702 - protein, 14 aa, Staphylococcus
KKRKNSTQSQQLNN

SEQ ID NO: 1855703 - protein, 42 aa, Staphylococcus
KKRKQQEKQFEEKFEQDKPSMKEKVSAQTDALKANAQDQLQG

SEQ ID NO: 1855704 - protein, 4 aa, Staphylococcus
KKRL

SEQ ID NO: 1855705 - protein, 8 aa, Staphylococcus
KKRPDTKY

SEQ ID NO: 1855706 - protein, 8 aa, Staphylococcus
KKRPETRY

SEQ ID NO: 1855707 - protein, 6 aa, Staphylococcus
KKRPLS

SEQ ID NO: 1855708 - protein, 9 aa, Staphylococcus
KKRPTGKQN

SEQ ID NO: 1855709 - protein, 8 aa, Staphylococcus
KKSAGNGA

SEQ ID NO: 1855710 - protein, 10 aa, Staphylococcus
KKSDAKKYHS

SEQ ID NO: 1855711 - protein, 10 aa, Staphylococcus
KKSDAKQAID

SEQ ID NO: 1855712 - protein, 7 aa, Staphylococcus
KKSFKTT

SEQ ID NO: 1855713 - protein, 8 aa, Staphylococcus
KKSGDRVT

SEQ ID NO: 1855714 - protein, 10 aa, Staphylococcus
KKSGEVSAVE

SEQ ID NO: 1855715 - protein, 6 aa, Staphylococcus
KKSHKI

SEQ ID NO: 1855716 - protein, 6 aa, Staphylococcus
KKSHNN

SEQ ID NO: 1855717 - protein, 8 aa, Staphylococcus
KKSKHGRI

SEQ ID NO: 1855718 - protein, 12 aa, Staphylococcus
KKSKIPTKAKEK

SEQ ID NO: 1855719 - protein, 9 aa, Staphylococcus
KKSKQGRVS

SEQ ID NO: 1855720 - protein, 9 aa, Staphylococcus
KKSKVTPHT

SEQ ID NO: 1855721 - protein, 6 aa, Staphylococcus
KKSPKF

SEQ ID NO: 1855722 - protein, 7 aa, Staphylococcus
KKSSPLL

SEQ ID NO: 1855723 - protein, 7 aa, Staphylococcus
KKSVTNK

SEQ ID NO: 1855724 - protein, 8 aa, Staphylococcus
KKSVVGDY

SEQ ID NO: 1855725 - protein, 4 aa, Staphylococcus
KKSY

SEQ ID NO: 1855726 - protein, 8 aa, Staphylococcus
KKTALDKR

SEQ ID NO: 1855727 - protein, 14 aa, Staphylococcus
KKTANGVDTSPAFY

SEQ ID NO: 1855728 - protein, 14 aa, Staphylococcus
KKTATGVDTTPVAY

SEQ ID NO: 1855729 - protein, 6 aa, Staphylococcus
KKTKGR

SEQ ID NO: 1855730 - protein, 7 aa, Staphylococcus
KKTLRNS

SEQ ID NO: 1855731 - protein, 4 aa, Staphylococcus
KKTN

SEQ ID NO: 1855732 - protein, 8 aa, Staphylococcus
KKTNEVER

SEQ ID NO: 1855733 - protein, 6 aa, Staphylococcus
KKTPKE

SEQ ID NO: 1855734 - protein, 4 aa, Staphylococcus
KKTQ

SEQ ID NO: 1855735 - protein, 64 aa, Staphylococcus
KKTQAKKSIDDEVTAKKAEIDSNHEATNEEKEMTKRKVDEAATKAKHNVDQSTTNDTVDQSTQI

SEQ ID NO: 1855736 - protein, 8 aa, Staphylococcus
KKTSKLGA

SEQ ID NO: 1855737 - protein, 7 aa, Staphylococcus
KKTSSKI

SEQ ID NO: 1855738 - protein, 17 aa, Staphylococcus
KKTSSTESQAAKLSEVT

SEQ ID NO: 1855739 - protein, 7 aa, Staphylococcus
KKTTLGT

SEQ ID NO: 1855740 - protein, 5 aa, Staphylococcus
KKTYD

SEQ ID NO: 1855741 - protein, 9 aa, Staphylococcus
KKTYQQAKQ

SEQ ID NO: 1855742 - protein, 11 aa, Staphylococcus
KKTYQQHTQDV

SEQ ID NO: 1855743 - protein, 27 aa, Staphylococcus
KKVADLTKKTENYSKLEEQGKTEEIKN

SEQ ID NO: 1855744 - protein, 8 aa, Staphylococcus
KKVDEPYL

SEQ ID NO: 1855745 - protein, 4 aa, Staphylococcus
KKVE

SEQ ID NO: 1855746 - protein, 11 aa, Staphylococcus
KKVENKDPFEE

SEQ ID NO: 1855747 - protein, 9 aa, Staphylococcus
KKVGKLKEN

SEQ ID NO: 1855748 - protein, 10 aa, Staphylococcus
KKVGKLKENI

SEQ ID NO: 1855749 - protein, 9 aa, Staphylococcus
KKVGQLKKD

SEQ ID NO: 1855750 - protein, 6 aa, Staphylococcus
KKVGTY

SEQ ID NO: 1855751 - protein, 11 aa, Staphylococcus
KKVKTDSSDGY

SEQ ID NO: 1855752 - protein, 11 aa, Staphylococcus
KKVPATQKELD

SEQ ID NO: 1855753 - protein, 5 aa, Staphylococcus
KKVPG

SEQ ID NO: 1855754 - protein, 15 aa, Staphylococcus
KKVQEQANFIIHLIL

SEQ ID NO: 1855755 - protein, 13 aa, Staphylococcus
KKVSKNKKRVDAQ

SEQ ID NO: 1855756 - protein, 17 aa, Staphylococcus
KKVTFKRSQRTLPKEDH

SEQ ID NO: 1855757 - protein, 9 aa, Staphylococcus
KKVTNPRNV

SEQ ID NO: 1855758 - protein, 8 aa, Staphylococcus
KKVTREAT

SEQ ID NO: 1855759 - protein, 9 aa, Staphylococcus
KKYDAGIKF

SEQ ID NO: 1855760 - protein, 8 aa, Staphylococcus
KKYESITN

SEQ ID NO: 1855761 - protein, 9 aa, Staphylococcus
KKYGNSPKA

SEQ ID NO: 1855762 - protein, 9 aa, Staphylococcus
KKYGSSPKA

SEQ ID NO: 1855763 - protein, 9 aa, Staphylococcus
KKYGSSPKS

SEQ ID NO: 1855764 - protein, 6 aa, Staphylococcus
KKYIEG

SEQ ID NO: 1855765 - protein, 7 aa, Staphylococcus
KKYLEGS

SEQ ID NO: 1855766 - protein, 4 aa, Staphylococcus
KKYN

SEQ ID NO: 1855767 - protein, 7 aa, Staphylococcus
KKYPNSG

SEQ ID NO: 1855768 - protein, 8 aa, Staphylococcus
KKYQKVKN

SEQ ID NO: 1855769 - protein, 8 aa, Staphylococcus
KLAKKDAV

SEQ ID NO: 1855770 - protein, 13 aa, Staphylococcus
KLAPEGKQGQYQG

SEQ ID NO: 1855771 - protein, 8 aa, Staphylococcus
KLAPKSFN

SEQ ID NO: 1855772 - protein, 8 aa, Staphylococcus
KLDDDTTE

SEQ ID NO: 1855773 - protein, 6 aa, Staphylococcus
KLDDVE

SEQ ID NO: 1855774 - protein, 8 aa, Staphylococcus
KLDETPRN

SEQ ID NO: 1855775 - protein, 24 aa, Staphylococcus
KLDGEDAELKGKVEEVGKATASSF

SEQ ID NO: 1855776 - protein, 4 aa, Staphylococcus
KLDN

SEQ ID NO: 1855777 - protein, 6 aa, Staphylococcus
KLDPKG

SEQ ID NO: 1855778 - protein, 24 aa, Staphylococcus
KLDTDTKNNTQKQELSLSTDIDNE

SEQ ID NO: 1855779 - protein, 69 aa, Staphylococcus
KLEADAHSKVGASATELAAQQNAIKSETNHDQLADQSPQAKEIQEAKAEAKSTQVDSNIDNNKHVSDKE

SEQ ID NO: 1855780 - protein, 5 aa, Staphylococcus
KLEDP

SEQ ID NO: 1855781 - protein, 21 aa, Staphylococcus
KLEDTSKKDGDDSDLKIISNQ

SEQ ID NO: 1855782 - protein, 7 aa, Staphylococcus
KLEETPR

SEQ ID NO: 1855783 - protein, 5 aa, Staphylococcus
KLEEY

SEQ ID NO: 1855784 - protein, 11 aa, Staphylococcus
KLEGGQLKGGD

SEQ ID NO: 1855785 - protein, 7 aa, Staphylococcus
KLEKGDL

SEQ ID NO: 1855786 - protein, 6 aa, Staphylococcus
KLEPRY

SEQ ID NO: 1855787 - protein, 228 aa, Staphylococcus
KLEQNHKKDSNDRKSKDDVGSLDDRSAVSNDSKDGKDNQKKSNNTGKKAAAAGAAGIVGGAAAKHQKDKNASANESESKTPKSKENDKAASTAAGSTAAKNENPDNNDSNEDNKKESPNKDKKHSKAGKAAAAGAAAIGGAAAGKAAKDHSKKENNKKNDKNESEDKNSENKSGKAAAAGTAAGAAGAASASSANASGSSGGNGGNGSGNGGDHGDGNGQEPKKSGGL

SEQ ID NO: 1855788 - protein, 20 aa, Staphylococcus
KLESDSADDSSDDSEEVTRA

SEQ ID NO: 1855789 - protein, 14 aa, Staphylococcus
KLESRADKYREVER

SEQ ID NO: 1855790 - protein, 4 aa, Staphylococcus
KLET

SEQ ID NO: 1855791 - protein, 12 aa, Staphylococcus
KLETAKTSALQN

SEQ ID NO: 1855792 - protein, 15 aa, Staphylococcus
KLETRADKLKEVERR

SEQ ID NO: 1855793 - protein, 12 aa, Staphylococcus
KLGESGNQVSDQ

SEQ ID NO: 1855794 - protein, 6 aa, Staphylococcus
KLGGKL

SEQ ID NO: 1855795 - protein, 14 aa, Staphylococcus
KLGNSLSEKKGYNI

SEQ ID NO: 1855796 - protein, 7 aa, Staphylococcus
KLGQKPV

SEQ ID NO: 1855797 - protein, 9 aa, Staphylococcus
KLHASGRAL

SEQ ID NO: 1855798 - protein, 11 aa, Staphylococcus
KLKADAQHKED

SEQ ID NO: 1855799 - protein, 4 aa, Staphylococcus
KLKD

SEQ ID NO: 1855800 - protein, 10 aa, Staphylococcus
KLKDGKALKV

SEQ ID NO: 1855801 - protein, 8 aa, Staphylococcus
KLKDNDKF

SEQ ID NO: 1855802 - protein, 8 aa, Staphylococcus
KLKDNKKF

SEQ ID NO: 1855803 - protein, 5 aa, Staphylococcus
KLKDQ

SEQ ID NO: 1855804 - protein, 18 aa, Staphylococcus
KLKEANNAQQNNANENKV

SEQ ID NO: 1855805 - protein, 17 aa, Staphylococcus
KLKEAYKEDIKKSRQLT

SEQ ID NO: 1855806 - protein, 9 aa, Staphylococcus
KLKEGKDNI

SEQ ID NO: 1855807 - protein, 11 aa, Staphylococcus
KLKGVASAAGI

SEQ ID NO: 1855808 - protein, 19 aa, Staphylococcus
KLKNANNAQQNNENQSKIN

SEQ ID NO: 1855809 - protein, 6 aa, Staphylococcus
KLKNEP

SEQ ID NO: 1855810 - protein, 9 aa, Staphylococcus
KLKSDDATI

SEQ ID NO: 1855811 - protein, 8 aa, Staphylococcus
KLKSDQAT

SEQ ID NO: 1855812 - protein, 9 aa, Staphylococcus
KLLDSDSKA

SEQ ID NO: 1855813 - protein, 17 aa, Staphylococcus
KLLQTTNENLPSVPSNI

SEQ ID NO: 1855814 - protein, 12 aa, Staphylococcus
KLNDGKAKSTIN

SEQ ID NO: 1855815 - protein, 8 aa, Staphylococcus
KLNDNTTE

SEQ ID NO: 1855816 - protein, 5 aa, Staphylococcus
KLNDP

SEQ ID NO: 1855817 - protein, 4 aa, Staphylococcus
KLNE

SEQ ID NO: 1855818 - protein, 16 aa, Staphylococcus
KLNGERNVARTQETNL

SEQ ID NO: 1855819 - protein, 23 aa, Staphylococcus
KLNKDKLDKIKTSIKNMENSKDF

SEQ ID NO: 1855820 - protein, 31 aa, Staphylococcus
KLNKKMGDKLRKRRRKARRKDWKERDRQEQN

SEQ ID NO: 1855821 - protein, 6 aa, Staphylococcus
KLNPEG

SEQ ID NO: 1855822 - protein, 10 aa, Staphylococcus
KLNQTNVNTV

SEQ ID NO: 1855823 - protein, 5 aa, Staphylococcus
KLPDK

SEQ ID NO: 1855824 - protein, 8 aa, Staphylococcus
KLPDKVKN

SEQ ID NO: 1855825 - protein, 7 aa, Staphylococcus
KLPGINT

SEQ ID NO: 1855826 - protein, 7 aa, Staphylococcus
KLPHVPG

SEQ ID NO: 1855827 - protein, 24 aa, Staphylococcus
KLPKGDISKYQSSAHSAEQASTYG

SEQ ID NO: 1855828 - protein, 7 aa, Staphylococcus
KLPKTNQ

SEQ ID NO: 1855829 - protein, 9 aa, Staphylococcus
KLPNDVTDR

SEQ ID NO: 1855830 - protein, 8 aa, Staphylococcus
KLPNGDSE

SEQ ID NO: 1855831 - protein, 6 aa, Staphylococcus
KLPQKD

SEQ ID NO: 1855832 - protein, 7 aa, Staphylococcus
KLPQSPY

SEQ ID NO: 1855833 - protein, 4 aa, Staphylococcus
KLPS

SEQ ID NO: 1855834 - protein, 12 aa, Staphylococcus
KLPSDAKVSVKK

SEQ ID NO: 1855835 - protein, 7 aa, Staphylococcus
KLPSDVT

SEQ ID NO: 1855836 - protein, 21 aa, Staphylococcus
KLPSDVTAKINSAMKSISDSL

SEQ ID NO: 1855837 - protein, 12 aa, Staphylococcus
KLPSDVTDRINS

SEQ ID NO: 1855838 - protein, 11 aa, Staphylococcus
KLPSNANVSVK

SEQ ID NO: 1855839 - protein, 19 aa, Staphylococcus
KLPSVESVRSSLANDPNVD

SEQ ID NO: 1855840 - protein, 4 aa, Staphylococcus
KLPT

SEQ ID NO: 1855841 - protein, 4 aa, Staphylococcus
KLPY

SEQ ID NO: 1855842 - protein, 14 aa, Staphylococcus
KLQERGMSASGVED

SEQ ID NO: 1855843 - protein, 27 aa, Staphylococcus
KLQETTSNGQLDNNRELNNNQETLSEV

SEQ ID NO: 1855844 - protein, 4 aa, Staphylococcus
KLQT

SEQ ID NO: 1855845 - protein, 31 aa, Staphylococcus
KLQTTDAEMKKNLSSFDKAEKSVEKYETEIE

SEQ ID NO: 1855846 - protein, 11 aa, Staphylococcus
KLRGEGAKNMD

SEQ ID NO: 1855847 - protein, 11 aa, Staphylococcus
KLRSEGAKDMD

SEQ ID NO: 1855848 - protein, 12 aa, Staphylococcus
KLSDDSKPSRRT

SEQ ID NO: 1855849 - protein, 15 aa, Staphylococcus
KLSDESMKPITLGDS

SEQ ID NO: 1855850 - protein, 8 aa, Staphylococcus
KLSDNKAR

SEQ ID NO: 1855851 - protein, 6 aa, Staphylococcus
KLSDNL

SEQ ID NO: 1855852 - protein, 32 aa, Staphylococcus
KLSERDSISAKNKEKLKKEIEKTQQSLKKQND

SEQ ID NO: 1855853 - protein, 5 aa, Staphylococcus
KLSGD

SEQ ID NO: 1855854 - protein, 21 aa, Staphylococcus
KLSGDTSKFTDNMNAKAKELG

SEQ ID NO: 1855855 - protein, 10 aa, Staphylococcus
KLSKDRPDWI

SEQ ID NO: 1855856 - protein, 14 aa, Staphylococcus
KLSKQKKGSGEQDM

SEQ ID NO: 1855857 - protein, 9 aa, Staphylococcus
KLSNQAANV

SEQ ID NO: 1855858 - protein, 5 aa, Staphylococcus
KLSNY

SEQ ID NO: 1855859 - protein, 6 aa, Staphylococcus
KLSPGK

SEQ ID NO: 1855860 - protein, 11 aa, Staphylococcus
KLSPPESAIKD

SEQ ID NO: 1855861 - protein, 8 aa, Staphylococcus
KLSQSDEK

SEQ ID NO: 1855862 - protein, 12 aa, Staphylococcus
KLSSKREKWTKK

SEQ ID NO: 1855863 - protein, 5 aa, Staphylococcus
KLSSN

SEQ ID NO: 1855864 - protein, 8 aa, Staphylococcus
KLSSPQDF

SEQ ID NO: 1855865 - protein, 7 aa, Staphylococcus
KLSSTSD

SEQ ID NO: 1855866 - protein, 5 aa, Staphylococcus
KLSTR

SEQ ID NO: 1855867 - protein, 10 aa, Staphylococcus
KLSYEPGAQE

SEQ ID NO: 1855868 - protein, 6 aa, Staphylococcus
KLTDDA

SEQ ID NO: 1855869 - protein, 7 aa, Staphylococcus
KLTDRAI

SEQ ID NO: 1855870 - protein, 13 aa, Staphylococcus
KLTDRAIKQSPDA

SEQ ID NO: 1855871 - protein, 5 aa, Staphylococcus
KLTEA

SEQ ID NO: 1855872 - protein, 14 aa, Staphylococcus
KLTEQEIKASESMD

SEQ ID NO: 1855873 - protein, 4 aa, Staphylococcus
KLTG

SEQ ID NO: 1855874 - protein, 7 aa, Staphylococcus
KLTGEGI

SEQ ID NO: 1855875 - protein, 8 aa, Staphylococcus
KLTGEGLK

SEQ ID NO: 1855876 - protein, 8 aa, Staphylococcus
KLTGLDGQ

SEQ ID NO: 1855877 - protein, 8 aa, Staphylococcus
KLTGNDLK

SEQ ID NO: 1855878 - protein, 11 aa, Staphylococcus
KLTGQDVKKGD

SEQ ID NO: 1855879 - protein, 20 aa, Staphylococcus
KLTPTAYTREGDISSLGAQR

SEQ ID NO: 1855880 - protein, 7 aa, Staphylococcus
KLTQANF

SEQ ID NO: 1855881 - protein, 14 aa, Staphylococcus
KLTQDEIQSSEAMN

SEQ ID NO: 1855882 - protein, 35 aa, Staphylococcus
KLTQEEIQQQQAMATKRNSSNSESEFEPSEDNALN

SEQ ID NO: 1855883 - protein, 8 aa, Staphylococcus
KLTQESQY

SEQ ID NO: 1855884 - protein, 8 aa, Staphylococcus
KLTRHPDT

SEQ ID NO: 1855885 - protein, 5 aa, Staphylococcus
KLTSV

SEQ ID NO: 1855886 - protein, 7 aa, Staphylococcus
KLTTQQQ

SEQ ID NO: 1855887 - protein, 19 aa, Staphylococcus
KLTVESSSFTQSSNVSQQS

SEQ ID NO: 1855888 - protein, 7 aa, Staphylococcus
KLVDGPG

SEQ ID NO: 1855889 - protein, 8 aa, Staphylococcus
KLYEDSKP

SEQ ID NO: 1855890 - protein, 8 aa, Staphylococcus
KMAKEEGL

SEQ ID NO: 1855891 - protein, 11 aa, Staphylococcus
KMAKEEGLALT

SEQ ID NO: 1855892 - protein, 6 aa, Staphylococcus
KMASQN

SEQ ID NO: 1855893 - protein, 24 aa, Staphylococcus
KMDAESDSDSDDSDSSSGEVTRDN

SEQ ID NO: 1855894 - protein, 5 aa, Staphylococcus
KMDDP

SEQ ID NO: 1855895 - protein, 18 aa, Staphylococcus
KMDEKRAKQHKVDIKRRY

SEQ ID NO: 1855896 - protein, 7 aa, Staphylococcus
KMDKTHG

SEQ ID NO: 1855897 - protein, 8 aa, Staphylococcus
KMDSAKKD

SEQ ID NO: 1855898 - protein, 9 aa, Staphylococcus
KMDTPISKL

SEQ ID NO: 1855899 - protein, 5 aa, Staphylococcus
KMEDP

SEQ ID NO: 1855900 - protein, 4 aa, Staphylococcus
KMEP

SEQ ID NO: 1855901 - protein, 5 aa, Staphylococcus
KMEPK

SEQ ID NO: 1855902 - protein, 8 aa, Staphylococcus
KMGKKATA

SEQ ID NO: 1855903 - protein, 5 aa, Staphylococcus
KMGPE

SEQ ID NO: 1855904 - protein, 4 aa, Staphylococcus
KMGY

SEQ ID NO: 1855905 - protein, 4 aa, Staphylococcus
KMHA

SEQ ID NO: 1855906 - protein, 15 aa, Staphylococcus
KMKNAKSSVDSLQSE

SEQ ID NO: 1855907 - protein, 17 aa, Staphylococcus
KMLNNGEISQDQYDEEL

SEQ ID NO: 1855908 - protein, 5 aa, Staphylococcus
KMLPK

SEQ ID NO: 1855909 - protein, 6 aa, Staphylococcus
KMLPKG

SEQ ID NO: 1855910 - protein, 40 aa, Staphylococcus
KMNSNMGDKLKKRKRREKREKIAEKRQEQQDKEEKRQNKE

SEQ ID NO: 1855911 - protein, 6 aa, Staphylococcus
KMNSTR

SEQ ID NO: 1855912 - protein, 9 aa, Staphylococcus
KMQAELKQR

SEQ ID NO: 1855913 - protein, 6 aa, Staphylococcus
KMQSTD

SEQ ID NO: 1855914 - protein, 8 aa, Staphylococcus
KMRKGRTT

SEQ ID NO: 1855915 - protein, 5 aa, Staphylococcus
KMSPE

SEQ ID NO: 1855916 - protein, 5 aa, Staphylococcus
KMTRP

SEQ ID NO: 1855917 - protein, 9 aa, Staphylococcus
KMTRSDDEY

SEQ ID NO: 1855918 - protein, 7 aa, Staphylococcus
KMTSASS

SEQ ID NO: 1855919 - protein, 7 aa, Staphylococcus
KMTSTSA

SEQ ID NO: 1855920 - protein, 6 aa, Staphylococcus
KNAAGQ

SEQ ID NO: 1855921 - protein, 5 aa, Staphylococcus
KNADY

SEQ ID NO: 1855922 - protein, 6 aa, Staphylococcus
KNAGHS

SEQ ID NO: 1855923 - protein, 17 aa, Staphylococcus
KNAISALSKGLSKAGTW

SEQ ID NO: 1855924 - protein, 6 aa, Staphylococcus
KNAKGG

SEQ ID NO: 1855925 - protein, 6 aa, Staphylococcus
KNAKNF

SEQ ID NO: 1855926 - protein, 11 aa, Staphylococcus
KNANGKTEYAG

SEQ ID NO: 1855927 - protein, 7 aa, Staphylococcus
KNAPKTD

SEQ ID NO: 1855928 - protein, 9 aa, Staphylococcus
KNAPQPKIG

SEQ ID NO: 1855929 - protein, 19 aa, Staphylococcus
KNARRDYSENVKPPLSPPG

SEQ ID NO: 1855930 - protein, 14 aa, Staphylococcus
KNARTNTQNAPHYN

SEQ ID NO: 1855931 - protein, 8 aa, Staphylococcus
KNASKQLH

SEQ ID NO: 1855932 - protein, 7 aa, Staphylococcus
KNASQTL

SEQ ID NO: 1855933 - protein, 9 aa, Staphylococcus
KNATELNTN

SEQ ID NO: 1855934 - protein, 10 aa, Staphylococcus
KNATIQRKDE

SEQ ID NO: 1855935 - protein, 10 aa, Staphylococcus
KNATQTKTYG

SEQ ID NO: 1855936 - protein, 10 aa, Staphylococcus
KNATSSKTFG

SEQ ID NO: 1855937 - protein, 9 aa, Staphylococcus
KNATSTKTF

SEQ ID NO: 1855938 - protein, 9 aa, Staphylococcus
KNATTSKTF

SEQ ID NO: 1855939 - protein, 9 aa, Staphylococcus
KNAVNPTDV

SEQ ID NO: 1855940 - protein, 13 aa, Staphylococcus
KNDARAAITNAEA

SEQ ID NO: 1855941 - protein, 10 aa, Staphylococcus
KNDDFSKGNH

SEQ ID NO: 1855942 - protein, 19 aa, Staphylococcus
KNDDKTNNKIESNTIQNGD

SEQ ID NO: 1855943 - protein, 8 aa, Staphylococcus
KNDDKTSL

SEQ ID NO: 1855944 - protein, 13 aa, Staphylococcus
KNDENSGQFTSEQ

SEQ ID NO: 1855945 - protein, 7 aa, Staphylococcus
KNDGQYE

SEQ ID NO: 1855946 - protein, 6 aa, Staphylococcus
KNDHKG

SEQ ID NO: 1855947 - protein, 29 aa, Staphylococcus
KNDHTNDSAFNGNDKNHTTTMKNANNSVK

SEQ ID NO: 1855948 - protein, 48 aa, Staphylococcus
KNDIESTKESAHSSVEDIRDQTDSSIQDDNSTESQSKNNTNTASDKSI

SEQ ID NO: 1855949 - protein, 5 aa, Staphylococcus
KNDIK

SEQ ID NO: 1855950 - protein, 19 aa, Staphylococcus
KNDIKSKMKESDNKGKIAQ

SEQ ID NO: 1855951 - protein, 12 aa, Staphylococcus
KNDKDKAKTTAN

SEQ ID NO: 1855952 - protein, 17 aa, Staphylococcus
KNDKENEMTDIAKSEKL

SEQ ID NO: 1855953 - protein, 9 aa, Staphylococcus
KNDLKKQAD

SEQ ID NO: 1855954 - protein, 6 aa, Staphylococcus
KNDLNG

SEQ ID NO: 1855955 - protein, 9 aa, Staphylococcus
KNDNRKRTK

SEQ ID NO: 1855956 - protein, 10 aa, Staphylococcus
KNDPKGFIQE

SEQ ID NO: 1855957 - protein, 12 aa, Staphylococcus
KNDPNANPQAIK

SEQ ID NO: 1855958 - protein, 4 aa, Staphylococcus
KNDS

SEQ ID NO: 1855959 - protein, 7 aa, Staphylococcus
KNDSKSM

SEQ ID NO: 1855960 - protein, 13 aa, Staphylococcus
KNDSTNNKGQNLK

SEQ ID NO: 1855961 - protein, 15 aa, Staphylococcus
KNDYGSGTAIHPQTG

SEQ ID NO: 1855962 - protein, 5 aa, Staphylococcus
KNEAQ

SEQ ID NO: 1855963 - protein, 6 aa, Staphylococcus
KNEAQK

SEQ ID NO: 1855964 - protein, 8 aa, Staphylococcus
KNEAQKIA

SEQ ID NO: 1855965 - protein, 12 aa, Staphylococcus
KNEDKVKTQTRV

SEQ ID NO: 1855966 - protein, 19 aa, Staphylococcus
KNEDPYKVAKDYLKRHHLI

SEQ ID NO: 1855967 - protein, 7 aa, Staphylococcus
KNEDPYN

SEQ ID NO: 1855968 - protein, 11 aa, Staphylococcus
KNEEPEEELEQ

SEQ ID NO: 1855969 - protein, 13 aa, Staphylococcus
KNEFGHSPSVNTV

SEQ ID NO: 1855970 - protein, 22 aa, Staphylococcus
KNEIGPSEVLGGSSSEFSPTQL

SEQ ID NO: 1855971 - protein, 20 aa, Staphylococcus
KNEKPELKAGHYPTKDNEVA

SEQ ID NO: 1855972 - protein, 8 aa, Staphylococcus
KNEKSVDL

SEQ ID NO: 1855973 - protein, 25 aa, Staphylococcus
KNELDSAKAEANSVINNNNPSVEQV

SEQ ID NO: 1855974 - protein, 6 aa, Staphylococcus
KNENST

SEQ ID NO: 1855975 - protein, 7 aa, Staphylococcus
KNEPKVK

SEQ ID NO: 1855976 - protein, 16 aa, Staphylococcus
KNEQHHGDNGVDQHDK

SEQ ID NO: 1855977 - protein, 5 aa, Staphylococcus
KNEQL

SEQ ID NO: 1855978 - protein, 9 aa, Staphylococcus
KNEQTNHCP

SEQ ID NO: 1855979 - protein, 11 aa, Staphylococcus
KNESKNNPSID

SEQ ID NO: 1855980 - protein, 6 aa, Staphylococcus
KNESSA

SEQ ID NO: 1855981 - protein, 9 aa, Staphylococcus
KNFDKRPPH

SEQ ID NO: 1855982 - protein, 7 aa, Staphylococcus
KNFSHRP

SEQ ID NO: 1855983 - protein, 6 aa, Staphylococcus
KNGEMP

SEQ ID NO: 1855984 - protein, 10 aa, Staphylococcus
KNGEQLSRSS

SEQ ID NO: 1855985 - protein, 7 aa, Staphylococcus
KNGETWT

SEQ ID NO: 1855986 - protein, 11 aa, Staphylococcus
KNGGLGIDQTT

SEQ ID NO: 1855987 - protein, 9 aa, Staphylococcus
KNGHATADD

SEQ ID NO: 1855988 - protein, 5 aa, Staphylococcus
KNGHI

SEQ ID NO: 1855989 - protein, 23 aa, Staphylococcus
KNGIAADENHDAETGYKSAKALK

SEQ ID NO: 1855990 - protein, 9 aa, Staphylococcus
KNGIGAQPI

SEQ ID NO: 1855991 - protein, 6 aa, Staphylococcus
KNGKID

SEQ ID NO: 1855992 - protein, 5 aa, Staphylococcus
KNGKR

SEQ ID NO: 1855993 - protein, 9 aa, Staphylococcus
KNGKSYDKN

SEQ ID NO: 1855994 - protein, 9 aa, Staphylococcus
KNGKTDYAG

SEQ ID NO: 1855995 - protein, 8 aa, Staphylococcus
KNGLGEKK

SEQ ID NO: 1855996 - protein, 6 aa, Staphylococcus
KNGNDV

SEQ ID NO: 1855997 - protein, 7 aa, Staphylococcus
KNGNETI

SEQ ID NO: 1855998 - protein, 6 aa, Staphylococcus
KNGNIN

SEQ ID NO: 1855999 - protein, 18 aa, Staphylococcus
KNGNKIGTGTTDSSGHAY

SEQ ID NO: 1856000 - protein, 16 aa, Staphylococcus
KNGNLTVSDHKGQSNV

SEQ ID NO: 1856001 - protein, 11 aa, Staphylococcus
KNGSDASDGEP

SEQ ID NO: 1856002 - protein, 17 aa, Staphylococcus
KNGSNEKSDEKKNRNVK

SEQ ID NO: 1856003 - protein, 10 aa, Staphylococcus
KNGSSGKAEA

SEQ ID NO: 1856004 - protein, 20 aa, Staphylococcus
KNGTSTAYGGVGSGSGAPLP

SEQ ID NO: 1856005 - protein, 5 aa, Staphylococcus
KNGYI

SEQ ID NO: 1856006 - protein, 5 aa, Staphylococcus
KNGYT

SEQ ID NO: 1856007 - protein, 7 aa, Staphylococcus
KNHPNSG

SEQ ID NO: 1856008 - protein, 5 aa, Staphylococcus
KNHRK

SEQ ID NO: 1856009 - protein, 7 aa, Staphylococcus
KNHSSEH

SEQ ID NO: 1856010 - protein, 6 aa, Staphylococcus
KNIADE

SEQ ID NO: 1856011 - protein, 15 aa, Staphylococcus
KNIADEYDVDPRKSA

SEQ ID NO: 1856012 - protein, 16 aa, Staphylococcus
KNIADEYDVDPRKSAS

SEQ ID NO: 1856013 - protein, 5 aa, Staphylococcus
KNIAN

SEQ ID NO: 1856014 - protein, 10 aa, Staphylococcus
KNIASNTSAR

SEQ ID NO: 1856015 - protein, 7 aa, Staphylococcus
KNIENNR

SEQ ID NO: 1856016 - protein, 7 aa, Staphylococcus
KNIKNGY

SEQ ID NO: 1856017 - protein, 5 aa, Staphylococcus
KNIND

SEQ ID NO: 1856018 - protein, 19 aa, Staphylococcus
KNINNLQDSTLNQKVQQGF

SEQ ID NO: 1856019 - protein, 21 aa, Staphylococcus
KNINNQKTTSDWLSSDANEVE

SEQ ID NO: 1856020 - protein, 5 aa, Staphylococcus
KNINT

SEQ ID NO: 1856021 - protein, 7 aa, Staphylococcus
KNISHGT

SEQ ID NO: 1856022 - protein, 8 aa, Staphylococcus
KNISPKQL

SEQ ID NO: 1856023 - protein, 22 aa, Staphylococcus
KNKAEASGKGKNTQVVSKKNKK

SEQ ID NO: 1856024 - protein, 7 aa, Staphylococcus
KNKAHTT

SEQ ID NO: 1856025 - protein, 14 aa, Staphylococcus
KNKASTYISKIAKR

SEQ ID NO: 1856026 - protein, 8 aa, Staphylococcus
KNKDNGYT

SEQ ID NO: 1856027 - protein, 9 aa, Staphylococcus
KNKDPYQVA

SEQ ID NO: 1856028 - protein, 10 aa, Staphylococcus
KNKDSEQSHR

SEQ ID NO: 1856029 - protein, 7 aa, Staphylococcus
KNKEDDW

SEQ ID NO: 1856030 - protein, 7 aa, Staphylococcus
KNKEKHK

SEQ ID NO: 1856031 - protein, 7 aa, Staphylococcus
KNKGQKL

SEQ ID NO: 1856032 - protein, 5 aa, Staphylococcus
KNKIA

SEQ ID NO: 1856033 - protein, 5 aa, Staphylococcus
KNKIG

SEQ ID NO: 1856034 - protein, 9 aa, Staphylococcus
KNKITQAGA

SEQ ID NO: 1856035 - protein, 7 aa, Staphylococcus
KNKKEKL

SEQ ID NO: 1856036 - protein, 7 aa, Staphylococcus
KNKKGKA

SEQ ID NO: 1856037 - protein, 9 aa, Staphylococcus
KNKLKDKRN

SEQ ID NO: 1856038 - protein, 5 aa, Staphylococcus
KNKLQ

SEQ ID NO: 1856039 - protein, 4 aa, Staphylococcus
KNKM

SEQ ID NO: 1856040 - protein, 6 aa, Staphylococcus
KNKMND

SEQ ID NO: 1856041 - protein, 8 aa, Staphylococcus
KNKNDEDK

SEQ ID NO: 1856042 - protein, 7 aa, Staphylococcus
KNKNDNG

SEQ ID NO: 1856043 - protein, 7 aa, Staphylococcus
KNKNMQP

SEQ ID NO: 1856044 - protein, 8 aa, Staphylococcus
KNKNYSDL

SEQ ID NO: 1856045 - protein, 11 aa, Staphylococcus
KNKQKVTSNTR

SEQ ID NO: 1856046 - protein, 13 aa, Staphylococcus
KNKRTKKRGEKHN

SEQ ID NO: 1856047 - protein, 8 aa, Staphylococcus
KNKTTRKD

SEQ ID NO: 1856048 - protein, 7 aa, Staphylococcus
KNKTYPK

SEQ ID NO: 1856049 - protein, 8 aa, Staphylococcus
KNKYESQK

SEQ ID NO: 1856050 - protein, 8 aa, Staphylococcus
KNLDSYDR

SEQ ID NO: 1856051 - protein, 19 aa, Staphylococcus
KNLGLAGRNVPNPLTKPEL

SEQ ID NO: 1856052 - protein, 12 aa, Staphylococcus
KNLKGKYSSEEI

SEQ ID NO: 1856053 - protein, 11 aa, Staphylococcus
KNLKNDEPTKI

SEQ ID NO: 1856054 - protein, 9 aa, Staphylococcus
KNLKNGSAN

SEQ ID NO: 1856055 - protein, 10 aa, Staphylococcus
KNLRKQEYDR

SEQ ID NO: 1856056 - protein, 5 aa, Staphylococcus
KNLYQ

SEQ ID NO: 1856057 - protein, 9 aa, Staphylococcus
KNMNQSNLD

SEQ ID NO: 1856058 - protein, 14 aa, Staphylococcus
KNMTNSYVTESSRN

SEQ ID NO: 1856059 - protein, 13 aa, Staphylococcus
KNNAKKGGKSDKI

SEQ ID NO: 1856060 - protein, 19 aa, Staphylococcus
KNNARANVQKMREGNKPKA

SEQ ID NO: 1856061 - protein, 47 aa, Staphylococcus
KNNARKNIEAEANQRDNVINSNGESTLEEKDAAKQLVSQAKNQALQN

SEQ ID NO: 1856062 - protein, 6 aa, Staphylococcus
KNNDKE

SEQ ID NO: 1856063 - protein, 8 aa, Staphylococcus
KNNDTQRI

SEQ ID NO: 1856064 - protein, 13 aa, Staphylococcus
KNNEITKEDSKLT

SEQ ID NO: 1856065 - protein, 6 aa, Staphylococcus
KNNETV

SEQ ID NO: 1856066 - protein, 4 aa, Staphylococcus
KNNG

SEQ ID NO: 1856067 - protein, 7 aa, Staphylococcus
KNNGRLK

SEQ ID NO: 1856068 - protein, 24 aa, Staphylococcus
KNNIAQSTTNSDVEIAKESGKHAI

SEQ ID NO: 1856069 - protein, 22 aa, Staphylococcus
KNNINQATTNDGVNNAKTTGKN

SEQ ID NO: 1856070 - protein, 7 aa, Staphylococcus
KNNITNK

SEQ ID NO: 1856071 - protein, 6 aa, Staphylococcus
KNNKDF

SEQ ID NO: 1856072 - protein, 6 aa, Staphylococcus
KNNKGK

SEQ ID NO: 1856073 - protein, 5 aa, Staphylococcus
KNNKI

SEQ ID NO: 1856074 - protein, 7 aa, Staphylococcus
KNNKIKE

SEQ ID NO: 1856075 - protein, 7 aa, Staphylococcus
KNNLNDA

SEQ ID NO: 1856076 - protein, 25 aa, Staphylococcus
KNNNTFNNDEDQVKNNQAHATSKFE

SEQ ID NO: 1856077 - protein, 9 aa, Staphylococcus
KNNPQNKRY

SEQ ID NO: 1856078 - protein, 7 aa, Staphylococcus
KNNPSIS

SEQ ID NO: 1856079 - protein, 24 aa, Staphylococcus
KNNPTYQADKTDINAQTYQPDFTE

SEQ ID NO: 1856080 - protein, 4 aa, Staphylococcus
KNNQ

SEQ ID NO: 1856081 - protein, 17 aa, Staphylococcus
KNNQEVEIQPHSGSSFK

SEQ ID NO: 1856082 - protein, 72 aa, Staphylococcus
KNNQKDSSSSDDNNDDSTNSDNNNNIQSSEENSSNSNEGIDQSSQGSTQSDNYNQTNSSNSFNNNQDQMNQI

SEQ ID NO: 1856083 - protein, 7 aa, Staphylococcus
KNNQTRL

SEQ ID NO: 1856084 - protein, 8 aa, Staphylococcus
KNNSEDSI

SEQ ID NO: 1856085 - protein, 11 aa, Staphylococcus
KNNSKEEIPVG

SEQ ID NO: 1856086 - protein, 19 aa, Staphylococcus
KNNSKNGGKSDEQKNRNVK

SEQ ID NO: 1856087 - protein, 6 aa, Staphylococcus
KNNTSH

SEQ ID NO: 1856088 - protein, 7 aa, Staphylococcus
KNNVTNK

SEQ ID NO: 1856089 - protein, 8 aa, Staphylococcus
KNNYDKDL

SEQ ID NO: 1856090 - protein, 8 aa, Staphylococcus
KNPEEHKH

SEQ ID NO: 1856091 - protein, 7 aa, Staphylococcus
KNPELHK

SEQ ID NO: 1856092 - protein, 7 aa, Staphylococcus
KNPGQRT

SEQ ID NO: 1856093 - protein, 4 aa, Staphylococcus
KNPI

SEQ ID NO: 1856094 - protein, 15 aa, Staphylococcus
KNPKDALWWEDEVRK

SEQ ID NO: 1856095 - protein, 4 aa, Staphylococcus
KNPL

SEQ ID NO: 1856096 - protein, 7 aa, Staphylococcus
KNPLAEP

SEQ ID NO: 1856097 - protein, 8 aa, Staphylococcus
KNPNGKFE

SEQ ID NO: 1856098 - protein, 6 aa, Staphylococcus
KNPNYA

SEQ ID NO: 1856099 - protein, 8 aa, Staphylococcus
KNPPEVAS

SEQ ID NO: 1856100 - protein, 12 aa, Staphylococcus
KNPPVKKEEINK

SEQ ID NO: 1856101 - protein, 4 aa, Staphylococcus
KNPQ

SEQ ID NO: 1856102 - protein, 9 aa, Staphylococcus
KNPQEHKDN

SEQ ID NO: 1856103 - protein, 8 aa, Staphylococcus
KNPQEKTY

SEQ ID NO: 1856104 - protein, 8 aa, Staphylococcus
KNPSDADI

SEQ ID NO: 1856105 - protein, 7 aa, Staphylococcus
KNPSNEQ

SEQ ID NO: 1856106 - protein, 15 aa, Staphylococcus
KNPTKLESDYKEPKR

SEQ ID NO: 1856107 - protein, 15 aa, Staphylococcus
KNPTTLEAGRKEPKR

SEQ ID NO: 1856108 - protein, 13 aa, Staphylococcus
KNPTYLDNAPDKI

SEQ ID NO: 1856109 - protein, 29 aa, Staphylococcus
KNQEAQQSQTEQDVTKNSQQENEAKSELQ

SEQ ID NO: 1856110 - protein, 9 aa, Staphylococcus
KNQEKAKNE

SEQ ID NO: 1856111 - protein, 7 aa, Staphylococcus
KNQETNE

SEQ ID NO: 1856112 - protein, 12 aa, Staphylococcus
KNQGKANALNQG

SEQ ID NO: 1856113 - protein, 4 aa, Staphylococcus
KNQI

SEQ ID NO: 1856114 - protein, 7 aa, Staphylococcus
KNQIEEE

SEQ ID NO: 1856115 - protein, 7 aa, Staphylococcus
KNQIQSR

SEQ ID NO: 1856116 - protein, 10 aa, Staphylococcus
KNQKGSFNSI

SEQ ID NO: 1856117 - protein, 21 aa, Staphylococcus
KNQKSISSQSYNSEDNNSQFI

SEQ ID NO: 1856118 - protein, 7 aa, Staphylococcus
KNQLQRT

SEQ ID NO: 1856119 - protein, 9 aa, Staphylococcus
KNQPLDTTT

SEQ ID NO: 1856120 - protein, 11 aa, Staphylococcus
KNQPQAKQALG

SEQ ID NO: 1856121 - protein, 6 aa, Staphylococcus
KNQSDE

SEQ ID NO: 1856122 - protein, 7 aa, Staphylococcus
KNQSEYV

SEQ ID NO: 1856123 - protein, 6 aa, Staphylococcus
KNQTSK

SEQ ID NO: 1856124 - protein, 8 aa, Staphylococcus
KNRHDINE

SEQ ID NO: 1856125 - protein, 6 aa, Staphylococcus
KNRING

SEQ ID NO: 1856126 - protein, 9 aa, Staphylococcus
KNRKANNHI

SEQ ID NO: 1856127 - protein, 7 aa, Staphylococcus
KNRKELN

SEQ ID NO: 1856128 - protein, 5 aa, Staphylococcus
KNRPS

SEQ ID NO: 1856129 - protein, 6 aa, Staphylococcus
KNRPSL

SEQ ID NO: 1856130 - protein, 246 aa, Staphylococcus
KNRQAIDPEDHNEQTSSHEEQEDNAVDRTEDKSNQQFPPRNAQRRKRRRDIATNNNRQADSRTKASQDGSLDDRHDDTSLHNGDNKNYDASNHNDVNKDHKQDHRPEDHSTRESEQDFKQDEPLNRSRKSDDLQHDDRHDKKDGHGKDAALAGGAAVGGAAVGKKMTSDHKQDDNHRQENRVSDHQKDRDRHDDFTKDEHRQDSSKDRQDELKKGHHDEEHHDSGKGKKAAATGAGVAGAAGAAGL

SEQ ID NO: 1856131 - protein, 216 aa, Staphylococcus
KNRQSIDPEEHNNRVNDEQQDESKENIEDKSNQQFPPRNAQRRKRRRDVATNHNKQQDDRNDNSNENNSLDDRYDEASLHNGENDNYDTASRTDHGQHDHDENLNRSSNNVREDQGAQDDRLGSGKDATIAGGAAGAGATGNAAQHSNKKAGARPGPKVNEGHNNDLTDDNHRRQQDHEERDFDEDRERHDKKSGKGKKAAAAGAGVAGAAGAAGV

SEQ ID NO: 1856132 - protein, 77 aa, Staphylococcus
KNRQSIDSNDQFDRVNNETNDEIDNFNNETDQQFPPRNAQRRQRRRNQSSSRNKKFNDQVNDYEEGSLDDRYDEETF

SEQ ID NO: 1856133 - protein, 82 aa, Staphylococcus
KNRQSINSDDQFEDNTNEFDENSNESNDFDNQSDQQFPPRNAQRRQRRRNQATNKNRKFGNQNSDSNANGSLDDRHDEDSFN

SEQ ID NO: 1856134 - protein, 8 aa, Staphylococcus
KNRYNDGN

SEQ ID NO: 1856135 - protein, 9 aa, Staphylococcus
KNSDIKNSQ

SEQ ID NO: 1856136 - protein, 5 aa, Staphylococcus
KNSDY

SEQ ID NO: 1856137 - protein, 12 aa, Staphylococcus
KNSHPDKDGNTI

SEQ ID NO: 1856138 - protein, 7 aa, Staphylococcus
KNSITNK

SEQ ID NO: 1856139 - protein, 7 aa, Staphylococcus
KNSKDLG

SEQ ID NO: 1856140 - protein, 11 aa, Staphylococcus
KNSKEGDRQNE

SEQ ID NO: 1856141 - protein, 7 aa, Staphylococcus
KNSKGDL

SEQ ID NO: 1856142 - protein, 11 aa, Staphylococcus
KNSKTKPDAAI

SEQ ID NO: 1856143 - protein, 8 aa, Staphylococcus
KNSKYQKV

SEQ ID NO: 1856144 - protein, 17 aa, Staphylococcus
KNSLKKVNEKLKENLNL

SEQ ID NO: 1856145 - protein, 11 aa, Staphylococcus
KNSPKSNKGIY

SEQ ID NO: 1856146 - protein, 6 aa, Staphylococcus
KNSQVA

SEQ ID NO: 1856147 - protein, 6 aa, Staphylococcus
KNSSIY

SEQ ID NO: 1856148 - protein, 4 aa, Staphylococcus
KNST

SEQ ID NO: 1856149 - protein, 29 aa, Staphylococcus
KNSTGAQSESEQSVSQTSQKETDAKEELQ

SEQ ID NO: 1856150 - protein, 9 aa, Staphylococcus
KNSTLSEEN

SEQ ID NO: 1856151 - protein, 7 aa, Staphylococcus
KNSVTGL

SEQ ID NO: 1856152 - protein, 5 aa, Staphylococcus
KNTCN

SEQ ID NO: 1856153 - protein, 6 aa, Staphylococcus
KNTGSL

SEQ ID NO: 1856154 - protein, 15 aa, Staphylococcus
KNTITKSEIAHTPDV

SEQ ID NO: 1856155 - protein, 7 aa, Staphylococcus
KNTKEHK

SEQ ID NO: 1856156 - protein, 13 aa, Staphylococcus
KNTKQGKDVKQQW

SEQ ID NO: 1856157 - protein, 11 aa, Staphylococcus
KNTNDPNINPQ

SEQ ID NO: 1856158 - protein, 8 aa, Staphylococcus
KNTPKNTY

SEQ ID NO: 1856159 - protein, 12 aa, Staphylococcus
KNTPNFEEEPDK

SEQ ID NO: 1856160 - protein, 7 aa, Staphylococcus
KNTQTEI

SEQ ID NO: 1856161 - protein, 7 aa, Staphylococcus
KNTSEYV

SEQ ID NO: 1856162 - protein, 5 aa, Staphylococcus
KNTTN

SEQ ID NO: 1856163 - protein, 6 aa, Staphylococcus
KNTTVN

SEQ ID NO: 1856164 - protein, 13 aa, Staphylococcus
KNTVDNQKNGTVF

SEQ ID NO: 1856165 - protein, 5 aa, Staphylococcus
KNTVS

SEQ ID NO: 1856166 - protein, 7 aa, Staphylococcus
KNVAKKY

SEQ ID NO: 1856167 - protein, 13 aa, Staphylococcus
KNVDKDEKKDILN

SEQ ID NO: 1856168 - protein, 19 aa, Staphylococcus
KNVDKNIETRSEAASEISS

SEQ ID NO: 1856169 - protein, 5 aa, Staphylococcus
KNVGT

SEQ ID NO: 1856170 - protein, 6 aa, Staphylococcus
KNVKDI

SEQ ID NO: 1856171 - protein, 9 aa, Staphylococcus
KNVKKRKSV

SEQ ID NO: 1856172 - protein, 25 aa, Staphylococcus
KNVKNVTDPFQNKDVEDKLVSKNKK

SEQ ID NO: 1856173 - protein, 7 aa, Staphylococcus
KNVKTDL

SEQ ID NO: 1856174 - protein, 6 aa, Staphylococcus
KNVLTK

SEQ ID NO: 1856175 - protein, 4 aa, Staphylococcus
KNVN

SEQ ID NO: 1856176 - protein, 27 aa, Staphylococcus
KNVQKTLQDRIDNGDYYKNDDQQVGST

SEQ ID NO: 1856177 - protein, 4 aa, Staphylococcus
KNVR

SEQ ID NO: 1856178 - protein, 11 aa, Staphylococcus
KNVSKKDYKAI

SEQ ID NO: 1856179 - protein, 8 aa, Staphylococcus
KNVTHTGK

SEQ ID NO: 1856180 - protein, 9 aa, Staphylococcus
KNVTSIATH

SEQ ID NO: 1856181 - protein, 14 aa, Staphylococcus
KNVYNSKSLKTAID

SEQ ID NO: 1856182 - protein, 4 aa, Staphylococcus
KNYD

SEQ ID NO: 1856183 - protein, 7 aa, Staphylococcus
KNYHGIK

SEQ ID NO: 1856184 - protein, 7 aa, Staphylococcus
KNYKSGT

SEQ ID NO: 1856185 - protein, 4 aa, Staphylococcus
KNYQ

SEQ ID NO: 1856186 - protein, 8 aa, Staphylococcus
KNYRGTTD

SEQ ID NO: 1856187 - protein, 7 aa, Staphylococcus
KNYTKKD

SEQ ID NO: 1856188 - protein, 7 aa, Staphylococcus
KNYTTIE

SEQ ID NO: 1856189 - protein, 9 aa, Staphylococcus
KPADKSNRY

SEQ ID NO: 1856190 - protein, 9 aa, Staphylococcus
KPAKYTKKS

SEQ ID NO: 1856191 - protein, 5 aa, Staphylococcus
KPALD

SEQ ID NO: 1856192 - protein, 6 aa, Staphylococcus
KPALES

SEQ ID NO: 1856193 - protein, 16 aa, Staphylococcus
KPALTEGHYPKADNEI

SEQ ID NO: 1856194 - protein, 14 aa, Staphylococcus
KPAREDIDKVIGGQ

SEQ ID NO: 1856195 - protein, 13 aa, Staphylococcus
KPATEEDASWNEM

SEQ ID NO: 1856196 - protein, 16 aa, Staphylococcus
KPAYKEVEALASERGD

SEQ ID NO: 1856197 - protein, 6 aa, Staphylococcus
KPAYQD

SEQ ID NO: 1856198 - protein, 8 aa, Staphylococcus
KPDAKKIP

SEQ ID NO: 1856199 - protein, 6 aa, Staphylococcus
KPDALD

SEQ ID NO: 1856200 - protein, 6 aa, Staphylococcus
KPDALN

SEQ ID NO: 1856201 - protein, 10 aa, Staphylococcus
KPDATKAEVE

SEQ ID NO: 1856202 - protein, 8 aa, Staphylococcus
KPDKRQQF

SEQ ID NO: 1856203 - protein, 5 aa, Staphylococcus
KPDMA

SEQ ID NO: 1856204 - protein, 6 aa, Staphylococcus
KPDRVH

SEQ ID NO: 1856205 - protein, 10 aa, Staphylococcus
KPDTDNYKTM

SEQ ID NO: 1856206 - protein, 7 aa, Staphylococcus
KPDTLQA

SEQ ID NO: 1856207 - protein, 6 aa, Staphylococcus
KPEAIN

SEQ ID NO: 1856208 - protein, 7 aa, Staphylococcus
KPEAIND

SEQ ID NO: 1856209 - protein, 8 aa, Staphylococcus
KPEANEAL

SEQ ID NO: 1856210 - protein, 11 aa, Staphylococcus
KPEAPAQTKHK

SEQ ID NO: 1856211 - protein, 8 aa, Staphylococcus
KPEEISHG

SEQ ID NO: 1856212 - protein, 12 aa, Staphylococcus
KPEKLPHKPHEP

SEQ ID NO: 1856213 - protein, 4 aa, Staphylococcus
KPEQ

SEQ ID NO: 1856214 - protein, 8 aa, Staphylococcus
KPESKENM

SEQ ID NO: 1856215 - protein, 14 aa, Staphylococcus
KPETLENGEKGISP

SEQ ID NO: 1856216 - protein, 14 aa, Staphylococcus
KPETLESGEKGISP

SEQ ID NO: 1856217 - protein, 14 aa, Staphylococcus
KPETLESGKKGISP

SEQ ID NO: 1856218 - protein, 15 aa, Staphylococcus
KPFGTPTTADEVKKA

SEQ ID NO: 1856219 - protein, 8 aa, Staphylococcus
KPGAGHSD

SEQ ID NO: 1856220 - protein, 10 aa, Staphylococcus
KPGASDEEVV

SEQ ID NO: 1856221 - protein, 8 aa, Staphylococcus
KPGKLSFS

SEQ ID NO: 1856222 - protein, 6 aa, Staphylococcus
KPGNNL

SEQ ID NO: 1856223 - protein, 5 aa, Staphylococcus
KPGQA

SEQ ID NO: 1856224 - protein, 32 aa, Staphylococcus
KPGQGLDRSKLPSGDISKYQTTAQAAEHSTYG

SEQ ID NO: 1856225 - protein, 6 aa, Staphylococcus
KPHKQV

SEQ ID NO: 1856226 - protein, 5 aa, Staphylococcus
KPIAQ

SEQ ID NO: 1856227 - protein, 7 aa, Staphylococcus
KPIDTIS

SEQ ID NO: 1856228 - protein, 21 aa, Staphylococcus
KPINPNSEEARVNEKIKNQQS

SEQ ID NO: 1856229 - protein, 5 aa, Staphylococcus
KPITQ

SEQ ID NO: 1856230 - protein, 18 aa, Staphylococcus
KPITSNSNTTASANATNQ

SEQ ID NO: 1856231 - protein, 23 aa, Staphylococcus
KPKDIKKRQYALQQEKQQTIDRL

SEQ ID NO: 1856232 - protein, 7 aa, Staphylococcus
KPKFDND

SEQ ID NO: 1856233 - protein, 11 aa, Staphylococcus
KPKGYEPTQSV

SEQ ID NO: 1856234 - protein, 4 aa, Staphylococcus
KPKI

SEQ ID NO: 1856235 - protein, 5 aa, Staphylococcus
KPKKD

SEQ ID NO: 1856236 - protein, 14 aa, Staphylococcus
KPKKNRDLKNEKIS

SEQ ID NO: 1856237 - protein, 4 aa, Staphylococcus
KPKL

SEQ ID NO: 1856238 - protein, 31 aa, Staphylococcus
KPKLDTKYEFKDGGKKKTVIADANKTTSLGT

SEQ ID NO: 1856239 - protein, 7 aa, Staphylococcus
KPKNATG

SEQ ID NO: 1856240 - protein, 8 aa, Staphylococcus
KPKNDQKI

SEQ ID NO: 1856241 - protein, 57 aa, Staphylococcus
KPKNDSNHQYNDKHNAYANNEHHRNNNHNEYDKNNNYNNNHNEYDRNHSHDDNHHNY

SEQ ID NO: 1856242 - protein, 16 aa, Staphylococcus
KPKNNGQAFESTAKPT

SEQ ID NO: 1856243 - protein, 7 aa, Staphylococcus
KPKNRGK

SEQ ID NO: 1856244 - protein, 14 aa, Staphylococcus
KPKRNRDLKNERIS

SEQ ID NO: 1856245 - protein, 14 aa, Staphylococcus
KPKRNRELKNEKIS

SEQ ID NO: 1856246 - protein, 13 aa, Staphylococcus
KPKRNRELSHEKI

SEQ ID NO: 1856247 - protein, 8 aa, Staphylococcus
KPKSKIAV

SEQ ID NO: 1856248 - protein, 8 aa, Staphylococcus
KPKTQYDY

SEQ ID NO: 1856249 - protein, 5 aa, Staphylococcus
KPKVA

SEQ ID NO: 1856250 - protein, 29 aa, Staphylococcus
KPKYDATYKFKSDDKQKTVTAEKNKTTAI

SEQ ID NO: 1856251 - protein, 4 aa, Staphylococcus
KPLH

SEQ ID NO: 1856252 - protein, 13 aa, Staphylococcus
KPLPSDEVDNTYK

SEQ ID NO: 1856253 - protein, 4 aa, Staphylococcus
KPLS

SEQ ID NO: 1856254 - protein, 46 aa, Staphylococcus
KPLSENDSDNRETGSEKSEDSNETKDEKHEDTQVEASEKNGNNKQP

SEQ ID NO: 1856255 - protein, 6 aa, Staphylococcus
KPLTRV

SEQ ID NO: 1856256 - protein, 14 aa, Staphylococcus
KPNAPGDKSGLKKD

SEQ ID NO: 1856257 - protein, 11 aa, Staphylococcus
KPNDSNDSNQL

SEQ ID NO: 1856258 - protein, 4 aa, Staphylococcus
KPNE

SEQ ID NO: 1856259 - protein, 10 aa, Staphylococcus
KPNKDIGDQG

SEQ ID NO: 1856260 - protein, 5 aa, Staphylococcus
KPNQA

SEQ ID NO: 1856261 - protein, 10 aa, Staphylococcus
KPNQLPQRAH

SEQ ID NO: 1856262 - protein, 6 aa, Staphylococcus
KPNRLK

SEQ ID NO: 1856263 - protein, 6 aa, Staphylococcus
KPNVQK

SEQ ID NO: 1856264 - protein, 10 aa, Staphylococcus
KPPGSTHSRN

SEQ ID NO: 1856265 - protein, 17 aa, Staphylococcus
KPPYKDIEKLEGNRGEA

SEQ ID NO: 1856266 - protein, 11 aa, Staphylococcus
KPQEDASSKHS

SEQ ID NO: 1856267 - protein, 11 aa, Staphylococcus
KPQGANIGEQR

SEQ ID NO: 1856268 - protein, 8 aa, Staphylococcus
KPQYEKTY

SEQ ID NO: 1856269 - protein, 14 aa, Staphylococcus
KPQYRKSYTDSEGV

SEQ ID NO: 1856270 - protein, 21 aa, Staphylococcus
KPRDYKRESYTDNEAGNTEIK

SEQ ID NO: 1856271 - protein, 4 aa, Staphylococcus
KPRF

SEQ ID NO: 1856272 - protein, 8 aa, Staphylococcus
KPRFYNDG

SEQ ID NO: 1856273 - protein, 7 aa, Staphylococcus
KPRRHYD

SEQ ID NO: 1856274 - protein, 8 aa, Staphylococcus
KPRYHTPR

SEQ ID NO: 1856275 - protein, 8 aa, Staphylococcus
KPSAKDDI

SEQ ID NO: 1856276 - protein, 5 aa, Staphylococcus
KPSDL

SEQ ID NO: 1856277 - protein, 4 aa, Staphylococcus
KPSH

SEQ ID NO: 1856278 - protein, 21 aa, Staphylococcus
KPSINQPEAQIKDQQTHQSAH

SEQ ID NO: 1856279 - protein, 16 aa, Staphylococcus
KPSNTFDLNTNQAKVD

SEQ ID NO: 1856280 - protein, 9 aa, Staphylococcus
KPSNTPNKF

SEQ ID NO: 1856281 - protein, 16 aa, Staphylococcus
KPSSEYDLKSRQAQVD

SEQ ID NO: 1856282 - protein, 5 aa, Staphylococcus
KPSYF

SEQ ID NO: 1856283 - protein, 6 aa, Staphylococcus
KPSYNN

SEQ ID NO: 1856284 - protein, 14 aa, Staphylococcus
KPTARKAINTKADE

SEQ ID NO: 1856285 - protein, 4 aa, Staphylococcus
KPTF

SEQ ID NO: 1856286 - protein, 7 aa, Staphylococcus
KPTGLTQ

SEQ ID NO: 1856287 - protein, 10 aa, Staphylococcus
KPTQAKKSSY

SEQ ID NO: 1856288 - protein, 5 aa, Staphylococcus
KPTSA

SEQ ID NO: 1856289 - protein, 5 aa, Staphylococcus
KPVRA

SEQ ID NO: 1856290 - protein, 6 aa, Staphylococcus
KPVSES

SEQ ID NO: 1856291 - protein, 4 aa, Staphylococcus
KPVV

SEQ ID NO: 1856292 - protein, 9 aa, Staphylococcus
KPYDDSNDV

SEQ ID NO: 1856293 - protein, 19 aa, Staphylococcus
KPYEPKSYKDDTISHTTAR

SEQ ID NO: 1856294 - protein, 6 aa, Staphylococcus
KPYEVS

SEQ ID NO: 1856295 - protein, 6 aa, Staphylococcus
KPYKDI

SEQ ID NO: 1856296 - protein, 6 aa, Staphylococcus
KPYTRY

SEQ ID NO: 1856297 - protein, 23 aa, Staphylococcus
KQAAKSGGGVNKAASAWKPDIRR

SEQ ID NO: 1856298 - protein, 7 aa, Staphylococcus
KQADSQI

SEQ ID NO: 1856299 - protein, 5 aa, Staphylococcus
KQAFG

SEQ ID NO: 1856300 - protein, 6 aa, Staphylococcus
KQAHEQ

SEQ ID NO: 1856301 - protein, 6 aa, Staphylococcus
KQAHTP

SEQ ID NO: 1856302 - protein, 6 aa, Staphylococcus
KQAKDI

SEQ ID NO: 1856303 - protein, 8 aa, Staphylococcus
KQAKNSEP

SEQ ID NO: 1856304 - protein, 12 aa, Staphylococcus
KQAKSQGSKSTR

SEQ ID NO: 1856305 - protein, 5 aa, Staphylococcus
KQANG

SEQ ID NO: 1856306 - protein, 20 aa, Staphylococcus
KQANGLSSNNISNGQKLIIP

SEQ ID NO: 1856307 - protein, 10 aa, Staphylococcus
KQANTNKTFG

SEQ ID NO: 1856308 - protein, 7 aa, Staphylococcus
KQAPDKY

SEQ ID NO: 1856309 - protein, 4 aa, Staphylococcus
KQAQ

SEQ ID NO: 1856310 - protein, 7 aa, Staphylococcus
KQAQDKI

SEQ ID NO: 1856311 - protein, 7 aa, Staphylococcus
KQAQQMM

SEQ ID NO: 1856312 - protein, 6 aa, Staphylococcus
KQASNM

SEQ ID NO: 1856313 - protein, 8 aa, Staphylococcus
KQATGDLS

SEQ ID NO: 1856314 - protein, 7 aa, Staphylococcus
KQATSIN

SEQ ID NO: 1856315 - protein, 11 aa, Staphylococcus
KQAYSKANKSS

SEQ ID NO: 1856316 - protein, 9 aa, Staphylococcus
KQDFSKGNH

SEQ ID NO: 1856317 - protein, 10 aa, Staphylococcus
KQDGDQLNSR

SEQ ID NO: 1856318 - protein, 10 aa, Staphylococcus
KQDGNQLNTR

SEQ ID NO: 1856319 - protein, 9 aa, Staphylococcus
KQDGPPSVT

SEQ ID NO: 1856320 - protein, 8 aa, Staphylococcus
KQDGTGYA

SEQ ID NO: 1856321 - protein, 8 aa, Staphylococcus
KQDKGAAL

SEQ ID NO: 1856322 - protein, 7 aa, Staphylococcus
KQDKGKY

SEQ ID NO: 1856323 - protein, 6 aa, Staphylococcus
KQDLYS

SEQ ID NO: 1856324 - protein, 16 aa, Staphylococcus
KQDNESLEPAKQSDID

SEQ ID NO: 1856325 - protein, 20 aa, Staphylococcus
KQDPKLGAVTGNPRIRNKSS

SEQ ID NO: 1856326 - protein, 10 aa, Staphylococcus
KQDSSDKQYE

SEQ ID NO: 1856327 - protein, 11 aa, Staphylococcus
KQDYDKSKLKY

SEQ ID NO: 1856328 - protein, 28 aa, Staphylococcus
KQDYKDKKGGTASSEQPKSTGNEYDDKA

SEQ ID NO: 1856329 - protein, 27 aa, Staphylococcus
KQDYKEKKGEGKASKSQSTGNEYDDKA

SEQ ID NO: 1856330 - protein, 4 aa, Staphylococcus
KQEA

SEQ ID NO: 1856331 - protein, 10 aa, Staphylococcus
KQEEETRAIQ

SEQ ID NO: 1856332 - protein, 10 aa, Staphylococcus
KQEEQARAVQ

SEQ ID NO: 1856333 - protein, 9 aa, Staphylococcus
KQEEQTRAI

SEQ ID NO: 1856334 - protein, 10 aa, Staphylococcus
KQEEQTRAIQ

SEQ ID NO: 1856335 - protein, 10 aa, Staphylococcus
KQEEQTRGVQ

SEQ ID NO: 1856336 - protein, 4 aa, Staphylococcus
KQEG

SEQ ID NO: 1856337 - protein, 6 aa, Staphylococcus
KQEGEW

SEQ ID NO: 1856338 - protein, 11 aa, Staphylococcus
KQEHDNKRELK

SEQ ID NO: 1856339 - protein, 6 aa, Staphylococcus
KQEHNP

SEQ ID NO: 1856340 - protein, 5 aa, Staphylococcus
KQEIG

SEQ ID NO: 1856341 - protein, 16 aa, Staphylococcus
KQELPDTGYDVANNGT

SEQ ID NO: 1856342 - protein, 5 aa, Staphylococcus
KQELR

SEQ ID NO: 1856343 - protein, 17 aa, Staphylococcus
KQEPKASYAYEDKAEFE

SEQ ID NO: 1856344 - protein, 5 aa, Staphylococcus
KQEQL

SEQ ID NO: 1856345 - protein, 8 aa, Staphylococcus
KQERRQKI

SEQ ID NO: 1856346 - protein, 13 aa, Staphylococcus
KQEVPRAERNHQP

SEQ ID NO: 1856347 - protein, 12 aa, Staphylococcus
KQGDVGRKKLNN

SEQ ID NO: 1856348 - protein, 8 aa, Staphylococcus
KQGETGRQ

SEQ ID NO: 1856349 - protein, 12 aa, Staphylococcus
KQGGPYNHVGKS

SEQ ID NO: 1856350 - protein, 5 aa, Staphylococcus
KQGIE

SEQ ID NO: 1856351 - protein, 6 aa, Staphylococcus
KQGQMP

SEQ ID NO: 1856352 - protein, 22 aa, Staphylococcus
KQGQSSCKSGETISIKNGEAVA

SEQ ID NO: 1856353 - protein, 10 aa, Staphylococcus
KQGRKNADIM

SEQ ID NO: 1856354 - protein, 10 aa, Staphylococcus
KQGRKNKEIM

SEQ ID NO: 1856355 - protein, 6 aa, Staphylococcus
KQGSVN

SEQ ID NO: 1856356 - protein, 4 aa, Staphylococcus
KQGV

SEQ ID NO: 1856357 - protein, 4 aa, Staphylococcus
KQGY

SEQ ID NO: 1856358 - protein, 6 aa, Staphylococcus
KQGYGT

SEQ ID NO: 1856359 - protein, 5 aa, Staphylococcus
KQGYI

SEQ ID NO: 1856360 - protein, 6 aa, Staphylococcus
KQGYIG

SEQ ID NO: 1856361 - protein, 6 aa, Staphylococcus
KQGYVG

SEQ ID NO: 1856362 - protein, 8 aa, Staphylococcus
KQHATPKQ

SEQ ID NO: 1856363 - protein, 27 aa, Staphylococcus
KQHDGSGYNEVGHDEQHPQTTDAPSVI

SEQ ID NO: 1856364 - protein, 10 aa, Staphylococcus
KQHHSKRELK

SEQ ID NO: 1856365 - protein, 5 aa, Staphylococcus
KQHKQ

SEQ ID NO: 1856366 - protein, 9 aa, Staphylococcus
KQHNKVDRA

SEQ ID NO: 1856367 - protein, 9 aa, Staphylococcus
KQHTTKNKD

SEQ ID NO: 1856368 - protein, 12 aa, Staphylococcus
KQIDKNGDLTDY

SEQ ID NO: 1856369 - protein, 7 aa, Staphylococcus
KQIEQKQ

SEQ ID NO: 1856370 - protein, 6 aa, Staphylococcus
KQIGGT

SEQ ID NO: 1856371 - protein, 17 aa, Staphylococcus
KQIKNESTAYASSIGDE

SEQ ID NO: 1856372 - protein, 8 aa, Staphylococcus
KQINAKDN

SEQ ID NO: 1856373 - protein, 8 aa, Staphylococcus
KQINGKGN

SEQ ID NO: 1856374 - protein, 15 aa, Staphylococcus
KQINSPGTVSIGQNS

SEQ ID NO: 1856375 - protein, 14 aa, Staphylococcus
KQIQKQDVKPTPSA

SEQ ID NO: 1856376 - protein, 12 aa, Staphylococcus
KQISKNGKLTDY

SEQ ID NO: 1856377 - protein, 12 aa, Staphylococcus
KQKAATETQSNP

SEQ ID NO: 1856378 - protein, 8 aa, Staphylococcus
KQKANEQK

SEQ ID NO: 1856379 - protein, 9 aa, Staphylococcus
KQKDQYQAT

SEQ ID NO: 1856380 - protein, 8 aa, Staphylococcus
KQKDTSKE

SEQ ID NO: 1856381 - protein, 5 aa, Staphylococcus
KQKEP

SEQ ID NO: 1856382 - protein, 16 aa, Staphylococcus
KQKLQSNRLKTTVENI

SEQ ID NO: 1856383 - protein, 12 aa, Staphylococcus
KQKPAGPDQITT

SEQ ID NO: 1856384 - protein, 4 aa, Staphylococcus
KQKQ

SEQ ID NO: 1856385 - protein, 60 aa, Staphylococcus
KQKSYDRYQPAKGNRKKEQAKHHHNNQKRNTETTYHEEDDHKSEEQDKAPTQLSRKARYK

SEQ ID NO: 1856386 - protein, 14 aa, Staphylococcus
KQLDAKAEKGDSTL

SEQ ID NO: 1856387 - protein, 31 aa, Staphylococcus
KQLDTNNRNEKHAREAGANTVEKKEAKDLET

SEQ ID NO: 1856388 - protein, 31 aa, Staphylococcus
KQLEQENDADYNNDEESNDYAGRKQTHREEE

SEQ ID NO: 1856389 - protein, 14 aa, Staphylococcus
KQLESRLDENKTTI

SEQ ID NO: 1856390 - protein, 5 aa, Staphylococcus
KQLGE

SEQ ID NO: 1856391 - protein, 4 aa, Staphylococcus
KQLK

SEQ ID NO: 1856392 - protein, 11 aa, Staphylococcus
KQLKDLSAKSV

SEQ ID NO: 1856393 - protein, 6 aa, Staphylococcus
KQLKST

SEQ ID NO: 1856394 - protein, 10 aa, Staphylococcus
KQLMQSSNEN

SEQ ID NO: 1856395 - protein, 5 aa, Staphylococcus
KQLNN

SEQ ID NO: 1856396 - protein, 6 aa, Staphylococcus
KQLNNT

SEQ ID NO: 1856397 - protein, 8 aa, Staphylococcus
KQLNQLTK

SEQ ID NO: 1856398 - protein, 6 aa, Staphylococcus
KQLPTA

SEQ ID NO: 1856399 - protein, 5 aa, Staphylococcus
KQLPV

SEQ ID NO: 1856400 - protein, 6 aa, Staphylococcus
KQLPVG

SEQ ID NO: 1856401 - protein, 9 aa, Staphylococcus
KQLTPTEKI

SEQ ID NO: 1856402 - protein, 7 aa, Staphylococcus
KQMEAEG

SEQ ID NO: 1856403 - protein, 20 aa, Staphylococcus
KQMKYSSSREYGPYPQTKDV

SEQ ID NO: 1856404 - protein, 33 aa, Staphylococcus
KQMNDGNSEVKEDKNASKEQTAALNSAKNYADG

SEQ ID NO: 1856405 - protein, 8 aa, Staphylococcus
KQMPQEQR

SEQ ID NO: 1856406 - protein, 6 aa, Staphylococcus
KQNAPL

SEQ ID NO: 1856407 - protein, 7 aa, Staphylococcus
KQNATLN

SEQ ID NO: 1856408 - protein, 13 aa, Staphylococcus
KQNEELEEKQSEL

SEQ ID NO: 1856409 - protein, 14 aa, Staphylococcus
KQNENNEIKNISAN

SEQ ID NO: 1856410 - protein, 12 aa, Staphylococcus
KQNESIGEKYEL

SEQ ID NO: 1856411 - protein, 6 aa, Staphylococcus
KQNGPL

SEQ ID NO: 1856412 - protein, 7 aa, Staphylococcus
KQNKALN

SEQ ID NO: 1856413 - protein, 13 aa, Staphylococcus
KQNKQTDWSPKKL

SEQ ID NO: 1856414 - protein, 13 aa, Staphylococcus
KQNKQTNWSQNKL

SEQ ID NO: 1856415 - protein, 15 aa, Staphylococcus
KQNKRTDWSKTKLEN

SEQ ID NO: 1856416 - protein, 5 aa, Staphylococcus
KQNLS

SEQ ID NO: 1856417 - protein, 5 aa, Staphylococcus
KQNND

SEQ ID NO: 1856418 - protein, 7 aa, Staphylococcus
KQNPNPS

SEQ ID NO: 1856419 - protein, 12 aa, Staphylococcus
KQNPYSKSAFKT

SEQ ID NO: 1856420 - protein, 9 aa, Staphylococcus
KQNSNGAPV

SEQ ID NO: 1856421 - protein, 35 aa, Staphylococcus
KQNVKEQLSQLGENQKQVINSNTEATKDEKDEAIE

SEQ ID NO: 1856422 - protein, 11 aa, Staphylococcus
KQNYDKSKLKY

SEQ ID NO: 1856423 - protein, 7 aa, Staphylococcus
KQPESGH

SEQ ID NO: 1856424 - protein, 21 aa, Staphylococcus
KQPGDWKNQDLGTGAGNDSIE

SEQ ID NO: 1856425 - protein, 9 aa, Staphylococcus
KQPISQQQH

SEQ ID NO: 1856426 - protein, 15 aa, Staphylococcus
KQPKITNSDEIKTSQ

SEQ ID NO: 1856427 - protein, 13 aa, Staphylococcus
KQPLSNDPFDSTK

SEQ ID NO: 1856428 - protein, 9 aa, Staphylococcus
KQPQSQEAI

SEQ ID NO: 1856429 - protein, 21 aa, Staphylococcus
KQPSLNKEKEEKVEAAKPKGL

SEQ ID NO: 1856430 - protein, 6 aa, Staphylococcus
KQQAID

SEQ ID NO: 1856431 - protein, 7 aa, Staphylococcus
KQQAQTI

SEQ ID NO: 1856432 - protein, 4 aa, Staphylococcus
KQQD

SEQ ID NO: 1856433 - protein, 7 aa, Staphylococcus
KQQEKLK

SEQ ID NO: 1856434 - protein, 20 aa, Staphylococcus
KQQEYISDSQYQEALSQLNN

SEQ ID NO: 1856435 - protein, 19 aa, Staphylococcus
KQQGYISNSQYENAIQELG

SEQ ID NO: 1856436 - protein, 10 aa, Staphylococcus
KQQHSGYDTY

SEQ ID NO: 1856437 - protein, 4 aa, Staphylococcus
KQQI

SEQ ID NO: 1856438 - protein, 10 aa, Staphylococcus
KQQIQSTEAA

SEQ ID NO: 1856439 - protein, 19 aa, Staphylococcus
KQQLDERDISYTSTSQNVG

SEQ ID NO: 1856440 - protein, 8 aa, Staphylococcus
KQQLDERG

SEQ ID NO: 1856441 - protein, 7 aa, Staphylococcus
KQQLNEQ

SEQ ID NO: 1856442 - protein, 7 aa, Staphylococcus
KQQLQNA

SEQ ID NO: 1856443 - protein, 20 aa, Staphylococcus
KQQRQVKQNNESLGTVGRGY

SEQ ID NO: 1856444 - protein, 30 aa, Staphylococcus
KQQTDLTDAQKDKLIEKTKASTTSDELENI

SEQ ID NO: 1856445 - protein, 13 aa, Staphylococcus
KQQTVKSKNSLDF

SEQ ID NO: 1856446 - protein, 27 aa, Staphylococcus
KQQVDAKDDSIKKAIKSKNESELQSIN

SEQ ID NO: 1856447 - protein, 4 aa, Staphylococcus
KQRE

SEQ ID NO: 1856448 - protein, 7 aa, Staphylococcus
KQRGASH

SEQ ID NO: 1856449 - protein, 6 aa, Staphylococcus
KQRGEL

SEQ ID NO: 1856450 - protein, 14 aa, Staphylococcus
KQRHDINEGKDVHD

SEQ ID NO: 1856451 - protein, 5 aa, Staphylococcus
KQRLT

SEQ ID NO: 1856452 - protein, 16 aa, Staphylococcus
KQRNGYTIKKDKQQNG

SEQ ID NO: 1856453 - protein, 12 aa, Staphylococcus
KQRNQSSEVNDH

SEQ ID NO: 1856454 - protein, 8 aa, Staphylococcus
KQRPDESY

SEQ ID NO: 1856455 - protein, 24 aa, Staphylococcus
KQRQKEKQQEENIESLSEARRETK

SEQ ID NO: 1856456 - protein, 9 aa, Staphylococcus
KQRYNTKDG

SEQ ID NO: 1856457 - protein, 18 aa, Staphylococcus
KQSDNISELNALIEKLVK

SEQ ID NO: 1856458 - protein, 15 aa, Staphylococcus
KQSEHVQATGCEAQQ

SEQ ID NO: 1856459 - protein, 6 aa, Staphylococcus
KQSETI

SEQ ID NO: 1856460 - protein, 30 aa, Staphylococcus
KQSIADKNDTLNSSNYINEDPDKKIAYDNA

SEQ ID NO: 1856461 - protein, 109 aa, Staphylococcus
KQSKFVDKTSTEKKALETQTSEKEITNSTSTSIKEKIEESSPVTKEEKTNELKEKSSPIVGTQSSNQSKQKVKFSSSKSVKQIDDKIDTPRESKSDNRQKIDSKNISKL

SEQ ID NO: 1856462 - protein, 7 aa, Staphylococcus
KQSKGTI

SEQ ID NO: 1856463 - protein, 7 aa, Staphylococcus
KQSLDRD

SEQ ID NO: 1856464 - protein, 27 aa, Staphylococcus
KQSNDKAAVERKHKEEQFQKKQDEEIA

SEQ ID NO: 1856465 - protein, 10 aa, Staphylococcus
KQSNGRGETY

SEQ ID NO: 1856466 - protein, 26 aa, Staphylococcus
KQSNNDDAVERQQKEEKYQKQQDEEL

SEQ ID NO: 1856467 - protein, 27 aa, Staphylococcus
KQSNSEDAAERKHKEEQFQKQQDEEIA

SEQ ID NO: 1856468 - protein, 8 aa, Staphylococcus
KQSPDKYD

SEQ ID NO: 1856469 - protein, 8 aa, Staphylococcus
KQSPEFGC

SEQ ID NO: 1856470 - protein, 9 aa, Staphylococcus
KQSPEFGHP

SEQ ID NO: 1856471 - protein, 10 aa, Staphylococcus
KQSPEFGNPE

SEQ ID NO: 1856472 - protein, 6 aa, Staphylococcus
KQSRLK

SEQ ID NO: 1856473 - protein, 13 aa, Staphylococcus
KQSRNDVNGKNRH

SEQ ID NO: 1856474 - protein, 11 aa, Staphylococcus
KQSSGGSTITQ

SEQ ID NO: 1856475 - protein, 12 aa, Staphylococcus
KQSSHLQNTGCE

SEQ ID NO: 1856476 - protein, 8 aa, Staphylococcus
KQSTGNLS

SEQ ID NO: 1856477 - protein, 8 aa, Staphylococcus
KQSTGNVS

SEQ ID NO: 1856478 - protein, 16 aa, Staphylococcus
KQTDDHTTTSSLNEEI

SEQ ID NO: 1856479 - protein, 10 aa, Staphylococcus
KQTIQSKNNL

SEQ ID NO: 1856480 - protein, 6 aa, Staphylococcus
KQTKLP

SEQ ID NO: 1856481 - protein, 8 aa, Staphylococcus
KQTLREGD

SEQ ID NO: 1856482 - protein, 6 aa, Staphylococcus
KQTNGV

SEQ ID NO: 1856483 - protein, 12 aa, Staphylococcus
KQTNHENNQNDD

SEQ ID NO: 1856484 - protein, 7 aa, Staphylococcus
KQTNQFE

SEQ ID NO: 1856485 - protein, 8 aa, Staphylococcus
KQTPDKYD

SEQ ID NO: 1856486 - protein, 12 aa, Staphylococcus
KQTRREKSTKER

SEQ ID NO: 1856487 - protein, 10 aa, Staphylococcus
KQTRSEKQIK

SEQ ID NO: 1856488 - protein, 4 aa, Staphylococcus
KQTT

SEQ ID NO: 1856489 - protein, 10 aa, Staphylococcus
KQTTERTNDD

SEQ ID NO: 1856490 - protein, 8 aa, Staphylococcus
KQVGKESD

SEQ ID NO: 1856491 - protein, 8 aa, Staphylococcus
KQVGKESE

SEQ ID NO: 1856492 - protein, 14 aa, Staphylococcus
KQVKTEEKKPISTK

SEQ ID NO: 1856493 - protein, 9 aa, Staphylococcus
KQVNSLSPH

SEQ ID NO: 1856494 - protein, 18 aa, Staphylococcus
KQVQSASQSSSEKQSQFA

SEQ ID NO: 1856495 - protein, 15 aa, Staphylococcus
KQYDESAKDGQGRDY

SEQ ID NO: 1856496 - protein, 15 aa, Staphylococcus
KQYEKGIYSKREATV

SEQ ID NO: 1856497 - protein, 6 aa, Staphylococcus
KQYGDQ

SEQ ID NO: 1856498 - protein, 4 aa, Staphylococcus
KQYP

SEQ ID NO: 1856499 - protein, 7 aa, Staphylococcus
KQYPPTY

SEQ ID NO: 1856500 - protein, 7 aa, Staphylococcus
KQYSSRR

SEQ ID NO: 1856501 - protein, 6 aa, Staphylococcus
KRADHD

SEQ ID NO: 1856502 - protein, 10 aa, Staphylococcus
KRAGKDTDSF

SEQ ID NO: 1856503 - protein, 8 aa, Staphylococcus
KRAKEEVA

SEQ ID NO: 1856504 - protein, 5 aa, Staphylococcus
KRALQ

SEQ ID NO: 1856505 - protein, 20 aa, Staphylococcus
KRANGLNSNNISNGQQLVIP

SEQ ID NO: 1856506 - protein, 20 aa, Staphylococcus
KRANGLSSNDIHNGQTLVIP

SEQ ID NO: 1856507 - protein, 20 aa, Staphylococcus
KRANGLTSNNIVNGQKLVIP

SEQ ID NO: 1856508 - protein, 8 aa, Staphylococcus
KRASDQHI

SEQ ID NO: 1856509 - protein, 10 aa, Staphylococcus
KRASQDTDSF

SEQ ID NO: 1856510 - protein, 10 aa, Staphylococcus
KRASQNTDSF

SEQ ID NO: 1856511 - protein, 8 aa, Staphylococcus
KRATAKLE

SEQ ID NO: 1856512 - protein, 5 aa, Staphylococcus
KRATE

SEQ ID NO: 1856513 - protein, 7 aa, Staphylococcus
KRATNRL

SEQ ID NO: 1856514 - protein, 9 aa, Staphylococcus
KRDDKSEVK

SEQ ID NO: 1856515 - protein, 8 aa, Staphylococcus
KRDGITPS

SEQ ID NO: 1856516 - protein, 20 aa, Staphylococcus
KRDKSSANKEQKLKKQEPGH

SEQ ID NO: 1856517 - protein, 12 aa, Staphylococcus
KRDRKGENFARK

SEQ ID NO: 1856518 - protein, 15 aa, Staphylococcus
KRDRKGENVARKSMT

SEQ ID NO: 1856519 - protein, 13 aa, Staphylococcus
KRDRSGENIARKT

SEQ ID NO: 1856520 - protein, 13 aa, Staphylococcus
KRDRTGENIARKS

SEQ ID NO: 1856521 - protein, 9 aa, Staphylococcus
KRDTPYGYV

SEQ ID NO: 1856522 - protein, 8 aa, Staphylococcus
KRDYKKGT

SEQ ID NO: 1856523 - protein, 12 aa, Staphylococcus
KREEKGQYRGGP

SEQ ID NO: 1856524 - protein, 11 aa, Staphylococcus
KREGKDLPEPS

SEQ ID NO: 1856525 - protein, 10 aa, Staphylococcus
KREGKDLPIP

SEQ ID NO: 1856526 - protein, 11 aa, Staphylococcus
KREGKDLPKPD

SEQ ID NO: 1856527 - protein, 9 aa, Staphylococcus
KREGKDLPM

SEQ ID NO: 1856528 - protein, 10 aa, Staphylococcus
KREGKDLPVP

SEQ ID NO: 1856529 - protein, 10 aa, Staphylococcus
KREGNDLPVP

SEQ ID NO: 1856530 - protein, 38 aa, Staphylococcus
KREHDINKDIDDAEQAKLNAQKLEEQNKQTLKETQDEV

SEQ ID NO: 1856531 - protein, 19 aa, Staphylococcus
KREPEQHKNSPYKLPGGRI

SEQ ID NO: 1856532 - protein, 38 aa, Staphylococcus
KREQDINKDIDDAEQAKINAQKLEEENRQTLRETQNEV

SEQ ID NO: 1856533 - protein, 23 aa, Staphylococcus
KREQNRLKKEERQREKEEERERL

SEQ ID NO: 1856534 - protein, 38 aa, Staphylococcus
KRERDINKDIDDAEQAKINAQKLEEENRKTLKETQDEV

SEQ ID NO: 1856535 - protein, 5 aa, Staphylococcus
KRERL

SEQ ID NO: 1856536 - protein, 5 aa, Staphylococcus
KRFDH

SEQ ID NO: 1856537 - protein, 6 aa, Staphylococcus
KRFGGN

SEQ ID NO: 1856538 - protein, 5 aa, Staphylococcus
KRGLK

SEQ ID NO: 1856539 - protein, 10 aa, Staphylococcus
KRGNPDSNYT

SEQ ID NO: 1856540 - protein, 11 aa, Staphylococcus
KRGSEEKDIKI

SEQ ID NO: 1856541 - protein, 11 aa, Staphylococcus
KRGSEEKDINI

SEQ ID NO: 1856542 - protein, 10 aa, Staphylococcus
KRGSQEKDIK

SEQ ID NO: 1856543 - protein, 10 aa, Staphylococcus
KRGSQEKEIK

SEQ ID NO: 1856544 - protein, 6 aa, Staphylococcus
KRGVSK

SEQ ID NO: 1856545 - protein, 13 aa, Staphylococcus
KRHKKSASTLKTS

SEQ ID NO: 1856546 - protein, 6 aa, Staphylococcus
KRIEDN

SEQ ID NO: 1856547 - protein, 23 aa, Staphylococcus
KRIGAQKQTTQEELAKNEIENAD

SEQ ID NO: 1856548 - protein, 15 aa, Staphylococcus
KRIKKAIDNGEVEPT

SEQ ID NO: 1856549 - protein, 17 aa, Staphylococcus
KRIKKAIEKGEVEETQD

SEQ ID NO: 1856550 - protein, 5 aa, Staphylococcus
KRIPN

SEQ ID NO: 1856551 - protein, 17 aa, Staphylococcus
KRIQKGIAKGEIEQTQD

SEQ ID NO: 1856552 - protein, 7 aa, Staphylococcus
KRIQQTI

SEQ ID NO: 1856553 - protein, 5 aa, Staphylococcus
KRIRP

SEQ ID NO: 1856554 - protein, 5 aa, Staphylococcus
KRIRR

SEQ ID NO: 1856555 - protein, 4 aa, Staphylococcus
KRIT

SEQ ID NO: 1856556 - protein, 12 aa, Staphylococcus
KRKARQQSEQSH

SEQ ID NO: 1856557 - protein, 5 aa, Staphylococcus
KRKAY

SEQ ID NO: 1856558 - protein, 6 aa, Staphylococcus
KRKELD

SEQ ID NO: 1856559 - protein, 6 aa, Staphylococcus
KRKEYP

SEQ ID NO: 1856560 - protein, 8 aa, Staphylococcus
KRKGIQNL

SEQ ID NO: 1856561 - protein, 9 aa, Staphylococcus
KRKGVKRPK

SEQ ID NO: 1856562 - protein, 7 aa, Staphylococcus
KRKINRN

SEQ ID NO: 1856563 - protein, 9 aa, Staphylococcus
KRKKGQPSH

SEQ ID NO: 1856564 - protein, 9 aa, Staphylococcus
KRKKHAPSH

SEQ ID NO: 1856565 - protein, 9 aa, Staphylococcus
KRKKHEASH

SEQ ID NO: 1856566 - protein, 9 aa, Staphylococcus
KRKKHENSD

SEQ ID NO: 1856567 - protein, 9 aa, Staphylococcus
KRKKKEEGH

SEQ ID NO: 1856568 - protein, 8 aa, Staphylococcus
KRKSKEFL

SEQ ID NO: 1856569 - protein, 13 aa, Staphylococcus
KRKSTRAGIASHH

SEQ ID NO: 1856570 - protein, 9 aa, Staphylococcus
KRKTTEDAY

SEQ ID NO: 1856571 - protein, 7 aa, Staphylococcus
KRLGSGN

SEQ ID NO: 1856572 - protein, 6 aa, Staphylococcus
KRLPDA

SEQ ID NO: 1856573 - protein, 5 aa, Staphylococcus
KRLQE

SEQ ID NO: 1856574 - protein, 5 aa, Staphylococcus
KRLSK

SEQ ID NO: 1856575 - protein, 12 aa, Staphylococcus
KRLSSGECTPEG

SEQ ID NO: 1856576 - protein, 4 aa, Staphylococcus
KRMP

SEQ ID NO: 1856577 - protein, 5 aa, Staphylococcus
KRNHV

SEQ ID NO: 1856578 - protein, 11 aa, Staphylococcus
KRNKRTSRDAI

SEQ ID NO: 1856579 - protein, 6 aa, Staphylococcus
KRNPST

SEQ ID NO: 1856580 - protein, 12 aa, Staphylococcus
KRNRDGEKASRK

SEQ ID NO: 1856581 - protein, 13 aa, Staphylococcus
KRNTKQTKGYYKQ

SEQ ID NO: 1856582 - protein, 9 aa, Staphylococcus
KRNTNQTKW

SEQ ID NO: 1856583 - protein, 5 aa, Staphylococcus
KRPIL

SEQ ID NO: 1856584 - protein, 6 aa, Staphylococcus
KRPTLN

SEQ ID NO: 1856585 - protein, 14 aa, Staphylococcus
KRPTYTNADAGKTF

SEQ ID NO: 1856586 - protein, 4 aa, Staphylococcus
KRQA

SEQ ID NO: 1856587 - protein, 6 aa, Staphylococcus
KRQASG

SEQ ID NO: 1856588 - protein, 7 aa, Staphylococcus
KRQEFPD

SEQ ID NO: 1856589 - protein, 7 aa, Staphylococcus
KRQEQHS

SEQ ID NO: 1856590 - protein, 9 aa, Staphylococcus
KRQGDTPRS

SEQ ID NO: 1856591 - protein, 8 aa, Staphylococcus
KRQGKEET

SEQ ID NO: 1856592 - protein, 11 aa, Staphylococcus
KRQGKNPDELL

SEQ ID NO: 1856593 - protein, 8 aa, Staphylococcus
KRQKFSPD

SEQ ID NO: 1856594 - protein, 13 aa, Staphylococcus
KRQLVEKAEERKL

SEQ ID NO: 1856595 - protein, 14 aa, Staphylococcus
KRQNEELEEKQSEL

SEQ ID NO: 1856596 - protein, 7 aa, Staphylococcus
KRQQFSP

SEQ ID NO: 1856597 - protein, 7 aa, Staphylococcus
KRQSGKL

SEQ ID NO: 1856598 - protein, 5 aa, Staphylococcus
KRQSV

SEQ ID NO: 1856599 - protein, 7 aa, Staphylococcus
KRQTQHS

SEQ ID NO: 1856600 - protein, 8 aa, Staphylococcus
KRQTTDGF

SEQ ID NO: 1856601 - protein, 14 aa, Staphylococcus
KRQTTSETSSDTSN

SEQ ID NO: 1856602 - protein, 13 aa, Staphylococcus
KRQVVEQTEERKI

SEQ ID NO: 1856603 - protein, 8 aa, Staphylococcus
KRRDEIAN

SEQ ID NO: 1856604 - protein, 9 aa, Staphylococcus
KRRDEIATK

SEQ ID NO: 1856605 - protein, 8 aa, Staphylococcus
KRREEIAT

SEQ ID NO: 1856606 - protein, 4 aa, Staphylococcus
KRRG

SEQ ID NO: 1856607 - protein, 8 aa, Staphylococcus
KRRGEIAE

SEQ ID NO: 1856608 - protein, 15 aa, Staphylococcus
KRRGKYGWKTERPNS

SEQ ID NO: 1856609 - protein, 9 aa, Staphylococcus
KRSAGQDSD

SEQ ID NO: 1856610 - protein, 9 aa, Staphylococcus
KRSAGQESD

SEQ ID NO: 1856611 - protein, 74 aa, Staphylococcus
KRSFDKDKTELENDKNKKIKDDVKSKDRLQKEKNLSNDRRSNKSLNSSKNKGENLKKEVKTRLREKRNKFQNDK

SEQ ID NO: 1856612 - protein, 8 aa, Staphylococcus
KRSGKDDI

SEQ ID NO: 1856613 - protein, 5 aa, Staphylococcus
KRSGR

SEQ ID NO: 1856614 - protein, 9 aa, Staphylococcus
KRSKNGRVS

SEQ ID NO: 1856615 - protein, 9 aa, Staphylococcus
KRSQSNPLS

SEQ ID NO: 1856616 - protein, 9 aa, Staphylococcus
KRSSKITKT

SEQ ID NO: 1856617 - protein, 13 aa, Staphylococcus
KRSYESANGGRIL

SEQ ID NO: 1856618 - protein, 6 aa, Staphylococcus
KRSYFN

SEQ ID NO: 1856619 - protein, 6 aa, Staphylococcus
KRTKKD

SEQ ID NO: 1856620 - protein, 9 aa, Staphylococcus
KRTNESVHT

SEQ ID NO: 1856621 - protein, 7 aa, Staphylococcus
KRTNSFE

SEQ ID NO: 1856622 - protein, 17 aa, Staphylococcus
KRTNSRSLHSSSLDNLS

SEQ ID NO: 1856623 - protein, 12 aa, Staphylococcus
KRTPLRDAEKAE

SEQ ID NO: 1856624 - protein, 7 aa, Staphylococcus
KRTRIPE

SEQ ID NO: 1856625 - protein, 4 aa, Staphylococcus
KRTS

SEQ ID NO: 1856626 - protein, 7 aa, Staphylococcus
KRTSLSG

SEQ ID NO: 1856627 - protein, 8 aa, Staphylococcus
KRTSSYEI

SEQ ID NO: 1856628 - protein, 20 aa, Staphylococcus
KRTTKERQISNDDSNSEYDS

SEQ ID NO: 1856629 - protein, 7 aa, Staphylococcus
KRTVREG

SEQ ID NO: 1856630 - protein, 8 aa, Staphylococcus
KRTVREGD

SEQ ID NO: 1856631 - protein, 7 aa, Staphylococcus
KRTYDQD

SEQ ID NO: 1856632 - protein, 6 aa, Staphylococcus
KRVDTP

SEQ ID NO: 1856633 - protein, 5 aa, Staphylococcus
KRVNS

SEQ ID NO: 1856634 - protein, 20 aa, Staphylococcus
KRYESTKQAIQDSDYHSPAL

SEQ ID NO: 1856635 - protein, 5 aa, Staphylococcus
KRYFE

SEQ ID NO: 1856636 - protein, 7 aa, Staphylococcus
KRYPTNY

SEQ ID NO: 1856637 - protein, 14 aa, Staphylococcus
KRYQEPDTLDTAKT

SEQ ID NO: 1856638 - protein, 10 aa, Staphylococcus
KSAAAQSPTI

SEQ ID NO: 1856639 - protein, 27 aa, Staphylococcus
KSAAENIDTDESHDTPSKESKQQREHI

SEQ ID NO: 1856640 - protein, 13 aa, Staphylococcus
KSAARSLNPAKQS

SEQ ID NO: 1856641 - protein, 6 aa, Staphylococcus
KSADMK

SEQ ID NO: 1856642 - protein, 16 aa, Staphylococcus
KSADNVKSTPVSMGKN

SEQ ID NO: 1856643 - protein, 9 aa, Staphylococcus
KSADSSPIK

SEQ ID NO: 1856644 - protein, 8 aa, Staphylococcus
KSAGMPTV

SEQ ID NO: 1856645 - protein, 7 aa, Staphylococcus
KSAGQYS

SEQ ID NO: 1856646 - protein, 21 aa, Staphylococcus
KSANKQLITSSGSGKKQSNEL

SEQ ID NO: 1856647 - protein, 7 aa, Staphylococcus
KSANQTF

SEQ ID NO: 1856648 - protein, 14 aa, Staphylococcus
KSARLVQQDGTETM

SEQ ID NO: 1856649 - protein, 10 aa, Staphylococcus
KSASTEGYKG

SEQ ID NO: 1856650 - protein, 10 aa, Staphylococcus
KSATAITTGT

SEQ ID NO: 1856651 - protein, 6 aa, Staphylococcus
KSATII

SEQ ID NO: 1856652 - protein, 7 aa, Staphylococcus
KSATITM

SEQ ID NO: 1856653 - protein, 9 aa, Staphylococcus
KSATSETPL

SEQ ID NO: 1856654 - protein, 9 aa, Staphylococcus
KSDADNLKD

SEQ ID NO: 1856655 - protein, 9 aa, Staphylococcus
KSDAGGVKI

SEQ ID NO: 1856656 - protein, 6 aa, Staphylococcus
KSDAIQ

SEQ ID NO: 1856657 - protein, 8 aa, Staphylococcus
KSDAPGAK

SEQ ID NO: 1856658 - protein, 8 aa, Staphylococcus
KSDAPRQT

SEQ ID NO: 1856659 - protein, 5 aa, Staphylococcus
KSDAS

SEQ ID NO: 1856660 - protein, 9 aa, Staphylococcus
KSDASAKSI

SEQ ID NO: 1856661 - protein, 5 aa, Staphylococcus
KSDDI

SEQ ID NO: 1856662 - protein, 13 aa, Staphylococcus
KSDEETNDTKPIV

SEQ ID NO: 1856663 - protein, 8 aa, Staphylococcus
KSDHDNAS

SEQ ID NO: 1856664 - protein, 6 aa, Staphylococcus
KSDHKK

SEQ ID NO: 1856665 - protein, 8 aa, Staphylococcus
KSDKGDLT

SEQ ID NO: 1856666 - protein, 31 aa, Staphylococcus
KSDKNKYKDLKDFTGKKIAAQKGTDQEKIAH

SEQ ID NO: 1856667 - protein, 6 aa, Staphylococcus
KSDLIS

SEQ ID NO: 1856668 - protein, 10 aa, Staphylococcus
KSDLSQTYDQ

SEQ ID NO: 1856669 - protein, 8 aa, Staphylococcus
KSDPRLKM

SEQ ID NO: 1856670 - protein, 8 aa, Staphylococcus
KSDPRLNM

SEQ ID NO: 1856671 - protein, 19 aa, Staphylococcus
KSDPRLRMSKKSGGRIAYE

SEQ ID NO: 1856672 - protein, 7 aa, Staphylococcus
KSDSLQL

SEQ ID NO: 1856673 - protein, 8 aa, Staphylococcus
KSDSRVNE

SEQ ID NO: 1856674 - protein, 7 aa, Staphylococcus
KSDTISK

SEQ ID NO: 1856675 - protein, 12 aa, Staphylococcus
KSDYDKAQDNVE

SEQ ID NO: 1856676 - protein, 10 aa, Staphylococcus
KSEAKDQDYI

SEQ ID NO: 1856677 - protein, 7 aa, Staphylococcus
KSEALDK

SEQ ID NO: 1856678 - protein, 17 aa, Staphylococcus
KSEANQNRDNAEDTIGK

SEQ ID NO: 1856679 - protein, 8 aa, Staphylococcus
KSEARQAI

SEQ ID NO: 1856680 - protein, 7 aa, Staphylococcus
KSEDNIN

SEQ ID NO: 1856681 - protein, 9 aa, Staphylococcus
KSEEQIDEI

SEQ ID NO: 1856682 - protein, 15 aa, Staphylococcus
KSEGRNKVMFNPIIK

SEQ ID NO: 1856683 - protein, 15 aa, Staphylococcus
KSEGRNKVMFNPIVK

SEQ ID NO: 1856684 - protein, 10 aa, Staphylococcus
KSEGYQVNPK

SEQ ID NO: 1856685 - protein, 9 aa, Staphylococcus
KSEKGGADI

SEQ ID NO: 1856686 - protein, 4 aa, Staphylococcus
KSEL

SEQ ID NO: 1856687 - protein, 8 aa, Staphylococcus
KSELGKGT

SEQ ID NO: 1856688 - protein, 6 aa, Staphylococcus
KSELYE

SEQ ID NO: 1856689 - protein, 13 aa, Staphylococcus
KSEMEKTSWPTKE

SEQ ID NO: 1856690 - protein, 7 aa, Staphylococcus
KSENTQI

SEQ ID NO: 1856691 - protein, 10 aa, Staphylococcus
KSEPNKGSTF

SEQ ID NO: 1856692 - protein, 14 aa, Staphylococcus
KSEPNSGERVEEGE

SEQ ID NO: 1856693 - protein, 9 aa, Staphylococcus
KSEQTSDNV

SEQ ID NO: 1856694 - protein, 7 aa, Staphylococcus
KSERGKI

SEQ ID NO: 1856695 - protein, 5 aa, Staphylococcus
KSERL

SEQ ID NO: 1856696 - protein, 11 aa, Staphylococcus
KSESGAVKPEV

SEQ ID NO: 1856697 - protein, 7 aa, Staphylococcus
KSETAAR

SEQ ID NO: 1856698 - protein, 6 aa, Staphylococcus
KSETFR

SEQ ID NO: 1856699 - protein, 12 aa, Staphylococcus
KSETKKAIDESN

SEQ ID NO: 1856700 - protein, 15 aa, Staphylococcus
KSFDSDPKQGTERKV

SEQ ID NO: 1856701 - protein, 13 aa, Staphylococcus
KSFESQARSEKHL

SEQ ID NO: 1856702 - protein, 24 aa, Staphylococcus
KSFQKKNNLDVNGTFNKSTNEKFT

SEQ ID NO: 1856703 - protein, 6 aa, Staphylococcus
KSFYDP

SEQ ID NO: 1856704 - protein, 14 aa, Staphylococcus
KSGAINKPISIPGT

SEQ ID NO: 1856705 - protein, 15 aa, Staphylococcus
KSGAINKPISIPGTY

SEQ ID NO: 1856706 - protein, 11 aa, Staphylococcus
KSGATSRLSTL

SEQ ID NO: 1856707 - protein, 6 aa, Staphylococcus
KSGETC

SEQ ID NO: 1856708 - protein, 8 aa, Staphylococcus
KSGGKQQI

SEQ ID NO: 1856709 - protein, 9 aa, Staphylococcus
KSGGKQQLP

SEQ ID NO: 1856710 - protein, 6 aa, Staphylococcus
KSGKAI

SEQ ID NO: 1856711 - protein, 7 aa, Staphylococcus
KSGKAVG

SEQ ID NO: 1856712 - protein, 7 aa, Staphylococcus
KSGKIKM

SEQ ID NO: 1856713 - protein, 6 aa, Staphylococcus
KSGNVT

SEQ ID NO: 1856714 - protein, 9 aa, Staphylococcus
KSGPPSSNQ

SEQ ID NO: 1856715 - protein, 6 aa, Staphylococcus
KSGQKV

SEQ ID NO: 1856716 - protein, 6 aa, Staphylococcus
KSGQTH

SEQ ID NO: 1856717 - protein, 7 aa, Staphylococcus
KSGSFES

SEQ ID NO: 1856718 - protein, 5 aa, Staphylococcus
KSGSG

SEQ ID NO: 1856719 - protein, 11 aa, Staphylococcus
KSGSGASQNKE

SEQ ID NO: 1856720 - protein, 6 aa, Staphylococcus
KSGYEA

SEQ ID NO: 1856721 - protein, 6 aa, Staphylococcus
KSHDNY

SEQ ID NO: 1856722 - protein, 14 aa, Staphylococcus
KSHINDSEEENAVN

SEQ ID NO: 1856723 - protein, 14 aa, Staphylococcus
KSHINDVEDTNEVD

SEQ ID NO: 1856724 - protein, 8 aa, Staphylococcus
KSHNHSES

SEQ ID NO: 1856725 - protein, 6 aa, Staphylococcus
KSHSKV

SEQ ID NO: 1856726 - protein, 7 aa, Staphylococcus
KSHSPAA

SEQ ID NO: 1856727 - protein, 8 aa, Staphylococcus
KSHTITSY

SEQ ID NO: 1856728 - protein, 21 aa, Staphylococcus
KSIDTNDKISKEFHQDSEKAS

SEQ ID NO: 1856729 - protein, 11 aa, Staphylococcus
KSIENKSNFVS

SEQ ID NO: 1856730 - protein, 8 aa, Staphylococcus
KSIKEVND

SEQ ID NO: 1856731 - protein, 9 aa, Staphylococcus
KSIKNKPLD

SEQ ID NO: 1856732 - protein, 21 aa, Staphylococcus
KSILEDKSKSDKDKKQAIKDI

SEQ ID NO: 1856733 - protein, 12 aa, Staphylococcus
KSINNENAGTIV

SEQ ID NO: 1856734 - protein, 8 aa, Staphylococcus
KSINTLSP

SEQ ID NO: 1856735 - protein, 16 aa, Staphylococcus
KSISASTSLSESRSAS

SEQ ID NO: 1856736 - protein, 11 aa, Staphylococcus
KSISDKQKGNI

SEQ ID NO: 1856737 - protein, 31 aa, Staphylococcus
KSISKQVDDKLTEKDFSTFKTEEKEPVSTNY

SEQ ID NO: 1856738 - protein, 4 aa, Staphylococcus
KSIY

SEQ ID NO: 1856739 - protein, 8 aa, Staphylococcus
KSKAGVDY

SEQ ID NO: 1856740 - protein, 11 aa, Staphylococcus
KSKARNNLKEK

SEQ ID NO: 1856741 - protein, 9 aa, Staphylococcus
KSKAVNTKE

SEQ ID NO: 1856742 - protein, 8 aa, Staphylococcus
KSKDKAAI

SEQ ID NO: 1856743 - protein, 9 aa, Staphylococcus
KSKDKSAIK

SEQ ID NO: 1856744 - protein, 16 aa, Staphylococcus
KSKDTKVENSEDVQTI

SEQ ID NO: 1856745 - protein, 9 aa, Staphylococcus
KSKEDESIN

SEQ ID NO: 1856746 - protein, 7 aa, Staphylococcus
KSKEKHK

SEQ ID NO: 1856747 - protein, 31 aa, Staphylococcus; identical to SEQ ID NO: 1733202

SEQ ID NO: 1856748 - protein, 8 aa, Staphylococcus
KSKGIPTD

SEQ ID NO: 1856749 - protein, 4 aa, Staphylococcus
KSKI

SEQ ID NO: 1856750 - protein, 9 aa, Staphylococcus
KSKKENYAI

SEQ ID NO: 1856751 - protein, 7 aa, Staphylococcus
KSKKKMT

SEQ ID NO: 1856752 - protein, 14 aa, Staphylococcus
KSKLLTKEKYNQRS

SEQ ID NO: 1856753 - protein, 10 aa, Staphylococcus
KSKLTETKQP

SEQ ID NO: 1856754 - protein, 23 aa, Staphylococcus
KSKNETTTNENINPQNSVKENLT

SEQ ID NO: 1856755 - protein, 13 aa, Staphylococcus
KSKNKKDAKNIAN

SEQ ID NO: 1856756 - protein, 18 aa, Staphylococcus
KSKNVSFTNPQDVNNIPG

SEQ ID NO: 1856757 - protein, 8 aa, Staphylococcus
KSKPDQSI

SEQ ID NO: 1856758 - protein, 8 aa, Staphylococcus
KSKPSQRK

SEQ ID NO: 1856759 - protein, 12 aa, Staphylococcus
KSKRTKKRGEKH

SEQ ID NO: 1856760 - protein, 7 aa, Staphylococcus
KSKSPVA

SEQ ID NO: 1856761 - protein, 11 aa, Staphylococcus
KSKTGNAMQNE

SEQ ID NO: 1856762 - protein, 10 aa, Staphylococcus
KSKTVRGANG

SEQ ID NO: 1856763 - protein, 8 aa, Staphylococcus
KSKTYTQT

SEQ ID NO: 1856764 - protein, 4 aa, Staphylococcus
KSKV

SEQ ID NO: 1856765 - protein, 9 aa, Staphylococcus
KSLADTPFQ

SEQ ID NO: 1856766 - protein, 6 aa, Staphylococcus
KSLDEI

SEQ ID NO: 1856767 - protein, 7 aa, Staphylococcus
KSLDNAE

SEQ ID NO: 1856768 - protein, 8 aa, Staphylococcus
KSLDSYDK

SEQ ID NO: 1856769 - protein, 10 aa, Staphylococcus
KSLDTNDKIE

SEQ ID NO: 1856770 - protein, 4 aa, Staphylococcus
KSLE

SEQ ID NO: 1856771 - protein, 12 aa, Staphylococcus
KSLGGVVSPEQF

SEQ ID NO: 1856772 - protein, 6 aa, Staphylococcus
KSLGSS

SEQ ID NO: 1856773 - protein, 17 aa, Staphylococcus
KSLKGSYPNVDSEEDRR

SEQ ID NO: 1856774 - protein, 8 aa, Staphylococcus
KSLKTPID

SEQ ID NO: 1856775 - protein, 4 aa, Staphylococcus
KSLN

SEQ ID NO: 1856776 - protein, 10 aa, Staphylococcus
KSLNDKKGDI

SEQ ID NO: 1856777 - protein, 10 aa, Staphylococcus
KSLNDKKGDV

SEQ ID NO: 1856778 - protein, 9 aa, Staphylococcus
KSLNNEKGD

SEQ ID NO: 1856779 - protein, 9 aa, Staphylococcus
KSLNSEKGD

SEQ ID NO: 1856780 - protein, 21 aa, Staphylococcus
KSLPDGLDTAIGEGGEMLSGG

SEQ ID NO: 1856781 - protein, 6 aa, Staphylococcus
KSLPVG

SEQ ID NO: 1856782 - protein, 12 aa, Staphylococcus
KSLSNTLGTDGG

SEQ ID NO: 1856783 - protein, 4 aa, Staphylococcus
KSLV

SEQ ID NO: 1856784 - protein, 9 aa, Staphylococcus
KSLVPEDDN

SEQ ID NO: 1856785 - protein, 19 aa, Staphylococcus
KSMDEAQNRLDSLSDNINN

SEQ ID NO: 1856786 - protein, 42 aa, Staphylococcus
KSMTKDIKKTLKDIKNDDKHVDKISDPYQTKQISKDKSTAIA

SEQ ID NO: 1856787 - protein, 20 aa, Staphylococcus
KSNAEDLAERTRSQGRNSIN

SEQ ID NO: 1856788 - protein, 16 aa, Staphylococcus
KSNAKNALNQKAQEQH

SEQ ID NO: 1856789 - protein, 6 aa, Staphylococcus
KSNART

SEQ ID NO: 1856790 - protein, 6 aa, Staphylococcus
KSNDKP

SEQ ID NO: 1856791 - protein, 5 aa, Staphylococcus
KSNDY

SEQ ID NO: 1856792 - protein, 4 aa, Staphylococcus
KSNG

SEQ ID NO: 1856793 - protein, 5 aa, Staphylococcus
KSNIE

SEQ ID NO: 1856794 - protein, 16 aa, Staphylococcus
KSNNEDTVLDKLLKLI

SEQ ID NO: 1856795 - protein, 7 aa, Staphylococcus
KSNNQKL

SEQ ID NO: 1856796 - protein, 6 aa, Staphylococcus
KSNQSG

SEQ ID NO: 1856797 - protein, 6 aa, Staphylococcus
KSNQTG

SEQ ID NO: 1856798 - protein, 8 aa, Staphylococcus
KSNSKGAR

SEQ ID NO: 1856799 - protein, 6 aa, Staphylococcus
KSNSVG

SEQ ID NO: 1856800 - protein, 17 aa, Staphylococcus
KSNTDYTLKATSPQDIN

SEQ ID NO: 1856801 - protein, 8 aa, Staphylococcus
KSNTVEVN

SEQ ID NO: 1856802 - protein, 7 aa, Staphylococcus
KSNYKGL

SEQ ID NO: 1856803 - protein, 8 aa, Staphylococcus
KSPDPNQY

SEQ ID NO: 1856804 - protein, 6 aa, Staphylococcus
KSPGTA

SEQ ID NO: 1856805 - protein, 7 aa, Staphylococcus
KSPKKIR

SEQ ID NO: 1856806 - protein, 4 aa, Staphylococcus
KSPL

SEQ ID NO: 1856807 - protein, 7 aa, Staphylococcus
KSPLDRE

SEQ ID NO: 1856808 - protein, 8 aa, Staphylococcus
KSPLDREQ

SEQ ID NO: 1856809 - protein, 6 aa, Staphylococcus
KSPLSH

SEQ ID NO: 1856810 - protein, 6 aa, Staphylococcus
KSPLTT

SEQ ID NO: 1856811 - protein, 7 aa, Staphylococcus
KSPNLQE

SEQ ID NO: 1856812 - protein, 14 aa, Staphylococcus
KSPREATGDNWDGL

SEQ ID NO: 1856813 - protein, 6 aa, Staphylococcus
KSPRKF

SEQ ID NO: 1856814 - protein, 4 aa, Staphylococcus
KSPS

SEQ ID NO: 1856815 - protein, 8 aa, Staphylococcus
KSPSDATI

SEQ ID NO: 1856816 - protein, 7 aa, Staphylococcus
KSPSKLR

SEQ ID NO: 1856817 - protein, 4 aa, Staphylococcus
KSPV

SEQ ID NO: 1856818 - protein, 7 aa, Staphylococcus
KSPYATI

SEQ ID NO: 1856819 - protein, 7 aa, Staphylococcus
KSPYETI

SEQ ID NO: 1856820 - protein, 7 aa, Staphylococcus
KSPYHIP

SEQ ID NO: 1856821 - protein, 12 aa, Staphylococcus
KSQADSESFSKN

SEQ ID NO: 1856822 - protein, 9 aa, Staphylococcus
KSQAKKADI

SEQ ID NO: 1856823 - protein, 7 aa, Staphylococcus
KSQDATI

SEQ ID NO: 1856824 - protein, 6 aa, Staphylococcus
KSQEFN

SEQ ID NO: 1856825 - protein, 16 aa, Staphylococcus
KSQGGKVTKSSPNVVE

SEQ ID NO: 1856826 - protein, 8 aa, Staphylococcus
KSQGPTPM

SEQ ID NO: 1856827 - protein, 9 aa, Staphylococcus
KSQGPTPTF

SEQ ID NO: 1856828 - protein, 4 aa, Staphylococcus
KSQI

SEQ ID NO: 1856829 - protein, 18 aa, Staphylococcus
KSQKASHTSESSRSSQFA

SEQ ID NO: 1856830 - protein, 10 aa, Staphylococcus
KSQLKGDNDY

SEQ ID NO: 1856831 - protein, 10 aa, Staphylococcus
KSQLKGKDDY

SEQ ID NO: 1856832 - protein, 7 aa, Staphylococcus
KSQLSNE

SEQ ID NO: 1856833 - protein, 14 aa, Staphylococcus
KSQMIEKAEERKHK

SEQ ID NO: 1856834 - protein, 5 aa, Staphylococcus
KSQMP

SEQ ID NO: 1856835 - protein, 6 aa, Staphylococcus
KSQPKR

SEQ ID NO: 1856836 - protein, 20 aa, Staphylococcus
KSQPTQNTKKSKNKKKQPSH

SEQ ID NO: 1856837 - protein, 5 aa, Staphylococcus
KSQQA

SEQ ID NO: 1856838 - protein, 23 aa, Staphylococcus
KSQSDISSNQSSDSESDNSRNSQ

SEQ ID NO: 1856839 - protein, 7 aa, Staphylococcus
KSQSLEN

SEQ ID NO: 1856840 - protein, 5 aa, Staphylococcus
KSRAL

SEQ ID NO: 1856841 - protein, 8 aa, Staphylococcus
KSRAQIPE

SEQ ID NO: 1856842 - protein, 8 aa, Staphylococcus
KSRDKAEI

SEQ ID NO: 1856843 - protein, 7 aa, Staphylococcus
KSRDKDI

SEQ ID NO: 1856844 - protein, 5 aa, Staphylococcus
KSRDY

SEQ ID NO: 1856845 - protein, 8 aa, Staphylococcus
KSRDYYKN

SEQ ID NO: 1856846 - protein, 7 aa, Staphylococcus
KSREQLN

SEQ ID NO: 1856847 - protein, 12 aa, Staphylococcus
KSRGSEISSGGV

SEQ ID NO: 1856848 - protein, 12 aa, Staphylococcus
KSRGSEISSGSI

SEQ ID NO: 1856849 - protein, 14 aa, Staphylococcus
KSRGSEISSGSIGQ

SEQ ID NO: 1856850 - protein, 6 aa, Staphylococcus
KSRGYH

SEQ ID NO: 1856851 - protein, 14 aa, Staphylococcus
KSRKDKKDRKEDNN

SEQ ID NO: 1856852 - protein, 15 aa, Staphylococcus
KSRKNKKDKKNKGSE

SEQ ID NO: 1856853 - protein, 4 aa, Staphylococcus
KSRL

SEQ ID NO: 1856854 - protein, 15 aa, Staphylococcus
KSRPGKGERVERGDK

SEQ ID NO: 1856855 - protein, 6 aa, Staphylococcus
KSRQRV

SEQ ID NO: 1856856 - protein, 7 aa, Staphylococcus
KSRQTGL

SEQ ID NO: 1856857 - protein, 5 aa, Staphylococcus
KSRSL

SEQ ID NO: 1856858 - protein, 8 aa, Staphylococcus
KSRSRLPE

SEQ ID NO: 1856859 - protein, 7 aa, Staphylococcus
KSRSTRK

SEQ ID NO: 1856860 - protein, 7 aa, Staphylococcus
KSRTRIP

SEQ ID NO: 1856861 - protein, 6 aa, Staphylococcus
KSRTRR

SEQ ID NO: 1856862 - protein, 14 aa, Staphylococcus
KSRVPKANIDGKVG

SEQ ID NO: 1856863 - protein, 8 aa, Staphylococcus
KSSAQHTN

SEQ ID NO: 1856864 - protein, 6 aa, Staphylococcus
KSSASQ

SEQ ID NO: 1856865 - protein, 7 aa, Staphylococcus
KSSDRIK

SEQ ID NO: 1856866 - protein, 15 aa, Staphylococcus
KSSDVEGKFKEEAPL

SEQ ID NO: 1856867 - protein, 6 aa, Staphylococcus
KSSEFI

SEQ ID NO: 1856868 - protein, 6 aa, Staphylococcus
KSSEFL

SEQ ID NO: 1856869 - protein, 5 aa, Staphylococcus
KSSEG

SEQ ID NO: 1856870 - protein, 7 aa, Staphylococcus
KSSGQYA

SEQ ID NO: 1856871 - protein, 7 aa, Staphylococcus
KSSGQYD

SEQ ID NO: 1856872 - protein, 8 aa, Staphylococcus
KSSGQYGI

SEQ ID NO: 1856873 - protein, 4 aa, Staphylococcus
KSSI

SEQ ID NO: 1856874 - protein, 6 aa, Staphylococcus
KSSIYK

SEQ ID NO: 1856875 - protein, 6 aa, Staphylococcus
KSSKGV

SEQ ID NO: 1856876 - protein, 5 aa, Staphylococcus
KSSLA

SEQ ID NO: 1856877 - protein, 6 aa, Staphylococcus
KSSLAY

SEQ ID NO: 1856878 - protein, 5 aa, Staphylococcus
KSSNE

SEQ ID NO: 1856879 - protein, 8 aa, Staphylococcus
KSSNESTI

SEQ ID NO: 1856880 - protein, 10 aa, Staphylococcus
KSSNQKEKYI

SEQ ID NO: 1856881 - protein, 5 aa, Staphylococcus
KSSPF

SEQ ID NO: 1856882 - protein, 6 aa, Staphylococcus
KSSQHY

SEQ ID NO: 1856883 - protein, 4 aa, Staphylococcus
KSSS

SEQ ID NO: 1856884 - protein, 7 aa, Staphylococcus
KSSSLDD

SEQ ID NO: 1856885 - protein, 7 aa, Staphylococcus
KSSSVYG

SEQ ID NO: 1856886 - protein, 8 aa, Staphylococcus
KSSTDTNP

SEQ ID NO: 1856887 - protein, 5 aa, Staphylococcus
KSSWT

SEQ ID NO: 1856888 - protein, 7 aa, Staphylococcus
KSSYAYD

SEQ ID NO: 1856889 - protein, 5 aa, Staphylococcus
KSTDL

SEQ ID NO: 1856890 - protein, 5 aa, Staphylococcus
KSTEF

SEQ ID NO: 1856891 - protein, 21 aa, Staphylococcus
KSTELPQQNASLPETGHTSNN

SEQ ID NO: 1856892 - protein, 10 aa, Staphylococcus
KSTEQKHKDV

SEQ ID NO: 1856893 - protein, 7 aa, Staphylococcus
KSTERNR

SEQ ID NO: 1856894 - protein, 10 aa, Staphylococcus
KSTEYKTEGV

SEQ ID NO: 1856895 - protein, 6 aa, Staphylococcus
KSTGIT

SEQ ID NO: 1856896 - protein, 15 aa, Staphylococcus
KSTGKYENLDSNRTY

SEQ ID NO: 1856897 - protein, 6 aa, Staphylococcus
KSTGTL

SEQ ID NO: 1856898 - protein, 14 aa, Staphylococcus
KSTHHNAKESQLNN

SEQ ID NO: 1856899 - protein, 5 aa, Staphylococcus
KSTIP

SEQ ID NO: 1856900 - protein, 20 aa, Staphylococcus
KSTKPIPQYDQGTYGILRDV

SEQ ID NO: 1856901 - protein, 7 aa, Staphylococcus
KSTLGKG

SEQ ID NO: 1856902 - protein, 6 aa, Staphylococcus
KSTNLD

SEQ ID NO: 1856903 - protein, 5 aa, Staphylococcus
KSTQM

SEQ ID NO: 1856904 - protein, 7 aa, Staphylococcus
KSTSLKD

SEQ ID NO: 1856905 - protein, 7 aa, Staphylococcus
KSTSPAA

SEQ ID NO: 1856906 - protein, 8 aa, Staphylococcus
KSTTKDME

SEQ ID NO: 1856907 - protein, 7 aa, Staphylococcus
KSTVSNA

SEQ ID NO: 1856908 - protein, 6 aa, Staphylococcus
KSVGYR

SEQ ID NO: 1856909 - protein, 34 aa, Staphylococcus
KSVMKEKVESGEIPAQQAQKMKEKMGNQSVNVKQ

SEQ ID NO: 1856910 - protein, 9 aa, Staphylococcus
KSVNNPKFE

SEQ ID NO: 1856911 - protein, 6 aa, Staphylococcus
KSVNPN

SEQ ID NO: 1856912 - protein, 14 aa, Staphylococcus
KSVREASYGLGGNK

SEQ ID NO: 1856913 - protein, 10 aa, Staphylococcus
KSVSKQVDSE

SEQ ID NO: 1856914 - protein, 7 aa, Staphylococcus
KSVSQSP

SEQ ID NO: 1856915 - protein, 6 aa, Staphylococcus
KSYADR

SEQ ID NO: 1856916 - protein, 6 aa, Staphylococcus
KSYAQR

SEQ ID NO: 1856917 - protein, 4 aa, Staphylococcus
KSYD

SEQ ID NO: 1856918 - protein, 5 aa, Staphylococcus
KSYDD

SEQ ID NO: 1856919 - protein, 5 aa, Staphylococcus
KSYES

SEQ ID NO: 1856920 - protein, 7 aa, Staphylococcus
KSYGETA

SEQ ID NO: 1856921 - protein, 5 aa, Staphylococcus
KSYLQ

SEQ ID NO: 1856922 - protein, 22 aa, Staphylococcus
KSYNEISKDKVPHKPLKKLEMQ

SEQ ID NO: 1856923 - protein, 7 aa, Staphylococcus
KSYRRQR

SEQ ID NO: 1856924 - protein, 9 aa, Staphylococcus
KTADTKQLN

SEQ ID NO: 1856925 - protein, 7 aa, Staphylococcus
KTAEDKL

SEQ ID NO: 1856926 - protein, 5 aa, Staphylococcus
KTAFT

SEQ ID NO: 1856927 - protein, 4 aa, Staphylococcus
KTAN

SEQ ID NO: 1856928 - protein, 16 aa, Staphylococcus
KTANNQLNDQLKTTNQ

SEQ ID NO: 1856929 - protein, 16 aa, Staphylococcus
KTAPELNETATNQNIT

SEQ ID NO: 1856930 - protein, 13 aa, Staphylococcus
KTAQKAHIQPKRA

SEQ ID NO: 1856931 - protein, 16 aa, Staphylococcus
KTAQKANIQPKKALTA

SEQ ID NO: 1856932 - protein, 10 aa, Staphylococcus
KTAQNKEGAY

SEQ ID NO: 1856933 - protein, 8 aa, Staphylococcus
KTAQTITD

SEQ ID NO: 1856934 - protein, 6 aa, Staphylococcus
KTASFE

SEQ ID NO: 1856935 - protein, 6 aa, Staphylococcus
KTASSM

SEQ ID NO: 1856936 - protein, 8 aa, Staphylococcus
KTASSMLP

SEQ ID NO: 1856937 - protein, 13 aa, Staphylococcus
KTATKAGIQPKRP

SEQ ID NO: 1856938 - protein, 9 aa, Staphylococcus
KTAVQGFGN

SEQ ID NO: 1856939 - protein, 16 aa, Staphylococcus
KTDGMEGSMAQAGTPI

SEQ ID NO: 1856940 - protein, 5 aa, Staphylococcus
KTDHG

SEQ ID NO: 1856941 - protein, 11 aa, Staphylococcus
KTDKGETTTLT

SEQ ID NO: 1856942 - protein, 5 aa, Staphylococcus
KTDKS

SEQ ID NO: 1856943 - protein, 9 aa, Staphylococcus
KTDNAREQY

SEQ ID NO: 1856944 - protein, 6 aa, Staphylococcus
KTEDGI

SEQ ID NO: 1856945 - protein, 9 aa, Staphylococcus
KTEESIPYE

SEQ ID NO: 1856946 - protein, 7 aa, Staphylococcus
KTEFHAS

SEQ ID NO: 1856947 - protein, 9 aa, Staphylococcus
KTEFHASDS

SEQ ID NO: 1856948 - protein, 5 aa, Staphylococcus
KTEGK

SEQ ID NO: 1856949 - protein, 11 aa, Staphylococcus
KTEKGRASSAL

SEQ ID NO: 1856950 - protein, 9 aa, Staphylococcus
KTEKSNAPW

SEQ ID NO: 1856951 - protein, 4 aa, Staphylococcus
KTEN

SEQ ID NO: 1856952 - protein, 8 aa, Staphylococcus
KTEQQEKY

SEQ ID NO: 1856953 - protein, 7 aa, Staphylococcus
KTESNHI

SEQ ID NO: 1856954 - protein, 9 aa, Staphylococcus
KTFEGSNTK

SEQ ID NO: 1856955 - protein, 9 aa, Staphylococcus
KTFESKGTE

SEQ ID NO: 1856956 - protein, 5 aa, Staphylococcus
KTFPN

SEQ ID NO: 1856957 - protein, 18 aa, Staphylococcus
KTFTSTSKTIKAKDLGNI

SEQ ID NO: 1856958 - protein, 4 aa, Staphylococcus
KTFY

SEQ ID NO: 1856959 - protein, 7 aa, Staphylococcus
KTGGHGV

SEQ ID NO: 1856960 - protein, 4 aa, Staphylococcus
KTGI

SEQ ID NO: 1856961 - protein, 5 aa, Staphylococcus
KTGKI

SEQ ID NO: 1856962 - protein, 6 aa, Staphylococcus
KTGNLR

SEQ ID NO: 1856963 - protein, 6 aa, Staphylococcus
KTGNPL

SEQ ID NO: 1856964 - protein, 5 aa, Staphylococcus
KTGPL

SEQ ID NO: 1856965 - protein, 5 aa, Staphylococcus
KTGSA

SEQ ID NO: 1856966 - protein, 6 aa, Staphylococcus
KTGSLR

SEQ ID NO: 1856967 - protein, 51 aa, Staphylococcus
KTGSQSAAIHRKERKERQAERAEEKRRRKEEKELERQEREAAKAQQEEVKD

SEQ ID NO: 1856968 - protein, 5 aa, Staphylococcus
KTGST

SEQ ID NO: 1856969 - protein, 4 aa, Staphylococcus
KTGT

SEQ ID NO: 1856970 - protein, 21 aa, Staphylococcus
KTGTITNGKPVVTDFDGDEEA

SEQ ID NO: 1856971 - protein, 21 aa, Staphylococcus
KTGTITNGTPEVTDFSGDDQT

SEQ ID NO: 1856972 - protein, 14 aa, Staphylococcus
KTGTLTEGRPKVSE

SEQ ID NO: 1856973 - protein, 4 aa, Staphylococcus
KTGV

SEQ ID NO: 1856974 - protein, 14 aa, Staphylococcus
KTGVGNVEVNNSKL

SEQ ID NO: 1856975 - protein, 5 aa, Staphylococcus
KTGVT

SEQ ID NO: 1856976 - protein, 6 aa, Staphylococcus
KTHEVT

SEQ ID NO: 1856977 - protein, 12 aa, Staphylococcus
KTHGLSEHAKGV

SEQ ID NO: 1856978 - protein, 8 aa, Staphylococcus
KTHKEDIY

SEQ ID NO: 1856979 - protein, 10 aa, Staphylococcus
KTHKSEHKSL

SEQ ID NO: 1856980 - protein, 7 aa, Staphylococcus
KTHLDGD

SEQ ID NO: 1856981 - protein, 13 aa, Staphylococcus
KTHTTEYTQQSVE

SEQ ID NO: 1856982 - protein, 17 aa, Staphylococcus
KTIEKINPALSKDKTNA

SEQ ID NO: 1856983 - protein, 18 aa, Staphylococcus
KTIENINPSLTEDKTNAV

SEQ ID NO: 1856984 - protein, 18 aa, Staphylococcus
KTIENKSSYVSADNMPDY

SEQ ID NO: 1856985 - protein, 4 aa, Staphylococcus
KTII

SEQ ID NO: 1856986 - protein, 4 aa, Staphylococcus
KTIL

SEQ ID NO: 1856987 - protein, 4 aa, Staphylococcus
KTIN

SEQ ID NO: 1856988 - protein, 13 aa, Staphylococcus
KTIPSLKSKGVSK

SEQ ID NO: 1856989 - protein, 17 aa, Staphylococcus
KTITNKGANMQASQISS

SEQ ID NO: 1856990 - protein, 14 aa, Staphylococcus
KTITVPKGQDGHSV

SEQ ID NO: 1856991 - protein, 9 aa, Staphylococcus
KTKDKQAIK

SEQ ID NO: 1856992 - protein, 9 aa, Staphylococcus
KTKEFANGN

SEQ ID NO: 1856993 - protein, 11 aa, Staphylococcus
KTKGQSDKQIA

SEQ ID NO: 1856994 - protein, 10 aa, Staphylococcus
KTKHKSDYKT

SEQ ID NO: 1856995 - protein, 17 aa, Staphylococcus
KTKKDRALKKEIEEKNK

SEQ ID NO: 1856996 - protein, 7 aa, Staphylococcus
KTKKEYR

SEQ ID NO: 1856997 - protein, 7 aa, Staphylococcus
KTKKTAN

SEQ ID NO: 1856998 - protein, 9 aa, Staphylococcus
KTKNKVKTV

SEQ ID NO: 1856999 - protein, 8 aa, Staphylococcus
KTKNRKDN

SEQ ID NO: 1857000 - protein, 13 aa, Staphylococcus
KTKPKQGERVNQH

SEQ ID NO: 1857001 - protein, 6 aa, Staphylococcus
KTKQLT

SEQ ID NO: 1857002 - protein, 5 aa, Staphylococcus
KTKRL

SEQ ID NO: 1857003 - protein, 8 aa, Staphylococcus
KTKRNTRK

SEQ ID NO: 1857004 - protein, 7 aa, Staphylococcus
KTLADNR

SEQ ID NO: 1857005 - protein, 7 aa, Staphylococcus
KTLAENR

SEQ ID NO: 1857006 - protein, 7 aa, Staphylococcus
KTLANNR

SEQ ID NO: 1857007 - protein, 14 aa, Staphylococcus
KTLANNRLASTDQV

SEQ ID NO: 1857008 - protein, 6 aa, Staphylococcus
KTLATQ

SEQ ID NO: 1857009 - protein, 33 aa, Staphylococcus
KTLDDIKKDDKHVDKITDPYKNRQISKDKTTAF

SEQ ID NO: 1857010 - protein, 12 aa, Staphylococcus
KTLDGTKAKSTI

SEQ ID NO: 1857011 - protein, 14 aa, Staphylococcus
KTLEKLADEGEITE

SEQ ID NO: 1857012 - protein, 6 aa, Staphylococcus
KTLEND

SEQ ID NO: 1857013 - protein, 16 aa, Staphylococcus
KTLENLAEEGNITTSA

SEQ ID NO: 1857014 - protein, 6 aa, Staphylococcus
KTLERL

SEQ ID NO: 1857015 - protein, 6 aa, Staphylococcus
KTLKNI

SEQ ID NO: 1857016 - protein, 19 aa, Staphylococcus
KTLPENKAKLNAKKKIEKI

SEQ ID NO: 1857017 - protein, 8 aa, Staphylococcus
KTLPGGQD

SEQ ID NO: 1857018 - protein, 6 aa, Staphylococcus
KTLSSH

SEQ ID NO: 1857019 - protein, 4 aa, Staphylococcus
KTLT

SEQ ID NO: 1857020 - protein, 61 aa, Staphylococcus
KTLTQQGRASEQAQKKLDQLRRAQETMSDKLEESARNAQKAKKSYDTLANSYDKLNNELKE

SEQ ID NO: 1857021 - protein, 9 aa, Staphylococcus
KTLVPDKEN

SEQ ID NO: 1857022 - protein, 9 aa, Staphylococcus
KTLVPEKDN

SEQ ID NO: 1857023 - protein, 5 aa, Staphylococcus
KTMEP

SEQ ID NO: 1857024 - protein, 8 aa, Staphylococcus
KTMSPVRQ

SEQ ID NO: 1857025 - protein, 15 aa, Staphylococcus
KTMTIPKGQDGTSIG

SEQ ID NO: 1857026 - protein, 15 aa, Staphylococcus
KTMTVPKGQDGQSVG

SEQ ID NO: 1857027 - protein, 15 aa, Staphylococcus
KTMTVPKGQDGTSIG

SEQ ID NO: 1857028 - protein, 14 aa, Staphylococcus
KTMTVPKGQNGTSI

SEQ ID NO: 1857029 - protein, 10 aa, Staphylococcus
KTNATQQEIE

SEQ ID NO: 1857030 - protein, 9 aa, Staphylococcus
KTNDSVGTY

SEQ ID NO: 1857031 - protein, 4 aa, Staphylococcus
KTNG

SEQ ID NO: 1857032 - protein, 6 aa, Staphylococcus
KTNHHS

SEQ ID NO: 1857033 - protein, 7 aa, Staphylococcus
KTNIGTR

SEQ ID NO: 1857034 - protein, 9 aa, Staphylococcus
KTNKEVANS

SEQ ID NO: 1857035 - protein, 8 aa, Staphylococcus
KTNKNGVP

SEQ ID NO: 1857036 - protein, 8 aa, Staphylococcus
KTNKSGVP

SEQ ID NO: 1857037 - protein, 7 aa, Staphylococcus
KTNKYGV

SEQ ID NO: 1857038 - protein, 12 aa, Staphylococcus
KTNNHETQPTVK

SEQ ID NO: 1857039 - protein, 6 aa, Staphylococcus
KTNNKI

SEQ ID NO: 1857040 - protein, 7 aa, Staphylococcus
KTNNKIG

SEQ ID NO: 1857041 - protein, 7 aa, Staphylococcus
KTNQLKG

SEQ ID NO: 1857042 - protein, 13 aa, Staphylococcus
KTNQSLDEVEPNN

SEQ ID NO: 1857043 - protein, 25 aa, Staphylococcus
KTNSKTKTKARQSKKKKQQKTDSSI

SEQ ID NO: 1857044 - protein, 9 aa, Staphylococcus
KTNYEETDN

SEQ ID NO: 1857045 - protein, 41 aa, Staphylococcus
KTPAINVDETQAKTTLATEVTTPPQSSVNENLDNKNTAEQQ

SEQ ID NO: 1857046 - protein, 8 aa, Staphylococcus
KTPASPGS

SEQ ID NO: 1857047 - protein, 9 aa, Staphylococcus
KTPGKSAVD

SEQ ID NO: 1857048 - protein, 21 aa, Staphylococcus
KTPGREDEGVTETVEATDRAK

SEQ ID NO: 1857049 - protein, 16 aa, Staphylococcus
KTPGREDKEQEIRNSS

SEQ ID NO: 1857050 - protein, 17 aa, Staphylococcus
KTPGREDKEQEVRDSSV

SEQ ID NO: 1857051 - protein, 22 aa, Staphylococcus
KTPGREDKEQIESVEATERADT

SEQ ID NO: 1857052 - protein, 19 aa, Staphylococcus
KTPGREDKEVKSSNVAASE

SEQ ID NO: 1857053 - protein, 21 aa, Staphylococcus
KTPGREDKQAQFTNSSASELP

SEQ ID NO: 1857054 - protein, 20 aa, Staphylococcus
KTPGREDKQASVANTSASKL

SEQ ID NO: 1857055 - protein, 21 aa, Staphylococcus
KTPGREDKQASVANTSASKLP

SEQ ID NO: 1857056 - protein, 6 aa, Staphylococcus
KTPGRY

SEQ ID NO: 1857057 - protein, 14 aa, Staphylococcus
KTPPNFNKPFQSKN

SEQ ID NO: 1857058 - protein, 9 aa, Staphylococcus
KTPQPLPRR

SEQ ID NO: 1857059 - protein, 4 aa, Staphylococcus
KTPS

SEQ ID NO: 1857060 - protein, 4 aa, Staphylococcus
KTPT

SEQ ID NO: 1857061 - protein, 16 aa, Staphylococcus
KTPTEGSVSFNNEDTR

SEQ ID NO: 1857062 - protein, 5 aa, Staphylococcus
KTPYE

SEQ ID NO: 1857063 - protein, 5 aa, Staphylococcus
KTQAA

SEQ ID NO: 1857064 - protein, 9 aa, Staphylococcus
KTQAEASIN

SEQ ID NO: 1857065 - protein, 5 aa, Staphylococcus
KTQCN

SEQ ID NO: 1857066 - protein, 6 aa, Staphylococcus
KTQDSA

SEQ ID NO: 1857067 - protein, 8 aa, Staphylococcus
KTQGGMST

SEQ ID NO: 1857068 - protein, 9 aa, Staphylococcus
KTQPHNQSI

SEQ ID NO: 1857069 - protein, 11 aa, Staphylococcus
KTQPPKALRAT

SEQ ID NO: 1857070 - protein, 22 aa, Staphylococcus
KTQTRKSAKRYAQSLLANCDFK

SEQ ID NO: 1857071 - protein, 8 aa, Staphylococcus
KTRAGNNY

SEQ ID NO: 1857072 - protein, 31 aa, Staphylococcus
KTRFTNLDENKADDLEEGKFDDEGGATANNN

SEQ ID NO: 1857073 - protein, 15 aa, Staphylococcus
KTRINASSSLSVTDN

SEQ ID NO: 1857074 - protein, 6 aa, Staphylococcus
KTRKEY

SEQ ID NO: 1857075 - protein, 5 aa, Staphylococcus
KTRKL

SEQ ID NO: 1857076 - protein, 6 aa, Staphylococcus
KTRSNS

SEQ ID NO: 1857077 - protein, 15 aa, Staphylococcus
KTSAQGKNIDSALDS

SEQ ID NO: 1857078 - protein, 7 aa, Staphylococcus
KTSDHKV

SEQ ID NO: 1857079 - protein, 16 aa, Staphylococcus
KTSGMEGSVAQAGSPI

SEQ ID NO: 1857080 - protein, 7 aa, Staphylococcus
KTSGQYS

SEQ ID NO: 1857081 - protein, 16 aa, Staphylococcus
KTSKSNDKFKETSSLT

SEQ ID NO: 1857082 - protein, 6 aa, Staphylococcus
KTSLKN

SEQ ID NO: 1857083 - protein, 8 aa, Staphylococcus
KTSNLKSF

SEQ ID NO: 1857084 - protein, 20 aa, Staphylococcus
KTSRANESKYISDEAAAQTI

SEQ ID NO: 1857085 - protein, 4 aa, Staphylococcus
KTSS

SEQ ID NO: 1857086 - protein, 6 aa, Staphylococcus
KTSSID

SEQ ID NO: 1857087 - protein, 11 aa, Staphylococcus
KTSSKADDQVT

SEQ ID NO: 1857088 - protein, 6 aa, Staphylococcus
KTSSNS

SEQ ID NO: 1857089 - protein, 8 aa, Staphylococcus
KTSWPTKE

SEQ ID NO: 1857090 - protein, 4 aa, Staphylococcus
KTSY

SEQ ID NO: 1857091 - protein, 6 aa, Staphylococcus
KTTCCN

SEQ ID NO: 1857092 - protein, 5 aa, Staphylococcus
KTTDH

SEQ ID NO: 1857093 - protein, 6 aa, Staphylococcus
KTTDIR

SEQ ID NO: 1857094 - protein, 7 aa, Staphylococcus
KTTDLNQ

SEQ ID NO: 1857095 - protein, 7 aa, Staphylococcus
KTTEETQ

SEQ ID NO: 1857096 - protein, 15 aa, Staphylococcus
KTTGMSMGSEPGGVS

SEQ ID NO: 1857097 - protein, 10 aa, Staphylococcus
KTTGSNTSQW

SEQ ID NO: 1857098 - protein, 7 aa, Staphylococcus
KTTGTDA

SEQ ID NO: 1857099 - protein, 13 aa, Staphylococcus
KTTINSASSLSVT

SEQ ID NO: 1857100 - protein, 5 aa, Staphylococcus
KTTIS

SEQ ID NO: 1857101 - protein, 5 aa, Staphylococcus
KTTKI

SEQ ID NO: 1857102 - protein, 5 aa, Staphylococcus
KTTNH

SEQ ID NO: 1857103 - protein, 11 aa, Staphylococcus
KTTNRDTKDKD

SEQ ID NO: 1857104 - protein, 15 aa, Staphylococcus
KTTPEKGDRLEQQSK

SEQ ID NO: 1857105 - protein, 7 aa, Staphylococcus
KTTPTWG

SEQ ID NO: 1857106 - protein, 10 aa, Staphylococcus
KTTQNSKAEG

SEQ ID NO: 1857107 - protein, 6 aa, Staphylococcus
KTTRTA

SEQ ID NO: 1857108 - protein, 4 aa, Staphylococcus
KTTS

SEQ ID NO: 1857109 - protein, 12 aa, Staphylococcus
KTTSQIAQASAR

SEQ ID NO: 1857110 - protein, 5 aa, Staphylococcus
KTTSY

SEQ ID NO: 1857111 - protein, 7 aa, Staphylococcus
KTTTPVK

SEQ ID NO: 1857112 - protein, 9 aa, Staphylococcus
KTVAERKNV

SEQ ID NO: 1857113 - protein, 7 aa, Staphylococcus
KTVDYSE

SEQ ID NO: 1857114 - protein, 10 aa, Staphylococcus
KTVETEDSSE

SEQ ID NO: 1857115 - protein, 9 aa, Staphylococcus
KTVNGKGNI

SEQ ID NO: 1857116 - protein, 12 aa, Staphylococcus
KTVQAKDDNIEQ

SEQ ID NO: 1857117 - protein, 7 aa, Staphylococcus
KTVSDQA

SEQ ID NO: 1857118 - protein, 5 aa, Staphylococcus
KTYED

SEQ ID NO: 1857119 - protein, 6 aa, Staphylococcus
KTYEQD

SEQ ID NO: 1857120 - protein, 15 aa, Staphylococcus
KTYGLSNYTTGEAPF

SEQ ID NO: 1857121 - protein, 5 aa, Staphylococcus
KTYNF

SEQ ID NO: 1857122 - protein, 7 aa, Staphylococcus
KTYSASM

SEQ ID NO: 1857123 - protein, 13 aa, Staphylococcus
KTYVNQKPKMKQF

SEQ ID NO: 1857124 - protein, 24 aa, Staphylococcus
KVAASNSFGNRSISSSDKTHDAET

SEQ ID NO: 1857125 - protein, 12 aa, Staphylococcus
KVANTKDKKLEI

SEQ ID NO: 1857126 - protein, 11 aa, Staphylococcus
KVASPKLNDNN

SEQ ID NO: 1857127 - protein, 8 aa, Staphylococcus
KVDAKEDK

SEQ ID NO: 1857128 - protein, 36 aa, Staphylococcus
KVDAKQAIKDIANAKRDEINSNPNLTDDQKAKALKE

SEQ ID NO: 1857129 - protein, 7 aa, Staphylococcus
KVDETTT

SEQ ID NO: 1857130 - protein, 8 aa, Staphylococcus
KVDHDDVP

SEQ ID NO: 1857131 - protein, 5 aa, Staphylococcus
KVDNT

SEQ ID NO: 1857132 - protein, 11 aa, Staphylococcus
KVDRGDLQQNL

SEQ ID NO: 1857133 - protein, 6 aa, Staphylococcus
KVDTTH

SEQ ID NO: 1857134 - protein, 4 aa, Staphylococcus
KVED

SEQ ID NO: 1857135 - protein, 4 aa, Staphylococcus
KVEK

SEQ ID NO: 1857136 - protein, 8 aa, Staphylococcus
KVEKLQPN

SEQ ID NO: 1857137 - protein, 9 aa, Staphylococcus
KVENKDYND

SEQ ID NO: 1857138 - protein, 17 aa, Staphylococcus
KVENQQDNTSKRYSDHK

SEQ ID NO: 1857139 - protein, 16 aa, Staphylococcus
KVEPGITKYIEEQMTK

SEQ ID NO: 1857140 - protein, 25 aa, Staphylococcus
KVEQAMKKTSGVANVKSDLSETYDQ

SEQ ID NO: 1857141 - protein, 7 aa, Staphylococcus
KVEQSYG

SEQ ID NO: 1857142 - protein, 16 aa, Staphylococcus
KVETTEKAEEEAYPEN

SEQ ID NO: 1857143 - protein, 26 aa, Staphylococcus
KVETVPSYYNGGYGYQPYEEMPEQEA

SEQ ID NO: 1857144 - protein, 7 aa, Staphylococcus
KVGAKKP

SEQ ID NO: 1857145 - protein, 13 aa, Staphylococcus
KVGDKQINSLSKK

SEQ ID NO: 1857146 - protein, 6 aa, Staphylococcus
KVGGKL

SEQ ID NO: 1857147 - protein, 4 aa, Staphylococcus
KVGK

SEQ ID NO: 1857148 - protein, 11 aa, Staphylococcus
KVGKAAGEQLK

SEQ ID NO: 1857149 - protein, 13 aa, Staphylococcus
KVGKNQINSLNDK

SEQ ID NO: 1857150 - protein, 6 aa, Staphylococcus
KVGNKR

SEQ ID NO: 1857151 - protein, 4 aa, Staphylococcus
KVGQ

SEQ ID NO: 1857152 - protein, 8 aa, Staphylococcus
KVGQLKQE

SEQ ID NO: 1857153 - protein, 11 aa, Staphylococcus
KVGRSQKNVAN

SEQ ID NO: 1857154 - protein, 5 aa, Staphylococcus
KVGVA

SEQ ID NO: 1857155 - protein, 17 aa, Staphylococcus
KVHGNKATLTNLKGPLS

SEQ ID NO: 1857156 - protein, 7 aa, Staphylococcus
KVHNGHS

SEQ ID NO: 1857157 - protein, 35 aa, Staphylococcus
KVKAQKAIEDAIKQKTDEINARKDLSDKEKQDAIK

SEQ ID NO: 1857158 - protein, 10 aa, Staphylococcus
KVKDGKDGNF

SEQ ID NO: 1857159 - protein, 12 aa, Staphylococcus
KVKDNKGTASVI

SEQ ID NO: 1857160 - protein, 8 aa, Staphylococcus
KVKDTKLA

SEQ ID NO: 1857161 - protein, 6 aa, Staphylococcus
KVKELG

SEQ ID NO: 1857162 - protein, 6 aa, Staphylococcus
KVKEPY

SEQ ID NO: 1857163 - protein, 7 aa, Staphylococcus
KVKEPYL

SEQ ID NO: 1857164 - protein, 40 aa, Staphylococcus
KVKESYLSENKKYKDGKYLTEDFNSKSLNGANGKAKIPAD

SEQ ID NO: 1857165 - protein, 6 aa, Staphylococcus
KVKGNV

SEQ ID NO: 1857166 - protein, 4 aa, Staphylococcus
KVKK

SEQ ID NO: 1857167 - protein, 6 aa, Staphylococcus
KVKKNV

SEQ ID NO: 1857168 - protein, 7 aa, Staphylococcus
KVKNSEL

SEQ ID NO: 1857169 - protein, 9 aa, Staphylococcus
KVKPNSYGA

SEQ ID NO: 1857170 - protein, 10 aa, Staphylococcus
KVKQQPDGNF

SEQ ID NO: 1857171 - protein, 6 aa, Staphylococcus
KVKRDL

SEQ ID NO: 1857172 - protein, 6 aa, Staphylococcus
KVKRNV

SEQ ID NO: 1857173 - protein, 16 aa, Staphylococcus
KVKRSRTQEEKMAANS

SEQ ID NO: 1857174 - protein, 10 aa, Staphylococcus
KVKSKRGAEF

SEQ ID NO: 1857175 - protein, 10 aa, Staphylococcus
KVKSKRGAQF

SEQ ID NO: 1857176 - protein, 6 aa, Staphylococcus
KVLETT

SEQ ID NO: 1857177 - protein, 24 aa, Staphylococcus
KVNAQNSEVDKNKEATLEERNDAL

SEQ ID NO: 1857178 - protein, 9 aa, Staphylococcus
KVNDNSVQK

SEQ ID NO: 1857179 - protein, 9 aa, Staphylococcus
KVNDSSVQK

SEQ ID NO: 1857180 - protein, 8 aa, Staphylococcus
KVNEEDDK

SEQ ID NO: 1857181 - protein, 8 aa, Staphylococcus
KVNEEEDK

SEQ ID NO: 1857182 - protein, 7 aa, Staphylococcus
KVNEPYL

SEQ ID NO: 1857183 - protein, 11 aa, Staphylococcus
KVNGEDKDVKK

SEQ ID NO: 1857184 - protein, 8 aa, Staphylococcus
KVNIGDKL

SEQ ID NO: 1857185 - protein, 20 aa, Staphylococcus
KVNKDGNHETIQTSDIKDGD

SEQ ID NO: 1857186 - protein, 6 aa, Staphylococcus
KVNPGQ

SEQ ID NO: 1857187 - protein, 19 aa, Staphylococcus
KVNQKNNAVAPKMTDTGST

SEQ ID NO: 1857188 - protein, 15 aa, Staphylococcus
KVNSGLEITKPKSAH

SEQ ID NO: 1857189 - protein, 8 aa, Staphylococcus
KVNSQQGG

SEQ ID NO: 1857190 - protein, 8 aa, Staphylococcus
KVNSTVDH

SEQ ID NO: 1857191 - protein, 6 aa, Staphylococcus
KVNTET

SEQ ID NO: 1857192 - protein, 11 aa, Staphylococcus
KVPAEAAKVSA

SEQ ID NO: 1857193 - protein, 5 aa, Staphylococcus
KVPDD

SEQ ID NO: 1857194 - protein, 6 aa, Staphylococcus
KVPEGL

SEQ ID NO: 1857195 - protein, 21 aa, Staphylococcus
KVPEKHSKNYEDEKSKIDKEI

SEQ ID NO: 1857196 - protein, 8 aa, Staphylococcus
KVPEKQVD

SEQ ID NO: 1857197 - protein, 17 aa, Staphylococcus
KVPESLQEDEKDSNGIK

SEQ ID NO: 1857198 - protein, 7 aa, Staphylococcus
KVPESPV

SEQ ID NO: 1857199 - protein, 10 aa, Staphylococcus
KVPGTQKELD

SEQ ID NO: 1857200 - protein, 7 aa, Staphylococcus
KVPMDEK

SEQ ID NO: 1857201 - protein, 5 aa, Staphylococcus
KVPNN

SEQ ID NO: 1857202 - protein, 5 aa, Staphylococcus
KVPTI

SEQ ID NO: 1857203 - protein, 8 aa, Staphylococcus
KVQARDQH

SEQ ID NO: 1857204 - protein, 10 aa, Staphylococcus
KVQARKQQEE

SEQ ID NO: 1857205 - protein, 7 aa, Staphylococcus
KVQGTID

SEQ ID NO: 1857206 - protein, 9 aa, Staphylococcus
KVQQSSKRT

SEQ ID NO: 1857207 - protein, 8 aa, Staphylococcus
KVQSLNNI

SEQ ID NO: 1857208 - protein, 6 aa, Staphylococcus
KVRIND

SEQ ID NO: 1857209 - protein, 6 aa, Staphylococcus
KVRKNV

SEQ ID NO: 1857210 - protein, 4 aa, Staphylococcus
KVRN

SEQ ID NO: 1857211 - protein, 6 aa, Staphylococcus
KVRNSV

SEQ ID NO: 1857212 - protein, 9 aa, Staphylococcus
KVSDQIKPG

SEQ ID NO: 1857213 - protein, 17 aa, Staphylococcus
KVSEIETDIDGTQEEVN

SEQ ID NO: 1857214 - protein, 7 aa, Staphylococcus
KVSEPYL

SEQ ID NO: 1857215 - protein, 30 aa, Staphylococcus
KVSERDTISKENKARIEKKIEESKRDLKQR

SEQ ID NO: 1857216 - protein, 7 aa, Staphylococcus
KVSKDTR

SEQ ID NO: 1857217 - protein, 8 aa, Staphylococcus
KVSKGDYA

SEQ ID NO: 1857218 - protein, 20 aa, Staphylococcus
KVSNGKTVENDHKEEPYEQN

SEQ ID NO: 1857219 - protein, 8 aa, Staphylococcus
KVSQSSQH

SEQ ID NO: 1857220 - protein, 9 aa, Staphylococcus
KVSTDNAEL

SEQ ID NO: 1857221 - protein, 6 aa, Staphylococcus
KVTDDE

SEQ ID NO: 1857222 - protein, 19 aa, Staphylococcus
KVTEESLNDRNDSGSFYTP

SEQ ID NO: 1857223 - protein, 8 aa, Staphylococcus
KVTGEGTH

SEQ ID NO: 1857224 - protein, 9 aa, Staphylococcus
KVTGRGTHQ

SEQ ID NO: 1857225 - protein, 32 aa, Staphylococcus
KVTIPKGEKGDTGQNAQPLTVTGSEKDAEGNT

SEQ ID NO: 1857226 - protein, 14 aa, Staphylococcus
KVTKNEIEASKAMD

SEQ ID NO: 1857227 - protein, 14 aa, Staphylococcus
KVTKNEIQASKAMD

SEQ ID NO: 1857228 - protein, 10 aa, Staphylococcus
KVTNANYARH

SEQ ID NO: 1857229 - protein, 10 aa, Staphylococcus
KVTNANYERH

SEQ ID NO: 1857230 - protein, 5 aa, Staphylococcus
KVTPN

SEQ ID NO: 1857231 - protein, 6 aa, Staphylococcus
KVTPQT

SEQ ID NO: 1857232 - protein, 5 aa, Staphylococcus
KVTQT

SEQ ID NO: 1857233 - protein, 28 aa, Staphylococcus
KVTRQDQDQYAVQSHQRAAKAQSEGKFD

SEQ ID NO: 1857234 - protein, 9 aa, Staphylococcus
KVTTKRGAE

SEQ ID NO: 1857235 - protein, 10 aa, Staphylococcus
KVVKGEHTLA

SEQ ID NO: 1857236 - protein, 8 aa, Staphylococcus
KVYRGHED

SEQ ID NO: 1857237 - protein, 4 aa, Staphylococcus
KWPT

SEQ ID NO: 1857238 - protein, 5 aa, Staphylococcus
KWPYS

SEQ ID NO: 1857239 - protein, 7 aa, Staphylococcus
KWQKGRN

SEQ ID NO: 1857240 - protein, 11 aa, Staphylococcus
KYAKDHGKTLK

SEQ ID NO: 1857241 - protein, 10 aa, Staphylococcus
KYANKNKTFG

SEQ ID NO: 1857242 - protein, 7 aa, Staphylococcus
KYDAKNK

SEQ ID NO: 1857243 - protein, 5 aa, Staphylococcus
KYDDI

SEQ ID NO: 1857244 - protein, 21 aa, Staphylococcus
KYDDSDAHDDMEETSSHITPV

SEQ ID NO: 1857245 - protein, 23 aa, Staphylococcus
KYDDSKAELDDTDQPSSTVTPIE

SEQ ID NO: 1857246 - protein, 6 aa, Staphylococcus
KYDEHQ

SEQ ID NO: 1857247 - protein, 77 aa, Staphylococcus
KYDEQYRKRNRQSADGRARHERRESQEAYNRSNSRYRDDDPRYRNDDRRYQDDYDYREDYRRRNDEYDEDGNRYYND

SEQ ID NO: 1857248 - protein, 10 aa, Staphylococcus
KYDKDNKQIE

SEQ ID NO: 1857249 - protein, 6 aa, Staphylococcus
KYDKER

SEQ ID NO: 1857250 - protein, 6 aa, Staphylococcus
KYDKNM

SEQ ID NO: 1857251 - protein, 68 aa, Staphylococcus
KYDNQYQNHRRRAEEDEFRNRAQSPNKMNGQRSNQREFEDEPERYYNGRDYRREQQLEEENEKSGRTK

SEQ ID NO: 1857252 - protein, 7 aa, Staphylococcus
KYDNYNA

SEQ ID NO: 1857253 - protein, 6 aa, Staphylococcus
KYDTDN

SEQ ID NO: 1857254 - protein, 14 aa, Staphylococcus
KYDTKRKKIKVETQ

SEQ ID NO: 1857255 - protein, 7 aa, Staphylococcus
KYDYANQ

SEQ ID NO: 1857256 - protein, 5 aa, Staphylococcus
KYEAN

SEQ ID NO: 1857257 - protein, 6 aa, Staphylococcus
KYEANT

SEQ ID NO: 1857258 - protein, 11 aa, Staphylococcus
KYEASTNIKNL

SEQ ID NO: 1857259 - protein, 21 aa, Staphylococcus
KYEEHDAQSVTKQNNKETHHE

SEQ ID NO: 1857260 - protein, 19 aa, Staphylococcus
KYEETPDLSGKTEKEAEQL

SEQ ID NO: 1857261 - protein, 10 aa, Staphylococcus
KYEKQNYNKT

SEQ ID NO: 1857262 - protein, 16 aa, Staphylococcus
KYERQKSRKAKFKPVG

SEQ ID NO: 1857263 - protein, 6 aa, Staphylococcus
KYERTY

SEQ ID NO: 1857264 - protein, 9 aa, Staphylococcus
KYESGTGYH

SEQ ID NO: 1857265 - protein, 8 aa, Staphylococcus
KYGASPKA

SEQ ID NO: 1857266 - protein, 5 aa, Staphylococcus
KYGEQ

SEQ ID NO: 1857267 - protein, 6 aa, Staphylococcus
KYGEVE

SEQ ID NO: 1857268 - protein, 5 aa, Staphylococcus
KYGGR

SEQ ID NO: 1857269 - protein, 4 aa, Staphylococcus
KYGK

SEQ ID NO: 1857270 - protein, 8 aa, Staphylococcus
KYGPPSVE

SEQ ID NO: 1857271 - protein, 6 aa, Staphylococcus
KYGPRP

SEQ ID NO: 1857272 - protein, 16 aa, Staphylococcus
KYGQANRTYPVKGGYT

SEQ ID NO: 1857273 - protein, 14 aa, Staphylococcus
KYGRNEVKTHESNN

SEQ ID NO: 1857274 - protein, 5 aa, Staphylococcus
KYHPN

SEQ ID NO: 1857275 - protein, 6 aa, Staphylococcus
KYIGGH

SEQ ID NO: 1857276 - protein, 6 aa, Staphylococcus
KYKEAH

SEQ ID NO: 1857277 - protein, 4 aa, Staphylococcus
KYKN

SEQ ID NO: 1857278 - protein, 4 aa, Staphylococcus
KYKR

SEQ ID NO: 1857279 - protein, 7 aa, Staphylococcus
KYKYNDT

SEQ ID NO: 1857280 - protein, 12 aa, Staphylococcus
KYLDSKDKVQTV

SEQ ID NO: 1857281 - protein, 7 aa, Staphylococcus
KYNEDES

SEQ ID NO: 1857282 - protein, 21 aa, Staphylococcus
KYNEMGGEVTNGYYTLIFVED

SEQ ID NO: 1857283 - protein, 10 aa, Staphylococcus
KYNKDAEYHK

SEQ ID NO: 1857284 - protein, 16 aa, Staphylococcus
KYNKPLGASRTNDKGH

SEQ ID NO: 1857285 - protein, 12 aa, Staphylococcus
KYNLSTKRQKQR

SEQ ID NO: 1857286 - protein, 16 aa, Staphylococcus
KYNSRMTSFGTQHDYE

SEQ ID NO: 1857287 - protein, 19 aa, Staphylococcus
KYNYAKKNQFNDKIAKDKA

SEQ ID NO: 1857288 - protein, 14 aa, Staphylococcus
KYPDLKADKQFTGL

SEQ ID NO: 1857289 - protein, 27 aa, Staphylococcus
KYPNGVKKGHPAYQSKLDRDKDGWACE

SEQ ID NO: 1857290 - protein, 10 aa, Staphylococcus
KYPTSGGITQ

SEQ ID NO: 1857291 - protein, 4 aa, Staphylococcus
KYPY

SEQ ID NO: 1857292 - protein, 7 aa, Staphylococcus
KYPYGET

SEQ ID NO: 1857293 - protein, 6 aa, Staphylococcus
KYPYKD

SEQ ID NO: 1857294 - protein, 6 aa, Staphylococcus
KYRKTY

SEQ ID NO: 1857295 - protein, 15 aa, Staphylococcus
KYRKTYVDSEGKTYH

SEQ ID NO: 1857296 - protein, 10 aa, Staphylococcus
KYSEDAPYHK

SEQ ID NO: 1857297 - protein, 9 aa, Staphylococcus
KYSKEQLKQ

SEQ ID NO: 1857298 - protein, 20 aa, Staphylococcus
KYSNKAANVLKNEADVKKGD

SEQ ID NO: 1857299 - protein, 7 aa, Staphylococcus
KYSPEAL

SEQ ID NO: 1857300 - protein, 7 aa, Staphylococcus
KYSSSTQ

SEQ ID NO: 1857301 - protein, 9 aa, Staphylococcus
KYTDASKVN

SEQ ID NO: 1857302 - protein, 18 aa, Staphylococcus
KYTEMDTPTIENRGALPK

SEQ ID NO: 1857303 - protein, 8 aa, Staphylococcus
KYTETHHE

SEQ ID NO: 1857304 - protein, 18 aa, Staphylococcus
KYTETPDLRGKTEAQAQQ

SEQ ID NO: 1857305 - protein, 9 aa, Staphylococcus
KYTKSSKKG

SEQ ID NO: 1857306 - protein, 13 aa, Staphylococcus
KYVNKGGAAYAYS

SEQ ID NO: 1857307 - protein, 5 aa, Staphylococcus
KYVPD

SEQ ID NO: 1857308 - protein, 6 aa, Staphylococcus
KYVPDG

SEQ ID NO: 1857309 - protein, 11 aa, Staphylococcus
KYVSKSGAAYA

SEQ ID NO: 1857310 - protein, 6 aa, Staphylococcus
KYYENL

SEQ ID NO: 1857311 - protein, 23 aa, Staphylococcus
KYYGDDSGEYEIKKEETKECTQS

SEQ ID NO: 1857312 - protein, 14 aa, Staphylococcus
KYYGTDDTAKYGNN

SEQ ID NO: 1857313 - protein, 6 aa, Staphylococcus
KYYNPD

SEQ ID NO: 1857314 - protein, 8 aa, Staphylococcus
LAAGAATI

SEQ ID NO: 1857315 - protein, 7 aa, Staphylococcus
LAAGQGG

SEQ ID NO: 1857316 - protein, 10 aa, Staphylococcus
LAAGSAAIGV

SEQ ID NO: 1857317 - protein, 9 aa, Staphylococcus
LAAGSAAVG

SEQ ID NO: 1857318 - protein, 12 aa, Staphylococcus
LAAGSASIGITS

SEQ ID NO: 1857319 - protein, 8 aa, Staphylococcus
LAAGSASL

SEQ ID NO: 1857320 - protein, 21 aa, Staphylococcus
LAAKNKNKALDDNTSVAENTA

SEQ ID NO: 1857321 - protein, 7 aa, Staphylococcus
LADAPRA

SEQ ID NO: 1857322 - protein, 11 aa, Staphylococcus
LADEGNGSAKI

SEQ ID NO: 1857323 - protein, 8 aa, Staphylococcus
LADKYEKG

SEQ ID NO: 1857324 - protein, 39 aa, Staphylococcus
LADNKYGRGPAGKKFEQGHTPTSHKSYSDSTSGSHHTHY

SEQ ID NO: 1857325 - protein, 32 aa, Staphylococcus; identical to SEQ ID NO: 1565123

SEQ ID NO: 1857326 - protein, 5 aa, Staphylococcus
LAEKT

SEQ ID NO: 1857327 - protein, 12 aa, Staphylococcus
LAENKNHVHGPG

SEQ ID NO: 1857328 - protein, 7 aa, Staphylococcus
LAENRLK

SEQ ID NO: 1857329 - protein, 18 aa, Staphylococcus
LAERKNELYKRSGKNPII

SEQ ID NO: 1857330 - protein, 5 aa, Staphylococcus
LAESI

SEQ ID NO: 1857331 - protein, 7 aa, Staphylococcus
LAETPFQ

SEQ ID NO: 1857332 - protein, 11 aa, Staphylococcus
LAGAKHNSNVI

SEQ ID NO: 1857333 - protein, 6 aa, Staphylococcus
LAGDAA

SEQ ID NO: 1857334 - protein, 8 aa, Staphylococcus
LAGGDGVA

SEQ ID NO: 1857335 - protein, 6 aa, Staphylococcus
LAGGGK

SEQ ID NO: 1857336 - protein, 9 aa, Staphylococcus
LAGGSTTQI

SEQ ID NO: 1857337 - protein, 12 aa, Staphylococcus
LAGKNLKEAQKG

SEQ ID NO: 1857338 - protein, 28 aa, Staphylococcus
LAGTGTAKLTGNMDKDKFNSNEYGDLST

SEQ ID NO: 1857339 - protein, 13 aa, Staphylococcus
LAGTGTAKLTKNW

SEQ ID NO: 1857340 - protein, 27 aa, Staphylococcus
LAGTGTAKLTNNLDKDTYNDNEYAEIT

SEQ ID NO: 1857341 - protein, 29 aa, Staphylococcus
LAGTGTAKLTNNLDKEKFNSNQYGDLSTD

SEQ ID NO: 1857342 - protein, 11 aa, Staphylococcus
LAGTGTAKLTR

SEQ ID NO: 1857343 - protein, 29 aa, Staphylococcus
LAGTGTARLTGNLDKEKFNSNHYGELSTE

SEQ ID NO: 1857344 - protein, 11 aa, Staphylococcus
LAGTGTARLTK

SEQ ID NO: 1857345 - protein, 20 aa, Staphylococcus
LAKAERKADERHERLHRHNR

SEQ ID NO: 1857346 - protein, 8 aa, Staphylococcus
LAKGLGQN

SEQ ID NO: 1857347 - protein, 12 aa, Staphylococcus
LAKGNLAEEGQS

SEQ ID NO: 1857348 - protein, 10 aa, Staphylococcus
LAKHKNNAIS

SEQ ID NO: 1857349 - protein, 12 aa, Staphylococcus
LAKSEAKNEDYI

SEQ ID NO: 1857350 - protein, 11 aa, Staphylococcus
LAKTQEEKLEA

SEQ ID NO: 1857351 - protein, 12 aa, Staphylococcus
LAKTTELAKHGQ

SEQ ID NO: 1857352 - protein, 13 aa, Staphylococcus
LAKTTELAQKGQS

SEQ ID NO: 1857353 - protein, 21 aa, Staphylococcus
LANDKGSIAPPKDTTSEHMIR

SEQ ID NO: 1857354 - protein, 8 aa, Staphylococcus
LANGKTGK

SEQ ID NO: 1857355 - protein, 9 aa, Staphylococcus
LANGQLSNQ

SEQ ID NO: 1857356 - protein, 5 aa, Staphylococcus
LANNS

SEQ ID NO: 1857357 - protein, 7 aa, Staphylococcus
LANPKRG

SEQ ID NO: 1857358 - protein, 13 aa, Staphylococcus
LANQNVNDAKTQY

SEQ ID NO: 1857359 - protein, 8 aa, Staphylococcus
LANTGTAY

SEQ ID NO: 1857360 - protein, 5 aa, Staphylococcus
LAPEG

SEQ ID NO: 1857361 - protein, 12 aa, Staphylococcus
LAPEGRQGSYQG

SEQ ID NO: 1857362 - protein, 6 aa, Staphylococcus
LAPKAF

SEQ ID NO: 1857363 - protein, 7 aa, Staphylococcus
LAPKAFN

SEQ ID NO: 1857364 - protein, 7 aa, Staphylococcus
LAPNGVP

SEQ ID NO: 1857365 - protein, 14 aa, Staphylococcus
LAPTNPLSSTEKKR

SEQ ID NO: 1857366 - protein, 6 aa, Staphylococcus
LAPTTH

SEQ ID NO: 1857367 - protein, 12 aa, Staphylococcus
LAPTVGQPAQQL

SEQ ID NO: 1857368 - protein, 10 aa, Staphylococcus
LAQAEDKEAV

SEQ ID NO: 1857369 - protein, 11 aa, Staphylococcus
LAQANQNDYSV

SEQ ID NO: 1857370 - protein, 21 aa, Staphylococcus
LAQKTKSSSLKSAAKDNLSDG

SEQ ID NO: 1857371 - protein, 7 aa, Staphylococcus
LAQNQCN

SEQ ID NO: 1857372 - protein, 7 aa, Staphylococcus
LAQQTHS

SEQ ID NO: 1857373 - protein, 5 aa, Staphylococcus
LARQA

SEQ ID NO: 1857374 - protein, 5 aa, Staphylococcus
LASPD

SEQ ID NO: 1857375 - protein, 13 aa, Staphylococcus
LASTSDSLSVSDS

SEQ ID NO: 1857376 - protein, 6 aa, Staphylococcus
LASYNN

SEQ ID NO: 1857377 - protein, 5 aa, Staphylococcus
LATAG

SEQ ID NO: 1857378 - protein, 8 aa, Staphylococcus
LATANGGY

SEQ ID NO: 1857379 - protein, 17 aa, Staphylococcus
LATEGSGETISPTAESG

SEQ ID NO: 1857380 - protein, 6 aa, Staphylococcus
LATGLG

SEQ ID NO: 1857381 - protein, 8 aa, Staphylococcus
LATGSYKY

SEQ ID NO: 1857382 - protein, 14 aa, Staphylococcus
LATGTAWGSASTAG

SEQ ID NO: 1857383 - protein, 10 aa, Staphylococcus
LATKKTNQIN

SEQ ID NO: 1857384 - protein, 10 aa, Staphylococcus
LATPSEWQTQ

SEQ ID NO: 1857385 - protein, 4 aa, Staphylococcus
LATS

SEQ ID NO: 1857386 - protein, 7 aa, Staphylococcus
LATSLGQ

SEQ ID NO: 1857387 - protein, 44 aa, Staphylococcus
LATSNGNGNGDDTDSDADADADADADSEKENNELPGTGSDEKNG

SEQ ID NO: 1857388 - protein, 11 aa, Staphylococcus
LATTEEMDKTG

SEQ ID NO: 1857389 - protein, 7 aa, Staphylococcus
LATVGTR

SEQ ID NO: 1857390 - protein, 17 aa, Staphylococcus
LDADESARIEYDDDTGY

SEQ ID NO: 1857391 - protein, 17 aa, Staphylococcus
LDADESARIEYDEDTGY

SEQ ID NO: 1857392 - protein, 11 aa, Staphylococcus
LDADSKKNLKS

SEQ ID NO: 1857393 - protein, 17 aa, Staphylococcus
LDAEESARIEYDEDSGY

SEQ ID NO: 1857394 - protein, 24 aa, Staphylococcus
LDDDGQETSLEKVSDTLNQHTPKS

SEQ ID NO: 1857395 - protein, 10 aa, Staphylococcus
LDDDNFEKDD

SEQ ID NO: 1857396 - protein, 16 aa, Staphylococcus
LDDKEIAKKYKDLNAN

SEQ ID NO: 1857397 - protein, 9 aa, Staphylococcus
LDDKSNSIK

SEQ ID NO: 1857398 - protein, 12 aa, Staphylococcus
LDDNGEKITNKD

SEQ ID NO: 1857399 - protein, 8 aa, Staphylococcus
LDDPYSDY

SEQ ID NO: 1857400 - protein, 4 aa, Staphylococcus
LDDR

SEQ ID NO: 1857401 - protein, 10 aa, Staphylococcus
LDDVSDNATL

SEQ ID NO: 1857402 - protein, 6 aa, Staphylococcus
LDEDQL

SEQ ID NO: 1857403 - protein, 7 aa, Staphylococcus
LDEEREI

SEQ ID NO: 1857404 - protein, 14 aa, Staphylococcus
LDEGSNKKEVANKV

SEQ ID NO: 1857405 - protein, 4 aa, Staphylococcus
LDEI

SEQ ID NO: 1857406 - protein, 6 aa, Staphylococcus
LDEINN

SEQ ID NO: 1857407 - protein, 8 aa, Staphylococcus
LDEKQAEL

SEQ ID NO: 1857408 - protein, 13 aa, Staphylococcus
LDENAQEPELTRN

SEQ ID NO: 1857409 - protein, 13 aa, Staphylococcus
LDEPNTDDTGRIK

SEQ ID NO: 1857410 - protein, 8 aa, Staphylococcus
LDEQNELT

SEQ ID NO: 1857411 - protein, 6 aa, Staphylococcus
LDEQQL

SEQ ID NO: 1857412 - protein, 17 aa, Staphylococcus
LDESPAYESTLEEQEEL

SEQ ID NO: 1857413 - protein, 9 aa, Staphylococcus
LDESTGKLT

SEQ ID NO: 1857414 - protein, 22 aa, Staphylococcus
LDESYKKAEEKVNQAQTNKQVD

SEQ ID NO: 1857415 - protein, 8 aa, Staphylococcus
LDEVEENN

SEQ ID NO: 1857416 - protein, 6 aa, Staphylococcus
LDGAAE

SEQ ID NO: 1857417 - protein, 19 aa, Staphylococcus
LDGDHRLEEAQNTANQTIT

SEQ ID NO: 1857418 - protein, 5 aa, Staphylococcus
LDGEG

SEQ ID NO: 1857419 - protein, 6 aa, Staphylococcus
LDGEGF

SEQ ID NO: 1857420 - protein, 12 aa, Staphylococcus
LDGENHNPLDKD

SEQ ID NO: 1857421 - protein, 14 aa, Staphylococcus
LDGENLSGGEKQRL

SEQ ID NO: 1857422 - protein, 11 aa, Staphylococcus
LDGNTLSGGEV

SEQ ID NO: 1857423 - protein, 10 aa, Staphylococcus
LDGQGGIQDD

SEQ ID NO: 1857424 - protein, 5 aa, Staphylococcus
LDGSL

SEQ ID NO: 1857425 - protein, 12 aa, Staphylococcus
LDGTSLSGGEIQ

SEQ ID NO: 1857426 - protein, 7 aa, Staphylococcus
LDGTSPK

SEQ ID NO: 1857427 - protein, 8 aa, Staphylococcus
LDHESGAF

SEQ ID NO: 1857428 - protein, 10 aa, Staphylococcus
LDKANKRRTT

SEQ ID NO: 1857429 - protein, 39 aa, Staphylococcus
LDKASKKQIDNYTSQQVSSKDNKTWRDASSTEIKAAMDS

SEQ ID NO: 1857430 - protein, 8 aa, Staphylococcus
LDKDGKYD

SEQ ID NO: 1857431 - protein, 9 aa, Staphylococcus
LDKDKKGNI

SEQ ID NO: 1857432 - protein, 8 aa, Staphylococcus
LDKEDDTY

SEQ ID NO: 1857433 - protein, 86 aa, Staphylococcus
LDKEEMSKNGFNQSKSNDIEDDKRKHQFNDTTEHIATTETGDTSDKLQHADETSHGVNQGDDAHDAINPNSVEGRVNEQIKNQNED

SEQ ID NO: 1857434 - protein, 4 aa, Staphylococcus
LDKG

SEQ ID NO: 1857435 - protein, 7 aa, Staphylococcus
LDKGDLK

SEQ ID NO: 1857436 - protein, 21 aa, Staphylococcus
LDKGEKIDKKALQATSRTLEN

SEQ ID NO: 1857437 - protein, 16 aa, Staphylococcus
LDKKRAKQQHVDIPRK

SEQ ID NO: 1857438 - protein, 14 aa, Staphylococcus
LDKNNRRYSKNYTR

SEQ ID NO: 1857439 - protein, 11 aa, Staphylococcus
LDKNPKKIKIE

SEQ ID NO: 1857440 - protein, 21 aa, Staphylococcus
LDKPDQPARKPEITNANYERH

SEQ ID NO: 1857441 - protein, 41 aa, Staphylococcus
LDKQISDLSERSTKLLSDSQNSKSTADDISGELNKLDDNVG

SEQ ID NO: 1857442 - protein, 10 aa, Staphylococcus
LDKTNPAIQD

SEQ ID NO: 1857443 - protein, 16 aa, Staphylococcus
LDNDINNNDVDSITNK

SEQ ID NO: 1857444 - protein, 8 aa, Staphylococcus
LDNGARRE

SEQ ID NO: 1857445 - protein, 9 aa, Staphylococcus
LDNGARREH

SEQ ID NO: 1857446 - protein, 6 aa, Staphylococcus
LDNGDY

SEQ ID NO: 1857447 - protein, 31 aa, Staphylococcus
LDNGGSDVNEASNHNSGGNTLDGKSDKYDSV

SEQ ID NO: 1857448 - protein, 8 aa, Staphylococcus
LDNGQRHE

SEQ ID NO: 1857449 - protein, 8 aa, Staphylococcus
LDPAESPY

SEQ ID NO: 1857450 - protein, 7 aa, Staphylococcus
LDPEGSP

SEQ ID NO: 1857451 - protein, 9 aa, Staphylococcus
LDPENPPAS

SEQ ID NO: 1857452 - protein, 6 aa, Staphylococcus
LDPERT

SEQ ID NO: 1857453 - protein, 7 aa, Staphylococcus
LDPKESP

SEQ ID NO: 1857454 - protein, 23 aa, Staphylococcus
LDPSDNRYKDDDYFKREQEYRDI

SEQ ID NO: 1857455 - protein, 18 aa, Staphylococcus
LDPSNKTHKKKKHETQSI

SEQ ID NO: 1857456 - protein, 7 aa, Staphylococcus
LDPSRIG

SEQ ID NO: 1857457 - protein, 8 aa, Staphylococcus
LDPSTGER

SEQ ID NO: 1857458 - protein, 20 aa, Staphylococcus
LDPTHKNKKTQSQEDQVQKL

SEQ ID NO: 1857459 - protein, 14 aa, Staphylococcus
LDPTHRSSKQVQSL

SEQ ID NO: 1857460 - protein, 17 aa, Staphylococcus
LDPTNNSKKRDNKVQSI

SEQ ID NO: 1857461 - protein, 15 aa, Staphylococcus
LDPTQKKKGPQPQTI

SEQ ID NO: 1857462 - protein, 18 aa, Staphylococcus
LDPTRKNKKKFEHQPQQI

SEQ ID NO: 1857463 - protein, 16 aa, Staphylococcus
LDPVKKKKGPQPQGMD

SEQ ID NO: 1857464 - protein, 6 aa, Staphylococcus
LDQAGD

SEQ ID NO: 1857465 - protein, 13 aa, Staphylococcus
LDQNIRKNPDNYT

SEQ ID NO: 1857466 - protein, 5 aa, Staphylococcus
LDQVK

SEQ ID NO: 1857467 - protein, 64 aa, Staphylococcus
LDRDKVSNRTQDSQRDDDKQRHMNSEDRHIENDKRKNHFENEQDQQDHASEQIHPEQKQASHSL

SEQ ID NO: 1857468 - protein, 14 aa, Staphylococcus
LDRSNLSRTLEDSG

SEQ ID NO: 1857469 - protein, 10 aa, Staphylococcus
LDSAGKLSDI

SEQ ID NO: 1857470 - protein, 21 aa, Staphylococcus
LDSAPSKNVVPGMNAEVKIHK

SEQ ID NO: 1857471 - protein, 10 aa, Staphylococcus
LDSAPSNSVV

SEQ ID NO: 1857472 - protein, 8 aa, Staphylococcus
LDSASRGV

SEQ ID NO: 1857473 - protein, 8 aa, Staphylococcus
LDSDISQE

SEQ ID NO: 1857474 - protein, 29 aa, Staphylococcus
LDSDPIKTGSEYAKKHGWDTPEKAIKGGA

SEQ ID NO: 1857475 - protein, 27 aa, Staphylococcus
LDSDPVKTGAEYAKKHGWDTPQKAIYG

SEQ ID NO: 1857476 - protein, 7 aa, Staphylococcus
LDSDSDK

SEQ ID NO: 1857477 - protein, 21 aa, Staphylococcus
LDSKPSKNVVPGMNAEVKIHK

SEQ ID NO: 1857478 - protein, 8 aa, Staphylococcus
LDSKTGGI

SEQ ID NO: 1857479 - protein, 10 aa, Staphylococcus
LDSLPGVNTT

SEQ ID NO: 1857480 - protein, 15 aa, Staphylococcus
LDSNHKNESSSNKRI

SEQ ID NO: 1857481 - protein, 8 aa, Staphylococcus
LDSQLSDD

SEQ ID NO: 1857482 - protein, 21 aa, Staphylococcus
LDSQPSKNVVPGMNAEVKIHK

SEQ ID NO: 1857483 - protein, 13 aa, Staphylococcus
LDSRDNGSANNRL

SEQ ID NO: 1857484 - protein, 21 aa, Staphylococcus
LDSSNTRTEISSELEKAKTIN

SEQ ID NO: 1857485 - protein, 25 aa, Staphylococcus
LDSTDSKKVSSKSIGKPMSAKEETV

SEQ ID NO: 1857486 - protein, 21 aa, Staphylococcus
LDSTPSKDVVPGMNAEVKIHK

SEQ ID NO: 1857487 - protein, 7 aa, Staphylococcus
LDTAKNN

SEQ ID NO: 1857488 - protein, 4 aa, Staphylococcus
LDTD

SEQ ID NO: 1857489 - protein, 11 aa, Staphylococcus
LDTENGEITDS

SEQ ID NO: 1857490 - protein, 13 aa, Staphylococcus
LDTPNTTNISDDL

SEQ ID NO: 1857491 - protein, 8 aa, Staphylococcus
LDTSRKPF

SEQ ID NO: 1857492 - protein, 29 aa, Staphylococcus
LDTSRKPFIARGDSQHGNASEQNEKQSFG

SEQ ID NO: 1857493 - protein, 31 aa, Staphylococcus
LDTSRKPFKAHGGQKNTDKDSNDEKLSPGKA

SEQ ID NO: 1857494 - protein, 31 aa, Staphylococcus
LDTSRKPFVARGDSAKENDDKNEEKLSPGKA

SEQ ID NO: 1857495 - protein, 7 aa, Staphylococcus
LDTSRRP

SEQ ID NO: 1857496 - protein, 6 aa, Staphylococcus
LDTTQG

SEQ ID NO: 1857497 - protein, 221 aa, Staphylococcus
LDYDTDSTSYDYNTDTGYDTNSEYNTDCDYNTDSDYNSDCDYSSDSDSGLDYDSDSSYDSDSSYDSDASYDSDTDCDYNSDCDSDSSYDSDTDYDSDSDSDFDSDSDSDSDSDSDSDCGSDSDCDSDSDSDSDSDSDSDSDSDSDSDSDSDSDSDSDSDSDSDSDSDSDSDCDSDSDSDSDSDSDSDSDSDSDSDSDSDSDSDSDSDSDSGSNCDSGSEHK

SEQ ID NO: 1857498 - protein, 8 aa, Staphylococcus
LDYGTNGH

SEQ ID NO: 1857499 - protein, 26 aa, Staphylococcus
LEAAQSNLHGDQKLAQAKQDAANTIN

SEQ ID NO: 1857500 - protein, 9 aa, Staphylococcus
LEAKEENQI

SEQ ID NO: 1857501 - protein, 5 aa, Staphylococcus
LEATS

SEQ ID NO: 1857502 - protein, 10 aa, Staphylococcus
LEDEHKMKGS

SEQ ID NO: 1857503 - protein, 4 aa, Staphylococcus
LEDK

SEQ ID NO: 1857504 - protein, 4 aa, Staphylococcus
LEDP

SEQ ID NO: 1857505 - protein, 5 aa, Staphylococcus
LEDPE

SEQ ID NO: 1857506 - protein, 12 aa, Staphylococcus
LEDREKVDLSDE

SEQ ID NO: 1857507 - protein, 5 aa, Staphylococcus
LEDTI

SEQ ID NO: 1857508 - protein, 23 aa, Staphylococcus
LEDTTTTATPNMDDANGASVKSR

SEQ ID NO: 1857509 - protein, 11 aa, Staphylococcus
LEDYSNSLDSL

SEQ ID NO: 1857510 - protein, 8 aa, Staphylococcus
LEEAKEKL

SEQ ID NO: 1857511 - protein, 9 aa, Staphylococcus
LEEANNSVN

SEQ ID NO: 1857512 - protein, 5 aa, Staphylococcus
LEEID

SEQ ID NO: 1857513 - protein, 10 aa, Staphylococcus
LEEKNNESHP

SEQ ID NO: 1857514 - protein, 7 aa, Staphylococcus
LEESPVY

SEQ ID NO: 1857515 - protein, 20 aa, Staphylococcus
LEESTTPNKIETKAGDEIAT

SEQ ID NO: 1857516 - protein, 6 aa, Staphylococcus
LEEVAP

SEQ ID NO: 1857517 - protein, 23 aa, Staphylococcus
LEGANTNSDVDQTTEQGKQSINS

SEQ ID NO: 1857518 - protein, 4 aa, Staphylococcus
LEGE

SEQ ID NO: 1857519 - protein, 4 aa, Staphylococcus
LEGK

SEQ ID NO: 1857520 - protein, 7 aa, Staphylococcus
LEGKVNG

SEQ ID NO: 1857521 - protein, 8 aa, Staphylococcus
LEGPAGPD

SEQ ID NO: 1857522 - protein, 4 aa, Staphylococcus
LEGQ

SEQ ID NO: 1857523 - protein, 6 aa, Staphylococcus
LEGSKS

SEQ ID NO: 1857524 - protein, 21 aa, Staphylococcus
LEGTGESFSESKSSKPSGTEI

SEQ ID NO: 1857525 - protein, 5 aa, Staphylococcus
LEGTK

SEQ ID NO: 1857526 - protein, 6 aa, Staphylococcus
LEGTKS

SEQ ID NO: 1857527 - protein, 7 aa, Staphylococcus
LEGTKSV

SEQ ID NO: 1857528 - protein, 11 aa, Staphylococcus
LEHDNESGAFS

SEQ ID NO: 1857529 - protein, 9 aa, Staphylococcus
LEHNNENPH

SEQ ID NO: 1857530 - protein, 4 aa, Staphylococcus
LEKA

SEQ ID NO: 1857531 - protein, 6 aa, Staphylococcus
LEKAGA

SEQ ID NO: 1857532 - protein, 8 aa, Staphylococcus
LEKDGDTY

SEQ ID NO: 1857533 - protein, 22 aa, Staphylococcus
LEKGDDKEQLKTSNDSLKQAKD

SEQ ID NO: 1857534 - protein, 21 aa, Staphylococcus
LEKGEKIDDKAVQATAKTLEN

SEQ ID NO: 1857535 - protein, 7 aa, Staphylococcus
LEKGKQV

SEQ ID NO: 1857536 - protein, 7 aa, Staphylococcus
LEKGMTN

SEQ ID NO: 1857537 - protein, 22 aa, Staphylococcus
LEKGNDKETIDTSNDSLKEAKD

SEQ ID NO: 1857538 - protein, 4 aa, Staphylococcus
LEKL

SEQ ID NO: 1857539 - protein, 8 aa, Staphylococcus
LEKNQDGY

SEQ ID NO: 1857540 - protein, 19 aa, Staphylococcus
LEKQTSKSQATTATKQVQT

SEQ ID NO: 1857541 - protein, 9 aa, Staphylococcus
LEKSEHVDL

SEQ ID NO: 1857542 - protein, 37 aa, Staphylococcus
LEKSSTPSKLTQEDGDYSTTVSGKITNSDVGGTSQKV

SEQ ID NO: 1857543 - protein, 6 aa, Staphylococcus
LENNGI

SEQ ID NO: 1857544 - protein, 6 aa, Staphylococcus
LENPDE

SEQ ID NO: 1857545 - protein, 9 aa, Staphylococcus
LENSGVKAL

SEQ ID NO: 1857546 - protein, 8 aa, Staphylococcus
LENSHELS

SEQ ID NO: 1857547 - protein, 48 aa, Staphylococcus
LENSITQQTDTEGMTTQTLQNYNEKLEAAKQELNKDKGILSGSPTVAE

SEQ ID NO: 1857548 - protein, 11 aa, Staphylococcus
LENTDGDIIPP

SEQ ID NO: 1857549 - protein, 15 aa, Staphylococcus
LENVSSRLENATKYN

SEQ ID NO: 1857550 - protein, 12 aa, Staphylococcus
LEPLNNSATDQI

SEQ ID NO: 1857551 - protein, 8 aa, Staphylococcus
LEPNGVPI

SEQ ID NO: 1857552 - protein, 7 aa, Staphylococcus
LEPSGTQ

SEQ ID NO: 1857553 - protein, 9 aa, Staphylococcus
LEPSGVKAL

SEQ ID NO: 1857554 - protein, 14 aa, Staphylococcus
LEQKPAGPDQITSS

SEQ ID NO: 1857555 - protein, 64 aa, Staphylococcus
LERHAQAVNNAEKEISQAQSQDSEPSHRTSRNEQSVAQQTTSKENQHLQNETTQDARTQQHPQI

SEQ ID NO: 1857556 - protein, 36 aa, Staphylococcus
LERTTTPSKLVQEDGDYATTVSGKITDSDVGGVSSK

SEQ ID NO: 1857557 - protein, 11 aa, Staphylococcus
LESDDFSKGNH

SEQ ID NO: 1857558 - protein, 6 aa, Staphylococcus
LESDQG

SEQ ID NO: 1857559 - protein, 4 aa, Staphylococcus
LESK

SEQ ID NO: 1857560 - protein, 7 aa, Staphylococcus
LESSDIK

SEQ ID NO: 1857561 - protein, 7 aa, Staphylococcus
LESSDIQ

SEQ ID NO: 1857562 - protein, 12 aa, Staphylococcus
LESSQEQAKAEK

SEQ ID NO: 1857563 - protein, 10 aa, Staphylococcus
LETAGKGKDW

SEQ ID NO: 1857564 - protein, 8 aa, Staphylococcus
LETGTQNI

SEQ ID NO: 1857565 - protein, 7 aa, Staphylococcus
LETGTQQ

SEQ ID NO: 1857566 - protein, 13 aa, Staphylococcus
LETRADKHKEIER

SEQ ID NO: 1857567 - protein, 14 aa, Staphylococcus
LETRADKLKEVERR

SEQ ID NO: 1857568 - protein, 14 aa, Staphylococcus
LETRAEKLKEVERR

SEQ ID NO: 1857569 - protein, 5 aa, Staphylococcus
LETRS

SEQ ID NO: 1857570 - protein, 6 aa, Staphylococcus
LETRSQ

SEQ ID NO: 1857571 - protein, 16 aa, Staphylococcus
LETSIGQTTAKKTVTV

SEQ ID NO: 1857572 - protein, 10 aa, Staphylococcus
LETSIHDQTK

SEQ ID NO: 1857573 - protein, 13 aa, Staphylococcus
LETSRQYKESSAL

SEQ ID NO: 1857574 - protein, 10 aa, Staphylococcus
LEVTSKSNQK

SEQ ID NO: 1857575 - protein, 11 aa, Staphylococcus
LGADQAAHAGQ

SEQ ID NO: 1857576 - protein, 12 aa, Staphylococcus
LGADQAASAGQS

SEQ ID NO: 1857577 - protein, 12 aa, Staphylococcus
LGADQAATAGQS

SEQ ID NO: 1857578 - protein, 4 aa, Staphylococcus
LGAG

SEQ ID NO: 1857579 - protein, 16 aa, Staphylococcus
LGANPKLSSKETIRNS

SEQ ID NO: 1857580 - protein, 5 aa, Staphylococcus
LGATN

SEQ ID NO: 1857581 - protein, 10 aa, Staphylococcus
LGDKEAQRIA

SEQ ID NO: 1857582 - protein, 8 aa, Staphylococcus
LGDKRNLS

SEQ ID NO: 1857583 - protein, 6 aa, Staphylococcus
LGDRKS

SEQ ID NO: 1857584 - protein, 4 aa, Staphylococcus
LGDS

SEQ ID NO: 1857585 - protein, 5 aa, Staphylococcus
LGDSY

SEQ ID NO: 1857586 - protein, 19 aa, Staphylococcus
LGEDTRLPKELKADDGTTF

SEQ ID NO: 1857587 - protein, 8 aa, Staphylococcus
LGEEFRNT

SEQ ID NO: 1857588 - protein, 11 aa, Staphylococcus
LGEEGEDPEFS

SEQ ID NO: 1857589 - protein, 5 aa, Staphylococcus
LGEES

SEQ ID NO: 1857590 - protein, 6 aa, Staphylococcus
LGEGGA

SEQ ID NO: 1857591 - protein, 7 aa, Staphylococcus
LGEGGAI

SEQ ID NO: 1857592 - protein, 20 aa, Staphylococcus
LGEKTLGEYNESFLNFKMSL

SEQ ID NO: 1857593 - protein, 5 aa, Staphylococcus
LGGAD

SEQ ID NO: 1857594 - protein, 4 aa, Staphylococcus
LGGE

SEQ ID NO: 1857595 - protein, 77 aa, Staphylococcus
LGGEDDESSKHEQKTAHQTKEKAKKAPEKDSDAENNKEKEFKAAPTKKSETEDTSNKKDKEKPETKSETEKEANGLV

SEQ ID NO: 1857596 - protein, 12 aa, Staphylococcus
LGGEKERNKMGN

SEQ ID NO: 1857597 - protein, 8 aa, Staphylococcus
LGGEQMAT

SEQ ID NO: 1857598 - protein, 6 aa, Staphylococcus
LGGGGM

SEQ ID NO: 1857599 - protein, 7 aa, Staphylococcus
LGGGGMS

SEQ ID NO: 1857600 - protein, 5 aa, Staphylococcus
LGGKE

SEQ ID NO: 1857601 - protein, 9 aa, Staphylococcus
LGGKENITS

SEQ ID NO: 1857602 - protein, 5 aa, Staphylococcus
LGGKR

SEQ ID NO: 1857603 - protein, 5 aa, Staphylococcus
LGGKS

SEQ ID NO: 1857604 - protein, 10 aa, Staphylococcus
LGGKSNIDSL

SEQ ID NO: 1857605 - protein, 5 aa, Staphylococcus
LGGPT

SEQ ID NO: 1857606 - protein, 5 aa, Staphylococcus
LGGQQ

SEQ ID NO: 1857607 - protein, 5 aa, Staphylococcus
LGGSQ

SEQ ID NO: 1857608 - protein, 4 aa, Staphylococcus
LGGT

SEQ ID NO: 1857609 - protein, 11 aa, Staphylococcus
LGHPKSGNAIL

SEQ ID NO: 1857610 - protein, 6 aa, Staphylococcus
LGHSDK

SEQ ID NO: 1857611 - protein, 6 aa, Staphylococcus
LGHSNA

SEQ ID NO: 1857612 - protein, 5 aa, Staphylococcus
LGIDP

SEQ ID NO: 1857613 - protein, 17 aa, Staphylococcus
LGIKDSKVKQAYTKQNI

SEQ ID NO: 1857614 - protein, 4 aa, Staphylococcus
LGIN

SEQ ID NO: 1857615 - protein, 10 aa, Staphylococcus
LGKAETQSKL

SEQ ID NO: 1857616 - protein, 11 aa, Staphylococcus
LGKASDKPEFN

SEQ ID NO: 1857617 - protein, 20 aa, Staphylococcus
LGKDNINDKAQTFNTSENDK

SEQ ID NO: 1857618 - protein, 38 aa, Staphylococcus
LGKEHEAKQHSKKTSFNTNHKKQPKPQPDQNKGQTKFN

SEQ ID NO: 1857619 - protein, 10 aa, Staphylococcus
LGKETSDFAV

SEQ ID NO: 1857620 - protein, 5 aa, Staphylococcus
LGKKY

SEQ ID NO: 1857621 - protein, 8 aa, Staphylococcus
LGKNGPIK

SEQ ID NO: 1857622 - protein, 11 aa, Staphylococcus
LGKPKDKPEFK

SEQ ID NO: 1857623 - protein, 17 aa, Staphylococcus
LGKPNDKPITIITLNKI

SEQ ID NO: 1857624 - protein, 11 aa, Staphylococcus
LGKPVSNQWGN

SEQ ID NO: 1857625 - protein, 11 aa, Staphylococcus
LGLGKTATQAL

SEQ ID NO: 1857626 - protein, 7 aa, Staphylococcus
LGLSSDD

SEQ ID NO: 1857627 - protein, 6 aa, Staphylococcus
LGMSTN

SEQ ID NO: 1857628 - protein, 7 aa, Staphylococcus
LGMTSSQ

SEQ ID NO: 1857629 - protein, 11 aa, Staphylococcus
LGNPKAGDAIL

SEQ ID NO: 1857630 - protein, 15 aa, Staphylococcus
LGNSSTNISSNPQGL

SEQ ID NO: 1857631 - protein, 4 aa, Staphylococcus
LGNT

SEQ ID NO: 1857632 - protein, 7 aa, Staphylococcus
LGPHEKG

SEQ ID NO: 1857633 - protein, 6 aa, Staphylococcus
LGPISA

SEQ ID NO: 1857634 - protein, 9 aa, Staphylococcus
LGPKITPIG

SEQ ID NO: 1857635 - protein, 9 aa, Staphylococcus
LGPKLTPIG

SEQ ID NO: 1857636 - protein, 20 aa, Staphylococcus
LGPKTLGEYNESFLNFKMSL

SEQ ID NO: 1857637 - protein, 14 aa, Staphylococcus
LGPLQFSNSSSGQV

SEQ ID NO: 1857638 - protein, 13 aa, Staphylococcus
LGPLQFSTSGGGQ

SEQ ID NO: 1857639 - protein, 10 aa, Staphylococcus
LGPMSKEEKL

SEQ ID NO: 1857640 - protein, 8 aa, Staphylococcus
LGPNAEDA

SEQ ID NO: 1857641 - protein, 10 aa, Staphylococcus
LGQAEAQSKL

SEQ ID NO: 1857642 - protein, 9 aa, Staphylococcus
LGQAETQSA

SEQ ID NO: 1857643 - protein, 8 aa, Staphylococcus
LGQHSKGL

SEQ ID NO: 1857644 - protein, 5 aa, Staphylococcus
LGQKP

SEQ ID NO: 1857645 - protein, 17 aa, Staphylococcus
LGQSKEKAEKSLVPEND

SEQ ID NO: 1857646 - protein, 8 aa, Staphylococcus
LGQTKDQT

SEQ ID NO: 1857647 - protein, 4 aa, Staphylococcus
LGQV

SEQ ID NO: 1857648 - protein, 9 aa, Staphylococcus
LGREDNKEV

SEQ ID NO: 1857649 - protein, 11 aa, Staphylococcus
LGRPEASDQDV

SEQ ID NO: 1857650 - protein, 5 aa, Staphylococcus
LGRRR

SEQ ID NO: 1857651 - protein, 4 aa, Staphylococcus
LGSA

SEQ ID NO: 1857652 - protein, 9 aa, Staphylococcus
LGSGDITEK

SEQ ID NO: 1857653 - protein, 4 aa, Staphylococcus
LGSM

SEQ ID NO: 1857654 - protein, 19 aa, Staphylococcus
LGSNYQKSKIGKNYQSITY

SEQ ID NO: 1857655 - protein, 12 aa, Staphylococcus
LGSREEVEIDEQ

SEQ ID NO: 1857656 - protein, 8 aa, Staphylococcus
LGSSGHTL

SEQ ID NO: 1857657 - protein, 8 aa, Staphylococcus
LGSSGLTA

SEQ ID NO: 1857658 - protein, 20 aa, Staphylococcus
LGSVGMKPTNPLSKEEKRKY

SEQ ID NO: 1857659 - protein, 19 aa, Staphylococcus
LGSVGMKPTNPLSPTEKKK

SEQ ID NO: 1857660 - protein, 5 aa, Staphylococcus
LGSVS

SEQ ID NO: 1857661 - protein, 11 aa, Staphylococcus
LGTDQAAHAGQ

SEQ ID NO: 1857662 - protein, 11 aa, Staphylococcus
LGTDQAASAGQ

SEQ ID NO: 1857663 - protein, 11 aa, Staphylococcus
LGTDTEEEAQG

SEQ ID NO: 1857664 - protein, 7 aa, Staphylococcus
LGTGNAL

SEQ ID NO: 1857665 - protein, 5 aa, Staphylococcus
LGTNK

SEQ ID NO: 1857666 - protein, 14 aa, Staphylococcus
LGTSFSNGEPVTER

SEQ ID NO: 1857667 - protein, 23 aa, Staphylococcus
LGTSGHSLGVSSAQEFGETEASM

SEQ ID NO: 1857668 - protein, 6 aa, Staphylococcus
LGTSTG

SEQ ID NO: 1857669 - protein, 9 aa, Staphylococcus
LGTSTGAQA

SEQ ID NO: 1857670 - protein, 10 aa, Staphylococcus
LGTTAYPESY

SEQ ID NO: 1857671 - protein, 5 aa, Staphylococcus
LGVPE

SEQ ID NO: 1857672 - protein, 12 aa, Staphylococcus
LGVSNEETISAL

SEQ ID NO: 1857673 - protein, 9 aa, Staphylococcus
LGYQESNSF

SEQ ID NO: 1857674 - protein, 4 aa, Staphylococcus
LGYS

SEQ ID NO: 1857675 - protein, 10 aa, Staphylococcus
LGYSDSNSFV

SEQ ID NO: 1857676 - protein, 7 aa, Staphylococcus
LHASGNT

SEQ ID NO: 1857677 - protein, 6 aa, Staphylococcus
LHETPR

SEQ ID NO: 1857678 - protein, 10 aa, Staphylococcus
LHISDSKKVD

SEQ ID NO: 1857679 - protein, 20 aa, Staphylococcus
LHKDSKNKMVKKSLEVDKRN

SEQ ID NO: 1857680 - protein, 12 aa, Staphylococcus
LHKSEAKDEDYI

SEQ ID NO: 1857681 - protein, 20 aa, Staphylococcus
LHQPTSKRKRFKNRRTYPEL

SEQ ID NO: 1857682 - protein, 19 aa, Staphylococcus
LHQPTTKGNIKKYSKTFPE

SEQ ID NO: 1857683 - protein, 4 aa, Staphylococcus
LIDD

SEQ ID NO: 1857684 - protein, 5 aa, Staphylococcus
LIDGT

SEQ ID NO: 1857685 - protein, 20 aa, Staphylococcus
LIDQNKVEKNISSRGKTNKL

SEQ ID NO: 1857686 - protein, 8 aa, Staphylococcus
LIEKDGKK

SEQ ID NO: 1857687 - protein, 4 aa, Staphylococcus
LIGG

SEQ ID NO: 1857688 - protein, 9 aa, Staphylococcus
LIKDGKDQW

SEQ ID NO: 1857689 - protein, 6 aa, Staphylococcus
LISGSG

SEQ ID NO: 1857690 - protein, 15 aa, Staphylococcus
LISSSGGTGNLDVNT

SEQ ID NO: 1857691 - protein, 14 aa, Staphylococcus
LKAEGAKQHGVKNS

SEQ ID NO: 1857692 - protein, 10 aa, Staphylococcus
LKAKKRRFRE

SEQ ID NO: 1857693 - protein, 15 aa, Staphylococcus
LKAKNEGKSDDPEFK

SEQ ID NO: 1857694 - protein, 8 aa, Staphylococcus
LKANDKQL

SEQ ID NO: 1857695 - protein, 9 aa, Staphylococcus
LKANPNNRD

SEQ ID NO: 1857696 - protein, 9 aa, Staphylococcus
LKASGANKM

SEQ ID NO: 1857697 - protein, 10 aa, Staphylococcus
LKASGANKTK

SEQ ID NO: 1857698 - protein, 16 aa, Staphylococcus
LKAYEPEELESVVEHE

SEQ ID NO: 1857699 - protein, 17 aa, Staphylococcus
LKDDQYKIKQKQTFEVL

SEQ ID NO: 1857700 - protein, 16 aa, Staphylococcus
LKDGELDEAERSSKDI

SEQ ID NO: 1857701 - protein, 12 aa, Staphylococcus
LKDGGNAVDASM

SEQ ID NO: 1857702 - protein, 8 aa, Staphylococcus
LKDKGFKV

SEQ ID NO: 1857703 - protein, 9 aa, Staphylococcus
LKDYTDKDN

SEQ ID NO: 1857704 - protein, 18 aa, Staphylococcus
LKEANNAQQNNESQSKVN

SEQ ID NO: 1857705 - protein, 18 aa, Staphylococcus
LKEANQAQQNGENQSKVD

SEQ ID NO: 1857706 - protein, 10 aa, Staphylococcus
LKEDGNYRQA

SEQ ID NO: 1857707 - protein, 6 aa, Staphylococcus
LKEENY

SEQ ID NO: 1857708 - protein, 12 aa, Staphylococcus
LKEGDNNKNVKS

SEQ ID NO: 1857709 - protein, 9 aa, Staphylococcus
LKEKDLENK

SEQ ID NO: 1857710 - protein, 7 aa, Staphylococcus
LKEKGFK

SEQ ID NO: 1857711 - protein, 14 aa, Staphylococcus
LKEKRRKRRERQRR

SEQ ID NO: 1857712 - protein, 9 aa, Staphylococcus
LKELPNETV

SEQ ID NO: 1857713 - protein, 11 aa, Staphylococcus
LKENTTEGKDW

SEQ ID NO: 1857714 - protein, 4 aa, Staphylococcus
LKEQ

SEQ ID NO: 1857715 - protein, 7 aa, Staphylococcus
LKESFGR

SEQ ID NO: 1857716 - protein, 7 aa, Staphylococcus
LKESGPV

SEQ ID NO: 1857717 - protein, 34 aa, Staphylococcus
LKETKTPSKLIKEDGDYTTTVTGTISDKDVGGIS

SEQ ID NO: 1857718 - protein, 10 aa, Staphylococcus
LKETVNPVKS

SEQ ID NO: 1857719 - protein, 5 aa, Staphylococcus
LKGAL

SEQ ID NO: 1857720 - protein, 4 aa, Staphylococcus
LKGD

SEQ ID NO: 1857721 - protein, 7 aa, Staphylococcus
LKGEKIN

SEQ ID NO: 1857722 - protein, 12 aa, Staphylococcus
LKGETKTKYDAL

SEQ ID NO: 1857723 - protein, 23 aa, Staphylococcus
LKGETKTKYDAMKKDNTESTNKY

SEQ ID NO: 1857724 - protein, 20 aa, Staphylococcus
LKGETQQEHDRLKRESLNNI

SEQ ID NO: 1857725 - protein, 13 aa, Staphylococcus
LKGETRKKYDAFK

SEQ ID NO: 1857726 - protein, 20 aa, Staphylococcus
LKGETRTKYDALKQNTLDHT

SEQ ID NO: 1857727 - protein, 11 aa, Staphylococcus
LKGISEHAKGI

SEQ ID NO: 1857728 - protein, 10 aa, Staphylococcus
LKGKDTPDVH

SEQ ID NO: 1857729 - protein, 11 aa, Staphylococcus
LKGKSDLDKNT

SEQ ID NO: 1857730 - protein, 9 aa, Staphylococcus
LKGKSEAEI

SEQ ID NO: 1857731 - protein, 4 aa, Staphylococcus
LKGL

SEQ ID NO: 1857732 - protein, 4 aa, Staphylococcus
LKGN

SEQ ID NO: 1857733 - protein, 14 aa, Staphylococcus
LKGNNARLTNTKTA

SEQ ID NO: 1857734 - protein, 6 aa, Staphylococcus
LKGPAG

SEQ ID NO: 1857735 - protein, 8 aa, Staphylococcus
LKGPAGPD

SEQ ID NO: 1857736 - protein, 7 aa, Staphylococcus
LKGPASV

SEQ ID NO: 1857737 - protein, 7 aa, Staphylococcus
LKGPTQA

SEQ ID NO: 1857738 - protein, 5 aa, Staphylococcus
LKGQQ

SEQ ID NO: 1857739 - protein, 11 aa, Staphylococcus
LKGQQKELQSK

SEQ ID NO: 1857740 - protein, 7 aa, Staphylococcus
LKGQSLG

SEQ ID NO: 1857741 - protein, 4 aa, Staphylococcus
LKGR

SEQ ID NO: 1857742 - protein, 9 aa, Staphylococcus
LKGRSEEQI

SEQ ID NO: 1857743 - protein, 5 aa, Staphylococcus
LKHNA

SEQ ID NO: 1857744 - protein, 7 aa, Staphylococcus
LKHPNQV

SEQ ID NO: 1857745 - protein, 7 aa, Staphylococcus
LKKAEQR

SEQ ID NO: 1857746 - protein, 16 aa, Staphylococcus
LKKAQEHANFILHFIL

SEQ ID NO: 1857747 - protein, 16 aa, Staphylococcus
LKKDFQKSEAKDEDYI

SEQ ID NO: 1857748 - protein, 9 aa, Staphylococcus
LKKDNATLQ

SEQ ID NO: 1857749 - protein, 10 aa, Staphylococcus
LKKKEQELEQ

SEQ ID NO: 1857750 - protein, 9 aa, Staphylococcus
LKKPKVAVP

SEQ ID NO: 1857751 - protein, 9 aa, Staphylococcus
LKKQADKMG

SEQ ID NO: 1857752 - protein, 7 aa, Staphylococcus
LKKQADV

SEQ ID NO: 1857753 - protein, 8 aa, Staphylococcus
LKKQAEQM

SEQ ID NO: 1857754 - protein, 6 aa, Staphylococcus
LKKQAN

SEQ ID NO: 1857755 - protein, 8 aa, Staphylococcus
LKKSENGK

SEQ ID NO: 1857756 - protein, 7 aa, Staphylococcus
LKNAEQV

SEQ ID NO: 1857757 - protein, 18 aa, Staphylococcus
LKNANNAQQNNENQNKVD

SEQ ID NO: 1857758 - protein, 19 aa, Staphylococcus
LKNANQAQQNNADQSKVEG

SEQ ID NO: 1857759 - protein, 8 aa, Staphylococcus
LKNEGSRL

SEQ ID NO: 1857760 - protein, 4 aa, Staphylococcus
LKNK

SEQ ID NO: 1857761 - protein, 14 aa, Staphylococcus
LKNKKEKKSKSGYK

SEQ ID NO: 1857762 - protein, 6 aa, Staphylococcus
LKNNDS

SEQ ID NO: 1857763 - protein, 11 aa, Staphylococcus
LKNNRKPDSID

SEQ ID NO: 1857764 - protein, 5 aa, Staphylococcus
LKNQP

SEQ ID NO: 1857765 - protein, 26 aa, Staphylococcus
LKNSTPEQKAAAHSKLNDDARNNVNG

SEQ ID NO: 1857766 - protein, 7 aa, Staphylococcus
LKNTDKK

SEQ ID NO: 1857767 - protein, 7 aa, Staphylococcus
LKNTEGF

SEQ ID NO: 1857768 - protein, 11 aa, Staphylococcus
LKNTENEITPF

SEQ ID NO: 1857769 - protein, 10 aa, Staphylococcus
LKPASASKFS

SEQ ID NO: 1857770 - protein, 18 aa, Staphylococcus
LKPEHSDDSFKNYGEVEY

SEQ ID NO: 1857771 - protein, 20 aa, Staphylococcus
LKPENSDDSFKDYSKVESNE

SEQ ID NO: 1857772 - protein, 21 aa, Staphylococcus
LKPEQAEETTQDYSESDRNEY

SEQ ID NO: 1857773 - protein, 5 aa, Staphylococcus
LKPGV

SEQ ID NO: 1857774 - protein, 28 aa, Staphylococcus
LKPIDNESSQKQTHNKVETPQYKNRDDY

SEQ ID NO: 1857775 - protein, 6 aa, Staphylococcus
LKPNQL

SEQ ID NO: 1857776 - protein, 4 aa, Staphylococcus
LKPS

SEQ ID NO: 1857777 - protein, 11 aa, Staphylococcus
LKQASKSLKPV

SEQ ID NO: 1857778 - protein, 5 aa, Staphylococcus
LKQEA

SEQ ID NO: 1857779 - protein, 8 aa, Staphylococcus
LKQGTERL

SEQ ID NO: 1857780 - protein, 13 aa, Staphylococcus
LKQKEENNADSKF

SEQ ID NO: 1857781 - protein, 14 aa, Staphylococcus
LKQKEETNADSKLT

SEQ ID NO: 1857782 - protein, 9 aa, Staphylococcus
LKQKSGSYA

SEQ ID NO: 1857783 - protein, 11 aa, Staphylococcus
LKQLDTNTSIW

SEQ ID NO: 1857784 - protein, 7 aa, Staphylococcus
LKQQDQD

SEQ ID NO: 1857785 - protein, 5 aa, Staphylococcus
LKQRR

SEQ ID NO: 1857786 - protein, 18 aa, Staphylococcus
LKQTIKQVNQDSAIENTN

SEQ ID NO: 1857787 - protein, 20 aa, Staphylococcus
LKRKKGGYATWSSPDRGNIQ

SEQ ID NO: 1857788 - protein, 12 aa, Staphylococcus
LKRKPRLKRGML

SEQ ID NO: 1857789 - protein, 20 aa, Staphylococcus
LKRKQNEVNQLPNATTDELQ

SEQ ID NO: 1857790 - protein, 13 aa, Staphylococcus
LKRNGNKETIQLT

SEQ ID NO: 1857791 - protein, 13 aa, Staphylococcus
LKRNSQRQNDRGL

SEQ ID NO: 1857792 - protein, 7 aa, Staphylococcus
LKRYKND

SEQ ID NO: 1857793 - protein, 6 aa, Staphylococcus
LKSDAY

SEQ ID NO: 1857794 - protein, 6 aa, Staphylococcus
LKSGQT

SEQ ID NO: 1857795 - protein, 12 aa, Staphylococcus
LKSGTSSTFSRV

SEQ ID NO: 1857796 - protein, 10 aa, Staphylococcus
LKSGTYPNHK

SEQ ID NO: 1857797 - protein, 9 aa, Staphylococcus
LKSKENRKR

SEQ ID NO: 1857798 - protein, 13 aa, Staphylococcus
LKSKSQKGDRKYE

SEQ ID NO: 1857799 - protein, 11 aa, Staphylococcus
LKSLAAKDQNV

SEQ ID NO: 1857800 - protein, 6 aa, Staphylococcus
LKSNHA

SEQ ID NO: 1857801 - protein, 10 aa, Staphylococcus
LKSNSNISTE

SEQ ID NO: 1857802 - protein, 7 aa, Staphylococcus
LKSPLTS

SEQ ID NO: 1857803 - protein, 7 aa, Staphylococcus
LKSPLTT

SEQ ID NO: 1857804 - protein, 9 aa, Staphylococcus
LKSPTGETV

SEQ ID NO: 1857805 - protein, 10 aa, Staphylococcus
LKSQKQANQL

SEQ ID NO: 1857806 - protein, 8 aa, Staphylococcus
LKSQLDNE

SEQ ID NO: 1857807 - protein, 50 aa, Staphylococcus
LKSQSENQTDSSNEKLKENTSYKEDRRSSVVDDAKDEIDQMKDTSSHKTE

SEQ ID NO: 1857808 - protein, 7 aa, Staphylococcus
LKSQSLG

SEQ ID NO: 1857809 - protein, 9 aa, Staphylococcus
LKSREKDAA

SEQ ID NO: 1857810 - protein, 19 aa, Staphylococcus
LKSSDKSERNDIRQKYQDG

SEQ ID NO: 1857811 - protein, 6 aa, Staphylococcus
LKTAGL

SEQ ID NO: 1857812 - protein, 6 aa, Staphylococcus
LKTAKE

SEQ ID NO: 1857813 - protein, 40 aa, Staphylococcus
LKTDQQYGKKLTNTNLSLPGSQDALNGAQGLKTGTSDNGY

SEQ ID NO: 1857814 - protein, 18 aa, Staphylococcus
LKTGSEGWKENSALTNEA

SEQ ID NO: 1857815 - protein, 6 aa, Staphylococcus
LKTNQL

SEQ ID NO: 1857816 - protein, 9 aa, Staphylococcus
LKTNTKEHK

SEQ ID NO: 1857817 - protein, 11 aa, Staphylococcus
LKTPDQAIKDP

SEQ ID NO: 1857818 - protein, 18 aa, Staphylococcus
LKTPGREDKEVESKDVSV

SEQ ID NO: 1857819 - protein, 7 aa, Staphylococcus
LKTPITS

SEQ ID NO: 1857820 - protein, 28 aa, Staphylococcus
LKTQAQKVSEGDYSQISSVSTKDEIGDL

SEQ ID NO: 1857821 - protein, 13 aa, Staphylococcus
LKTRSQIASEISS

SEQ ID NO: 1857822 - protein, 8 aa, Staphylococcus
LKTTTSDD

SEQ ID NO: 1857823 - protein, 10 aa, Staphylococcus
LKYNAPSKPI

SEQ ID NO: 1857824 - protein, 6 aa, Staphylococcus
LKYSED

SEQ ID NO: 1857825 - protein, 9 aa, Staphylococcus
LKYSKNSDI

SEQ ID NO: 1857826 - protein, 7 aa, Staphylococcus
LKYSQGK

SEQ ID NO: 1857827 - protein, 7 aa, Staphylococcus
LKYSQGQ

SEQ ID NO: 1857828 - protein, 5 aa, Staphylococcus
LLKNG

SEQ ID NO: 1857829 - protein, 7 aa, Staphylococcus
LLKTDAK

SEQ ID NO: 1857830 - protein, 9 aa, Staphylococcus
LLNSDSDTI

SEQ ID NO: 1857831 - protein, 6 aa, Staphylococcus
LLPGQG

SEQ ID NO: 1857832 - protein, 23 aa, Staphylococcus
LLPKGDISKYESTAKAAEQSTYD

SEQ ID NO: 1857833 - protein, 24 aa, Staphylococcus
LLPNRQSNGVQSQHLTKNNNISNY

SEQ ID NO: 1857834 - protein, 12 aa, Staphylococcus
LMETSNDNSITF

SEQ ID NO: 1857835 - protein, 12 aa, Staphylococcus
LMGGDNDVATSP

SEQ ID NO: 1857836 - protein, 12 aa, Staphylococcus
LMGGENSISTSP

SEQ ID NO: 1857837 - protein, 5 aa, Staphylococcus
LMTTD

SEQ ID NO: 1857838 - protein, 22 aa, Staphylococcus
LNAAKSEANGVLNNNNPTVSQV

SEQ ID NO: 1857839 - protein, 8 aa, Staphylococcus
LNAASDAS

SEQ ID NO: 1857840 - protein, 6 aa, Staphylococcus
LNAGAS

SEQ ID NO: 1857841 - protein, 6 aa, Staphylococcus
LNAGTA

SEQ ID NO: 1857842 - protein, 9 aa, Staphylococcus
LNAPTSRDA

SEQ ID NO: 1857843 - protein, 32 aa, Staphylococcus
LNASTSLSEVASTSLSDSTEASTSLSESTSMS

SEQ ID NO: 1857844 - protein, 8 aa, Staphylococcus
LNDADSSL

SEQ ID NO: 1857845 - protein, 9 aa, Staphylococcus
LNDAKAKAL

SEQ ID NO: 1857846 - protein, 10 aa, Staphylococcus
LNDDNQFGDW

SEQ ID NO: 1857847 - protein, 9 aa, Staphylococcus
LNDFPKNEL

SEQ ID NO: 1857848 - protein, 6 aa, Staphylococcus
LNDKDE

SEQ ID NO: 1857849 - protein, 5 aa, Staphylococcus
LNDKE

SEQ ID NO: 1857850 - protein, 5 aa, Staphylococcus
LNDKN

SEQ ID NO: 1857851 - protein, 10 aa, Staphylococcus
LNDKTQESIA

SEQ ID NO: 1857852 - protein, 10 aa, Staphylococcus
LNDNHSSHIQ

SEQ ID NO: 1857853 - protein, 5 aa, Staphylococcus
LNDNQ

SEQ ID NO: 1857854 - protein, 33 aa, Staphylococcus
LNDPEDKAVDDALKAGQEVEGDLNATPEQVKQA

SEQ ID NO: 1857855 - protein, 5 aa, Staphylococcus
LNDPI

SEQ ID NO: 1857856 - protein, 7 aa, Staphylococcus
LNDPNIN

SEQ ID NO: 1857857 - protein, 32 aa, Staphylococcus
LNDPQRQAEHNEINSAPSRTEVQSDLNNAKAL

SEQ ID NO: 1857858 - protein, 8 aa, Staphylococcus
LNDQQQAE

SEQ ID NO: 1857859 - protein, 8 aa, Staphylococcus
LNDSSGFP

SEQ ID NO: 1857860 - protein, 17 aa, Staphylococcus
LNDTHKDQDLDTDARHH

SEQ ID NO: 1857861 - protein, 7 aa, Staphylococcus
LNEDDYN

SEQ ID NO: 1857862 - protein, 4 aa, Staphylococcus
LNEE

SEQ ID NO: 1857863 - protein, 7 aa, Staphylococcus
LNEEDYE

SEQ ID NO: 1857864 - protein, 10 aa, Staphylococcus
LNEEDYERLD

SEQ ID NO: 1857865 - protein, 38 aa, Staphylococcus
LNEEKHTRISDTTQTVPIDKKEIKNKLEEETHKKDIAQ

SEQ ID NO: 1857866 - protein, 9 aa, Staphylococcus
LNEENSKTD

SEQ ID NO: 1857867 - protein, 15 aa, Staphylococcus
LNEEQRSQLADDSKL

SEQ ID NO: 1857868 - protein, 38 aa, Staphylococcus
LNEESKDIADMNDSEENKNTASEKDEGAVKENNQDGLA

SEQ ID NO: 1857869 - protein, 10 aa, Staphylococcus
LNEFPKNDLP

SEQ ID NO: 1857870 - protein, 6 aa, Staphylococcus
LNEGNG

SEQ ID NO: 1857871 - protein, 8 aa, Staphylococcus
LNEHDTDV

SEQ ID NO: 1857872 - protein, 9 aa, Staphylococcus
LNEKSARPV

SEQ ID NO: 1857873 - protein, 13 aa, Staphylococcus
LNEPNTDDSGRIK

SEQ ID NO: 1857874 - protein, 10 aa, Staphylococcus
LNEQSAKKAA

SEQ ID NO: 1857875 - protein, 11 aa, Staphylococcus
LNETKTKETIN

SEQ ID NO: 1857876 - protein, 6 aa, Staphylococcus
LNETQL

SEQ ID NO: 1857877 - protein, 22 aa, Staphylococcus
LNETSTPSKLVQEEGDYATTIS

SEQ ID NO: 1857878 - protein, 9 aa, Staphylococcus
LNGDKKVNT

SEQ ID NO: 1857879 - protein, 5 aa, Staphylococcus
LNGEN

SEQ ID NO: 1857880 - protein, 8 aa, Staphylococcus
LNGENYDT

SEQ ID NO: 1857881 - protein, 6 aa, Staphylococcus
LNGGGA

SEQ ID NO: 1857882 - protein, 7 aa, Staphylococcus
LNGGGAL

SEQ ID NO: 1857883 - protein, 7 aa, Staphylococcus
LNGGGSL

SEQ ID NO: 1857884 - protein, 7 aa, Staphylococcus
LNGKAND

SEQ ID NO: 1857885 - protein, 7 aa, Staphylococcus
LNGKGGA

SEQ ID NO: 1857886 - protein, 6 aa, Staphylococcus
LNGKGK

SEQ ID NO: 1857887 - protein, 21 aa, Staphylococcus
LNGNKKHISVDEGDSKSLGTF

SEQ ID NO: 1857888 - protein, 4 aa, Staphylococcus
LNGQ

SEQ ID NO: 1857889 - protein, 6 aa, Staphylococcus
LNGQGF

SEQ ID NO: 1857890 - protein, 8 aa, Staphylococcus
LNGQGGGS

SEQ ID NO: 1857891 - protein, 8 aa, Staphylococcus
LNGQTERQ

SEQ ID NO: 1857892 - protein, 16 aa, Staphylococcus
LNGQTSKSENKDKVYT

SEQ ID NO: 1857893 - protein, 4 aa, Staphylococcus
LNGS

SEQ ID NO: 1857894 - protein, 5 aa, Staphylococcus
LNINK

SEQ ID NO: 1857895 - protein, 5 aa, Staphylococcus
LNKAN

SEQ ID NO: 1857896 - protein, 6 aa, Staphylococcus
LNKDKV

SEQ ID NO: 1857897 - protein, 8 aa, Staphylococcus
LNKDNAPK

SEQ ID NO: 1857898 - protein, 14 aa, Staphylococcus
LNKEENKEKHSVDQ

SEQ ID NO: 1857899 - protein, 8 aa, Staphylococcus
LNKEGDSY

SEQ ID NO: 1857900 - protein, 4 aa, Staphylococcus
LNKG

SEQ ID NO: 1857901 - protein, 7 aa, Staphylococcus
LNKGYGY

SEQ ID NO: 1857902 - protein, 8 aa, Staphylococcus
LNKNNRKS

SEQ ID NO: 1857903 - protein, 34 aa, Staphylococcus
LNKQITQQSLDTLEKQDVKVSANEIEGLTNPVKV

SEQ ID NO: 1857904 - protein, 39 aa, Staphylococcus
LNKQITSQSLSTLEKQDVKVSASDIKGITNPVKVDNQEI

SEQ ID NO: 1857905 - protein, 37 aa, Staphylococcus
LNKTTTPSKLVQKDGDYATTVSGKITASDVGGTSSKV

SEQ ID NO: 1857906 - protein, 19 aa, Staphylococcus
LNNAKDGLRADKSQLQTAY

SEQ ID NO: 1857907 - protein, 7 aa, Staphylococcus
LNNAQDK

SEQ ID NO: 1857908 - protein, 9 aa, Staphylococcus
LNNAQKDAF

SEQ ID NO: 1857909 - protein, 8 aa, Staphylococcus
LNNAQNNY

SEQ ID NO: 1857910 - protein, 25 aa, Staphylococcus
LNNAQRKVAENSITNSEDLNSLAES

SEQ ID NO: 1857911 - protein, 20 aa, Staphylococcus
LNNAQRVDSIKQANDTDNLK

SEQ ID NO: 1857912 - protein, 25 aa, Staphylococcus
LNNDGNYEKEKDKLPDTGNEDKHNG

SEQ ID NO: 1857913 - protein, 4 aa, Staphylococcus
LNNE

SEQ ID NO: 1857914 - protein, 14 aa, Staphylococcus
LNNGDTKLSTVQSK

SEQ ID NO: 1857915 - protein, 13 aa, Staphylococcus
LNNKQKIQSNRLK

SEQ ID NO: 1857916 - protein, 13 aa, Staphylococcus
LNNKQKMQSNRLK

SEQ ID NO: 1857917 - protein, 9 aa, Staphylococcus
LNNLNDKDY

SEQ ID NO: 1857918 - protein, 9 aa, Staphylococcus
LNNLNDKSY

SEQ ID NO: 1857919 - protein, 8 aa, Staphylococcus
LNNLNNKD

SEQ ID NO: 1857920 - protein, 14 aa, Staphylococcus
LNNMNGVSKEEKDR

SEQ ID NO: 1857921 - protein, 11 aa, Staphylococcus
LNNPQSQQQVD

SEQ ID NO: 1857922 - protein, 8 aa, Staphylococcus
LNNQGKPN

SEQ ID NO: 1857923 - protein, 12 aa, Staphylococcus
LNNSQKIQSNRL

SEQ ID NO: 1857924 - protein, 7 aa, Staphylococcus
LNNSSVG

SEQ ID NO: 1857925 - protein, 9 aa, Staphylococcus
LNNTDRETF

SEQ ID NO: 1857926 - protein, 7 aa, Staphylococcus
LNNTSQP

SEQ ID NO: 1857927 - protein, 30 aa, Staphylococcus
LNNVTNSDSSKKNEPKPLSKPMTASMEGTV

SEQ ID NO: 1857928 - protein, 9 aa, Staphylococcus
LNPGERKDL

SEQ ID NO: 1857929 - protein, 14 aa, Staphylococcus
LNPNESEPKSYDKY

SEQ ID NO: 1857930 - protein, 13 aa, Staphylococcus
LNPNQSEPGSYDK

SEQ ID NO: 1857931 - protein, 5 aa, Staphylococcus
LNPQG

SEQ ID NO: 1857932 - protein, 7 aa, Staphylococcus
LNPQKKN

SEQ ID NO: 1857933 - protein, 8 aa, Staphylococcus
LNPSDSPY

SEQ ID NO: 1857934 - protein, 32 aa, Staphylococcus
LNPTQATQSLVQSSHKPKVKTADDNKAPSYAT

SEQ ID NO: 1857935 - protein, 7 aa, Staphylococcus
LNPTTKL

SEQ ID NO: 1857936 - protein, 11 aa, Staphylococcus
LNQAGKLNDLT

SEQ ID NO: 1857937 - protein, 8 aa, Staphylococcus
LNQAKANA

SEQ ID NO: 1857938 - protein, 12 aa, Staphylococcus
LNQAPITGESIP

SEQ ID NO: 1857939 - protein, 11 aa, Staphylococcus
LNQAQKDELNH

SEQ ID NO: 1857940 - protein, 9 aa, Staphylococcus
LNQAQKEAL

SEQ ID NO: 1857941 - protein, 6 aa, Staphylococcus
LNQAQS

SEQ ID NO: 1857942 - protein, 8 aa, Staphylococcus
LNQDEVAS

SEQ ID NO: 1857943 - protein, 6 aa, Staphylococcus
LNQDKA

SEQ ID NO: 1857944 - protein, 14 aa, Staphylococcus
LNQDKTTASKELNN

SEQ ID NO: 1857945 - protein, 83 aa, Staphylococcus
LNQNATENHVKEESKEVSTEEESIEDRKTEESTTEESKAVEEANKENTTEKNDEGSLDLEKEKDTYKDEKDNGKKKNELESHN

SEQ ID NO: 1857946 - protein, 6 aa, Staphylococcus
LNQQGY

SEQ ID NO: 1857947 - protein, 11 aa, Staphylococcus
LNQQSSVTSSF

SEQ ID NO: 1857948 - protein, 8 aa, Staphylococcus
LNQRVNDQ

SEQ ID NO: 1857949 - protein, 7 aa, Staphylococcus
LNQSHNK

SEQ ID NO: 1857950 - protein, 6 aa, Staphylococcus
LNQTPG

SEQ ID NO: 1857951 - protein, 8 aa, Staphylococcus
LNQTQAKA

SEQ ID NO: 1857952 - protein, 18 aa, Staphylococcus
LNSAKNDLRADKSELQTA

SEQ ID NO: 1857953 - protein, 10 aa, Staphylococcus
LNSAQPTAGM

SEQ ID NO: 1857954 - protein, 8 aa, Staphylococcus
LNSDMSDI

SEQ ID NO: 1857955 - protein, 7 aa, Staphylococcus
LNSDSRK

SEQ ID NO: 1857956 - protein, 6 aa, Staphylococcus
LNSGDY

SEQ ID NO: 1857957 - protein, 7 aa, Staphylococcus
LNSGGSL

SEQ ID NO: 1857958 - protein, 7 aa, Staphylococcus
LNSGQSR

SEQ ID NO: 1857959 - protein, 10 aa, Staphylococcus
LNSKDKVRTV

SEQ ID NO: 1857960 - protein, 25 aa, Staphylococcus
LNSKIERQTGLQEKQFESQERQEKH

SEQ ID NO: 1857961 - protein, 4 aa, Staphylococcus
LNSN

SEQ ID NO: 1857962 - protein, 28 aa, Staphylococcus
LNSNGQYETTNYELREDSDTGNIQLVDS

SEQ ID NO: 1857963 - protein, 23 aa, Staphylococcus
LNTDEGDTSDSKDKATPFEQNPN

SEQ ID NO: 1857964 - protein, 12 aa, Staphylococcus
LNTEANTKSSQY

SEQ ID NO: 1857965 - protein, 7 aa, Staphylococcus
LNTGKSR

SEQ ID NO: 1857966 - protein, 10 aa, Staphylococcus
LNTKEDNGRF

SEQ ID NO: 1857967 - protein, 5 aa, Staphylococcus
LNTNI

SEQ ID NO: 1857968 - protein, 10 aa, Staphylococcus
LNTRPSGGNI

SEQ ID NO: 1857969 - protein, 22 aa, Staphylococcus
LNVSQPTTITVTDTTPPSLEDI

SEQ ID NO: 1857970 - protein, 4 aa, Staphylococcus
LNVT

SEQ ID NO: 1857971 - protein, 15 aa, Staphylococcus
LPDDKTDTSTYKNVD

SEQ ID NO: 1857972 - protein, 4 aa, Staphylococcus
LPDG

SEQ ID NO: 1857973 - protein, 13 aa, Staphylococcus
LPDNDEKALASRT

SEQ ID NO: 1857974 - protein, 6 aa, Staphylococcus
LPEDKE

SEQ ID NO: 1857975 - protein, 9 aa, Staphylococcus
LPEEAKKPF

SEQ ID NO: 1857976 - protein, 8 aa, Staphylococcus
LPEEEKQQ

SEQ ID NO: 1857977 - protein, 11 aa, Staphylococcus
LPEETLPSEFS

SEQ ID NO: 1857978 - protein, 6 aa, Staphylococcus
LPEEVN

SEQ ID NO: 1857979 - protein, 11 aa, Staphylococcus
LPEITTSSHKF

SEQ ID NO: 1857980 - protein, 7 aa, Staphylococcus
LPENDYF

SEQ ID NO: 1857981 - protein, 4 aa, Staphylococcus
LPEP

SEQ ID NO: 1857982 - protein, 13 aa, Staphylococcus
LPESKQVKAQSNH

SEQ ID NO: 1857983 - protein, 65 aa, Staphylococcus
LPESNEQPDTSKEDNDNNHSTNGHDGQQQTPDSNNDDKDNTGHINDNDDNIKDDNEADSSNKDNV

SEQ ID NO: 1857984 - protein, 8 aa, Staphylococcus
LPEVDYDS

SEQ ID NO: 1857985 - protein, 5 aa, Staphylococcus
LPGGQ

SEQ ID NO: 1857986 - protein, 7 aa, Staphylococcus
LPGGQTL

SEQ ID NO: 1857987 - protein, 8 aa, Staphylococcus
LPGGVTTS

SEQ ID NO: 1857988 - protein, 6 aa, Staphylococcus
LPGINT

SEQ ID NO: 1857989 - protein, 12 aa, Staphylococcus
LPGKIRRKVGFL

SEQ ID NO: 1857990 - protein, 17 aa, Staphylococcus
LPGQGQTSRANKGQIKN

SEQ ID NO: 1857991 - protein, 12 aa, Staphylococcus
LPGRKKDEEDVK

SEQ ID NO: 1857992 - protein, 11 aa, Staphylococcus
LPGRKKGTEEV

SEQ ID NO: 1857993 - protein, 10 aa, Staphylococcus
LPGRRDEEDV

SEQ ID NO: 1857994 - protein, 11 aa, Staphylococcus
LPGRRKNEEEV

SEQ ID NO: 1857995 - protein, 10 aa, Staphylococcus
LPGTMSEATH

SEQ ID NO: 1857996 - protein, 12 aa, Staphylococcus
LPGVEKDLAKAD

SEQ ID NO: 1857997 - protein, 7 aa, Staphylococcus
LPGYTAQ

SEQ ID NO: 1857998 - protein, 11 aa, Staphylococcus
LPHSEGDIIPP

SEQ ID NO: 1857999 - protein, 10 aa, Staphylococcus
LPKAGEAAKK

SEQ ID NO: 1858000 - protein, 8 aa, Staphylococcus
LPKASAQQ

SEQ ID NO: 1858001 - protein, 21 aa, Staphylococcus
LPKGDKGDKGDTGADGQSITV

SEQ ID NO: 1858002 - protein, 31 aa, Staphylococcus
LPKGKDGVDGKSVTVQNTETTPEGNTKVTFS

SEQ ID NO: 1858003 - protein, 8 aa, Staphylococcus
LPLGDKQV

SEQ ID NO: 1858004 - protein, 8 aa, Staphylococcus
LPLGDQEV

SEQ ID NO: 1858005 - protein, 9 aa, Staphylococcus
LPLGNKSVP

SEQ ID NO: 1858006 - protein, 18 aa, Staphylococcus
LPLSDSAKIAKSLGTRHR

SEQ ID NO: 1858007 - protein, 22 aa, Staphylococcus
LPNGVSYNSDTQEISGKPTQVG

SEQ ID NO: 1858008 - protein, 7 aa, Staphylococcus
LPNKDDI

SEQ ID NO: 1858009 - protein, 6 aa, Staphylococcus
LPNKDS

SEQ ID NO: 1858010 - protein, 6 aa, Staphylococcus
LPNNPY

SEQ ID NO: 1858011 - protein, 13 aa, Staphylococcus
LPPADTGESIGLG

SEQ ID NO: 1858012 - protein, 6 aa, Staphylococcus
LPPNNA

SEQ ID NO: 1858013 - protein, 8 aa, Staphylococcus
LPQEGGPQ

SEQ ID NO: 1858014 - protein, 17 aa, Staphylococcus
LPQGSAYSLKGDNTYQS

SEQ ID NO: 1858015 - protein, 5 aa, Staphylococcus
LPQTG

SEQ ID NO: 1858016 - protein, 5 aa, Staphylococcus
LPQVQ

SEQ ID NO: 1858017 - protein, 4 aa, Staphylococcus
LPRP

SEQ ID NO: 1858018 - protein, 11 aa, Staphylococcus
LPRQEKDNKMY

SEQ ID NO: 1858019 - protein, 20 aa, Staphylococcus
LPSETLDTKNTDRTGYDERQ

SEQ ID NO: 1858020 - protein, 9 aa, Staphylococcus
LPSGQEGDY

SEQ ID NO: 1858021 - protein, 4 aa, Staphylococcus
LPSL

SEQ ID NO: 1858022 - protein, 4 aa, Staphylococcus
LPSN

SEQ ID NO: 1858023 - protein, 7 aa, Staphylococcus
LPSSIEQ

SEQ ID NO: 1858024 - protein, 11 aa, Staphylococcus
LPSTSNKELTF

SEQ ID NO: 1858025 - protein, 7 aa, Staphylococcus
LPTGRAT

SEQ ID NO: 1858026 - protein, 31 aa, Staphylococcus
LPTRTTKINKNNRSTRSVNKDRASSKSNSAY

SEQ ID NO: 1858027 - protein, 8 aa, Staphylococcus
LPTSEEGS

SEQ ID NO: 1858028 - protein, 10 aa, Staphylococcus
LPTSEPIKKD

SEQ ID NO: 1858029 - protein, 55 aa, Staphylococcus
LPTSYDDSASGEASGAQAGAGSQGDEGQEGGSAAQASNPTVNNPSGGKEGDTSKY

SEQ ID NO: 1858030 - protein, 12 aa, Staphylococcus
LPTTENKNLTFS

SEQ ID NO: 1858031 - protein, 11 aa, Staphylococcus
LPTTKNQELTF

SEQ ID NO: 1858032 - protein, 4 aa, Staphylococcus
LPVG

SEQ ID NO: 1858033 - protein, 19 aa, Staphylococcus
LPVGQQEVQREGQVGKRGT

SEQ ID NO: 1858034 - protein, 15 aa, Staphylococcus
LPYGRSGWGPSGHRR

SEQ ID NO: 1858035 - protein, 4 aa, Staphylococcus
LPYI

SEQ ID NO: 1858036 - protein, 10 aa, Staphylococcus
LQAAKDEINT

SEQ ID NO: 1858037 - protein, 4 aa, Staphylococcus
LQAK

SEQ ID NO: 1858038 - protein, 12 aa, Staphylococcus
LQASDDKATQQT

SEQ ID NO: 1858039 - protein, 14 aa, Staphylococcus
LQDAMNKAKKDIKQ

SEQ ID NO: 1858040 - protein, 10 aa, Staphylococcus
LQDGGNAVDA

SEQ ID NO: 1858041 - protein, 15 aa, Staphylococcus
LQDMTKDIDKKDNVD

SEQ ID NO: 1858042 - protein, 6 aa, Staphylococcus
LQEGDH

SEQ ID NO: 1858043 - protein, 10 aa, Staphylococcus
LQGARNNTIT

SEQ ID NO: 1858044 - protein, 10 aa, Staphylococcus
LQGARNSTIT

SEQ ID NO: 1858045 - protein, 16 aa, Staphylococcus
LQGDGDADNLKVVKYS

SEQ ID NO: 1858046 - protein, 6 aa, Staphylococcus
LQGSQI

SEQ ID NO: 1858047 - protein, 6 aa, Staphylococcus
LQHEDG

SEQ ID NO: 1858048 - protein, 19 aa, Staphylococcus
LQIETTNQAPFDAEIGASA

SEQ ID NO: 1858049 - protein, 6 aa, Staphylococcus
LQKGSN

SEQ ID NO: 1858050 - protein, 4 aa, Staphylococcus
LQKR

SEQ ID NO: 1858051 - protein, 37 aa, Staphylococcus
LQKTTTPSKLTQEDGDYATTVTGKVSDKDVGGKSREV

SEQ ID NO: 1858052 - protein, 9 aa, Staphylococcus
LQNESQLVQ

SEQ ID NO: 1858053 - protein, 12 aa, Staphylococcus
LQNQAQNKNITI

SEQ ID NO: 1858054 - protein, 11 aa, Staphylococcus
LQNRADNSQLV

SEQ ID NO: 1858055 - protein, 16 aa, Staphylococcus
LQNRGQQISEELSSDK

SEQ ID NO: 1858056 - protein, 16 aa, Staphylococcus
LQPEQIESEASIRKPL

SEQ ID NO: 1858057 - protein, 21 aa, Staphylococcus
LQPGDAFTGAGSSSENSAQYF

SEQ ID NO: 1858058 - protein, 9 aa, Staphylococcus
LQPKIEPIQ

SEQ ID NO: 1858059 - protein, 6 aa, Staphylococcus
LQPTAQ

SEQ ID NO: 1858060 - protein, 7 aa, Staphylococcus
LQQKYDN

SEQ ID NO: 1858061 - protein, 7 aa, Staphylococcus
LQQKYNN

SEQ ID NO: 1858062 - protein, 7 aa, Staphylococcus
LQQKYNQ

SEQ ID NO: 1858063 - protein, 21 aa, Staphylococcus
LQQNHRQSHIETYSNNDNMRS

SEQ ID NO: 1858064 - protein, 7 aa, Staphylococcus
LQQRNNL

SEQ ID NO: 1858065 - protein, 7 aa, Staphylococcus
LQQSSGP

SEQ ID NO: 1858066 - protein, 26 aa, Staphylococcus
LQSASEALHGEQKLQESKDQANSQID

SEQ ID NO: 1858067 - protein, 20 aa, Staphylococcus
LQSDQTNQQVDQTETQSIED

SEQ ID NO: 1858068 - protein, 12 aa, Staphylococcus
LQSIKDKLNQLF

SEQ ID NO: 1858069 - protein, 5 aa, Staphylococcus
LQSLS

SEQ ID NO: 1858070 - protein, 13 aa, Staphylococcus
LQSSSKPAQSEKG

SEQ ID NO: 1858071 - protein, 37 aa, Staphylococcus
LQSVTTETTGITSSETTNKETLDKRTKETKEHVQSTL

SEQ ID NO: 1858072 - protein, 7 aa, Staphylococcus
LQTGEGM

SEQ ID NO: 1858073 - protein, 5 aa, Staphylococcus
LQYNA

SEQ ID NO: 1858074 - protein, 11 aa, Staphylococcus
LRATDKQKRIG

SEQ ID NO: 1858075 - protein, 26 aa, Staphylococcus
LRDDHNVQTELTGNGMQTNEVGGSSE

SEQ ID NO: 1858076 - protein, 15 aa, Staphylococcus
LRDGEIDEAEHSSSE

SEQ ID NO: 1858077 - protein, 7 aa, Staphylococcus
LRDGQIY

SEQ ID NO: 1858078 - protein, 12 aa, Staphylococcus
LRDRLSEKRDLY

SEQ ID NO: 1858079 - protein, 13 aa, Staphylococcus
LREGEVEEAEHSL

SEQ ID NO: 1858080 - protein, 5 aa, Staphylococcus
LRESV

SEQ ID NO: 1858081 - protein, 15 aa, Staphylococcus
LRGKNEGKSNDPEFK

SEQ ID NO: 1858082 - protein, 8 aa, Staphylococcus
LRGTPAQG

SEQ ID NO: 1858083 - protein, 6 aa, Staphylococcus
LRGTTT

SEQ ID NO: 1858084 - protein, 7 aa, Staphylococcus
LRHGGAN

SEQ ID NO: 1858085 - protein, 8 aa, Staphylococcus
LRHPEDQN

SEQ ID NO: 1858086 - protein, 4 aa, Staphylococcus
LRKD

SEQ ID NO: 1858087 - protein, 10 aa, Staphylococcus
LRKDPQRADI

SEQ ID NO: 1858088 - protein, 5 aa, Staphylococcus
LRKDQ

SEQ ID NO: 1858089 - protein, 5 aa, Staphylococcus
LRKGL

SEQ ID NO: 1858090 - protein, 9 aa, Staphylococcus
LRKHPQKAD

SEQ ID NO: 1858091 - protein, 11 aa, Staphylococcus
LRKKPQKADIE

SEQ ID NO: 1858092 - protein, 11 aa, Staphylococcus
LRKNPQQADVE

SEQ ID NO: 1858093 - protein, 9 aa, Staphylococcus
LRKPKPKFA

SEQ ID NO: 1858094 - protein, 7 aa, Staphylococcus
LRNESHP

SEQ ID NO: 1858095 - protein, 5 aa, Staphylococcus
LRNGG

SEQ ID NO: 1858096 - protein, 28 aa, Staphylococcus
LRNQAKSVSKGDYSQISSVTTKDEIGEL

SEQ ID NO: 1858097 - protein, 16 aa, Staphylococcus
LRNQTNKRKKKRNGNT

SEQ ID NO: 1858098 - protein, 16 aa, Staphylococcus
LRNSELDEAERSSTDI

SEQ ID NO: 1858099 - protein, 5 aa, Staphylococcus
LRPGE

SEQ ID NO: 1858100 - protein, 6 aa, Staphylococcus
LRPGEK

SEQ ID NO: 1858101 - protein, 12 aa, Staphylococcus
LRPGERNKNDLG

SEQ ID NO: 1858102 - protein, 5 aa, Staphylococcus
LRQDA

SEQ ID NO: 1858103 - protein, 4 aa, Staphylococcus
LRQK

SEQ ID NO: 1858104 - protein, 12 aa, Staphylococcus
LRQTDGEDPRDQ

SEQ ID NO: 1858105 - protein, 7 aa, Staphylococcus
LRRDVSD

SEQ ID NO: 1858106 - protein, 16 aa, Staphylococcus
LRSDNESDQELNDTNT

SEQ ID NO: 1858107 - protein, 8 aa, Staphylococcus
LRSDNNAQ

SEQ ID NO: 1858108 - protein, 8 aa, Staphylococcus
LRSGKTNI

SEQ ID NO: 1858109 - protein, 8 aa, Staphylococcus
LRSHPNSA

SEQ ID NO: 1858110 - protein, 12 aa, Staphylococcus
LRSQDKSKSLGT

SEQ ID NO: 1858111 - protein, 15 aa, Staphylococcus
LRSRTNATDANIHES

SEQ ID NO: 1858112 - protein, 5 aa, Staphylococcus
LRTEA

SEQ ID NO: 1858113 - protein, 12 aa, Staphylococcus
LRYHKNKEDEWK

SEQ ID NO: 1858114 - protein, 5 aa, Staphylococcus
LRYND

SEQ ID NO: 1858115 - protein, 12 aa, Staphylococcus
LSAATPNENQTM

SEQ ID NO: 1858116 - protein, 9 aa, Staphylococcus
LSADASKEL

SEQ ID NO: 1858117 - protein, 9 aa, Staphylococcus
LSAHAAPRE

SEQ ID NO: 1858118 - protein, 10 aa, Staphylococcus
LSAHSAPREI

SEQ ID NO: 1858119 - protein, 20 aa, Staphylococcus
LSAKPEAFSIQSDNDVSSIV

SEQ ID NO: 1858120 - protein, 18 aa, Staphylococcus
LSAPTESKNGKPQLTANG

SEQ ID NO: 1858121 - protein, 15 aa, Staphylococcus
LSATPKMASKSSIRE

SEQ ID NO: 1858122 - protein, 8 aa, Staphylococcus
LSDDFSDG

SEQ ID NO: 1858123 - protein, 12 aa, Staphylococcus
LSDDNGKKLEHD

SEQ ID NO: 1858124 - protein, 5 aa, Staphylococcus
LSDEG

SEQ ID NO: 1858125 - protein, 4 aa, Staphylococcus
LSDK

SEQ ID NO: 1858126 - protein, 8 aa, Staphylococcus
LSDKDSGL

SEQ ID NO: 1858127 - protein, 6 aa, Staphylococcus
LSDKLG

SEQ ID NO: 1858128 - protein, 10 aa, Staphylococcus
LSDKRNLPDN

SEQ ID NO: 1858129 - protein, 13 aa, Staphylococcus
LSDLSSDKITYEQ

SEQ ID NO: 1858130 - protein, 10 aa, Staphylococcus
LSDMPGVNTT

SEQ ID NO: 1858131 - protein, 4 aa, Staphylococcus
LSDN

SEQ ID NO: 1858132 - protein, 8 aa, Staphylococcus
LSDNGSFD

SEQ ID NO: 1858133 - protein, 10 aa, Staphylococcus
LSDPGEQLKG

SEQ ID NO: 1858134 - protein, 11 aa, Staphylococcus
LSDPKEELSGN

SEQ ID NO: 1858135 - protein, 11 aa, Staphylococcus
LSDPKEQLKGN

SEQ ID NO: 1858136 - protein, 4 aa, Staphylococcus
LSDQ

SEQ ID NO: 1858137 - protein, 11 aa, Staphylococcus
LSDQRNLSNDI

SEQ ID NO: 1858138 - protein, 5 aa, Staphylococcus
LSDSK

SEQ ID NO: 1858139 - protein, 96 aa, Staphylococcus
LSEAHSNSQSASASSSASDSEANSASTSDSLSISTAASESRSASLSDSMEVSTSESTSTSEATSDSLSTSTAASESRSISLSSSISTSTSSSEEVS

SEQ ID NO: 1858140 - protein, 16 aa, Staphylococcus
LSEDAKSSSNMEETIP

SEQ ID NO: 1858141 - protein, 16 aa, Staphylococcus
LSEDEKSSTNMEDTIG

SEQ ID NO: 1858142 - protein, 17 aa, Staphylococcus
LSEDESGSKDMDTSIPS

SEQ ID NO: 1858143 - protein, 17 aa, Staphylococcus
LSEDESSSSDMDSTIPS

SEQ ID NO: 1858144 - protein, 17 aa, Staphylococcus
LSEDESSSSDMETTIPS

SEQ ID NO: 1858145 - protein, 12 aa, Staphylococcus
LSEEKSFDLKSS

SEQ ID NO: 1858146 - protein, 11 aa, Staphylococcus
LSEGDSRASAM

SEQ ID NO: 1858147 - protein, 20 aa, Staphylococcus
LSEGDYSQVNDINSKDEIGE

SEQ ID NO: 1858148 - protein, 10 aa, Staphylococcus
LSEKNKDIDY

SEQ ID NO: 1858149 - protein, 12 aa, Staphylococcus
LSEKRDTISRNN

SEQ ID NO: 1858150 - protein, 6 aa, Staphylococcus
LSELAG

SEQ ID NO: 1858151 - protein, 1427 aa, Staphylococcus
LSESESTSQSLSLSTSESLSQSLSLSASESLSESESLSESESLSESESLSASESLSESESLSESESLSASESLSTSESLSASESLSESESLSESESLSESESLSESESLSTSESLSASESLSESESLSESESLSASESLSDSESLSASESLSASESLSASESLSASESLSASESLSESESLSDSESLSESESLSESESLSTSESLSASESISASESLSTSESLSTSESLSESESLSESESLSEYESLSASESLSASESLSTSESLSESASLSESESLSTSESLSASESISASESLSASESLSESESLSTSESLSTSESLSESESLSESESLSSSESLSSSESLSESESLSTSESISESESLSTSESLSASESLSESESLSASESISESESLSASESLSEYESLSTSESLSSSESLSESESLSASESLSESESLSASESISESESLSESESLSTSESLSASESLSESESLSESESLSESESLSESESLSASESLSESESLSESESLSARESLSQSEALSESESLSTSESLSESESLSASESISESEYLSESESLSASESLSESESISASESLSESESLSESESLSESESLSTSESLSASESLSESESLSESESLSESESLSESESLSESESLSDSESLSESESLSESESLSESESLSDSESLSESESLSESESLSESESLSESESLSESELLSESESLSESESISESESISASESLSESESLSESESLSESESLSESESLSESESLSESESLSESESLSASESISASESLSESESLSESESLSESESLSESESLSTSESLSESESLSTSESISESESLSESESLSESESLSESESLSKSESLSESESLSESESLSTSESLSESESLSASESISESESLSESESLSESESLSTSESLRQSESLSQSLSLSASESLSASESISESESLSESESLSASESLSESESLSASESLSESESLSESESLSGSESLSASESLSESESLSESESLSESESLSESESLSGSESLSASESISESESISASESLSESESISASESISESESLSTSESLSTSESLSESESLSASESLSESESLSESESLSESESLSESESLSASESLSASESLSESESLSESESLSESESLSESESLSESESISESESLSESESLSESESLSESESISDSESISESESLSESESLSESESISESESLSESESLSESESLSESESISDSESLSESESLSESESLSESESLSESESLSESESLSASESLSASESLSASESLSESESLSDSESLSESESLSESESLSASESLSASESLSESESLSESESISDSESLSTSESLSESESLSESESLSGSESLSASESLSASESLSASESLSASESISESESLSESESLSESESLSDSESLSESESLSTSESLSASESLSESESLNTSESMSESESLGASESISEYE

SEQ ID NO: 1858152 - protein, 22 aa, Staphylococcus
LSESTSESIEASASNSESMAAS

SEQ ID NO: 1858153 - protein, 8 aa, Staphylococcus
LSESYEGV

SEQ ID NO: 1858154 - protein, 9 aa, Staphylococcus
LSETTMTQT

SEQ ID NO: 1858155 - protein, 6 aa, Staphylococcus
LSEVGS

SEQ ID NO: 1858156 - protein, 6 aa, Staphylococcus
LSEVPD

SEQ ID NO: 1858157 - protein, 9 aa, Staphylococcus
LSGAKKNKV

SEQ ID NO: 1858158 - protein, 41 aa, Staphylococcus
LSGAPLGETIKHKSKDYRANAEAQAQANKSEFQSKQKRGKF

SEQ ID NO: 1858159 - protein, 4 aa, Staphylococcus
LSGG

SEQ ID NO: 1858160 - protein, 5 aa, Staphylococcus
LSGGE

SEQ ID NO: 1858161 - protein, 9 aa, Staphylococcus
LSGHAAPRE

SEQ ID NO: 1858162 - protein, 6 aa, Staphylococcus
LSGIEK

SEQ ID NO: 1858163 - protein, 6 aa, Staphylococcus
LSGNKY

SEQ ID NO: 1858164 - protein, 9 aa, Staphylococcus
LSGNSTFKT

SEQ ID NO: 1858165 - protein, 11 aa, Staphylococcus
LSGPISDKLGR

SEQ ID NO: 1858166 - protein, 7 aa, Staphylococcus
LSGSAGN

SEQ ID NO: 1858167 - protein, 7 aa, Staphylococcus
LSGSHGL

SEQ ID NO: 1858168 - protein, 9 aa, Staphylococcus
LSGSTKAMT

SEQ ID NO: 1858169 - protein, 9 aa, Staphylococcus
LSGTQLSPL

SEQ ID NO: 1858170 - protein, 7 aa, Staphylococcus
LSGTTSA

SEQ ID NO: 1858171 - protein, 7 aa, Staphylococcus
LSGYQGG

SEQ ID NO: 1858172 - protein, 4 aa, Staphylococcus
LSHP

SEQ ID NO: 1858173 - protein, 23 aa, Staphylococcus
LSHSEIQTTVNGETTMQSAETSS

SEQ ID NO: 1858174 - protein, 13 aa, Staphylococcus
LSIDGKYEAESDF

SEQ ID NO: 1858175 - protein, 20 aa, Staphylococcus
LSISTSLSNSYSGSTSVSGV

SEQ ID NO: 1858176 - protein, 26 aa, Staphylococcus
LSKDEVSKIQDTVDQSFGNKPTVNTV

SEQ ID NO: 1858177 - protein, 41 aa, Staphylococcus
LSKDKQSNQELHNTNTSLPNEADGMKDVDGLKTGTSDNGYN

SEQ ID NO: 1858178 - protein, 23 aa, Staphylococcus
LSKEDIKDYQTRIDRAKDDSKID

SEQ ID NO: 1858179 - protein, 9 aa, Staphylococcus
LSKGSGINV

SEQ ID NO: 1858180 - protein, 12 aa, Staphylococcus
LSKGTHKINGKK

SEQ ID NO: 1858181 - protein, 11 aa, Staphylococcus
LSKKDKNRIND

SEQ ID NO: 1858182 - protein, 5 aa, Staphylococcus
LSKNE

SEQ ID NO: 1858183 - protein, 8 aa, Staphylococcus
LSKPNQGI

SEQ ID NO: 1858184 - protein, 8 aa, Staphylococcus
LSKPSNAE

SEQ ID NO: 1858185 - protein, 8 aa, Staphylococcus
LSKQQDYQ

SEQ ID NO: 1858186 - protein, 12 aa, Staphylococcus
LSKSEQEKVNDI

SEQ ID NO: 1858187 - protein, 19 aa, Staphylococcus
LSKSPKKSKEEKQKLEQTR

SEQ ID NO: 1858188 - protein, 10 aa, Staphylococcus
LSKTNGSSVP

SEQ ID NO: 1858189 - protein, 10 aa, Staphylococcus
LSKTNSNGVP

SEQ ID NO: 1858190 - protein, 25 aa, Staphylococcus
LSLPAQADGLAGADGLKTGTSNHGY

SEQ ID NO: 1858191 - protein, 47 aa, Staphylococcus
LSMSDSSSASTSDQLSNSLSASASLSDVDSTSLNDYQSASASISTSY

SEQ ID NO: 1858192 - protein, 5 aa, Staphylococcus
LSMSE

SEQ ID NO: 1858193 - protein, 4 aa, Staphylococcus
LSNG

SEQ ID NO: 1858194 - protein, 7 aa, Staphylococcus
LSNGSPL

SEQ ID NO: 1858195 - protein, 11 aa, Staphylococcus
LSNGSSGQSEA

SEQ ID NO: 1858196 - protein, 15 aa, Staphylococcus
LSNGTDETKRFSKEE

SEQ ID NO: 1858197 - protein, 14 aa, Staphylococcus
LSNKRGCLKLEKHK

SEQ ID NO: 1858198 - protein, 10 aa, Staphylococcus
LSNLNDSDYV

SEQ ID NO: 1858199 - protein, 9 aa, Staphylococcus
LSNLNNKDY

SEQ ID NO: 1858200 - protein, 9 aa, Staphylococcus
LSNNKELSI

SEQ ID NO: 1858201 - protein, 10 aa, Staphylococcus
LSNPFGSDGG

SEQ ID NO: 1858202 - protein, 8 aa, Staphylococcus
LSNQKDEN

SEQ ID NO: 1858203 - protein, 12 aa, Staphylococcus
LSNRGAKQENYQ

SEQ ID NO: 1858204 - protein, 14 aa, Staphylococcus
LSNSSNNDQLPNGQ

SEQ ID NO: 1858205 - protein, 9 aa, Staphylococcus
LSNTTNNEY

SEQ ID NO: 1858206 - protein, 33 aa, Staphylococcus
LSPDKSSISEQGATFEVTKDGQRLTDTYTTTAG

SEQ ID NO: 1858207 - protein, 22 aa, Staphylococcus
LSPEEAKKAAQRLTNAKLSNKA

SEQ ID NO: 1858208 - protein, 17 aa, Staphylococcus
LSPEQAKGEPTDESTDI

SEQ ID NO: 1858209 - protein, 17 aa, Staphylococcus
LSPEQAKGESTDEGTDI

SEQ ID NO: 1858210 - protein, 21 aa, Staphylococcus
LSPEQSVDQISDALKKEDHRQ

SEQ ID NO: 1858211 - protein, 4 aa, Staphylococcus
LSPH

SEQ ID NO: 1858212 - protein, 10 aa, Staphylococcus
LSPISKDETV

SEQ ID NO: 1858213 - protein, 7 aa, Staphylococcus
LSPKETT

SEQ ID NO: 1858214 - protein, 4 aa, Staphylococcus
LSPL

SEQ ID NO: 1858215 - protein, 9 aa, Staphylococcus
LSPLSDTTN

SEQ ID NO: 1858216 - protein, 6 aa, Staphylococcus
LSPNGG

SEQ ID NO: 1858217 - protein, 5 aa, Staphylococcus
LSPNL

SEQ ID NO: 1858218 - protein, 4 aa, Staphylococcus
LSPQ

SEQ ID NO: 1858219 - protein, 6 aa, Staphylococcus
LSPQDI

SEQ ID NO: 1858220 - protein, 7 aa, Staphylococcus
LSPQTDN

SEQ ID NO: 1858221 - protein, 8 aa, Staphylococcus
LSPQTDNL

SEQ ID NO: 1858222 - protein, 8 aa, Staphylococcus
LSPSETSI

SEQ ID NO: 1858223 - protein, 7 aa, Staphylococcus
LSPSGEH

SEQ ID NO: 1858224 - protein, 4 aa, Staphylococcus
LSPT

SEQ ID NO: 1858225 - protein, 6 aa, Staphylococcus
LSPTGN

SEQ ID NO: 1858226 - protein, 13 aa, Staphylococcus
LSQAGQKASDSAV

SEQ ID NO: 1858227 - protein, 6 aa, Staphylococcus
LSQESL

SEQ ID NO: 1858228 - protein, 19 aa, Staphylococcus
LSQGELKQLQSQSKVTSEV

SEQ ID NO: 1858229 - protein, 7 aa, Staphylococcus
LSQGTPQ

SEQ ID NO: 1858230 - protein, 8 aa, Staphylococcus
LSQGTPQL

SEQ ID NO: 1858231 - protein, 11 aa, Staphylococcus
LSQIDSEDNVD

SEQ ID NO: 1858232 - protein, 5 aa, Staphylococcus
LSQIR

SEQ ID NO: 1858233 - protein, 4 aa, Staphylococcus
LSQL

SEQ ID NO: 1858234 - protein, 10 aa, Staphylococcus
LSQLPSQDSG

SEQ ID NO: 1858235 - protein, 16 aa, Staphylococcus
LSQNKGYLNRMIHINK

SEQ ID NO: 1858236 - protein, 63 aa, Staphylococcus
LSQPASTSSNASAQTFSAQAAPVDATAQAAPAGTNVNDQVTASNYKLSTKTVDANDSGSTDMS

SEQ ID NO: 1858237 - protein, 16 aa, Staphylococcus
LSQPEQFQQPKNTNIT

SEQ ID NO: 1858238 - protein, 12 aa, Staphylococcus
LSQQEEKQINDI

SEQ ID NO: 1858239 - protein, 5 aa, Staphylococcus
LSQQS

SEQ ID NO: 1858240 - protein, 25 aa, Staphylococcus
LSRAEDNKLSDKIKSEFGDTPQINS

SEQ ID NO: 1858241 - protein, 6 aa, Staphylococcus
LSRENA

SEQ ID NO: 1858242 - protein, 20 aa, Staphylococcus
LSREQPADLKSQPPMSAKEA

SEQ ID NO: 1858243 - protein, 16 aa, Staphylococcus
LSRKISNNQLTIDEAK

SEQ ID NO: 1858244 - protein, 17 aa, Staphylococcus
LSRKISSNKLDIDQAKS

SEQ ID NO: 1858245 - protein, 16 aa, Staphylococcus
LSRKISSNQLTIDEAK

SEQ ID NO: 1858246 - protein, 9 aa, Staphylococcus
LSRTLEDSG

SEQ ID NO: 1858247 - protein, 5 aa, Staphylococcus
LSSAS

SEQ ID NO: 1858248 - protein, 6 aa, Staphylococcus
LSSASI

SEQ ID NO: 1858249 - protein, 11 aa, Staphylococcus
LSSEKTYRRKA

SEQ ID NO: 1858250 - protein, 9 aa, Staphylococcus
LSSENPPAS

SEQ ID NO: 1858251 - protein, 12 aa, Staphylococcus
LSSGGKGSAESI

SEQ ID NO: 1858252 - protein, 9 aa, Staphylococcus
LSSGKEDYT

SEQ ID NO: 1858253 - protein, 8 aa, Staphylococcus
LSSGNDEF

SEQ ID NO: 1858254 - protein, 4 aa, Staphylococcus
LSSK

SEQ ID NO: 1858255 - protein, 21 aa, Staphylococcus
LSSKDGFKFTEEEAQYAVDHL

SEQ ID NO: 1858256 - protein, 9 aa, Staphylococcus
LSSKIPKDF

SEQ ID NO: 1858257 - protein, 10 aa, Staphylococcus
LSSKKKRTMI

SEQ ID NO: 1858258 - protein, 11 aa, Staphylococcus
LSSKKTYSRKA

SEQ ID NO: 1858259 - protein, 9 aa, Staphylococcus
LSSNNDVGH

SEQ ID NO: 1858260 - protein, 19 aa, Staphylococcus
LSSNNEISPHSKRNAKREL

SEQ ID NO: 1858261 - protein, 13 aa, Staphylococcus
LSSNSRKRSMEDD

SEQ ID NO: 1858262 - protein, 8 aa, Staphylococcus
LSSQTNYN

SEQ ID NO: 1858263 - protein, 4 aa, Staphylococcus
LSSS

SEQ ID NO: 1858264 - protein, 9 aa, Staphylococcus
LSSSDKNGV

SEQ ID NO: 1858265 - protein, 7 aa, Staphylococcus
LSSSDPM

SEQ ID NO: 1858266 - protein, 12 aa, Staphylococcus
LSSSKKKQTIKD

SEQ ID NO: 1858267 - protein, 9 aa, Staphylococcus
LSSSKNIRD

SEQ ID NO: 1858268 - protein, 9 aa, Staphylococcus
LSSSKSIRD

SEQ ID NO: 1858269 - protein, 4 aa, Staphylococcus
LSST

SEQ ID NO: 1858270 - protein, 4 aa, Staphylococcus
LSSV

SEQ ID NO: 1858271 - protein, 4 aa, Staphylococcus
LSTA

SEQ ID NO: 1858272 - protein, 10 aa, Staphylococcus
LSTAGGNTEI

SEQ ID NO: 1858273 - protein, 27 aa, Staphylococcus
LSTDSSQDTVNDNQIVSNNDVKSMNSA

SEQ ID NO: 1858274 - protein, 9 aa, Staphylococcus
LSTESNVKN

SEQ ID NO: 1858275 - protein, 8 aa, Staphylococcus
LSTGNDDF

SEQ ID NO: 1858276 - protein, 8 aa, Staphylococcus
LSTGNEDF

SEQ ID NO: 1858277 - protein, 8 aa, Staphylococcus
LSTGQSRF

SEQ ID NO: 1858278 - protein, 12 aa, Staphylococcus
LSTGSSASSNHE

SEQ ID NO: 1858279 - protein, 9 aa, Staphylococcus
LSTQKNIRD

SEQ ID NO: 1858280 - protein, 9 aa, Staphylococcus
LSTSKNIRD

SEQ ID NO: 1858281 - protein, 7 aa, Staphylococcus
LSTTTKL

SEQ ID NO: 1858282 - protein, 4 aa, Staphylococcus
LSTV

SEQ ID NO: 1858283 - protein, 4 aa, Staphylococcus
LSYH

SEQ ID NO: 1858284 - protein, 49 aa, Staphylococcus
LSYSNSKEYGPYPKNKDITVSAEGSAKDKTFESETKTIKASKLKDNTTI

SEQ ID NO: 1858285 - protein, 8 aa, Staphylococcus
LTADGINV

SEQ ID NO: 1858286 - protein, 8 aa, Staphylococcus
LTAKGIQI

SEQ ID NO: 1858287 - protein, 7 aa, Staphylococcus
LTAKPGE

SEQ ID NO: 1858288 - protein, 16 aa, Staphylococcus
LTASLQEQLKNNQDLN

SEQ ID NO: 1858289 - protein, 8 aa, Staphylococcus
LTDAQREK

SEQ ID NO: 1858290 - protein, 12 aa, Staphylococcus
LTDAQRTKEKEL

SEQ ID NO: 1858291 - protein, 10 aa, Staphylococcus
LTDEDIQNAT

SEQ ID NO: 1858292 - protein, 30 aa, Staphylococcus
LTDEEDISDDKFNNDRNNKNSLPYEQNPNQ

SEQ ID NO: 1858293 - protein, 7 aa, Staphylococcus
LTDEEKK

SEQ ID NO: 1858294 - protein, 13 aa, Staphylococcus
LTDEKYKSYNYKS

SEQ ID NO: 1858295 - protein, 10 aa, Staphylococcus
LTDFPKNDLP

SEQ ID NO: 1858296 - protein, 12 aa, Staphylococcus
LTDKTPSSVTRY

SEQ ID NO: 1858297 - protein, 5 aa, Staphylococcus
LTDPD

SEQ ID NO: 1858298 - protein, 10 aa, Staphylococcus
LTDQQKDAFN

SEQ ID NO: 1858299 - protein, 8 aa, Staphylococcus
LTDQQKEA

SEQ ID NO: 1858300 - protein, 5 aa, Staphylococcus
LTDSA

SEQ ID NO: 1858301 - protein, 7 aa, Staphylococcus
LTDSNID

SEQ ID NO: 1858302 - protein, 4 aa, Staphylococcus
LTDY

SEQ ID NO: 1858303 - protein, 4 aa, Staphylococcus
LTEN

SEQ ID NO: 1858304 - protein, 13 aa, Staphylococcus
LTENEIEASKAMD

SEQ ID NO: 1858305 - protein, 5 aa, Staphylococcus
LTEPE

SEQ ID NO: 1858306 - protein, 16 aa, Staphylococcus
LTEPKAESRTGHKTDK

SEQ ID NO: 1858307 - protein, 9 aa, Staphylococcus
LTEQSARSV

SEQ ID NO: 1858308 - protein, 4 aa, Staphylococcus
LTES

SEQ ID NO: 1858309 - protein, 13 aa, Staphylococcus
LTETVQKKTEAST

SEQ ID NO: 1858310 - protein, 83 aa, Staphylococcus
LTGDQESDDGEDSDNPGNTNGESNDDDTTPNPPSENDGSNTDHDVDNGEQPDNGDDTSNNDEDNHSSDDTNGNDEGLEPPYEV

SEQ ID NO: 1858311 - protein, 9 aa, Staphylococcus
LTGENMSNF

SEQ ID NO: 1858312 - protein, 20 aa, Staphylococcus
LTGEQQVGGTAHIETTAPNM

SEQ ID NO: 1858313 - protein, 22 aa, Staphylococcus
LTGETKSTYDRLKQSSLDSKNQ

SEQ ID NO: 1858314 - protein, 4 aa, Staphylococcus
LTGF

SEQ ID NO: 1858315 - protein, 7 aa, Staphylococcus
LTGGAGA

SEQ ID NO: 1858316 - protein, 7 aa, Staphylococcus
LTGGASA

SEQ ID NO: 1858317 - protein, 5 aa, Staphylococcus
LTGGG

SEQ ID NO: 1858318 - protein, 6 aa, Staphylococcus
LTGGKN

SEQ ID NO: 1858319 - protein, 7 aa, Staphylococcus
LTGKETI

SEQ ID NO: 1858320 - protein, 23 aa, Staphylococcus
LTGNGSNPINSKTVQQTIKGKKI

SEQ ID NO: 1858321 - protein, 19 aa, Staphylococcus
LTGQTSHPYKREESQSYPE

SEQ ID NO: 1858322 - protein, 4 aa, Staphylococcus
LTGS

SEQ ID NO: 1858323 - protein, 9 aa, Staphylococcus
LTGSAETVQ

SEQ ID NO: 1858324 - protein, 6 aa, Staphylococcus
LTGSRS

SEQ ID NO: 1858325 - protein, 5 aa, Staphylococcus
LTGSS

SEQ ID NO: 1858326 - protein, 36 aa, Staphylococcus
LTIRDADDKVKLSGADIKQGSAKQEFKQNTNDPTVT

SEQ ID NO: 1858327 - protein, 12 aa, Staphylococcus
LTIRDSDDHVKL

SEQ ID NO: 1858328 - protein, 7 aa, Staphylococcus
LTKDGNT

SEQ ID NO: 1858329 - protein, 17 aa, Staphylococcus
LTKENKQLSVPNDDTIE

SEQ ID NO: 1858330 - protein, 59 aa, Staphylococcus
LTKQELGEEEPELSRTNKGSVTNQTKETWKTLQDKTTEFTRKTRRSVDIQKARDKKDKF

SEQ ID NO: 1858331 - protein, 85 aa, Staphylococcus
LTKSQKDSSEDENSNENQSNENDNSNSETNNAEDYNNQQQTDQFGNEQNNVNQPQNDSNQQQNDPNQQQIDPNQQQNAQEVPTNQ

SEQ ID NO: 1858332 - protein, 8 aa, Staphylococcus
LTKSVTRT

SEQ ID NO: 1858333 - protein, 6 aa, Staphylococcus
LTNDTE

SEQ ID NO: 1858334 - protein, 7 aa, Staphylococcus
LTNDTET

SEQ ID NO: 1858335 - protein, 12 aa, Staphylococcus
LTNEKTYDRKAN

SEQ ID NO: 1858336 - protein, 7 aa, Staphylococcus
LTNEQKA

SEQ ID NO: 1858337 - protein, 4 aa, Staphylococcus
LTNG

SEQ ID NO: 1858338 - protein, 8 aa, Staphylococcus
LTNGQHGK

SEQ ID NO: 1858339 - protein, 10 aa, Staphylococcus
LTNKGARQEN

SEQ ID NO: 1858340 - protein, 13 aa, Staphylococcus
LTNKKHKDTLEND

SEQ ID NO: 1858341 - protein, 13 aa, Staphylococcus
LTNKNYDGRMSAN

SEQ ID NO: 1858342 - protein, 6 aa, Staphylococcus
LTNRAY

SEQ ID NO: 1858343 - protein, 11 aa, Staphylococcus
LTNRGARQQNY

SEQ ID NO: 1858344 - protein, 10 aa, Staphylococcus
LTNTYGQAER

SEQ ID NO: 1858345 - protein, 13 aa, Staphylococcus
LTPAIQGAAKGIQ

SEQ ID NO: 1858346 - protein, 10 aa, Staphylococcus
LTPDATNEEI

SEQ ID NO: 1858347 - protein, 5 aa, Staphylococcus
LTPDQ

SEQ ID NO: 1858348 - protein, 18 aa, Staphylococcus
LTPEHRDESYKNYGEVEY

SEQ ID NO: 1858349 - protein, 8 aa, Staphylococcus
LTPNGDNL

SEQ ID NO: 1858350 - protein, 4 aa, Staphylococcus
LTPT

SEQ ID NO: 1858351 - protein, 7 aa, Staphylococcus
LTPTKAP

SEQ ID NO: 1858352 - protein, 17 aa, Staphylococcus
LTQAKEQYQNAQQNIDK

SEQ ID NO: 1858353 - protein, 4 aa, Staphylococcus
LTQD

SEQ ID NO: 1858354 - protein, 9 aa, Staphylococcus
LTQEEIQQQ

SEQ ID NO: 1858355 - protein, 22 aa, Staphylococcus
LTQKPSERTIGELDEVKQILHT

SEQ ID NO: 1858356 - protein, 12 aa, Staphylococcus
LTQPNLERVGNH

SEQ ID NO: 1858357 - protein, 5 aa, Staphylococcus
LTQQI

SEQ ID NO: 1858358 - protein, 25 aa, Staphylococcus
LTQSTSVSEATSASLSDSKSESASI

SEQ ID NO: 1858359 - protein, 8 aa, Staphylococcus
LTQTGTAL

SEQ ID NO: 1858360 - protein, 9 aa, Staphylococcus
LTRERSQAL

SEQ ID NO: 1858361 - protein, 11 aa, Staphylococcus
LTRTDDSYVSL

SEQ ID NO: 1858362 - protein, 6 aa, Staphylococcus
LTSAEK

SEQ ID NO: 1858363 - protein, 13 aa, Staphylococcus
LTSDGKKLNDNQA

SEQ ID NO: 1858364 - protein, 9 aa, Staphylococcus
LTSDKQHGH

SEQ ID NO: 1858365 - protein, 7 aa, Staphylococcus
LTSGAPI

SEQ ID NO: 1858366 - protein, 5 aa, Staphylococcus
LTSGG

SEQ ID NO: 1858367 - protein, 8 aa, Staphylococcus
LTSGKDNL

SEQ ID NO: 1858368 - protein, 7 aa, Staphylococcus
LTSGTEG

SEQ ID NO: 1858369 - protein, 5 aa, Staphylococcus
LTSLQ

SEQ ID NO: 1858370 - protein, 7 aa, Staphylococcus
LTSNGSQ

SEQ ID NO: 1858371 - protein, 16 aa, Staphylococcus
LTSSAGDQFSEEDAQY

SEQ ID NO: 1858372 - protein, 6 aa, Staphylococcus
LTSSDD

SEQ ID NO: 1858373 - protein, 6 aa, Staphylococcus
LTSSDH

SEQ ID NO: 1858374 - protein, 6 aa, Staphylococcus
LTSSED

SEQ ID NO: 1858375 - protein, 5 aa, Staphylococcus
LTSYQ

SEQ ID NO: 1858376 - protein, 12 aa, Staphylococcus
LTTEGSEKLNQM

SEQ ID NO: 1858377 - protein, 8 aa, Staphylococcus
LTTEKQAQ

SEQ ID NO: 1858378 - protein, 5 aa, Staphylococcus
LTTEQ

SEQ ID NO: 1858379 - protein, 4 aa, Staphylococcus
LTTG

SEQ ID NO: 1858380 - protein, 5 aa, Staphylococcus
LTTHR

SEQ ID NO: 1858381 - protein, 19 aa, Staphylococcus
LTTKQPNINAEEKDTNWQK

SEQ ID NO: 1858382 - protein, 6 aa, Staphylococcus
LTTNQL

SEQ ID NO: 1858383 - protein, 11 aa, Staphylococcus
LTTPSTKTDFN

SEQ ID NO: 1858384 - protein, 14 aa, Staphylococcus
LTVEPTQRLTNNGG

SEQ ID NO: 1858385 - protein, 12 aa, Staphylococcus
LTYENGHSPNAY

SEQ ID NO: 1858386 - protein, 13 aa, Staphylococcus
LTYGNASHAFGTA

SEQ ID NO: 1858387 - protein, 20 aa, Staphylococcus
LVDKNKVEKNLSSRDKKNSL

SEQ ID NO: 1858388 - protein, 9 aa, Staphylococcus
LVEEGQHRS

SEQ ID NO: 1858389 - protein, 15 aa, Staphylococcus
LVNNNNEATQEEKDV

SEQ ID NO: 1858390 - protein, 10 aa, Staphylococcus
LVPESGKDDR

SEQ ID NO: 1858391 - protein, 9 aa, Staphylococcus
LVPSSKPAL

SEQ ID NO: 1858392 - protein, 7 aa, Staphylococcus
LVQDSNK

SEQ ID NO: 1858393 - protein, 7 aa, Staphylococcus
LVQGSNK

SEQ ID NO: 1858394 - protein, 11 aa, Staphylococcus
LVQPYGTSDTL

SEQ ID NO: 1858395 - protein, 4 aa, Staphylococcus
LVTP

SEQ ID NO: 1858396 - protein, 5 aa, Staphylococcus
LVTPD

SEQ ID NO: 1858397 - protein, 5 aa, Staphylococcus
LVTPS

SEQ ID NO: 1858398 - protein, 12 aa, Staphylococcus
LYENGNKKYDID

SEQ ID NO: 1858399 - protein, 7 aa, Staphylococcus
LYESSKP

SEQ ID NO: 1858400 - protein, 17 aa, Staphylococcus
LYGAAKPKIKGDQSMKD

SEQ ID NO: 1858401 - protein, 4 aa, Staphylococcus
LYGS

SEQ ID NO: 1858402 - protein, 7 aa, Staphylococcus
LYKGNEL

SEQ ID NO: 1858403 - protein, 12 aa, Staphylococcus
LYNSQSLKTPID

SEQ ID NO: 1858404 - protein, 5 aa, Staphylococcus
LYQEN

SEQ ID NO: 1858405 - protein, 10 aa, Staphylococcus
LYQPTTKSKL

SEQ ID NO: 1858406 - protein, 12 aa, Staphylococcus
LYQSSTKKDIDS

SEQ ID NO: 1858407 - protein, 27 aa, Staphylococcus
LYSNEAGQGTGPHAAAAAEVSHPAKQG

SEQ ID NO: 1858408 - protein, 27 aa, Staphylococcus
LYSNEAGQGTGPHAASAAEVSHPAKQG

SEQ ID NO: 1858409 - protein, 27 aa, Staphylococcus
LYSNEAGQGTGPHAASAAEVSHPTKQG

SEQ ID NO: 1858410 - protein, 28 aa, Staphylococcus
LYSNKDNELLTKKPKDFDKNKKQVEKDL

SEQ ID NO: 1858411 - protein, 28 aa, Staphylococcus
LYSNKDNELLTKKPKDFEKNQKQVEKDL

SEQ ID NO: 1858412 - protein, 12 aa, Staphylococcus
LYSSKGGGMGGY

SEQ ID NO: 1858413 - protein, 7 aa, Staphylococcus
MAAVPGT

SEQ ID NO: 1858414 - protein, 5 aa, Staphylococcus
MADKL

SEQ ID NO: 1858415 - protein, 43 aa, Staphylococcus
MAGAQGQQLLQGNEKVTSGLQELQQNNNQLKSKIDDAVQKQTD

SEQ ID NO: 1858416 - protein, 11 aa, Staphylococcus
MAGAVGGGGIG

SEQ ID NO: 1858417 - protein, 4 aa, Staphylococcus
MAGN

SEQ ID NO: 1858418 - protein, 5 aa, Staphylococcus
MAGVP

SEQ ID NO: 1858419 - protein, 5 aa, Staphylococcus
MANEG

SEQ ID NO: 1858420 - protein, 7 aa, Staphylococcus
MAPTLNK

SEQ ID NO: 1858421 - protein, 8 aa, Staphylococcus
MAQDGNPF

SEQ ID NO: 1858422 - protein, 7 aa, Staphylococcus
MAQGGAA

SEQ ID NO: 1858423 - protein, 9 aa, Staphylococcus
MAQNDSEIA

SEQ ID NO: 1858424 - protein, 8 aa, Staphylococcus
MAQPSAQD

SEQ ID NO: 1858425 - protein, 8 aa, Staphylococcus
MATEDRQV

SEQ ID NO: 1858426 - protein, 11 aa, Staphylococcus
MATTSDNTNKH

SEQ ID NO: 1858427 - protein, 5 aa, Staphylococcus
MAYGN

SEQ ID NO: 1858428 - protein, 4 aa, Staphylococcus
MDAN

SEQ ID NO: 1858429 - protein, 19 aa, Staphylococcus
MDDKPDKDDIEVQRNSEFT

SEQ ID NO: 1858430 - protein, 4 aa, Staphylococcus
MDDP

SEQ ID NO: 1858431 - protein, 7 aa, Staphylococcus
MDEGEKY

SEQ ID NO: 1858432 - protein, 4 aa, Staphylococcus
MDGD

SEQ ID NO: 1858433 - protein, 35 aa, Staphylococcus
MDGKDPKNHKVDYSKNQPPKKDHKAHDHHEKKHHD

SEQ ID NO: 1858434 - protein, 4 aa, Staphylococcus
MDKL

SEQ ID NO: 1858435 - protein, 10 aa, Staphylococcus
MDNESDQINK

SEQ ID NO: 1858436 - protein, 9 aa, Staphylococcus
MDNESEQIT

SEQ ID NO: 1858437 - protein, 10 aa, Staphylococcus
MDNESEQITK

SEQ ID NO: 1858438 - protein, 9 aa, Staphylococcus
MDNETEQIT

SEQ ID NO: 1858439 - protein, 11 aa, Staphylococcus
MDNSGELGQSE

SEQ ID NO: 1858440 - protein, 7 aa, Staphylococcus
MDPSESP

SEQ ID NO: 1858441 - protein, 32 aa, Staphylococcus
MDSIGDKTKQAKEWGGEKLSQIKGAVGKGTKW

SEQ ID NO: 1858442 - protein, 8 aa, Staphylococcus
MEAPTPVS

SEQ ID NO: 1858443 - protein, 7 aa, Staphylococcus
MEDNQTV

SEQ ID NO: 1858444 - protein, 13 aa, Staphylococcus
MEKGQKQTRLERS

SEQ ID NO: 1858445 - protein, 19 aa, Staphylococcus
MEPDAPTDKADAQSEDPLY

SEQ ID NO: 1858446 - protein, 18 aa, Staphylococcus
MEPDAPVDKSEMKSEDAL

SEQ ID NO: 1858447 - protein, 19 aa, Staphylococcus
MEPDAPVDKSEMKSEDALY

SEQ ID NO: 1858448 - protein, 19 aa, Staphylococcus
MEPDAPVDKSEMKSEDSLY

SEQ ID NO: 1858449 - protein, 7 aa, Staphylococcus
MEPPKKI

SEQ ID NO: 1858450 - protein, 10 aa, Staphylococcus
MEQQSEHPLS

SEQ ID NO: 1858451 - protein, 7 aa, Staphylococcus
METDTTL

SEQ ID NO: 1858452 - protein, 4 aa, Staphylococcus
METY

SEQ ID NO: 1858453 - protein, 9 aa, Staphylococcus
MFSPSSQSY

SEQ ID NO: 1858454 - protein, 12 aa, Staphylococcus
MGAKTGTGTYGA

SEQ ID NO: 1858455 - protein, 13 aa, Staphylococcus
MGAKTGTGTYGSE

SEQ ID NO: 1858456 - protein, 15 aa, Staphylococcus
MGAKTGTSTYGTEIN

SEQ ID NO: 1858457 - protein, 13 aa, Staphylococcus
MGDGLQAAAGDRL

SEQ ID NO: 1858458 - protein, 6 aa, Staphylococcus
MGDGVT

SEQ ID NO: 1858459 - protein, 4 aa, Staphylococcus
MGDN

SEQ ID NO: 1858460 - protein, 5 aa, Staphylococcus
MGGDN

SEQ ID NO: 1858461 - protein, 7 aa, Staphylococcus
MGGEENI

SEQ ID NO: 1858462 - protein, 8 aa, Staphylococcus
MGGGQYSA

SEQ ID NO: 1858463 - protein, 9 aa, Staphylococcus
MGGGQYSSN

SEQ ID NO: 1858464 - protein, 7 aa, Staphylococcus
MGGKDNI

SEQ ID NO: 1858465 - protein, 7 aa, Staphylococcus
MGGKTNI

SEQ ID NO: 1858466 - protein, 22 aa, Staphylococcus
MGGNEPTNNPILQDEDSGVSYP

SEQ ID NO: 1858467 - protein, 21 aa, Staphylococcus
MGGNEPTNNPTLQEEDAGVSY

SEQ ID NO: 1858468 - protein, 7 aa, Staphylococcus
MGGQAGG

SEQ ID NO: 1858469 - protein, 8 aa, Staphylococcus
MGKPLPGI

SEQ ID NO: 1858470 - protein, 11 aa, Staphylococcus
MGNQSVDVKQA

SEQ ID NO: 1858471 - protein, 8 aa, Staphylococcus
MGNTNGIN

SEQ ID NO: 1858472 - protein, 5 aa, Staphylococcus
MGQKP

SEQ ID NO: 1858473 - protein, 6 aa, Staphylococcus
MGRTYT

SEQ ID NO: 1858474 - protein, 8 aa, Staphylococcus
MGSNNPSM

SEQ ID NO: 1858475 - protein, 6 aa, Staphylococcus
MGSRGL

SEQ ID NO: 1858476 - protein, 8 aa, Staphylococcus
MGSRGLRK

SEQ ID NO: 1858477 - protein, 10 aa, Staphylococcus
MGTGAGNNSL

SEQ ID NO: 1858478 - protein, 10 aa, Staphylococcus
MGTGTEVAIE

SEQ ID NO: 1858479 - protein, 11 aa, Staphylococcus
MGTGVGNSSIE

SEQ ID NO: 1858480 - protein, 4 aa, Staphylococcus
MGVS

SEQ ID NO: 1858481 - protein, 9 aa, Staphylococcus
MHENKQKQL

SEQ ID NO: 1858482 - protein, 8 aa, Staphylococcus
MHESKQKQ

SEQ ID NO: 1858483 - protein, 6 aa, Staphylococcus
MHPDGA

SEQ ID NO: 1858484 - protein, 7 aa, Staphylococcus
MHPDGAP

SEQ ID NO: 1858485 - protein, 20 aa, Staphylococcus
MKDEDGSTVKLNGTSQVDDD

SEQ ID NO: 1858486 - protein, 5 aa, Staphylococcus
MKDES

SEQ ID NO: 1858487 - protein, 23 aa, Staphylococcus
MKDPGEWKNQDLGTGAGNNSVDV

SEQ ID NO: 1858488 - protein, 15 aa, Staphylococcus
MKDSPAEKAGIQPKD

SEQ ID NO: 1858489 - protein, 15 aa, Staphylococcus
MKDSPAEKAGLQPKD

SEQ ID NO: 1858490 - protein, 10 aa, Staphylococcus
MKEQKIKNGD

SEQ ID NO: 1858491 - protein, 7 aa, Staphylococcus
MKGHDDS

SEQ ID NO: 1858492 - protein, 7 aa, Staphylococcus
MKGPIGG

SEQ ID NO: 1858493 - protein, 10 aa, Staphylococcus
MKKAKQEGMT

SEQ ID NO: 1858494 - protein, 11 aa, Staphylococcus
MKNSKKDDQRI

SEQ ID NO: 1858495 - protein, 10 aa, Staphylococcus
MKNSKREDER

SEQ ID NO: 1858496 - protein, 9 aa, Staphylococcus
MKPDIRSSI

SEQ ID NO: 1858497 - protein, 12 aa, Staphylococcus
MKQDQQKIQDTM

SEQ ID NO: 1858498 - protein, 10 aa, Staphylococcus
MKQGNYDEAK

SEQ ID NO: 1858499 - protein, 11 aa, Staphylococcus
MKSASTSGYQG

SEQ ID NO: 1858500 - protein, 6 aa, Staphylococcus
MKSNAV

SEQ ID NO: 1858501 - protein, 17 aa, Staphylococcus
MKSSNDIKASTKKGDIN

SEQ ID NO: 1858502 - protein, 65 aa, Staphylococcus
MKSSSKSASESFRDKRETSKARKEERAQLKAERSEEKKRKKEQERLQQENVKDVSDLPEVPQNND

SEQ ID NO: 1858503 - protein, 6 aa, Staphylococcus
MKTEAV

SEQ ID NO: 1858504 - protein, 5 aa, Staphylococcus
MKTRS

SEQ ID NO: 1858505 - protein, 13 aa, Staphylococcus
MNAHGSSMTNTVQ

SEQ ID NO: 1858506 - protein, 4 aa, Staphylococcus
MNAV

SEQ ID NO: 1858507 - protein, 21 aa, Staphylococcus
MNDDKQPKVDHKDKQKHQEDN

SEQ ID NO: 1858508 - protein, 13 aa, Staphylococcus
MNDESESHNYDEI

SEQ ID NO: 1858509 - protein, 62 aa, Staphylococcus
MNDPEDKAVDDALKAGQDVEGDLNATTAQVEKVSKDLNDALDAKAKQDALDAAAKDKQAAFD

SEQ ID NO: 1858510 - protein, 34 aa, Staphylococcus
MNDPEDKAVDDALKAGQNVEGDLNATPEQVKKAA

SEQ ID NO: 1858511 - protein, 11 aa, Staphylococcus
MNDSKRNDERI

SEQ ID NO: 1858512 - protein, 16 aa, Staphylococcus
MNEGGPQKPSEKPKRS

SEQ ID NO: 1858513 - protein, 11 aa, Staphylococcus
MNEKNNPKENY

SEQ ID NO: 1858514 - protein, 11 aa, Staphylococcus
MNFSTSQLKAQ

SEQ ID NO: 1858515 - protein, 4 aa, Staphylococcus
MNGG

SEQ ID NO: 1858516 - protein, 4 aa, Staphylococcus
MNGT

SEQ ID NO: 1858517 - protein, 5 aa, Staphylococcus
MNHID

SEQ ID NO: 1858518 - protein, 23 aa, Staphylococcus
MNKDSGEDKKPKNTQVVSKKKKK

SEQ ID NO: 1858519 - protein, 6 aa, Staphylococcus
MNKDSK

SEQ ID NO: 1858520 - protein, 5 aa, Staphylococcus
MNNDE

SEQ ID NO: 1858521 - protein, 9 aa, Staphylococcus
MNPGEHQYA

SEQ ID NO: 1858522 - protein, 8 aa, Staphylococcus
MNPKQAKR

SEQ ID NO: 1858523 - protein, 9 aa, Staphylococcus
MNPNSNDNY

SEQ ID NO: 1858524 - protein, 6 aa, Staphylococcus
MNPQKK

SEQ ID NO: 1858525 - protein, 6 aa, Staphylococcus
MNPQQA

SEQ ID NO: 1858526 - protein, 10 aa, Staphylococcus
MNQKKKPSKW

SEQ ID NO: 1858527 - protein, 10 aa, Staphylococcus
MNQNKHEDER

SEQ ID NO: 1858528 - protein, 23 aa, Staphylococcus
MNQPGEWKNQDMGNGSGNDSVEV

SEQ ID NO: 1858529 - protein, 11 aa, Staphylococcus
MNRGQSLNKTQ

SEQ ID NO: 1858530 - protein, 20 aa, Staphylococcus
MNRKNGSRDLATQTPGDNNY

SEQ ID NO: 1858531 - protein, 18 aa, Staphylococcus
MNRRNGSRDFGSNADDNY

SEQ ID NO: 1858532 - protein, 7 aa, Staphylococcus
MNSASYD

SEQ ID NO: 1858533 - protein, 13 aa, Staphylococcus
MNSETDVKGSSKL

SEQ ID NO: 1858534 - protein, 8 aa, Staphylococcus
MNSRNNNV

SEQ ID NO: 1858535 - protein, 4 aa, Staphylococcus
MNTA

SEQ ID NO: 1858536 - protein, 10 aa, Staphylococcus
MNTGEGGLSE

SEQ ID NO: 1858537 - protein, 7 aa, Staphylococcus
MNTQTEI

SEQ ID NO: 1858538 - protein, 5 aa, Staphylococcus
MNYEE

SEQ ID NO: 1858539 - protein, 6 aa, Staphylococcus
MNYEER

SEQ ID NO: 1858540 - protein, 4 aa, Staphylococcus
MPAN

SEQ ID NO: 1858541 - protein, 16 aa, Staphylococcus
MPDDSLKPNDSSAHKA

SEQ ID NO: 1858542 - protein, 40 aa, Staphylococcus
MPDEGVSYSTRSTADTNFDDAHTASNVDIPTDVSTSEAIG

SEQ ID NO: 1858543 - protein, 8 aa, Staphylococcus
MPEDKESI

SEQ ID NO: 1858544 - protein, 7 aa, Staphylococcus
MPEPQNI

SEQ ID NO: 1858545 - protein, 11 aa, Staphylococcus
MPETAKDTHSK

SEQ ID NO: 1858546 - protein, 17 aa, Staphylococcus
MPGDSMKPTDSTQYKAD

SEQ ID NO: 1858547 - protein, 5 aa, Staphylococcus
MPGGS

SEQ ID NO: 1858548 - protein, 7 aa, Staphylococcus
MPGGSIS

SEQ ID NO: 1858549 - protein, 9 aa, Staphylococcus
MPGKEGSVI

SEQ ID NO: 1858550 - protein, 16 aa, Staphylococcus
MPKKSKAEKQKLQQTR

SEQ ID NO: 1858551 - protein, 5 aa, Staphylococcus
MPNDT

SEQ ID NO: 1858552 - protein, 6 aa, Staphylococcus
MPNQSS

SEQ ID NO: 1858553 - protein, 5 aa, Staphylococcus
MPNYT

SEQ ID NO: 1858554 - protein, 5 aa, Staphylococcus
MPPET

SEQ ID NO: 1858555 - protein, 12 aa, Staphylococcus
MPPSTALGTNKL

SEQ ID NO: 1858556 - protein, 7 aa, Staphylococcus
MPQDGTI

SEQ ID NO: 1858557 - protein, 24 aa, Staphylococcus
MPQNGTIVKTDGAEGSMAQAGNPI

SEQ ID NO: 1858558 - protein, 7 aa, Staphylococcus
MPQSTIN

SEQ ID NO: 1858559 - protein, 16 aa, Staphylococcus
MPRKSPVEKQKLEQTR

SEQ ID NO: 1858560 - protein, 16 aa, Staphylococcus
MPRQSNLKAATKNGDI

SEQ ID NO: 1858561 - protein, 12 aa, Staphylococcus
MPSAAADKPSIS

SEQ ID NO: 1858562 - protein, 5 aa, Staphylococcus
MPSEV

SEQ ID NO: 1858563 - protein, 15 aa, Staphylococcus
MPSKQQRPTVNERIS

SEQ ID NO: 1858564 - protein, 15 aa, Staphylococcus
MPSKQSRPTVNDRIS

SEQ ID NO: 1858565 - protein, 16 aa, Staphylococcus
MPSKQSRPTVNDRISD

SEQ ID NO: 1858566 - protein, 13 aa, Staphylococcus
MPSSNSDGNYTKV

SEQ ID NO: 1858567 - protein, 8 aa, Staphylococcus
MPTKTADH

SEQ ID NO: 1858568 - protein, 7 aa, Staphylococcus
MPTSVNS

SEQ ID NO: 1858569 - protein, 17 aa, Staphylococcus
MQAYEGDKKVTVKQGNG

SEQ ID NO: 1858570 - protein, 4 aa, Staphylococcus
MQDN

SEQ ID NO: 1858571 - protein, 18 aa, Staphylococcus
MQEESVSRYQSTNGRQNM

SEQ ID NO: 1858572 - protein, 6 aa, Staphylococcus
MQEKEN

SEQ ID NO: 1858573 - protein, 6 aa, Staphylococcus
MQENNN

SEQ ID NO: 1858574 - protein, 7 aa, Staphylococcus
MQGDPTT

SEQ ID NO: 1858575 - protein, 28 aa, Staphylococcus
MQKKNDQISITSPMKDSPAEKAGIQPKD

SEQ ID NO: 1858576 - protein, 29 aa, Staphylococcus
MQKKNDQISITSPMKGSPAEKAGIKPKDV

SEQ ID NO: 1858577 - protein, 15 aa, Staphylococcus
MQKSSKQNAARPAAQ

SEQ ID NO: 1858578 - protein, 13 aa, Staphylococcus
MQQAKSQGQKSTR

SEQ ID NO: 1858579 - protein, 5 aa, Staphylococcus
MQQQN

SEQ ID NO: 1858580 - protein, 5 aa, Staphylococcus
MQQRN

SEQ ID NO: 1858581 - protein, 13 aa, Staphylococcus
MQRKAGKNPVFKP

SEQ ID NO: 1858582 - protein, 10 aa, Staphylococcus
MQSQDRKHAK

SEQ ID NO: 1858583 - protein, 6 aa, Staphylococcus
MRGPIG

SEQ ID NO: 1858584 - protein, 5 aa, Staphylococcus
MRTTR

SEQ ID NO: 1858585 - protein, 10 aa, Staphylococcus
MSAEDDSDEA

SEQ ID NO: 1858586 - protein, 12 aa, Staphylococcus
MSAPKDNPFKQE

SEQ ID NO: 1858587 - protein, 8 aa, Staphylococcus
MSDKDYEK

SEQ ID NO: 1858588 - protein, 15 aa, Staphylococcus
MSDKEDSQLNSGQKT

SEQ ID NO: 1858589 - protein, 5 aa, Staphylococcus
MSDQA

SEQ ID NO: 1858590 - protein, 13 aa, Staphylococcus
MSESAKNTGIDTT

SEQ ID NO: 1858591 - protein, 45 aa, Staphylococcus
MSETSGAPLDDDTSHTENKSYKAQAEEQARQNKQNFQSHRKQSKW

SEQ ID NO: 1858592 - protein, 6 aa, Staphylococcus
MSGADK

SEQ ID NO: 1858593 - protein, 4 aa, Staphylococcus
MSGD

SEQ ID NO: 1858594 - protein, 4 aa, Staphylococcus
MSGK

SEQ ID NO: 1858595 - protein, 4 aa, Staphylococcus
MSKL

SEQ ID NO: 1858596 - protein, 4 aa, Staphylococcus
MSLE

SEQ ID NO: 1858597 - protein, 18 aa, Staphylococcus
MSLEGTDGLKTGSSDIAD

SEQ ID NO: 1858598 - protein, 30 aa, Staphylococcus
MSLPGTDGLKTGSSDTADYNHTITTKRNGF

SEQ ID NO: 1858599 - protein, 4 aa, Staphylococcus
MSPE

SEQ ID NO: 1858600 - protein, 14 aa, Staphylococcus
MSPLSDTTNLASGL

SEQ ID NO: 1858601 - protein, 15 aa, Staphylococcus
MSPLSDTTNLASGLT

SEQ ID NO: 1858602 - protein, 9 aa, Staphylococcus
MSPTMKKDD

SEQ ID NO: 1858603 - protein, 9 aa, Staphylococcus
MSSNYTNRV

SEQ ID NO: 1858604 - protein, 8 aa, Staphylococcus
MSTKSKGL

SEQ ID NO: 1858605 - protein, 5 aa, Staphylococcus
MSTSE

SEQ ID NO: 1858606 - protein, 9 aa, Staphylococcus
MSVRPEQTQ

SEQ ID NO: 1858607 - protein, 38 aa, Staphylococcus
MSVTKKADSVASAIKNENADQLKNNVTSDGKPLTKEEA

SEQ ID NO: 1858608 - protein, 7 aa, Staphylococcus
MSYNTRK

SEQ ID NO: 1858609 - protein, 5 aa, Staphylococcus
MTDHT

SEQ ID NO: 1858610 - protein, 5 aa, Staphylococcus
MTDVG

SEQ ID NO: 1858611 - protein, 5 aa, Staphylococcus
MTEAA

SEQ ID NO: 1858612 - protein, 6 aa, Staphylococcus
MTESDV

SEQ ID NO: 1858613 - protein, 11 aa, Staphylococcus
MTGGKTSEEAI

SEQ ID NO: 1858614 - protein, 13 aa, Staphylococcus
MTGISNKDDISPL

SEQ ID NO: 1858615 - protein, 14 aa, Staphylococcus
MTKDETKSFNEDVS

SEQ ID NO: 1858616 - protein, 14 aa, Staphylococcus
MTKEQTKSFNEGVS

SEQ ID NO: 1858617 - protein, 14 aa, Staphylococcus
MTKKETKSFNEDVS

SEQ ID NO: 1858618 - protein, 11 aa, Staphylococcus
MTKNGKSTRAQ

SEQ ID NO: 1858619 - protein, 5 aa, Staphylococcus
MTKRE

SEQ ID NO: 1858620 - protein, 6 aa, Staphylococcus
MTNSKA

SEQ ID NO: 1858621 - protein, 6 aa, Staphylococcus
MTPDKP

SEQ ID NO: 1858622 - protein, 6 aa, Staphylococcus
MTPKPN

SEQ ID NO: 1858623 - protein, 6 aa, Staphylococcus
MTPPPI

SEQ ID NO: 1858624 - protein, 12 aa, Staphylococcus
MTPTPEREKEVD

SEQ ID NO: 1858625 - protein, 14 aa, Staphylococcus
MTPTPERKKEVDFS

SEQ ID NO: 1858626 - protein, 9 aa, Staphylococcus
MTRSNDTYV

SEQ ID NO: 1858627 - protein, 7 aa, Staphylococcus
MTSGDTG

SEQ ID NO: 1858628 - protein, 7 aa, Staphylococcus
MTSGGTG

SEQ ID NO: 1858629 - protein, 4 aa, Staphylococcus
MTSS

SEQ ID NO: 1858630 - protein, 21 aa, Staphylococcus
MTSTPERKKEVDFSDSYTKTG

SEQ ID NO: 1858631 - protein, 29 aa, Staphylococcus
MTTESSNNVKKDNIISQSPKNTEVEEGST

SEQ ID NO: 1858632 - protein, 5 aa, Staphylococcus
MTTGS

SEQ ID NO: 1858633 - protein, 5 aa, Staphylococcus
MTTNQ

SEQ ID NO: 1858634 - protein, 16 aa, Staphylococcus
MTYTDPSIYIKSVLGG

SEQ ID NO: 1858635 - protein, 4 aa, Staphylococcus
MVKE

SEQ ID NO: 1858636 - protein, 8 aa, Staphylococcus
MVSDKTND

SEQ ID NO: 1858637 - protein, 4 aa, Staphylococcus
MYHG

SEQ ID NO: 1858638 - protein, 6 aa, Staphylococcus
MYKGKE

SEQ ID NO: 1858639 - protein, 9 aa, Staphylococcus
MYPTLKDGE

SEQ ID NO: 1858640 - protein, 6 aa, Staphylococcus
NAAGEM

SEQ ID NO: 1858641 - protein, 13 aa, Staphylococcus
NAAMSHTSEGAVS

SEQ ID NO: 1858642 - protein, 4 aa, Staphylococcus
NAAQ

SEQ ID NO: 1858643 - protein, 9 aa, Staphylococcus
NAARDLGAT

SEQ ID NO: 1858644 - protein, 4 aa, Staphylococcus
NAAY

SEQ ID NO: 1858645 - protein, 8 aa, Staphylococcus
NADEYQPE

SEQ ID NO: 1858646 - protein, 6 aa, Staphylococcus
NADFAG

SEQ ID NO: 1858647 - protein, 12 aa, Staphylococcus
NADGSKDYSGTA

SEQ ID NO: 1858648 - protein, 10 aa, Staphylococcus
NADHTNQVNY

SEQ ID NO: 1858649 - protein, 6 aa, Staphylococcus
NADIPT

SEQ ID NO: 1858650 - protein, 10 aa, Staphylococcus
NADKLTGGKN

SEQ ID NO: 1858651 - protein, 8 aa, Staphylococcus
NADNPPAS

SEQ ID NO: 1858652 - protein, 9 aa, Staphylococcus
NADNPPASV

SEQ ID NO: 1858653 - protein, 10 aa, Staphylococcus
NADNRETAIQ

SEQ ID NO: 1858654 - protein, 9 aa, Staphylococcus
NADNSSGYD

SEQ ID NO: 1858655 - protein, 10 aa, Staphylococcus
NADPTKISAY

SEQ ID NO: 1858656 - protein, 9 aa, Staphylococcus
NADTRAEVK

SEQ ID NO: 1858657 - protein, 5 aa, Staphylococcus
NADVN

SEQ ID NO: 1858658 - protein, 21 aa, Staphylococcus
NAEAIKDKTQNPELDKNSIQQ

SEQ ID NO: 1858659 - protein, 4 aa, Staphylococcus
NAEE

SEQ ID NO: 1858660 - protein, 9 aa, Staphylococcus
NAEESNEKW

SEQ ID NO: 1858661 - protein, 9 aa, Staphylococcus
NAENGDVTP

SEQ ID NO: 1858662 - protein, 7 aa, Staphylococcus
NAESPEK

SEQ ID NO: 1858663 - protein, 8 aa, Staphylococcus
NAETRPKV

SEQ ID NO: 1858664 - protein, 10 aa, Staphylococcus
NAFDTTASQV

SEQ ID NO: 1858665 - protein, 21 aa, Staphylococcus
NAFSDTKAPAAEPAKQTQQYV

SEQ ID NO: 1858666 - protein, 4 aa, Staphylococcus
NAGL

SEQ ID NO: 1858667 - protein, 13 aa, Staphylococcus
NAGPLTWNSRGKV

SEQ ID NO: 1858668 - protein, 9 aa, Staphylococcus
NAGSTLDPQ

SEQ ID NO: 1858669 - protein, 30 aa, Staphylococcus
NAHDNTHSHDNYQNNEHYENGDRQVNEKNN

SEQ ID NO: 1858670 - protein, 5 aa, Staphylococcus
NAHKN

SEQ ID NO: 1858671 - protein, 10 aa, Staphylococcus
NAHPNSNVIP

SEQ ID NO: 1858672 - protein, 5 aa, Staphylococcus
NAHTN

SEQ ID NO: 1858673 - protein, 22 aa, Staphylococcus
NAIHTGKSYAKEASWTSPRKAI

SEQ ID NO: 1858674 - protein, 4 aa, Staphylococcus
NAIK

SEQ ID NO: 1858675 - protein, 18 aa, Staphylococcus
NAKDENQQQEGIDTSLSK

SEQ ID NO: 1858676 - protein, 14 aa, Staphylococcus
NAKDKDEIYNILKE

SEQ ID NO: 1858677 - protein, 9 aa, Staphylococcus
NAKDKRQAI

SEQ ID NO: 1858678 - protein, 18 aa, Staphylococcus
NAKDNNDNWHKNQEETQL

SEQ ID NO: 1858679 - protein, 10 aa, Staphylococcus
NAKEKDVEQA

SEQ ID NO: 1858680 - protein, 8 aa, Staphylococcus
NAKHGKVS

SEQ ID NO: 1858681 - protein, 7 aa, Staphylococcus
NAKHNLS

SEQ ID NO: 1858682 - protein, 12 aa, Staphylococcus
NAKHNLTSSEIK

SEQ ID NO: 1858683 - protein, 11 aa, Staphylococcus
NAKHNLTTEEI

SEQ ID NO: 1858684 - protein, 7 aa, Staphylococcus
NAKKFSF

SEQ ID NO: 1858685 - protein, 9 aa, Staphylococcus
NAKNKKEAI

SEQ ID NO: 1858686 - protein, 9 aa, Staphylococcus
NAKNNAISE

SEQ ID NO: 1858687 - protein, 7 aa, Staphylococcus
NAKRDLR

SEQ ID NO: 1858688 - protein, 8 aa, Staphylococcus
NAKTGSLI

SEQ ID NO: 1858689 - protein, 9 aa, Staphylococcus
NAKTGSLID

SEQ ID NO: 1858690 - protein, 8 aa, Staphylococcus
NAKTGSLL

SEQ ID NO: 1858691 - protein, 8 aa, Staphylococcus
NAKTMEPK

SEQ ID NO: 1858692 - protein, 21 aa, Staphylococcus
NALDGEAQLRKAKEDADNTIN

SEQ ID NO: 1858693 - protein, 5 aa, Staphylococcus
NALGG

SEQ ID NO: 1858694 - protein, 19 aa, Staphylococcus
NALNGDQNVTKAKGKADQF

SEQ ID NO: 1858695 - protein, 12 aa, Staphylococcus
NALNKTKDHQTT

SEQ ID NO: 1858696 - protein, 6 aa, Staphylococcus
NALSNT

SEQ ID NO: 1858697 - protein, 6 aa, Staphylococcus
NALTED

SEQ ID NO: 1858698 - protein, 10 aa, Staphylococcus
NAMGQGIAKT

SEQ ID NO: 1858699 - protein, 13 aa, Staphylococcus
NAMGQGISKTGAA

SEQ ID NO: 1858700 - protein, 14 aa, Staphylococcus
NANDLKSPLDKEQA

SEQ ID NO: 1858701 - protein, 11 aa, Staphylococcus
NANPKSNIIPK

SEQ ID NO: 1858702 - protein, 7 aa, Staphylococcus
NANSQLG

SEQ ID NO: 1858703 - protein, 10 aa, Staphylococcus
NANSVVSKEG

SEQ ID NO: 1858704 - protein, 68 aa, Staphylococcus
NANYAKATSRVKGVEQAYKSLTAANQKNKQALEKSNASLKESNRELKKAETQSNRTNNQREKAAQRLE

SEQ ID NO: 1858705 - protein, 9 aa, Staphylococcus
NAPADTSSL

SEQ ID NO: 1858706 - protein, 8 aa, Staphylococcus
NAPASTAD

SEQ ID NO: 1858707 - protein, 6 aa, Staphylococcus
NAPEVK

SEQ ID NO: 1858708 - protein, 4 aa, Staphylococcus
NAPI

SEQ ID NO: 1858709 - protein, 6 aa, Staphylococcus
NAPLRT

SEQ ID NO: 1858710 - protein, 4 aa, Staphylococcus
NAPN

SEQ ID NO: 1858711 - protein, 9 aa, Staphylococcus
NAPPDPGAV

SEQ ID NO: 1858712 - protein, 10 aa, Staphylococcus
NAPRNEETHP

SEQ ID NO: 1858713 - protein, 6 aa, Staphylococcus
NAPSHA

SEQ ID NO: 1858714 - protein, 39 aa, Staphylococcus
NAPTKQPVVKPKVDTKYEFKSGGKRKKVIAEADKTTPLG

SEQ ID NO: 1858715 - protein, 13 aa, Staphylococcus
NAQASSNSGAEIK

SEQ ID NO: 1858716 - protein, 19 aa, Staphylococcus
NAQDKNQQREGVKTSLGKN

SEQ ID NO: 1858717 - protein, 17 aa, Staphylococcus
NAQIEKGYKSYVKSNYT

SEQ ID NO: 1858718 - protein, 6 aa, Staphylococcus
NAQKNV

SEQ ID NO: 1858719 - protein, 34 aa, Staphylococcus
NAQKQMAQQQINSASTLNDVTQAVQKAATLDQSM

SEQ ID NO: 1858720 - protein, 11 aa, Staphylococcus
NAQLNGQTNRE

SEQ ID NO: 1858721 - protein, 10 aa, Staphylococcus
NAQPHKRQDA

SEQ ID NO: 1858722 - protein, 14 aa, Staphylococcus
NAQPPTMDKGEIDK

SEQ ID NO: 1858723 - protein, 7 aa, Staphylococcus
NAQSSKF

SEQ ID NO: 1858724 - protein, 10 aa, Staphylococcus
NARANYNSSN

SEQ ID NO: 1858725 - protein, 12 aa, Staphylococcus
NARTKDDISNAL

SEQ ID NO: 1858726 - protein, 13 aa, Staphylococcus
NARTPESKSKHQK

SEQ ID NO: 1858727 - protein, 5 aa, Staphylococcus
NASAD

SEQ ID NO: 1858728 - protein, 10 aa, Staphylococcus
NASDNSNGLG

SEQ ID NO: 1858729 - protein, 5 aa, Staphylococcus
NASGG

SEQ ID NO: 1858730 - protein, 23 aa, Staphylococcus
NASGQTQSATTATNSDSKNDGII

SEQ ID NO: 1858731 - protein, 6 aa, Staphylococcus
NASGSI

SEQ ID NO: 1858732 - protein, 20 aa, Staphylococcus
NASKKSITYTRGRKTSQTEI

SEQ ID NO: 1858733 - protein, 9 aa, Staphylococcus
NASNKENEF

SEQ ID NO: 1858734 - protein, 17 aa, Staphylococcus
NASSELNELKLNHIKNN

SEQ ID NO: 1858735 - protein, 8 aa, Staphylococcus
NASSLNDA

SEQ ID NO: 1858736 - protein, 7 aa, Staphylococcus
NASSPEE

SEQ ID NO: 1858737 - protein, 7 aa, Staphylococcus
NASTIST

SEQ ID NO: 1858738 - protein, 5 aa, Staphylococcus
NASTM

SEQ ID NO: 1858739 - protein, 13 aa, Staphylococcus
NASVEELEKAGAF

SEQ ID NO: 1858740 - protein, 14 aa, Staphylococcus
NASYSGEVSHINEL

SEQ ID NO: 1858741 - protein, 14 aa, Staphylococcus
NATDPSSAGYQAAG

SEQ ID NO: 1858742 - protein, 4 aa, Staphylococcus
NATE

SEQ ID NO: 1858743 - protein, 18 aa, Staphylococcus
NATFRGRDTQRTGDNTVN

SEQ ID NO: 1858744 - protein, 14 aa, Staphylococcus
NATGESDDKNTYEV

SEQ ID NO: 1858745 - protein, 4 aa, Staphylococcus
NATH

SEQ ID NO: 1858746 - protein, 8 aa, Staphylococcus
NATKQKDL

SEQ ID NO: 1858747 - protein, 22 aa, Staphylococcus
NATQTSVPKRQPQTSPQKQTVK

SEQ ID NO: 1858748 - protein, 8 aa, Staphylococcus
NATSKQDV

SEQ ID NO: 1858749 - protein, 8 aa, Staphylococcus
NATTGQQV

SEQ ID NO: 1858750 - protein, 14 aa, Staphylococcus
NATTKDEIYNILKM

SEQ ID NO: 1858751 - protein, 11 aa, Staphylococcus
NATTVSDESSL

SEQ ID NO: 1858752 - protein, 5 aa, Staphylococcus
NATYI

SEQ ID NO: 1858753 - protein, 11 aa, Staphylococcus
NAVGEGIAKTG

SEQ ID NO: 1858754 - protein, 21 aa, Staphylococcus
NAVHTGKSYAKKESWTSPRKA

SEQ ID NO: 1858755 - protein, 22 aa, Staphylococcus
NAVHTGKSYAKQQSWTTPSKAI

SEQ ID NO: 1858756 - protein, 21 aa, Staphylococcus
NAVHTGSSFAKKQKWTSPEKA

SEQ ID NO: 1858757 - protein, 13 aa, Staphylococcus
NAVNQTSDTYKDF

SEQ ID NO: 1858758 - protein, 6 aa, Staphylococcus
NAVSHG

SEQ ID NO: 1858759 - protein, 14 aa, Staphylococcus
NAYDADKEFQKEKK

SEQ ID NO: 1858760 - protein, 4 aa, Staphylococcus
NAYL

SEQ ID NO: 1858761 - protein, 38 aa, Staphylococcus
NAYNNKNADKGHNHHSTTSDQKQSTTNKEDELPETKPV

SEQ ID NO: 1858762 - protein, 10 aa, Staphylococcus
NAYTKDEEKL

SEQ ID NO: 1858763 - protein, 5 aa, Staphylococcus
NCPKI

SEQ ID NO: 1858764 - protein, 4 aa, Staphylococcus
NDAI

SEQ ID NO: 1858765 - protein, 16 aa, Staphylococcus
NDAKQHLTADTSRLQN

SEQ ID NO: 1858766 - protein, 65 aa, Staphylococcus
NDAQAAEETSEKAVAEVANDSTEGQTFPQPENEITQETPPQLTKENENSTLENNINDVKSENDLK

SEQ ID NO: 1858767 - protein, 10 aa, Staphylococcus
NDATGTATPI

SEQ ID NO: 1858768 - protein, 10 aa, Staphylococcus
NDATGTATPL

SEQ ID NO: 1858769 - protein, 8 aa, Staphylococcus
NDAVPDAS

SEQ ID NO: 1858770 - protein, 5 aa, Staphylococcus
NDAVT

SEQ ID NO: 1858771 - protein, 7 aa, Staphylococcus
NDDDINR

SEQ ID NO: 1858772 - protein, 7 aa, Staphylococcus
NDDDTLK

SEQ ID NO: 1858773 - protein, 33 aa, Staphylococcus
NDDDTTTSNETKSEDHEHNDKKDSFTESQLNED

SEQ ID NO: 1858774 - protein, 10 aa, Staphylococcus
NDDGGEKPFT

SEQ ID NO: 1858775 - protein, 70 aa, Staphylococcus
NDDKNNDYSETNHDYSSRSDDHDHHKDALDSRHQDNKHDIQNHDDAHDSDSTDHLKEHSSYKQDRRSSVV

SEQ ID NO: 1858776 - protein, 9 aa, Staphylococcus
NDDKRTQTY

SEQ ID NO: 1858777 - protein, 50 aa, Staphylococcus
NDDKVNNDPNVSQNYKKQVESQNDDINKQVDSAKSDIKNNKNSESQISKL

SEQ ID NO: 1858778 - protein, 4 aa, Staphylococcus
NDDN

SEQ ID NO: 1858779 - protein, 42 aa, Staphylococcus
NDDPYEGKFKDEEKHNHKEMEKISKSAKDENASKHDDDHGGG

SEQ ID NO: 1858780 - protein, 7 aa, Staphylococcus
NDDQQLK

SEQ ID NO: 1858781 - protein, 23 aa, Staphylococcus
NDDTDDSNKTSNSELDKKETLYQ

SEQ ID NO: 1858782 - protein, 4 aa, Staphylococcus
NDDY

SEQ ID NO: 1858783 - protein, 9 aa, Staphylococcus
NDDYGQPYY

SEQ ID NO: 1858784 - protein, 9 aa, Staphylococcus
NDEDNKVYE

SEQ ID NO: 1858785 - protein, 8 aa, Staphylococcus
NDEDSSTI

SEQ ID NO: 1858786 - protein, 7 aa, Staphylococcus
NDEFYNS

SEQ ID NO: 1858787 - protein, 15 aa, Staphylococcus
NDEGTNTKEKPPKRS

SEQ ID NO: 1858788 - protein, 8 aa, Staphylococcus
NDEGTSVF

SEQ ID NO: 1858789 - protein, 18 aa, Staphylococcus
NDEGTTIQSNKVDIGKKI

SEQ ID NO: 1858790 - protein, 8 aa, Staphylococcus
NDEGTTVF

SEQ ID NO: 1858791 - protein, 7 aa, Staphylococcus
NDEKIER

SEQ ID NO: 1858792 - protein, 5 aa, Staphylococcus
NDELD

SEQ ID NO: 1858793 - protein, 11 aa, Staphylococcus
NDENKVEDSSY

SEQ ID NO: 1858794 - protein, 20 aa, Staphylococcus
NDEPGKVELNEDGKPNRMTD

SEQ ID NO: 1858795 - protein, 10 aa, Staphylococcus
NDESKVEDTA

SEQ ID NO: 1858796 - protein, 11 aa, Staphylococcus
NDESKVQDSSY

SEQ ID NO: 1858797 - protein, 4 aa, Staphylococcus
NDET

SEQ ID NO: 1858798 - protein, 11 aa, Staphylococcus
NDETKVEDSGY

SEQ ID NO: 1858799 - protein, 6 aa, Staphylococcus
NDEVER

SEQ ID NO: 1858800 - protein, 11 aa, Staphylococcus
NDFNTTTANAQ

SEQ ID NO: 1858801 - protein, 8 aa, Staphylococcus
NDFPKNEL

SEQ ID NO: 1858802 - protein, 53 aa, Staphylococcus
NDFRTRKRKKFKDKVDDEQSFSSSFDDNDKERKNRNNNEMDSRQYEDHNTHQY

SEQ ID NO: 1858803 - protein, 5 aa, Staphylococcus
NDGEL

SEQ ID NO: 1858804 - protein, 34 aa, Staphylococcus
NDGENKKDVGKKVEKELNKKGTGVSDGQYSFADN

SEQ ID NO: 1858805 - protein, 7 aa, Staphylococcus
NDGEQVD

SEQ ID NO: 1858806 - protein, 5 aa, Staphylococcus
NDGFR

SEQ ID NO: 1858807 - protein, 7 aa, Staphylococcus
NDGKEKF

SEQ ID NO: 1858808 - protein, 5 aa, Staphylococcus
NDGKG

SEQ ID NO: 1858809 - protein, 14 aa, Staphylococcus
NDGKNLSELSEHNK

SEQ ID NO: 1858810 - protein, 9 aa, Staphylococcus
NDGQPMTKE

SEQ ID NO: 1858811 - protein, 5 aa, Staphylococcus
NDGTT

SEQ ID NO: 1858812 - protein, 7 aa, Staphylococcus
NDGTTQI

SEQ ID NO: 1858813 - protein, 4 aa, Staphylococcus
NDHK

SEQ ID NO: 1858814 - protein, 6 aa, Staphylococcus
NDHLTN

SEQ ID NO: 1858815 - protein, 4 aa, Staphylococcus
NDHN

SEQ ID NO: 1858816 - protein, 12 aa, Staphylococcus
NDHNQSDSRRYG

SEQ ID NO: 1858817 - protein, 5 aa, Staphylococcus
NDIDD

SEQ ID NO: 1858818 - protein, 5 aa, Staphylococcus
NDIES

SEQ ID NO: 1858819 - protein, 6 aa, Staphylococcus
NDIGRN

SEQ ID NO: 1858820 - protein, 4 aa, Staphylococcus
NDIK

SEQ ID NO: 1858821 - protein, 4 aa, Staphylococcus
NDIN

SEQ ID NO: 1858822 - protein, 13 aa, Staphylococcus
NDINAVQGAAGPG

SEQ ID NO: 1858823 - protein, 6 aa, Staphylococcus
NDIPAS

SEQ ID NO: 1858824 - protein, 9 aa, Staphylococcus
NDISGDDKA

SEQ ID NO: 1858825 - protein, 7 aa, Staphylococcus
NDISRNV

SEQ ID NO: 1858826 - protein, 16 aa, Staphylococcus
NDITSEIPSYQAEQAP

SEQ ID NO: 1858827 - protein, 9 aa, Staphylococcus
NDKAKVDVA

SEQ ID NO: 1858828 - protein, 10 aa, Staphylococcus
NDKAKVDVPG

SEQ ID NO: 1858829 - protein, 9 aa, Staphylococcus
NDKAKVDVQ

SEQ ID NO: 1858830 - protein, 4 aa, Staphylococcus
NDKD

SEQ ID NO: 1858831 - protein, 5 aa, Staphylococcus
NDKDE

SEQ ID NO: 1858832 - protein, 23 aa, Staphylococcus
NDKEIGSESSSETFGPYDPDEEV

SEQ ID NO: 1858833 - protein, 45 aa, Staphylococcus
NDKEKQKDNLKEKSITNKQSTKEDSKNKQVEDTNKPKLVQPPLDK

SEQ ID NO: 1858834 - protein, 33 aa, Staphylococcus
NDKEKQLKQQGNDQEEASQNVMTESPRKRPKRQ

SEQ ID NO: 1858835 - protein, 7 aa, Staphylococcus
NDKERDQ

SEQ ID NO: 1858836 - protein, 34 aa, Staphylococcus
NDKGDKVGDINPTTTGHSKTLTFPTDKVQQGTQQ

SEQ ID NO: 1858837 - protein, 34 aa, Staphylococcus
NDKGKKVADVKPSTIGHSDTLSFSGKQLKEGTQQ

SEQ ID NO: 1858838 - protein, 8 aa, Staphylococcus
NDKGTQLT

SEQ ID NO: 1858839 - protein, 12 aa, Staphylococcus
NDKGVDIQGNKV

SEQ ID NO: 1858840 - protein, 134 aa, Staphylococcus
NDKKDSNQADNKTEQTANKDNNKDSKDKASNDSDKDKASSDKDKDKATNDDDSNDKATTDNDSSNNSSDDNSSSSDNSTSSNSSDNSSSSDNNGNNSNSDNNNGNSQATSNNSSQSNSNNNQSNSSNSGQQTHV

SEQ ID NO: 1858841 - protein, 38 aa, Staphylococcus
NDKKEVSEDKKSVKSELDSKKNIVSSVKEKSNHIEEQD

SEQ ID NO: 1858842 - protein, 9 aa, Staphylococcus
NDKKPEYYK

SEQ ID NO: 1858843 - protein, 13 aa, Staphylococcus
NDKNRTRIDDQQM

SEQ ID NO: 1858844 - protein, 13 aa, Staphylococcus
NDKSSSNSKSSSN

SEQ ID NO: 1858845 - protein, 54 aa, Staphylococcus
NDKTYDYAKAKEIGPYPKTNDITVSAEGEAKKKTFKSAETTVKTDNLKDKTKVT

SEQ ID NO: 1858846 - protein, 7 aa, Staphylococcus
NDKVTFE

SEQ ID NO: 1858847 - protein, 15 aa, Staphylococcus
NDLAGSHTGQSKTEM

SEQ ID NO: 1858848 - protein, 19 aa, Staphylococcus
NDLDGNARVTNAKAQAIQD

SEQ ID NO: 1858849 - protein, 6 aa, Staphylococcus
NDLESN

SEQ ID NO: 1858850 - protein, 7 aa, Staphylococcus
NDLKKQA

SEQ ID NO: 1858851 - protein, 8 aa, Staphylococcus
NDLKKQAD

SEQ ID NO: 1858852 - protein, 21 aa, Staphylococcus
NDLKKQADTIANPINKKTTDV

SEQ ID NO: 1858853 - protein, 19 aa, Staphylococcus
NDLKSVSKEIEEKEREIQS

SEQ ID NO: 1858854 - protein, 5 aa, Staphylococcus
NDLST

SEQ ID NO: 1858855 - protein, 11 aa, Staphylococcus
NDMDKNDVSLD

SEQ ID NO: 1858856 - protein, 24 aa, Staphylococcus
NDMKKAERIASKVDPNVTSKDELK

SEQ ID NO: 1858857 - protein, 16 aa, Staphylococcus
NDNKKSEIKNIANNQE

SEQ ID NO: 1858858 - protein, 14 aa, Staphylococcus
NDNKSSKAKSSDEN

SEQ ID NO: 1858859 - protein, 9 aa, Staphylococcus
NDNLKGTDA

SEQ ID NO: 1858860 - protein, 9 aa, Staphylococcus
NDNLKQDFQ

SEQ ID NO: 1858861 - protein, 10 aa, Staphylococcus
NDNQETPPKR

SEQ ID NO: 1858862 - protein, 6 aa, Staphylococcus
NDNVEI

SEQ ID NO: 1858863 - protein, 11 aa, Staphylococcus
NDPEKVEDSGY

SEQ ID NO: 1858864 - protein, 10 aa, Staphylococcus
NDPEKVEESA

SEQ ID NO: 1858865 - protein, 11 aa, Staphylococcus
NDPQKTGEEAL

SEQ ID NO: 1858866 - protein, 10 aa, Staphylococcus
NDPTMNGSDI

SEQ ID NO: 1858867 - protein, 47 aa, Staphylococcus; identical to SEQ ID NO: 1571504

SEQ ID NO: 1858868 - protein, 11 aa, Staphylococcus
NDQDSNRLTIT

SEQ ID NO: 1858869 - protein, 9 aa, Staphylococcus
NDQKSDRIT

SEQ ID NO: 1858870 - protein, 11 aa, Staphylococcus
NDQLDEEYSDG

SEQ ID NO: 1858871 - protein, 5 aa, Staphylococcus
NDQPA

SEQ ID NO: 1858872 - protein, 8 aa, Staphylococcus
NDQPGDVE

SEQ ID NO: 1858873 - protein, 10 aa, Staphylococcus
NDQPQNQDHY

SEQ ID NO: 1858874 - protein, 4 aa, Staphylococcus
NDQQ

SEQ ID NO: 1858875 - protein, 4 aa, Staphylococcus
NDQR

SEQ ID NO: 1858876 - protein, 33 aa, Staphylococcus
NDQSQVQSTSNYINEDQPQKTAYNNAITKGQTI

SEQ ID NO: 1858877 - protein, 11 aa, Staphylococcus
NDQSSGGSTIT

SEQ ID NO: 1858878 - protein, 9 aa, Staphylococcus
NDQVEEGQP

SEQ ID NO: 1858879 - protein, 6 aa, Staphylococcus
NDQVNY

SEQ ID NO: 1858880 - protein, 11 aa, Staphylococcus
NDRAQNPKLKT

SEQ ID NO: 1858881 - protein, 8 aa, Staphylococcus
NDRIKDTI

SEQ ID NO: 1858882 - protein, 15 aa, Staphylococcus
NDRKDLKTLAEQNKI

SEQ ID NO: 1858883 - protein, 9 aa, Staphylococcus
NDRKQNPVE

SEQ ID NO: 1858884 - protein, 5 aa, Staphylococcus
NDRRL

SEQ ID NO: 1858885 - protein, 13 aa, Staphylococcus
NDSETNEEVDNSL

SEQ ID NO: 1858886 - protein, 11 aa, Staphylococcus
NDSGNNNGQNI

SEQ ID NO: 1858887 - protein, 7 aa, Staphylococcus
NDSISSQ

SEQ ID NO: 1858888 - protein, 9 aa, Staphylococcus
NDSKGTKAI

SEQ ID NO: 1858889 - protein, 7 aa, Staphylococcus
NDSNDTH

SEQ ID NO: 1858890 - protein, 8 aa, Staphylococcus
NDSQRTSQ

SEQ ID NO: 1858891 - protein, 7 aa, Staphylococcus
NDSQTGT

SEQ ID NO: 1858892 - protein, 5 aa, Staphylococcus
NDSQV

SEQ ID NO: 1858893 - protein, 6 aa, Staphylococcus
NDSSYI

SEQ ID NO: 1858894 - protein, 17 aa, Staphylococcus
NDSTSTEAGYRSHDDRS

SEQ ID NO: 1858895 - protein, 21 aa, Staphylococcus
NDSVRKQFEKQLDEATSRQEI

SEQ ID NO: 1858896 - protein, 8 aa, Staphylococcus
NDSVTSVQ

SEQ ID NO: 1858897 - protein, 77 aa, Staphylococcus
NDTDEDLTDVGDEYNVSETDETHHSANVNAATAETSSEVQDKEDPTDRHHESNASDQDNQYNSTEDTAHEDDSRANI

SEQ ID NO: 1858898 - protein, 15 aa, Staphylococcus
NDTDEPLSDGDQTNL

SEQ ID NO: 1858899 - protein, 10 aa, Staphylococcus
NDTEGKPFSR

SEQ ID NO: 1858900 - protein, 13 aa, Staphylococcus
NDTEGKPFSRNQY

SEQ ID NO: 1858901 - protein, 9 aa, Staphylococcus
NDTENNKDI

SEQ ID NO: 1858902 - protein, 7 aa, Staphylococcus
NDTFTTN

SEQ ID NO: 1858903 - protein, 32 aa, Staphylococcus
NDTGGDSDNNTQQDKNATRQQKSALNKAKTYS

SEQ ID NO: 1858904 - protein, 11 aa, Staphylococcus
NDTKERDANLK

SEQ ID NO: 1858905 - protein, 25 aa, Staphylococcus
NDTKTEESTDDCDIEETEKEESDKV

SEQ ID NO: 1858906 - protein, 4 aa, Staphylococcus
NDTL

SEQ ID NO: 1858907 - protein, 8 aa, Staphylococcus
NDTNPNLS

SEQ ID NO: 1858908 - protein, 7 aa, Staphylococcus
NDTNSTT

SEQ ID NO: 1858909 - protein, 154 aa, Staphylococcus
NDTQSNETSEQSTEEPKTQQNKASDDVTTQEVTSTEQPTQEKTQSTSKQEVTTQETSTTEVQPKNGQSQTEEQPQHETKETSSQSNTQEAPTKETKKPTQPTTENKQSEKSNTTQQTNQKANSEVSQSNVTSTEEVTNTNETRTRTQPFSKEEM

SEQ ID NO: 1858910 - protein, 7 aa, Staphylococcus
NDTSIQK

SEQ ID NO: 1858911 - protein, 15 aa, Staphylococcus
NDTSIQNLENSMNSN

SEQ ID NO: 1858912 - protein, 5 aa, Staphylococcus
NDTTI

SEQ ID NO: 1858913 - protein, 7 aa, Staphylococcus
NDTVDKS

SEQ ID NO: 1858914 - protein, 17 aa, Staphylococcus
NDTYQVKADDKNLSSAD

SEQ ID NO: 1858915 - protein, 10 aa, Staphylococcus
NDVKTETQNV

SEQ ID NO: 1858916 - protein, 5 aa, Staphylococcus
NDVLD

SEQ ID NO: 1858917 - protein, 6 aa, Staphylococcus
NDVLTK

SEQ ID NO: 1858918 - protein, 7 aa, Staphylococcus
NDVPAQF

SEQ ID NO: 1858919 - protein, 6 aa, Staphylococcus
NDVPNS

SEQ ID NO: 1858920 - protein, 29 aa, Staphylococcus
NDVPNSENSINYQNADDDTKANFTQAKDQ

SEQ ID NO: 1858921 - protein, 4 aa, Staphylococcus
NDVS

SEQ ID NO: 1858922 - protein, 15 aa, Staphylococcus
NEADLKQGMKDEKYY

SEQ ID NO: 1858923 - protein, 16 aa, Staphylococcus
NEADVKQSDHKQDEYV

SEQ ID NO: 1858924 - protein, 5 aa, Staphylococcus
NEAEK

SEQ ID NO: 1858925 - protein, 22 aa, Staphylococcus
NEAGMGSAPNAAATAAPPHPVK

SEQ ID NO: 1858926 - protein, 5 aa, Staphylococcus
NEAGV

SEQ ID NO: 1858927 - protein, 21 aa, Staphylococcus
NEAINQAQTNQDVEDRRQQAI

SEQ ID NO: 1858928 - protein, 5 aa, Staphylococcus
NEAKM

SEQ ID NO: 1858929 - protein, 7 aa, Staphylococcus
NEANDKL

SEQ ID NO: 1858930 - protein, 7 aa, Staphylococcus
NEARISQ

SEQ ID NO: 1858931 - protein, 8 aa, Staphylococcus
NEASAKRV

SEQ ID NO: 1858932 - protein, 9 aa, Staphylococcus
NEASANKAA

SEQ ID NO: 1858933 - protein, 4 aa, Staphylococcus
NEAT

SEQ ID NO: 1858934 - protein, 9 aa, Staphylococcus
NEATTEEKE

SEQ ID NO: 1858935 - protein, 10 aa, Staphylococcus
NEAVGKVEKH

SEQ ID NO: 1858936 - protein, 6 aa, Staphylococcus
NEAVTS

SEQ ID NO: 1858937 - protein, 7 aa, Staphylococcus
NEDANEI

SEQ ID NO: 1858938 - protein, 4 aa, Staphylococcus
NEDD

SEQ ID NO: 1858939 - protein, 7 aa, Staphylococcus
NEDDASL

SEQ ID NO: 1858940 - protein, 7 aa, Staphylococcus
NEDISHG

SEQ ID NO: 1858941 - protein, 9 aa, Staphylococcus
NEDKEQDTV

SEQ ID NO: 1858942 - protein, 15 aa, Staphylococcus
NEDKGDKVRGKEINV

SEQ ID NO: 1858943 - protein, 28 aa, Staphylococcus
NEDKGDKVRGKKINVGNTLEDNLKKNDK

SEQ ID NO: 1858944 - protein, 27 aa, Staphylococcus
NEDKGDKVRGKRINVGDEVSKQLKKDN

SEQ ID NO: 1858945 - protein, 29 aa, Staphylococcus
NEDKGDTVKDKNVNVGNKITNKLKKDDNF

SEQ ID NO: 1858946 - protein, 10 aa, Staphylococcus
NEDKKTYSHY

SEQ ID NO: 1858947 - protein, 11 aa, Staphylococcus
NEDKQTAHQTI

SEQ ID NO: 1858948 - protein, 5 aa, Staphylococcus
NEDKY

SEQ ID NO: 1858949 - protein, 7 aa, Staphylococcus
NEDNCKT

SEQ ID NO: 1858950 - protein, 13 aa, Staphylococcus
NEDPEPEKQKKGL

SEQ ID NO: 1858951 - protein, 11 aa, Staphylococcus
NEDPSKSSAVK

SEQ ID NO: 1858952 - protein, 28 aa, Staphylococcus
NEDQGDKIRGKKINVGNTLEDTLKNNDK

SEQ ID NO: 1858953 - protein, 16 aa, Staphylococcus
NEDQGDKVRNKEINVG

SEQ ID NO: 1858954 - protein, 11 aa, Staphylococcus
NEDQPEQDAYK

SEQ ID NO: 1858955 - protein, 6 aa, Staphylococcus
NEDQSE

SEQ ID NO: 1858956 - protein, 17 aa, Staphylococcus
NEDSGDKIRGKKINVGD

SEQ ID NO: 1858957 - protein, 15 aa, Staphylococcus
NEDVSEKEYAAVSQQ

SEQ ID NO: 1858958 - protein, 6 aa, Staphylococcus
NEEEKV

SEQ ID NO: 1858959 - protein, 17 aa, Staphylococcus
NEEEPSDDYTVNPPGSV

SEQ ID NO: 1858960 - protein, 16 aa, Staphylococcus
NEEGEDKKKEKPPKRS

SEQ ID NO: 1858961 - protein, 5 aa, Staphylococcus
NEEGK

SEQ ID NO: 1858962 - protein, 8 aa, Staphylococcus
NEEHHYSG

SEQ ID NO: 1858963 - protein, 22 aa, Staphylococcus
NEEIKENSIETNQDEKTIEPEL

SEQ ID NO: 1858964 - protein, 5 aa, Staphylococcus
NEEKI

SEQ ID NO: 1858965 - protein, 8 aa, Staphylococcus
NEEKKPTC

SEQ ID NO: 1858966 - protein, 8 aa, Staphylococcus
NEEKKPTV

SEQ ID NO: 1858967 - protein, 4 aa, Staphylococcus
NEEL

SEQ ID NO: 1858968 - protein, 7 aa, Staphylococcus
NEENGAS

SEQ ID NO: 1858969 - protein, 5 aa, Staphylococcus
NEENV

SEQ ID NO: 1858970 - protein, 7 aa, Staphylococcus
NEEQEKL

SEQ ID NO: 1858971 - protein, 5 aa, Staphylococcus
NEEQY

SEQ ID NO: 1858972 - protein, 9 aa, Staphylococcus
NEEREQRVQ

SEQ ID NO: 1858973 - protein, 9 aa, Staphylococcus
NEETAETRN

SEQ ID NO: 1858974 - protein, 4 aa, Staphylococcus
NEEV

SEQ ID NO: 1858975 - protein, 15 aa, Staphylococcus
NEEYNKLTEDKKEPL

SEQ ID NO: 1858976 - protein, 11 aa, Staphylococcus
NEFEASDSGQV

SEQ ID NO: 1858977 - protein, 6 aa, Staphylococcus
NEFKTY

SEQ ID NO: 1858978 - protein, 10 aa, Staphylococcus
NEFPKDTQPP

SEQ ID NO: 1858979 - protein, 22 aa, Staphylococcus
NEGKSIAKELEKNGKVNYPNTG

SEQ ID NO: 1858980 - protein, 31 aa, Staphylococcus
NEGKTTSSESSDKLREGTAIEDKAKDELQNT

SEQ ID NO: 1858981 - protein, 23 aa, Staphylococcus
NEGLDQYEKNELKTSHHQYLSKG

SEQ ID NO: 1858982 - protein, 24 aa, Staphylococcus
NEGLDSYEQQELKNGEQQYLSKGA

SEQ ID NO: 1858983 - protein, 4 aa, Staphylococcus
NEGN

SEQ ID NO: 1858984 - protein, 6 aa, Staphylococcus
NEGNAA

SEQ ID NO: 1858985 - protein, 11 aa, Staphylococcus
NEGPNAKSTTD

SEQ ID NO: 1858986 - protein, 19 aa, Staphylococcus
NEGQSIESYSESKKAGHPV

SEQ ID NO: 1858987 - protein, 9 aa, Staphylococcus
NEGQTISKQ

SEQ ID NO: 1858988 - protein, 13 aa, Staphylococcus
NEGSITQDQYDKQ

SEQ ID NO: 1858989 - protein, 13 aa, Staphylococcus
NEGSTFKVTFFDE

SEQ ID NO: 1858990 - protein, 16 aa, Staphylococcus
NEGTNLDKAENDLKKE

SEQ ID NO: 1858991 - protein, 15 aa, Staphylococcus
NEGTSYKDKAPNLLT

SEQ ID NO: 1858992 - protein, 7 aa, Staphylococcus
NEHEGMS

SEQ ID NO: 1858993 - protein, 6 aa, Staphylococcus
NEHNMD

SEQ ID NO: 1858994 - protein, 4 aa, Staphylococcus
NEIE

SEQ ID NO: 1858995 - protein, 6 aa, Staphylococcus
NEIHPE

SEQ ID NO: 1858996 - protein, 11 aa, Staphylococcus
NEIKDSQVSSL

SEQ ID NO: 1858997 - protein, 14 aa, Staphylococcus
NEINDAEKSADNVS

SEQ ID NO: 1858998 - protein, 6 aa, Staphylococcus
NEINSR

SEQ ID NO: 1858999 - protein, 5 aa, Staphylococcus
NEIPT

SEQ ID NO: 1859000 - protein, 6 aa, Staphylococcus
NEIQSR

SEQ ID NO: 1859001 - protein, 5 aa, Staphylococcus
NEKDE

SEQ ID NO: 1859002 - protein, 27 aa, Staphylococcus
NEKDGTGYQSFKDTEVPSAGKTGTAEV

SEQ ID NO: 1859003 - protein, 9 aa, Staphylococcus
NEKDLENTM

SEQ ID NO: 1859004 - protein, 15 aa, Staphylococcus
NEKGNNLSGGEKQRI

SEQ ID NO: 1859005 - protein, 42 aa, Staphylococcus
NEKGQANHSSRKKRRFETTDMNSDTDENKAPSLEAETNEETM

SEQ ID NO: 1859006 - protein, 10 aa, Staphylococcus
NEKGTRPLPN

SEQ ID NO: 1859007 - protein, 10 aa, Staphylococcus
NEKHKQGEYI

SEQ ID NO: 1859008 - protein, 7 aa, Staphylococcus
NEKNGLE

SEQ ID NO: 1859009 - protein, 6 aa, Staphylococcus
NEKNHL

SEQ ID NO: 1859010 - protein, 7 aa, Staphylococcus
NEKPELK

SEQ ID NO: 1859011 - protein, 8 aa, Staphylococcus
NEKPKPAQ

SEQ ID NO: 1859012 - protein, 4 aa, Staphylococcus
NEKQ

SEQ ID NO: 1859013 - protein, 7 aa, Staphylococcus
NEKQAPK

SEQ ID NO: 1859014 - protein, 8 aa, Staphylococcus
NEKQDKLQ

SEQ ID NO: 1859015 - protein, 10 aa, Staphylococcus
NEKRKQGEYI

SEQ ID NO: 1859016 - protein, 20 aa, Staphylococcus
NEKRSETYTKLIEEENRKRY

SEQ ID NO: 1859017 - protein, 7 aa, Staphylococcus
NEKSKLP

SEQ ID NO: 1859018 - protein, 5 aa, Staphylococcus
NEKSL

SEQ ID NO: 1859019 - protein, 8 aa, Staphylococcus
NEKTGKIA

SEQ ID NO: 1859020 - protein, 7 aa, Staphylococcus
NEKTVDL

SEQ ID NO: 1859021 - protein, 45 aa, Staphylococcus; identical to SEQ ID NO: 1733856

SEQ ID NO: 1859022 - protein, 40 aa, Staphylococcus
NEKYDNEFKKKEKHNAKEMEKISKEAKDDSPSKKDDHGGG

SEQ ID NO: 1859023 - protein, 12 aa, Staphylococcus
NELASKPKRDNI

SEQ ID NO: 1859024 - protein, 8 aa, Staphylococcus
NELGGTDT

SEQ ID NO: 1859025 - protein, 7 aa, Staphylococcus
NELGPVS

SEQ ID NO: 1859026 - protein, 15 aa, Staphylococcus
NELKHGDTKPESISK

SEQ ID NO: 1859027 - protein, 18 aa, Staphylococcus
NELQKNPDSNVSRDQTIE

SEQ ID NO: 1859028 - protein, 16 aa, Staphylococcus
NELSKSGKASKQELTA

SEQ ID NO: 1859029 - protein, 9 aa, Staphylococcus
NELYEDSKP

SEQ ID NO: 1859030 - protein, 7 aa, Staphylococcus
NEMDDKS

SEQ ID NO: 1859031 - protein, 4 aa, Staphylococcus
NEME

SEQ ID NO: 1859032 - protein, 9 aa, Staphylococcus
NEMNDGHIP

SEQ ID NO: 1859033 - protein, 6 aa, Staphylococcus
NEMPLD

SEQ ID NO: 1859034 - protein, 4 aa, Staphylococcus
NEMT

SEQ ID NO: 1859035 - protein, 4 aa, Staphylococcus
NENA

SEQ ID NO: 1859036 - protein, 17 aa, Staphylococcus
NENDNTPINDRKNQATI

SEQ ID NO: 1859037 - protein, 7 aa, Staphylococcus
NENKGEA

SEQ ID NO: 1859038 - protein, 5 aa, Staphylococcus
NENKM

SEQ ID NO: 1859039 - protein, 4 aa, Staphylococcus
NENQ

SEQ ID NO: 1859040 - protein, 7 aa, Staphylococcus
NENQEKL

SEQ ID NO: 1859041 - protein, 9 aa, Staphylococcus
NENSDEFSR

SEQ ID NO: 1859042 - protein, 31 aa, Staphylococcus
NENSSGDSKSDQNVRQKSQQETDAKDELQSA

SEQ ID NO: 1859043 - protein, 31 aa, Staphylococcus
NENSSINSKSDQNVRQKTQQETEAKNELQSA

SEQ ID NO: 1859044 - protein, 5 aa, Staphylococcus
NENTN

SEQ ID NO: 1859045 - protein, 4 aa, Staphylococcus
NENV

SEQ ID NO: 1859046 - protein, 6 aa, Staphylococcus
NEPEGF

SEQ ID NO: 1859047 - protein, 10 aa, Staphylococcus
NEPGNIQRGY

SEQ ID NO: 1859048 - protein, 15 aa, Staphylococcus
NEPNATTEEKEAALQ

SEQ ID NO: 1859049 - protein, 8 aa, Staphylococcus
NEPNTREA

SEQ ID NO: 1859050 - protein, 4 aa, Staphylococcus
NEPQ

SEQ ID NO: 1859051 - protein, 8 aa, Staphylococcus
NEPQIKTT

SEQ ID NO: 1859052 - protein, 9 aa, Staphylococcus
NEPVTQGQP

SEQ ID NO: 1859053 - protein, 11 aa, Staphylococcus
NEQEVKASNFD

SEQ ID NO: 1859054 - protein, 8 aa, Staphylococcus
NEQFSTKP

SEQ ID NO: 1859055 - protein, 5 aa, Staphylococcus
NEQIA

SEQ ID NO: 1859056 - protein, 10 aa, Staphylococcus
NEQKIQSNRL

SEQ ID NO: 1859057 - protein, 8 aa, Staphylococcus
NEQQEKTE

SEQ ID NO: 1859058 - protein, 21 aa, Staphylococcus
NEQQNNVAIENQASQETINNV

SEQ ID NO: 1859059 - protein, 12 aa, Staphylococcus
NEQRSESRRPHY

SEQ ID NO: 1859060 - protein, 7 aa, Staphylococcus
NEQSFTR

SEQ ID NO: 1859061 - protein, 9 aa, Staphylococcus
NEQTEKIEK

SEQ ID NO: 1859062 - protein, 22 aa, Staphylococcus
NEQTEKVEKNVKLPSNTNVKVK

SEQ ID NO: 1859063 - protein, 27 aa, Staphylococcus
NEQTFDNESVQEQTDNQVNNDNNIDEL

SEQ ID NO: 1859064 - protein, 7 aa, Staphylococcus
NEREGME

SEQ ID NO: 1859065 - protein, 15 aa, Staphylococcus
NERTIDANTTGGNTK

SEQ ID NO: 1859066 - protein, 16 aa, Staphylococcus
NERTIDTQTADGTNKV

SEQ ID NO: 1859067 - protein, 4 aa, Staphylococcus
NESA

SEQ ID NO: 1859068 - protein, 7 aa, Staphylococcus
NESEIEN

SEQ ID NO: 1859069 - protein, 14 aa, Staphylococcus
NESIPEQITEQRFS

SEQ ID NO: 1859070 - protein, 14 aa, Staphylococcus
NESISEPIAEQRFG

SEQ ID NO: 1859071 - protein, 5 aa, Staphylococcus
NESKM

SEQ ID NO: 1859072 - protein, 6 aa, Staphylococcus
NESQTG

SEQ ID NO: 1859073 - protein, 14 aa, Staphylococcus
NESRAGKLTDTFPG

SEQ ID NO: 1859074 - protein, 12 aa, Staphylococcus
NESRLVDKAGKN

SEQ ID NO: 1859075 - protein, 8 aa, Staphylococcus
NESSKDYI

SEQ ID NO: 1859076 - protein, 10 aa, Staphylococcus
NESSPPKSSV

SEQ ID NO: 1859077 - protein, 11 aa, Staphylococcus
NESTSTSAKLD

SEQ ID NO: 1859078 - protein, 8 aa, Staphylococcus
NESVSQSP

SEQ ID NO: 1859079 - protein, 8 aa, Staphylococcus
NESVTQSP

SEQ ID NO: 1859080 - protein, 16 aa, Staphylococcus
NETANTVGTSFNTPQG

SEQ ID NO: 1859081 - protein, 8 aa, Staphylococcus
NETELPTT

SEQ ID NO: 1859082 - protein, 5 aa, Staphylococcus
NETGD

SEQ ID NO: 1859083 - protein, 6 aa, Staphylococcus
NETGDI

SEQ ID NO: 1859084 - protein, 8 aa, Staphylococcus
NETGQFDT

SEQ ID NO: 1859085 - protein, 6 aa, Staphylococcus
NETHSY

SEQ ID NO: 1859086 - protein, 7 aa, Staphylococcus
NETIDDE

SEQ ID NO: 1859087 - protein, 10 aa, Staphylococcus
NETKQTKLDK

SEQ ID NO: 1859088 - protein, 5 aa, Staphylococcus
NETLS

SEQ ID NO: 1859089 - protein, 9 aa, Staphylococcus
NETNPDLSR

SEQ ID NO: 1859090 - protein, 9 aa, Staphylococcus
NETQKANSI

SEQ ID NO: 1859091 - protein, 11 aa, Staphylococcus
NETQKQGNEVS

SEQ ID NO: 1859092 - protein, 6 aa, Staphylococcus
NETQNE

SEQ ID NO: 1859093 - protein, 7 aa, Staphylococcus
NETQQSL

SEQ ID NO: 1859094 - protein, 42 aa, Staphylococcus
NETSEHMTTSNANNSQFNNNEKYNKNKNDNNLSTSSKENSTI

SEQ ID NO: 1859095 - protein, 6 aa, Staphylococcus
NETVTY

SEQ ID NO: 1859096 - protein, 4 aa, Staphylococcus
NEVD

SEQ ID NO: 1859097 - protein, 4 aa, Staphylococcus
NEVE

SEQ ID NO: 1859098 - protein, 8 aa, Staphylococcus
NEVGNESQ

SEQ ID NO: 1859099 - protein, 9 aa, Staphylococcus
NEVNSTVDK

SEQ ID NO: 1859100 - protein, 11 aa, Staphylococcus
NEYDDKKERDI

SEQ ID NO: 1859101 - protein, 10 aa, Staphylococcus
NEYETLKRQP

SEQ ID NO: 1859102 - protein, 13 aa, Staphylococcus
NEYETLKSEGNYV

SEQ ID NO: 1859103 - protein, 7 aa, Staphylococcus
NEYGTLS

SEQ ID NO: 1859104 - protein, 5 aa, Staphylococcus
NEYGV

SEQ ID NO: 1859105 - protein, 5 aa, Staphylococcus
NEYKE

SEQ ID NO: 1859106 - protein, 10 aa, Staphylococcus
NEYKNEEQEK

SEQ ID NO: 1859107 - protein, 16 aa, Staphylococcus
NFASNRELNNLQENTG

SEQ ID NO: 1859108 - protein, 7 aa, Staphylococcus
NFEPMSA

SEQ ID NO: 1859109 - protein, 8 aa, Staphylococcus
NFGAPKDV

SEQ ID NO: 1859110 - protein, 9 aa, Staphylococcus
NFKAKSAIS

SEQ ID NO: 1859111 - protein, 11 aa, Staphylococcus
NFKDPGPKNAV

SEQ ID NO: 1859112 - protein, 11 aa, Staphylococcus
NFKDPGSKNAV

SEQ ID NO: 1859113 - protein, 11 aa, Staphylococcus
NFKEPGPNNAV

SEQ ID NO: 1859114 - protein, 5 aa, Staphylococcus
NFKPE

SEQ ID NO: 1859115 - protein, 8 aa, Staphylococcus
NFKREKDS

SEQ ID NO: 1859116 - protein, 13 aa, Staphylococcus
NFNTNNVDNTSTT

SEQ ID NO: 1859117 - protein, 5 aa, Staphylococcus
NFPVN

SEQ ID NO: 1859118 - protein, 4 aa, Staphylococcus
NFQQ

SEQ ID NO: 1859119 - protein, 17 aa, Staphylococcus
NFRNRSKDGLTSDELQA

SEQ ID NO: 1859120 - protein, 6 aa, Staphylococcus
NFSAEP

SEQ ID NO: 1859121 - protein, 7 aa, Staphylococcus
NFSGNSY

SEQ ID NO: 1859122 - protein, 7 aa, Staphylococcus
NFSKDEV

SEQ ID NO: 1859123 - protein, 11 aa, Staphylococcus
NFSRPSVAGTA

SEQ ID NO: 1859124 - protein, 27 aa, Staphylococcus
NFTDTSNGAEIPTAATESAMDAASTIP

SEQ ID NO: 1859125 - protein, 7 aa, Staphylococcus
NFTGDTQ

SEQ ID NO: 1859126 - protein, 11 aa, Staphylococcus
NFTKNDNSKRK

SEQ ID NO: 1859127 - protein, 13 aa, Staphylococcus
NFTKNDNSKRKPV

SEQ ID NO: 1859128 - protein, 6 aa, Staphylococcus
NFVPTK

SEQ ID NO: 1859129 - protein, 4 aa, Staphylococcus
NGAA

SEQ ID NO: 1859130 - protein, 15 aa, Staphylococcus
NGAKELSQAAKDPAN

SEQ ID NO: 1859131 - protein, 10 aa, Staphylococcus
NGANITGIAS

SEQ ID NO: 1859132 - protein, 4 aa, Staphylococcus
NGAS

SEQ ID NO: 1859133 - protein, 5 aa, Staphylococcus
NGASE

SEQ ID NO: 1859134 - protein, 29 aa, Staphylococcus
NGATGAESESDQNVTKSTQQESEAKEELQ

SEQ ID NO: 1859135 - protein, 6 aa, Staphylococcus
NGATMS

SEQ ID NO: 1859136 - protein, 27 aa, Staphylococcus
NGATVNEASNSKGGNQLYGKSDKYSSV

SEQ ID NO: 1859137 - protein, 9 aa, Staphylococcus
NGAVKNDGK

SEQ ID NO: 1859138 - protein, 4 aa, Staphylococcus
NGAY

SEQ ID NO: 1859139 - protein, 8 aa, Staphylococcus
NGDDLPTN

SEQ ID NO: 1859140 - protein, 34 aa, Staphylococcus
NGDDSNSGGSQVQQATNDKGGNVLDGKSDKYKSV

SEQ ID NO: 1859141 - protein, 15 aa, Staphylococcus
NGDEMENINKQEHID

SEQ ID NO: 1859142 - protein, 4 aa, Staphylococcus
NGDG

SEQ ID NO: 1859143 - protein, 6 aa, Staphylococcus
NGDITT

SEQ ID NO: 1859144 - protein, 10 aa, Staphylococcus
NGDKDYSGTA

SEQ ID NO: 1859145 - protein, 10 aa, Staphylococcus
NGDKHSGETL

SEQ ID NO: 1859146 - protein, 9 aa, Staphylococcus
NGDKKVNTH

SEQ ID NO: 1859147 - protein, 9 aa, Staphylococcus
NGDKYEISD

SEQ ID NO: 1859148 - protein, 12 aa, Staphylococcus
NGDNTYKKGNVN

SEQ ID NO: 1859149 - protein, 8 aa, Staphylococcus
NGEEGLGG

SEQ ID NO: 1859150 - protein, 5 aa, Staphylococcus
NGEGI

SEQ ID NO: 1859151 - protein, 10 aa, Staphylococcus
NGEGKNYVDP

SEQ ID NO: 1859152 - protein, 13 aa, Staphylococcus
NGEKTEGMPATGH

SEQ ID NO: 1859153 - protein, 5 aa, Staphylococcus
NGELF

SEQ ID NO: 1859154 - protein, 7 aa, Staphylococcus
NGEPNVR

SEQ ID NO: 1859155 - protein, 8 aa, Staphylococcus
NGEPPQSI

SEQ ID NO: 1859156 - protein, 11 aa, Staphylococcus
NGERSQQSTHD

SEQ ID NO: 1859157 - protein, 10 aa, Staphylococcus
NGESAQTRVQ

SEQ ID NO: 1859158 - protein, 8 aa, Staphylococcus
NGESISSI

SEQ ID NO: 1859159 - protein, 9 aa, Staphylococcus
NGESTQTRI

SEQ ID NO: 1859160 - protein, 9 aa, Staphylococcus
NGESTQTRV

SEQ ID NO: 1859161 - protein, 14 aa, Staphylococcus
NGEVEYKNGRYSDF

SEQ ID NO: 1859162 - protein, 5 aa, Staphylococcus
NGFKP

SEQ ID NO: 1859163 - protein, 5 aa, Staphylococcus
NGFNT

SEQ ID NO: 1859164 - protein, 6 aa, Staphylococcus
NGGEAI

SEQ ID NO: 1859165 - protein, 16 aa, Staphylococcus
NGGGPPRGGGRRRDDS

SEQ ID NO: 1859166 - protein, 6 aa, Staphylococcus
NGGHPV

SEQ ID NO: 1859167 - protein, 12 aa, Staphylococcus
NGGNNYRKHSKN

SEQ ID NO: 1859168 - protein, 6 aa, Staphylococcus
NGGRQT

SEQ ID NO: 1859169 - protein, 9 aa, Staphylococcus
NGGSTRTRV

SEQ ID NO: 1859170 - protein, 14 aa, Staphylococcus
NGHDSTERPKKKKK

SEQ ID NO: 1859171 - protein, 6 aa, Staphylococcus
NGHGGS

SEQ ID NO: 1859172 - protein, 15 aa, Staphylococcus
NGHIEDIASYKLKLI

SEQ ID NO: 1859173 - protein, 8 aa, Staphylococcus
NGIEAGDL

SEQ ID NO: 1859174 - protein, 5 aa, Staphylococcus
NGIGI

SEQ ID NO: 1859175 - protein, 6 aa, Staphylococcus
NGIGIP

SEQ ID NO: 1859176 - protein, 13 aa, Staphylococcus
NGIPRAKYKEYED

SEQ ID NO: 1859177 - protein, 10 aa, Staphylococcus
NGISEHAKGV

SEQ ID NO: 1859178 - protein, 31 aa, Staphylococcus
NGKAYDNKTNQPLTKEPADLQKNKQQVEKDL

SEQ ID NO: 1859179 - protein, 31 aa, Staphylococcus
NGKAYSNKTNELLETQPKDLDKNKKQVEKDL

SEQ ID NO: 1859180 - protein, 8 aa, Staphylococcus
NGKDLGKV

SEQ ID NO: 1859181 - protein, 11 aa, Staphylococcus
NGKDPEKATKE

SEQ ID NO: 1859182 - protein, 14 aa, Staphylococcus
NGKEDSEHPAPITT

SEQ ID NO: 1859183 - protein, 14 aa, Staphylococcus
NGKEVAQATVKDGK

SEQ ID NO: 1859184 - protein, 11 aa, Staphylococcus
NGKGLNDTEDI

SEQ ID NO: 1859185 - protein, 10 aa, Staphylococcus
NGKIDATNVR

SEQ ID NO: 1859186 - protein, 8 aa, Staphylococcus
NGKIERPS

SEQ ID NO: 1859187 - protein, 6 aa, Staphylococcus
NGKIPG

SEQ ID NO: 1859188 - protein, 10 aa, Staphylococcus
NGKLASTTNT

SEQ ID NO: 1859189 - protein, 11 aa, Staphylococcus
NGKLASTTNTL

SEQ ID NO: 1859190 - protein, 24 aa, Staphylococcus
NGKLNQNTLATVGDKGKGNGPGGF

SEQ ID NO: 1859191 - protein, 6 aa, Staphylococcus
NGKLSL

SEQ ID NO: 1859192 - protein, 17 aa, Staphylococcus
NGKNGKSKAKKNKNVKR

SEQ ID NO: 1859193 - protein, 8 aa, Staphylococcus
NGKQVDAK

SEQ ID NO: 1859194 - protein, 6 aa, Staphylococcus
NGKQVE

SEQ ID NO: 1859195 - protein, 8 aa, Staphylococcus
NGKQVSEH

SEQ ID NO: 1859196 - protein, 5 aa, Staphylococcus
NGKQY

SEQ ID NO: 1859197 - protein, 13 aa, Staphylococcus
NGKTAKPEEAGIG

SEQ ID NO: 1859198 - protein, 7 aa, Staphylococcus
NGKTATL

SEQ ID NO: 1859199 - protein, 13 aa, Staphylococcus
NGKVENKNYTSYL

SEQ ID NO: 1859200 - protein, 7 aa, Staphylococcus
NGKVENV

SEQ ID NO: 1859201 - protein, 9 aa, Staphylococcus
NGLGSGAAN

SEQ ID NO: 1859202 - protein, 4 aa, Staphylococcus
NGLK

SEQ ID NO: 1859203 - protein, 4 aa, Staphylococcus
NGLQ

SEQ ID NO: 1859204 - protein, 6 aa, Staphylococcus
NGLSGS

SEQ ID NO: 1859205 - protein, 7 aa, Staphylococcus
NGMSPKS

SEQ ID NO: 1859206 - protein, 10 aa, Staphylococcus
NGNENNNRGV

SEQ ID NO: 1859207 - protein, 19 aa, Staphylococcus
NGNGTEITLEKPAIKQVDP

SEQ ID NO: 1859208 - protein, 17 aa, Staphylococcus
NGNGYSNNLDPYSTQNY

SEQ ID NO: 1859209 - protein, 7 aa, Staphylococcus
NGNMPKQ

SEQ ID NO: 1859210 - protein, 5 aa, Staphylococcus
NGNQR

SEQ ID NO: 1859211 - protein, 8 aa, Staphylococcus
NGNSMEGN

SEQ ID NO: 1859212 - protein, 8 aa, Staphylococcus
NGNSSASS

SEQ ID NO: 1859213 - protein, 9 aa, Staphylococcus
NGNSYGKSG

SEQ ID NO: 1859214 - protein, 16 aa, Staphylococcus
NGNTGHSSFPSGHTGN

SEQ ID NO: 1859215 - protein, 16 aa, Staphylococcus
NGNVNEENKLGRISKE

SEQ ID NO: 1859216 - protein, 4 aa, Staphylococcus
NGNW

SEQ ID NO: 1859217 - protein, 4 aa, Staphylococcus
NGNY

SEQ ID NO: 1859218 - protein, 9 aa, Staphylococcus
NGQDIPTNT

SEQ ID NO: 1859219 - protein, 5 aa, Staphylococcus
NGQEM

SEQ ID NO: 1859220 - protein, 4 aa, Staphylococcus
NGQH

SEQ ID NO: 1859221 - protein, 15 aa, Staphylococcus
NGQMYQPTEISQSTK

SEQ ID NO: 1859222 - protein, 10 aa, Staphylococcus
NGQQETPEEL

SEQ ID NO: 1859223 - protein, 9 aa, Staphylococcus
NGQQTVSRI

SEQ ID NO: 1859224 - protein, 8 aa, Staphylococcus
NGQSYKVE

SEQ ID NO: 1859225 - protein, 8 aa, Staphylococcus
NGQTKETV

SEQ ID NO: 1859226 - protein, 28 aa, Staphylococcus
NGQTPEEAALDHDDNNQNHYNEDTTYEY

SEQ ID NO: 1859227 - protein, 4 aa, Staphylococcus
NGQV

SEQ ID NO: 1859228 - protein, 10 aa, Staphylococcus
NGQVEYKNGK

SEQ ID NO: 1859229 - protein, 22 aa, Staphylococcus
NGRDYRREQELQEENQKTRKSK

SEQ ID NO: 1859230 - protein, 17 aa, Staphylococcus
NGREIVPSRKGQLPPEQ

SEQ ID NO: 1859231 - protein, 32 aa, Staphylococcus
NGRGHNSGRNSSSYFPQNHYDEGPVANNQRQS

SEQ ID NO: 1859232 - protein, 8 aa, Staphylococcus
NGRGNQLT

SEQ ID NO: 1859233 - protein, 9 aa, Staphylococcus
NGRKGTKPA

SEQ ID NO: 1859234 - protein, 6 aa, Staphylococcus
NGRYTQ

SEQ ID NO: 1859235 - protein, 48 aa, Staphylococcus
NGSAQAEEINKTNSTTSPKTIQTESNKTNTTTSNNETHHKSSKNLNDY

SEQ ID NO: 1859236 - protein, 14 aa, Staphylococcus
NGSASSSNSLNQGS

SEQ ID NO: 1859237 - protein, 8 aa, Staphylococcus
NGSDIEQR

SEQ ID NO: 1859238 - protein, 6 aa, Staphylococcus
NGSEWS

SEQ ID NO: 1859239 - protein, 8 aa, Staphylococcus
NGSGAAIV

SEQ ID NO: 1859240 - protein, 13 aa, Staphylococcus
NGSISQEQYDKQL

SEQ ID NO: 1859241 - protein, 7 aa, Staphylococcus
NGSMGEI

SEQ ID NO: 1859242 - protein, 22 aa, Staphylococcus
NGSNLGEGGGIGSINSYQTSYR

SEQ ID NO: 1859243 - protein, 5 aa, Staphylococcus
NGSNT

SEQ ID NO: 1859244 - protein, 5 aa, Staphylococcus
NGSPL

SEQ ID NO: 1859245 - protein, 10 aa, Staphylococcus
NGTGNALSTY

SEQ ID NO: 1859246 - protein, 9 aa, Staphylococcus
NGTGTALSA

SEQ ID NO: 1859247 - protein, 5 aa, Staphylococcus
NGTHS

SEQ ID NO: 1859248 - protein, 10 aa, Staphylococcus
NGTKKVRPGT

SEQ ID NO: 1859249 - protein, 8 aa, Staphylococcus
NGTLTTNE

SEQ ID NO: 1859250 - protein, 10 aa, Staphylococcus
NGTPITEGTV

SEQ ID NO: 1859251 - protein, 8 aa, Staphylococcus
NGTRNAIE

SEQ ID NO: 1859252 - protein, 11 aa, Staphylococcus
NGTTPYRGHEK

SEQ ID NO: 1859253 - protein, 20 aa, Staphylococcus
NGVGIDGEVASSLKSIRERT

SEQ ID NO: 1859254 - protein, 9 aa, Staphylococcus
NGVGISKAD

SEQ ID NO: 1859255 - protein, 9 aa, Staphylococcus
NGVKGAANG

SEQ ID NO: 1859256 - protein, 30 aa, Staphylococcus
NGVSSAKIKETQESTYAAKATNTQGNGEVN

SEQ ID NO: 1859257 - protein, 22 aa, Staphylococcus
NGYDTEVGERGVKLSGGQKQRL

SEQ ID NO: 1859258 - protein, 6 aa, Staphylococcus
NGYSGL

SEQ ID NO: 1859259 - protein, 22 aa, Staphylococcus
NGYSKVTEAYQPESAINVSQDG

SEQ ID NO: 1859260 - protein, 55 aa, Staphylococcus
NHDDSESADNLSSTKDASTLTNESTTESEATYSKNRPQTKKTEKAKSKIDKRTFN

SEQ ID NO: 1859261 - protein, 5 aa, Staphylococcus
NHDTV

SEQ ID NO: 1859262 - protein, 5 aa, Staphylococcus
NHENS

SEQ ID NO: 1859263 - protein, 15 aa, Staphylococcus
NHENTGRIIIDFNAS

SEQ ID NO: 1859264 - protein, 6 aa, Staphylococcus
NHEPKV

SEQ ID NO: 1859265 - protein, 6 aa, Staphylococcus
NHEQSI

SEQ ID NO: 1859266 - protein, 12 aa, Staphylococcus
NHETQKVANGSF

SEQ ID NO: 1859267 - protein, 9 aa, Staphylococcus
NHGDSGEPI

SEQ ID NO: 1859268 - protein, 8 aa, Staphylococcus
NHGEVDGN

SEQ ID NO: 1859269 - protein, 8 aa, Staphylococcus
NHGGTLES

SEQ ID NO: 1859270 - protein, 4 aa, Staphylococcus
NHGV

SEQ ID NO: 1859271 - protein, 6 aa, Staphylococcus
NHHHQS

SEQ ID NO: 1859272 - protein, 8 aa, Staphylococcus
NHHNSSQL

SEQ ID NO: 1859273 - protein, 33 aa, Staphylococcus
NHHSDDKENDDDKGNDKYSKKDSVKTSNKNDNF

SEQ ID NO: 1859274 - protein, 4 aa, Staphylococcus
NHIK

SEQ ID NO: 1859275 - protein, 5 aa, Staphylococcus
NHKAD

SEQ ID NO: 1859276 - protein, 9 aa, Staphylococcus
NHKDGKQVI

SEQ ID NO: 1859277 - protein, 7 aa, Staphylococcus
NHKGEVI

SEQ ID NO: 1859278 - protein, 22 aa, Staphylococcus
NHKKPGTKNYGVASNNAIATKI

SEQ ID NO: 1859279 - protein, 8 aa, Staphylococcus
NHKPLTKG

SEQ ID NO: 1859280 - protein, 60 aa, Staphylococcus
NHNHDNEERSQFGSRSDRYQDEANKDLNDFDKDRHDHKDNDFVRDEADKLKDKKDNDPYK

SEQ ID NO: 1859281 - protein, 12 aa, Staphylococcus
NHNHQLNQKQQV

SEQ ID NO: 1859282 - protein, 5 aa, Staphylococcus
NHNHR

SEQ ID NO: 1859283 - protein, 9 aa, Staphylococcus
NHNNFEPTH

SEQ ID NO: 1859284 - protein, 132 aa, Staphylococcus
NHNNSKNDDNKVSDQSKKDSDKKANDKDKASSDKDKDKNKDGNKDSDKDKASSNNSASNSDENGNSANGGAAGSDQNANSTDNSSNQNGTANNQNQGTQNNQQNNGNSTQGNNNNQQNTQGQQSHTVNGKEN

SEQ ID NO: 1859285 - protein, 5 aa, Staphylococcus
NHNPL

SEQ ID NO: 1859286 - protein, 11 aa, Staphylococcus
NHPAFNKNSTQ

SEQ ID NO: 1859287 - protein, 8 aa, Staphylococcus
NHPDELDG

SEQ ID NO: 1859288 - protein, 7 aa, Staphylococcus
NHPKAKR

SEQ ID NO: 1859289 - protein, 7 aa, Staphylococcus
NHPKAKS

SEQ ID NO: 1859290 - protein, 11 aa, Staphylococcus
NHPQGSQGATE

SEQ ID NO: 1859291 - protein, 7 aa, Staphylococcus
NHQGTRT

SEQ ID NO: 1859292 - protein, 10 aa, Staphylococcus
NHQISDASQL

SEQ ID NO: 1859293 - protein, 24 aa, Staphylococcus
NHQSDLQKAHDDYKKTLDERIETN

SEQ ID NO: 1859294 - protein, 8 aa, Staphylococcus
NHQTSKKY

SEQ ID NO: 1859295 - protein, 16 aa, Staphylococcus
NHRPSVDEEDESENSD

SEQ ID NO: 1859296 - protein, 5 aa, Staphylococcus
NHSES

SEQ ID NO: 1859297 - protein, 12 aa, Staphylococcus
NHSKSSSDTASI

SEQ ID NO: 1859298 - protein, 6 aa, Staphylococcus
NHSNDT

SEQ ID NO: 1859299 - protein, 12 aa, Staphylococcus
NHSNELSTTVTS

SEQ ID NO: 1859300 - protein, 132 aa, Staphylococcus
NHSNSGNDDNKIANEDSKDGKKNNDTSKDKNSSKDKDSSKDKDKSKDSDKDKATTSDESDSSDASNSDKNSASDNTNGANSQASNSQSQNGSNSQNGQGQNSQQNGQQGSNSQNSNSNQQGKQTHTVNGKEN

SEQ ID NO: 1859301 - protein, 12 aa, Staphylococcus
NHSRQEKLPKKT

SEQ ID NO: 1859302 - protein, 5 aa, Staphylococcus
NHSSL

SEQ ID NO: 1859303 - protein, 34 aa, Staphylococcus
NHTSLNQNGSQVQEATNSKGGNRLDGKSEKYNSV

SEQ ID NO: 1859304 - protein, 6 aa, Staphylococcus
NHVKGS

SEQ ID NO: 1859305 - protein, 14 aa, Staphylococcus
NIADEYDVDPRKSA

SEQ ID NO: 1859306 - protein, 6 aa, Staphylococcus
NIAEEK

SEQ ID NO: 1859307 - protein, 11 aa, Staphylococcus
NIAKEATETAT

SEQ ID NO: 1859308 - protein, 6 aa, Staphylococcus
NIAQSA

SEQ ID NO: 1859309 - protein, 4 aa, Staphylococcus
NIDE

SEQ ID NO: 1859310 - protein, 9 aa, Staphylococcus
NIDKPDNVK

SEQ ID NO: 1859311 - protein, 5 aa, Staphylococcus
NIDKY

SEQ ID NO: 1859312 - protein, 6 aa, Staphylococcus
NIDNEP

SEQ ID NO: 1859313 - protein, 29 aa, Staphylococcus
NIDQEFNHDNNGQPITSQDSNNNVDSGFN

SEQ ID NO: 1859314 - protein, 4 aa, Staphylococcus
NIDR

SEQ ID NO: 1859315 - protein, 13 aa, Staphylococcus
NIEESDKHDLSEQ

SEQ ID NO: 1859316 - protein, 29 aa, Staphylococcus
NIEPEQTSEISQESNDSNKTQSSKNQSQH

SEQ ID NO: 1859317 - protein, 7 aa, Staphylococcus
NIEPQSG

SEQ ID NO: 1859318 - protein, 13 aa, Staphylococcus
NIGDNSKVTNEKR

SEQ ID NO: 1859319 - protein, 6 aa, Staphylococcus
NIGKKI

SEQ ID NO: 1859320 - protein, 20 aa, Staphylococcus
NIGNVGTKPTNPLNQSEKKK

SEQ ID NO: 1859321 - protein, 4 aa, Staphylococcus
NIGP

SEQ ID NO: 1859322 - protein, 12 aa, Staphylococcus
NIHNANEEKEIH

SEQ ID NO: 1859323 - protein, 16 aa, Staphylococcus
NIINDNPDPTLSNSDV

SEQ ID NO: 1859324 - protein, 4 aa, Staphylococcus
NIIP

SEQ ID NO: 1859325 - protein, 12 aa, Staphylococcus
NIKDAGKGMGMT

SEQ ID NO: 1859326 - protein, 13 aa, Staphylococcus
NIKDAGKGMGMTS

SEQ ID NO: 1859327 - protein, 34 aa, Staphylococcus
NIKDNKEGKDVKSKLEAVDKASSMNAKADKLSQL

SEQ ID NO: 1859328 - protein, 24 aa, Staphylococcus
NIKDSQKDASIKEITKAKSTEEVE

SEQ ID NO: 1859329 - protein, 17 aa, Staphylococcus
NIKGNNNVSKSKINKEL

SEQ ID NO: 1859330 - protein, 4 aa, Staphylococcus
NIKK

SEQ ID NO: 1859331 - protein, 8 aa, Staphylococcus
NIKKGSRI

SEQ ID NO: 1859332 - protein, 13 aa, Staphylococcus
NIKNGEDAGDGQP

SEQ ID NO: 1859333 - protein, 12 aa, Staphylococcus
NIKPNVDKPIKE

SEQ ID NO: 1859334 - protein, 9 aa, Staphylococcus
NIKQDDDYI

SEQ ID NO: 1859335 - protein, 7 aa, Staphylococcus
NINNPGN

SEQ ID NO: 1859336 - protein, 6 aa, Staphylococcus
NINQSA

SEQ ID NO: 1859337 - protein, 6 aa, Staphylococcus
NINTKV

SEQ ID NO: 1859338 - protein, 17 aa, Staphylococcus
NIPEDTITTINEKGHKV

SEQ ID NO: 1859339 - protein, 7 aa, Staphylococcus
NIPGPSS

SEQ ID NO: 1859340 - protein, 5 aa, Staphylococcus
NIPGV

SEQ ID NO: 1859341 - protein, 8 aa, Staphylococcus
NIPSGKDL

SEQ ID NO: 1859342 - protein, 11 aa, Staphylococcus
NIQENKQNQAD

SEQ ID NO: 1859343 - protein, 5 aa, Staphylococcus
NIRPI

SEQ ID NO: 1859344 - protein, 8 aa, Staphylococcus
NIRQGVEK

SEQ ID NO: 1859345 - protein, 9 aa, Staphylococcus
NIRSGVEKS

SEQ ID NO: 1859346 - protein, 8 aa, Staphylococcus
NIRTGVEK

SEQ ID NO: 1859347 - protein, 58 aa, Staphylococcus
NISKEVDESQLKEKETLTNEESSNNKVTEQANQTKSQIKDLKDEVDNLAKQSENLNSD

SEQ ID NO: 1859348 - protein, 12 aa, Staphylococcus
NISNGDIKEKSK

SEQ ID NO: 1859349 - protein, 6 aa, Staphylococcus
NISQTG

SEQ ID NO: 1859350 - protein, 5 aa, Staphylococcus
NISQY

SEQ ID NO: 1859351 - protein, 14 aa, Staphylococcus
NISSEATKARITIP

SEQ ID NO: 1859352 - protein, 14 aa, Staphylococcus
NISYKDERDRTDSV

SEQ ID NO: 1859353 - protein, 15 aa, Staphylococcus
NISYKDERDRTDSVK

SEQ ID NO: 1859354 - protein, 7 aa, Staphylococcus
NITDGAE

SEQ ID NO: 1859355 - protein, 4 aa, Staphylococcus
NITF

SEQ ID NO: 1859356 - protein, 4 aa, Staphylococcus
NITG

SEQ ID NO: 1859357 - protein, 23 aa, Staphylococcus
NITGKEASTTSEVKAQGNKNMNP

SEQ ID NO: 1859358 - protein, 6 aa, Staphylococcus
NITNKP

SEQ ID NO: 1859359 - protein, 19 aa, Staphylococcus
NITSKQGTTIDIMIPREGV

SEQ ID NO: 1859360 - protein, 10 aa, Staphylococcus
NITSTSQSVS

SEQ ID NO: 1859361 - protein, 17 aa, Staphylococcus
NITTSNTKATTPSSTTH

SEQ ID NO: 1859362 - protein, 14 aa, Staphylococcus
NITYDDDKTATATV

SEQ ID NO: 1859363 - protein, 4 aa, Staphylococcus
NIVP

SEQ ID NO: 1859364 - protein, 13 aa, Staphylococcus
NIYNQNASQMDPA

SEQ ID NO: 1859365 - protein, 10 aa, Staphylococcus
NKAADEYGVP

SEQ ID NO: 1859366 - protein, 60 aa, Staphylococcus
NKAAEAKKAEIDQTPNATDEEKAAAKAKVDEAVTTAKNAIDQATNNAGVDTAKTNGVDSI

SEQ ID NO: 1859367 - protein, 7 aa, Staphylococcus
NKAAEEF

SEQ ID NO: 1859368 - protein, 9 aa, Staphylococcus
NKAAEEYNV

SEQ ID NO: 1859369 - protein, 16 aa, Staphylococcus
NKAEEIGKDNTKSNQY

SEQ ID NO: 1859370 - protein, 29 aa, Staphylococcus
NKAEKEAIKQIENSNSVDQINKVKDDSLN

SEQ ID NO: 1859371 - protein, 8 aa, Staphylococcus
NKAFDETV

SEQ ID NO: 1859372 - protein, 14 aa, Staphylococcus
NKAFKTAKSELEAK

SEQ ID NO: 1859373 - protein, 8 aa, Staphylococcus
NKAGDEKG

SEQ ID NO: 1859374 - protein, 6 aa, Staphylococcus
NKAGKN

SEQ ID NO: 1859375 - protein, 13 aa, Staphylococcus
NKAKGNALTNAEV

SEQ ID NO: 1859376 - protein, 25 aa, Staphylococcus
NKAKNDINRFTDDTEVENTKNKAIN

SEQ ID NO: 1859377 - protein, 8 aa, Staphylococcus
NKAKSLMK

SEQ ID NO: 1859378 - protein, 8 aa, Staphylococcus
NKAPKQVK

SEQ ID NO: 1859379 - protein, 12 aa, Staphylococcus
NKATDKGLQKTE

SEQ ID NO: 1859380 - protein, 19 aa, Staphylococcus
NKATNQEDVDHAKQSGQDQ

SEQ ID NO: 1859381 - protein, 10 aa, Staphylococcus
NKATTNQAVD

SEQ ID NO: 1859382 - protein, 10 aa, Staphylococcus
NKATTRDNVT

SEQ ID NO: 1859383 - protein, 17 aa, Staphylococcus
NKAYSDNPKFNIGDNPA

SEQ ID NO: 1859384 - protein, 10 aa, Staphylococcus
NKDHQKDNDN

SEQ ID NO: 1859385 - protein, 4 aa, Staphylococcus
NKDI

SEQ ID NO: 1859386 - protein, 18 aa, Staphylococcus
NKDIADAGLSEKATKEYQ

SEQ ID NO: 1859387 - protein, 8 aa, Staphylococcus
NKDIYDKS

SEQ ID NO: 1859388 - protein, 4 aa, Staphylococcus
NKDK

SEQ ID NO: 1859389 - protein, 5 aa, Staphylococcus
NKDKI

SEQ ID NO: 1859390 - protein, 7 aa, Staphylococcus
NKDKVSQ

SEQ ID NO: 1859391 - protein, 10 aa, Staphylococcus
NKDLEKSSQF

SEQ ID NO: 1859392 - protein, 16 aa, Staphylococcus
NKDMKRSIDQYSANHG

SEQ ID NO: 1859393 - protein, 189 aa, Staphylococcus
NKDNHDIKDKDSAHNKHSKDKHHDKADHLNDDNRKHHHDVEDRHDRDVEGRDARKGFDADRRDDNRHGADHHDVDRRDANHQDTDRRFEDTERRHDDRNVEGRDARNGFDADRRDDNRHGADHHDVDRRDANYQDTDRRFEDTERRHDDRNVEGRDARNGFDADRRDDNRRDTDHSQDHFENETHNKDN

SEQ ID NO: 1859394 - protein, 8 aa, Staphylococcus
NKDNPNAV

SEQ ID NO: 1859395 - protein, 14 aa, Staphylococcus
NKDPEPEKEKKGIK

SEQ ID NO: 1859396 - protein, 6 aa, Staphylococcus
NKDPKY

SEQ ID NO: 1859397 - protein, 7 aa, Staphylococcus
NKDQNTL

SEQ ID NO: 1859398 - protein, 5 aa, Staphylococcus
NKDSK

SEQ ID NO: 1859399 - protein, 7 aa, Staphylococcus
NKDTIDR

SEQ ID NO: 1859400 - protein, 14 aa, Staphylococcus
NKDVSEKEYAAVSQ

SEQ ID NO: 1859401 - protein, 4 aa, Staphylococcus
NKDY

SEQ ID NO: 1859402 - protein, 15 aa, Staphylococcus
NKEAPPYRRKSKESL

SEQ ID NO: 1859403 - protein, 18 aa, Staphylococcus
NKEDGLKDKTTKKDIEDA

SEQ ID NO: 1859404 - protein, 7 aa, Staphylococcus
NKEDNKT

SEQ ID NO: 1859405 - protein, 9 aa, Staphylococcus
NKEGSRFKQ

SEQ ID NO: 1859406 - protein, 31 aa, Staphylococcus
NKEHKNGKYLTGSFKSSDLQNANGETKIPKD

SEQ ID NO: 1859407 - protein, 11 aa, Staphylococcus
NKELASKNVDY

SEQ ID NO: 1859408 - protein, 5 aa, Staphylococcus
NKELT

SEQ ID NO: 1859409 - protein, 6 aa, Staphylococcus
NKENNL

SEQ ID NO: 1859410 - protein, 11 aa, Staphylococcus
NKEPEIQRESK

SEQ ID NO: 1859411 - protein, 12 aa, Staphylococcus
NKEPEMKRESKN

SEQ ID NO: 1859412 - protein, 12 aa, Staphylococcus
NKEPEMQRESKN

SEQ ID NO: 1859413 - protein, 6 aa, Staphylococcus
NKEPEN

SEQ ID NO: 1859414 - protein, 13 aa, Staphylococcus
NKEPKAASTLKSS

SEQ ID NO: 1859415 - protein, 7 aa, Staphylococcus
NKEPKVK

SEQ ID NO: 1859416 - protein, 18 aa, Staphylococcus
NKEQTIANSQYTKTADHM

SEQ ID NO: 1859417 - protein, 7 aa, Staphylococcus
NKERKEL

SEQ ID NO: 1859418 - protein, 4 aa, Staphylococcus
NKFG

SEQ ID NO: 1859419 - protein, 14 aa, Staphylococcus
NKGASYTAKAPNLL

SEQ ID NO: 1859420 - protein, 4 aa, Staphylococcus
NKGD

SEQ ID NO: 1859421 - protein, 8 aa, Staphylococcus
NKGDLSLN

SEQ ID NO: 1859422 - protein, 5 aa, Staphylococcus
NKGDT

SEQ ID NO: 1859423 - protein, 4 aa, Staphylococcus
NKGE

SEQ ID NO: 1859424 - protein, 9 aa, Staphylococcus
NKGEGITPA

SEQ ID NO: 1859425 - protein, 7 aa, Staphylococcus
NKGELSL

SEQ ID NO: 1859426 - protein, 7 aa, Staphylococcus
NKGGTLL

SEQ ID NO: 1859427 - protein, 5 aa, Staphylococcus
NKGGY

SEQ ID NO: 1859428 - protein, 12 aa, Staphylococcus
NKGHSSSNKTQY

SEQ ID NO: 1859429 - protein, 4 aa, Staphylococcus
NKGI

SEQ ID NO: 1859430 - protein, 13 aa, Staphylococcus
NKGKSGNKKRSKT

SEQ ID NO: 1859431 - protein, 9 aa, Staphylococcus
NKGLETEEA

SEQ ID NO: 1859432 - protein, 9 aa, Staphylococcus
NKGLSTEEA

SEQ ID NO: 1859433 - protein, 9 aa, Staphylococcus
NKGMKDNNT

SEQ ID NO: 1859434 - protein, 9 aa, Staphylococcus
NKGMKDSNT

SEQ ID NO: 1859435 - protein, 5 aa, Staphylococcus
NKGMT

SEQ ID NO: 1859436 - protein, 18 aa, Staphylococcus
NKGMTSTKTMDTAKPIED

SEQ ID NO: 1859437 - protein, 4 aa, Staphylococcus
NKGQ

SEQ ID NO: 1859438 - protein, 16 aa, Staphylococcus
NKGQQTLSTAQSKLTS

SEQ ID NO: 1859439 - protein, 13 aa, Staphylococcus
NKGTNYKQKAKNL

SEQ ID NO: 1859440 - protein, 10 aa, Staphylococcus
NKGYDDDETY

SEQ ID NO: 1859441 - protein, 9 aa, Staphylococcus
NKGYEDDET

SEQ ID NO: 1859442 - protein, 5 aa, Staphylococcus
NKGYG

SEQ ID NO: 1859443 - protein, 8 aa, Staphylococcus
NKGYSGAT

SEQ ID NO: 1859444 - protein, 9 aa, Staphylococcus
NKGYSGATV

SEQ ID NO: 1859445 - protein, 10 aa, Staphylococcus
NKHEALEDEL

SEQ ID NO: 1859446 - protein, 6 aa, Staphylococcus
NKHESL

SEQ ID NO: 1859447 - protein, 6 aa, Staphylococcus
NKHGVP

SEQ ID NO: 1859448 - protein, 17 aa, Staphylococcus
NKHKANSSEVKRYEQTE

SEQ ID NO: 1859449 - protein, 6 aa, Staphylococcus
NKHLPN

SEQ ID NO: 1859450 - protein, 6 aa, Staphylococcus
NKHQTV

SEQ ID NO: 1859451 - protein, 11 aa, Staphylococcus
NKHSEDKTYHK

SEQ ID NO: 1859452 - protein, 12 aa, Staphylococcus
NKHTDKEDPESP

SEQ ID NO: 1859453 - protein, 28 aa, Staphylococcus
NKIANRKSATSDEQKTYGVASNNAIATR

SEQ ID NO: 1859454 - protein, 8 aa, Staphylococcus
NKIDKDRY

SEQ ID NO: 1859455 - protein, 5 aa, Staphylococcus
NKIDN

SEQ ID NO: 1859456 - protein, 9 aa, Staphylococcus
NKIDNHPGK

SEQ ID NO: 1859457 - protein, 6 aa, Staphylococcus
NKIGNS

SEQ ID NO: 1859458 - protein, 5 aa, Staphylococcus
NKIGP

SEQ ID NO: 1859459 - protein, 4 aa, Staphylococcus
NKIL

SEQ ID NO: 1859460 - protein, 22 aa, Staphylococcus
NKINDINNNTTLTKAQKDAAIA

SEQ ID NO: 1859461 - protein, 10 aa, Staphylococcus
NKINNTNKQL

SEQ ID NO: 1859462 - protein, 5 aa, Staphylococcus
NKIPS

SEQ ID NO: 1859463 - protein, 10 aa, Staphylococcus
NKIQNPSNVL

SEQ ID NO: 1859464 - protein, 4 aa, Staphylococcus
NKIS

SEQ ID NO: 1859465 - protein, 7 aa, Staphylococcus
NKITNDI

SEQ ID NO: 1859466 - protein, 9 aa, Staphylococcus
NKITNDVAT

SEQ ID NO: 1859467 - protein, 7 aa, Staphylococcus
NKITTTQ

SEQ ID NO: 1859468 - protein, 8 aa, Staphylococcus
NKKANAQN

SEQ ID NO: 1859469 - protein, 10 aa, Staphylococcus
NKKDDNEVIP

SEQ ID NO: 1859470 - protein, 8 aa, Staphylococcus
NKKDGDNL

SEQ ID NO: 1859471 - protein, 9 aa, Staphylococcus
NKKDKSYID

SEQ ID NO: 1859472 - protein, 9 aa, Staphylococcus
NKKEHKASD

SEQ ID NO: 1859473 - protein, 12 aa, Staphylococcus
NKKFKKMGSRIP

SEQ ID NO: 1859474 - protein, 6 aa, Staphylococcus
NKKGVP

SEQ ID NO: 1859475 - protein, 4 aa, Staphylococcus
NKKI

SEQ ID NO: 1859476 - protein, 12 aa, Staphylococcus
NKKIKRQTVDEY

SEQ ID NO: 1859477 - protein, 14 aa, Staphylococcus
NKKKDVDERSDDFK

SEQ ID NO: 1859478 - protein, 9 aa, Staphylococcus
NKKKKSHIA

SEQ ID NO: 1859479 - protein, 16 aa, Staphylococcus
NKKKNANIKDDIDKDK

SEQ ID NO: 1859480 - protein, 9 aa, Staphylococcus
NKKKNEFEK

SEQ ID NO: 1859481 - protein, 4 aa, Staphylococcus
NKKN

SEQ ID NO: 1859482 - protein, 8 aa, Staphylococcus
NKKNNSYI

SEQ ID NO: 1859483 - protein, 8 aa, Staphylococcus
NKKPGDTM

SEQ ID NO: 1859484 - protein, 9 aa, Staphylococcus
NKKPGDTVN

SEQ ID NO: 1859485 - protein, 8 aa, Staphylococcus
NKKPGEDV

SEQ ID NO: 1859486 - protein, 9 aa, Staphylococcus
NKKPGETAK

SEQ ID NO: 1859487 - protein, 8 aa, Staphylococcus
NKKPGETV

SEQ ID NO: 1859488 - protein, 9 aa, Staphylococcus
NKKPSSIED

SEQ ID NO: 1859489 - protein, 8 aa, Staphylococcus
NKKQEQNY

SEQ ID NO: 1859490 - protein, 4 aa, Staphylococcus
NKKS

SEQ ID NO: 1859491 - protein, 8 aa, Staphylococcus
NKKSKSYI

SEQ ID NO: 1859492 - protein, 6 aa, Staphylococcus
NKKTQF

SEQ ID NO: 1859493 - protein, 7 aa, Staphylococcus
NKKTTDV

SEQ ID NO: 1859494 - protein, 11 aa, Staphylococcus
NKKTTKKNYPS

SEQ ID NO: 1859495 - protein, 8 aa, Staphylococcus
NKKTVEDN

SEQ ID NO: 1859496 - protein, 6 aa, Staphylococcus
NKKTYQ

SEQ ID NO: 1859497 - protein, 10 aa, Staphylococcus
NKLASSFGSL

SEQ ID NO: 1859498 - protein, 11 aa, Staphylococcus
NKLASSFGSLT

SEQ ID NO: 1859499 - protein, 14 aa, Staphylococcus
NKLDEAGLTADDVE

SEQ ID NO: 1859500 - protein, 7 aa, Staphylococcus
NKLGHKS

SEQ ID NO: 1859501 - protein, 6 aa, Staphylococcus
NKLGIK

SEQ ID NO: 1859502 - protein, 49 aa, Staphylococcus
NKLNGSLSQSTQSTTESFNSEIQSTSHSTAIKQEQINGEQNHSEYDRGE

SEQ ID NO: 1859503 - protein, 15 aa, Staphylococcus
NKLPDVEKDLKKADK

SEQ ID NO: 1859504 - protein, 8 aa, Staphylococcus
NKLQEKTN

SEQ ID NO: 1859505 - protein, 4 aa, Staphylococcus
NKLS

SEQ ID NO: 1859506 - protein, 4 aa, Staphylococcus
NKMN

SEQ ID NO: 1859507 - protein, 10 aa, Staphylococcus
NKNATNTTSY

SEQ ID NO: 1859508 - protein, 9 aa, Staphylococcus
NKNDESGKM

SEQ ID NO: 1859509 - protein, 10 aa, Staphylococcus
NKNDESGKMH

SEQ ID NO: 1859510 - protein, 18 aa, Staphylococcus
NKNDGLNNKDTKKDIEDA

SEQ ID NO: 1859511 - protein, 30 aa, Staphylococcus
NKNDHTNDSALTPTNKHYTDTMKSANSTVK

SEQ ID NO: 1859512 - protein, 9 aa, Staphylococcus
NKNDKENRL

SEQ ID NO: 1859513 - protein, 9 aa, Staphylococcus
NKNDTPASM

SEQ ID NO: 1859514 - protein, 23 aa, Staphylococcus
NKNETKINATPTNQSNLNTSESI

SEQ ID NO: 1859515 - protein, 6 aa, Staphylococcus
NKNGEL

SEQ ID NO: 1859516 - protein, 7 aa, Staphylococcus
NKNGVPY

SEQ ID NO: 1859517 - protein, 7 aa, Staphylococcus
NKNISHG

SEQ ID NO: 1859518 - protein, 13 aa, Staphylococcus
NKNKSEKQNDYRD

SEQ ID NO: 1859519 - protein, 6 aa, Staphylococcus
NKNLPN

SEQ ID NO: 1859520 - protein, 8 aa, Staphylococcus
NKNNITGQ

SEQ ID NO: 1859521 - protein, 7 aa, Staphylococcus
NKNNTSK

SEQ ID NO: 1859522 - protein, 5 aa, Staphylococcus
NKNNY

SEQ ID NO: 1859523 - protein, 5 aa, Staphylococcus
NKNPK

SEQ ID NO: 1859524 - protein, 9 aa, Staphylococcus
NKNSETGKM

SEQ ID NO: 1859525 - protein, 37 aa, Staphylococcus
NKNSNTPKQQLKEQQSSTKNQSNNDKNHQQQADQNKQ

SEQ ID NO: 1859526 - protein, 9 aa, Staphylococcus
NKNSTRAIG

SEQ ID NO: 1859527 - protein, 8 aa, Staphylococcus
NKNTIDKA

SEQ ID NO: 1859528 - protein, 23 aa, Staphylococcus
NKNTNSKTRSEVAENLNNAQALD

SEQ ID NO: 1859529 - protein, 10 aa, Staphylococcus
NKNYADDETY

SEQ ID NO: 1859530 - protein, 5 aa, Staphylococcus
NKNYY

SEQ ID NO: 1859531 - protein, 11 aa, Staphylococcus
NKPAKYTKKPN

SEQ ID NO: 1859532 - protein, 4 aa, Staphylococcus
NKPD

SEQ ID NO: 1859533 - protein, 5 aa, Staphylococcus
NKPDH

SEQ ID NO: 1859534 - protein, 6 aa, Staphylococcus
NKPGVP

SEQ ID NO: 1859535 - protein, 4 aa, Staphylococcus
NKPI

SEQ ID NO: 1859536 - protein, 6 aa, Staphylococcus
NKPMSI

SEQ ID NO: 1859537 - protein, 72 aa, Staphylococcus
NKPNETSKQQDQNQSIDEDNFNNQSNESEQLEQNEAIEQSNETSDENAQNVESTKTNDSHRLSTNSSENTYK

SEQ ID NO: 1859538 - protein, 11 aa, Staphylococcus
NKPRNEDTHPV

SEQ ID NO: 1859539 - protein, 11 aa, Staphylococcus
NKPRNQDTHPV

SEQ ID NO: 1859540 - protein, 16 aa, Staphylococcus
NKPTNVNASMSQTTGI

SEQ ID NO: 1859541 - protein, 16 aa, Staphylococcus
NKPTNVNTSMSQTTGI

SEQ ID NO: 1859542 - protein, 7 aa, Staphylococcus
NKPYPEG

SEQ ID NO: 1859543 - protein, 5 aa, Staphylococcus
NKQAE

SEQ ID NO: 1859544 - protein, 7 aa, Staphylococcus
NKQEKLL

SEQ ID NO: 1859545 - protein, 12 aa, Staphylococcus
NKQFKQMGSRIP

SEQ ID NO: 1859546 - protein, 7 aa, Staphylococcus
NKQFNET

SEQ ID NO: 1859547 - protein, 8 aa, Staphylococcus
NKQFNTTV

SEQ ID NO: 1859548 - protein, 44 aa, Staphylococcus
NKQGNGHDNYPRRDDRLDDHSERSHSYARRSQSRPQSNEARTTD

SEQ ID NO: 1859549 - protein, 7 aa, Staphylococcus
NKQHVNY

SEQ ID NO: 1859550 - protein, 7 aa, Staphylococcus
NKQKEEN

SEQ ID NO: 1859551 - protein, 14 aa, Staphylococcus
NKQLANAAKKHKNV

SEQ ID NO: 1859552 - protein, 8 aa, Staphylococcus
NKQNIEGG

SEQ ID NO: 1859553 - protein, 14 aa, Staphylococcus
NKQNNKKSLINNEN

SEQ ID NO: 1859554 - protein, 5 aa, Staphylococcus
NKQQF

SEQ ID NO: 1859555 - protein, 9 aa, Staphylococcus
NKQSNTYAP

SEQ ID NO: 1859556 - protein, 9 aa, Staphylococcus
NKQSNTYGP

SEQ ID NO: 1859557 - protein, 16 aa, Staphylococcus
NKQSYHAPATEDVTTS

SEQ ID NO: 1859558 - protein, 7 aa, Staphylococcus
NKQTYTI

SEQ ID NO: 1859559 - protein, 6 aa, Staphylococcus
NKRAET

SEQ ID NO: 1859560 - protein, 47 aa, Staphylococcus
NKREKEENKQIKRETCSSKKAKTNKTQRPSSNTKSKKGTTKNKKRSK

SEQ ID NO: 1859561 - protein, 6 aa, Staphylococcus
NKRFGT

SEQ ID NO: 1859562 - protein, 4 aa, Staphylococcus
NKRG

SEQ ID NO: 1859563 - protein, 8 aa, Staphylococcus
NKRKIKRD

SEQ ID NO: 1859564 - protein, 8 aa, Staphylococcus
NKRNKKSL

SEQ ID NO: 1859565 - protein, 16 aa, Staphylococcus
NKRNSIEKAEERKNEI

SEQ ID NO: 1859566 - protein, 9 aa, Staphylococcus
NKRPDLDGG

SEQ ID NO: 1859567 - protein, 4 aa, Staphylococcus
NKRR

SEQ ID NO: 1859568 - protein, 15 aa, Staphylococcus
NKRSHRRNESASNGW

SEQ ID NO: 1859569 - protein, 7 aa, Staphylococcus
NKRSIKK

SEQ ID NO: 1859570 - protein, 7 aa, Staphylococcus
NKRSTRT

SEQ ID NO: 1859571 - protein, 6 aa, Staphylococcus
NKSDAY

SEQ ID NO: 1859572 - protein, 9 aa, Staphylococcus
NKSDRQCSN

SEQ ID NO: 1859573 - protein, 6 aa, Staphylococcus
NKSEAI

SEQ ID NO: 1859574 - protein, 10 aa, Staphylococcus
NKSGEKILPN

SEQ ID NO: 1859575 - protein, 8 aa, Staphylococcus
NKSHKTVK

SEQ ID NO: 1859576 - protein, 6 aa, Staphylococcus
NKSLPF

SEQ ID NO: 1859577 - protein, 12 aa, Staphylococcus
NKSNKHKDIESI

SEQ ID NO: 1859578 - protein, 14 aa, Staphylococcus
NKSNRGNKKRSKTL

SEQ ID NO: 1859579 - protein, 8 aa, Staphylococcus
NKSPKAIT

SEQ ID NO: 1859580 - protein, 16 aa, Staphylococcus
NKSQINEAESDNRVNF

SEQ ID NO: 1859581 - protein, 11 aa, Staphylococcus
NKSQQTHNHDQ

SEQ ID NO: 1859582 - protein, 11 aa, Staphylococcus
NKSVNEGLKTT

SEQ ID NO: 1859583 - protein, 10 aa, Staphylococcus
NKSYADDETY

SEQ ID NO: 1859584 - protein, 8 aa, Staphylococcus
NKTADKSI

SEQ ID NO: 1859585 - protein, 8 aa, Staphylococcus
NKTDAKKA

SEQ ID NO: 1859586 - protein, 8 aa, Staphylococcus
NKTEKAAR

SEQ ID NO: 1859587 - protein, 9 aa, Staphylococcus
NKTGSRFKQ

SEQ ID NO: 1859588 - protein, 10 aa, Staphylococcus
NKTHKEERSR

SEQ ID NO: 1859589 - protein, 10 aa, Staphylococcus
NKTIDKPKQM

SEQ ID NO: 1859590 - protein, 17 aa, Staphylococcus
NKTIENVKRAKDELEQA

SEQ ID NO: 1859591 - protein, 9 aa, Staphylococcus
NKTKGQNLD

SEQ ID NO: 1859592 - protein, 5 aa, Staphylococcus
NKTKN

SEQ ID NO: 1859593 - protein, 4 aa, Staphylococcus
NKTL

SEQ ID NO: 1859594 - protein, 26 aa, Staphylococcus
NKTLDDKTSYKIDGKGWQKDKSWGGY

SEQ ID NO: 1859595 - protein, 4 aa, Staphylococcus
NKTN

SEQ ID NO: 1859596 - protein, 14 aa, Staphylococcus
NKTNGTDANKEQVE

SEQ ID NO: 1859597 - protein, 7 aa, Staphylococcus
NKTRMKD

SEQ ID NO: 1859598 - protein, 5 aa, Staphylococcus
NKTRN

SEQ ID NO: 1859599 - protein, 16 aa, Staphylococcus
NKTRPTLEELEEEEEN

SEQ ID NO: 1859600 - protein, 9 aa, Staphylococcus
NKTTGVKQA

SEQ ID NO: 1859601 - protein, 8 aa, Staphylococcus
NKTTIDKS

SEQ ID NO: 1859602 - protein, 7 aa, Staphylococcus
NKTTKLP

SEQ ID NO: 1859603 - protein, 13 aa, Staphylococcus
NKVEKNISSRITK

SEQ ID NO: 1859604 - protein, 10 aa, Staphylococcus
NKVEKNLNKL

SEQ ID NO: 1859605 - protein, 6 aa, Staphylococcus
NKVHKR

SEQ ID NO: 1859606 - protein, 15 aa, Staphylococcus
NKVKDEVKAQESPFT

SEQ ID NO: 1859607 - protein, 8 aa, Staphylococcus
NKVKDPGL

SEQ ID NO: 1859608 - protein, 5 aa, Staphylococcus
NKVKT

SEQ ID NO: 1859609 - protein, 8 aa, Staphylococcus
NKVQRGRN

SEQ ID NO: 1859610 - protein, 12 aa, Staphylococcus
NKVTATEESDVA

SEQ ID NO: 1859611 - protein, 8 aa, Staphylococcus
NKVTEQTK

SEQ ID NO: 1859612 - protein, 8 aa, Staphylococcus
NKVTNEIA

SEQ ID NO: 1859613 - protein, 9 aa, Staphylococcus
NKVTNEVAT

SEQ ID NO: 1859614 - protein, 13 aa, Staphylococcus
NKYAKDNDIPLEA

SEQ ID NO: 1859615 - protein, 12 aa, Staphylococcus
NKYASREQDKKE

SEQ ID NO: 1859616 - protein, 14 aa, Staphylococcus
NKYETNEVDKGERL

SEQ ID NO: 1859617 - protein, 39 aa, Staphylococcus
NKYKEDPESYKENAKEIANDLGSRATNKIQDVKNNPQAY

SEQ ID NO: 1859618 - protein, 14 aa, Staphylococcus
NKYQDTARDRTESL

SEQ ID NO: 1859619 - protein, 5 aa, Staphylococcus
NKYQI

SEQ ID NO: 1859620 - protein, 6 aa, Staphylococcus
NKYQPI

SEQ ID NO: 1859621 - protein, 21 aa, Staphylococcus
NKYYGDDAGDYDIPKEDSKIA

SEQ ID NO: 1859622 - protein, 19 aa, Staphylococcus
NKYYGDDAGEYEITNDEQI

SEQ ID NO: 1859623 - protein, 24 aa, Staphylococcus
NKYYGDDAGQYEIKKEEHKNYTEA

SEQ ID NO: 1859624 - protein, 4 aa, Staphylococcus
NLAP

SEQ ID NO: 1859625 - protein, 5 aa, Staphylococcus
NLATK

SEQ ID NO: 1859626 - protein, 8 aa, Staphylococcus
NLDGDEAM

SEQ ID NO: 1859627 - protein, 11 aa, Staphylococcus
NLDSSQIEHEA

SEQ ID NO: 1859628 - protein, 12 aa, Staphylococcus
NLGDSKKIGSYG

SEQ ID NO: 1859629 - protein, 12 aa, Staphylococcus
NLGDSKKVGSYG

SEQ ID NO: 1859630 - protein, 10 aa, Staphylococcus
NLGGEKQRNM

SEQ ID NO: 1859631 - protein, 7 aa, Staphylococcus
NLGHNDK

SEQ ID NO: 1859632 - protein, 4 aa, Staphylococcus
NLGL

SEQ ID NO: 1859633 - protein, 8 aa, Staphylococcus
NLGNSIGS

SEQ ID NO: 1859634 - protein, 6 aa, Staphylococcus
NLGQDS

SEQ ID NO: 1859635 - protein, 7 aa, Staphylococcus
NLGQDSG

SEQ ID NO: 1859636 - protein, 7 aa, Staphylococcus
NLGQESG

SEQ ID NO: 1859637 - protein, 6 aa, Staphylococcus
NLGQKP

SEQ ID NO: 1859638 - protein, 9 aa, Staphylococcus
NLGSSIGST

SEQ ID NO: 1859639 - protein, 8 aa, Staphylococcus
NLGSSVGS

SEQ ID NO: 1859640 - protein, 9 aa, Staphylococcus
NLGSSVGSS

SEQ ID NO: 1859641 - protein, 21 aa, Staphylococcus
NLGSVGMNPTNPLSSEEKKKY

SEQ ID NO: 1859642 - protein, 13 aa, Staphylococcus
NLGTPSSRTPGAF

SEQ ID NO: 1859643 - protein, 5 aa, Staphylococcus
NLHGS

SEQ ID NO: 1859644 - protein, 13 aa, Staphylococcus
NLHNNKKTQEKVR

SEQ ID NO: 1859645 - protein, 15 aa, Staphylococcus
NLIDDGSITQDQYDE

SEQ ID NO: 1859646 - protein, 12 aa, Staphylococcus
NLKAEKDGGYSF

SEQ ID NO: 1859647 - protein, 8 aa, Staphylococcus
NLKEPTHD

SEQ ID NO: 1859648 - protein, 23 aa, Staphylococcus
NLKGETKTKYDAMKKDNLENTNQ

SEQ ID NO: 1859649 - protein, 7 aa, Staphylococcus
NLKKQSK

SEQ ID NO: 1859650 - protein, 6 aa, Staphylococcus
NLKSDE

SEQ ID NO: 1859651 - protein, 6 aa, Staphylococcus
NLKTPI

SEQ ID NO: 1859652 - protein, 10 aa, Staphylococcus
NLNDAQKQSI

SEQ ID NO: 1859653 - protein, 9 aa, Staphylococcus
NLNDKETQN

SEQ ID NO: 1859654 - protein, 10 aa, Staphylococcus
NLNDKQKQAL

SEQ ID NO: 1859655 - protein, 21 aa, Staphylococcus
NLNKTAESDKSPYLQDKQKKN

SEQ ID NO: 1859656 - protein, 8 aa, Staphylococcus
NLNPNQRN

SEQ ID NO: 1859657 - protein, 8 aa, Staphylococcus
NLNSQSIK

SEQ ID NO: 1859658 - protein, 23 aa, Staphylococcus
NLNTPASKRTKHDEIKKDLKNTK

SEQ ID NO: 1859659 - protein, 12 aa, Staphylococcus
NLNTPQKNAEKA

SEQ ID NO: 1859660 - protein, 11 aa, Staphylococcus
NLPDAPEQAPI

SEQ ID NO: 1859661 - protein, 8 aa, Staphylococcus
NLPDNAAK

SEQ ID NO: 1859662 - protein, 18 aa, Staphylococcus
NLPEKTITTVKDKGKKID

SEQ ID NO: 1859663 - protein, 7 aa, Staphylococcus
NLPGHGI

SEQ ID NO: 1859664 - protein, 13 aa, Staphylococcus
NLPNANGSNTIPK

SEQ ID NO: 1859665 - protein, 8 aa, Staphylococcus
NLPRAERD

SEQ ID NO: 1859666 - protein, 8 aa, Staphylococcus
NLPSGSSL

SEQ ID NO: 1859667 - protein, 5 aa, Staphylococcus
NLPSV

SEQ ID NO: 1859668 - protein, 6 aa, Staphylococcus
NLPVDP

SEQ ID NO: 1859669 - protein, 7 aa, Staphylococcus
NLQKTDR

SEQ ID NO: 1859670 - protein, 4 aa, Staphylococcus
NLQQ

SEQ ID NO: 1859671 - protein, 7 aa, Staphylococcus
NLQSGEG

SEQ ID NO: 1859672 - protein, 8 aa, Staphylococcus
NLQTAQDL

SEQ ID NO: 1859673 - protein, 12 aa, Staphylococcus
NLQTPKNAIKDE

SEQ ID NO: 1859674 - protein, 5 aa, Staphylococcus
NLQTS

SEQ ID NO: 1859675 - protein, 17 aa, Staphylococcus
NLQYNKTNNIKNENNYE

SEQ ID NO: 1859676 - protein, 8 aa, Staphylococcus
NLRNGGAN

SEQ ID NO: 1859677 - protein, 7 aa, Staphylococcus
NLSAKQQ

SEQ ID NO: 1859678 - protein, 6 aa, Staphylococcus
NLSNNK

SEQ ID NO: 1859679 - protein, 5 aa, Staphylococcus
NLSSK

SEQ ID NO: 1859680 - protein, 9 aa, Staphylococcus
NLSTTTSDD

SEQ ID NO: 1859681 - protein, 13 aa, Staphylococcus
NLTDKKPSSVERY

SEQ ID NO: 1859682 - protein, 5 aa, Staphylococcus
NLTGQ

SEQ ID NO: 1859683 - protein, 9 aa, Staphylococcus
NLTHSESQN

SEQ ID NO: 1859684 - protein, 7 aa, Staphylococcus
NLTKSNR

SEQ ID NO: 1859685 - protein, 7 aa, Staphylococcus
NLTKTNR

SEQ ID NO: 1859686 - protein, 9 aa, Staphylococcus
NLTNAQNAL

SEQ ID NO: 1859687 - protein, 7 aa, Staphylococcus
NLTRSNR

SEQ ID NO: 1859688 - protein, 10 aa, Staphylococcus
NLTSNEQERN

SEQ ID NO: 1859689 - protein, 5 aa, Staphylococcus
NLTTE

SEQ ID NO: 1859690 - protein, 11 aa, Staphylococcus
NLTTEKATIEY

SEQ ID NO: 1859691 - protein, 20 aa, Staphylococcus
NLTTEQASVDYYPGQTDADT

SEQ ID NO: 1859692 - protein, 8 aa, Staphylococcus
NLTTEQAT

SEQ ID NO: 1859693 - protein, 6 aa, Staphylococcus
NMDETQ

SEQ ID NO: 1859694 - protein, 7 aa, Staphylococcus
NMDQKRT

SEQ ID NO: 1859695 - protein, 19 aa, Staphylococcus
NMDTPSPENNLSLGSGDGL

SEQ ID NO: 1859696 - protein, 15 aa, Staphylococcus
NMGNASEEIGNTKGL

SEQ ID NO: 1859697 - protein, 5 aa, Staphylococcus
NMNDR

SEQ ID NO: 1859698 - protein, 6 aa, Staphylococcus
NMNNDE

SEQ ID NO: 1859699 - protein, 10 aa, Staphylococcus
NMNNNKQNKL

SEQ ID NO: 1859700 - protein, 6 aa, Staphylococcus
NMPADL

SEQ ID NO: 1859701 - protein, 5 aa, Staphylococcus
NMPDK

SEQ ID NO: 1859702 - protein, 8 aa, Staphylococcus
NMPKEQRQ

SEQ ID NO: 1859703 - protein, 5 aa, Staphylococcus
NMPNY

SEQ ID NO: 1859704 - protein, 14 aa, Staphylococcus
NMPTKSLKDANPLQ

SEQ ID NO: 1859705 - protein, 8 aa, Staphylococcus
NMPTSQTK

SEQ ID NO: 1859706 - protein, 25 aa, Staphylococcus
NMRSDVEDIDNVDTVSKAQLTDNNN

SEQ ID NO: 1859707 - protein, 8 aa, Staphylococcus
NMSAEKSY

SEQ ID NO: 1859708 - protein, 9 aa, Staphylococcus
NMSDELKQR

SEQ ID NO: 1859709 - protein, 5 aa, Staphylococcus
NMSGE

SEQ ID NO: 1859710 - protein, 17 aa, Staphylococcus
NMSNPSQEDANDNEHSQ

SEQ ID NO: 1859711 - protein, 5 aa, Staphylococcus
NMSQN

SEQ ID NO: 1859712 - protein, 7 aa, Staphylococcus
NMSTDNA

SEQ ID NO: 1859713 - protein, 28 aa, Staphylococcus
NMTDGDAVEKDSKNPLLPPVDTGEAIGL

SEQ ID NO: 1859714 - protein, 11 aa, Staphylococcus
NNAAGAGMGTS

SEQ ID NO: 1859715 - protein, 12 aa, Staphylococcus
NNAAGAGMGTSG

SEQ ID NO: 1859716 - protein, 7 aa, Staphylococcus
NNAEKTA

SEQ ID NO: 1859717 - protein, 44 aa, Staphylococcus
NNAKDIANKATINDQAKKASFSPGLSSDLGYNQSYTTQKKGDDY

SEQ ID NO: 1859718 - protein, 11 aa, Staphylococcus
NNAKKGGASDK

SEQ ID NO: 1859719 - protein, 11 aa, Staphylococcus
NNAKKGGTSDK

SEQ ID NO: 1859720 - protein, 42 aa, Staphylococcus
NNAKNNLETSINQVPETKNMTSDSVENYRNKLSQAKDTLANA

SEQ ID NO: 1859721 - protein, 14 aa, Staphylococcus
NNAKYAHNGAHAHP

SEQ ID NO: 1859722 - protein, 13 aa, Staphylococcus
NNANGTDEDDKEL

SEQ ID NO: 1859723 - protein, 10 aa, Staphylococcus
NNANNTKTVL

SEQ ID NO: 1859724 - protein, 11 aa, Staphylococcus
NNANSEQTYEM

SEQ ID NO: 1859725 - protein, 11 aa, Staphylococcus
NNAQKTAEKQL

SEQ ID NO: 1859726 - protein, 19 aa, Staphylococcus
NNAQRQALTDQINHSDNIT

SEQ ID NO: 1859727 - protein, 4 aa, Staphylococcus
NNAT

SEQ ID NO: 1859728 - protein, 27 aa, Staphylococcus
NNATAKKQNINQTPDATTEEKEAAITQ

SEQ ID NO: 1859729 - protein, 16 aa, Staphylococcus
NNATDDEKNAAQAQVD

SEQ ID NO: 1859730 - protein, 21 aa, Staphylococcus
NNATETDLKSIPGVGPSKARE

SEQ ID NO: 1859731 - protein, 7 aa, Staphylococcus
NNATHDG

SEQ ID NO: 1859732 - protein, 19 aa, Staphylococcus
NNDDIKATKTMDTAKPIED

SEQ ID NO: 1859733 - protein, 6 aa, Staphylococcus
NNDEKI

SEQ ID NO: 1859734 - protein, 8 aa, Staphylococcus
NNDEKQDI

SEQ ID NO: 1859735 - protein, 14 aa, Staphylococcus
NNDGKATSYKQTAM

SEQ ID NO: 1859736 - protein, 15 aa, Staphylococcus
NNDGVQNDSNAAAAG

SEQ ID NO: 1859737 - protein, 5 aa, Staphylococcus
NNDKQ

SEQ ID NO: 1859738 - protein, 14 aa, Staphylococcus
NNDNEIDILDEDFD

SEQ ID NO: 1859739 - protein, 46 aa, Staphylococcus
NNDPYDNEFKKEEDHNSKEMEKISKSAKDENASKFGSKADNDHGGG

SEQ ID NO: 1859740 - protein, 42 aa, Staphylococcus
NNDPYDSEFKDEETHNAKEMEKINKGAKDENASKADNDHGGE

SEQ ID NO: 1859741 - protein, 10 aa, Staphylococcus
NNDQSSNGLG

SEQ ID NO: 1859742 - protein, 9 aa, Staphylococcus
NNDRAQNND

SEQ ID NO: 1859743 - protein, 10 aa, Staphylococcus
NNDRSQNPKF

SEQ ID NO: 1859744 - protein, 16 aa, Staphylococcus
NNDTDMDKAEEQLKKE

SEQ ID NO: 1859745 - protein, 12 aa, Staphylococcus
NNDTPYRNNPDA

SEQ ID NO: 1859746 - protein, 17 aa, Staphylococcus
NNDYYKKQNAGKLSEAA

SEQ ID NO: 1859747 - protein, 16 aa, Staphylococcus
NNDYYKKQSPNKLTEA

SEQ ID NO: 1859748 - protein, 6 aa, Staphylococcus
NNEADE

SEQ ID NO: 1859749 - protein, 7 aa, Staphylococcus
NNEAQRA

SEQ ID NO: 1859750 - protein, 4 aa, Staphylococcus
NNEH

SEQ ID NO: 1859751 - protein, 4 aa, Staphylococcus
NNEK

SEQ ID NO: 1859752 - protein, 7 aa, Staphylococcus
NNEKENI

SEQ ID NO: 1859753 - protein, 5 aa, Staphylococcus
NNEKS

SEQ ID NO: 1859754 - protein, 9 aa, Staphylococcus
NNEKSGMDM

SEQ ID NO: 1859755 - protein, 4 aa, Staphylococcus
NNEL

SEQ ID NO: 1859756 - protein, 8 aa, Staphylococcus
NNELTAPK

SEQ ID NO: 1859757 - protein, 12 aa, Staphylococcus
NNEMSPTLKQGD

SEQ ID NO: 1859758 - protein, 7 aa, Staphylococcus
NNENYEE

SEQ ID NO: 1859759 - protein, 18 aa, Staphylococcus
NNEPYDSEFKDEESHNMD

SEQ ID NO: 1859760 - protein, 7 aa, Staphylococcus
NNETIDK

SEQ ID NO: 1859761 - protein, 8 aa, Staphylococcus
NNETKRKE

SEQ ID NO: 1859762 - protein, 9 aa, Staphylococcus
NNETQVDYP

SEQ ID NO: 1859763 - protein, 7 aa, Staphylococcus
NNETVER

SEQ ID NO: 1859764 - protein, 6 aa, Staphylococcus
NNEVKR

SEQ ID NO: 1859765 - protein, 19 aa, Staphylococcus
NNEVTFKRDNQNITNSEEG

SEQ ID NO: 1859766 - protein, 23 aa, Staphylococcus
NNEYQDVEKGKGFDSDNNDIEDK

SEQ ID NO: 1859767 - protein, 14 aa, Staphylococcus
NNGDFSLPDTGTVV

SEQ ID NO: 1859768 - protein, 23 aa, Staphylococcus
NNGETNQEVEDALTNGETAINGI

SEQ ID NO: 1859769 - protein, 5 aa, Staphylococcus
NNGGI

SEQ ID NO: 1859770 - protein, 6 aa, Staphylococcus
NNGGQL

SEQ ID NO: 1859771 - protein, 4 aa, Staphylococcus
NNGK

SEQ ID NO: 1859772 - protein, 12 aa, Staphylococcus
NNGKYYAKGSLE

SEQ ID NO: 1859773 - protein, 14 aa, Staphylococcus
NNGNATDQEISTEI

SEQ ID NO: 1859774 - protein, 8 aa, Staphylococcus
NNGNMPKQ

SEQ ID NO: 1859775 - protein, 10 aa, Staphylococcus
NNGSPDVQNQ

SEQ ID NO: 1859776 - protein, 12 aa, Staphylococcus
NNGTDMDKAEEV

SEQ ID NO: 1859777 - protein, 20 aa, Staphylococcus
NNHSIYDKNNNQGDQSDGND

SEQ ID NO: 1859778 - protein, 18 aa, Staphylococcus
NNHTEDSKKGNSTINSEQ

SEQ ID NO: 1859779 - protein, 22 aa, Staphylococcus
NNIDSTDSKKSNTKTIGKPMSA

SEQ ID NO: 1859780 - protein, 26 aa, Staphylococcus
NNIEQNAEEVKNNHYRNTTVDANGNN

SEQ ID NO: 1859781 - protein, 4 aa, Staphylococcus
NNIG

SEQ ID NO: 1859782 - protein, 13 aa, Staphylococcus
NNIKKQKDNKNPF

SEQ ID NO: 1859783 - protein, 7 aa, Staphylococcus
NNINTKV

SEQ ID NO: 1859784 - protein, 4 aa, Staphylococcus
NNIP

SEQ ID NO: 1859785 - protein, 6 aa, Staphylococcus
NNIRKA

SEQ ID NO: 1859786 - protein, 14 aa, Staphylococcus
NNISDAGQKLRKGL

SEQ ID NO: 1859787 - protein, 18 aa, Staphylococcus
NNISNNNINQNEGNKQIN

SEQ ID NO: 1859788 - protein, 6 aa, Staphylococcus
NNITNR

SEQ ID NO: 1859789 - protein, 7 aa, Staphylococcus
NNKDGNV

SEQ ID NO: 1859790 - protein, 5 aa, Staphylococcus
NNKDI

SEQ ID NO: 1859791 - protein, 7 aa, Staphylococcus
NNKIEKR

SEQ ID NO: 1859792 - protein, 10 aa, Staphylococcus
NNKISEIETE

SEQ ID NO: 1859793 - protein, 25 aa, Staphylococcus
NNKKIGAQKGSEQEKIAQQEIENAQ

SEQ ID NO: 1859794 - protein, 20 aa, Staphylococcus
NNKKQEALENKEATQDEKDA

SEQ ID NO: 1859795 - protein, 5 aa, Staphylococcus
NNKNI

SEQ ID NO: 1859796 - protein, 25 aa, Staphylococcus
NNKNTRTEVQTQLDDAKTLDSSMGS

SEQ ID NO: 1859797 - protein, 12 aa, Staphylococcus
NNKPAKYTKDSN

SEQ ID NO: 1859798 - protein, 19 aa, Staphylococcus
NNKPYDNEFKKEESHNMDE

SEQ ID NO: 1859799 - protein, 12 aa, Staphylococcus
NNKQKMQSNRLK

SEQ ID NO: 1859800 - protein, 8 aa, Staphylococcus
NNKQKSSF

SEQ ID NO: 1859801 - protein, 4 aa, Staphylococcus
NNKR

SEQ ID NO: 1859802 - protein, 7 aa, Staphylococcus
NNKTKLP

SEQ ID NO: 1859803 - protein, 7 aa, Staphylococcus
NNKTNIT

SEQ ID NO: 1859804 - protein, 23 aa, Staphylococcus
NNKTPYTKDTKIDELKNEFKDKM

SEQ ID NO: 1859805 - protein, 18 aa, Staphylococcus
NNKVDDIKKKLNSILGNN

SEQ ID NO: 1859806 - protein, 6 aa, Staphylococcus
NNLDGF

SEQ ID NO: 1859807 - protein, 20 aa, Staphylococcus
NNLDSADSKKNNTKTIGKPL

SEQ ID NO: 1859808 - protein, 4 aa, Staphylococcus
NNLN

SEQ ID NO: 1859809 - protein, 20 aa, Staphylococcus
NNLNGEAKLTEAKTTGNQAI

SEQ ID NO: 1859810 - protein, 20 aa, Staphylococcus
NNLNGETKLAKAKQDAQATI

SEQ ID NO: 1859811 - protein, 4 aa, Staphylococcus
NNLP

SEQ ID NO: 1859812 - protein, 8 aa, Staphylococcus
NNLQTDNE

SEQ ID NO: 1859813 - protein, 14 aa, Staphylococcus
NNLSPKSQNHANEI

SEQ ID NO: 1859814 - protein, 18 aa, Staphylococcus
NNLSQSKIQNQNVDPYEE

SEQ ID NO: 1859815 - protein, 4 aa, Staphylococcus
NNLY

SEQ ID NO: 1859816 - protein, 6 aa, Staphylococcus
NNNDDQ

SEQ ID NO: 1859817 - protein, 16 aa, Staphylococcus
NNNDPTKHQAEDNDMG

SEQ ID NO: 1859818 - protein, 7 aa, Staphylococcus
NNNDTYH

SEQ ID NO: 1859819 - protein, 11 aa, Staphylococcus
NNNEETSSYRQ

SEQ ID NO: 1859820 - protein, 16 aa, Staphylococcus
NNNENANEDNEMIGKN

SEQ ID NO: 1859821 - protein, 16 aa, Staphylococcus
NNNGEATTEEKDDAIQ

SEQ ID NO: 1859822 - protein, 11 aa, Staphylococcus
NNNGEKGTGQI

SEQ ID NO: 1859823 - protein, 4 aa, Staphylococcus
NNNI

SEQ ID NO: 1859824 - protein, 16 aa, Staphylococcus
NNNNGIFDEGDEEISS

SEQ ID NO: 1859825 - protein, 16 aa, Staphylococcus
NNNQEATSEEKQAALT

SEQ ID NO: 1859826 - protein, 15 aa, Staphylococcus
NNNSLSKNKVCVQLS

SEQ ID NO: 1859827 - protein, 77 aa, Staphylococcus
NNNSSDNQQTNNASNDNNVSKDYKNEVQNQSDNIKQQVEDAKNDIKDKVDTDSRIKQIQEDVNNLKNSEQTGEDSKL

SEQ ID NO: 1859828 - protein, 6 aa, Staphylococcus
NNNSSL

SEQ ID NO: 1859829 - protein, 8 aa, Staphylococcus
NNNTEQYQ

SEQ ID NO: 1859830 - protein, 7 aa, Staphylococcus
NNNYNNN

SEQ ID NO: 1859831 - protein, 6 aa, Staphylococcus
NNNYQE

SEQ ID NO: 1859832 - protein, 15 aa, Staphylococcus
NNPDATNEEKQEAVN

SEQ ID NO: 1859833 - protein, 7 aa, Staphylococcus
NNPDLPT

SEQ ID NO: 1859834 - protein, 7 aa, Staphylococcus
NNPGGLL

SEQ ID NO: 1859835 - protein, 5 aa, Staphylococcus
NNPGY

SEQ ID NO: 1859836 - protein, 11 aa, Staphylococcus
NNPKEANSRKD

SEQ ID NO: 1859837 - protein, 4 aa, Staphylococcus
NNPL

SEQ ID NO: 1859838 - protein, 6 aa, Staphylococcus
NNPLYT

SEQ ID NO: 1859839 - protein, 28 aa, Staphylococcus
NNPNVEAINTNKATAERINNELTQAKQA

SEQ ID NO: 1859840 - protein, 9 aa, Staphylococcus
NNPQFSTGT

SEQ ID NO: 1859841 - protein, 9 aa, Staphylococcus
NNPSGADNR

SEQ ID NO: 1859842 - protein, 6 aa, Staphylococcus
NNPSKA

SEQ ID NO: 1859843 - protein, 6 aa, Staphylococcus
NNPSTL

SEQ ID NO: 1859844 - protein, 7 aa, Staphylococcus
NNQAGQV

SEQ ID NO: 1859845 - protein, 7 aa, Staphylococcus
NNQFSER

SEQ ID NO: 1859846 - protein, 65 aa, Staphylococcus
NNQKDTTTDENSIQSNGTNPSTQSQSEQNPSDSTMDQQNQMSNQVNSNNSDNSNDFNNQNEINQL

SEQ ID NO: 1859847 - protein, 11 aa, Staphylococcus
NNQKKKKGISD

SEQ ID NO: 1859848 - protein, 14 aa, Staphylococcus
NNQLNSKATEAHAN

SEQ ID NO: 1859849 - protein, 18 aa, Staphylococcus
NNQLSETGKFDTKTNEKF

SEQ ID NO: 1859850 - protein, 8 aa, Staphylococcus
NNQNSYDG

SEQ ID NO: 1859851 - protein, 5 aa, Staphylococcus
NNQQF

SEQ ID NO: 1859852 - protein, 6 aa, Staphylococcus
NNQQKI

SEQ ID NO: 1859853 - protein, 5 aa, Staphylococcus
NNQVS

SEQ ID NO: 1859854 - protein, 13 aa, Staphylococcus
NNRGSTSTSSSSV

SEQ ID NO: 1859855 - protein, 8 aa, Staphylococcus
NNRHDINE

SEQ ID NO: 1859856 - protein, 11 aa, Staphylococcus
NNRNKQADIQR

SEQ ID NO: 1859857 - protein, 12 aa, Staphylococcus
NNRQKIQSNRLK

SEQ ID NO: 1859858 - protein, 5 aa, Staphylococcus
NNRSL

SEQ ID NO: 1859859 - protein, 6 aa, Staphylococcus
NNRTQQ

SEQ ID NO: 1859860 - protein, 7 aa, Staphylococcus
NNRVSRS

SEQ ID NO: 1859861 - protein, 10 aa, Staphylococcus
NNSDDEYSKG

SEQ ID NO: 1859862 - protein, 19 aa, Staphylococcus
NNSDIKATKTMDTAKPIED

SEQ ID NO: 1859863 - protein, 19 aa, Staphylococcus
NNSEINSKVDNANGTYRID

SEQ ID NO: 1859864 - protein, 6 aa, Staphylococcus
NNSEKL

SEQ ID NO: 1859865 - protein, 18 aa, Staphylococcus
NNSELPNQEIKSKINSET

SEQ ID NO: 1859866 - protein, 5 aa, Staphylococcus
NNSFN

SEQ ID NO: 1859867 - protein, 7 aa, Staphylococcus
NNSIKEQ

SEQ ID NO: 1859868 - protein, 26 aa, Staphylococcus
NNSINESLDRDHSQLRQKAAKEGDPM

SEQ ID NO: 1859869 - protein, 7 aa, Staphylococcus
NNSNDTH

SEQ ID NO: 1859870 - protein, 11 aa, Staphylococcus
NNSNNETIDVS

SEQ ID NO: 1859871 - protein, 24 aa, Staphylococcus
NNSRPKIEAITPQARKKRSAIDEI

SEQ ID NO: 1859872 - protein, 10 aa, Staphylococcus
NNSTNKTPTY

SEQ ID NO: 1859873 - protein, 5 aa, Staphylococcus
NNTAH

SEQ ID NO: 1859874 - protein, 26 aa, Staphylococcus
NNTEANQSFKPNKNLLSDASATLKDA

SEQ ID NO: 1859875 - protein, 8 aa, Staphylococcus
NNTEKSSI

SEQ ID NO: 1859876 - protein, 8 aa, Staphylococcus
NNTGNDLY

SEQ ID NO: 1859877 - protein, 22 aa, Staphylococcus
NNTGRDLYNRTSRNSSNTPKRK

SEQ ID NO: 1859878 - protein, 32 aa, Staphylococcus
NNTGTNQSGLLNSGNHDKKYTATMKSANSAVK

SEQ ID NO: 1859879 - protein, 13 aa, Staphylococcus
NNTILRPNSKKFD

SEQ ID NO: 1859880 - protein, 9 aa, Staphylococcus
NNTKERPKV

SEQ ID NO: 1859881 - protein, 8 aa, Staphylococcus
NNTKSVNL

SEQ ID NO: 1859882 - protein, 16 aa, Staphylococcus
NNTKSVNTTFSPNKNL

SEQ ID NO: 1859883 - protein, 6 aa, Staphylococcus
NNTPIE

SEQ ID NO: 1859884 - protein, 15 aa, Staphylococcus
NNTPNATDEEKQNAL

SEQ ID NO: 1859885 - protein, 36 aa, Staphylococcus
NNTSKSLESNASPSDSVPKISQSSIDTTSNKLSSIQ

SEQ ID NO: 1859886 - protein, 7 aa, Staphylococcus
NNTTLRT

SEQ ID NO: 1859887 - protein, 4 aa, Staphylococcus
NNTV

SEQ ID NO: 1859888 - protein, 4 aa, Staphylococcus
NNVI

SEQ ID NO: 1859889 - protein, 11 aa, Staphylococcus
NNVKKKEGTIV

SEQ ID NO: 1859890 - protein, 24 aa, Staphylococcus
NNVLSSSKYINEDTAQQNAYTSAI

SEQ ID NO: 1859891 - protein, 9 aa, Staphylococcus
NNVNSNDYT

SEQ ID NO: 1859892 - protein, 9 aa, Staphylococcus
NNVNTKVKG

SEQ ID NO: 1859893 - protein, 77 aa, Staphylococcus
NNVQPTVVKKDEAKTAIDKAAEAKKAEIDQTPNATDEEKAAAKAKVDEAVTTAKNAIDQATNNAGVDTAKTNGVDSI

SEQ ID NO: 1859894 - protein, 76 aa, Staphylococcus
NNVQPTVVKKDEAKTAIENAARAKKAEIDQTPNATDEEKAVAKAKVDEAVTTAKNAIDQATNNNGVDTAKTNGVDA

SEQ ID NO: 1859895 - protein, 77 aa, Staphylococcus
NNVQPTVVKKDEAKTAIENAARAKKAEIDQTPNATDEEKVAAKAKVDEAVNNAKASIDQATNNDGVDTAKSNGLDSI

SEQ ID NO: 1859896 - protein, 77 aa, Staphylococcus
NNVQPTVVKKDEAKTAIENAARAKKAEIDQTPNATDEEKVAAKAKVDEAVNNAKASIDQVTNNEGVDTAKSNGLDSI

SEQ ID NO: 1859897 - protein, 23 aa, Staphylococcus
NNVSNNTTIPKSKSGSDNEIGSG

SEQ ID NO: 1859898 - protein, 7 aa, Staphylococcus
NNWSQDE

SEQ ID NO: 1859899 - protein, 15 aa, Staphylococcus
NNYATDEEKAKAREL

SEQ ID NO: 1859900 - protein, 6 aa, Staphylococcus
NNYKVA

SEQ ID NO: 1859901 - protein, 4 aa, Staphylococcus
NPAE

SEQ ID NO: 1859902 - protein, 5 aa, Staphylococcus
NPAKQ

SEQ ID NO: 1859903 - protein, 6 aa, Staphylococcus
NPATKI

SEQ ID NO: 1859904 - protein, 4 aa, Staphylococcus
NPCA

SEQ ID NO: 1859905 - protein, 19 aa, Staphylococcus
NPDAFKQATQSAVATFNNS

SEQ ID NO: 1859906 - protein, 8 aa, Staphylococcus
NPDAIDAE

SEQ ID NO: 1859907 - protein, 4 aa, Staphylococcus
NPDI

SEQ ID NO: 1859908 - protein, 5 aa, Staphylococcus
NPDIR

SEQ ID NO: 1859909 - protein, 4 aa, Staphylococcus
NPDL

SEQ ID NO: 1859910 - protein, 8 aa, Staphylococcus
NPDNISKT

SEQ ID NO: 1859911 - protein, 6 aa, Staphylococcus
NPDQNT

SEQ ID NO: 1859912 - protein, 9 aa, Staphylococcus
NPDSTAEGK

SEQ ID NO: 1859913 - protein, 10 aa, Staphylococcus
NPDTSVKANA

SEQ ID NO: 1859914 - protein, 15 aa, Staphylococcus
NPDYETQKEISEQYR

SEQ ID NO: 1859915 - protein, 7 aa, Staphylococcus
NPEDKKT

SEQ ID NO: 1859916 - protein, 7 aa, Staphylococcus
NPEEHHK

SEQ ID NO: 1859917 - protein, 8 aa, Staphylococcus
NPEEQEET

SEQ ID NO: 1859918 - protein, 10 aa, Staphylococcus
NPEEVSAQYG

SEQ ID NO: 1859919 - protein, 10 aa, Staphylococcus
NPEGKSDTII

SEQ ID NO: 1859920 - protein, 6 aa, Staphylococcus
NPEHTL

SEQ ID NO: 1859921 - protein, 9 aa, Staphylococcus
NPEKKTTEI

SEQ ID NO: 1859922 - protein, 6 aa, Staphylococcus
NPEKYD

SEQ ID NO: 1859923 - protein, 6 aa, Staphylococcus
NPEKYN

SEQ ID NO: 1859924 - protein, 7 aa, Staphylococcus
NPELHND

SEQ ID NO: 1859925 - protein, 4 aa, Staphylococcus
NPEN

SEQ ID NO: 1859926 - protein, 18 aa, Staphylococcus
NPEQHKESNYRMPGGKYT

SEQ ID NO: 1859927 - protein, 5 aa, Staphylococcus
NPEVG

SEQ ID NO: 1859928 - protein, 33 aa, Staphylococcus
NPFKKEKDKPNPSFNRDADKKKVAKKDHNEDVL

SEQ ID NO: 1859929 - protein, 12 aa, Staphylococcus
NPFSAESGTGYH

SEQ ID NO: 1859930 - protein, 9 aa, Staphylococcus
NPGEETERY

SEQ ID NO: 1859931 - protein, 5 aa, Staphylococcus
NPGGS

SEQ ID NO: 1859932 - protein, 4 aa, Staphylococcus
NPGH

SEQ ID NO: 1859933 - protein, 4 aa, Staphylococcus
NPGS

SEQ ID NO: 1859934 - protein, 7 aa, Staphylococcus
NPHQGDL

SEQ ID NO: 1859935 - protein, 6 aa, Staphylococcus
NPINKK

SEQ ID NO: 1859936 - protein, 5 aa, Staphylococcus
NPIPA

SEQ ID NO: 1859937 - protein, 8 aa, Staphylococcus
NPIQKKNL

SEQ ID NO: 1859938 - protein, 34 aa, Staphylococcus
NPISNPPNQTEQNMDNPNNNTKQPQHGKRYSIED

SEQ ID NO: 1859939 - protein, 14 aa, Staphylococcus
NPISNQKKEVNTPI

SEQ ID NO: 1859940 - protein, 11 aa, Staphylococcus
NPISSDRNVQG

SEQ ID NO: 1859941 - protein, 19 aa, Staphylococcus
NPITENEDSNSSNNTNNVA

SEQ ID NO: 1859942 - protein, 17 aa, Staphylococcus
NPKAHAKKEIKSLPNET

SEQ ID NO: 1859943 - protein, 12 aa, Staphylococcus
NPKAVDPESYEK

SEQ ID NO: 1859944 - protein, 5 aa, Staphylococcus
NPKDN

SEQ ID NO: 1859945 - protein, 7 aa, Staphylococcus
NPKEAMG

SEQ ID NO: 1859946 - protein, 9 aa, Staphylococcus
NPKEKKTEI

SEQ ID NO: 1859947 - protein, 9 aa, Staphylococcus
NPKEQEETW

SEQ ID NO: 1859948 - protein, 8 aa, Staphylococcus
NPKERSNF

SEQ ID NO: 1859949 - protein, 8 aa, Staphylococcus
NPKETLGS

SEQ ID NO: 1859950 - protein, 30 aa, Staphylococcus
NPKGTDKSLITQSHQKRSETPKDANASDYA

SEQ ID NO: 1859951 - protein, 8 aa, Staphylococcus
NPKHAKKD

SEQ ID NO: 1859952 - protein, 5 aa, Staphylococcus
NPKMV

SEQ ID NO: 1859953 - protein, 9 aa, Staphylococcus
NPKNENSIT

SEQ ID NO: 1859954 - protein, 11 aa, Staphylococcus
NPKNPGQHQYA

SEQ ID NO: 1859955 - protein, 11 aa, Staphylococcus
NPKNPGSHQYA

SEQ ID NO: 1859956 - protein, 6 aa, Staphylococcus
NPKNPP

SEQ ID NO: 1859957 - protein, 8 aa, Staphylococcus
NPKNQNHN

SEQ ID NO: 1859958 - protein, 8 aa, Staphylococcus
NPKNQQHN

SEQ ID NO: 1859959 - protein, 11 aa, Staphylococcus
NPKNSGEHQYA

SEQ ID NO: 1859960 - protein, 14 aa, Staphylococcus
NPKNSTQDGFTQYQ

SEQ ID NO: 1859961 - protein, 11 aa, Staphylococcus
NPKPGETKESV

SEQ ID NO: 1859962 - protein, 7 aa, Staphylococcus
NPKPKDL

SEQ ID NO: 1859963 - protein, 7 aa, Staphylococcus
NPKPKDM

SEQ ID NO: 1859964 - protein, 7 aa, Staphylococcus
NPKPKQL

SEQ ID NO: 1859965 - protein, 10 aa, Staphylococcus
NPKQVKKEHY

SEQ ID NO: 1859966 - protein, 11 aa, Staphylococcus
NPKSPGEHQYA

SEQ ID NO: 1859967 - protein, 10 aa, Staphylococcus
NPKSPGQHQY

SEQ ID NO: 1859968 - protein, 7 aa, Staphylococcus
NPLASPD

SEQ ID NO: 1859969 - protein, 4 aa, Staphylococcus
NPLL

SEQ ID NO: 1859970 - protein, 4 aa, Staphylococcus
NPLP

SEQ ID NO: 1859971 - protein, 8 aa, Staphylococcus
NPMNQPLS

SEQ ID NO: 1859972 - protein, 5 aa, Staphylococcus
NPNEP

SEQ ID NO: 1859973 - protein, 6 aa, Staphylococcus
NPNKQQ

SEQ ID NO: 1859974 - protein, 6 aa, Staphylococcus
NPNNGD

SEQ ID NO: 1859975 - protein, 21 aa, Staphylococcus
NPNPKPILDDDELGKGFENSG

SEQ ID NO: 1859976 - protein, 21 aa, Staphylococcus
NPNSADAAEQDNVNVNGPLTD

SEQ ID NO: 1859977 - protein, 9 aa, Staphylococcus
NPNTSENGY

SEQ ID NO: 1859978 - protein, 6 aa, Staphylococcus
NPPKKV

SEQ ID NO: 1859979 - protein, 20 aa, Staphylococcus
NPPVESHSNNNTESKTSHRL

SEQ ID NO: 1859980 - protein, 7 aa, Staphylococcus
NPPYAEA

SEQ ID NO: 1859981 - protein, 5 aa, Staphylococcus
NPPYS

SEQ ID NO: 1859982 - protein, 11 aa, Staphylococcus
NPQNPGQHQYA

SEQ ID NO: 1859983 - protein, 11 aa, Staphylococcus
NPRAKYKAYEN

SEQ ID NO: 1859984 - protein, 12 aa, Staphylococcus
NPRVKGQEALSR

SEQ ID NO: 1859985 - protein, 13 aa, Staphylococcus
NPSASASGHDADL

SEQ ID NO: 1859986 - protein, 10 aa, Staphylococcus
NPSDYSQEAW

SEQ ID NO: 1859987 - protein, 7 aa, Staphylococcus
NPSEAIK

SEQ ID NO: 1859988 - protein, 5 aa, Staphylococcus
NPSEI

SEQ ID NO: 1859989 - protein, 9 aa, Staphylococcus
NPSKQKTDI

SEQ ID NO: 1859990 - protein, 6 aa, Staphylococcus
NPSNKP

SEQ ID NO: 1859991 - protein, 8 aa, Staphylococcus
NPSSDTVV

SEQ ID NO: 1859992 - protein, 7 aa, Staphylococcus
NPSSSCN

SEQ ID NO: 1859993 - protein, 9 aa, Staphylococcus
NPSTQQSSL

SEQ ID NO: 1859994 - protein, 13 aa, Staphylococcus
NPTALERGYKEPK

SEQ ID NO: 1859995 - protein, 10 aa, Staphylococcus
NPTGAENKQL

SEQ ID NO: 1859996 - protein, 30 aa, Staphylococcus
NPTGAENKQLKDFAPKKYKNEDNNTSTAKD

SEQ ID NO: 1859997 - protein, 11 aa, Staphylococcus
NPTGKAAKEIE

SEQ ID NO: 1859998 - protein, 16 aa, Staphylococcus
NPTKNAVDRKVAQASG

SEQ ID NO: 1859999 - protein, 8 aa, Staphylococcus
NPTKNDQA

SEQ ID NO: 1860000 - protein, 5 aa, Staphylococcus
NPTKQ

SEQ ID NO: 1860001 - protein, 9 aa, Staphylococcus
NPTKSHNDI

SEQ ID NO: 1860002 - protein, 14 aa, Staphylococcus
NPTNLEQEHKESKR

SEQ ID NO: 1860003 - protein, 12 aa, Staphylococcus
NPTNSSKYYKNL

SEQ ID NO: 1860004 - protein, 14 aa, Staphylococcus
NPTRLEQQTKEKKR

SEQ ID NO: 1860005 - protein, 7 aa, Staphylococcus
NPTTPQF

SEQ ID NO: 1860006 - protein, 4 aa, Staphylococcus
NPTV

SEQ ID NO: 1860007 - protein, 8 aa, Staphylococcus
NPTYKSFT

SEQ ID NO: 1860008 - protein, 7 aa, Staphylococcus
NPVHTEE

SEQ ID NO: 1860009 - protein, 122 aa, Staphylococcus
NPVNEGNQEQAQPQSNQEQAQETPKEKQDKESPIESNEGLNKQSKPVDTVENNQTPKKRNKRDVGDDQNGNNVAPNQNQPVNAQDEALENAKQGATNEINQKATDKNQAIDNTTEATQEEKQ

SEQ ID NO: 1860010 - protein, 12 aa, Staphylococcus
NPVSGEVRAPFN

SEQ ID NO: 1860011 - protein, 6 aa, Staphylococcus
NPWRQP

SEQ ID NO: 1860012 - protein, 8 aa, Staphylococcus
NPYQGDNS

SEQ ID NO: 1860013 - protein, 8 aa, Staphylococcus
NPYQTKYS

SEQ ID NO: 1860014 - protein, 8 aa, Staphylococcus
NPYQTQYS

SEQ ID NO: 1860015 - protein, 7 aa, Staphylococcus
NPYSGNN

SEQ ID NO: 1860016 - protein, 8 aa, Staphylococcus
NPYTGDNS

SEQ ID NO: 1860017 - protein, 6 aa, Staphylococcus
NPYTIG

SEQ ID NO: 1860018 - protein, 6 aa, Staphylococcus
NQAESQ

SEQ ID NO: 1860019 - protein, 12 aa, Staphylococcus
NQAGNVESMGGA

SEQ ID NO: 1860020 - protein, 31 aa, Staphylococcus
NQAHTNNAVNEAKNNGVSDINSDVPENTYRA

SEQ ID NO: 1860021 - protein, 7 aa, Staphylococcus
NQAIEGT

SEQ ID NO: 1860022 - protein, 7 aa, Staphylococcus
NQAIETT

SEQ ID NO: 1860023 - protein, 14 aa, Staphylococcus
NQAKLGAVESTQAT

SEQ ID NO: 1860024 - protein, 7 aa, Staphylococcus
NQALETT

SEQ ID NO: 1860025 - protein, 10 aa, Staphylococcus
NQANDNLDKS

SEQ ID NO: 1860026 - protein, 5 aa, Staphylococcus
NQAPA

SEQ ID NO: 1860027 - protein, 7 aa, Staphylococcus
NQAPDAE

SEQ ID NO: 1860028 - protein, 25 aa, Staphylococcus
NQASENLNGDQRVQEAKTDANNNID

SEQ ID NO: 1860029 - protein, 7 aa, Staphylococcus
NQASNMR

SEQ ID NO: 1860030 - protein, 8 aa, Staphylococcus
NQDEIDNY

SEQ ID NO: 1860031 - protein, 19 aa, Staphylococcus
NQDNPKKYHDSKEKDDFYA

SEQ ID NO: 1860032 - protein, 8 aa, Staphylococcus
NQDQIDNY

SEQ ID NO: 1860033 - protein, 17 aa, Staphylococcus
NQDQSAKLNGEKVTIGD

SEQ ID NO: 1860034 - protein, 6 aa, Staphylococcus
NQDQSS

SEQ ID NO: 1860035 - protein, 14 aa, Staphylococcus
NQDQVAQNKKDIST

SEQ ID NO: 1860036 - protein, 7 aa, Staphylococcus
NQEALAE

SEQ ID NO: 1860037 - protein, 7 aa, Staphylococcus
NQEEIDY

SEQ ID NO: 1860038 - protein, 7 aa, Staphylococcus
NQEGYKY

SEQ ID NO: 1860039 - protein, 12 aa, Staphylococcus
NQEPELQRESKN

SEQ ID NO: 1860040 - protein, 19 aa, Staphylococcus
NQEQAPPAFSKTNKNGVPH

SEQ ID NO: 1860041 - protein, 11 aa, Staphylococcus
NQEQKDLHNSP

SEQ ID NO: 1860042 - protein, 13 aa, Staphylococcus
NQERPSYEVNSDE

SEQ ID NO: 1860043 - protein, 14 aa, Staphylococcus
NQESLAQTLNSNIQ

SEQ ID NO: 1860044 - protein, 4 aa, Staphylococcus
NQEY

SEQ ID NO: 1860045 - protein, 4 aa, Staphylococcus
NQGD

SEQ ID NO: 1860046 - protein, 5 aa, Staphylococcus
NQGIR

SEQ ID NO: 1860047 - protein, 4 aa, Staphylococcus
NQGS

SEQ ID NO: 1860048 - protein, 5 aa, Staphylococcus
NQGTY

SEQ ID NO: 1860049 - protein, 9 aa, Staphylococcus
NQHNTASGY

SEQ ID NO: 1860050 - protein, 10 aa, Staphylococcus
NQIENPQKKE

SEQ ID NO: 1860051 - protein, 13 aa, Staphylococcus
NQIHQSQALRPPS

SEQ ID NO: 1860052 - protein, 4 aa, Staphylococcus
NQIQ

SEQ ID NO: 1860053 - protein, 13 aa, Staphylococcus
NQIREQESNLGSY

SEQ ID NO: 1860054 - protein, 9 aa, Staphylococcus
NQIRRDGFQ

SEQ ID NO: 1860055 - protein, 16 aa, Staphylococcus
NQISNSNSVSASTSLS

SEQ ID NO: 1860056 - protein, 11 aa, Staphylococcus
NQKANDGSVQK

SEQ ID NO: 1860057 - protein, 10 aa, Staphylococcus
NQKANDNSIQ

SEQ ID NO: 1860058 - protein, 11 aa, Staphylococcus
NQKANDSSVQK

SEQ ID NO: 1860059 - protein, 8 aa, Staphylococcus
NQKASDIN

SEQ ID NO: 1860060 - protein, 6 aa, Staphylococcus
NQKEKV

SEQ ID NO: 1860061 - protein, 4 aa, Staphylococcus
NQKG

SEQ ID NO: 1860062 - protein, 6 aa, Staphylococcus
NQKPNM

SEQ ID NO: 1860063 - protein, 5 aa, Staphylococcus
NQKTP

SEQ ID NO: 1860064 - protein, 7 aa, Staphylococcus
NQKTSDF

SEQ ID NO: 1860065 - protein, 9 aa, Staphylococcus
NQLGPVKPS

SEQ ID NO: 1860066 - protein, 4 aa, Staphylococcus
NQLN

SEQ ID NO: 1860067 - protein, 20 aa, Staphylococcus
NQLNGDARLQDAKNKAIQSI

SEQ ID NO: 1860068 - protein, 14 aa, Staphylococcus
NQLPDVEKDLAKAN

SEQ ID NO: 1860069 - protein, 6 aa, Staphylococcus
NQLPKN

SEQ ID NO: 1860070 - protein, 6 aa, Staphylococcus
NQLPND

SEQ ID NO: 1860071 - protein, 6 aa, Staphylococcus
NQLPNN

SEQ ID NO: 1860072 - protein, 10 aa, Staphylococcus
NQLPNSNYTE

SEQ ID NO: 1860073 - protein, 6 aa, Staphylococcus
NQLPSD

SEQ ID NO: 1860074 - protein, 37 aa, Staphylococcus
NQLQQNNDQLKAQIDQSVEQQDGVAFEGDNEKALNNV

SEQ ID NO: 1860075 - protein, 13 aa, Staphylococcus
NQLSNKITDEQMQ

SEQ ID NO: 1860076 - protein, 11 aa, Staphylococcus
NQLSPKLKQRY

SEQ ID NO: 1860077 - protein, 13 aa, Staphylococcus
NQLSPKVASQLRE

SEQ ID NO: 1860078 - protein, 73 aa, Staphylococcus
NQLTKAKTQYASLSKSVDSAKRDLNESKIATANAKNELQNFSKANQQAMASAKSAMDTAKKEANAAEQSYASL

SEQ ID NO: 1860079 - protein, 13 aa, Staphylococcus
NQMKHDKENFPIQ

SEQ ID NO: 1860080 - protein, 5 aa, Staphylococcus
NQMNN

SEQ ID NO: 1860081 - protein, 11 aa, Staphylococcus
NQMTSDKLDPL

SEQ ID NO: 1860082 - protein, 6 aa, Staphylococcus
NQNAQT

SEQ ID NO: 1860083 - protein, 6 aa, Staphylococcus
NQNDVK

SEQ ID NO: 1860084 - protein, 5 aa, Staphylococcus
NQNIG

SEQ ID NO: 1860085 - protein, 13 aa, Staphylococcus
NQNKATDNGISAS

SEQ ID NO: 1860086 - protein, 5 aa, Staphylococcus
NQNNQ

SEQ ID NO: 1860087 - protein, 5 aa, Staphylococcus
NQNPL

SEQ ID NO: 1860088 - protein, 13 aa, Staphylococcus
NQNQNTQSNKGYK

SEQ ID NO: 1860089 - protein, 9 aa, Staphylococcus
NQNQSNQGL

SEQ ID NO: 1860090 - protein, 12 aa, Staphylococcus
NQNSKKTGKTSK

SEQ ID NO: 1860091 - protein, 27 aa, Staphylococcus
NQNSSIEQSSNNDTKYTTTMKNAETAV

SEQ ID NO: 1860092 - protein, 20 aa, Staphylococcus
NQNTPEESVTTVKEKGKSID

SEQ ID NO: 1860093 - protein, 17 aa, Staphylococcus
NQNTPGDSSAQLNPDVT

SEQ ID NO: 1860094 - protein, 24 aa, Staphylococcus
NQNYSYDASSQLSDKTTAQLNEEN

SEQ ID NO: 1860095 - protein, 26 aa, Staphylococcus
NQNYSYEDSSALSKKTTAQLDKEDQV

SEQ ID NO: 1860096 - protein, 9 aa, Staphylococcus
NQPKSSPTL

SEQ ID NO: 1860097 - protein, 4 aa, Staphylococcus
NQPL

SEQ ID NO: 1860098 - protein, 34 aa, Staphylococcus
NQPQKDALKQAIDGATTREQVAEKLKEAKALDNA

SEQ ID NO: 1860099 - protein, 11 aa, Staphylococcus
NQPQVKASVSE

SEQ ID NO: 1860100 - protein, 19 aa, Staphylococcus
NQPTKQQTTSKAEVQRKGR

SEQ ID NO: 1860101 - protein, 9 aa, Staphylococcus
NQPTNVNAS

SEQ ID NO: 1860102 - protein, 22 aa, Staphylococcus
NQPTQKQSTSKAEVKRKGQVLE

SEQ ID NO: 1860103 - protein, 7 aa, Staphylococcus
NQPVPEP

SEQ ID NO: 1860104 - protein, 10 aa, Staphylococcus
NQQATNASQL

SEQ ID NO: 1860105 - protein, 9 aa, Staphylococcus
NQQDKSVWD

SEQ ID NO: 1860106 - protein, 9 aa, Staphylococcus
NQQLNDAQD

SEQ ID NO: 1860107 - protein, 5 aa, Staphylococcus
NQQLT

SEQ ID NO: 1860108 - protein, 6 aa, Staphylococcus
NQQSIS

SEQ ID NO: 1860109 - protein, 9 aa, Staphylococcus
NQQSNQGSR

SEQ ID NO: 1860110 - protein, 9 aa, Staphylococcus
NQQSYKVEN

SEQ ID NO: 1860111 - protein, 6 aa, Staphylococcus
NQQYNN

SEQ ID NO: 1860112 - protein, 7 aa, Staphylococcus
NQRANGM

SEQ ID NO: 1860113 - protein, 5 aa, Staphylococcus
NQRQA

SEQ ID NO: 1860114 - protein, 12 aa, Staphylococcus
NQSLNSIEDDDA

SEQ ID NO: 1860115 - protein, 14 aa, Staphylococcus
NQSLTSLGYSNTNP

SEQ ID NO: 1860116 - protein, 6 aa, Staphylococcus
NQSNQK

SEQ ID NO: 1860117 - protein, 18 aa, Staphylococcus
NQSQKSYQKYKDAVNDYK

SEQ ID NO: 1860118 - protein, 9 aa, Staphylococcus
NQSQTIPGV

SEQ ID NO: 1860119 - protein, 16 aa, Staphylococcus
NQSTTRVNNARQIKTD

SEQ ID NO: 1860120 - protein, 8 aa, Staphylococcus
NQSVSQSP

SEQ ID NO: 1860121 - protein, 11 aa, Staphylococcus
NQTADNQDKVI

SEQ ID NO: 1860122 - protein, 13 aa, Staphylococcus
NQTGNVESMGGAV

SEQ ID NO: 1860123 - protein, 7 aa, Staphylococcus
NQTHPDL

SEQ ID NO: 1860124 - protein, 4 aa, Staphylococcus
NQTL

SEQ ID NO: 1860125 - protein, 10 aa, Staphylococcus
NQTSNEVNDK

SEQ ID NO: 1860126 - protein, 9 aa, Staphylococcus
NQTSNPTMD

SEQ ID NO: 1860127 - protein, 6 aa, Staphylococcus
NQTTQH

SEQ ID NO: 1860128 - protein, 4 aa, Staphylococcus
NQVN

SEQ ID NO: 1860129 - protein, 4 aa, Staphylococcus
NQVP

SEQ ID NO: 1860130 - protein, 12 aa, Staphylococcus
NQVPSTTGMTQQ

SEQ ID NO: 1860131 - protein, 4 aa, Staphylococcus
NQVS

SEQ ID NO: 1860132 - protein, 7 aa, Staphylococcus
NQYDIES

SEQ ID NO: 1860133 - protein, 12 aa, Staphylococcus
NQYKNDSDWHAE

SEQ ID NO: 1860134 - protein, 8 aa, Staphylococcus
NRAGTEKG

SEQ ID NO: 1860135 - protein, 9 aa, Staphylococcus
NRANQSDTR

SEQ ID NO: 1860136 - protein, 21 aa, Staphylococcus
NRAQTAKEVQDIQASETRTAV

SEQ ID NO: 1860137 - protein, 10 aa, Staphylococcus
NRDKKDTGVQ

SEQ ID NO: 1860138 - protein, 6 aa, Staphylococcus
NRDKSF

SEQ ID NO: 1860139 - protein, 5 aa, Staphylococcus
NREDV

SEQ ID NO: 1860140 - protein, 4 aa, Staphylococcus
NREE

SEQ ID NO: 1860141 - protein, 51 aa, Staphylococcus
NREEQNKFSNSNSNLSIKPSTDKPSSDSLNRTNSNTPASLNTNTNSRYSQL

SEQ ID NO: 1860142 - protein, 8 aa, Staphylococcus
NREGHSDS

SEQ ID NO: 1860143 - protein, 19 aa, Staphylococcus
NREREIEKESKKENKKNIK

SEQ ID NO: 1860144 - protein, 7 aa, Staphylococcus
NRETMSG

SEQ ID NO: 1860145 - protein, 16 aa, Staphylococcus
NRGKANALNEGVKHSS

SEQ ID NO: 1860146 - protein, 15 aa, Staphylococcus
NRGPNINSNQIGVEQ

SEQ ID NO: 1860147 - protein, 5 aa, Staphylococcus
NRHRT

SEQ ID NO: 1860148 - protein, 5 aa, Staphylococcus
NRHTR

SEQ ID NO: 1860149 - protein, 22 aa, Staphylococcus
NRHYRRESSNYKTSSVADDTKI

SEQ ID NO: 1860150 - protein, 29 aa, Staphylococcus
NRHYRRGSANYKANTVANDTDHSYTTRVD

SEQ ID NO: 1860151 - protein, 31 aa, Staphylococcus
NRHYRRGSANYRANSVANDANQNYTTNVEKN

SEQ ID NO: 1860152 - protein, 34 aa, Staphylococcus
NRHYRRGSANYRNTSVGNDANHSNENYTTNVEKN

SEQ ID NO: 1860153 - protein, 9 aa, Staphylococcus
NRKHQREEN

SEQ ID NO: 1860154 - protein, 11 aa, Staphylococcus
NRKISHNDRSH

SEQ ID NO: 1860155 - protein, 10 aa, Staphylococcus
NRKKNLTEAQ

SEQ ID NO: 1860156 - protein, 6 aa, Staphylococcus
NRKRSD

SEQ ID NO: 1860157 - protein, 13 aa, Staphylococcus
NRKVKSSDSSELY

SEQ ID NO: 1860158 - protein, 6 aa, Staphylococcus
NRKYNN

SEQ ID NO: 1860159 - protein, 4 aa, Staphylococcus
NRLG

SEQ ID NO: 1860160 - protein, 5 aa, Staphylococcus
NRLQE

SEQ ID NO: 1860161 - protein, 13 aa, Staphylococcus
NRLQKQVRHNSER

SEQ ID NO: 1860162 - protein, 12 aa, Staphylococcus
NRNAKDTDSSSE

SEQ ID NO: 1860163 - protein, 6 aa, Staphylococcus
NRNLAS

SEQ ID NO: 1860164 - protein, 16 aa, Staphylococcus
NRNNPDLRKAVEDQRG

SEQ ID NO: 1860165 - protein, 5 aa, Staphylococcus
NRPGL

SEQ ID NO: 1860166 - protein, 14 aa, Staphylococcus
NRPKLERYYHKLKN

SEQ ID NO: 1860167 - protein, 36 aa, Staphylococcus
NRPKYLKQDTNLNDEKGRQNVASIQSTNRDYRDNHK

SEQ ID NO: 1860168 - protein, 4 aa, Staphylococcus
NRPR

SEQ ID NO: 1860169 - protein, 5 aa, Staphylococcus
NRPRL

SEQ ID NO: 1860170 - protein, 16 aa, Staphylococcus
NRPTISEEDEDESHAK

SEQ ID NO: 1860171 - protein, 5 aa, Staphylococcus
NRQIS

SEQ ID NO: 1860172 - protein, 8 aa, Staphylococcus
NRRAMPTT

SEQ ID NO: 1860173 - protein, 10 aa, Staphylococcus
NRRGRKSKNT

SEQ ID NO: 1860174 - protein, 12 aa, Staphylococcus
NRRKKQKNNKNK

SEQ ID NO: 1860175 - protein, 6 aa, Staphylococcus
NRRKVR

SEQ ID NO: 1860176 - protein, 8 aa, Staphylococcus
NRRSATST

SEQ ID NO: 1860177 - protein, 21 aa, Staphylococcus
NRRVTSTSFSYSASGHGTIDN

SEQ ID NO: 1860178 - protein, 11 aa, Staphylococcus
NRSLGDKKSAL

SEQ ID NO: 1860179 - protein, 14 aa, Staphylococcus
NRSLSDNKKAEKYI

SEQ ID NO: 1860180 - protein, 11 aa, Staphylococcus
NRSSHGRKRSV

SEQ ID NO: 1860181 - protein, 10 aa, Staphylococcus
NRTDGVDQAT

SEQ ID NO: 1860182 - protein, 7 aa, Staphylococcus
NRTGGFD

SEQ ID NO: 1860183 - protein, 5 aa, Staphylococcus
NRTGK

SEQ ID NO: 1860184 - protein, 5 aa, Staphylococcus
NRTIR

SEQ ID NO: 1860185 - protein, 5 aa, Staphylococcus
NRTNT

SEQ ID NO: 1860186 - protein, 4 aa, Staphylococcus
NRTR

SEQ ID NO: 1860187 - protein, 6 aa, Staphylococcus
NRVPNS

SEQ ID NO: 1860188 - protein, 8 aa, Staphylococcus
NRYKRSIE

SEQ ID NO: 1860189 - protein, 31 aa, Staphylococcus
NRYKRSIEVSEQALESVEPGITKHIENEVIK

SEQ ID NO: 1860190 - protein, 5 aa, Staphylococcus
NRYPA

SEQ ID NO: 1860191 - protein, 4 aa, Staphylococcus
NRYQ

SEQ ID NO: 1860192 - protein, 18 aa, Staphylococcus
NRYRKDDNSLDKSLNEAE

SEQ ID NO: 1860193 - protein, 18 aa, Staphylococcus
NRYRKDDSSIDKSLNEAE

SEQ ID NO: 1860194 - protein, 18 aa, Staphylococcus
NRYRKDHHTVDKSLNEAE

SEQ ID NO: 1860195 - protein, 18 aa, Staphylococcus
NRYRKDHNNVDKSLNEAE

SEQ ID NO: 1860196 - protein, 18 aa, Staphylococcus
NRYRKDHNSVDKSLNEAE

SEQ ID NO: 1860197 - protein, 18 aa, Staphylococcus
NRYRKDHQSVDKSLNEAE

SEQ ID NO: 1860198 - protein, 4 aa, Staphylococcus
NRYS

SEQ ID NO: 1860199 - protein, 6 aa, Staphylococcus
NSADKI

SEQ ID NO: 1860200 - protein, 4 aa, Staphylococcus
NSAG

SEQ ID NO: 1860201 - protein, 9 aa, Staphylococcus
NSAHSQSDF

SEQ ID NO: 1860202 - protein, 25 aa, Staphylococcus
NSAIDEAKIKGAGAVGVTQSGKHNT

SEQ ID NO: 1860203 - protein, 6 aa, Staphylococcus
NSAKIP

SEQ ID NO: 1860204 - protein, 10 aa, Staphylococcus
NSAKKYGPVL

SEQ ID NO: 1860205 - protein, 9 aa, Staphylococcus
NSALSEENL

SEQ ID NO: 1860206 - protein, 7 aa, Staphylococcus
NSANGEL

SEQ ID NO: 1860207 - protein, 8 aa, Staphylococcus
NSANGELF

SEQ ID NO: 1860208 - protein, 9 aa, Staphylococcus
NSANGELFS

SEQ ID NO: 1860209 - protein, 12 aa, Staphylococcus
NSAQPTAGTSYE

SEQ ID NO: 1860210 - protein, 10 aa, Staphylococcus
NSATTNLNNG

SEQ ID NO: 1860211 - protein, 16 aa, Staphylococcus
NSDAEKNNSSKKLRNK

SEQ ID NO: 1860212 - protein, 4 aa, Staphylococcus
NSDE

SEQ ID NO: 1860213 - protein, 12 aa, Staphylococcus
NSDEEETPPNRA

SEQ ID NO: 1860214 - protein, 6 aa, Staphylococcus
NSDESP

SEQ ID NO: 1860215 - protein, 12 aa, Staphylococcus
NSDGSFASDSVR

SEQ ID NO: 1860216 - protein, 20 aa, Staphylococcus
NSDHNTEKDKNEQQKPLTLE

SEQ ID NO: 1860217 - protein, 10 aa, Staphylococcus
NSDINESDTT

SEQ ID NO: 1860218 - protein, 16 aa, Staphylococcus
NSDIYQPKSMTTYTTN

SEQ ID NO: 1860219 - protein, 8 aa, Staphylococcus
NSDKAVDK

SEQ ID NO: 1860220 - protein, 9 aa, Staphylococcus
NSDKLPNKL

SEQ ID NO: 1860221 - protein, 5 aa, Staphylococcus
NSDMS

SEQ ID NO: 1860222 - protein, 14 aa, Staphylococcus
NSDSDIDISDEDFD

SEQ ID NO: 1860223 - protein, 46 aa, Staphylococcus
NSDSTSTSISTSTSMSLNESTSESESISASKSTSIVDSESESTSIV

SEQ ID NO: 1860224 - protein, 8 aa, Staphylococcus
NSDTARPY

SEQ ID NO: 1860225 - protein, 4 aa, Staphylococcus
NSDW

SEQ ID NO: 1860226 - protein, 147 aa, Staphylococcus
NSEAHTAEIKSDDNTQKVVNKEYSDGISQEQQDKSLNLAQDKEKSNNVNKNKVTDVGTSDVLKDTKTTHENVQQQDNVASKEETTKKTPSAIDKNNTSAQSEVVTSSDATKTSTALNQVDRNQLSSQSTSERPKKRVKRDVGTDDKQ

SEQ ID NO: 1860227 - protein, 45 aa, Staphylococcus
NSEDIDKENSSNDGTNLEDENLPESNSNDNHQMNGTISEAGEESN

SEQ ID NO: 1860228 - protein, 4 aa, Staphylococcus
NSEH

SEQ ID NO: 1860229 - protein, 5 aa, Staphylococcus
NSEKI

SEQ ID NO: 1860230 - protein, 5 aa, Staphylococcus
NSEKQ

SEQ ID NO: 1860231 - protein, 4 aa, Staphylococcus
NSEL

SEQ ID NO: 1860232 - protein, 13 aa, Staphylococcus
NSELEYQPNTPQG

SEQ ID NO: 1860233 - protein, 7 aa, Staphylococcus
NSENLTV

SEQ ID NO: 1860234 - protein, 5 aa, Staphylococcus
NSEPI

SEQ ID NO: 1860235 - protein, 4 aa, Staphylococcus
NSEQ

SEQ ID NO: 1860236 - protein, 7 aa, Staphylococcus
NSETDLK

SEQ ID NO: 1860237 - protein, 12 aa, Staphylococcus
NSFDPKSAEHNA

SEQ ID NO: 1860238 - protein, 13 aa, Staphylococcus
NSFEKENEKEHKR

SEQ ID NO: 1860239 - protein, 5 aa, Staphylococcus
NSFGP

SEQ ID NO: 1860240 - protein, 8 aa, Staphylococcus
NSFPEDEV

SEQ ID NO: 1860241 - protein, 15 aa, Staphylococcus
NSFSTLSKSKGESLA

SEQ ID NO: 1860242 - protein, 22 aa, Staphylococcus
NSFTGRGSTILNGKGGYGKHKT

SEQ ID NO: 1860243 - protein, 24 aa, Staphylococcus
NSGDKKSLESAESVRSGLANNSNI

SEQ ID NO: 1860244 - protein, 8 aa, Staphylococcus
NSGDLTNS

SEQ ID NO: 1860245 - protein, 13 aa, Staphylococcus
NSGEGPILGGSLG

SEQ ID NO: 1860246 - protein, 17 aa, Staphylococcus
NSGESILTTGKDRVETI

SEQ ID NO: 1860247 - protein, 6 aa, Staphylococcus
NSGETI

SEQ ID NO: 1860248 - protein, 6 aa, Staphylococcus
NSGETL

SEQ ID NO: 1860249 - protein, 9 aa, Staphylococcus
NSGETTELA

SEQ ID NO: 1860250 - protein, 7 aa, Staphylococcus
NSGKETA

SEQ ID NO: 1860251 - protein, 9 aa, Staphylococcus
NSGLDTEAA

SEQ ID NO: 1860252 - protein, 5 aa, Staphylococcus
NSGLL

SEQ ID NO: 1860253 - protein, 4 aa, Staphylococcus
NSGM

SEQ ID NO: 1860254 - protein, 4 aa, Staphylococcus
NSGN

SEQ ID NO: 1860255 - protein, 6 aa, Staphylococcus
NSGPAL

SEQ ID NO: 1860256 - protein, 8 aa, Staphylococcus
NSGSYITS

SEQ ID NO: 1860257 - protein, 11 aa, Staphylococcus
NSGTMSAKEAA

SEQ ID NO: 1860258 - protein, 7 aa, Staphylococcus
NSGTTIG

SEQ ID NO: 1860259 - protein, 6 aa, Staphylococcus
NSGVEA

SEQ ID NO: 1860260 - protein, 6 aa, Staphylococcus
NSHSPS

SEQ ID NO: 1860261 - protein, 15 aa, Staphylococcus
NSIDTVDQSLTNAEV

SEQ ID NO: 1860262 - protein, 31 aa, Staphylococcus
NSIKDKDQVKNSSDYINEDPAEQQAYDNAVT

SEQ ID NO: 1860263 - protein, 27 aa, Staphylococcus
NSIQDQATVRQESRYINENEDKQQAYN

SEQ ID NO: 1860264 - protein, 7 aa, Staphylococcus
NSISEST

SEQ ID NO: 1860265 - protein, 5 aa, Staphylococcus
NSKAE

SEQ ID NO: 1860266 - protein, 13 aa, Staphylococcus
NSKAKAKLKDNPL

SEQ ID NO: 1860267 - protein, 18 aa, Staphylococcus
NSKAKQKNANAKSVKKNN

SEQ ID NO: 1860268 - protein, 10 aa, Staphylococcus
NSKDKVKKVQ

SEQ ID NO: 1860269 - protein, 7 aa, Staphylococcus
NSKDREI

SEQ ID NO: 1860270 - protein, 5 aa, Staphylococcus
NSKDY

SEQ ID NO: 1860271 - protein, 4 aa, Staphylococcus
NSKE

SEQ ID NO: 1860272 - protein, 22 aa, Staphylococcus
NSKIGPSEVLGGSSSEFSPTQL

SEQ ID NO: 1860273 - protein, 33 aa, Staphylococcus
NSKKNKATRSETHSTQQHHRRRTKREGLTQEGL

SEQ ID NO: 1860274 - protein, 9 aa, Staphylococcus
NSKKYYKNL

SEQ ID NO: 1860275 - protein, 8 aa, Staphylococcus
NSKNGASL

SEQ ID NO: 1860276 - protein, 15 aa, Staphylococcus
NSKPEAGSRINQGDA

SEQ ID NO: 1860277 - protein, 5 aa, Staphylococcus
NSKQV

SEQ ID NO: 1860278 - protein, 8 aa, Staphylococcus
NSKQVDAK

SEQ ID NO: 1860279 - protein, 9 aa, Staphylococcus
NSKQVKAKL

SEQ ID NO: 1860280 - protein, 7 aa, Staphylococcus
NSKQYKN

SEQ ID NO: 1860281 - protein, 7 aa, Staphylococcus
NSKSELL

SEQ ID NO: 1860282 - protein, 6 aa, Staphylococcus
NSKTDN

SEQ ID NO: 1860283 - protein, 16 aa, Staphylococcus
NSKTNVNADMSTSTGI

SEQ ID NO: 1860284 - protein, 5 aa, Staphylococcus
NSLEP

SEQ ID NO: 1860285 - protein, 22 aa, Staphylococcus
NSLKDSSKKNVDNELNDLKDKH

SEQ ID NO: 1860286 - protein, 10 aa, Staphylococcus
NSLKTDKNTV

SEQ ID NO: 1860287 - protein, 8 aa, Staphylococcus
NSLRQTAQ

SEQ ID NO: 1860288 - protein, 5 aa, Staphylococcus
NSLSG

SEQ ID NO: 1860289 - protein, 12 aa, Staphylococcus
NSLSNSLGTDGG

SEQ ID NO: 1860290 - protein, 5 aa, Staphylococcus
NSLST

SEQ ID NO: 1860291 - protein, 14 aa, Staphylococcus
NSLSTSNSVSVSTL

SEQ ID NO: 1860292 - protein, 11 aa, Staphylococcus
NSLTDGEKMNH

SEQ ID NO: 1860293 - protein, 7 aa, Staphylococcus
NSLTNKE

SEQ ID NO: 1860294 - protein, 9 aa, Staphylococcus
NSMAGQNIG

SEQ ID NO: 1860295 - protein, 10 aa, Staphylococcus
NSNAEADADV

SEQ ID NO: 1860296 - protein, 10 aa, Staphylococcus
NSNDTSNGLG

SEQ ID NO: 1860297 - protein, 12 aa, Staphylococcus
NSNEDEEMKGEG

SEQ ID NO: 1860298 - protein, 4 aa, Staphylococcus
NSNF

SEQ ID NO: 1860299 - protein, 5 aa, Staphylococcus
NSNKS

SEQ ID NO: 1860300 - protein, 10 aa, Staphylococcus
NSNNETGTLT

SEQ ID NO: 1860301 - protein, 11 aa, Staphylococcus
NSNNNIKRTGE

SEQ ID NO: 1860302 - protein, 18 aa, Staphylococcus
NSNNPTQSTHTRPNLSDL

SEQ ID NO: 1860303 - protein, 50 aa, Staphylococcus
NSNQSNKESNFTSENEHNHNQVTQHGEKHSDQQNDKSLPNTGEDETNRGG

SEQ ID NO: 1860304 - protein, 4 aa, Staphylococcus
NSNT

SEQ ID NO: 1860305 - protein, 7 aa, Staphylococcus
NSNTKDK

SEQ ID NO: 1860306 - protein, 13 aa, Staphylococcus
NSNTQNQETIDDS

SEQ ID NO: 1860307 - protein, 13 aa, Staphylococcus
NSNTVTYEQTYDG

SEQ ID NO: 1860308 - protein, 6 aa, Staphylococcus
NSPEAQ

SEQ ID NO: 1860309 - protein, 7 aa, Staphylococcus
NSPEAQS

SEQ ID NO: 1860310 - protein, 7 aa, Staphylococcus
NSPEAQT

SEQ ID NO: 1860311 - protein, 6 aa, Staphylococcus
NSPEFQ

SEQ ID NO: 1860312 - protein, 7 aa, Staphylococcus
NSPERKY

SEQ ID NO: 1860313 - protein, 9 aa, Staphylococcus
NSPKDATIL

SEQ ID NO: 1860314 - protein, 7 aa, Staphylococcus
NSPNAQT

SEQ ID NO: 1860315 - protein, 6 aa, Staphylococcus
NSPNLY

SEQ ID NO: 1860316 - protein, 5 aa, Staphylococcus
NSPQY

SEQ ID NO: 1860317 - protein, 5 aa, Staphylococcus
NSPRY

SEQ ID NO: 1860318 - protein, 12 aa, Staphylococcus
NSPRYDELLENL

SEQ ID NO: 1860319 - protein, 9 aa, Staphylococcus
NSPSEDTLT

SEQ ID NO: 1860320 - protein, 5 aa, Staphylococcus
NSPTA

SEQ ID NO: 1860321 - protein, 6 aa, Staphylococcus
NSPTEL

SEQ ID NO: 1860322 - protein, 22 aa, Staphylococcus
NSQAIISKGDKGEAGENGQSIT

SEQ ID NO: 1860323 - protein, 13 aa, Staphylococcus
NSQFRDSFSPDYA

SEQ ID NO: 1860324 - protein, 10 aa, Staphylococcus
NSQGNVNTKQ

SEQ ID NO: 1860325 - protein, 7 aa, Staphylococcus
NSQNKES

SEQ ID NO: 1860326 - protein, 7 aa, Staphylococcus
NSQQTGY

SEQ ID NO: 1860327 - protein, 9 aa, Staphylococcus
NSQSEDTIT

SEQ ID NO: 1860328 - protein, 8 aa, Staphylococcus
NSRDEIGE

SEQ ID NO: 1860329 - protein, 11 aa, Staphylococcus
NSRLGRYTESS

SEQ ID NO: 1860330 - protein, 4 aa, Staphylococcus
NSRS

SEQ ID NO: 1860331 - protein, 11 aa, Staphylococcus
NSRSGGSTITQ

SEQ ID NO: 1860332 - protein, 4 aa, Staphylococcus
NSSD

SEQ ID NO: 1860333 - protein, 7 aa, Staphylococcus
NSSDMKG

SEQ ID NO: 1860334 - protein, 11 aa, Staphylococcus
NSSGVTIAEGT

SEQ ID NO: 1860335 - protein, 7 aa, Staphylococcus
NSSLSHP

SEQ ID NO: 1860336 - protein, 7 aa, Staphylococcus
NSSNNTH

SEQ ID NO: 1860337 - protein, 12 aa, Staphylococcus
NSSNSDKLIEGS

SEQ ID NO: 1860338 - protein, 39 aa, Staphylococcus
NSSQEQSQENNIHNQDKYENVSNNESTQNDDSNSSNKGK

SEQ ID NO: 1860339 - protein, 6 aa, Staphylococcus
NSSQVA

SEQ ID NO: 1860340 - protein, 6 aa, Staphylococcus
NSSRFT

SEQ ID NO: 1860341 - protein, 27 aa, Staphylococcus
NSSRIADELKRNESELVPGNSNSSIEG

SEQ ID NO: 1860342 - protein, 8 aa, Staphylococcus
NSSSSEEM

SEQ ID NO: 1860343 - protein, 12 aa, Staphylococcus
NSSSSNKLIAGA

SEQ ID NO: 1860344 - protein, 12 aa, Staphylococcus
NSSTDKDEREKI

SEQ ID NO: 1860345 - protein, 5 aa, Staphylococcus
NSSTI

SEQ ID NO: 1860346 - protein, 14 aa, Staphylococcus
NSTDYKSTQGHQQA

SEQ ID NO: 1860347 - protein, 9 aa, Staphylococcus
NSTEQQDRM

SEQ ID NO: 1860348 - protein, 4 aa, Staphylococcus
NSTF

SEQ ID NO: 1860349 - protein, 11 aa, Staphylococcus
NSTGGVLGPQD

SEQ ID NO: 1860350 - protein, 15 aa, Staphylococcus
NSTHGGIKSGISTTL

SEQ ID NO: 1860351 - protein, 6 aa, Staphylococcus
NSTIEV

SEQ ID NO: 1860352 - protein, 7 aa, Staphylococcus
NSTIRRA

SEQ ID NO: 1860353 - protein, 78 aa, Staphylococcus
NSTLTTDTASNPQSFEKKANNSTHEDVQNAASTYQSNPLKNTENTTKAEIQSQITSKTTHSVKENANAQAIAASSQIE

SEQ ID NO: 1860354 - protein, 5 aa, Staphylococcus
NSTNR

SEQ ID NO: 1860355 - protein, 10 aa, Staphylococcus
NSTPQSTKIP

SEQ ID NO: 1860356 - protein, 10 aa, Staphylococcus
NSTQNEENID

SEQ ID NO: 1860357 - protein, 9 aa, Staphylococcus
NSTTTFPYG

SEQ ID NO: 1860358 - protein, 18 aa, Staphylococcus
NSTVSNDSNNDSKASKEL

SEQ ID NO: 1860359 - protein, 9 aa, Staphylococcus
NSVEGSRAI

SEQ ID NO: 1860360 - protein, 6 aa, Staphylococcus
NSVHSK

SEQ ID NO: 1860361 - protein, 6 aa, Staphylococcus
NSVPGI

SEQ ID NO: 1860362 - protein, 5 aa, Staphylococcus
NSVSP

SEQ ID NO: 1860363 - protein, 45 aa, Staphylococcus
NSVTKDSNEGINDTKLNKASATSDDVAKEETVSNTDTEKVGASSS

SEQ ID NO: 1860364 - protein, 14 aa, Staphylococcus
NSYASEYEPTPTEI

SEQ ID NO: 1860365 - protein, 4 aa, Staphylococcus
NSYD

SEQ ID NO: 1860366 - protein, 33 aa, Staphylococcus
NSYQNINTNNDGSALDIDKEKNKKAIESFLKDN

SEQ ID NO: 1860367 - protein, 33 aa, Staphylococcus
NSYQNINTNNDGSALDIDKQKNKEAIKKFLDDD

SEQ ID NO: 1860368 - protein, 5 aa, Staphylococcus
NSYQT

SEQ ID NO: 1860369 - protein, 9 aa, Staphylococcus
NTADKTGIK

SEQ ID NO: 1860370 - protein, 14 aa, Staphylococcus
NTADPEKVKSTNIT

SEQ ID NO: 1860371 - protein, 6 aa, Staphylococcus
NTAGGV

SEQ ID NO: 1860372 - protein, 7 aa, Staphylococcus
NTANERE

SEQ ID NO: 1860373 - protein, 4 aa, Staphylococcus
NTAQ

SEQ ID NO: 1860374 - protein, 7 aa, Staphylococcus
NTATATQ

SEQ ID NO: 1860375 - protein, 38 aa, Staphylococcus
NTATNVSNGVKNTAETVKNTVGEAVNNIGDNMNPMKWK

SEQ ID NO: 1860376 - protein, 9 aa, Staphylococcus
NTAYGRDGK

SEQ ID NO: 1860377 - protein, 9 aa, Staphylococcus
NTDATPNLA

SEQ ID NO: 1860378 - protein, 6 aa, Staphylococcus
NTDELG

SEQ ID NO: 1860379 - protein, 5 aa, Staphylococcus
NTDKS

SEQ ID NO: 1860380 - protein, 5 aa, Staphylococcus
NTDKV

SEQ ID NO: 1860381 - protein, 10 aa, Staphylococcus
NTDTSESMKN

SEQ ID NO: 1860382 - protein, 10 aa, Staphylococcus
NTDTVSVGAS

SEQ ID NO: 1860383 - protein, 16 aa, Staphylococcus
NTELKNYKGQLTDRGP

SEQ ID NO: 1860384 - protein, 12 aa, Staphylococcus
NTENVGEISKPK

SEQ ID NO: 1860385 - protein, 6 aa, Staphylococcus
NTEQVE

SEQ ID NO: 1860386 - protein, 19 aa, Staphylococcus
NTEQVTDEHHNKDTKHSDE

SEQ ID NO: 1860387 - protein, 22 aa, Staphylococcus
NTEVTINGTGPNGSTIIDDSTE

SEQ ID NO: 1860388 - protein, 6 aa, Staphylococcus
NTFDGV

SEQ ID NO: 1860389 - protein, 4 aa, Staphylococcus
NTFP

SEQ ID NO: 1860390 - protein, 4 aa, Staphylococcus
NTFT

SEQ ID NO: 1860391 - protein, 9 aa, Staphylococcus
NTGEGGLSN

SEQ ID NO: 1860392 - protein, 20 aa, Staphylococcus
NTGKSATQNVTISEKGTSHS

SEQ ID NO: 1860393 - protein, 7 aa, Staphylococcus
NTGNSFG

SEQ ID NO: 1860394 - protein, 28 aa, Staphylococcus
NTGRISVQRSSKEHGFGDNSSYYHGGSV

SEQ ID NO: 1860395 - protein, 7 aa, Staphylococcus
NTGSHEY

SEQ ID NO: 1860396 - protein, 23 aa, Staphylococcus
NTHADSTETSRTMTQAQDQNHSL

SEQ ID NO: 1860397 - protein, 6 aa, Staphylococcus
NTHGKF

SEQ ID NO: 1860398 - protein, 7 aa, Staphylococcus
NTHGTEA

SEQ ID NO: 1860399 - protein, 6 aa, Staphylococcus
NTIAES

SEQ ID NO: 1860400 - protein, 5 aa, Staphylococcus
NTIAG

SEQ ID NO: 1860401 - protein, 5 aa, Staphylococcus
NTIDV

SEQ ID NO: 1860402 - protein, 6 aa, Staphylococcus
NTIEQT

SEQ ID NO: 1860403 - protein, 6 aa, Staphylococcus
NTIGKS

SEQ ID NO: 1860404 - protein, 5 aa, Staphylococcus
NTIGR

SEQ ID NO: 1860405 - protein, 8 aa, Staphylococcus
NTIKSDDK

SEQ ID NO: 1860406 - protein, 7 aa, Staphylococcus
NTIKTTG

SEQ ID NO: 1860407 - protein, 6 aa, Staphylococcus
NTINYP

SEQ ID NO: 1860408 - protein, 7 aa, Staphylococcus
NTINYPA

SEQ ID NO: 1860409 - protein, 9 aa, Staphylococcus
NTIQKEKRY

SEQ ID NO: 1860410 - protein, 9 aa, Staphylococcus
NTIQKTGYG

SEQ ID NO: 1860411 - protein, 20 aa, Staphylococcus
NTITIEKGRDGRDGQDGKSI

SEQ ID NO: 1860412 - protein, 56 aa, Staphylococcus
NTITIEKGRDGRDGRDGRDGRDGNNGQNGYNGNNGYNGQNGYNGQNGYNGKDGQSI

SEQ ID NO: 1860413 - protein, 22 aa, Staphylococcus
NTITRPTGKPIKQLSATDQLNE

SEQ ID NO: 1860414 - protein, 6 aa, Staphylococcus
NTKAFT

SEQ ID NO: 1860415 - protein, 5 aa, Staphylococcus
NTKGI

SEQ ID NO: 1860416 - protein, 6 aa, Staphylococcus
NTKGIK

SEQ ID NO: 1860417 - protein, 5 aa, Staphylococcus
NTKLL

SEQ ID NO: 1860418 - protein, 8 aa, Staphylococcus
NTKLRNTL

SEQ ID NO: 1860419 - protein, 5 aa, Staphylococcus
NTLDT

SEQ ID NO: 1860420 - protein, 5 aa, Staphylococcus
NTLGN

SEQ ID NO: 1860421 - protein, 4 aa, Staphylococcus
NTLN

SEQ ID NO: 1860422 - protein, 11 aa, Staphylococcus
NTLRHSNGTKV

SEQ ID NO: 1860423 - protein, 10 aa, Staphylococcus
NTLRHSNGTR

SEQ ID NO: 1860424 - protein, 8 aa, Staphylococcus
NTNDTSMA

SEQ ID NO: 1860425 - protein, 5 aa, Staphylococcus
NTNEG

SEQ ID NO: 1860426 - protein, 11 aa, Staphylococcus
NTNGKTFTTNT

SEQ ID NO: 1860427 - protein, 8 aa, Staphylococcus
NTNLQQND

SEQ ID NO: 1860428 - protein, 13 aa, Staphylococcus
NTNLQQNDYVDTE

SEQ ID NO: 1860429 - protein, 4 aa, Staphylococcus
NTNV

SEQ ID NO: 1860430 - protein, 57 aa, Staphylococcus
NTPANEVDDSNVNSESINDMKNDNKTQNVGTTPLTEKSLQNKNDNKKTEKEVKNKDV

SEQ ID NO: 1860431 - protein, 17 aa, Staphylococcus
NTPDHPEQSATNDANGK

SEQ ID NO: 1860432 - protein, 13 aa, Staphylococcus
NTPGRGDDEIADP

SEQ ID NO: 1860433 - protein, 42 aa, Staphylococcus
NTPGRGDNLLPDPTSDEATTGDVDENETQTKSTNKYSQPAKQ

SEQ ID NO: 1860434 - protein, 4 aa, Staphylococcus
NTPI

SEQ ID NO: 1860435 - protein, 13 aa, Staphylococcus
NTPIKQTRQDEIG

SEQ ID NO: 1860436 - protein, 13 aa, Staphylococcus
NTPPNFKQPFKAK

SEQ ID NO: 1860437 - protein, 13 aa, Staphylococcus
NTPPNFKQPFKAR

SEQ ID NO: 1860438 - protein, 5 aa, Staphylococcus
NTPVK

SEQ ID NO: 1860439 - protein, 7 aa, Staphylococcus
NTQAPQT

SEQ ID NO: 1860440 - protein, 10 aa, Staphylococcus
NTQDKGEISV

SEQ ID NO: 1860441 - protein, 4 aa, Staphylococcus
NTQE

SEQ ID NO: 1860442 - protein, 8 aa, Staphylococcus
NTQTDGDI

SEQ ID NO: 1860443 - protein, 6 aa, Staphylococcus
NTRKEY

SEQ ID NO: 1860444 - protein, 50 aa, Staphylococcus
NTRLNDAQGYLTSAQQRVGDYQEAAGRAQEVNNQANSALRQQSTSGLPQY

SEQ ID NO: 1860445 - protein, 9 aa, Staphylococcus
NTRSEDSIT

SEQ ID NO: 1860446 - protein, 4 aa, Staphylococcus
NTSD

SEQ ID NO: 1860447 - protein, 9 aa, Staphylococcus
NTSDKAEEL

SEQ ID NO: 1860448 - protein, 9 aa, Staphylococcus
NTSEKAEEL

SEQ ID NO: 1860449 - protein, 10 aa, Staphylococcus
NTSEKAHEAG

SEQ ID NO: 1860450 - protein, 10 aa, Staphylococcus
NTSEKAHQEG

SEQ ID NO: 1860451 - protein, 8 aa, Staphylococcus
NTSELDYP

SEQ ID NO: 1860452 - protein, 7 aa, Staphylococcus
NTSENTA

SEQ ID NO: 1860453 - protein, 8 aa, Staphylococcus
NTSKRAQE

SEQ ID NO: 1860454 - protein, 5 aa, Staphylococcus
NTSLY

SEQ ID NO: 1860455 - protein, 15 aa, Staphylococcus
NTSNDKKDKEERHLN

SEQ ID NO: 1860456 - protein, 122 aa, Staphylococcus
NTSQTSSTATSSSTKKDDTIPSEVNSEKPTTQKDSEQPTQPEPTKPTTQKEQEKPAQPEPSKPATQKEPEQPTQSGPSKPTTQEEPEKPTQSGPTKPTTQKEPVIPTKQQENNQNNVNDKPK

SEQ ID NO: 1860457 - protein, 4 aa, Staphylococcus
NTSS

SEQ ID NO: 1860458 - protein, 5 aa, Staphylococcus
NTSSA

SEQ ID NO: 1860459 - protein, 9 aa, Staphylococcus
NTSSNDPLI

SEQ ID NO: 1860460 - protein, 31 aa, Staphylococcus
NTSSSGVERNNQSNNNENNNMNQDVQLDPFS

SEQ ID NO: 1860461 - protein, 30 aa, Staphylococcus
NTSSSGVESGESTDVKSGNQTNNSVSLYPF

SEQ ID NO: 1860462 - protein, 8 aa, Staphylococcus
NTTEEAQQ

SEQ ID NO: 1860463 - protein, 9 aa, Staphylococcus
NTTKNTVGI

SEQ ID NO: 1860464 - protein, 6 aa, Staphylococcus
NTTLKD

SEQ ID NO: 1860465 - protein, 24 aa, Staphylococcus
NTTLKIPKGPKGDKGDQGPAGKSI

SEQ ID NO: 1860466 - protein, 7 aa, Staphylococcus
NTTLRDT

SEQ ID NO: 1860467 - protein, 8 aa, Staphylococcus
NTTPSKEN

SEQ ID NO: 1860468 - protein, 27 aa, Staphylococcus
NTTSSSNEDNSTKDHIHTEKRRPTGNK

SEQ ID NO: 1860469 - protein, 5 aa, Staphylococcus
NTTVR

SEQ ID NO: 1860470 - protein, 14 aa, Staphylococcus
NTTVTTAVNPNDSI

SEQ ID NO: 1860471 - protein, 10 aa, Staphylococcus
NTVDRDGEFV

SEQ ID NO: 1860472 - protein, 8 aa, Staphylococcus
NTVPETSA

SEQ ID NO: 1860473 - protein, 5 aa, Staphylococcus
NTVQS

SEQ ID NO: 1860474 - protein, 12 aa, Staphylococcus
NTVRSNQVDEQK

SEQ ID NO: 1860475 - protein, 6 aa, Staphylococcus
NTVSNK

SEQ ID NO: 1860476 - protein, 4 aa, Staphylococcus
NTYQ

SEQ ID NO: 1860477 - protein, 31 aa, Staphylococcus
NTYQDINTNNDGSALQIDKEKNKKAIQDFFD

SEQ ID NO: 1860478 - protein, 10 aa, Staphylococcus
NTYSAAPKII

SEQ ID NO: 1860479 - protein, 8 aa, Staphylococcus
NTYSHDEE

SEQ ID NO: 1860480 - protein, 7 aa, Staphylococcus
NTYTQRH

SEQ ID NO: 1860481 - protein, 8 aa, Staphylococcus
NVAANKQV

SEQ ID NO: 1860482 - protein, 5 aa, Staphylococcus
NVADQ

SEQ ID NO: 1860483 - protein, 27 aa, Staphylococcus
NVANKTKTLLEEPSVAKSIGNKTVPNL

SEQ ID NO: 1860484 - protein, 6 aa, Staphylococcus
NVANRK

SEQ ID NO: 1860485 - protein, 16 aa, Staphylococcus
NVAPDEVKKPDARNTI

SEQ ID NO: 1860486 - protein, 7 aa, Staphylococcus
NVAQGGA

SEQ ID NO: 1860487 - protein, 24 aa, Staphylococcus
NVDNQGSNSKDYEPNTIGKPLNQG

SEQ ID NO: 1860488 - protein, 28 aa, Staphylococcus
NVDQPINSDSVEISGGFNGKKGVKEAKQ

SEQ ID NO: 1860489 - protein, 9 aa, Staphylococcus
NVDSDRNKK

SEQ ID NO: 1860490 - protein, 14 aa, Staphylococcus
NVDTVSKAQLNGNN

SEQ ID NO: 1860491 - protein, 15 aa, Staphylococcus
NVDTVSKAQLTDNNN

SEQ ID NO: 1860492 - protein, 9 aa, Staphylococcus
NVENIGSQA

SEQ ID NO: 1860493 - protein, 9 aa, Staphylococcus
NVEQVQKET

SEQ ID NO: 1860494 - protein, 23 aa, Staphylococcus
NVETSHGQKVTDEHHNTDTTYNQ

SEQ ID NO: 1860495 - protein, 17 aa, Staphylococcus
NVGDERESISRTNGKDA

SEQ ID NO: 1860496 - protein, 11 aa, Staphylococcus
NVGESKTVGRY

SEQ ID NO: 1860497 - protein, 12 aa, Staphylococcus
NVGGANEDISNA

SEQ ID NO: 1860498 - protein, 12 aa, Staphylococcus
NVGGATDDINQA

SEQ ID NO: 1860499 - protein, 5 aa, Staphylococcus
NVGGD

SEQ ID NO: 1860500 - protein, 46 aa, Staphylococcus
NVGPDADGNTEVTFSDGSKVTIPKAKDGIDGKSITITGNETLPSGD

SEQ ID NO: 1860501 - protein, 6 aa, Staphylococcus
NVGQTE

SEQ ID NO: 1860502 - protein, 23 aa, Staphylococcus
NVGSNTENGSDFNQIRTDNTSTT

SEQ ID NO: 1860503 - protein, 23 aa, Staphylococcus
NVGTAAEGGSDFNPIQTDNTSTT

SEQ ID NO: 1860504 - protein, 22 aa, Staphylococcus
NVIGPQKGSKPRQVLIDFENEE

SEQ ID NO: 1860505 - protein, 22 aa, Staphylococcus
NVIGPQRGSKPRQVLVDLDNGE

SEQ ID NO: 1860506 - protein, 8 aa, Staphylococcus
NVKGNEAN

SEQ ID NO: 1860507 - protein, 5 aa, Staphylococcus
NVKKL

SEQ ID NO: 1860508 - protein, 12 aa, Staphylococcus
NVKLNSKDATDT

SEQ ID NO: 1860509 - protein, 9 aa, Staphylococcus
NVKNGQVEK

SEQ ID NO: 1860510 - protein, 4 aa, Staphylococcus
NVKP

SEQ ID NO: 1860511 - protein, 9 aa, Staphylococcus
NVKSSSRMY

SEQ ID NO: 1860512 - protein, 4 aa, Staphylococcus
NVLT

SEQ ID NO: 1860513 - protein, 9 aa, Staphylococcus
NVNAQSIQN

SEQ ID NO: 1860514 - protein, 4 aa, Staphylococcus
NVNE

SEQ ID NO: 1860515 - protein, 9 aa, Staphylococcus
NVNKTDDPM

SEQ ID NO: 1860516 - protein, 13 aa, Staphylococcus
NVNNDSKQFDTQL

SEQ ID NO: 1860517 - protein, 7 aa, Staphylococcus
NVNNNNL

SEQ ID NO: 1860518 - protein, 10 aa, Staphylococcus
NVNPKAVKNA

SEQ ID NO: 1860519 - protein, 23 aa, Staphylococcus
NVNSGGNEMNSDFDTSLDTTSTT

SEQ ID NO: 1860520 - protein, 8 aa, Staphylococcus
NVNSNDYT

SEQ ID NO: 1860521 - protein, 7 aa, Staphylococcus
NVPDPEG

SEQ ID NO: 1860522 - protein, 7 aa, Staphylococcus
NVPEPKL

SEQ ID NO: 1860523 - protein, 12 aa, Staphylococcus
NVPGSTLSREAD

SEQ ID NO: 1860524 - protein, 6 aa, Staphylococcus
NVPIPE

SEQ ID NO: 1860525 - protein, 4 aa, Staphylococcus
NVPQ

SEQ ID NO: 1860526 - protein, 7 aa, Staphylococcus
NVPSSQI

SEQ ID NO: 1860527 - protein, 5 aa, Staphylococcus
NVPTI

SEQ ID NO: 1860528 - protein, 7 aa, Staphylococcus
NVPTSQI

SEQ ID NO: 1860529 - protein, 13 aa, Staphylococcus
NVQPNVTKKQEAI

SEQ ID NO: 1860530 - protein, 25 aa, Staphylococcus
NVQPSTQVKTDARNAVTNKANEAIT

SEQ ID NO: 1860531 - protein, 76 aa, Staphylococcus
NVQPTVVKKDEAKTAIDKAAEAKKAEIDQTPDATDEEKAAAKAKVDEAVNNAKASIDQATNNNGVDTAKSEGSDAI

SEQ ID NO: 1860532 - protein, 6 aa, Staphylococcus
NVRPIP

SEQ ID NO: 1860533 - protein, 15 aa, Staphylococcus
NVSFTNPQDVNNIPG

SEQ ID NO: 1860534 - protein, 9 aa, Staphylococcus
NVSKGETKA

SEQ ID NO: 1860535 - protein, 20 aa, Staphylococcus
NVSNPYDSHQVNDDKDTAIA

SEQ ID NO: 1860536 - protein, 7 aa, Staphylococcus
NVSQEGA

SEQ ID NO: 1860537 - protein, 5 aa, Staphylococcus
NVTDG

SEQ ID NO: 1860538 - protein, 9 aa, Staphylococcus
NVTQSVNQN

SEQ ID NO: 1860539 - protein, 8 aa, Staphylococcus
NVTTETFD

SEQ ID NO: 1860540 - protein, 15 aa, Staphylococcus
NVTTVSEKTLTDNIA

SEQ ID NO: 1860541 - protein, 5 aa, Staphylococcus
NVVKP

SEQ ID NO: 1860542 - protein, 13 aa, Staphylococcus
NWKDHKLDSDLEG

SEQ ID NO: 1860543 - protein, 12 aa, Staphylococcus
NYAADTSISDPK

SEQ ID NO: 1860544 - protein, 6 aa, Staphylococcus
NYAASS

SEQ ID NO: 1860545 - protein, 4 aa, Staphylococcus
NYAN

SEQ ID NO: 1860546 - protein, 7 aa, Staphylococcus
NYAQNSN

SEQ ID NO: 1860547 - protein, 9 aa, Staphylococcus
NYAQSSNSK

SEQ ID NO: 1860548 - protein, 7 aa, Staphylococcus
NYAQSSS

SEQ ID NO: 1860549 - protein, 8 aa, Staphylococcus
NYAQTSSA

SEQ ID NO: 1860550 - protein, 11 aa, Staphylococcus
NYDKDKVGKGY

SEQ ID NO: 1860551 - protein, 8 aa, Staphylococcus
NYDKTTID

SEQ ID NO: 1860552 - protein, 6 aa, Staphylococcus
NYEESV

SEQ ID NO: 1860553 - protein, 8 aa, Staphylococcus
NYENSDSR

SEQ ID NO: 1860554 - protein, 12 aa, Staphylococcus
NYENSDVNNEQK

SEQ ID NO: 1860555 - protein, 8 aa, Staphylococcus
NYEQEDVD

SEQ ID NO: 1860556 - protein, 19 aa, Staphylococcus
NYGKMKGKSYHKQFNMNNR

SEQ ID NO: 1860557 - protein, 10 aa, Staphylococcus
NYGNENLGSY

SEQ ID NO: 1860558 - protein, 10 aa, Staphylococcus
NYGNKNLGSY

SEQ ID NO: 1860559 - protein, 6 aa, Staphylococcus
NYGPDS

SEQ ID NO: 1860560 - protein, 7 aa, Staphylococcus
NYGPDSK

SEQ ID NO: 1860561 - protein, 5 aa, Staphylococcus
NYGQA

SEQ ID NO: 1860562 - protein, 5 aa, Staphylococcus
NYGVP

SEQ ID NO: 1860563 - protein, 5 aa, Staphylococcus
NYKGD

SEQ ID NO: 1860564 - protein, 15 aa, Staphylococcus
NYKPQSGSVTFKDPS

SEQ ID NO: 1860565 - protein, 9 aa, Staphylococcus
NYKSQAEHH

SEQ ID NO: 1860566 - protein, 5 aa, Staphylococcus
NYKYP

SEQ ID NO: 1860567 - protein, 12 aa, Staphylococcus
NYLSSDKGARDI

SEQ ID NO: 1860568 - protein, 12 aa, Staphylococcus
NYNANDDNYNKK

SEQ ID NO: 1860569 - protein, 6 aa, Staphylococcus
NYNEAE

SEQ ID NO: 1860570 - protein, 9 aa, Staphylococcus
NYNEKQNVL

SEQ ID NO: 1860571 - protein, 8 aa, Staphylococcus
NYNKTYGS

SEQ ID NO: 1860572 - protein, 5 aa, Staphylococcus
NYNLQ

SEQ ID NO: 1860573 - protein, 14 aa, Staphylococcus
NYNNTTKPARPGDV

SEQ ID NO: 1860574 - protein, 7 aa, Staphylococcus
NYNQASN

SEQ ID NO: 1860575 - protein, 13 aa, Staphylococcus
NYNTEDVDAHDYS

SEQ ID NO: 1860576 - protein, 10 aa, Staphylococcus
NYNTKPVKEQ

SEQ ID NO: 1860577 - protein, 11 aa, Staphylococcus
NYNTKPVSEQL

SEQ ID NO: 1860578 - protein, 11 aa, Staphylococcus
NYNTRKVSQQL

SEQ ID NO: 1860579 - protein, 10 aa, Staphylococcus
NYNTRPVKQQ

SEQ ID NO: 1860580 - protein, 5 aa, Staphylococcus
NYPKK

SEQ ID NO: 1860581 - protein, 7 aa, Staphylococcus
NYPNNPS

SEQ ID NO: 1860582 - protein, 9 aa, Staphylococcus
NYQATDEEI

SEQ ID NO: 1860583 - protein, 6 aa, Staphylococcus
NYQQGK

SEQ ID NO: 1860584 - protein, 12 aa, Staphylococcus
NYQQPQPGKPKF

SEQ ID NO: 1860585 - protein, 20 aa, Staphylococcus
NYQQQQTDHFDDSRYNQSEL

SEQ ID NO: 1860586 - protein, 4 aa, Staphylococcus
NYRG

SEQ ID NO: 1860587 - protein, 5 aa, Staphylococcus
NYRGI

SEQ ID NO: 1860588 - protein, 9 aa, Staphylococcus
NYSDTHQRT

SEQ ID NO: 1860589 - protein, 15 aa, Staphylococcus
NYSEASPDKKSAYDE

SEQ ID NO: 1860590 - protein, 7 aa, Staphylococcus
NYSENRT

SEQ ID NO: 1860591 - protein, 10 aa, Staphylococcus
NYSENRTVRY

SEQ ID NO: 1860592 - protein, 10 aa, Staphylococcus
NYSKEEINQG

SEQ ID NO: 1860593 - protein, 9 aa, Staphylococcus
NYSKTYGSI

SEQ ID NO: 1860594 - protein, 10 aa, Staphylococcus
NYSNKQKKIK

SEQ ID NO: 1860595 - protein, 8 aa, Staphylococcus
NYSSDEST

SEQ ID NO: 1860596 - protein, 22 aa, Staphylococcus
NYSSGESKSRSNKNLTIDEKKE

SEQ ID NO: 1860597 - protein, 7 aa, Staphylococcus
NYSTNDN

SEQ ID NO: 1860598 - protein, 5 aa, Staphylococcus
NYSYE

SEQ ID NO: 1860599 - protein, 14 aa, Staphylococcus
NYTAGTNDKTGALE

SEQ ID NO: 1860600 - protein, 14 aa, Staphylococcus
NYTAGTNEKTGNLE

SEQ ID NO: 1860601 - protein, 5 aa, Staphylococcus
NYTDI

SEQ ID NO: 1860602 - protein, 15 aa, Staphylococcus
NYTDKQAESSQEDIN

SEQ ID NO: 1860603 - protein, 12 aa, Staphylococcus
NYTEASTDKQDA

SEQ ID NO: 1860604 - protein, 7 aa, Staphylococcus
NYTEDKK

SEQ ID NO: 1860605 - protein, 9 aa, Staphylococcus
NYTKGEAPF

SEQ ID NO: 1860606 - protein, 9 aa, Staphylococcus
NYTKGQAPF

SEQ ID NO: 1860607 - protein, 10 aa, Staphylococcus
NYTQKDPNFV

SEQ ID NO: 1860608 - protein, 5 aa, Staphylococcus
NYTSA

SEQ ID NO: 1860609 - protein, 6 aa, Staphylococcus
NYTTYS

SEQ ID NO: 1860610 - protein, 6 aa, Staphylococcus
PAAAAT

SEQ ID NO: 1860611 - protein, 5 aa, Staphylococcus
PAAGY

SEQ ID NO: 1860612 - protein, 12 aa, Staphylococcus
PAAQAISQSSNV

SEQ ID NO: 1860613 - protein, 29 aa, Staphylococcus
PAASTNGMTQQSAQNYNAKRQAAEQAIQN

SEQ ID NO: 1860614 - protein, 8 aa, Staphylococcus
PADEADLT

SEQ ID NO: 1860615 - protein, 7 aa, Staphylococcus
PADKKNR

SEQ ID NO: 1860616 - protein, 7 aa, Staphylococcus
PADKNNR

SEQ ID NO: 1860617 - protein, 4 aa, Staphylococcus
PADN

SEQ ID NO: 1860618 - protein, 9 aa, Staphylococcus
PAENNQKIY

SEQ ID NO: 1860619 - protein, 23 aa, Staphylococcus
PAFNESKLQDPKPAEIYDKNGDL

SEQ ID NO: 1860620 - protein, 23 aa, Staphylococcus
PAFTESKLQDPAPAKIYDKNGKL

SEQ ID NO: 1860621 - protein, 22 aa, Staphylococcus
PAFTESKLQDPKPAEIYDRNGD

SEQ ID NO: 1860622 - protein, 10 aa, Staphylococcus
PAGGAMADKL

SEQ ID NO: 1860623 - protein, 6 aa, Staphylococcus
PAGTTN

SEQ ID NO: 1860624 - protein, 5 aa, Staphylococcus
PAIND

SEQ ID NO: 1860625 - protein, 8 aa, Staphylococcus
PAKAGQTT

SEQ ID NO: 1860626 - protein, 7 aa, Staphylococcus
PAKDAMT

SEQ ID NO: 1860627 - protein, 24 aa, Staphylococcus
PAKGGNEVPPPKPSEKRVNKVKPV

SEQ ID NO: 1860628 - protein, 5 aa, Staphylococcus
PALAN

SEQ ID NO: 1860629 - protein, 16 aa, Staphylococcus
PAMTGQSNLSTNATSL

SEQ ID NO: 1860630 - protein, 5 aa, Staphylococcus
PANEH

SEQ ID NO: 1860631 - protein, 5 aa, Staphylococcus
PANGK

SEQ ID NO: 1860632 - protein, 63 aa, Staphylococcus
PANHAEAAETEAASSPQIEKVNQPSTATPENIDQASKNNQPETSENSQLQNQQPKANATDQPL

SEQ ID NO: 1860633 - protein, 11 aa, Staphylococcus
PANTKKETALA

SEQ ID NO: 1860634 - protein, 13 aa, Staphylococcus
PANYSRPSVAGTA

SEQ ID NO: 1860635 - protein, 20 aa, Staphylococcus
PAPGVNPAAFDNNQGSQGVT

SEQ ID NO: 1860636 - protein, 8 aa, Staphylococcus
PAPGVNPE

SEQ ID NO: 1860637 - protein, 19 aa, Staphylococcus
PAPGVNPEPFEQQGSDQGV

SEQ ID NO: 1860638 - protein, 21 aa, Staphylococcus
PAPGVNPNAFDQAAKGSQGVT

SEQ ID NO: 1860639 - protein, 7 aa, Staphylococcus
PAPRTSL

SEQ ID NO: 1860640 - protein, 7 aa, Staphylococcus
PAPTYLG

SEQ ID NO: 1860641 - protein, 11 aa, Staphylococcus
PASTAKPNAIA

SEQ ID NO: 1860642 - protein, 16 aa, Staphylococcus
PASTTDGQRRMYNEQS

SEQ ID NO: 1860643 - protein, 7 aa, Staphylococcus
PASVTAY

SEQ ID NO: 1860644 - protein, 13 aa, Staphylococcus
PATGLDVKTEQTI

SEQ ID NO: 1860645 - protein, 6 aa, Staphylococcus
PATGSI

SEQ ID NO: 1860646 - protein, 5 aa, Staphylococcus
PATKI

SEQ ID NO: 1860647 - protein, 6 aa, Staphylococcus
PATKIV

SEQ ID NO: 1860648 - protein, 23 aa, Staphylococcus
PATTVKSNAKQELQNKANDQIAQ

SEQ ID NO: 1860649 - protein, 7 aa, Staphylococcus
PAVASGP

SEQ ID NO: 1860650 - protein, 5 aa, Staphylococcus
PAVEH

SEQ ID NO: 1860651 - protein, 8 aa, Staphylococcus
PAVGSGAF

SEQ ID NO: 1860652 - protein, 11 aa, Staphylococcus
PDAHSDAMSEE

SEQ ID NO: 1860653 - protein, 7 aa, Staphylococcus
PDAPDLS

SEQ ID NO: 1860654 - protein, 11 aa, Staphylococcus
PDAQSDAMSEE

SEQ ID NO: 1860655 - protein, 13 aa, Staphylococcus
PDATEDEKQNAID

SEQ ID NO: 1860656 - protein, 8 aa, Staphylococcus
PDDDSTRI

SEQ ID NO: 1860657 - protein, 23 aa, Staphylococcus
PDDFTKEVSESTRLEKLPEGKTA

SEQ ID NO: 1860658 - protein, 16 aa, Staphylococcus
PDDGVKPDHTTQKKAY

SEQ ID NO: 1860659 - protein, 16 aa, Staphylococcus
PDDGVKPSDTTQKKAY

SEQ ID NO: 1860660 - protein, 4 aa, Staphylococcus
PDDN

SEQ ID NO: 1860661 - protein, 8 aa, Staphylococcus
PDEAARQF

SEQ ID NO: 1860662 - protein, 7 aa, Staphylococcus
PDEATRQ

SEQ ID NO: 1860663 - protein, 4 aa, Staphylococcus
PDEE

SEQ ID NO: 1860664 - protein, 5 aa, Staphylococcus
PDEEL

SEQ ID NO: 1860665 - protein, 14 aa, Staphylococcus
PDEFTKEVSENTRL

SEQ ID NO: 1860666 - protein, 17 aa, Staphylococcus
PDEKSDNITRLQNEGRQ

SEQ ID NO: 1860667 - protein, 43 aa, Staphylococcus
PDESSTKIEEKSNVDIQGNTDKKYPNDGQPASKKSTDSYNKSK

SEQ ID NO: 1860668 - protein, 25 aa, Staphylococcus
PDEYAKDVSSDARTEQLPESKTAIG

SEQ ID NO: 1860669 - protein, 4 aa, Staphylococcus
PDFD

SEQ ID NO: 1860670 - protein, 9 aa, Staphylococcus
PDFKTPSVA

SEQ ID NO: 1860671 - protein, 5 aa, Staphylococcus
PDFSY

SEQ ID NO: 1860672 - protein, 4 aa, Staphylococcus
PDGS

SEQ ID NO: 1860673 - protein, 16 aa, Staphylococcus
PDGTTGTGTVGEDGSW

SEQ ID NO: 1860674 - protein, 8 aa, Staphylococcus
PDGYDSDE

SEQ ID NO: 1860675 - protein, 4 aa, Staphylococcus
PDIE

SEQ ID NO: 1860676 - protein, 8 aa, Staphylococcus
PDKKHRVG

SEQ ID NO: 1860677 - protein, 13 aa, Staphylococcus
PDKTAAQSTSDKQ

SEQ ID NO: 1860678 - protein, 12 aa, Staphylococcus
PDKTLDKTTIEQ

SEQ ID NO: 1860679 - protein, 4 aa, Staphylococcus
PDLE

SEQ ID NO: 1860680 - protein, 5 aa, Staphylococcus
PDLEQ

SEQ ID NO: 1860681 - protein, 32 aa, Staphylococcus
PDLSNADSTPENKRDNTKPISKPGTAKMDSTI

SEQ ID NO: 1860682 - protein, 4 aa, Staphylococcus
PDMP

SEQ ID NO: 1860683 - protein, 15 aa, Staphylococcus
PDNALKTGTTRPGSL

SEQ ID NO: 1860684 - protein, 10 aa, Staphylococcus
PDNKNTKELR

SEQ ID NO: 1860685 - protein, 8 aa, Staphylococcus
PDNSTQTI

SEQ ID NO: 1860686 - protein, 4 aa, Staphylococcus
PDNV

SEQ ID NO: 1860687 - protein, 12 aa, Staphylococcus
PDNVNDAASGYA

SEQ ID NO: 1860688 - protein, 8 aa, Staphylococcus
PDQQVENK

SEQ ID NO: 1860689 - protein, 8 aa, Staphylococcus
PDQTSTIT

SEQ ID NO: 1860690 - protein, 6 aa, Staphylococcus
PDQVVT

SEQ ID NO: 1860691 - protein, 5 aa, Staphylococcus
PDREE

SEQ ID NO: 1860692 - protein, 6 aa, Staphylococcus
PDSDHY

SEQ ID NO: 1860693 - protein, 17 aa, Staphylococcus
PDSGTRIEVKAPLTKEE

SEQ ID NO: 1860694 - protein, 10 aa, Staphylococcus
PDSKVENKDY

SEQ ID NO: 1860695 - protein, 7 aa, Staphylococcus
PDSPTAS

SEQ ID NO: 1860696 - protein, 11 aa, Staphylococcus
PDSQASNNTDL

SEQ ID NO: 1860697 - protein, 11 aa, Staphylococcus
PDSQSSNNTDL

SEQ ID NO: 1860698 - protein, 13 aa, Staphylococcus
PDSSNTSLFRNVI

SEQ ID NO: 1860699 - protein, 4 aa, Staphylococcus
PDTE

SEQ ID NO: 1860700 - protein, 7 aa, Staphylococcus
PDTGMNS

SEQ ID NO: 1860701 - protein, 7 aa, Staphylococcus
PDTSLAN

SEQ ID NO: 1860702 - protein, 4 aa, Staphylococcus
PDTV

SEQ ID NO: 1860703 - protein, 4 aa, Staphylococcus
PDWN

SEQ ID NO: 1860704 - protein, 31 aa, Staphylococcus
PDYPSEKGKPTITVDDPSKLPDGNTPGTTEV

SEQ ID NO: 1860705 - protein, 8 aa, Staphylococcus
PEAGRASE

SEQ ID NO: 1860706 - protein, 6 aa, Staphylococcus
PEARNT

SEQ ID NO: 1860707 - protein, 10 aa, Staphylococcus
PEAVSSEYGN

SEQ ID NO: 1860708 - protein, 20 aa, Staphylococcus
PEDGALPSIENQPPVKPTIN

SEQ ID NO: 1860709 - protein, 12 aa, Staphylococcus
PEDGPNAQSTNN

SEQ ID NO: 1860710 - protein, 12 aa, Staphylococcus
PEDGPNAQSTSD

SEQ ID NO: 1860711 - protein, 5 aa, Staphylococcus
PEDIR

SEQ ID NO: 1860712 - protein, 8 aa, Staphylococcus
PEDISQKA

SEQ ID NO: 1860713 - protein, 9 aa, Staphylococcus
PEDKELEQQ

SEQ ID NO: 1860714 - protein, 8 aa, Staphylococcus
PEDMSQKA

SEQ ID NO: 1860715 - protein, 23 aa, Staphylococcus
PEDTPIKAAADGKVTRTFDDDLG

SEQ ID NO: 1860716 - protein, 5 aa, Staphylococcus
PEDVQ

SEQ ID NO: 1860717 - protein, 9 aa, Staphylococcus
PEDYSGAAM

SEQ ID NO: 1860718 - protein, 8 aa, Staphylococcus
PEEAKEPF

SEQ ID NO: 1860719 - protein, 11 aa, Staphylococcus
PEEGPNAVSTN

SEQ ID NO: 1860720 - protein, 17 aa, Staphylococcus
PEEKAAKIKSLQTQDKT

SEQ ID NO: 1860721 - protein, 6 aa, Staphylococcus
PEEKAE

SEQ ID NO: 1860722 - protein, 17 aa, Staphylococcus
PEEKASKVAEIQSEGKK

SEQ ID NO: 1860723 - protein, 13 aa, Staphylococcus
PEENFEKKKQYNR

SEQ ID NO: 1860724 - protein, 162 aa, Staphylococcus
PEEQQLKNEHKENNDKVTKPTDEMEKQEKEDNNSASSKHDEIEPKYSRVEKNKGKQKQDNINKSEVNHLDKSEQTKKHKETKESSEDVLETNKSQKIEQKEQKASSNETSNKELNSYTKDKNNKVEDNQDLKKASSQNLAHSNKLEENEHLENEPKNNDTMD

SEQ ID NO: 1860725 - protein, 6 aa, Staphylococcus
PEERTS

SEQ ID NO: 1860726 - protein, 14 aa, Staphylococcus
PEETFEKKKEHKQQ

SEQ ID NO: 1860727 - protein, 14 aa, Staphylococcus
PEETFEKKKEYSQQ

SEQ ID NO: 1860728 - protein, 4 aa, Staphylococcus
PEEV

SEQ ID NO: 1860729 - protein, 8 aa, Staphylococcus
PEGEPASI

SEQ ID NO: 1860730 - protein, 6 aa, Staphylococcus
PEGGGA

SEQ ID NO: 1860731 - protein, 5 aa, Staphylococcus
PEGLQ

SEQ ID NO: 1860732 - protein, 19 aa, Staphylococcus
PEGNVTAKATDNALHPNSS

SEQ ID NO: 1860733 - protein, 4 aa, Staphylococcus
PEGY

SEQ ID NO: 1860734 - protein, 7 aa, Staphylococcus
PEGYKWN

SEQ ID NO: 1860735 - protein, 8 aa, Staphylococcus
PEGYSSDE

SEQ ID NO: 1860736 - protein, 6 aa, Staphylococcus
PEHARG

SEQ ID NO: 1860737 - protein, 4 aa, Staphylococcus
PEHI

SEQ ID NO: 1860738 - protein, 11 aa, Staphylococcus
PEHNAIEGGKD

SEQ ID NO: 1860739 - protein, 7 aa, Staphylococcus
PEHYQTQ

SEQ ID NO: 1860740 - protein, 7 aa, Staphylococcus
PEHYTNS

SEQ ID NO: 1860741 - protein, 12 aa, Staphylococcus
PEIDELPKEERI

SEQ ID NO: 1860742 - protein, 6 aa, Staphylococcus
PEIERE

SEQ ID NO: 1860743 - protein, 18 aa, Staphylococcus
PEIKETANAKSWAQNELK

SEQ ID NO: 1860744 - protein, 4 aa, Staphylococcus
PEIP

SEQ ID NO: 1860745 - protein, 12 aa, Staphylococcus
PEISTSSRKFGS

SEQ ID NO: 1860746 - protein, 11 aa, Staphylococcus
PEKAADAATGF

SEQ ID NO: 1860747 - protein, 16 aa, Staphylococcus
PEKAKPEYQNAKVPTL

SEQ ID NO: 1860748 - protein, 5 aa, Staphylococcus
PEKEH

SEQ ID NO: 1860749 - protein, 4 aa, Staphylococcus
PEKF

SEQ ID NO: 1860750 - protein, 12 aa, Staphylococcus
PEKFKGESENDK

SEQ ID NO: 1860751 - protein, 29 aa, Staphylococcus
PEKGENSVQQVQSQSNQFNGTGNVDKAPI

SEQ ID NO: 1860752 - protein, 18 aa, Staphylococcus
PEKGIDRYETAKSFQQSL

SEQ ID NO: 1860753 - protein, 18 aa, Staphylococcus
PEKGIERYETASNYKQSL

SEQ ID NO: 1860754 - protein, 9 aa, Staphylococcus
PEKHRAEGV

SEQ ID NO: 1860755 - protein, 27 aa, Staphylococcus
PEKMADNLKKQGSYVPGIRPGDQTKKY

SEQ ID NO: 1860756 - protein, 26 aa, Staphylococcus
PEKMADNLKKQGSYVPGIRPGEQTKK

SEQ ID NO: 1860757 - protein, 27 aa, Staphylococcus
PEKMSDNLKKQGSYVPGIRPGEQTKKY

SEQ ID NO: 1860758 - protein, 5 aa, Staphylococcus
PEKRG

SEQ ID NO: 1860759 - protein, 8 aa, Staphylococcus
PEKRGSAM

SEQ ID NO: 1860760 - protein, 7 aa, Staphylococcus
PEKRGVA

SEQ ID NO: 1860761 - protein, 10 aa, Staphylococcus
PEKRKGEGIG

SEQ ID NO: 1860762 - protein, 7 aa, Staphylococcus
PEKVEGH

SEQ ID NO: 1860763 - protein, 5 aa, Staphylococcus
PELHK

SEQ ID NO: 1860764 - protein, 14 aa, Staphylococcus
PELHKQSNYKMPGG

SEQ ID NO: 1860765 - protein, 5 aa, Staphylococcus
PELKA

SEQ ID NO: 1860766 - protein, 13 aa, Staphylococcus
PELNAHGSSMTNT

SEQ ID NO: 1860767 - protein, 4 aa, Staphylococcus
PELS

SEQ ID NO: 1860768 - protein, 20 aa, Staphylococcus
PELSTELTDGLSGSLNGSVD

SEQ ID NO: 1860769 - protein, 14 aa, Staphylococcus
PEMNAHGSSMTNTV

SEQ ID NO: 1860770 - protein, 8 aa, Staphylococcus
PENDSRID

SEQ ID NO: 1860771 - protein, 8 aa, Staphylococcus
PENDTRMD

SEQ ID NO: 1860772 - protein, 19 aa, Staphylococcus
PENNQATLQTQAKDTYEDK

SEQ ID NO: 1860773 - protein, 21 aa, Staphylococcus
PEQGIDRYEAAKGYKQTLEQE

SEQ ID NO: 1860774 - protein, 8 aa, Staphylococcus
PEQGIERY

SEQ ID NO: 1860775 - protein, 5 aa, Staphylococcus
PEQGY

SEQ ID NO: 1860776 - protein, 8 aa, Staphylococcus
PEQSVENK

SEQ ID NO: 1860777 - protein, 5 aa, Staphylococcus
PEQVE

SEQ ID NO: 1860778 - protein, 6 aa, Staphylococcus
PEREEI

SEQ ID NO: 1860779 - protein, 11 aa, Staphylococcus
PERESIEGGKT

SEQ ID NO: 1860780 - protein, 4 aa, Staphylococcus
PERM

SEQ ID NO: 1860781 - protein, 9 aa, Staphylococcus
PERRGAAMG

SEQ ID NO: 1860782 - protein, 5 aa, Staphylococcus
PERTN

SEQ ID NO: 1860783 - protein, 4 aa, Staphylococcus
PESF

SEQ ID NO: 1860784 - protein, 8 aa, Staphylococcus
PESKQNMK

SEQ ID NO: 1860785 - protein, 8 aa, Staphylococcus
PESNVKET

SEQ ID NO: 1860786 - protein, 9 aa, Staphylococcus
PESNVKETR

SEQ ID NO: 1860787 - protein, 12 aa, Staphylococcus
PESPEVKTIKLN

SEQ ID NO: 1860788 - protein, 10 aa, Staphylococcus
PESPNKKPDL

SEQ ID NO: 1860789 - protein, 9 aa, Staphylococcus
PESPRRNAD

SEQ ID NO: 1860790 - protein, 9 aa, Staphylococcus
PESPVKNPD

SEQ ID NO: 1860791 - protein, 68 aa, Staphylococcus
PETEQQSPQKSDVGSNPTKEANGNDEGNDESNALTKIESDESVETDTEVDKQNSLETLPETGQHDNQL

SEQ ID NO: 1860792 - protein, 4 aa, Staphylococcus
PETF

SEQ ID NO: 1860793 - protein, 16 aa, Staphylococcus
PETRGKSLEEIELQLQ

SEQ ID NO: 1860794 - protein, 8 aa, Staphylococcus
PETRGRSL

SEQ ID NO: 1860795 - protein, 34 aa, Staphylococcus
PETTVKQAAKQGIEQTTQNQINKINDNNNSTFEE

SEQ ID NO: 1860796 - protein, 5 aa, Staphylococcus
PEVDY

SEQ ID NO: 1860797 - protein, 6 aa, Staphylococcus
PEVDYD

SEQ ID NO: 1860798 - protein, 6 aa, Staphylococcus
PEVNYD

SEQ ID NO: 1860799 - protein, 5 aa, Staphylococcus
PEVQS

SEQ ID NO: 1860800 - protein, 9 aa, Staphylococcus
PFENGVGGT

SEQ ID NO: 1860801 - protein, 5 aa, Staphylococcus
PFEQP

SEQ ID NO: 1860802 - protein, 4 aa, Staphylococcus
PFGH

SEQ ID NO: 1860803 - protein, 12 aa, Staphylococcus
PFGKTGVSNVYN

SEQ ID NO: 1860804 - protein, 8 aa, Staphylococcus
PFNKEKKL

SEQ ID NO: 1860805 - protein, 4 aa, Staphylococcus
PFNN

SEQ ID NO: 1860806 - protein, 12 aa, Staphylococcus
PFNQSKSKIEVT

SEQ ID NO: 1860807 - protein, 7 aa, Staphylococcus
PFSAAGG

SEQ ID NO: 1860808 - protein, 8 aa, Staphylococcus
PFSAKPSY

SEQ ID NO: 1860809 - protein, 8 aa, Staphylococcus
PFSSSPKY

SEQ ID NO: 1860810 - protein, 11 aa, Staphylococcus
PFSSSSGTGYH

SEQ ID NO: 1860811 - protein, 8 aa, Staphylococcus
PFSSTPKY

SEQ ID NO: 1860812 - protein, 6 aa, Staphylococcus
PGAGLD

SEQ ID NO: 1860813 - protein, 31 aa, Staphylococcus
PGAGLDPDKLPKGDISKYQSSASAAEQSTYG

SEQ ID NO: 1860814 - protein, 31 aa, Staphylococcus
PGAGLEPNKLPKGDISHYESSAKAAEQSTYG

SEQ ID NO: 1860815 - protein, 20 aa, Staphylococcus
PGATPETVQDEISDKIDNQV

SEQ ID NO: 1860816 - protein, 12 aa, Staphylococcus
PGDRNNKQAQGT

SEQ ID NO: 1860817 - protein, 7 aa, Staphylococcus
PGDSIEY

SEQ ID NO: 1860818 - protein, 15 aa, Staphylococcus
PGEDLNEKYKPRNLD

SEQ ID NO: 1860819 - protein, 14 aa, Staphylococcus
PGEKVIAQSKNFTF

SEQ ID NO: 1860820 - protein, 8 aa, Staphylococcus
PGEKVPVD

SEQ ID NO: 1860821 - protein, 4 aa, Staphylococcus
PGGA

SEQ ID NO: 1860822 - protein, 14 aa, Staphylococcus
PGGETTSVIKATLG

SEQ ID NO: 1860823 - protein, 4 aa, Staphylococcus
PGGS

SEQ ID NO: 1860824 - protein, 8 aa, Staphylococcus
PGGSATGA

SEQ ID NO: 1860825 - protein, 6 aa, Staphylococcus
PGGTVA

SEQ ID NO: 1860826 - protein, 49 aa, Staphylococcus
PGHAATQEEESNSSQATSQNVKSQTDDKSIHNNDNYIENEKNSNDSIKE

SEQ ID NO: 1860827 - protein, 20 aa, Staphylococcus
PGHGGGDQGASSSTPSKSLE

SEQ ID NO: 1860828 - protein, 33 aa, Staphylococcus
PGHGGNDQGASSNTSKKSLEKNYTLKTAKELRR

SEQ ID NO: 1860829 - protein, 20 aa, Staphylococcus
PGHGGRDQGASSNTSSKSLE

SEQ ID NO: 1860830 - protein, 24 aa, Staphylococcus
PGHGGSDQGASSNTPSKSLEKNYT

SEQ ID NO: 1860831 - protein, 19 aa, Staphylococcus
PGHGKSVVTQSAFKEGKVG

SEQ ID NO: 1860832 - protein, 5 aa, Staphylococcus
PGIAN

SEQ ID NO: 1860833 - protein, 11 aa, Staphylococcus
PGIEKDLTKAD

SEQ ID NO: 1860834 - protein, 5 aa, Staphylococcus
PGIPY

SEQ ID NO: 1860835 - protein, 6 aa, Staphylococcus
PGISGG

SEQ ID NO: 1860836 - protein, 5 aa, Staphylococcus
PGKHT

SEQ ID NO: 1860837 - protein, 14 aa, Staphylococcus
PGKPGGVDHTYGGQ

SEQ ID NO: 1860838 - protein, 14 aa, Staphylococcus
PGKSGGINKEYAGQ

SEQ ID NO: 1860839 - protein, 14 aa, Staphylococcus
PGKSGGVNKEYAGQ

SEQ ID NO: 1860840 - protein, 4 aa, Staphylococcus
PGLE

SEQ ID NO: 1860841 - protein, 17 aa, Staphylococcus
PGLEQQLSDTTATVNNT

SEQ ID NO: 1860842 - protein, 4 aa, Staphylococcus
PGMG

SEQ ID NO: 1860843 - protein, 5 aa, Staphylococcus
PGNNP

SEQ ID NO: 1860844 - protein, 5 aa, Staphylococcus
PGNYG

SEQ ID NO: 1860845 - protein, 6 aa, Staphylococcus
PGQAPW

SEQ ID NO: 1860846 - protein, 5 aa, Staphylococcus
PGQFE

SEQ ID NO: 1860847 - protein, 6 aa, Staphylococcus
PGQSVE

SEQ ID NO: 1860848 - protein, 6 aa, Staphylococcus
PGQTDL

SEQ ID NO: 1860849 - protein, 6 aa, Staphylococcus
PGSAPV

SEQ ID NO: 1860850 - protein, 4 aa, Staphylococcus
PGSE

SEQ ID NO: 1860851 - protein, 4 aa, Staphylococcus
PGSF

SEQ ID NO: 1860852 - protein, 31 aa, Staphylococcus
PGSGLDPSKLPKGDISKYQSSAHAAEQSTYG

SEQ ID NO: 1860853 - protein, 4 aa, Staphylococcus
PGSI

SEQ ID NO: 1860854 - protein, 31 aa, Staphylococcus
PGTGLDPNKLPKGDISKYESSAHAAEHSTYG

SEQ ID NO: 1860855 - protein, 8 aa, Staphylococcus
PGTHPPKV

SEQ ID NO: 1860856 - protein, 8 aa, Staphylococcus
PGTQDINY

SEQ ID NO: 1860857 - protein, 5 aa, Staphylococcus
PGTVN

SEQ ID NO: 1860858 - protein, 7 aa, Staphylococcus
PGTVNEV

SEQ ID NO: 1860859 - protein, 6 aa, Staphylococcus
PGTVNK

SEQ ID NO: 1860860 - protein, 4 aa, Staphylococcus
PGVS

SEQ ID NO: 1860861 - protein, 6 aa, Staphylococcus
PGVSGG

SEQ ID NO: 1860862 - protein, 7 aa, Staphylococcus
PGVSGGT

SEQ ID NO: 1860863 - protein, 6 aa, Staphylococcus
PGYKAQ

SEQ ID NO: 1860864 - protein, 7 aa, Staphylococcus
PGYKPQN

SEQ ID NO: 1860865 - protein, 14 aa, Staphylococcus
PGYNDDIYKFELPK

SEQ ID NO: 1860866 - protein, 8 aa, Staphylococcus
PHADAGHS

SEQ ID NO: 1860867 - protein, 9 aa, Staphylococcus
PHATQEEVV

SEQ ID NO: 1860868 - protein, 7 aa, Staphylococcus
PHDPNTQ

SEQ ID NO: 1860869 - protein, 5 aa, Staphylococcus
PHDVT

SEQ ID NO: 1860870 - protein, 15 aa, Staphylococcus
PHDVTLKDKEKANEL

SEQ ID NO: 1860871 - protein, 5 aa, Staphylococcus
PHETN

SEQ ID NO: 1860872 - protein, 15 aa, Staphylococcus
PHFPNDQIDEDYSDG

SEQ ID NO: 1860873 - protein, 10 aa, Staphylococcus
PHGDPEKVSK

SEQ ID NO: 1860874 - protein, 12 aa, Staphylococcus
PHGKSDAVKQPA

SEQ ID NO: 1860875 - protein, 8 aa, Staphylococcus
PHGSQPPL

SEQ ID NO: 1860876 - protein, 10 aa, Staphylococcus
PHGTSMNNTM

SEQ ID NO: 1860877 - protein, 11 aa, Staphylococcus
PHGTTGIGTKK

SEQ ID NO: 1860878 - protein, 5 aa, Staphylococcus
PHKRK

SEQ ID NO: 1860879 - protein, 5 aa, Staphylococcus
PHNNY

SEQ ID NO: 1860880 - protein, 6 aa, Staphylococcus
PHNQQH

SEQ ID NO: 1860881 - protein, 13 aa, Staphylococcus
PHTGESEKANKTL

SEQ ID NO: 1860882 - protein, 5 aa, Staphylococcus
PHTSY

SEQ ID NO: 1860883 - protein, 5 aa, Staphylococcus
PIAGQ

SEQ ID NO: 1860884 - protein, 37 aa, Staphylococcus
PIATNTEIEHPEAKNEGNHSINKQQLPNTGQSQNHAP

SEQ ID NO: 1860885 - protein, 4 aa, Staphylococcus
PIDA

SEQ ID NO: 1860886 - protein, 5 aa, Staphylococcus
PIEAM

SEQ ID NO: 1860887 - protein, 7 aa, Staphylococcus
PIGDANT

SEQ ID NO: 1860888 - protein, 8 aa, Staphylococcus
PIGDTQSF

SEQ ID NO: 1860889 - protein, 6 aa, Staphylococcus
PIGNPA

SEQ ID NO: 1860890 - protein, 7 aa, Staphylococcus
PIGNPQS

SEQ ID NO: 1860891 - protein, 8 aa, Staphylococcus
PIGNTASF

SEQ ID NO: 1860892 - protein, 4 aa, Staphylococcus
PIGP

SEQ ID NO: 1860893 - protein, 5 aa, Staphylococcus
PIKDP

SEQ ID NO: 1860894 - protein, 5 aa, Staphylococcus
PIKEG

SEQ ID NO: 1860895 - protein, 6 aa, Staphylococcus
PIKEGG

SEQ ID NO: 1860896 - protein, 11 aa, Staphylococcus
PIKGTSDDMTG

SEQ ID NO: 1860897 - protein, 5 aa, Staphylococcus
PIKKA

SEQ ID NO: 1860898 - protein, 7 aa, Staphylococcus
PINKKAE

SEQ ID NO: 1860899 - protein, 20 aa, Staphylococcus
PINPNSVEGRVNEKIKNQES

SEQ ID NO: 1860900 - protein, 4 aa, Staphylococcus
PIPA

SEQ ID NO: 1860901 - protein, 25 aa, Staphylococcus
PIPDNAEKTPEAVEEPNESDEIEED

SEQ ID NO: 1860902 - protein, 7 aa, Staphylococcus
PIPEGNV

SEQ ID NO: 1860903 - protein, 5 aa, Staphylococcus
PIQTT

SEQ ID NO: 1860904 - protein, 7 aa, Staphylococcus
PIRIGNS

SEQ ID NO: 1860905 - protein, 11 aa, Staphylococcus
PISDSKGRKKP

SEQ ID NO: 1860906 - protein, 8 aa, Staphylococcus
PISKDETV

SEQ ID NO: 1860907 - protein, 8 aa, Staphylococcus
PISKYGKN

SEQ ID NO: 1860908 - protein, 4 aa, Staphylococcus
PISS

SEQ ID NO: 1860909 - protein, 7 aa, Staphylococcus
PITKDET

SEQ ID NO: 1860910 - protein, 4 aa, Staphylococcus
PIYQ

SEQ ID NO: 1860911 - protein, 60 aa, Staphylococcus
PKADSNQTNNSTNNNPNNNNATTNPVETPTTKPNETPTTKPAETQNTTSSVKPNSTEFES

SEQ ID NO: 1860912 - protein, 63 aa, Staphylococcus
PKAKDGAAGKDGKSITVQSTEKTPEGDTKVTFSDGTSVTIAKGDTGATGAAGQTGADGKSITV

SEQ ID NO: 1860913 - protein, 4 aa, Staphylococcus
PKAN

SEQ ID NO: 1860914 - protein, 8 aa, Staphylococcus
PKAPEAMK

SEQ ID NO: 1860915 - protein, 7 aa, Staphylococcus
PKAQQQV

SEQ ID NO: 1860916 - protein, 10 aa, Staphylococcus
PKAVEEGKAI

SEQ ID NO: 1860917 - protein, 11 aa, Staphylococcus
PKAVEPGSYEK

SEQ ID NO: 1860918 - protein, 16 aa, Staphylococcus
PKAYKSETFSHSTAQD

SEQ ID NO: 1860919 - protein, 7 aa, Staphylococcus
PKDEAVK

SEQ ID NO: 1860920 - protein, 23 aa, Staphylococcus
PKDGTIVKTDGMEGSMAQAGNPI

SEQ ID NO: 1860921 - protein, 9 aa, Staphylococcus
PKDKNKYKL

SEQ ID NO: 1860922 - protein, 10 aa, Staphylococcus
PKDKSKYQLK

SEQ ID NO: 1860923 - protein, 5 aa, Staphylococcus
PKDNF

SEQ ID NO: 1860924 - protein, 14 aa, Staphylococcus
PKDSEDIAESKQKH

SEQ ID NO: 1860925 - protein, 7 aa, Staphylococcus
PKDSPEV

SEQ ID NO: 1860926 - protein, 14 aa, Staphylococcus
PKDVPNQSAESARV

SEQ ID NO: 1860927 - protein, 22 aa, Staphylococcus
PKEDNEGADVRKKAPLPNDADL

SEQ ID NO: 1860928 - protein, 7 aa, Staphylococcus
PKEERRT

SEQ ID NO: 1860929 - protein, 6 aa, Staphylococcus
PKEGSN

SEQ ID NO: 1860930 - protein, 29 aa, Staphylococcus
PKEPIYDKEEDDDVNPYIKDGSQVNERNN

SEQ ID NO: 1860931 - protein, 7 aa, Staphylococcus
PKERATA

SEQ ID NO: 1860932 - protein, 6 aa, Staphylococcus
PKETKE

SEQ ID NO: 1860933 - protein, 5 aa, Staphylococcus
PKEVN

SEQ ID NO: 1860934 - protein, 4 aa, Staphylococcus
PKFA

SEQ ID NO: 1860935 - protein, 6 aa, Staphylococcus
PKFDDD

SEQ ID NO: 1860936 - protein, 7 aa, Staphylococcus
PKFDSDI

SEQ ID NO: 1860937 - protein, 4 aa, Staphylococcus
PKGA

SEQ ID NO: 1860938 - protein, 16 aa, Staphylococcus
PKGAKGDKGDKGDSIS

SEQ ID NO: 1860939 - protein, 28 aa, Staphylococcus
PKGAKGDKGENGTSIGISRTEVDGSGNT

SEQ ID NO: 1860940 - protein, 29 aa, Staphylococcus
PKGAKGDKGQDAAPLTVTGETKDANGNTV

SEQ ID NO: 1860941 - protein, 28 aa, Staphylococcus
PKGAKGDKGQDGTSVTLTNTTTDGDGNT

SEQ ID NO: 1860942 - protein, 34 aa, Staphylococcus
PKGDKGDKGDKGADGASPTVTATRTQHDGKDGVE

SEQ ID NO: 1860943 - protein, 19 aa, Staphylococcus
PKGDKGDKGDNGQNGTSVS

SEQ ID NO: 1860944 - protein, 16 aa, Staphylococcus
PKGDKGDKGDNGTSIG

SEQ ID NO: 1860945 - protein, 31 aa, Staphylococcus
PKGDKGDRGENGQNGTSISITSTGTDTAGNT

SEQ ID NO: 1860946 - protein, 15 aa, Staphylococcus
PKGDKSIVTQAESTI

SEQ ID NO: 1860947 - protein, 68 aa, Staphylococcus
PKGEKGEKGEKGDTGSAGQSITVQSTEKTPEGDTKVTFSDGTSVTIAKGDTGATGAAGQNGQDGQSIT

SEQ ID NO: 1860948 - protein, 22 aa, Staphylococcus
PKGKDGKSVTVESSAPDKDGNT

SEQ ID NO: 1860949 - protein, 4 aa, Staphylococcus
PKGL

SEQ ID NO: 1860950 - protein, 9 aa, Staphylococcus
PKGQSEAAY

SEQ ID NO: 1860951 - protein, 6 aa, Staphylococcus
PKHLTP

SEQ ID NO: 1860952 - protein, 5 aa, Staphylococcus
PKHRK

SEQ ID NO: 1860953 - protein, 10 aa, Staphylococcus
PKIKDKDELL

SEQ ID NO: 1860954 - protein, 9 aa, Staphylococcus
PKIQIEDPN

SEQ ID NO: 1860955 - protein, 9 aa, Staphylococcus
PKKETTDGF

SEQ ID NO: 1860956 - protein, 8 aa, Staphylococcus
PKKPKDIK

SEQ ID NO: 1860957 - protein, 8 aa, Staphylococcus
PKKQTTEI

SEQ ID NO: 1860958 - protein, 15 aa, Staphylococcus
PKKTIEEKQKLEQTR

SEQ ID NO: 1860959 - protein, 16 aa, Staphylococcus
PKKVEQKVTKTNTQTR

SEQ ID NO: 1860960 - protein, 10 aa, Staphylococcus
PKLKKALTTG

SEQ ID NO: 1860961 - protein, 17 aa, Staphylococcus
PKLSGENVVTGETEPNV

SEQ ID NO: 1860962 - protein, 14 aa, Staphylococcus
PKLSNTKLYPGETY

SEQ ID NO: 1860963 - protein, 17 aa, Staphylococcus
PKLTTNDNNSTSTAKDY

SEQ ID NO: 1860964 - protein, 12 aa, Staphylococcus
PKMTDAGTSAIV

SEQ ID NO: 1860965 - protein, 7 aa, Staphylococcus
PKMTRPY

SEQ ID NO: 1860966 - protein, 10 aa, Staphylococcus
PKNAKTVELP

SEQ ID NO: 1860967 - protein, 9 aa, Staphylococcus
PKNDGDVTI

SEQ ID NO: 1860968 - protein, 10 aa, Staphylococcus
PKNDGDVTIS

SEQ ID NO: 1860969 - protein, 8 aa, Staphylococcus
PKNEGAVT

SEQ ID NO: 1860970 - protein, 8 aa, Staphylococcus
PKNEGDVT

SEQ ID NO: 1860971 - protein, 7 aa, Staphylococcus
PKNQQHN

SEQ ID NO: 1860972 - protein, 66 aa, Staphylococcus
PKNQYAYNSGTTTDIPPEENERYNNYSENHNDEYRHQQQDVEVDNHDHHQSHSTNDKDVSDVYAII

SEQ ID NO: 1860973 - protein, 4 aa, Staphylococcus
PKNS

SEQ ID NO: 1860974 - protein, 7 aa, Staphylococcus
PKNSGAF

SEQ ID NO: 1860975 - protein, 5 aa, Staphylococcus
PKNSS

SEQ ID NO: 1860976 - protein, 6 aa, Staphylococcus
PKNVNK

SEQ ID NO: 1860977 - protein, 6 aa, Staphylococcus
PKPLSY

SEQ ID NO: 1860978 - protein, 15 aa, Staphylococcus
PKPPVENNDEVENKG

SEQ ID NO: 1860979 - protein, 4 aa, Staphylococcus
PKQA

SEQ ID NO: 1860980 - protein, 8 aa, Staphylococcus
PKQASELR

SEQ ID NO: 1860981 - protein, 9 aa, Staphylococcus
PKQQAEGKI

SEQ ID NO: 1860982 - protein, 8 aa, Staphylococcus
PKQQTTDG

SEQ ID NO: 1860983 - protein, 14 aa, Staphylococcus
PKQYSGDKQQLRTT

SEQ ID NO: 1860984 - protein, 13 aa, Staphylococcus
PKRDTLTEDGYYN

SEQ ID NO: 1860985 - protein, 8 aa, Staphylococcus
PKREGEVT

SEQ ID NO: 1860986 - protein, 13 aa, Staphylococcus
PKRKAKDFKKNGD

SEQ ID NO: 1860987 - protein, 6 aa, Staphylococcus
PKRREE

SEQ ID NO: 1860988 - protein, 9 aa, Staphylococcus
PKRRGEIAT

SEQ ID NO: 1860989 - protein, 7 aa, Staphylococcus
PKSLKSR

SEQ ID NO: 1860990 - protein, 6 aa, Staphylococcus
PKSPVG

SEQ ID NO: 1860991 - protein, 5 aa, Staphylococcus
PKTEH

SEQ ID NO: 1860992 - protein, 4 aa, Staphylococcus
PKTF

SEQ ID NO: 1860993 - protein, 10 aa, Staphylococcus
PKTPGQNQYA

SEQ ID NO: 1860994 - protein, 4 aa, Staphylococcus
PKTR

SEQ ID NO: 1860995 - protein, 7 aa, Staphylococcus
PKTRRTV

SEQ ID NO: 1860996 - protein, 14 aa, Staphylococcus
PKVERKSRKTADTR

SEQ ID NO: 1860997 - protein, 41 aa, Staphylococcus
PKVESAVESTTDKVEQGDNKKNDTKVKPEAADQRVKQTHKQ

SEQ ID NO: 1860998 - protein, 9 aa, Staphylococcus
PKVSNHPQK

SEQ ID NO: 1860999 - protein, 6 aa, Staphylococcus
PKYKTP

SEQ ID NO: 1861000 - protein, 4 aa, Staphylococcus
PKYN

SEQ ID NO: 1861001 - protein, 7 aa, Staphylococcus
PKYQATS

SEQ ID NO: 1861002 - protein, 14 aa, Staphylococcus
PLAKGKYQQYNKKG

SEQ ID NO: 1861003 - protein, 31 aa, Staphylococcus
PLANESDDNYNEEDFDKAKKDNLPYEQNPNQ

SEQ ID NO: 1861004 - protein, 6 aa, Staphylococcus
PLANNE

SEQ ID NO: 1861005 - protein, 7 aa, Staphylococcus
PLANPEQ

SEQ ID NO: 1861006 - protein, 8 aa, Staphylococcus
PLANPKSG

SEQ ID NO: 1861007 - protein, 5 aa, Staphylococcus
PLAPT

SEQ ID NO: 1861008 - protein, 6 aa, Staphylococcus
PLAPTH

SEQ ID NO: 1861009 - protein, 4 aa, Staphylococcus
PLAT

SEQ ID NO: 1861010 - protein, 17 aa, Staphylococcus
PLDADESARVEFDDETG

SEQ ID NO: 1861011 - protein, 16 aa, Staphylococcus
PLDDVTNPKVNFSTSK

SEQ ID NO: 1861012 - protein, 21 aa, Staphylococcus
PLDGDKKIDEKALQSTARTLE

SEQ ID NO: 1861013 - protein, 4 aa, Staphylococcus
PLDK

SEQ ID NO: 1861014 - protein, 6 aa, Staphylococcus
PLDNGT

SEQ ID NO: 1861015 - protein, 17 aa, Staphylococcus
PLDSEESARVEYDEDTR

SEQ ID NO: 1861016 - protein, 7 aa, Staphylococcus
PLDSPGG

SEQ ID NO: 1861017 - protein, 13 aa, Staphylococcus
PLGADFKGSVSSG

SEQ ID NO: 1861018 - protein, 11 aa, Staphylococcus
PLGNDFKNTVT

SEQ ID NO: 1861019 - protein, 4 aa, Staphylococcus
PLGT

SEQ ID NO: 1861020 - protein, 23 aa, Staphylococcus
PLIGSAEDVNKSLDAAQNVKQEH

SEQ ID NO: 1861021 - protein, 4 aa, Staphylococcus
PLKL

SEQ ID NO: 1861022 - protein, 6 aa, Staphylococcus
PLKPSQ

SEQ ID NO: 1861023 - protein, 8 aa, Staphylococcus
PLNEQKSE

SEQ ID NO: 1861024 - protein, 6 aa, Staphylococcus
PLNSQK

SEQ ID NO: 1861025 - protein, 8 aa, Staphylococcus
PLNSTTEG

SEQ ID NO: 1861026 - protein, 5 aa, Staphylococcus
PLNSV

SEQ ID NO: 1861027 - protein, 13 aa, Staphylococcus
PLPESHQSLKSRA

SEQ ID NO: 1861028 - protein, 5 aa, Staphylococcus
PLPKH

SEQ ID NO: 1861029 - protein, 14 aa, Staphylococcus
PLPKSHQSLKSRSS

SEQ ID NO: 1861030 - protein, 18 aa, Staphylococcus
PLPKTKDIKTTYYPGNNV

SEQ ID NO: 1861031 - protein, 6 aa, Staphylococcus
PLPTHR

SEQ ID NO: 1861032 - protein, 12 aa, Staphylococcus
PLPTSHQALNSR

SEQ ID NO: 1861033 - protein, 13 aa, Staphylococcus
PLPTTHKALNSRS

SEQ ID NO: 1861034 - protein, 12 aa, Staphylococcus
PLPTTHQALNSR

SEQ ID NO: 1861035 - protein, 6 aa, Staphylococcus
PLQAMT

SEQ ID NO: 1861036 - protein, 22 aa, Staphylococcus
PLQKGDKIDDKAVKATAKTLEN

SEQ ID NO: 1861037 - protein, 22 aa, Staphylococcus
PLQKGDKIDKKALQSTAQTLEN

SEQ ID NO: 1861038 - protein, 6 aa, Staphylococcus
PLQNQQ

SEQ ID NO: 1861039 - protein, 7 aa, Staphylococcus
PLQTTIN

SEQ ID NO: 1861040 - protein, 6 aa, Staphylococcus
PLRSDI

SEQ ID NO: 1861041 - protein, 8 aa, Staphylococcus
PLSAAGGI

SEQ ID NO: 1861042 - protein, 5 aa, Staphylococcus
PLSDK

SEQ ID NO: 1861043 - protein, 22 aa, Staphylococcus
PLSGDGKIDDKALQSTAQTLEN

SEQ ID NO: 1861044 - protein, 5 aa, Staphylococcus
PLSGL

SEQ ID NO: 1861045 - protein, 10 aa, Staphylococcus
PLSGTSAGQI

SEQ ID NO: 1861046 - protein, 10 aa, Staphylococcus
PLSNKTTTLD

SEQ ID NO: 1861047 - protein, 9 aa, Staphylococcus
PLSPSSTMG

SEQ ID NO: 1861048 - protein, 5 aa, Staphylococcus
PLSQT

SEQ ID NO: 1861049 - protein, 4 aa, Staphylococcus
PLSS

SEQ ID NO: 1861050 - protein, 7 aa, Staphylococcus
PLTHKQQ

SEQ ID NO: 1861051 - protein, 5 aa, Staphylococcus
PLTQE

SEQ ID NO: 1861052 - protein, 16 aa, Staphylococcus
PMKSSPAEKAGLRPKD

SEQ ID NO: 1861053 - protein, 4 aa, Staphylococcus
PMNH

SEQ ID NO: 1861054 - protein, 9 aa, Staphylococcus
PMPEEATRR

SEQ ID NO: 1861055 - protein, 7 aa, Staphylococcus
PMTKSDV

SEQ ID NO: 1861056 - protein, 8 aa, Staphylococcus
PNAEQPAL

SEQ ID NO: 1861057 - protein, 8 aa, Staphylococcus
PNAKKPKI

SEQ ID NO: 1861058 - protein, 10 aa, Staphylococcus
PNAPKPQANE

SEQ ID NO: 1861059 - protein, 39 aa, Staphylococcus
PNARQTINEKANEQKQKIQQDRIATQEEKEAANAQVDNH

SEQ ID NO: 1861060 - protein, 11 aa, Staphylococcus
PNATIDGKVGR

SEQ ID NO: 1861061 - protein, 6 aa, Staphylococcus
PNDEMK

SEQ ID NO: 1861062 - protein, 7 aa, Staphylococcus
PNDISED

SEQ ID NO: 1861063 - protein, 15 aa, Staphylococcus
PNDKTYKLGDNNKHV

SEQ ID NO: 1861064 - protein, 27 aa, Staphylococcus
PNDRRYKDEDYFKNPKQPDYSHSNQTF

SEQ ID NO: 1861065 - protein, 4 aa, Staphylococcus
PNDT

SEQ ID NO: 1861066 - protein, 9 aa, Staphylococcus
PNDTQLSPH

SEQ ID NO: 1861067 - protein, 15 aa, Staphylococcus
PNDTSYHKGDNNKHV

SEQ ID NO: 1861068 - protein, 5 aa, Staphylococcus
PNEAG

SEQ ID NO: 1861069 - protein, 5 aa, Staphylococcus
PNEDM

SEQ ID NO: 1861070 - protein, 5 aa, Staphylococcus
PNENY

SEQ ID NO: 1861071 - protein, 13 aa, Staphylococcus
PNERNVTERQREY

SEQ ID NO: 1861072 - protein, 9 aa, Staphylococcus
PNEVPGQTV

SEQ ID NO: 1861073 - protein, 10 aa, Staphylococcus
PNFKQPFKAK

SEQ ID NO: 1861074 - protein, 7 aa, Staphylococcus
PNFSDTG

SEQ ID NO: 1861075 - protein, 7 aa, Staphylococcus
PNGEREN

SEQ ID NO: 1861076 - protein, 21 aa, Staphylococcus
PNGEVQNAYSSFTSPQFRSPM

SEQ ID NO: 1861077 - protein, 32 aa, Staphylococcus
PNGKTAITPNRDTTAYLPKGSSVLNGKQTHSI

SEQ ID NO: 1861078 - protein, 10 aa, Staphylococcus
PNGSIKDESW

SEQ ID NO: 1861079 - protein, 5 aa, Staphylococcus
PNGTI

SEQ ID NO: 1861080 - protein, 6 aa, Staphylococcus
PNGTLL

SEQ ID NO: 1861081 - protein, 4 aa, Staphylococcus
PNHG

SEQ ID NO: 1861082 - protein, 7 aa, Staphylococcus
PNHSASL

SEQ ID NO: 1861083 - protein, 7 aa, Staphylococcus
PNHSDKI

SEQ ID NO: 1861084 - protein, 13 aa, Staphylococcus
PNIPRAKANLKKE

SEQ ID NO: 1861085 - protein, 14 aa, Staphylococcus
PNISRKKADKKKEM

SEQ ID NO: 1861086 - protein, 14 aa, Staphylococcus
PNITTEKREEVPQA

SEQ ID NO: 1861087 - protein, 22 aa, Staphylococcus
PNKGLTVNGQGYTSQGQSPANY

SEQ ID NO: 1861088 - protein, 4 aa, Staphylococcus
PNKI

SEQ ID NO: 1861089 - protein, 5 aa, Staphylococcus
PNKNI

SEQ ID NO: 1861090 - protein, 10 aa, Staphylococcus
PNKPGALSEE

SEQ ID NO: 1861091 - protein, 7 aa, Staphylococcus
PNKPKVK

SEQ ID NO: 1861092 - protein, 7 aa, Staphylococcus
PNKPVID

SEQ ID NO: 1861093 - protein, 9 aa, Staphylococcus
PNKRGGAMG

SEQ ID NO: 1861094 - protein, 7 aa, Staphylococcus
PNKTVEG

SEQ ID NO: 1861095 - protein, 4 aa, Staphylococcus
PNLT

SEQ ID NO: 1861096 - protein, 5 aa, Staphylococcus
PNNAN

SEQ ID NO: 1861097 - protein, 14 aa, Staphylococcus
PNNDDDSKSKSSND

SEQ ID NO: 1861098 - protein, 15 aa, Staphylococcus
PNNIEEAGQKLRKGL

SEQ ID NO: 1861099 - protein, 16 aa, Staphylococcus
PNNMKQKNAQQDENVK

SEQ ID NO: 1861100 - protein, 5 aa, Staphylococcus
PNNTH

SEQ ID NO: 1861101 - protein, 13 aa, Staphylococcus
PNQPSGGNETQIW

SEQ ID NO: 1861102 - protein, 15 aa, Staphylococcus
PNQSINGVQVGRGSN

SEQ ID NO: 1861103 - protein, 30 aa, Staphylococcus
PNQTYAASEIANTSTHMAQQEQQNNPVDCK

SEQ ID NO: 1861104 - protein, 8 aa, Staphylococcus
PNRPKDMR

SEQ ID NO: 1861105 - protein, 10 aa, Staphylococcus
PNRRKEIADK

SEQ ID NO: 1861106 - protein, 9 aa, Staphylococcus
PNSNFAASG

SEQ ID NO: 1861107 - protein, 10 aa, Staphylococcus
PNTDKVADNL

SEQ ID NO: 1861108 - protein, 10 aa, Staphylococcus
PNTGGSNHSD

SEQ ID NO: 1861109 - protein, 21 aa, Staphylococcus
PNTQDTNQYHEGVGTKKLNKN

SEQ ID NO: 1861110 - protein, 7 aa, Staphylococcus
PNTTNTL

SEQ ID NO: 1861111 - protein, 8 aa, Staphylococcus
PNVAQTAE

SEQ ID NO: 1861112 - protein, 10 aa, Staphylococcus
PNVARKAPNM

SEQ ID NO: 1861113 - protein, 9 aa, Staphylococcus
PNVDQSAGT

SEQ ID NO: 1861114 - protein, 11 aa, Staphylococcus
PNVDQTPGTIA

SEQ ID NO: 1861115 - protein, 18 aa, Staphylococcus
PNVEKGVGKLTEKVNEKY

SEQ ID NO: 1861116 - protein, 4 aa, Staphylococcus
PNVK

SEQ ID NO: 1861117 - protein, 14 aa, Staphylococcus
PNVPRAKVNKKREA

SEQ ID NO: 1861118 - protein, 11 aa, Staphylococcus
PNVPRNKPNMK

SEQ ID NO: 1861119 - protein, 6 aa, Staphylococcus
PPAQRN

SEQ ID NO: 1861120 - protein, 7 aa, Staphylococcus
PPASDGQ

SEQ ID NO: 1861121 - protein, 8 aa, Staphylococcus
PPASTHAR

SEQ ID NO: 1861122 - protein, 4 aa, Staphylococcus
PPDK

SEQ ID NO: 1861123 - protein, 12 aa, Staphylococcus
PPERDAIEGGKE

SEQ ID NO: 1861124 - protein, 12 aa, Staphylococcus
PPERDSIEGGKE

SEQ ID NO: 1861125 - protein, 8 aa, Staphylococcus
PPFSGETA

SEQ ID NO: 1861126 - protein, 10 aa, Staphylococcus
PPHGAKGMTD

SEQ ID NO: 1861127 - protein, 8 aa, Staphylococcus
PPHPGPTV

SEQ ID NO: 1861128 - protein, 26 aa, Staphylococcus
PPIRGESEEYYEGQEGEKEVEVTGSR

SEQ ID NO: 1861129 - protein, 4 aa, Staphylococcus
PPKF

SEQ ID NO: 1861130 - protein, 4 aa, Staphylococcus
PPLA

SEQ ID NO: 1861131 - protein, 19 aa, Staphylococcus
PPLSHVDPATDEKASWSQM

SEQ ID NO: 1861132 - protein, 12 aa, Staphylococcus
PPNGAKGMSDEA

SEQ ID NO: 1861133 - protein, 11 aa, Staphylococcus
PPNGAKGMTDE

SEQ ID NO: 1861134 - protein, 11 aa, Staphylococcus
PPNGAKPMSDE

SEQ ID NO: 1861135 - protein, 12 aa, Staphylococcus
PPNGAKSMSDEA

SEQ ID NO: 1861136 - protein, 9 aa, Staphylococcus
PPNTDTSAT

SEQ ID NO: 1861137 - protein, 5 aa, Staphylococcus
PPNTR

SEQ ID NO: 1861138 - protein, 7 aa, Staphylococcus
PPQVPGN

SEQ ID NO: 1861139 - protein, 16 aa, Staphylococcus
PPRSPRKYHYSKGHIH

SEQ ID NO: 1861140 - protein, 14 aa, Staphylococcus
PPRTPEREEEPPPM

SEQ ID NO: 1861141 - protein, 14 aa, Staphylococcus
PPRTPQREEEPPPM

SEQ ID NO: 1861142 - protein, 8 aa, Staphylococcus
PPSKLNVA

SEQ ID NO: 1861143 - protein, 12 aa, Staphylococcus
PPVDTGESIGLG

SEQ ID NO: 1861144 - protein, 5 aa, Staphylococcus
PPYAR

SEQ ID NO: 1861145 - protein, 4 aa, Staphylococcus
PPYL

SEQ ID NO: 1861146 - protein, 6 aa, Staphylococcus
PQAATT

SEQ ID NO: 1861147 - protein, 5 aa, Staphylococcus
PQAEF

SEQ ID NO: 1861148 - protein, 7 aa, Staphylococcus
PQAGGEK

SEQ ID NO: 1861149 - protein, 5 aa, Staphylococcus
PQALE

SEQ ID NO: 1861150 - protein, 5 aa, Staphylococcus
PQEEF

SEQ ID NO: 1861151 - protein, 6 aa, Staphylococcus
PQEQQF

SEQ ID NO: 1861152 - protein, 7 aa, Staphylococcus
PQESLGQ

SEQ ID NO: 1861153 - protein, 6 aa, Staphylococcus
PQETLG

SEQ ID NO: 1861154 - protein, 20 aa, Staphylococcus
PQETSNSSFNEDDKYDQYPK

SEQ ID NO: 1861155 - protein, 6 aa, Staphylococcus
PQGATT

SEQ ID NO: 1861156 - protein, 4 aa, Staphylococcus
PQGI

SEQ ID NO: 1861157 - protein, 10 aa, Staphylococcus
PQGKEAYNTK

SEQ ID NO: 1861158 - protein, 6 aa, Staphylococcus
PQGYDT

SEQ ID NO: 1861159 - protein, 23 aa, Staphylococcus
PQGYDTEVGERGVKLSGGQKQRL

SEQ ID NO: 1861160 - protein, 15 aa, Staphylococcus
PQKGTIVKTDGMEGS

SEQ ID NO: 1861161 - protein, 23 aa, Staphylococcus
PQKGTIVKTDGMEGSMAQAGNPI

SEQ ID NO: 1861162 - protein, 4 aa, Staphylococcus
PQLE

SEQ ID NO: 1861163 - protein, 5 aa, Staphylococcus
PQLQS

SEQ ID NO: 1861164 - protein, 13 aa, Staphylococcus
PQLRAKDLKNREC

SEQ ID NO: 1861165 - protein, 7 aa, Staphylococcus
PQNGGEK

SEQ ID NO: 1861166 - protein, 6 aa, Staphylococcus
PQNGTI

SEQ ID NO: 1861167 - protein, 5 aa, Staphylococcus
PQNPY

SEQ ID NO: 1861168 - protein, 9 aa, Staphylococcus
PQQSPNTQR

SEQ ID NO: 1861169 - protein, 4 aa, Staphylococcus
PQQV

SEQ ID NO: 1861170 - protein, 13 aa, Staphylococcus
PQSAKNKDTKDIQ

SEQ ID NO: 1861171 - protein, 10 aa, Staphylococcus
PQSGGMSNYA

SEQ ID NO: 1861172 - protein, 13 aa, Staphylococcus
PQSGGMSNYAQYS

SEQ ID NO: 1861173 - protein, 5 aa, Staphylococcus
PQSKI

SEQ ID NO: 1861174 - protein, 6 aa, Staphylococcus
PQSLEG

SEQ ID NO: 1861175 - protein, 6 aa, Staphylococcus
PQTTKI

SEQ ID NO: 1861176 - protein, 11 aa, Staphylococcus
PQTTTSSYPPR

SEQ ID NO: 1861177 - protein, 5 aa, Staphylococcus
PQVDR

SEQ ID NO: 1861178 - protein, 5 aa, Staphylococcus
PQVEL

SEQ ID NO: 1861179 - protein, 5 aa, Staphylococcus
PQVPN

SEQ ID NO: 1861180 - protein, 4 aa, Staphylococcus
PQVR

SEQ ID NO: 1861181 - protein, 6 aa, Staphylococcus
PQYEKT

SEQ ID NO: 1861182 - protein, 6 aa, Staphylococcus
PQYERT

SEQ ID NO: 1861183 - protein, 20 aa, Staphylococcus
PQYQTVNTESSTKQRESNYS

SEQ ID NO: 1861184 - protein, 4 aa, Staphylococcus
PRAA

SEQ ID NO: 1861185 - protein, 17 aa, Staphylococcus
PRDTQADIVGKGTTEKI

SEQ ID NO: 1861186 - protein, 6 aa, Staphylococcus
PRDTRA

SEQ ID NO: 1861187 - protein, 7 aa, Staphylococcus
PRDTRTE

SEQ ID NO: 1861188 - protein, 8 aa, Staphylococcus
PRDWQDNV

SEQ ID NO: 1861189 - protein, 12 aa, Staphylococcus
PREATGDNWDGL

SEQ ID NO: 1861190 - protein, 6 aa, Staphylococcus
PREPLP

SEQ ID NO: 1861191 - protein, 11 aa, Staphylococcus
PRERIATSQQG

SEQ ID NO: 1861192 - protein, 18 aa, Staphylococcus
PREYKQERLKDNGEKVAE

SEQ ID NO: 1861193 - protein, 18 aa, Staphylococcus
PREYKTETYVEDENTINE

SEQ ID NO: 1861194 - protein, 9 aa, Staphylococcus
PRKETTEGF

SEQ ID NO: 1861195 - protein, 19 aa, Staphylococcus
PRKPKLKNNLTQYFRSKPS

SEQ ID NO: 1861196 - protein, 16 aa, Staphylococcus
PRKYEERNINDRATVT

SEQ ID NO: 1861197 - protein, 18 aa, Staphylococcus
PRLRRRHTKRQAHEKRGV

SEQ ID NO: 1861198 - protein, 5 aa, Staphylococcus
PRNRI

SEQ ID NO: 1861199 - protein, 18 aa, Staphylococcus
PRQARPGASRNLSPKGNI

SEQ ID NO: 1861200 - protein, 8 aa, Staphylococcus
PRRSEPRV

SEQ ID NO: 1861201 - protein, 20 aa, Staphylococcus
PRSWQDNVNKQLSDAAKRHK

SEQ ID NO: 1861202 - protein, 14 aa, Staphylococcus
PRTPARDATNPPQE

SEQ ID NO: 1861203 - protein, 11 aa, Staphylococcus
PRYPKLGEKNY

SEQ ID NO: 1861204 - protein, 8 aa, Staphylococcus
PSADSLTK

SEQ ID NO: 1861205 - protein, 12 aa, Staphylococcus
PSATKKQPIPSH

SEQ ID NO: 1861206 - protein, 16 aa, Staphylococcus
PSAVTQTLGGHGTAQR

SEQ ID NO: 1861207 - protein, 24 aa, Staphylococcus
PSAYTKVGDISSLGTQKTFTEAEM

SEQ ID NO: 1861208 - protein, 4 aa, Staphylococcus
PSDA

SEQ ID NO: 1861209 - protein, 15 aa, Staphylococcus
PSDASIKANTAFKAN

SEQ ID NO: 1861210 - protein, 8 aa, Staphylococcus
PSDGGIDS

SEQ ID NO: 1861211 - protein, 5 aa, Staphylococcus
PSDGQ

SEQ ID NO: 1861212 - protein, 15 aa, Staphylococcus
PSDKQSDKSKSTDDD

SEQ ID NO: 1861213 - protein, 15 aa, Staphylococcus
PSDKSDAGSKSSKED

SEQ ID NO: 1861214 - protein, 17 aa, Staphylococcus
PSDKTYSVGDNNKNVKS

SEQ ID NO: 1861215 - protein, 4 aa, Staphylococcus
PSDS

SEQ ID NO: 1861216 - protein, 10 aa, Staphylococcus
PSDVSYEDAY

SEQ ID NO: 1861217 - protein, 4 aa, Staphylococcus
PSEA

SEQ ID NO: 1861218 - protein, 7 aa, Staphylococcus
PSEENTF

SEQ ID NO: 1861219 - protein, 5 aa, Staphylococcus
PSEEV

SEQ ID NO: 1861220 - protein, 27 aa, Staphylococcus
PSEPRDNKYGPVRGSARIQAGDSNWRD

SEQ ID NO: 1861221 - protein, 24 aa, Staphylococcus
PSERIETSQQGFAITQSKSSLGQA

SEQ ID NO: 1861222 - protein, 7 aa, Staphylococcus
PSERLQT

SEQ ID NO: 1861223 - protein, 4 aa, Staphylococcus
PSGA

SEQ ID NO: 1861224 - protein, 4 aa, Staphylococcus
PSGD

SEQ ID NO: 1861225 - protein, 6 aa, Staphylococcus
PSGIPA

SEQ ID NO: 1861226 - protein, 4 aa, Staphylococcus
PSGL

SEQ ID NO: 1861227 - protein, 4 aa, Staphylococcus
PSGV

SEQ ID NO: 1861228 - protein, 6 aa, Staphylococcus
PSGVPA

SEQ ID NO: 1861229 - protein, 125 aa, Staphylococcus
PSHGYENQYYPRDEYDDRYYGSNRNINDDYDYDDHNQYNDYDEDYVESPPKTKKSERRTRRKKPYYNDDIDSNYRDNNYDETTIRKDEEQDLATDTEEDKYNQYPKRAITGEYQSDADDVEATGV

SEQ ID NO: 1861230 - protein, 5 aa, Staphylococcus
PSISD

SEQ ID NO: 1861231 - protein, 6 aa, Staphylococcus
PSISGK

SEQ ID NO: 1861232 - protein, 6 aa, Staphylococcus
PSITPT

SEQ ID NO: 1861233 - protein, 5 aa, Staphylococcus
PSKEQ

SEQ ID NO: 1861234 - protein, 14 aa, Staphylococcus
PSKEQNEQTKLGEG

SEQ ID NO: 1861235 - protein, 4 aa, Staphylococcus
PSKL

SEQ ID NO: 1861236 - protein, 9 aa, Staphylococcus
PSKNAKDIT

SEQ ID NO: 1861237 - protein, 13 aa, Staphylococcus
PSKQNRPTVNDRI

SEQ ID NO: 1861238 - protein, 15 aa, Staphylococcus
PSKQNRPTVNDRISD

SEQ ID NO: 1861239 - protein, 5 aa, Staphylococcus
PSKTP

SEQ ID NO: 1861240 - protein, 5 aa, Staphylococcus
PSLPD

SEQ ID NO: 1861241 - protein, 15 aa, Staphylococcus
PSLPSKKNFSYGTAS

SEQ ID NO: 1861242 - protein, 4 aa, Staphylococcus
PSLS

SEQ ID NO: 1861243 - protein, 5 aa, Staphylococcus
PSLTG

SEQ ID NO: 1861244 - protein, 5 aa, Staphylococcus
PSMAQ

SEQ ID NO: 1861245 - protein, 5 aa, Staphylococcus
PSNDH

SEQ ID NO: 1861246 - protein, 4 aa, Staphylococcus
PSNE

SEQ ID NO: 1861247 - protein, 5 aa, Staphylococcus
PSNGR

SEQ ID NO: 1861248 - protein, 17 aa, Staphylococcus
PSNKTYQLGDDDKNVKT

SEQ ID NO: 1861249 - protein, 4 aa, Staphylococcus
PSNP

SEQ ID NO: 1861250 - protein, 20 aa, Staphylococcus
PSNQTSTPVPTNGKSYTIEE

SEQ ID NO: 1861251 - protein, 7 aa, Staphylococcus
PSPGGIT

SEQ ID NO: 1861252 - protein, 6 aa, Staphylococcus
PSQDYD

SEQ ID NO: 1861253 - protein, 6 aa, Staphylococcus
PSREEV

SEQ ID NO: 1861254 - protein, 8 aa, Staphylococcus
PSSGGFTE

SEQ ID NO: 1861255 - protein, 9 aa, Staphylococcus
PSSGIDSAA

SEQ ID NO: 1861256 - protein, 7 aa, Staphylococcus
PSSGLDT

SEQ ID NO: 1861257 - protein, 7 aa, Staphylococcus
PSSIANK

SEQ ID NO: 1861258 - protein, 11 aa, Staphylococcus
PSSIDTSQGAL

SEQ ID NO: 1861259 - protein, 7 aa, Staphylococcus
PSSLGEA

SEQ ID NO: 1861260 - protein, 8 aa, Staphylococcus
PSSNHKKP

SEQ ID NO: 1861261 - protein, 11 aa, Staphylococcus
PSSNTDGNYTK

SEQ ID NO: 1861262 - protein, 12 aa, Staphylococcus
PSSNTDGNYTKV

SEQ ID NO: 1861263 - protein, 23 aa, Staphylococcus
PSTEVRTNARKALKAKADEQNAL

SEQ ID NO: 1861264 - protein, 21 aa, Staphylococcus
PSTKVKRDARDALNQTTETKM

SEQ ID NO: 1861265 - protein, 11 aa, Staphylococcus
PSTLSDEEVNK

SEQ ID NO: 1861266 - protein, 5 aa, Staphylococcus
PSTSH

SEQ ID NO: 1861267 - protein, 23 aa, Staphylococcus
PSTTDKMHTNNIKGNAIEHHPTS

SEQ ID NO: 1861268 - protein, 8 aa, Staphylococcus
PSTTNTDQ

SEQ ID NO: 1861269 - protein, 4 aa, Staphylococcus
PSVA

SEQ ID NO: 1861270 - protein, 4 aa, Staphylococcus
PSVV

SEQ ID NO: 1861271 - protein, 5 aa, Staphylococcus
PSYKD

SEQ ID NO: 1861272 - protein, 7 aa, Staphylococcus
PTADTTV

SEQ ID NO: 1861273 - protein, 16 aa, Staphylococcus
PTAEQNEKSRHVEGDN

SEQ ID NO: 1861274 - protein, 15 aa, Staphylococcus
PTDISEAGQKLRKGL

SEQ ID NO: 1861275 - protein, 15 aa, Staphylococcus
PTDITSAGQKLRKGL

SEQ ID NO: 1861276 - protein, 14 aa, Staphylococcus
PTDKSYSVGDNTKY

SEQ ID NO: 1861277 - protein, 9 aa, Staphylococcus
PTDLDKDNK

SEQ ID NO: 1861278 - protein, 5 aa, Staphylococcus
PTEGE

SEQ ID NO: 1861279 - protein, 10 aa, Staphylococcus
PTELRGSLGS

SEQ ID NO: 1861280 - protein, 6 aa, Staphylococcus
PTESPV

SEQ ID NO: 1861281 - protein, 10 aa, Staphylococcus
PTEYRGSLGS

SEQ ID NO: 1861282 - protein, 7 aa, Staphylococcus
PTFNKQD

SEQ ID NO: 1861283 - protein, 6 aa, Staphylococcus
PTFNNQ

SEQ ID NO: 1861284 - protein, 4 aa, Staphylococcus
PTFS

SEQ ID NO: 1861285 - protein, 5 aa, Staphylococcus
PTGIP

SEQ ID NO: 1861286 - protein, 4 aa, Staphylococcus
PTGL

SEQ ID NO: 1861287 - protein, 5 aa, Staphylococcus
PTGPI

SEQ ID NO: 1861288 - protein, 9 aa, Staphylococcus
PTHLNNNAT

SEQ ID NO: 1861289 - protein, 5 aa, Staphylococcus
PTHRS

SEQ ID NO: 1861290 - protein, 8 aa, Staphylococcus
PTIADKEV

SEQ ID NO: 1861291 - protein, 9 aa, Staphylococcus
PTKEERDYL

SEQ ID NO: 1861292 - protein, 5 aa, Staphylococcus
PTKFR

SEQ ID NO: 1861293 - protein, 38 aa, Staphylococcus
PTKKISKRNEDKDDKTSHNHKTSKKELPETGVKEQEFN

SEQ ID NO: 1861294 - protein, 9 aa, Staphylococcus
PTKKKPSDF

SEQ ID NO: 1861295 - protein, 4 aa, Staphylococcus
PTKS

SEQ ID NO: 1861296 - protein, 8 aa, Staphylococcus
PTKSHSDI

SEQ ID NO: 1861297 - protein, 4 aa, Staphylococcus
PTLA

SEQ ID NO: 1861298 - protein, 5 aa, Staphylococcus
PTLNE

SEQ ID NO: 1861299 - protein, 19 aa, Staphylococcus
PTLNPKVPQSTQSSGFTTG

SEQ ID NO: 1861300 - protein, 17 aa, Staphylococcus
PTMDPNIKNSSTQAIPA

SEQ ID NO: 1861301 - protein, 13 aa, Staphylococcus
PTNINANMSQTTG

SEQ ID NO: 1861302 - protein, 9 aa, Staphylococcus
PTNYEETND

SEQ ID NO: 1861303 - protein, 6 aa, Staphylococcus
PTPESK

SEQ ID NO: 1861304 - protein, 5 aa, Staphylococcus
PTPGP

SEQ ID NO: 1861305 - protein, 8 aa, Staphylococcus
PTPPNIKK

SEQ ID NO: 1861306 - protein, 7 aa, Staphylococcus
PTPPSIK

SEQ ID NO: 1861307 - protein, 16 aa, Staphylococcus
PTPTPEKGLTLGSNDG

SEQ ID NO: 1861308 - protein, 7 aa, Staphylococcus
PTPYQPD

SEQ ID NO: 1861309 - protein, 4 aa, Staphylococcus
PTQA

SEQ ID NO: 1861310 - protein, 379 aa, Staphylococcus
PTQAIEQQENELDKNAQNNSSSVIKDDNDVLTKNSENTNKNDQSSDVDRSNNVSLPSNQKVSDSQTRATEQTDNTSEVNDEERSTGDPNKQNEKEDKQSAEDPDKQNGKEDKQSAEDPDKQNGKEDKQSAEDPDKQNGKEDKQSTEDPDKQNNQNGSDGESGDSEDSNNQGGGSKEPNYSGGSGGGSGKPDNSNEDGGGSKEPNHSGGSGGGSGKPDNSNEDGGGSEEPNHSGGSGGGSGEPDNSNEDGGGSEEPQQPNGSGGGSGKPQKPNKHGEGNGKPEQPNKGNGTTEKPEKPNNSGGNAYTPSNSNKSSNETGNASSTETNNRDSVNRTHRSSTQNDSNSQSNNGKNSSNSNNIDQPSMNQTTENNQNRESNEH

SEQ ID NO: 1861311 - protein, 7 aa, Staphylococcus
PTQKNHY

SEQ ID NO: 1861312 - protein, 7 aa, Staphylococcus
PTQYERR

SEQ ID NO: 1861313 - protein, 12 aa, Staphylococcus
PTRLEAGVKESK

SEQ ID NO: 1861314 - protein, 41 aa, Staphylococcus
PTRPIPEGNVTAKAYNHSDESKVSTSDPKFATDTIPPTTPV

SEQ ID NO: 1861315 - protein, 6 aa, Staphylococcus
PTRSLD

SEQ ID NO: 1861316 - protein, 10 aa, Staphylococcus
PTSADGSFTL

SEQ ID NO: 1861317 - protein, 10 aa, Staphylococcus
PTSDYMTTSK

SEQ ID NO: 1861318 - protein, 20 aa, Staphylococcus
PTSEEAAFTVSKGSNTGVTG

SEQ ID NO: 1861319 - protein, 7 aa, Staphylococcus
PTSEGMT

SEQ ID NO: 1861320 - protein, 52 aa, Staphylococcus
PTSFEDSTNTNTAQASQQGNMESNGEAGGTQTAINPTVNNPSGGKDGAASKY

SEQ ID NO: 1861321 - protein, 4 aa, Staphylococcus
PTSG

SEQ ID NO: 1861322 - protein, 14 aa, Staphylococcus
PTSGETGLSGQITN

SEQ ID NO: 1861323 - protein, 10 aa, Staphylococcus
PTSKGVKDSG

SEQ ID NO: 1861324 - protein, 4 aa, Staphylococcus
PTTA

SEQ ID NO: 1861325 - protein, 5 aa, Staphylococcus
PTTAL

SEQ ID NO: 1861326 - protein, 12 aa, Staphylococcus
PTTALDEDNTKQ

SEQ ID NO: 1861327 - protein, 13 aa, Staphylococcus
PTTALDEDNTTNV

SEQ ID NO: 1861328 - protein, 6 aa, Staphylococcus
PTTFPS

SEQ ID NO: 1861329 - protein, 6 aa, Staphylococcus
PTTGKQ

SEQ ID NO: 1861330 - protein, 5 aa, Staphylococcus
PTTGL

SEQ ID NO: 1861331 - protein, 7 aa, Staphylococcus
PTTGLDI

SEQ ID NO: 1861332 - protein, 7 aa, Staphylococcus
PTTSGWS

SEQ ID NO: 1861333 - protein, 8 aa, Staphylococcus
PTVADNEI

SEQ ID NO: 1861334 - protein, 9 aa, Staphylococcus
PTVIKGNAS

SEQ ID NO: 1861335 - protein, 16 aa, Staphylococcus
PTVKETPDAKDWAENE

SEQ ID NO: 1861336 - protein, 18 aa, Staphylococcus
PTVKETPNAKKWATEQLE

SEQ ID NO: 1861337 - protein, 15 aa, Staphylococcus
PTVKETPNAKQWAEN

SEQ ID NO: 1861338 - protein, 15 aa, Staphylococcus
PVDQSKQSLVTKQSN

SEQ ID NO: 1861339 - protein, 7 aa, Staphylococcus
PVEETNV

SEQ ID NO: 1861340 - protein, 5 aa, Staphylococcus
PVEPG

SEQ ID NO: 1861341 - protein, 12 aa, Staphylococcus
PVFSDGASGAKL

SEQ ID NO: 1861342 - protein, 13 aa, Staphylococcus
PVGAPPKKQKGKG

SEQ ID NO: 1861343 - protein, 4 aa, Staphylococcus
PVGE

SEQ ID NO: 1861344 - protein, 13 aa, Staphylococcus
PVGKPPKKKKNKR

SEQ ID NO: 1861345 - protein, 13 aa, Staphylococcus
PVGKPPKKKKSKR

SEQ ID NO: 1861346 - protein, 13 aa, Staphylococcus
PVGKPPKKKKSNK

SEQ ID NO: 1861347 - protein, 6 aa, Staphylococcus
PVKDGG

SEQ ID NO: 1861348 - protein, 10 aa, Staphylococcus
PVKDYADNFS

SEQ ID NO: 1861349 - protein, 9 aa, Staphylococcus
PVKNSGASI

SEQ ID NO: 1861350 - protein, 10 aa, Staphylococcus
PVKNSGASIG

SEQ ID NO: 1861351 - protein, 11 aa, Staphylococcus
PVKNSGASIGA

SEQ ID NO: 1861352 - protein, 7 aa, Staphylococcus
PVNGKPF

SEQ ID NO: 1861353 - protein, 8 aa, Staphylococcus
PVNKKAET

SEQ ID NO: 1861354 - protein, 10 aa, Staphylococcus
PVNKKAETAI

SEQ ID NO: 1861355 - protein, 9 aa, Staphylococcus
PVNKKAETT

SEQ ID NO: 1861356 - protein, 15 aa, Staphylococcus
PVNPGNSGGAVVDQN

SEQ ID NO: 1861357 - protein, 15 aa, Staphylococcus
PVNPGNSGGAVVDRD

SEQ ID NO: 1861358 - protein, 15 aa, Staphylococcus
PVNPGNSGGGVIDKN

SEQ ID NO: 1861359 - protein, 7 aa, Staphylococcus
PVNSSAK

SEQ ID NO: 1861360 - protein, 5 aa, Staphylococcus
PVPIE

SEQ ID NO: 1861361 - protein, 7 aa, Staphylococcus
PVQKNHR

SEQ ID NO: 1861362 - protein, 8 aa, Staphylococcus
PVSANYSN

SEQ ID NO: 1861363 - protein, 5 aa, Staphylococcus
PVSHA

SEQ ID NO: 1861364 - protein, 8 aa, Staphylococcus
PVSKDETV

SEQ ID NO: 1861365 - protein, 7 aa, Staphylococcus
PVSKDSK

SEQ ID NO: 1861366 - protein, 12 aa, Staphylococcus
PVSNNSKGEEMA

SEQ ID NO: 1861367 - protein, 13 aa, Staphylococcus
PVSNNSKGEEMAK

SEQ ID NO: 1861368 - protein, 4 aa, Staphylococcus
PVSR

SEQ ID NO: 1861369 - protein, 5 aa, Staphylococcus
PVSRL

SEQ ID NO: 1861370 - protein, 7 aa, Staphylococcus
PVTEPNV

SEQ ID NO: 1861371 - protein, 5 aa, Staphylococcus
PVTGT

SEQ ID NO: 1861372 - protein, 6 aa, Staphylococcus
PVTGTS

SEQ ID NO: 1861373 - protein, 18 aa, Staphylococcus
PVTLNGEREHVRTQETNL

SEQ ID NO: 1861374 - protein, 11 aa, Staphylococcus
PVTSEDASWSE

SEQ ID NO: 1861375 - protein, 4 aa, Staphylococcus
PVYK

SEQ ID NO: 1861376 - protein, 4 aa, Staphylococcus
PVYM

SEQ ID NO: 1861377 - protein, 10 aa, Staphylococcus
PWGGPTARAI

SEQ ID NO: 1861378 - protein, 6 aa, Staphylococcus
PYASSA

SEQ ID NO: 1861379 - protein, 7 aa, Staphylococcus
PYDKTDN

SEQ ID NO: 1861380 - protein, 7 aa, Staphylococcus
PYDKTDQ

SEQ ID NO: 1861381 - protein, 12 aa, Staphylococcus
PYGKEGLQALSG

SEQ ID NO: 1861382 - protein, 15 aa, Staphylococcus
PYGYTPYDNQGNLKS

SEQ ID NO: 1861383 - protein, 20 aa, Staphylococcus
PYGYTPYKENGDLKPDNQID

SEQ ID NO: 1861384 - protein, 12 aa, Staphylococcus
PYHPEKAEKDLP

SEQ ID NO: 1861385 - protein, 4 aa, Staphylococcus
PYKD

SEQ ID NO: 1861386 - protein, 26 aa, Staphylococcus
PYKDHSLPENAMDPSDKDGKKALRPV

SEQ ID NO: 1861387 - protein, 10 aa, Staphylococcus
PYKTVNSPNR

SEQ ID NO: 1861388 - protein, 4 aa, Staphylococcus
PYMK

SEQ ID NO: 1861389 - protein, 13 aa, Staphylococcus
PYPDEQAKHARQK

SEQ ID NO: 1861390 - protein, 13 aa, Staphylococcus
PYPSETSKHARQK

SEQ ID NO: 1861391 - protein, 14 aa, Staphylococcus
PYQEDGVLKPDDQI

SEQ ID NO: 1861392 - protein, 17 aa, Staphylococcus
PYQQAANNAKALKDQIE

SEQ ID NO: 1861393 - protein, 6 aa, Staphylococcus
PYQSAS

SEQ ID NO: 1861394 - protein, 8 aa, Staphylococcus
PYQSRDEN

SEQ ID NO: 1861395 - protein, 5 aa, Staphylococcus
PYSGR

SEQ ID NO: 1861396 - protein, 8 aa, Staphylococcus
PYTEASKH

SEQ ID NO: 1861397 - protein, 14 aa, Staphylococcus
PYTGETDYSGPLAG

SEQ ID NO: 1861398 - protein, 8 aa, Staphylococcus
PYTNKDTF

SEQ ID NO: 1861399 - protein, 6 aa, Staphylococcus
PYTSED

SEQ ID NO: 1861400 - protein, 8 aa, Staphylococcus
PYTSEDKY

SEQ ID NO: 1861401 - protein, 17 aa, Staphylococcus
PYTVKGDSMDPTLKDGE

SEQ ID NO: 1861402 - protein, 18 aa, Staphylococcus
PYTYTPYDEDGSIKNNNQ

SEQ ID NO: 1861403 - protein, 16 aa, Staphylococcus
PYTYTPYENNGDLKAY

SEQ ID NO: 1861404 - protein, 29 aa, Staphylococcus
QAAATHNGDIDANQNATNEEKAVAKEQVN

SEQ ID NO: 1861405 - protein, 18 aa, Staphylococcus
QAAITGESVPVSKAVDDE

SEQ ID NO: 1861406 - protein, 5 aa, Staphylococcus
QAATT

SEQ ID NO: 1861407 - protein, 9 aa, Staphylococcus
QADEQSQSY

SEQ ID NO: 1861408 - protein, 22 aa, Staphylococcus
QADHNDKVTMKEDAELRTGPNA

SEQ ID NO: 1861409 - protein, 13 aa, Staphylococcus
QADKNPNAKPLKD

SEQ ID NO: 1861410 - protein, 11 aa, Staphylococcus
QADLPKKSPHE

SEQ ID NO: 1861411 - protein, 8 aa, Staphylococcus
QADQQDKL

SEQ ID NO: 1861412 - protein, 9 aa, Staphylococcus
QAEAEKNKS

SEQ ID NO: 1861413 - protein, 15 aa, Staphylococcus
QAEDNHAKWTRNNES

SEQ ID NO: 1861414 - protein, 12 aa, Staphylococcus
QAEQDLQSLTPQ

SEQ ID NO: 1861415 - protein, 5 aa, Staphylococcus
QAESE

SEQ ID NO: 1861416 - protein, 9 aa, Staphylococcus
QAESELKEL

SEQ ID NO: 1861417 - protein, 36 aa, Staphylococcus
QAESEVITTETKGNSDSSPESKVTMPRKDVAPEGPV

SEQ ID NO: 1861418 - protein, 28 aa, Staphylococcus
QAESNKADIRNNSQATTEEKNTATQSIE

SEQ ID NO: 1861419 - protein, 7 aa, Staphylococcus
QAGEAWP

SEQ ID NO: 1861420 - protein, 9 aa, Staphylococcus
QAGQRSQTM

SEQ ID NO: 1861421 - protein, 13 aa, Staphylococcus
QAGRNRTIEQSLQ

SEQ ID NO: 1861422 - protein, 6 aa, Staphylococcus
QAGTSM

SEQ ID NO: 1861423 - protein, 7 aa, Staphylococcus
QAHRTQF

SEQ ID NO: 1861424 - protein, 26 aa, Staphylococcus
QAIDSTKDALNGEQRLAEAKEKSKQF

SEQ ID NO: 1861425 - protein, 7 aa, Staphylococcus
QAIESSD

SEQ ID NO: 1861426 - protein, 27 aa, Staphylococcus
QAIKDAKDALNGEQRLKNAQQAAHKAI

SEQ ID NO: 1861427 - protein, 27 aa, Staphylococcus
QAKAKKAEIDKDNKATKEEKDAAKAEV

SEQ ID NO: 1861428 - protein, 22 aa, Staphylococcus
QAKDATDEEKNNALDRLQNANN

SEQ ID NO: 1861429 - protein, 5 aa, Staphylococcus
QAKGI

SEQ ID NO: 1861430 - protein, 6 aa, Staphylococcus
QAKGIG

SEQ ID NO: 1861431 - protein, 19 aa, Staphylococcus
QAKHRKNDDNENNSTKHKR

SEQ ID NO: 1861432 - protein, 12 aa, Staphylococcus
QAKKQGMSLKND

SEQ ID NO: 1861433 - protein, 9 aa, Staphylococcus
QAKQSLEKK

SEQ ID NO: 1861434 - protein, 28 aa, Staphylococcus
QAKTEAKNNINSDHTTIDVNNEKTKGIQ

SEQ ID NO: 1861435 - protein, 10 aa, Staphylococcus
QAKTSLEKKD

SEQ ID NO: 1861436 - protein, 22 aa, Staphylococcus
QAKYHKNKYQDEFSDEGAAPFN

SEQ ID NO: 1861437 - protein, 18 aa, Staphylococcus
QAKYNKKSKKAKRDEQFQ

SEQ ID NO: 1861438 - protein, 84 aa, Staphylococcus
QAKYNKKSSSDKASTNNQDVYHEQDDVESSNQYNEEPQVDPKELKAQRKREKAEIRAKKKEKRKAYNQRMKEKRKNQPSAVSQR

SEQ ID NO: 1861439 - protein, 21 aa, Staphylococcus
QALQEQLSRNLDSLTKGDGEN

SEQ ID NO: 1861440 - protein, 6 aa, Staphylococcus
QALQNA

SEQ ID NO: 1861441 - protein, 26 aa, Staphylococcus
QALQQQSKVTAKVVGKDAKQLSEQDK

SEQ ID NO: 1861442 - protein, 5 aa, Staphylococcus
QALRP

SEQ ID NO: 1861443 - protein, 11 aa, Staphylococcus
QALSTSKNIRD

SEQ ID NO: 1861444 - protein, 10 aa, Staphylococcus
QAMNQSYDSL

SEQ ID NO: 1861445 - protein, 4 aa, Staphylococcus
QANE

SEQ ID NO: 1861446 - protein, 13 aa, Staphylococcus
QANEISRQITNGT

SEQ ID NO: 1861447 - protein, 14 aa, Staphylococcus
QAPAPAQEFRTELK

SEQ ID NO: 1861448 - protein, 7 aa, Staphylococcus
QAPDKEA

SEQ ID NO: 1861449 - protein, 7 aa, Staphylococcus
QAPPNLK

SEQ ID NO: 1861450 - protein, 4 aa, Staphylococcus
QAQD

SEQ ID NO: 1861451 - protein, 12 aa, Staphylococcus
QAQDDKSKAELL

SEQ ID NO: 1861452 - protein, 8 aa, Staphylococcus
QAQGAKRP

SEQ ID NO: 1861453 - protein, 11 aa, Staphylococcus
QAQGSKAPIQR

SEQ ID NO: 1861454 - protein, 10 aa, Staphylococcus
QAQKPSKTYT

SEQ ID NO: 1861455 - protein, 6 aa, Staphylococcus
QAQREP

SEQ ID NO: 1861456 - protein, 4 aa, Staphylococcus
QAQS

SEQ ID NO: 1861457 - protein, 11 aa, Staphylococcus
QARTRDAARNA

SEQ ID NO: 1861458 - protein, 7 aa, Staphylococcus
QASDKGL

SEQ ID NO: 1861459 - protein, 7 aa, Staphylococcus
QASDRGL

SEQ ID NO: 1861460 - protein, 8 aa, Staphylococcus
QASEINDG

SEQ ID NO: 1861461 - protein, 20 aa, Staphylococcus
QASENNVYTPKRKKRSKKKK

SEQ ID NO: 1861462 - protein, 15 aa, Staphylococcus
QASEPKLKGDPQMKD

SEQ ID NO: 1861463 - protein, 9 aa, Staphylococcus
QASPPEKIG

SEQ ID NO: 1861464 - protein, 6 aa, Staphylococcus
QASQSL

SEQ ID NO: 1861465 - protein, 7 aa, Staphylococcus
QASTGGA

SEQ ID NO: 1861466 - protein, 8 aa, Staphylococcus
QASTKAQV

SEQ ID NO: 1861467 - protein, 4 aa, Staphylococcus
QATD

SEQ ID NO: 1861468 - protein, 7 aa, Staphylococcus
QATDIPS

SEQ ID NO: 1861469 - protein, 18 aa, Staphylococcus
QATDTYSSKNQESRGQGI

SEQ ID NO: 1861470 - protein, 4 aa, Staphylococcus
QATG

SEQ ID NO: 1861471 - protein, 6 aa, Staphylococcus
QATGNL

SEQ ID NO: 1861472 - protein, 19 aa, Staphylococcus
QATGRGSTLLDGKGAYQLD

SEQ ID NO: 1861473 - protein, 9 aa, Staphylococcus
QATQGAEAF

SEQ ID NO: 1861474 - protein, 9 aa, Staphylococcus
QATQGEAAF

SEQ ID NO: 1861475 - protein, 18 aa, Staphylococcus
QATRSQAGNNAPKKFASK

SEQ ID NO: 1861476 - protein, 7 aa, Staphylococcus
QATRVSD

SEQ ID NO: 1861477 - protein, 9 aa, Staphylococcus
QATSLTESI

SEQ ID NO: 1861478 - protein, 8 aa, Staphylococcus
QATTKQKV

SEQ ID NO: 1861479 - protein, 14 aa, Staphylococcus
QATTTNKQIDSLSE

SEQ ID NO: 1861480 - protein, 4 aa, Staphylococcus
QAVA

SEQ ID NO: 1861481 - protein, 7 aa, Staphylococcus
QAVADAN

SEQ ID NO: 1861482 - protein, 28 aa, Staphylococcus
QAYEEGKANIKNAQTNDEVDNAKNSSIQ

SEQ ID NO: 1861483 - protein, 10 aa, Staphylococcus
QAYKKANKSS

SEQ ID NO: 1861484 - protein, 7 aa, Staphylococcus
QAYSHSV

SEQ ID NO: 1861485 - protein, 9 aa, Staphylococcus
QAYTKANRS

SEQ ID NO: 1861486 - protein, 10 aa, Staphylococcus
QAYYGKKKNS

SEQ ID NO: 1861487 - protein, 8 aa, Staphylococcus
QDAKNSGT

SEQ ID NO: 1861488 - protein, 14 aa, Staphylococcus
QDALDDKGLTADDV

SEQ ID NO: 1861489 - protein, 8 aa, Staphylococcus
QDANTVQV

SEQ ID NO: 1861490 - protein, 16 aa, Staphylococcus
QDANTVQVKKDTDQKI

SEQ ID NO: 1861491 - protein, 67 aa, Staphylococcus
QDAYASETSRTATEQNQSQAQHQANTQNQHTSGKHTSEVDITSPYGKTTDIIEKNNSNQNSSSHSKT

SEQ ID NO: 1861492 - protein, 4 aa, Staphylococcus
QDDA

SEQ ID NO: 1861493 - protein, 9 aa, Staphylococcus
QDDKGNVSH

SEQ ID NO: 1861494 - protein, 6 aa, Staphylococcus
QDDLDR

SEQ ID NO: 1861495 - protein, 29 aa, Staphylococcus
QDDNVIGSTMNKNGSITVKATKVGKDTAL

SEQ ID NO: 1861496 - protein, 5 aa, Staphylococcus
QDDTS

SEQ ID NO: 1861497 - protein, 15 aa, Staphylococcus
QDEIKQTEEHSPNNK

SEQ ID NO: 1861498 - protein, 7 aa, Staphylococcus
QDELDQY

SEQ ID NO: 1861499 - protein, 4 aa, Staphylococcus
QDES

SEQ ID NO: 1861500 - protein, 5 aa, Staphylococcus
QDEVD

SEQ ID NO: 1861501 - protein, 11 aa, Staphylococcus
QDGDQAFDASK

SEQ ID NO: 1861502 - protein, 7 aa, Staphylococcus
QDGEEVE

SEQ ID NO: 1861503 - protein, 9 aa, Staphylococcus
QDGEKQTTL

SEQ ID NO: 1861504 - protein, 10 aa, Staphylococcus
QDGEPRVNST

SEQ ID NO: 1861505 - protein, 10 aa, Staphylococcus
QDGESRVNST

SEQ ID NO: 1861506 - protein, 7 aa, Staphylococcus
QDGNNVE

SEQ ID NO: 1861507 - protein, 4 aa, Staphylococcus
QDGP

SEQ ID NO: 1861508 - protein, 9 aa, Staphylococcus
QDGQKQTTL

SEQ ID NO: 1861509 - protein, 9 aa, Staphylococcus
QDGQKTTTL

SEQ ID NO: 1861510 - protein, 5 aa, Staphylococcus
QDIER

SEQ ID NO: 1861511 - protein, 6 aa, Staphylococcus
QDIKDN

SEQ ID NO: 1861512 - protein, 7 aa, Staphylococcus
QDITQTA

SEQ ID NO: 1861513 - protein, 8 aa, Staphylococcus
QDKDENVA

SEQ ID NO: 1861514 - protein, 14 aa, Staphylococcus
QDKLEASGLTKERV

SEQ ID NO: 1861515 - protein, 8 aa, Staphylococcus
QDKPKATQ

SEQ ID NO: 1861516 - protein, 7 aa, Staphylococcus
QDKPKIG

SEQ ID NO: 1861517 - protein, 8 aa, Staphylococcus
QDKPKPAQ

SEQ ID NO: 1861518 - protein, 6 aa, Staphylococcus
QDKPTQ

SEQ ID NO: 1861519 - protein, 9 aa, Staphylococcus
QDKSATFQD

SEQ ID NO: 1861520 - protein, 15 aa, Staphylococcus
QDKTSEYAHKTRRSV

SEQ ID NO: 1861521 - protein, 15 aa, Staphylococcus
QDKTSEYARKTRRSV

SEQ ID NO: 1861522 - protein, 16 aa, Staphylococcus
QDKTTEYARKTRRSVD

SEQ ID NO: 1861523 - protein, 4 aa, Staphylococcus
QDKY

SEQ ID NO: 1861524 - protein, 5 aa, Staphylococcus
QDKYG

SEQ ID NO: 1861525 - protein, 11 aa, Staphylococcus
QDMQGTVGATQ

SEQ ID NO: 1861526 - protein, 5 aa, Staphylococcus
QDNDN

SEQ ID NO: 1861527 - protein, 6 aa, Staphylococcus
QDNLKT

SEQ ID NO: 1861528 - protein, 6 aa, Staphylococcus
QDNLRT

SEQ ID NO: 1861529 - protein, 8 aa, Staphylococcus
QDNPEMDP

SEQ ID NO: 1861530 - protein, 4 aa, Staphylococcus
QDNQ

SEQ ID NO: 1861531 - protein, 20 aa, Staphylococcus
QDNTAAELKTGIKKAHSEGV

SEQ ID NO: 1861532 - protein, 9 aa, Staphylococcus
QDNTAGELK

SEQ ID NO: 1861533 - protein, 9 aa, Staphylococcus
QDNTGTGEK

SEQ ID NO: 1861534 - protein, 6 aa, Staphylococcus
QDPPPL

SEQ ID NO: 1861535 - protein, 21 aa, Staphylococcus
QDPYQQAANNAKALKDQIESD

SEQ ID NO: 1861536 - protein, 10 aa, Staphylococcus
QDQDQSQASH

SEQ ID NO: 1861537 - protein, 6 aa, Staphylococcus
QDQLDK

SEQ ID NO: 1861538 - protein, 6 aa, Staphylococcus
QDQLDQ

SEQ ID NO: 1861539 - protein, 7 aa, Staphylococcus
QDQLDQY

SEQ ID NO: 1861540 - protein, 7 aa, Staphylococcus
QDRANTF

SEQ ID NO: 1861541 - protein, 7 aa, Staphylococcus
QDRKNTN

SEQ ID NO: 1861542 - protein, 22 aa, Staphylococcus
QDRQDSNEILKTPDAADITLPG

SEQ ID NO: 1861543 - protein, 10 aa, Staphylococcus
QDSEANADVA

SEQ ID NO: 1861544 - protein, 15 aa, Staphylococcus
QDTDDTVEVKDGMGK

SEQ ID NO: 1861545 - protein, 15 aa, Staphylococcus
QDTEDTVEVKDGMGK

SEQ ID NO: 1861546 - protein, 8 aa, Staphylococcus
QDTQLEHE

SEQ ID NO: 1861547 - protein, 31 aa, Staphylococcus
QDTSRKPFVAKGGNTGNKGAASNEKQGVGNT

SEQ ID NO: 1861548 - protein, 5 aa, Staphylococcus
QDTVT

SEQ ID NO: 1861549 - protein, 4 aa, Staphylococcus
QDVI

SEQ ID NO: 1861550 - protein, 6 aa, Staphylococcus
QDVPQA

SEQ ID NO: 1861551 - protein, 6 aa, Staphylococcus
QDVPSD

SEQ ID NO: 1861552 - protein, 11 aa, Staphylococcus
QDVRKKAKVDQ

SEQ ID NO: 1861553 - protein, 10 aa, Staphylococcus
QDVTKDSFDE

SEQ ID NO: 1861554 - protein, 4 aa, Staphylococcus
QDYF

SEQ ID NO: 1861555 - protein, 15 aa, Staphylococcus
QDYQKEQNPPFSPPG

SEQ ID NO: 1861556 - protein, 5 aa, Staphylococcus
QEAES

SEQ ID NO: 1861557 - protein, 26 aa, Staphylococcus
QEAKKLQKQQSKLTKNFQKKAKEAIQ

SEQ ID NO: 1861558 - protein, 28 aa, Staphylococcus
QEALAQTLSSSIQKKSLLTNKEARQQNY

SEQ ID NO: 1861559 - protein, 18 aa, Staphylococcus
QEALTKTLKGIQDKGPDY

SEQ ID NO: 1861560 - protein, 11 aa, Staphylococcus
QEANDKLQQIN

SEQ ID NO: 1861561 - protein, 9 aa, Staphylococcus
QEASANMGN

SEQ ID NO: 1861562 - protein, 9 aa, Staphylococcus
QEASSSAVD

SEQ ID NO: 1861563 - protein, 139 aa, Staphylococcus
QEDIHNEKLKQQKPISSNGSKSENETNKSIEPTYSRLNKNNESRQKSKKEKDNQHNDTIKTQSKHPTITEESYTSTKDKESIDTEKEQMSTQQHSTQVEHTKSEQSKHISNSDKNTTENISDQQPHESHEQSANDTQNK

SEQ ID NO: 1861564 - protein, 8 aa, Staphylococcus
QEDKITKA

SEQ ID NO: 1861565 - protein, 9 aa, Staphylococcus
QEDKRGKQM

SEQ ID NO: 1861566 - protein, 4 aa, Staphylococcus
QEDQ

SEQ ID NO: 1861567 - protein, 7 aa, Staphylococcus
QEDRKSH

SEQ ID NO: 1861568 - protein, 16 aa, Staphylococcus
QEDTNTPIKSLTDEAY

SEQ ID NO: 1861569 - protein, 10 aa, Staphylococcus
QEEEGKRKKS

SEQ ID NO: 1861570 - protein, 7 aa, Staphylococcus
QEEIDNG

SEQ ID NO: 1861571 - protein, 5 aa, Staphylococcus
QEEIH

SEQ ID NO: 1861572 - protein, 10 aa, Staphylococcus
QEEIPDSQHQ

SEQ ID NO: 1861573 - protein, 9 aa, Staphylococcus
QEEQNSTNV

SEQ ID NO: 1861574 - protein, 9 aa, Staphylococcus
QEESSPRNM

SEQ ID NO: 1861575 - protein, 8 aa, Staphylococcus
QEETDPRH

SEQ ID NO: 1861576 - protein, 8 aa, Staphylococcus
QEETSPHE

SEQ ID NO: 1861577 - protein, 8 aa, Staphylococcus
QEETSPHQ

SEQ ID NO: 1861578 - protein, 6 aa, Staphylococcus
QEETTV

SEQ ID NO: 1861579 - protein, 8 aa, Staphylococcus
QEGVNPTI

SEQ ID NO: 1861580 - protein, 18 aa, Staphylococcus
QEINSLKQNEQNNADSKF

SEQ ID NO: 1861581 - protein, 5 aa, Staphylococcus
QEIPQ

SEQ ID NO: 1861582 - protein, 4 aa, Staphylococcus
QEKA

SEQ ID NO: 1861583 - protein, 7 aa, Staphylococcus
QEKLANT

SEQ ID NO: 1861584 - protein, 4 aa, Staphylococcus
QEKN

SEQ ID NO: 1861585 - protein, 13 aa, Staphylococcus
QEKSKKVKTDKGT

SEQ ID NO: 1861586 - protein, 12 aa, Staphylococcus
QELEDVKSQTQN

SEQ ID NO: 1861587 - protein, 7 aa, Staphylococcus
QELGGVD

SEQ ID NO: 1861588 - protein, 6 aa, Staphylococcus
QELKNF

SEQ ID NO: 1861589 - protein, 8 aa, Staphylococcus
QELNSSNY

SEQ ID NO: 1861590 - protein, 7 aa, Staphylococcus
QEMTNEI

SEQ ID NO: 1861591 - protein, 12 aa, Staphylococcus
QENEIKQKEYEV

SEQ ID NO: 1861592 - protein, 4 aa, Staphylococcus
QENH

SEQ ID NO: 1861593 - protein, 7 aa, Staphylococcus
QENIEAA

SEQ ID NO: 1861594 - protein, 7 aa, Staphylococcus
QENNRFS

SEQ ID NO: 1861595 - protein, 9 aa, Staphylococcus
QENTSGELK

SEQ ID NO: 1861596 - protein, 5 aa, Staphylococcus
QEPVL

SEQ ID NO: 1861597 - protein, 8 aa, Staphylococcus
QEQAPPLF

SEQ ID NO: 1861598 - protein, 9 aa, Staphylococcus
QEQDSKRKQ

SEQ ID NO: 1861599 - protein, 9 aa, Staphylococcus
QEQNQQRKQ

SEQ ID NO: 1861600 - protein, 8 aa, Staphylococcus
QEQNSSNV

SEQ ID NO: 1861601 - protein, 7 aa, Staphylococcus
QEQPEKL

SEQ ID NO: 1861602 - protein, 5 aa, Staphylococcus
QEQQE

SEQ ID NO: 1861603 - protein, 12 aa, Staphylococcus
QEQSLNEDSAEK

SEQ ID NO: 1861604 - protein, 8 aa, Staphylococcus
QERQRIGQ

SEQ ID NO: 1861605 - protein, 6 aa, Staphylococcus
QERRLN

SEQ ID NO: 1861606 - protein, 8 aa, Staphylococcus
QERSRIGQ

SEQ ID NO: 1861607 - protein, 6 aa, Staphylococcus
QESALK

SEQ ID NO: 1861608 - protein, 9 aa, Staphylococcus
QESEAGKQS

SEQ ID NO: 1861609 - protein, 9 aa, Staphylococcus
QESEGKNEY

SEQ ID NO: 1861610 - protein, 6 aa, Staphylococcus
QESFGK

SEQ ID NO: 1861611 - protein, 8 aa, Staphylococcus
QESGQFNT

SEQ ID NO: 1861612 - protein, 11 aa, Staphylococcus
QESSKHASQQT

SEQ ID NO: 1861613 - protein, 9 aa, Staphylococcus
QESTKFRDK

SEQ ID NO: 1861614 - protein, 6 aa, Staphylococcus
QETALK

SEQ ID NO: 1861615 - protein, 5 aa, Staphylococcus
QETDM

SEQ ID NO: 1861616 - protein, 15 aa, Staphylococcus
QETENSIKEDAKRIS

SEQ ID NO: 1861617 - protein, 11 aa, Staphylococcus
QETKGKTDAQI

SEQ ID NO: 1861618 - protein, 19 aa, Staphylococcus
QETPNKITNSFASENDEDN

SEQ ID NO: 1861619 - protein, 14 aa, Staphylococcus
QETYTTKKDRESHG

SEQ ID NO: 1861620 - protein, 8 aa, Staphylococcus
QEVASTTY

SEQ ID NO: 1861621 - protein, 13 aa, Staphylococcus
QEVLDTDETQEEI

SEQ ID NO: 1861622 - protein, 17 aa, Staphylococcus
QEVNEKASSQSTKKQIN

SEQ ID NO: 1861623 - protein, 6 aa, Staphylococcus
QEVTKN

SEQ ID NO: 1861624 - protein, 5 aa, Staphylococcus
QEVTS

SEQ ID NO: 1861625 - protein, 22 aa, Staphylococcus
QEYNNQVPKGAIAKQSVNPDSY

SEQ ID NO: 1861626 - protein, 5 aa, Staphylococcus
QFDAS

SEQ ID NO: 1861627 - protein, 8 aa, Staphylococcus
QFDDTENN

SEQ ID NO: 1861628 - protein, 4 aa, Staphylococcus
QFDN

SEQ ID NO: 1861629 - protein, 6 aa, Staphylococcus
QFEPDK

SEQ ID NO: 1861630 - protein, 11 aa, Staphylococcus
QFGEAAAPLEK

SEQ ID NO: 1861631 - protein, 12 aa, Staphylococcus
QFGEAASPLEQE

SEQ ID NO: 1861632 - protein, 8 aa, Staphylococcus
QFGGEQGA

SEQ ID NO: 1861633 - protein, 5 aa, Staphylococcus
QFGQA

SEQ ID NO: 1861634 - protein, 5 aa, Staphylococcus
QFGSA

SEQ ID NO: 1861635 - protein, 8 aa, Staphylococcus
QFKTKRSV

SEQ ID NO: 1861636 - protein, 9 aa, Staphylococcus
QFNEDDHAK

SEQ ID NO: 1861637 - protein, 9 aa, Staphylococcus
QFNTSTSSI

SEQ ID NO: 1861638 - protein, 8 aa, Staphylococcus
QFPYRGHQ

SEQ ID NO: 1861639 - protein, 5 aa, Staphylococcus
QFQSA

SEQ ID NO: 1861640 - protein, 11 aa, Staphylococcus
QFQSKSPKKKN

SEQ ID NO: 1861641 - protein, 9 aa, Staphylococcus
QFSDTENNK

SEQ ID NO: 1861642 - protein, 6 aa, Staphylococcus
QFSEVD

SEQ ID NO: 1861643 - protein, 11 aa, Staphylococcus
QFSPEKQASNI

SEQ ID NO: 1861644 - protein, 42 aa, Staphylococcus
QFSPEKQASNIAQAIKKDDEKALAKEVTTQNDQKLSKQEARA

SEQ ID NO: 1861645 - protein, 14 aa, Staphylococcus
QFTEGERSKMDGKE

SEQ ID NO: 1861646 - protein, 5 aa, Staphylococcus
QFTNI

SEQ ID NO: 1861647 - protein, 7 aa, Staphylococcus
QGAGEKL

SEQ ID NO: 1861648 - protein, 11 aa, Staphylococcus
QGAKPSPDQLG

SEQ ID NO: 1861649 - protein, 18 aa, Staphylococcus
QGAKTRGGHMEGEKVTEE

SEQ ID NO: 1861650 - protein, 19 aa, Staphylococcus
QGAKTRGGHMEGNKVNEEI

SEQ ID NO: 1861651 - protein, 19 aa, Staphylococcus
QGAKTRGGHMQGNKVTEEI

SEQ ID NO: 1861652 - protein, 6 aa, Staphylococcus
QGAQSQ

SEQ ID NO: 1861653 - protein, 9 aa, Staphylococcus
QGARNNTIS

SEQ ID NO: 1861654 - protein, 5 aa, Staphylococcus
QGAYT

SEQ ID NO: 1861655 - protein, 6 aa, Staphylococcus
QGDASQ

SEQ ID NO: 1861656 - protein, 7 aa, Staphylococcus
QGDGLES

SEQ ID NO: 1861657 - protein, 7 aa, Staphylococcus
QGDGLET

SEQ ID NO: 1861658 - protein, 10 aa, Staphylococcus
QGDKKAGKTY

SEQ ID NO: 1861659 - protein, 9 aa, Staphylococcus
QGDNNPDRH

SEQ ID NO: 1861660 - protein, 9 aa, Staphylococcus
QGDQYCGSC

SEQ ID NO: 1861661 - protein, 7 aa, Staphylococcus
QGDSMPT

SEQ ID NO: 1861662 - protein, 5 aa, Staphylococcus
QGDSV

SEQ ID NO: 1861663 - protein, 10 aa, Staphylococcus
QGDTSMSSSY

SEQ ID NO: 1861664 - protein, 6 aa, Staphylococcus
QGDYDE

SEQ ID NO: 1861665 - protein, 4 aa, Staphylococcus
QGEH

SEQ ID NO: 1861666 - protein, 9 aa, Staphylococcus
QGEKNNKLD

SEQ ID NO: 1861667 - protein, 8 aa, Staphylococcus
QGEKSAKL

SEQ ID NO: 1861668 - protein, 9 aa, Staphylococcus
QGEKSGKLD

SEQ ID NO: 1861669 - protein, 8 aa, Staphylococcus
QGEKSGNL

SEQ ID NO: 1861670 - protein, 4 aa, Staphylococcus
QGEY

SEQ ID NO: 1861671 - protein, 5 aa, Staphylococcus
QGEYT

SEQ ID NO: 1861672 - protein, 8 aa, Staphylococcus
QGFETEDA

SEQ ID NO: 1861673 - protein, 4 aa, Staphylococcus
QGFQ

SEQ ID NO: 1861674 - protein, 6 aa, Staphylococcus
QGFSNG

SEQ ID NO: 1861675 - protein, 6 aa, Staphylococcus
QGGAKY

SEQ ID NO: 1861676 - protein, 6 aa, Staphylococcus
QGGAQY

SEQ ID NO: 1861677 - protein, 6 aa, Staphylococcus
QGGTID

SEQ ID NO: 1861678 - protein, 4 aa, Staphylococcus
QGHK

SEQ ID NO: 1861679 - protein, 6 aa, Staphylococcus
QGHKNA

SEQ ID NO: 1861680 - protein, 4 aa, Staphylococcus
QGHR

SEQ ID NO: 1861681 - protein, 28 aa, Staphylococcus
QGHSLENDAKFKKVSKTKAEKLVKNEKL

SEQ ID NO: 1861682 - protein, 6 aa, Staphylococcus
QGIDEK

SEQ ID NO: 1861683 - protein, 6 aa, Staphylococcus
QGIDEN

SEQ ID NO: 1861684 - protein, 5 aa, Staphylococcus
QGIDH

SEQ ID NO: 1861685 - protein, 6 aa, Staphylococcus
QGIGGV

SEQ ID NO: 1861686 - protein, 16 aa, Staphylococcus
QGISNSDVDHAKDRGL

SEQ ID NO: 1861687 - protein, 9 aa, Staphylococcus
QGITRESTD

SEQ ID NO: 1861688 - protein, 10 aa, Staphylococcus
QGKDMSNSVL

SEQ ID NO: 1861689 - protein, 8 aa, Staphylococcus
QGKDMTNS

SEQ ID NO: 1861690 - protein, 4 aa, Staphylococcus
QGKE

SEQ ID NO: 1861691 - protein, 7 aa, Staphylococcus
QGKIEDV

SEQ ID NO: 1861692 - protein, 17 aa, Staphylococcus
QGKIKPSDSVKITPSYE

SEQ ID NO: 1861693 - protein, 6 aa, Staphylococcus
QGKKGM

SEQ ID NO: 1861694 - protein, 4 aa, Staphylococcus
QGKQ

SEQ ID NO: 1861695 - protein, 5 aa, Staphylococcus
QGKQN

SEQ ID NO: 1861696 - protein, 6 aa, Staphylococcus
QGKRDL

SEQ ID NO: 1861697 - protein, 13 aa, Staphylococcus
QGKSTKAQEAGIG

SEQ ID NO: 1861698 - protein, 10 aa, Staphylococcus
QGKSTTQNIT

SEQ ID NO: 1861699 - protein, 14 aa, Staphylococcus
QGKVASTTNTLSSY

SEQ ID NO: 1861700 - protein, 5 aa, Staphylococcus
QGLAR

SEQ ID NO: 1861701 - protein, 6 aa, Staphylococcus
QGLARA

SEQ ID NO: 1861702 - protein, 7 aa, Staphylococcus
QGLGPKM

SEQ ID NO: 1861703 - protein, 7 aa, Staphylococcus
QGLGPKV

SEQ ID NO: 1861704 - protein, 6 aa, Staphylococcus
QGLGRE

SEQ ID NO: 1861705 - protein, 6 aa, Staphylococcus
QGLRKD

SEQ ID NO: 1861706 - protein, 6 aa, Staphylococcus
QGLRTD

SEQ ID NO: 1861707 - protein, 4 aa, Staphylococcus
QGND

SEQ ID NO: 1861708 - protein, 7 aa, Staphylococcus
QGNDMRG

SEQ ID NO: 1861709 - protein, 6 aa, Staphylococcus
QGNDMS

SEQ ID NO: 1861710 - protein, 9 aa, Staphylococcus
QGNDMSNSV

SEQ ID NO: 1861711 - protein, 10 aa, Staphylococcus
QGNDMSSSVL

SEQ ID NO: 1861712 - protein, 8 aa, Staphylococcus
QGNGFPTG

SEQ ID NO: 1861713 - protein, 5 aa, Staphylococcus
QGPEL

SEQ ID NO: 1861714 - protein, 4 aa, Staphylococcus
QGPI

SEQ ID NO: 1861715 - protein, 4 aa, Staphylococcus
QGPL

SEQ ID NO: 1861716 - protein, 10 aa, Staphylococcus
QGPLSSSDHA

SEQ ID NO: 1861717 - protein, 4 aa, Staphylococcus
QGQP

SEQ ID NO: 1861718 - protein, 11 aa, Staphylococcus
QGQPDKNKLSP

SEQ ID NO: 1861719 - protein, 5 aa, Staphylococcus
QGRHY

SEQ ID NO: 1861720 - protein, 5 aa, Staphylococcus
QGRQP

SEQ ID NO: 1861721 - protein, 6 aa, Staphylococcus
QGRTRR

SEQ ID NO: 1861722 - protein, 4 aa, Staphylococcus
QGSA

SEQ ID NO: 1861723 - protein, 8 aa, Staphylococcus
QGSKPYKL

SEQ ID NO: 1861724 - protein, 7 aa, Staphylococcus
QGSLGGN

SEQ ID NO: 1861725 - protein, 7 aa, Staphylococcus
QGSQYSQ

SEQ ID NO: 1861726 - protein, 4 aa, Staphylococcus
QGST

SEQ ID NO: 1861727 - protein, 8 aa, Staphylococcus
QGSTTGNF

SEQ ID NO: 1861728 - protein, 4 aa, Staphylococcus
QGTH

SEQ ID NO: 1861729 - protein, 19 aa, Staphylococcus
QGTPATMSNGLTSVPEGTP

SEQ ID NO: 1861730 - protein, 8 aa, Staphylococcus
QGTPQTFK

SEQ ID NO: 1861731 - protein, 8 aa, Staphylococcus
QGTPQTLK

SEQ ID NO: 1861732 - protein, 9 aa, Staphylococcus
QGTPTNGID

SEQ ID NO: 1861733 - protein, 9 aa, Staphylococcus
QGTPTNSVK

SEQ ID NO: 1861734 - protein, 9 aa, Staphylococcus
QGTPTNTIG

SEQ ID NO: 1861735 - protein, 9 aa, Staphylococcus
QGTPTPTVK

SEQ ID NO: 1861736 - protein, 9 aa, Staphylococcus
QGTPTTSVG

SEQ ID NO: 1861737 - protein, 5 aa, Staphylococcus
QGTQV

SEQ ID NO: 1861738 - protein, 8 aa, Staphylococcus
QGTSNATK

SEQ ID NO: 1861739 - protein, 28 aa, Staphylococcus
QGTYEGKTFKSDSVNVTSSGEDDDDVTD

SEQ ID NO: 1861740 - protein, 15 aa, Staphylococcus
QGVNEEGTNQQFNQN

SEQ ID NO: 1861741 - protein, 6 aa, Staphylococcus
QGVNGT

SEQ ID NO: 1861742 - protein, 7 aa, Staphylococcus
QGYTQAE

SEQ ID NO: 1861743 - protein, 5 aa, Staphylococcus
QHAAT

SEQ ID NO: 1861744 - protein, 4 aa, Staphylococcus
QHAV

SEQ ID NO: 1861745 - protein, 4 aa, Staphylococcus
QHDF

SEQ ID NO: 1861746 - protein, 18 aa, Staphylococcus
QHEFNQSEKFDIKKHLMT

SEQ ID NO: 1861747 - protein, 10 aa, Staphylococcus
QHEKSEKIVE

SEQ ID NO: 1861748 - protein, 5 aa, Staphylococcus
QHENE

SEQ ID NO: 1861749 - protein, 28 aa, Staphylococcus
QHGPESPEAGDDHHYDQHGNEKKVGPKA

SEQ ID NO: 1861750 - protein, 6 aa, Staphylococcus
QHGPFE

SEQ ID NO: 1861751 - protein, 59 aa, Staphylococcus
QHHKDSQTEINEDDTNEDIEDIKEQSLSDSKSDASESSKDESGKANKDVHEEKSDKKGF

SEQ ID NO: 1861752 - protein, 8 aa, Staphylococcus
QHKQETSL

SEQ ID NO: 1861753 - protein, 24 aa, Staphylococcus
QHKTTSSPAQPTENKQHKNSNKRW

SEQ ID NO: 1861754 - protein, 8 aa, Staphylococcus
QHNDSDDV

SEQ ID NO: 1861755 - protein, 8 aa, Staphylococcus
QHNGINEG

SEQ ID NO: 1861756 - protein, 9 aa, Staphylococcus
QHNPHPETI

SEQ ID NO: 1861757 - protein, 237 aa, Staphylococcus
QHNQQENHLDNEPIHKDDKLSSEKDFNNDASRRNNRHEASNRKHDKDYDNGSLNDDDRHRRNHEEGIDERQDNRNHKDQQNKKSRHGKDAAIAGGAGVAGAAGAKAAKDKRKKDEHHDSKYNEHKDDRDLNNDNQFDQNRKHDKDLHDDHRDAKDNHSKEEPKKGNKGKKAAVGAGAAGAAGAAGVAAAKHKKDHKNNNHKDNHSHNRDHQDDHRNHKHEDGNDGFQAHNGKKKRGL

SEQ ID NO: 1861758 - protein, 7 aa, Staphylococcus
QHPAGLD

SEQ ID NO: 1861759 - protein, 22 aa, Staphylococcus
QHPEIKKPLNKLEGKISDEEMQ

SEQ ID NO: 1861760 - protein, 6 aa, Staphylococcus
QHPELH

SEQ ID NO: 1861761 - protein, 4 aa, Staphylococcus
QHPK

SEQ ID NO: 1861762 - protein, 4 aa, Staphylococcus
QHPP

SEQ ID NO: 1861763 - protein, 6 aa, Staphylococcus
QHPPEY

SEQ ID NO: 1861764 - protein, 5 aa, Staphylococcus
QHPPT

SEQ ID NO: 1861765 - protein, 10 aa, Staphylococcus
QHPQQHKQNT

SEQ ID NO: 1861766 - protein, 4 aa, Staphylococcus
QHPS

SEQ ID NO: 1861767 - protein, 12 aa, Staphylococcus
QHPTNKDREIVG

SEQ ID NO: 1861768 - protein, 16 aa, Staphylococcus
QHQAPISEEFRSKPRR

SEQ ID NO: 1861769 - protein, 6 aa, Staphylococcus
QHQTTT

SEQ ID NO: 1861770 - protein, 16 aa, Staphylococcus
QHRSETSEVKRHEQTE

SEQ ID NO: 1861771 - protein, 17 aa, Staphylococcus
QHSELRSKNVSLSNGDP

SEQ ID NO: 1861772 - protein, 4 aa, Staphylococcus
QHSS

SEQ ID NO: 1861773 - protein, 6 aa, Staphylococcus
QHTGPA

SEQ ID NO: 1861774 - protein, 14 aa, Staphylococcus
QHTRQTILGKKDSL

SEQ ID NO: 1861775 - protein, 5 aa, Staphylococcus
QHTSG

SEQ ID NO: 1861776 - protein, 6 aa, Staphylococcus
QIDPGQ

SEQ ID NO: 1861777 - protein, 6 aa, Staphylococcus
QIEEEI

SEQ ID NO: 1861778 - protein, 16 aa, Staphylococcus
QIEGTEYTATPATIPD

SEQ ID NO: 1861779 - protein, 5 aa, Staphylococcus
QIEPQ

SEQ ID NO: 1861780 - protein, 14 aa, Staphylococcus
QIEQQRQNKTNDDK

SEQ ID NO: 1861781 - protein, 6 aa, Staphylococcus
QIETEK

SEQ ID NO: 1861782 - protein, 5 aa, Staphylococcus
QIEYR

SEQ ID NO: 1861783 - protein, 105 aa, Staphylococcus
QIGKDTSKGEDSKDQNTSPEKDTNQPSTKPNNSKDTNKNDTKEGSNSGQESPDSSSGRTKPKDSTQNYPGQKSQYPGNTPQQNINRNDTNRGNGNNNKGTETQSI

SEQ ID NO: 1861784 - protein, 10 aa, Staphylococcus
QIGSSGPAYE

SEQ ID NO: 1861785 - protein, 25 aa, Staphylococcus
QIKNNTKEIKQGKYNSLSVNANDNN

SEQ ID NO: 1861786 - protein, 11 aa, Staphylococcus
QIKNSKDLGSM

SEQ ID NO: 1861787 - protein, 20 aa, Staphylococcus
QIKQDDKRQKQRKIDMKRRY

SEQ ID NO: 1861788 - protein, 9 aa, Staphylococcus
QIKSTKDLG

SEQ ID NO: 1861789 - protein, 13 aa, Staphylococcus
QINGNDNKQATVQ

SEQ ID NO: 1861790 - protein, 13 aa, Staphylococcus
QINGSGNKNATVQ

SEQ ID NO: 1861791 - protein, 9 aa, Staphylococcus
QINKQGKLK

SEQ ID NO: 1861792 - protein, 26 aa, Staphylococcus
QINNAKNALHGANKLQQAKNEANQTI

SEQ ID NO: 1861793 - protein, 5 aa, Staphylococcus
QINNR

SEQ ID NO: 1861794 - protein, 11 aa, Staphylococcus
QINNSASGELF

SEQ ID NO: 1861795 - protein, 13 aa, Staphylococcus
QINQTPDATIEEK

SEQ ID NO: 1861796 - protein, 11 aa, Staphylococcus
QINSSTGAMNA

SEQ ID NO: 1861797 - protein, 9 aa, Staphylococcus
QIPKNYTAA

SEQ ID NO: 1861798 - protein, 10 aa, Staphylococcus
QIPKNYTATQ

SEQ ID NO: 1861799 - protein, 4 aa, Staphylococcus
QIQQ

SEQ ID NO: 1861800 - protein, 9 aa, Staphylococcus
QIREEEAKL

SEQ ID NO: 1861801 - protein, 5 aa, Staphylococcus
QIRGA

SEQ ID NO: 1861802 - protein, 8 aa, Staphylococcus
QIRKEGSL

SEQ ID NO: 1861803 - protein, 6 aa, Staphylococcus
QIRRDG

SEQ ID NO: 1861804 - protein, 9 aa, Staphylococcus
QIRRDGFQE

SEQ ID NO: 1861805 - protein, 7 aa, Staphylococcus
QISGSKG

SEQ ID NO: 1861806 - protein, 11 aa, Staphylococcus
QISSPTSGQIK

SEQ ID NO: 1861807 - protein, 6 aa, Staphylococcus
QISTPT

SEQ ID NO: 1861808 - protein, 12 aa, Staphylococcus
QITAAKNNANTV

SEQ ID NO: 1861809 - protein, 44 aa, Staphylococcus
QITARSKDFSSYAKEHSSLDTSDKNKTLEGDIDKTVKVSDKNLK

SEQ ID NO: 1861810 - protein, 4 aa, Staphylococcus
QITD

SEQ ID NO: 1861811 - protein, 13 aa, Staphylococcus
QITNNGKSGASML

SEQ ID NO: 1861812 - protein, 4 aa, Staphylococcus
QITP

SEQ ID NO: 1861813 - protein, 6 aa, Staphylococcus
QITSKQ

SEQ ID NO: 1861814 - protein, 5 aa, Staphylococcus
QIVPS

SEQ ID NO: 1861815 - protein, 15 aa, Staphylococcus
QIYEPPKKKRSKKKK

SEQ ID NO: 1861816 - protein, 6 aa, Staphylococcus
QIYKNE

SEQ ID NO: 1861817 - protein, 6 aa, Staphylococcus
QKADSL

SEQ ID NO: 1861818 - protein, 11 aa, Staphylococcus
QKAEDRAITSD

SEQ ID NO: 1861819 - protein, 8 aa, Staphylococcus
QKAHGGEI

SEQ ID NO: 1861820 - protein, 4 aa, Staphylococcus
QKAI

SEQ ID NO: 1861821 - protein, 10 aa, Staphylococcus
QKAIRKEKNY

SEQ ID NO: 1861822 - protein, 9 aa, Staphylococcus
QKAKDLMKK

SEQ ID NO: 1861823 - protein, 9 aa, Staphylococcus
QKAKELNEA

SEQ ID NO: 1861824 - protein, 10 aa, Staphylococcus
QKAKKTVVAT

SEQ ID NO: 1861825 - protein, 13 aa, Staphylococcus
QKALAETLSASLQ

SEQ ID NO: 1861826 - protein, 27 aa, Staphylococcus
QKANYVKEMEPDAPVEKSEMKSEDTLY

SEQ ID NO: 1861827 - protein, 37 aa, Staphylococcus
QKAQEYETQEENNDANQSLSESADCENGIQAGSNNYD

SEQ ID NO: 1861828 - protein, 5 aa, Staphylococcus
QKDDY

SEQ ID NO: 1861829 - protein, 5 aa, Staphylococcus
QKDET

SEQ ID NO: 1861830 - protein, 10 aa, Staphylococcus
QKDKTNDVSH

SEQ ID NO: 1861831 - protein, 7 aa, Staphylococcus
QKDMARG

SEQ ID NO: 1861832 - protein, 10 aa, Staphylococcus
QKDNDEDDIS

SEQ ID NO: 1861833 - protein, 21 aa, Staphylococcus
QKDNDLTVNGEFDKETNDKFT

SEQ ID NO: 1861834 - protein, 6 aa, Staphylococcus
QKDTKY

SEQ ID NO: 1861835 - protein, 8 aa, Staphylococcus
QKDTRDSY

SEQ ID NO: 1861836 - protein, 18 aa, Staphylococcus
QKDVGKKKQTDSSDYSDD

SEQ ID NO: 1861837 - protein, 8 aa, Staphylococcus
QKEGYNSN

SEQ ID NO: 1861838 - protein, 8 aa, Staphylococcus
QKEGYTSD

SEQ ID NO: 1861839 - protein, 8 aa, Staphylococcus
QKEGYTSN

SEQ ID NO: 1861840 - protein, 8 aa, Staphylococcus
QKEKNKEL

SEQ ID NO: 1861841 - protein, 8 aa, Staphylococcus
QKEKNSDM

SEQ ID NO: 1861842 - protein, 11 aa, Staphylococcus
QKEKVTKQQHQ

SEQ ID NO: 1861843 - protein, 16 aa, Staphylococcus
QKELDKVGLSADDVEN

SEQ ID NO: 1861844 - protein, 15 aa, Staphylococcus
QKELDSKGVTADDVE

SEQ ID NO: 1861845 - protein, 12 aa, Staphylococcus
QKELSESSDSKD

SEQ ID NO: 1861846 - protein, 15 aa, Staphylococcus
QKESNEQYRAQEVQS

SEQ ID NO: 1861847 - protein, 8 aa, Staphylococcus
QKETDSQM

SEQ ID NO: 1861848 - protein, 4 aa, Staphylococcus
QKEV

SEQ ID NO: 1861849 - protein, 6 aa, Staphylococcus
QKFDNQ

SEQ ID NO: 1861850 - protein, 5 aa, Staphylococcus
QKFNG

SEQ ID NO: 1861851 - protein, 4 aa, Staphylococcus
QKFT

SEQ ID NO: 1861852 - protein, 21 aa, Staphylococcus
QKGDDKQQLKTENDPLKEAKD

SEQ ID NO: 1861853 - protein, 9 aa, Staphylococcus
QKGIDDEEV

SEQ ID NO: 1861854 - protein, 6 aa, Staphylococcus
QKGIRY

SEQ ID NO: 1861855 - protein, 21 aa, Staphylococcus
QKGNETEVVRAPSDALKEAKD

SEQ ID NO: 1861856 - protein, 6 aa, Staphylococcus
QKGNSI

SEQ ID NO: 1861857 - protein, 24 aa, Staphylococcus
QKGQVQEREAYTAQIDAADAEKGV

SEQ ID NO: 1861858 - protein, 14 aa, Staphylococcus
QKGTQSVYTENITN

SEQ ID NO: 1861859 - protein, 8 aa, Staphylococcus
QKGVENVT

SEQ ID NO: 1861860 - protein, 8 aa, Staphylococcus
QKGVYDRG

SEQ ID NO: 1861861 - protein, 5 aa, Staphylococcus
QKGYI

SEQ ID NO: 1861862 - protein, 5 aa, Staphylococcus
QKHTN

SEQ ID NO: 1861863 - protein, 9 aa, Staphylococcus
QKIDESKSF

SEQ ID NO: 1861864 - protein, 4 aa, Staphylococcus
QKIE

SEQ ID NO: 1861865 - protein, 5 aa, Staphylococcus
QKIEE

SEQ ID NO: 1861866 - protein, 6 aa, Staphylococcus
QKIEPV

SEQ ID NO: 1861867 - protein, 26 aa, Staphylococcus
QKIEQQSNENNAIQSEIKKNSSYERI

SEQ ID NO: 1861868 - protein, 26 aa, Staphylococcus
QKIETQSSQNSALKSEIKKNSSYERI

SEQ ID NO: 1861869 - protein, 20 aa, Staphylococcus
QKIKSAGAVSVTKSGKHSTQ

SEQ ID NO: 1861870 - protein, 12 aa, Staphylococcus
QKINANQKITAD

SEQ ID NO: 1861871 - protein, 16 aa, Staphylococcus
QKITDEHHNTDTKYKQ

SEQ ID NO: 1861872 - protein, 25 aa, Staphylococcus
QKITTENKQDHTKDNILEERSSDNK

SEQ ID NO: 1861873 - protein, 17 aa, Staphylococcus
QKKETKKLNNITKDNKT

SEQ ID NO: 1861874 - protein, 14 aa, Staphylococcus
QKKHIENQEYDREH

SEQ ID NO: 1861875 - protein, 10 aa, Staphylococcus
QKKKSSKGKK

SEQ ID NO: 1861876 - protein, 8 aa, Staphylococcus
QKKRTKKK

SEQ ID NO: 1861877 - protein, 9 aa, Staphylococcus
QKKTEEYLE

SEQ ID NO: 1861878 - protein, 9 aa, Staphylococcus
QKKTETMLS

SEQ ID NO: 1861879 - protein, 13 aa, Staphylococcus
QKKTKEQSKSHAY

SEQ ID NO: 1861880 - protein, 16 aa, Staphylococcus
QKKTTLYKKAGKNPIL

SEQ ID NO: 1861881 - protein, 27 aa, Staphylococcus
QKLDAAKNDLHGEQKLEQDKQQATERI

SEQ ID NO: 1861882 - protein, 8 aa, Staphylococcus
QKLDGQQN

SEQ ID NO: 1861883 - protein, 9 aa, Staphylococcus
QKLDNLSSA

SEQ ID NO: 1861884 - protein, 11 aa, Staphylococcus
QKLKDDEQEYD

SEQ ID NO: 1861885 - protein, 6 aa, Staphylococcus
QKLNDV

SEQ ID NO: 1861886 - protein, 4 aa, Staphylococcus
QKLT

SEQ ID NO: 1861887 - protein, 13 aa, Staphylococcus
QKMQKLKKSLYLL

SEQ ID NO: 1861888 - protein, 8 aa, Staphylococcus
QKNDNETY

SEQ ID NO: 1861889 - protein, 6 aa, Staphylococcus
QKNENV

SEQ ID NO: 1861890 - protein, 8 aa, Staphylococcus
QKNGSPIE

SEQ ID NO: 1861891 - protein, 8 aa, Staphylococcus
QKNNGSAY

SEQ ID NO: 1861892 - protein, 9 aa, Staphylococcus
QKNNRKPLS

SEQ ID NO: 1861893 - protein, 7 aa, Staphylococcus
QKNNTFH

SEQ ID NO: 1861894 - protein, 9 aa, Staphylococcus
QKPGDFVNK

SEQ ID NO: 1861895 - protein, 6 aa, Staphylococcus
QKPPAQ

SEQ ID NO: 1861896 - protein, 7 aa, Staphylococcus
QKPSGVV

SEQ ID NO: 1861897 - protein, 13 aa, Staphylococcus
QKQAGNKSRLDET

SEQ ID NO: 1861898 - protein, 8 aa, Staphylococcus
QKQGYTSD

SEQ ID NO: 1861899 - protein, 7 aa, Staphylococcus
QKQNNKQ

SEQ ID NO: 1861900 - protein, 10 aa, Staphylococcus
QKQNNPFLPT

SEQ ID NO: 1861901 - protein, 10 aa, Staphylococcus
QKQRQNQTPN

SEQ ID NO: 1861902 - protein, 15 aa, Staphylococcus
QKQTQSNQLNTIDKN

SEQ ID NO: 1861903 - protein, 15 aa, Staphylococcus
QKQYNKDTPKSQMTT

SEQ ID NO: 1861904 - protein, 5 aa, Staphylococcus
QKRAD

SEQ ID NO: 1861905 - protein, 4 aa, Staphylococcus
QKRF

SEQ ID NO: 1861906 - protein, 5 aa, Staphylococcus
QKRGM

SEQ ID NO: 1861907 - protein, 6 aa, Staphylococcus
QKRNNL

SEQ ID NO: 1861908 - protein, 6 aa, Staphylococcus
QKRNSV

SEQ ID NO: 1861909 - protein, 16 aa, Staphylococcus
QKRPEVASQLSKAKEL

SEQ ID NO: 1861910 - protein, 8 aa, Staphylococcus
QKRPTGKQ

SEQ ID NO: 1861911 - protein, 9 aa, Staphylococcus
QKRPTGKQN

SEQ ID NO: 1861912 - protein, 20 aa, Staphylococcus
QKRTEDNEKNENKQSNLENY

SEQ ID NO: 1861913 - protein, 6 aa, Staphylococcus
QKSEVS

SEQ ID NO: 1861914 - protein, 8 aa, Staphylococcus
QKSGNDAY

SEQ ID NO: 1861915 - protein, 16 aa, Staphylococcus
QKSKLTSKKDNQKELE

SEQ ID NO: 1861916 - protein, 12 aa, Staphylococcus
QKSRGSEISSGG

SEQ ID NO: 1861917 - protein, 13 aa, Staphylococcus
QKSRGSEISSGGL

SEQ ID NO: 1861918 - protein, 13 aa, Staphylococcus
QKSRGSEISSGSL

SEQ ID NO: 1861919 - protein, 13 aa, Staphylococcus
QKSRGSELSSGGL

SEQ ID NO: 1861920 - protein, 21 aa, Staphylococcus
QKSRSIQNSPFGTRSQKQDAL

SEQ ID NO: 1861921 - protein, 7 aa, Staphylococcus
QKSTLGF

SEQ ID NO: 1861922 - protein, 6 aa, Staphylococcus
QKSYND

SEQ ID NO: 1861923 - protein, 4 aa, Staphylococcus
QKTM

SEQ ID NO: 1861924 - protein, 10 aa, Staphylococcus
QKTPEKLNGF

SEQ ID NO: 1861925 - protein, 9 aa, Staphylococcus
QKTPKGIEA

SEQ ID NO: 1861926 - protein, 5 aa, Staphylococcus
QKVET

SEQ ID NO: 1861927 - protein, 7 aa, Staphylococcus
QKVTPEK

SEQ ID NO: 1861928 - protein, 7 aa, Staphylococcus
QKYDNNM

SEQ ID NO: 1861929 - protein, 6 aa, Staphylococcus
QKYEAD

SEQ ID NO: 1861930 - protein, 10 aa, Staphylococcus
QKYESPDFNK

SEQ ID NO: 1861931 - protein, 21 aa, Staphylococcus
QLAKEKGEIKPPDSTSSQKYE

SEQ ID NO: 1861932 - protein, 17 aa, Staphylococcus
QLAPDKVPVPDVRRPDY

SEQ ID NO: 1861933 - protein, 13 aa, Staphylococcus
QLAPKGKEGSFQG

SEQ ID NO: 1861934 - protein, 12 aa, Staphylococcus
QLAPKGKVGQYQ

SEQ ID NO: 1861935 - protein, 27 aa, Staphylococcus
QLASAKQSATQDVNGLTSLNDGQKREI

SEQ ID NO: 1861936 - protein, 13 aa, Staphylococcus
QLDNAKNNTEKQS

SEQ ID NO: 1861937 - protein, 15 aa, Staphylococcus
QLDPTTGHYAKGQTK

SEQ ID NO: 1861938 - protein, 7 aa, Staphylococcus
QLDQPSM

SEQ ID NO: 1861939 - protein, 9 aa, Staphylococcus
QLDSEGNVN

SEQ ID NO: 1861940 - protein, 9 aa, Staphylococcus
QLEDEYSDG

SEQ ID NO: 1861941 - protein, 10 aa, Staphylococcus
QLEGQGGIQD

SEQ ID NO: 1861942 - protein, 12 aa, Staphylococcus
QLEKQNADLESK

SEQ ID NO: 1861943 - protein, 6 aa, Staphylococcus
QLENKE

SEQ ID NO: 1861944 - protein, 5 aa, Staphylococcus
QLGAS

SEQ ID NO: 1861945 - protein, 7 aa, Staphylococcus
QLGDDDG

SEQ ID NO: 1861946 - protein, 6 aa, Staphylococcus
QLGQKP

SEQ ID NO: 1861947 - protein, 7 aa, Staphylococcus
QLGQKPV

SEQ ID NO: 1861948 - protein, 5 aa, Staphylococcus
QLGSE

SEQ ID NO: 1861949 - protein, 15 aa, Staphylococcus
QLGSNKEQVSDSEIS

SEQ ID NO: 1861950 - protein, 4 aa, Staphylococcus
QLGT

SEQ ID NO: 1861951 - protein, 13 aa, Staphylococcus
QLIGTGDTDQNGH

SEQ ID NO: 1861952 - protein, 8 aa, Staphylococcus
QLKEPTAV

SEQ ID NO: 1861953 - protein, 11 aa, Staphylococcus
QLKKADNGKLT

SEQ ID NO: 1861954 - protein, 9 aa, Staphylococcus
QLKKSDKGK

SEQ ID NO: 1861955 - protein, 9 aa, Staphylococcus
QLKKSDNNK

SEQ ID NO: 1861956 - protein, 8 aa, Staphylococcus
QLKKSPDH

SEQ ID NO: 1861957 - protein, 11 aa, Staphylococcus
QLKKSPNSKLT

SEQ ID NO: 1861958 - protein, 9 aa, Staphylococcus
QLKKSTNQK

SEQ ID NO: 1861959 - protein, 10 aa, Staphylococcus
QLKPEDKESI

SEQ ID NO: 1861960 - protein, 9 aa, Staphylococcus
QLKPSSKMN

SEQ ID NO: 1861961 - protein, 10 aa, Staphylococcus
QLKSNDSYRS

SEQ ID NO: 1861962 - protein, 6 aa, Staphylococcus
QLNDEL

SEQ ID NO: 1861963 - protein, 5 aa, Staphylococcus
QLNEE

SEQ ID NO: 1861964 - protein, 17 aa, Staphylococcus
QLNKSSNEREQNVNEAE

SEQ ID NO: 1861965 - protein, 8 aa, Staphylococcus
QLNNTDRE

SEQ ID NO: 1861966 - protein, 8 aa, Staphylococcus
QLNQQSDK

SEQ ID NO: 1861967 - protein, 18 aa, Staphylococcus
QLNQSTKDSINYQNADED

SEQ ID NO: 1861968 - protein, 26 aa, Staphylococcus
QLNSEEPKTLPTAESVRSALANNNNI

SEQ ID NO: 1861969 - protein, 5 aa, Staphylococcus
QLNSL

SEQ ID NO: 1861970 - protein, 12 aa, Staphylococcus
QLPQNNKHSDKV

SEQ ID NO: 1861971 - protein, 5 aa, Staphylococcus
QLPSK

SEQ ID NO: 1861972 - protein, 13 aa, Staphylococcus
QLPSTGKKEANLE

SEQ ID NO: 1861973 - protein, 19 aa, Staphylococcus
QLQQSTKKQQTTVKQQTQT

SEQ ID NO: 1861974 - protein, 4 aa, Staphylococcus
QLRS

SEQ ID NO: 1861975 - protein, 4 aa, Staphylococcus
QLRT

SEQ ID NO: 1861976 - protein, 4 aa, Staphylococcus
QLSD

SEQ ID NO: 1861977 - protein, 17 aa, Staphylococcus
QLSGTNIVSGETSPNAA

SEQ ID NO: 1861978 - protein, 8 aa, Staphylococcus
QLSIDEAK

SEQ ID NO: 1861979 - protein, 31 aa, Staphylococcus
QLSKDDTTTSLPEDKTIHTSSNNNNDNSQNI

SEQ ID NO: 1861980 - protein, 16 aa, Staphylococcus
QLTKKYGQASRTYPFR

SEQ ID NO: 1861981 - protein, 7 aa, Staphylococcus
QLTRDNA

SEQ ID NO: 1861982 - protein, 4 aa, Staphylococcus
QLVG

SEQ ID NO: 1861983 - protein, 4 aa, Staphylococcus
QLYR

SEQ ID NO: 1861984 - protein, 54 aa, Staphylococcus
QMDKDKVQANVPASKRAETNNESLSIETNTTNIEKTLAKPSTSKFRSANTRATN

SEQ ID NO: 1861985 - protein, 4 aa, Staphylococcus
QMNE

SEQ ID NO: 1861986 - protein, 46 aa, Staphylococcus
QMQQASQNPQAGVQSITQQASQLSQGLQQAQQGNEQVIDGQKEIQS

SEQ ID NO: 1861987 - protein, 25 aa, Staphylococcus
QMSKDEYKKQIEDALKKAEDAKEKE

SEQ ID NO: 1861988 - protein, 8 aa, Staphylococcus
QMSKEDFS

SEQ ID NO: 1861989 - protein, 27 aa, Staphylococcus
QMTDGDSVGKESSNPLLPPVDTGEAIG

SEQ ID NO: 1861990 - protein, 5 aa, Staphylococcus
QMTKK

SEQ ID NO: 1861991 - protein, 7 aa, Staphylococcus
QMTKTYT

SEQ ID NO: 1861992 - protein, 31 aa, Staphylococcus
QMTQQSNNSEQNNTKLEQKSEQDSQPVMASM

SEQ ID NO: 1861993 - protein, 10 aa, Staphylococcus
QNAKGDKKGW

SEQ ID NO: 1861994 - protein, 9 aa, Staphylococcus
QNAKYTYSN

SEQ ID NO: 1861995 - protein, 21 aa, Staphylococcus
QNANNNNVSNSQYQNSNNNSV

SEQ ID NO: 1861996 - protein, 4 aa, Staphylococcus
QNAP

SEQ ID NO: 1861997 - protein, 8 aa, Staphylococcus
QNDDQSSL

SEQ ID NO: 1861998 - protein, 7 aa, Staphylococcus
QNDGRSG

SEQ ID NO: 1861999 - protein, 7 aa, Staphylococcus
QNDKTDA

SEQ ID NO: 1862000 - protein, 5 aa, Staphylococcus
QNDNE

SEQ ID NO: 1862001 - protein, 9 aa, Staphylococcus
QNDNPTVNA

SEQ ID NO: 1862002 - protein, 5 aa, Staphylococcus
QNDNV

SEQ ID NO: 1862003 - protein, 7 aa, Staphylococcus
QNEDKDA

SEQ ID NO: 1862004 - protein, 8 aa, Staphylococcus
QNEDKSSL

SEQ ID NO: 1862005 - protein, 7 aa, Staphylococcus
QNEDQQS

SEQ ID NO: 1862006 - protein, 11 aa, Staphylococcus
QNEELDEKQAE

SEQ ID NO: 1862007 - protein, 12 aa, Staphylococcus
QNEELDEKQSEL

SEQ ID NO: 1862008 - protein, 4 aa, Staphylococcus
QNEI

SEQ ID NO: 1862009 - protein, 10 aa, Staphylococcus
QNEKPKRVAK

SEQ ID NO: 1862010 - protein, 8 aa, Staphylococcus
QNEPERDQ

SEQ ID NO: 1862011 - protein, 17 aa, Staphylococcus
QNEPMHRGKQYGKKKRS

SEQ ID NO: 1862012 - protein, 9 aa, Staphylococcus
QNERQGKTN

SEQ ID NO: 1862013 - protein, 7 aa, Staphylococcus
QNESGQL

SEQ ID NO: 1862014 - protein, 5 aa, Staphylococcus
QNETF

SEQ ID NO: 1862015 - protein, 5 aa, Staphylococcus
QNFAD

SEQ ID NO: 1862016 - protein, 5 aa, Staphylococcus
QNFDH

SEQ ID NO: 1862017 - protein, 15 aa, Staphylococcus
QNFEDAGLSGQQLDQ

SEQ ID NO: 1862018 - protein, 7 aa, Staphylococcus
QNFSGNE

SEQ ID NO: 1862019 - protein, 10 aa, Staphylococcus
QNGATATESF

SEQ ID NO: 1862020 - protein, 7 aa, Staphylococcus
QNGEITQ

SEQ ID NO: 1862021 - protein, 4 aa, Staphylococcus
QNGH

SEQ ID NO: 1862022 - protein, 6 aa, Staphylococcus
QNGHYD

SEQ ID NO: 1862023 - protein, 6 aa, Staphylococcus
QNGNKY

SEQ ID NO: 1862024 - protein, 5 aa, Staphylococcus
QNGNY

SEQ ID NO: 1862025 - protein, 8 aa, Staphylococcus
QNGSNVEP

SEQ ID NO: 1862026 - protein, 9 aa, Staphylococcus
QNGTMPKKV

SEQ ID NO: 1862027 - protein, 4 aa, Staphylococcus
QNHN

SEQ ID NO: 1862028 - protein, 13 aa, Staphylococcus
QNHSKDKHQSHAY

SEQ ID NO: 1862029 - protein, 16 aa, Staphylococcus
QNINQQITKQSINTLE

SEQ ID NO: 1862030 - protein, 47 aa, Staphylococcus
QNISKNDSNNTFNENKSIHKRTKRSTDNNVDNNQDQMSINETNSGQI

SEQ ID NO: 1862031 - protein, 5 aa, Staphylococcus
QNIVT

SEQ ID NO: 1862032 - protein, 10 aa, Staphylococcus
QNKDNQLSGT

SEQ ID NO: 1862033 - protein, 5 aa, Staphylococcus
QNKEH

SEQ ID NO: 1862034 - protein, 9 aa, Staphylococcus
QNKENNSAL

SEQ ID NO: 1862035 - protein, 6 aa, Staphylococcus
QNKGGY

SEQ ID NO: 1862036 - protein, 9 aa, Staphylococcus
QNKKPREIN

SEQ ID NO: 1862037 - protein, 8 aa, Staphylococcus
QNKNNGVA

SEQ ID NO: 1862038 - protein, 7 aa, Staphylococcus
QNKNNTL

SEQ ID NO: 1862039 - protein, 7 aa, Staphylococcus
QNKQKPN

SEQ ID NO: 1862040 - protein, 6 aa, Staphylococcus
QNKQSI

SEQ ID NO: 1862041 - protein, 14 aa, Staphylococcus
QNKSRKGNKKRSKT

SEQ ID NO: 1862042 - protein, 15 aa, Staphylococcus
QNKTRDAHDMLNGDD

SEQ ID NO: 1862043 - protein, 7 aa, Staphylococcus
QNKVDRQ

SEQ ID NO: 1862044 - protein, 29 aa, Staphylococcus
QNKYNEKKGEIDNLTSSSDIAPLKESSIA

SEQ ID NO: 1862045 - protein, 13 aa, Staphylococcus
QNLDPLQSPNSQH

SEQ ID NO: 1862046 - protein, 16 aa, Staphylococcus
QNLIDEAKRSTHNATW

SEQ ID NO: 1862047 - protein, 9 aa, Staphylococcus
QNLPADSKV

SEQ ID NO: 1862048 - protein, 10 aa, Staphylococcus
QNLTNENYNL

SEQ ID NO: 1862049 - protein, 9 aa, Staphylococcus
QNMTNENYN

SEQ ID NO: 1862050 - protein, 11 aa, Staphylococcus
QNNASFNNAEQ

SEQ ID NO: 1862051 - protein, 5 aa, Staphylococcus
QNNDN

SEQ ID NO: 1862052 - protein, 7 aa, Staphylococcus
QNNNQHD

SEQ ID NO: 1862053 - protein, 8 aa, Staphylococcus
QNNPDNAR

SEQ ID NO: 1862054 - protein, 4 aa, Staphylococcus
QNNR

SEQ ID NO: 1862055 - protein, 7 aa, Staphylococcus
QNNRDVS

SEQ ID NO: 1862056 - protein, 17 aa, Staphylococcus
QNNSQKERKDASETLAF

SEQ ID NO: 1862057 - protein, 11 aa, Staphylococcus
QNNTSGELKNA

SEQ ID NO: 1862058 - protein, 6 aa, Staphylococcus
QNPAEI

SEQ ID NO: 1862059 - protein, 4 aa, Staphylococcus
QNPE

SEQ ID NO: 1862060 - protein, 6 aa, Staphylococcus
QNPERI

SEQ ID NO: 1862061 - protein, 7 aa, Staphylococcus
QNPKENL

SEQ ID NO: 1862062 - protein, 4 aa, Staphylococcus
QNPQ

SEQ ID NO: 1862063 - protein, 13 aa, Staphylococcus
QNPTGRDEREQGV

SEQ ID NO: 1862064 - protein, 6 aa, Staphylococcus
QNQARY

SEQ ID NO: 1862065 - protein, 6 aa, Staphylococcus
QNQGKT

SEQ ID NO: 1862066 - protein, 11 aa, Staphylococcus
QNQKVTIETED

SEQ ID NO: 1862067 - protein, 5 aa, Staphylococcus
QNQNS

SEQ ID NO: 1862068 - protein, 10 aa, Staphylococcus
QNQPRAKEAL

SEQ ID NO: 1862069 - protein, 10 aa, Staphylococcus
QNQVNDSSAI

SEQ ID NO: 1862070 - protein, 11 aa, Staphylococcus
QNRELDEKQAE

SEQ ID NO: 1862071 - protein, 9 aa, Staphylococcus
QNRQETKKG

SEQ ID NO: 1862072 - protein, 14 aa, Staphylococcus
QNRSSKGNKKRSRT

SEQ ID NO: 1862073 - protein, 8 aa, Staphylococcus
QNSDEKSL

SEQ ID NO: 1862074 - protein, 6 aa, Staphylococcus
QNSTAH

SEQ ID NO: 1862075 - protein, 10 aa, Staphylococcus
QNSTKKSYNL

SEQ ID NO: 1862076 - protein, 9 aa, Staphylococcus
QNSTSGELK

SEQ ID NO: 1862077 - protein, 15 aa, Staphylococcus
QNSVAIGASQKEVAE

SEQ ID NO: 1862078 - protein, 10 aa, Staphylococcus
QNTANESTSI

SEQ ID NO: 1862079 - protein, 9 aa, Staphylococcus
QNTEQQIND

SEQ ID NO: 1862080 - protein, 18 aa, Staphylococcus
QNTEQTKLQSSSKQTFED

SEQ ID NO: 1862081 - protein, 4 aa, Staphylococcus
QNTI

SEQ ID NO: 1862082 - protein, 6 aa, Staphylococcus
QNTIDA

SEQ ID NO: 1862083 - protein, 8 aa, Staphylococcus
QNTIEPYQ

SEQ ID NO: 1862084 - protein, 5 aa, Staphylococcus
QNTIK

SEQ ID NO: 1862085 - protein, 5 aa, Staphylococcus
QNTND

SEQ ID NO: 1862086 - protein, 14 aa, Staphylococcus
QNTNLQKDDYVDTT

SEQ ID NO: 1862087 - protein, 21 aa, Staphylococcus
QNTTTNINDASNNQDVTQAKE

SEQ ID NO: 1862088 - protein, 7 aa, Staphylococcus
QNTTYGI

SEQ ID NO: 1862089 - protein, 8 aa, Staphylococcus
QNTTYGIG

SEQ ID NO: 1862090 - protein, 11 aa, Staphylococcus
QNVDRTNNKKL

SEQ ID NO: 1862091 - protein, 4 aa, Staphylococcus
QNVG

SEQ ID NO: 1862092 - protein, 5 aa, Staphylococcus
QNVGY

SEQ ID NO: 1862093 - protein, 21 aa, Staphylococcus
QPAATETESADGKIGKRVKPK

SEQ ID NO: 1862094 - protein, 12 aa, Staphylococcus
QPAKESELYHSE

SEQ ID NO: 1862095 - protein, 20 aa, Staphylococcus
QPAKQKATSKAEVQKKGQLL

SEQ ID NO: 1862096 - protein, 21 aa, Staphylococcus
QPAKQQSTSKAEVQRKGQVLE

SEQ ID NO: 1862097 - protein, 18 aa, Staphylococcus
QPAKQQSTSKSEVQRKGQ

SEQ ID NO: 1862098 - protein, 21 aa, Staphylococcus
QPDHQRKKDYIKNNTNQQSKI

SEQ ID NO: 1862099 - protein, 29 aa, Staphylococcus
QPDIKKDEQNKTDDSLKAVEQNKERKPII

SEQ ID NO: 1862100 - protein, 6 aa, Staphylococcus
QPDMNG

SEQ ID NO: 1862101 - protein, 8 aa, Staphylococcus
QPDRYHSQ

SEQ ID NO: 1862102 - protein, 73 aa, Staphylococcus
QPDTIKKAEAKRAIDEVAKAKKQEIDNNTNATKEEKDVAKSKVDEEVTKAKSAIDQATTNDQVDQGNNNGHTA

SEQ ID NO: 1862103 - protein, 8 aa, Staphylococcus
QPEKGMET

SEQ ID NO: 1862104 - protein, 5 aa, Staphylococcus
QPEKL

SEQ ID NO: 1862105 - protein, 9 aa, Staphylococcus
QPERIKPEI

SEQ ID NO: 1862106 - protein, 19 aa, Staphylococcus
QPESDITATASNGNSDNSI

SEQ ID NO: 1862107 - protein, 6 aa, Staphylococcus
QPETIQ

SEQ ID NO: 1862108 - protein, 9 aa, Staphylococcus
QPETKQSIQ

SEQ ID NO: 1862109 - protein, 38 aa, Staphylococcus
QPGAGKSELLNSDDVSSYQQTLEKEDSSQDSAAKQTFD

SEQ ID NO: 1862110 - protein, 18 aa, Staphylococcus
QPGIDDRKVTEMNKQTQT

SEQ ID NO: 1862111 - protein, 11 aa, Staphylococcus
QPGITTPSQKN

SEQ ID NO: 1862112 - protein, 14 aa, Staphylococcus
QPGRQVKTTVNTQS

SEQ ID NO: 1862113 - protein, 5 aa, Staphylococcus
QPGTF

SEQ ID NO: 1862114 - protein, 11 aa, Staphylococcus
QPGTKSYVDPI

SEQ ID NO: 1862115 - protein, 5 aa, Staphylococcus
QPIEG

SEQ ID NO: 1862116 - protein, 5 aa, Staphylococcus
QPISY

SEQ ID NO: 1862117 - protein, 11 aa, Staphylococcus
QPKDSNTVPTP

SEQ ID NO: 1862118 - protein, 11 aa, Staphylococcus
QPKEKEQLKPM

SEQ ID NO: 1862119 - protein, 9 aa, Staphylococcus
QPKENNSAL

SEQ ID NO: 1862120 - protein, 33 aa, Staphylococcus
QPKNDDQTANQNQQSEQAQQSNNQNKPNVTNNY

SEQ ID NO: 1862121 - protein, 6 aa, Staphylococcus
QPKTIS

SEQ ID NO: 1862122 - protein, 9 aa, Staphylococcus
QPLANSDKG

SEQ ID NO: 1862123 - protein, 5 aa, Staphylococcus
QPLAS

SEQ ID NO: 1862124 - protein, 11 aa, Staphylococcus
QPLKQSDFSTA

SEQ ID NO: 1862125 - protein, 10 aa, Staphylococcus
QPLPESKETL

SEQ ID NO: 1862126 - protein, 6 aa, Staphylococcus
QPLRNT

SEQ ID NO: 1862127 - protein, 9 aa, Staphylococcus
QPLTNEKEG

SEQ ID NO: 1862128 - protein, 11 aa, Staphylococcus
QPNALPKKAHE

SEQ ID NO: 1862129 - protein, 9 aa, Staphylococcus
QPNKRTNKM

SEQ ID NO: 1862130 - protein, 6 aa, Staphylococcus
QPNMNG

SEQ ID NO: 1862131 - protein, 10 aa, Staphylococcus
QPNNEDPIVD

SEQ ID NO: 1862132 - protein, 6 aa, Staphylococcus
QPNQSG

SEQ ID NO: 1862133 - protein, 6 aa, Staphylococcus
QPNSNQ

SEQ ID NO: 1862134 - protein, 8 aa, Staphylococcus
QPQNTAES

SEQ ID NO: 1862135 - protein, 10 aa, Staphylococcus
QPQQSPNTER

SEQ ID NO: 1862136 - protein, 9 aa, Staphylococcus
QPQSKNRYR

SEQ ID NO: 1862137 - protein, 5 aa, Staphylococcus
QPSHG

SEQ ID NO: 1862138 - protein, 5 aa, Staphylococcus
QPSKG

SEQ ID NO: 1862139 - protein, 4 aa, Staphylococcus
QPSL

SEQ ID NO: 1862140 - protein, 6 aa, Staphylococcus
QPSQMT

SEQ ID NO: 1862141 - protein, 5 aa, Staphylococcus
QPSTF

SEQ ID NO: 1862142 - protein, 63 aa, Staphylococcus
QPSVPVQPSVPAQPSVPAQPSVPVQPSVPVQPSVPVDPNGQIETPNIPGPQTPKEPTQPGGYT

SEQ ID NO: 1862143 - protein, 8 aa, Staphylococcus
QPTEQRLS

SEQ ID NO: 1862144 - protein, 6 aa, Staphylococcus
QPTKEV

SEQ ID NO: 1862145 - protein, 5 aa, Staphylococcus
QPTKL

SEQ ID NO: 1862146 - protein, 19 aa, Staphylococcus
QPTKQTTTSRAEVQRKGQI

SEQ ID NO: 1862147 - protein, 8 aa, Staphylococcus
QPTKSQKN

SEQ ID NO: 1862148 - protein, 5 aa, Staphylococcus
QPTMS

SEQ ID NO: 1862149 - protein, 14 aa, Staphylococcus
QPTNVNASMAQTTG

SEQ ID NO: 1862150 - protein, 4 aa, Staphylococcus
QPTR

SEQ ID NO: 1862151 - protein, 4 aa, Staphylococcus
QPTY

SEQ ID NO: 1862152 - protein, 14 aa, Staphylococcus
QPVGSPPKKKKSKR

SEQ ID NO: 1862153 - protein, 6 aa, Staphylococcus
QPVPEP

SEQ ID NO: 1862154 - protein, 6 aa, Staphylococcus
QPVTHE

SEQ ID NO: 1862155 - protein, 6 aa, Staphylococcus
QQADVS

SEQ ID NO: 1862156 - protein, 7 aa, Staphylococcus
QQADYEA

SEQ ID NO: 1862157 - protein, 8 aa, Staphylococcus
QQAQTRPD

SEQ ID NO: 1862158 - protein, 19 aa, Staphylococcus
QQARNTLSKATGKPASIEE

SEQ ID NO: 1862159 - protein, 25 aa, Staphylococcus
QQAVDAKDAPMKKAIKDKNHTELQS

SEQ ID NO: 1862160 - protein, 8 aa, Staphylococcus
QQDAYKKK

SEQ ID NO: 1862161 - protein, 17 aa, Staphylococcus
QQDDESQSNSQNKNKQV

SEQ ID NO: 1862162 - protein, 5 aa, Staphylococcus
QQDDY

SEQ ID NO: 1862163 - protein, 5 aa, Staphylococcus
QQDEI

SEQ ID NO: 1862164 - protein, 6 aa, Staphylococcus
QQDGRS

SEQ ID NO: 1862165 - protein, 20 aa, Staphylococcus
QQDNNLTVNGQFDKETNDKF

SEQ ID NO: 1862166 - protein, 29 aa, Staphylococcus
QQDQSPKSQMNSTLSKQATRSQETSQTSL

SEQ ID NO: 1862167 - protein, 6 aa, Staphylococcus
QQEGLA

SEQ ID NO: 1862168 - protein, 9 aa, Staphylococcus
QQEGTMKED

SEQ ID NO: 1862169 - protein, 7 aa, Staphylococcus
QQEGVAG

SEQ ID NO: 1862170 - protein, 13 aa, Staphylococcus
QQENEIKQKEYEL

SEQ ID NO: 1862171 - protein, 14 aa, Staphylococcus
QQENEIKQKEYELR

SEQ ID NO: 1862172 - protein, 19 aa, Staphylococcus
QQESEKKKQQREKVQINNP

SEQ ID NO: 1862173 - protein, 7 aa, Staphylococcus
QQEVSDL

SEQ ID NO: 1862174 - protein, 17 aa, Staphylococcus
QQFKSESLSNENEVRPQ

SEQ ID NO: 1862175 - protein, 9 aa, Staphylococcus
QQFNNSDYQ

SEQ ID NO: 1862176 - protein, 8 aa, Staphylococcus
QQFQSSEE

SEQ ID NO: 1862177 - protein, 5 aa, Staphylococcus
QQGNS

SEQ ID NO: 1862178 - protein, 29 aa, Staphylococcus
QQGNVIDEDASFKKVNKQEAKKQVKNEKL

SEQ ID NO: 1862179 - protein, 5 aa, Staphylococcus
QQGRQ

SEQ ID NO: 1862180 - protein, 18 aa, Staphylococcus
QQGYINEEQYKTALAQLG

SEQ ID NO: 1862181 - protein, 10 aa, Staphylococcus
QQHPTEKQWS

SEQ ID NO: 1862182 - protein, 6 aa, Staphylococcus
QQIEQQ

SEQ ID NO: 1862183 - protein, 9 aa, Staphylococcus
QQINENGQL

SEQ ID NO: 1862184 - protein, 8 aa, Staphylococcus
QQINQRGE

SEQ ID NO: 1862185 - protein, 5 aa, Staphylococcus
QQIRN

SEQ ID NO: 1862186 - protein, 22 aa, Staphylococcus
QQITNDNTNQEVANTKDNGLEK

SEQ ID NO: 1862187 - protein, 19 aa, Staphylococcus
QQKAEQSDEDNIDNENNDI

SEQ ID NO: 1862188 - protein, 8 aa, Staphylococcus
QQKDYESD

SEQ ID NO: 1862189 - protein, 4 aa, Staphylococcus
QQKF

SEQ ID NO: 1862190 - protein, 9 aa, Staphylococcus
QQKGIEPKF

SEQ ID NO: 1862191 - protein, 9 aa, Staphylococcus
QQKHELEEK

SEQ ID NO: 1862192 - protein, 10 aa, Staphylococcus
QQKKAKEHRE

SEQ ID NO: 1862193 - protein, 7 aa, Staphylococcus
QQKLNDV

SEQ ID NO: 1862194 - protein, 10 aa, Staphylococcus
QQKQHQAAQA

SEQ ID NO: 1862195 - protein, 8 aa, Staphylococcus
QQKRAGLK

SEQ ID NO: 1862196 - protein, 10 aa, Staphylococcus
QQKRAKEHRE

SEQ ID NO: 1862197 - protein, 9 aa, Staphylococcus
QQKRQKEHR

SEQ ID NO: 1862198 - protein, 5 aa, Staphylococcus
QQKTY

SEQ ID NO: 1862199 - protein, 10 aa, Staphylococcus
QQKYQKHAKD

SEQ ID NO: 1862200 - protein, 15 aa, Staphylococcus
QQLEDNGKVQYPNTG

SEQ ID NO: 1862201 - protein, 13 aa, Staphylococcus
QQLKSKQTQYQND

SEQ ID NO: 1862202 - protein, 10 aa, Staphylococcus
QQLNATQQAE

SEQ ID NO: 1862203 - protein, 12 aa, Staphylococcus
QQLPQSDVDATY

SEQ ID NO: 1862204 - protein, 4 aa, Staphylococcus
QQLT

SEQ ID NO: 1862205 - protein, 21 aa, Staphylococcus
QQLTKANKGLGQINNGLGTMQ

SEQ ID NO: 1862206 - protein, 10 aa, Staphylococcus
QQLTTDKELN

SEQ ID NO: 1862207 - protein, 13 aa, Staphylococcus
QQNAELDEKQAEL

SEQ ID NO: 1862208 - protein, 4 aa, Staphylococcus
QQND

SEQ ID NO: 1862209 - protein, 43 aa, Staphylococcus
QQNDPTMDPREINAAAQKVKETKDALHGADKLTQSQNESNETI

SEQ ID NO: 1862210 - protein, 7 aa, Staphylococcus
QQNEITT

SEQ ID NO: 1862211 - protein, 18 aa, Staphylococcus
QQNGTLQSIDTYKLKLLE

SEQ ID NO: 1862212 - protein, 12 aa, Staphylococcus
QQNGTVTNETTN

SEQ ID NO: 1862213 - protein, 5 aa, Staphylococcus
QQNNK

SEQ ID NO: 1862214 - protein, 13 aa, Staphylococcus
QQNNPPFICAIEK

SEQ ID NO: 1862215 - protein, 9 aa, Staphylococcus
QQNTAGELK

SEQ ID NO: 1862216 - protein, 19 aa, Staphylococcus
QQNYISDSQYQEALSQLNN

SEQ ID NO: 1862217 - protein, 6 aa, Staphylococcus
QQPLNR

SEQ ID NO: 1862218 - protein, 7 aa, Staphylococcus
QQPNSKT

SEQ ID NO: 1862219 - protein, 11 aa, Staphylococcus
QQPPKATNSVH

SEQ ID NO: 1862220 - protein, 4 aa, Staphylococcus
QQPQ

SEQ ID NO: 1862221 - protein, 12 aa, Staphylococcus
QQPRTSRPWTKP

SEQ ID NO: 1862222 - protein, 12 aa, Staphylococcus
QQPTKARDEIES

SEQ ID NO: 1862223 - protein, 16 aa, Staphylococcus
QQPTQTTQPSKKRFKP

SEQ ID NO: 1862224 - protein, 7 aa, Staphylococcus
QQPTRLK

SEQ ID NO: 1862225 - protein, 4 aa, Staphylococcus
QQPY

SEQ ID NO: 1862226 - protein, 24 aa, Staphylococcus
QQQANNQKTKINNNSEVTKEEKDA

SEQ ID NO: 1862227 - protein, 8 aa, Staphylococcus
QQQAPPIF

SEQ ID NO: 1862228 - protein, 8 aa, Staphylococcus
QQQDYESD

SEQ ID NO: 1862229 - protein, 12 aa, Staphylococcus
QQQFKAQPKDEV

SEQ ID NO: 1862230 - protein, 12 aa, Staphylococcus
QQQFKQQPKDEV

SEQ ID NO: 1862231 - protein, 11 aa, Staphylococcus
QQQFKSQPEDE

SEQ ID NO: 1862232 - protein, 5 aa, Staphylococcus
QQQGL

SEQ ID NO: 1862233 - protein, 8 aa, Staphylococcus
QQQGYTSS

SEQ ID NO: 1862234 - protein, 10 aa, Staphylococcus
QQQQSSNTER

SEQ ID NO: 1862235 - protein, 4 aa, Staphylococcus
QQRE

SEQ ID NO: 1862236 - protein, 6 aa, Staphylococcus
QQRNPL

SEQ ID NO: 1862237 - protein, 12 aa, Staphylococcus
QQSKDKHKATQS

SEQ ID NO: 1862238 - protein, 8 aa, Staphylococcus
QQSKNISE

SEQ ID NO: 1862239 - protein, 8 aa, Staphylococcus
QQSKTTYE

SEQ ID NO: 1862240 - protein, 5 aa, Staphylococcus
QQSNE

SEQ ID NO: 1862241 - protein, 5 aa, Staphylococcus
QQSNQ

SEQ ID NO: 1862242 - protein, 5 aa, Staphylococcus
QQSNR

SEQ ID NO: 1862243 - protein, 7 aa, Staphylococcus
QQSPVDK

SEQ ID NO: 1862244 - protein, 7 aa, Staphylococcus
QQSQEEA

SEQ ID NO: 1862245 - protein, 11 aa, Staphylococcus
QQSQQQPKTIP

SEQ ID NO: 1862246 - protein, 8 aa, Staphylococcus
QQSTNTHT

SEQ ID NO: 1862247 - protein, 7 aa, Staphylococcus
QQSVESK

SEQ ID NO: 1862248 - protein, 8 aa, Staphylococcus
QQTEIRTE

SEQ ID NO: 1862249 - protein, 13 aa, Staphylococcus
QQTENAIREDASR

SEQ ID NO: 1862250 - protein, 8 aa, Staphylococcus
QQTGQKPV

SEQ ID NO: 1862251 - protein, 35 aa, Staphylococcus
QQTNNKPQFNKDSSVSKQPSNTHVRKKRASNSDEI

SEQ ID NO: 1862252 - protein, 11 aa, Staphylococcus
QQVAQQQQTTI

SEQ ID NO: 1862253 - protein, 19 aa, Staphylococcus
QQVKQNNNLTNEQKQNVEK

SEQ ID NO: 1862254 - protein, 11 aa, Staphylococcus
QQVNQAKDALN

SEQ ID NO: 1862255 - protein, 5 aa, Staphylococcus
QQYED

SEQ ID NO: 1862256 - protein, 9 aa, Staphylococcus
QQYGGESGA

SEQ ID NO: 1862257 - protein, 5 aa, Staphylococcus
QQYQD

SEQ ID NO: 1862258 - protein, 12 aa, Staphylococcus
QQYQPQPKKSKK

SEQ ID NO: 1862259 - protein, 7 aa, Staphylococcus
QRAERKL

SEQ ID NO: 1862260 - protein, 19 aa, Staphylococcus
QRAHEREERRRKTYEKEHD

SEQ ID NO: 1862261 - protein, 10 aa, Staphylococcus
QRDREGEQLS

SEQ ID NO: 1862262 - protein, 6 aa, Staphylococcus
QRDSKA

SEQ ID NO: 1862263 - protein, 21 aa, Staphylococcus
QREDHNKSNEKEQGKEQNNEE

SEQ ID NO: 1862264 - protein, 9 aa, Staphylococcus
QREGKMDEK

SEQ ID NO: 1862265 - protein, 5 aa, Staphylococcus
QREQH

SEQ ID NO: 1862266 - protein, 17 aa, Staphylococcus
QRESNGNAGVTQGNIGD

SEQ ID NO: 1862267 - protein, 4 aa, Staphylococcus
QREV

SEQ ID NO: 1862268 - protein, 14 aa, Staphylococcus
QRFSTNKDIKNKIE

SEQ ID NO: 1862269 - protein, 8 aa, Staphylococcus
QRGATTAS

SEQ ID NO: 1862270 - protein, 4 aa, Staphylococcus
QRGL

SEQ ID NO: 1862271 - protein, 10 aa, Staphylococcus
QRGRKEKPKE

SEQ ID NO: 1862272 - protein, 7 aa, Staphylococcus
QRKDPVG

SEQ ID NO: 1862273 - protein, 18 aa, Staphylococcus
QRKQAPPILGKTNRNGVP

SEQ ID NO: 1862274 - protein, 17 aa, Staphylococcus
QRKYKRAARKYKRKNRK

SEQ ID NO: 1862275 - protein, 14 aa, Staphylococcus
QRKYKRAQRKYRKR

SEQ ID NO: 1862276 - protein, 16 aa, Staphylococcus
QRKYRRAARKYKKRNR

SEQ ID NO: 1862277 - protein, 16 aa, Staphylococcus
QRKYRRAVRKYKKRQR

SEQ ID NO: 1862278 - protein, 16 aa, Staphylococcus
QRKYRRAVRKYRKRHR

SEQ ID NO: 1862279 - protein, 29 aa, Staphylococcus
QRLKKEEEARRANQEERIKEIQKYEKKPN

SEQ ID NO: 1862280 - protein, 25 aa, Staphylococcus
QRLQQAVDSTPSTTGMTQQSVQNYN

SEQ ID NO: 1862281 - protein, 8 aa, Staphylococcus
QRNTPKEI

SEQ ID NO: 1862282 - protein, 8 aa, Staphylococcus
QRPDENVT

SEQ ID NO: 1862283 - protein, 6 aa, Staphylococcus
QRPGSF

SEQ ID NO: 1862284 - protein, 10 aa, Staphylococcus
QRPKTQWDGQ

SEQ ID NO: 1862285 - protein, 7 aa, Staphylococcus
QRPRPSA

SEQ ID NO: 1862286 - protein, 6 aa, Staphylococcus
QRPSSF

SEQ ID NO: 1862287 - protein, 16 aa, Staphylococcus
QRQDKEKYEPTPGQIN

SEQ ID NO: 1862288 - protein, 20 aa, Staphylococcus
QRQELEEEIRDATTRPGVQS

SEQ ID NO: 1862289 - protein, 17 aa, Staphylococcus
QRQQEKQKYAKPKSKKP

SEQ ID NO: 1862290 - protein, 15 aa, Staphylococcus
QRQRKAGKKPVFKPE

SEQ ID NO: 1862291 - protein, 14 aa, Staphylococcus
QRQSRQNDNNENYL

SEQ ID NO: 1862292 - protein, 14 aa, Staphylococcus
QRRQEEEKKSKRKK

SEQ ID NO: 1862293 - protein, 7 aa, Staphylococcus
QRSEVGN

SEQ ID NO: 1862294 - protein, 17 aa, Staphylococcus
QRTEAPVKASSNYIDAD

SEQ ID NO: 1862295 - protein, 4 aa, Staphylococcus
QRTH

SEQ ID NO: 1862296 - protein, 8 aa, Staphylococcus
QRTNKHDS

SEQ ID NO: 1862297 - protein, 18 aa, Staphylococcus
QRTQYQPDYQLQTTKKRS

SEQ ID NO: 1862298 - protein, 6 aa, Staphylococcus
QRTRDQ

SEQ ID NO: 1862299 - protein, 10 aa, Staphylococcus
QRVKNEQAAY

SEQ ID NO: 1862300 - protein, 15 aa, Staphylococcus
QRWETAAKDDDVTQM

SEQ ID NO: 1862301 - protein, 4 aa, Staphylococcus
QRYS

SEQ ID NO: 1862302 - protein, 4 aa, Staphylococcus
QRYT

SEQ ID NO: 1862303 - protein, 5 aa, Staphylococcus
QRYTH

SEQ ID NO: 1862304 - protein, 10 aa, Staphylococcus
QRYTISDTQL

SEQ ID NO: 1862305 - protein, 8 aa, Staphylococcus
QSAETTIY

SEQ ID NO: 1862306 - protein, 13 aa, Staphylococcus
QSAKIEDKGTKFQ

SEQ ID NO: 1862307 - protein, 5 aa, Staphylococcus
QSASA

SEQ ID NO: 1862308 - protein, 18 aa, Staphylococcus
QSDDGITDDNTKKDIEKA

SEQ ID NO: 1862309 - protein, 5 aa, Staphylococcus
QSDDY

SEQ ID NO: 1862310 - protein, 12 aa, Staphylococcus
QSDEKRYASTKK

SEQ ID NO: 1862311 - protein, 22 aa, Staphylococcus
QSDIGPSDVLGGGASEFSPTQL

SEQ ID NO: 1862312 - protein, 6 aa, Staphylococcus
QSDKIA

SEQ ID NO: 1862313 - protein, 9 aa, Staphylococcus
QSDKSNKKI

SEQ ID NO: 1862314 - protein, 8 aa, Staphylococcus
QSEEISHG

SEQ ID NO: 1862315 - protein, 4 aa, Staphylococcus
QSEG

SEQ ID NO: 1862316 - protein, 7 aa, Staphylococcus
QSEGHTV

SEQ ID NO: 1862317 - protein, 5 aa, Staphylococcus
QSEHE

SEQ ID NO: 1862318 - protein, 5 aa, Staphylococcus
QSEKG

SEQ ID NO: 1862319 - protein, 7 aa, Staphylococcus
QSEQPRW

SEQ ID NO: 1862320 - protein, 13 aa, Staphylococcus
QSEREVKEMIKDK

SEQ ID NO: 1862321 - protein, 5 aa, Staphylococcus
QSEYD

SEQ ID NO: 1862322 - protein, 9 aa, Staphylococcus
QSEYFEDSD

SEQ ID NO: 1862323 - protein, 14 aa, Staphylococcus
QSEYFEDSNEDIRQ

SEQ ID NO: 1862324 - protein, 14 aa, Staphylococcus
QSEYFEDTDDNNRQ

SEQ ID NO: 1862325 - protein, 14 aa, Staphylococcus
QSEYFEDTTNENRQ

SEQ ID NO: 1862326 - protein, 14 aa, Staphylococcus
QSEYFENTTNQNRQ

SEQ ID NO: 1862327 - protein, 7 aa, Staphylococcus
QSFDSNI

SEQ ID NO: 1862328 - protein, 10 aa, Staphylococcus
QSFKSLKNGH

SEQ ID NO: 1862329 - protein, 13 aa, Staphylococcus
QSFQNGQGAQSMM

SEQ ID NO: 1862330 - protein, 8 aa, Staphylococcus
QSFTTKTK

SEQ ID NO: 1862331 - protein, 9 aa, Staphylococcus
QSGETADSR

SEQ ID NO: 1862332 - protein, 9 aa, Staphylococcus
QSGGMSNYA

SEQ ID NO: 1862333 - protein, 7 aa, Staphylococcus
QSGMSIS

SEQ ID NO: 1862334 - protein, 7 aa, Staphylococcus
QSGMSRA

SEQ ID NO: 1862335 - protein, 6 aa, Staphylococcus
QSGPIA

SEQ ID NO: 1862336 - protein, 6 aa, Staphylococcus
QSGSIS

SEQ ID NO: 1862337 - protein, 9 aa, Staphylococcus
QSGTDIENP

SEQ ID NO: 1862338 - protein, 9 aa, Staphylococcus
QSHDKRKAL

SEQ ID NO: 1862339 - protein, 5 aa, Staphylococcus
QSHSQ

SEQ ID NO: 1862340 - protein, 9 aa, Staphylococcus
QSHTNPKQI

SEQ ID NO: 1862341 - protein, 6 aa, Staphylococcus
QSIANE

SEQ ID NO: 1862342 - protein, 4 aa, Staphylococcus
QSIP

SEQ ID NO: 1862343 - protein, 6 aa, Staphylococcus
QSIQSN

SEQ ID NO: 1862344 - protein, 23 aa, Staphylococcus
QSIRSTEDSLNVEKTVDTEQSKE

SEQ ID NO: 1862345 - protein, 6 aa, Staphylococcus
QSKGHT

SEQ ID NO: 1862346 - protein, 6 aa, Staphylococcus
QSKGIG

SEQ ID NO: 1862347 - protein, 6 aa, Staphylococcus
QSKIGR

SEQ ID NO: 1862348 - protein, 11 aa, Staphylococcus
QSKKDKYKESF

SEQ ID NO: 1862349 - protein, 8 aa, Staphylococcus
QSKLADTL

SEQ ID NO: 1862350 - protein, 5 aa, Staphylococcus
QSKLN

SEQ ID NO: 1862351 - protein, 6 aa, Staphylococcus
QSKLSD

SEQ ID NO: 1862352 - protein, 9 aa, Staphylococcus
QSKRYSPPI

SEQ ID NO: 1862353 - protein, 11 aa, Staphylococcus
QSKSGQCGSCS

SEQ ID NO: 1862354 - protein, 5 aa, Staphylococcus
QSKVT

SEQ ID NO: 1862355 - protein, 15 aa, Staphylococcus
QSLAKDSSGQLKTQG

SEQ ID NO: 1862356 - protein, 6 aa, Staphylococcus
QSLDEI

SEQ ID NO: 1862357 - protein, 16 aa, Staphylococcus
QSLERDESGNLKKSGY

SEQ ID NO: 1862358 - protein, 14 aa, Staphylococcus
QSLESQKKSEKHLE

SEQ ID NO: 1862359 - protein, 33 aa, Staphylococcus
QSLLESGNITQEQYDNQQRDKIGKKQLDELSKK

SEQ ID NO: 1862360 - protein, 5 aa, Staphylococcus
QSLPK

SEQ ID NO: 1862361 - protein, 6 aa, Staphylococcus
QSLSGT

SEQ ID NO: 1862362 - protein, 15 aa, Staphylococcus
QSLSKDDSGNLKTQG

SEQ ID NO: 1862363 - protein, 6 aa, Staphylococcus
QSLSNL

SEQ ID NO: 1862364 - protein, 15 aa, Staphylococcus
QSLSRDDSGNLKTDG

SEQ ID NO: 1862365 - protein, 15 aa, Staphylococcus
QSLSRDQSGNLTTDG

SEQ ID NO: 1862366 - protein, 6 aa, Staphylococcus
QSLTQV

SEQ ID NO: 1862367 - protein, 14 aa, Staphylococcus
QSMGPTAVSEVNEQ

SEQ ID NO: 1862368 - protein, 13 aa, Staphylococcus
QSMGPTAVSEVTE

SEQ ID NO: 1862369 - protein, 33 aa, Staphylococcus
QSMLEDGSISQEQYDEQQRKKIGKKQLSELSKK

SEQ ID NO: 1862370 - protein, 12 aa, Staphylococcus
QSNAAMTHTSEG

SEQ ID NO: 1862371 - protein, 23 aa, Staphylococcus
QSNDEKNSLNEINNNEKVENEQK

SEQ ID NO: 1862372 - protein, 15 aa, Staphylococcus
QSNHNASKANDGSFA

SEQ ID NO: 1862373 - protein, 26 aa, Staphylococcus
QSNNQATIERKQKEEQFQKKQDEEIA

SEQ ID NO: 1862374 - protein, 9 aa, Staphylococcus
QSNQGEKLP

SEQ ID NO: 1862375 - protein, 6 aa, Staphylococcus
QSNQSI

SEQ ID NO: 1862376 - protein, 8 aa, Staphylococcus
QSNTIAES

SEQ ID NO: 1862377 - protein, 13 aa, Staphylococcus
QSNTIAESLNTQY

SEQ ID NO: 1862378 - protein, 9 aa, Staphylococcus
QSNTSGELK

SEQ ID NO: 1862379 - protein, 5 aa, Staphylococcus
QSPFS

SEQ ID NO: 1862380 - protein, 13 aa, Staphylococcus
QSPKQTEVNEGST

SEQ ID NO: 1862381 - protein, 5 aa, Staphylococcus
QSPLS

SEQ ID NO: 1862382 - protein, 4 aa, Staphylococcus
QSPN

SEQ ID NO: 1862383 - protein, 9 aa, Staphylococcus
QSPNPEGYK

SEQ ID NO: 1862384 - protein, 15 aa, Staphylococcus
QSPQVTDVSQDGSDI

SEQ ID NO: 1862385 - protein, 10 aa, Staphylococcus
QSQEEAAEIY

SEQ ID NO: 1862386 - protein, 13 aa, Staphylococcus
QSQFNASDSSAGL

SEQ ID NO: 1862387 - protein, 25 aa, Staphylococcus
QSQIDSAKNEAKQVLDSSNPTVSQV

SEQ ID NO: 1862388 - protein, 12 aa, Staphylococcus
QSQLQKTSNTLT

SEQ ID NO: 1862389 - protein, 6 aa, Staphylococcus
QSRENE

SEQ ID NO: 1862390 - protein, 7 aa, Staphylococcus
QSRMKDT

SEQ ID NO: 1862391 - protein, 7 aa, Staphylococcus
QSRMNSN

SEQ ID NO: 1862392 - protein, 5 aa, Staphylococcus
QSRNK

SEQ ID NO: 1862393 - protein, 17 aa, Staphylococcus
QSRQYDRHSIKEKAQAI

SEQ ID NO: 1862394 - protein, 16 aa, Staphylococcus
QSSDIDEQGGISPAKQ

SEQ ID NO: 1862395 - protein, 8 aa, Staphylococcus
QSSTDTNP

SEQ ID NO: 1862396 - protein, 7 aa, Staphylococcus
QSSTEVS

SEQ ID NO: 1862397 - protein, 5 aa, Staphylococcus
QSSVG

SEQ ID NO: 1862398 - protein, 4 aa, Staphylococcus
QSTE

SEQ ID NO: 1862399 - protein, 7 aa, Staphylococcus
QSTEQSL

SEQ ID NO: 1862400 - protein, 5 aa, Staphylococcus
QSTIR

SEQ ID NO: 1862401 - protein, 7 aa, Staphylococcus
QSTLGGT

SEQ ID NO: 1862402 - protein, 6 aa, Staphylococcus
QSTLGS

SEQ ID NO: 1862403 - protein, 4 aa, Staphylococcus
QSTP

SEQ ID NO: 1862404 - protein, 10 aa, Staphylococcus
QSTPIPEEPH

SEQ ID NO: 1862405 - protein, 18 aa, Staphylococcus
QSTVKESNMKKNNDAQGY

SEQ ID NO: 1862406 - protein, 9 aa, Staphylococcus
QSTYRTGVN

SEQ ID NO: 1862407 - protein, 33 aa, Staphylococcus
QSVADNNSEIQQGNYINADKDKQDAYNSAVNQA

SEQ ID NO: 1862408 - protein, 5 aa, Staphylococcus
QSVEG

SEQ ID NO: 1862409 - protein, 6 aa, Staphylococcus
QSVNSY

SEQ ID NO: 1862410 - protein, 7 aa, Staphylococcus
QSVSNAA

SEQ ID NO: 1862411 - protein, 8 aa, Staphylococcus
QSVSTSDH

SEQ ID NO: 1862412 - protein, 4 aa, Staphylococcus
QSYG

SEQ ID NO: 1862413 - protein, 5 aa, Staphylococcus
QSYKI

SEQ ID NO: 1862414 - protein, 4 aa, Staphylococcus
QSYP

SEQ ID NO: 1862415 - protein, 9 aa, Staphylococcus
QTADSKITS

SEQ ID NO: 1862416 - protein, 5 aa, Staphylococcus
QTAGA

SEQ ID NO: 1862417 - protein, 5 aa, Staphylococcus
QTAGE

SEQ ID NO: 1862418 - protein, 5 aa, Staphylococcus
QTAGS

SEQ ID NO: 1862419 - protein, 11 aa, Staphylococcus
QTAHIQSTGCD

SEQ ID NO: 1862420 - protein, 12 aa, Staphylococcus
QTAHIQSTGCDA

SEQ ID NO: 1862421 - protein, 11 aa, Staphylococcus
QTAHIQSTGCE

SEQ ID NO: 1862422 - protein, 12 aa, Staphylococcus
QTAHVQSTGCEA

SEQ ID NO: 1862423 - protein, 9 aa, Staphylococcus
QTARTVTDL

SEQ ID NO: 1862424 - protein, 7 aa, Staphylococcus
QTDAAGN

SEQ ID NO: 1862425 - protein, 8 aa, Staphylococcus
QTDKEGKY

SEQ ID NO: 1862426 - protein, 7 aa, Staphylococcus
QTDTIGP

SEQ ID NO: 1862427 - protein, 8 aa, Staphylococcus
QTDTLRSS

SEQ ID NO: 1862428 - protein, 8 aa, Staphylococcus
QTEDQGAK

SEQ ID NO: 1862429 - protein, 13 aa, Staphylococcus
QTESSGNAGVTQQ

SEQ ID NO: 1862430 - protein, 6 aa, Staphylococcus
QTETGA

SEQ ID NO: 1862431 - protein, 11 aa, Staphylococcus
QTETSNNNHSE

SEQ ID NO: 1862432 - protein, 4 aa, Staphylococcus
QTFT

SEQ ID NO: 1862433 - protein, 6 aa, Staphylococcus
QTGATN

SEQ ID NO: 1862434 - protein, 6 aa, Staphylococcus
QTGAVT

SEQ ID NO: 1862435 - protein, 4 aa, Staphylococcus
QTGF

SEQ ID NO: 1862436 - protein, 21 aa, Staphylococcus
QTGNQNKINDNIDNEANPSNI

SEQ ID NO: 1862437 - protein, 13 aa, Staphylococcus
QTGQGKTSDSEFT

SEQ ID NO: 1862438 - protein, 8 aa, Staphylococcus
QTGSSVEP

SEQ ID NO: 1862439 - protein, 8 aa, Staphylococcus
QTGTSVEP

SEQ ID NO: 1862440 - protein, 4 aa, Staphylococcus
QTGV

SEQ ID NO: 1862441 - protein, 22 aa, Staphylococcus
QTGYTKDGKAKNIDYTASKKLK

SEQ ID NO: 1862442 - protein, 23 aa, Staphylococcus
QTGYTKDGKSKKIEYTASKKLKQ

SEQ ID NO: 1862443 - protein, 11 aa, Staphylococcus
QTHKKANAKRI

SEQ ID NO: 1862444 - protein, 8 aa, Staphylococcus
QTHPEDKR

SEQ ID NO: 1862445 - protein, 5 aa, Staphylococcus
QTHTF

SEQ ID NO: 1862446 - protein, 7 aa, Staphylococcus
QTINSPN

SEQ ID NO: 1862447 - protein, 4 aa, Staphylococcus
QTIP

SEQ ID NO: 1862448 - protein, 8 aa, Staphylococcus
QTISLTGP

SEQ ID NO: 1862449 - protein, 7 aa, Staphylococcus
QTKKEYR

SEQ ID NO: 1862450 - protein, 16 aa, Staphylococcus
QTKKPTVTHATSSNMT

SEQ ID NO: 1862451 - protein, 9 aa, Staphylococcus
QTKLNSETT

SEQ ID NO: 1862452 - protein, 8 aa, Staphylococcus
QTKNGNTV

SEQ ID NO: 1862453 - protein, 10 aa, Staphylococcus
QTKNTEARLY

SEQ ID NO: 1862454 - protein, 12 aa, Staphylococcus
QTLKQASHEVTP

SEQ ID NO: 1862455 - protein, 6 aa, Staphylococcus
QTLPGH

SEQ ID NO: 1862456 - protein, 12 aa, Staphylococcus
QTLQQLNGSNIK

SEQ ID NO: 1862457 - protein, 16 aa, Staphylococcus
QTLRQSASKIKARQKN

SEQ ID NO: 1862458 - protein, 17 aa, Staphylococcus
QTLRSTNSSILNTQDVG

SEQ ID NO: 1862459 - protein, 7 aa, Staphylococcus
QTLTNNE

SEQ ID NO: 1862460 - protein, 4 aa, Staphylococcus
QTMT

SEQ ID NO: 1862461 - protein, 5 aa, Staphylococcus
QTMTR

SEQ ID NO: 1862462 - protein, 10 aa, Staphylococcus
QTNASSSLDI

SEQ ID NO: 1862463 - protein, 5 aa, Staphylococcus
QTNEI

SEQ ID NO: 1862464 - protein, 5 aa, Staphylococcus
QTNIT

SEQ ID NO: 1862465 - protein, 8 aa, Staphylococcus
QTNKTKDT

SEQ ID NO: 1862466 - protein, 13 aa, Staphylococcus
QTNSVSRQLSAGQ

SEQ ID NO: 1862467 - protein, 8 aa, Staphylococcus
QTPALQKE

SEQ ID NO: 1862468 - protein, 10 aa, Staphylococcus
QTPALQKETE

SEQ ID NO: 1862469 - protein, 6 aa, Staphylococcus
QTPGRY

SEQ ID NO: 1862470 - protein, 4 aa, Staphylococcus
QTPI

SEQ ID NO: 1862471 - protein, 15 aa, Staphylococcus
QTPINQTRQDEIGTL

SEQ ID NO: 1862472 - protein, 9 aa, Staphylococcus
QTPKLDTSS

SEQ ID NO: 1862473 - protein, 4 aa, Staphylococcus
QTQA

SEQ ID NO: 1862474 - protein, 7 aa, Staphylococcus
QTQAKYK

SEQ ID NO: 1862475 - protein, 11 aa, Staphylococcus
QTQKSRLGVPE

SEQ ID NO: 1862476 - protein, 11 aa, Staphylococcus
QTQLDNSQIEI

SEQ ID NO: 1862477 - protein, 16 aa, Staphylococcus
QTQLSNLKSNNKEVRK

SEQ ID NO: 1862478 - protein, 9 aa, Staphylococcus
QTQSKGDKM

SEQ ID NO: 1862479 - protein, 9 aa, Staphylococcus
QTQTQRLGV

SEQ ID NO: 1862480 - protein, 10 aa, Staphylococcus
QTQTQRLGVP

SEQ ID NO: 1862481 - protein, 7 aa, Staphylococcus
QTRAGEN

SEQ ID NO: 1862482 - protein, 7 aa, Staphylococcus
QTRDGQD

SEQ ID NO: 1862483 - protein, 8 aa, Staphylococcus
QTRQDDTY

SEQ ID NO: 1862484 - protein, 5 aa, Staphylococcus
QTRQS

SEQ ID NO: 1862485 - protein, 7 aa, Staphylococcus
QTRSGQD

SEQ ID NO: 1862486 - protein, 27 aa, Staphylococcus
QTSGIDDDMSSDKEDELPKSKDNLKSH

SEQ ID NO: 1862487 - protein, 24 aa, Staphylococcus
QTSGIPGDITDNDKITKKTDSLDG

SEQ ID NO: 1862488 - protein, 23 aa, Staphylococcus
QTSGISGDITNDDNITKDTNSLE

SEQ ID NO: 1862489 - protein, 14 aa, Staphylococcus
QTSKKEGVSKKQSY

SEQ ID NO: 1862490 - protein, 4 aa, Staphylococcus
QTSM

SEQ ID NO: 1862491 - protein, 17 aa, Staphylococcus
QTTGSGNKDSKGYDTYT

SEQ ID NO: 1862492 - protein, 18 aa, Staphylococcus
QTTIKTKEAIDKKAEYLT

SEQ ID NO: 1862493 - protein, 9 aa, Staphylococcus
QTTKEFKDG

SEQ ID NO: 1862494 - protein, 10 aa, Staphylococcus
QTTKEYKDGS

SEQ ID NO: 1862495 - protein, 14 aa, Staphylococcus
QTTMKGTDSDSSLD

SEQ ID NO: 1862496 - protein, 5 aa, Staphylococcus
QTTPR

SEQ ID NO: 1862497 - protein, 15 aa, Staphylococcus
QTTQPTMSNDEIENT

SEQ ID NO: 1862498 - protein, 9 aa, Staphylococcus
QTTRELKDG

SEQ ID NO: 1862499 - protein, 31 aa, Staphylococcus
QTTVSTDGMTAQSTQNFNNKHQAAEQAIQNA

SEQ ID NO: 1862500 - protein, 4 aa, Staphylococcus
QTVK

SEQ ID NO: 1862501 - protein, 5 aa, Staphylococcus
QTVVG

SEQ ID NO: 1862502 - protein, 53 aa, Staphylococcus
QTYDNKDKVKWTGKANSEHPAPTLEVEKNANAVTVKGDNTKKDEKSQSSSGGS

SEQ ID NO: 1862503 - protein, 10 aa, Staphylococcus
QTYQSNHSRY

SEQ ID NO: 1862504 - protein, 19 aa, Staphylococcus
QVAGTEQSNGTEASDVPSK

SEQ ID NO: 1862505 - protein, 13 aa, Staphylococcus
QVAIGASQKEVAE

SEQ ID NO: 1862506 - protein, 4 aa, Staphylococcus
QVDD

SEQ ID NO: 1862507 - protein, 5 aa, Staphylococcus
QVDIK

SEQ ID NO: 1862508 - protein, 4 aa, Staphylococcus
QVDP

SEQ ID NO: 1862509 - protein, 10 aa, Staphylococcus
QVDSERFTKN

SEQ ID NO: 1862510 - protein, 6 aa, Staphylococcus
QVDVKN

SEQ ID NO: 1862511 - protein, 5 aa, Staphylococcus
QVEEK

SEQ ID NO: 1862512 - protein, 12 aa, Staphylococcus
QVEEKPKEENYS

SEQ ID NO: 1862513 - protein, 4 aa, Staphylococcus
QVEK

SEQ ID NO: 1862514 - protein, 7 aa, Staphylococcus
QVGNDTA

SEQ ID NO: 1862515 - protein, 9 aa, Staphylococcus
QVGTDSNIA

SEQ ID NO: 1862516 - protein, 22 aa, Staphylococcus
QVIGPQKGSKPRQILVDLDSDE

SEQ ID NO: 1862517 - protein, 22 aa, Staphylococcus
QVIGPQKGSKPRQVLIDLDNDE

SEQ ID NO: 1862518 - protein, 23 aa, Staphylococcus
QVITNGDATAQQISAEKDKVEQA

SEQ ID NO: 1862519 - protein, 15 aa, Staphylococcus
QVKQQAIKSKNTLDF

SEQ ID NO: 1862520 - protein, 12 aa, Staphylococcus
QVKSDQTEYQAN

SEQ ID NO: 1862521 - protein, 5 aa, Staphylococcus
QVKST

SEQ ID NO: 1862522 - protein, 8 aa, Staphylococcus
QVKTKPGF

SEQ ID NO: 1862523 - protein, 7 aa, Staphylococcus
QVNDASP

SEQ ID NO: 1862524 - protein, 5 aa, Staphylococcus
QVNDS

SEQ ID NO: 1862525 - protein, 31 aa, Staphylococcus
QVNPGSSFTGSQAAQKAIDTVTKTMQNNVRE

SEQ ID NO: 1862526 - protein, 22 aa, Staphylococcus
QVNQADTNAQVDQAQQNGDHNI

SEQ ID NO: 1862527 - protein, 6 aa, Staphylococcus
QVNRAG

SEQ ID NO: 1862528 - protein, 6 aa, Staphylococcus
QVNSET

SEQ ID NO: 1862529 - protein, 29 aa, Staphylococcus
QVPSTEGMTEQSIANYNAKKQAAQTELQK

SEQ ID NO: 1862530 - protein, 4 aa, Staphylococcus
QVQP

SEQ ID NO: 1862531 - protein, 5 aa, Staphylococcus
QVQSG

SEQ ID NO: 1862532 - protein, 14 aa, Staphylococcus
QVRSTSGKTGREVA

SEQ ID NO: 1862533 - protein, 21 aa, Staphylococcus
QVSAGDERASISKTNGKDAVN

SEQ ID NO: 1862534 - protein, 16 aa, Staphylococcus
QVSNAQIKATEDKLGL

SEQ ID NO: 1862535 - protein, 17 aa, Staphylococcus
QVSSNAGKDAPKDFASK

SEQ ID NO: 1862536 - protein, 27 aa, Staphylococcus
QVSTSSYDVPQAGQIVSNNDVKSMNSA

SEQ ID NO: 1862537 - protein, 10 aa, Staphylococcus
QVTGEGTHSE

SEQ ID NO: 1862538 - protein, 10 aa, Staphylococcus
QVTGKGTHGE

SEQ ID NO: 1862539 - protein, 10 aa, Staphylococcus
QVTGKGTHSE

SEQ ID NO: 1862540 - protein, 9 aa, Staphylococcus
QVTKDYPPT

SEQ ID NO: 1862541 - protein, 11 aa, Staphylococcus
QVTNRSKQTSV

SEQ ID NO: 1862542 - protein, 5 aa, Staphylococcus
QVTSG

SEQ ID NO: 1862543 - protein, 4 aa, Staphylococcus
QWGR

SEQ ID NO: 1862544 - protein, 31 aa, Staphylococcus
QWNPVSNDEPSVNHTQTKKDLAGGQRYTVKD

SEQ ID NO: 1862545 - protein, 4 aa, Staphylococcus
QYAT

SEQ ID NO: 1862546 - protein, 57 aa, Staphylococcus
QYDDQYQQRNQKSREYQQRQQGRQSEENYRRNEPRQEYHHQNQGDYDEKGNRYYNDR

SEQ ID NO: 1862547 - protein, 7 aa, Staphylococcus
QYDQLKG

SEQ ID NO: 1862548 - protein, 6 aa, Staphylococcus
QYDQTN

SEQ ID NO: 1862549 - protein, 5 aa, Staphylococcus
QYDRK

SEQ ID NO: 1862550 - protein, 11 aa, Staphylococcus
QYDRQHSREIK

SEQ ID NO: 1862551 - protein, 8 aa, Staphylococcus
QYDTKYGK

SEQ ID NO: 1862552 - protein, 7 aa, Staphylococcus
QYDTYSP

SEQ ID NO: 1862553 - protein, 6 aa, Staphylococcus
QYDTYT

SEQ ID NO: 1862554 - protein, 10 aa, Staphylococcus
QYEDAQAKEQ

SEQ ID NO: 1862555 - protein, 11 aa, Staphylococcus
QYEEGYYSRRE

SEQ ID NO: 1862556 - protein, 6 aa, Staphylococcus
QYEQGF

SEQ ID NO: 1862557 - protein, 6 aa, Staphylococcus
QYERGI

SEQ ID NO: 1862558 - protein, 8 aa, Staphylococcus
QYGPPTVQ

SEQ ID NO: 1862559 - protein, 4 aa, Staphylococcus
QYGV

SEQ ID NO: 1862560 - protein, 26 aa, Staphylococcus
QYHRDEDERRYQDDTHRSTYTSESHV

SEQ ID NO: 1862561 - protein, 5 aa, Staphylococcus
QYKEI

SEQ ID NO: 1862562 - protein, 13 aa, Staphylococcus
QYKHAEKKENPYI

SEQ ID NO: 1862563 - protein, 5 aa, Staphylococcus
QYKSD

SEQ ID NO: 1862564 - protein, 5 aa, Staphylococcus
QYNDG

SEQ ID NO: 1862565 - protein, 4 aa, Staphylococcus
QYNE

SEQ ID NO: 1862566 - protein, 10 aa, Staphylococcus
QYNEEKGAKL

SEQ ID NO: 1862567 - protein, 5 aa, Staphylococcus
QYPRP

SEQ ID NO: 1862568 - protein, 9 aa, Staphylococcus
QYPYRGHSD

SEQ ID NO: 1862569 - protein, 24 aa, Staphylococcus
QYQSNQELTSSKACHTNKGSRAYT

SEQ ID NO: 1862570 - protein, 10 aa, Staphylococcus
QYRQQIEEKN

SEQ ID NO: 1862571 - protein, 6 aa, Staphylococcus
QYRTSY

SEQ ID NO: 1862572 - protein, 15 aa, Staphylococcus
QYSEKTAKQRLSKHE

SEQ ID NO: 1862573 - protein, 7 aa, Staphylococcus
QYTETQN

SEQ ID NO: 1862574 - protein, 12 aa, Staphylococcus
QYTGKDDDSQEV

SEQ ID NO: 1862575 - protein, 5 aa, Staphylococcus
QYTGY

SEQ ID NO: 1862576 - protein, 6 aa, Staphylococcus
QYTIEG

SEQ ID NO: 1862577 - protein, 6 aa, Staphylococcus
QYTLEG

SEQ ID NO: 1862578 - protein, 15 aa, Staphylococcus
QYTVPSDKVPNTIEK

SEQ ID NO: 1862579 - protein, 10 aa, Staphylococcus
QYVPDQSTAD

SEQ ID NO: 1862580 - protein, 12 aa, Staphylococcus
RAAAKKELIDII

SEQ ID NO: 1862581 - protein, 13 aa, Staphylococcus
RAAGLSTESPTGK

SEQ ID NO: 1862582 - protein, 11 aa, Staphylococcus
RAANKTTANRQ

SEQ ID NO: 1862583 - protein, 12 aa, Staphylococcus
RAASKKELIDII

SEQ ID NO: 1862584 - protein, 8 aa, Staphylococcus
RADGESKW

SEQ ID NO: 1862585 - protein, 8 aa, Staphylococcus
RADKKAVS

SEQ ID NO: 1862586 - protein, 9 aa, Staphylococcus
RADNKQKAI

SEQ ID NO: 1862587 - protein, 7 aa, Staphylococcus
RAEDSIT

SEQ ID NO: 1862588 - protein, 44 aa, Staphylococcus
RAEKQAIRNEAASHDLADVSPKAQEEVSGDSNASTDSKDDVSAT

SEQ ID NO: 1862589 - protein, 17 aa, Staphylococcus
RAEVDKENQVKTESKYI

SEQ ID NO: 1862590 - protein, 14 aa, Staphylococcus
RAFNTGSKVRLSGQ

SEQ ID NO: 1862591 - protein, 8 aa, Staphylococcus
RAGLNGEP

SEQ ID NO: 1862592 - protein, 19 aa, Staphylococcus
RAGSGNTESSSTNTVAAPP

SEQ ID NO: 1862593 - protein, 8 aa, Staphylococcus
RAGSRGVG

SEQ ID NO: 1862594 - protein, 5 aa, Staphylococcus
RAGVE

SEQ ID NO: 1862595 - protein, 12 aa, Staphylococcus
RAGYRTGHKPKR

SEQ ID NO: 1862596 - protein, 12 aa, Staphylococcus
RAHAAGKASTLG

SEQ ID NO: 1862597 - protein, 6 aa, Staphylococcus
RAIKNK

SEQ ID NO: 1862598 - protein, 28 aa, Staphylococcus
RAIQDESSYSIDGGTFRNYDGNGHGTVT

SEQ ID NO: 1862599 - protein, 18 aa, Staphylococcus
RAIQSGTLKEAYSSEEIG

SEQ ID NO: 1862600 - protein, 20 aa, Staphylococcus
RAKEISEKQHAQQEHKTSVG

SEQ ID NO: 1862601 - protein, 13 aa, Staphylococcus
RAKNKEAYYSGIH

SEQ ID NO: 1862602 - protein, 7 aa, Staphylococcus
RAKNNTF

SEQ ID NO: 1862603 - protein, 11 aa, Staphylococcus
RAKSQNERQQS

SEQ ID NO: 1862604 - protein, 30 aa, Staphylococcus
RALDEEKEEKKKKAKQSSSHSKSKKEEIKD

SEQ ID NO: 1862605 - protein, 7 aa, Staphylococcus
RALDSEM

SEQ ID NO: 1862606 - protein, 9 aa, Staphylococcus
RALEDGGTL

SEQ ID NO: 1862607 - protein, 9 aa, Staphylococcus
RALGDSKTP

SEQ ID NO: 1862608 - protein, 11 aa, Staphylococcus
RALNDNDKSLK

SEQ ID NO: 1862609 - protein, 10 aa, Staphylococcus
RALRRKRQKR

SEQ ID NO: 1862610 - protein, 9 aa, Staphylococcus
RANEGLDKF

SEQ ID NO: 1862611 - protein, 6 aa, Staphylococcus
RANEPW

SEQ ID NO: 1862612 - protein, 8 aa, Staphylococcus
RANEPWKE

SEQ ID NO: 1862613 - protein, 4 aa, Staphylococcus
RANG

SEQ ID NO: 1862614 - protein, 12 aa, Staphylococcus
RANIQPKRPLTA

SEQ ID NO: 1862615 - protein, 5 aa, Staphylococcus
RANQP

SEQ ID NO: 1862616 - protein, 5 aa, Staphylococcus
RANVS

SEQ ID NO: 1862617 - protein, 5 aa, Staphylococcus
RAQIA

SEQ ID NO: 1862618 - protein, 22 aa, Staphylococcus
RAQKDNKKKEQKELDKMISKDL

SEQ ID NO: 1862619 - protein, 5 aa, Staphylococcus
RAQLS

SEQ ID NO: 1862620 - protein, 10 aa, Staphylococcus
RAQNDKANAL

SEQ ID NO: 1862621 - protein, 11 aa, Staphylococcus
RAQSLTGKVNT

SEQ ID NO: 1862622 - protein, 14 aa, Staphylococcus
RARTSATSANLDRH

SEQ ID NO: 1862623 - protein, 29 aa, Staphylococcus
RARYEEAKEWESTKYYSSDSEENKNTQKG

SEQ ID NO: 1862624 - protein, 6 aa, Staphylococcus
RASRRS

SEQ ID NO: 1862625 - protein, 16 aa, Staphylococcus
RATDGAETPNSIDSDH

SEQ ID NO: 1862626 - protein, 11 aa, Staphylococcus
RATDNSGEVVT

SEQ ID NO: 1862627 - protein, 20 aa, Staphylococcus
RATDNSGQAVTNKVSGLPQG

SEQ ID NO: 1862628 - protein, 20 aa, Staphylococcus
RATDNSGQAVTNTVRGLPEG

SEQ ID NO: 1862629 - protein, 22 aa, Staphylococcus
RATDNSGQPVTTKVSGLPEGVT

SEQ ID NO: 1862630 - protein, 11 aa, Staphylococcus
RATDNSGQVVT

SEQ ID NO: 1862631 - protein, 8 aa, Staphylococcus
RATKDGCH

SEQ ID NO: 1862632 - protein, 12 aa, Staphylococcus
RATKKAAAKQAI

SEQ ID NO: 1862633 - protein, 6 aa, Staphylococcus
RATNAK

SEQ ID NO: 1862634 - protein, 5 aa, Staphylococcus
RATSA

SEQ ID NO: 1862635 - protein, 13 aa, Staphylococcus
RAVDDSKRTNSKI

SEQ ID NO: 1862636 - protein, 7 aa, Staphylococcus
RAVGASQ

SEQ ID NO: 1862637 - protein, 15 aa, Staphylococcus
RAVPSSVREASYGLG

SEQ ID NO: 1862638 - protein, 13 aa, Staphylococcus
RAVTQNADQPIGE

SEQ ID NO: 1862639 - protein, 19 aa, Staphylococcus
RAYDKRSKKEKRKETEKNL

SEQ ID NO: 1862640 - protein, 6 aa, Staphylococcus
RCCSNP

SEQ ID NO: 1862641 - protein, 10 aa, Staphylococcus
RDAGQNKSIP

SEQ ID NO: 1862642 - protein, 12 aa, Staphylococcus
RDANTQDQQPKA

SEQ ID NO: 1862643 - protein, 8 aa, Staphylococcus
RDAQKQPF

SEQ ID NO: 1862644 - protein, 8 aa, Staphylococcus
RDDAVSPH

SEQ ID NO: 1862645 - protein, 12 aa, Staphylococcus
RDDDMPGLKSYF

SEQ ID NO: 1862646 - protein, 12 aa, Staphylococcus
RDDITDDQKVQY

SEQ ID NO: 1862647 - protein, 11 aa, Staphylococcus
RDDPSNAQKEV

SEQ ID NO: 1862648 - protein, 16 aa, Staphylococcus
RDDRRVNQQYGKNRQI

SEQ ID NO: 1862649 - protein, 7 aa, Staphylococcus
RDEAQRL

SEQ ID NO: 1862650 - protein, 5 aa, Staphylococcus
RDEGS

SEQ ID NO: 1862651 - protein, 11 aa, Staphylococcus
RDEHRKPADIK

SEQ ID NO: 1862652 - protein, 9 aa, Staphylococcus
RDEHRKRSQ

SEQ ID NO: 1862653 - protein, 10 aa, Staphylococcus
RDEHRKSKQV

SEQ ID NO: 1862654 - protein, 8 aa, Staphylococcus
RDEHRTKV

SEQ ID NO: 1862655 - protein, 11 aa, Staphylococcus
RDEKRKEQYSF

SEQ ID NO: 1862656 - protein, 9 aa, Staphylococcus
RDELTGQAS

SEQ ID NO: 1862657 - protein, 6 aa, Staphylococcus
RDENER

SEQ ID NO: 1862658 - protein, 8 aa, Staphylococcus
RDEPMSPS

SEQ ID NO: 1862659 - protein, 9 aa, Staphylococcus
RDETRGKQM

SEQ ID NO: 1862660 - protein, 10 aa, Staphylococcus
RDFESYNNNQ

SEQ ID NO: 1862661 - protein, 12 aa, Staphylococcus
RDGALNEIESER

SEQ ID NO: 1862662 - protein, 8 aa, Staphylococcus
RDGEDQVV

SEQ ID NO: 1862663 - protein, 6 aa, Staphylococcus
RDGEGA

SEQ ID NO: 1862664 - protein, 12 aa, Staphylococcus
RDGELKEVKIKL

SEQ ID NO: 1862665 - protein, 14 aa, Staphylococcus
RDGINNKDEVRHSS

SEQ ID NO: 1862666 - protein, 15 aa, Staphylococcus
RDGKAALDFVQQQFE

SEQ ID NO: 1862667 - protein, 11 aa, Staphylococcus
RDGKTKDVSVT

SEQ ID NO: 1862668 - protein, 5 aa, Staphylococcus
RDGLI

SEQ ID NO: 1862669 - protein, 15 aa, Staphylococcus
RDGQAALAFVQKQFE

SEQ ID NO: 1862670 - protein, 11 aa, Staphylococcus
RDGRLTHGYGT

SEQ ID NO: 1862671 - protein, 24 aa, Staphylococcus
RDGRTPNLTTSVQRGQDQNKPGSW

SEQ ID NO: 1862672 - protein, 29 aa, Staphylococcus
RDHHSKTMQLEPKKVENKISKNKKQTSYQ

SEQ ID NO: 1862673 - protein, 18 aa, Staphylococcus
RDIESATNINEISERKKQ

SEQ ID NO: 1862674 - protein, 6 aa, Staphylococcus
RDIGQG

SEQ ID NO: 1862675 - protein, 4 aa, Staphylococcus
RDIP

SEQ ID NO: 1862676 - protein, 4 aa, Staphylococcus
RDIS

SEQ ID NO: 1862677 - protein, 8 aa, Staphylococcus
RDISGDPI

SEQ ID NO: 1862678 - protein, 9 aa, Staphylococcus
RDISGDPIS

SEQ ID NO: 1862679 - protein, 9 aa, Staphylococcus
RDISGDPIT

SEQ ID NO: 1862680 - protein, 8 aa, Staphylococcus
RDISGDPM

SEQ ID NO: 1862681 - protein, 8 aa, Staphylococcus
RDISGEPV

SEQ ID NO: 1862682 - protein, 6 aa, Staphylococcus
RDISQG

SEQ ID NO: 1862683 - protein, 8 aa, Staphylococcus
RDKDTSAM

SEQ ID NO: 1862684 - protein, 6 aa, Staphylococcus
RDKGFT

SEQ ID NO: 1862685 - protein, 31 aa, Staphylococcus
RDKKDDKDESHSDNKQQNESTNENSNADNND

SEQ ID NO: 1862686 - protein, 8 aa, Staphylococcus
RDKPKPAQ

SEQ ID NO: 1862687 - protein, 10 aa, Staphylococcus
RDKPMSPSSW

SEQ ID NO: 1862688 - protein, 15 aa, Staphylococcus
RDKQNSYFLKALKEY

SEQ ID NO: 1862689 - protein, 9 aa, Staphylococcus
RDKQSKCGH

SEQ ID NO: 1862690 - protein, 18 aa, Staphylococcus
RDKTNEKEEKQEKKKYKS

SEQ ID NO: 1862691 - protein, 4 aa, Staphylococcus
RDKV

SEQ ID NO: 1862692 - protein, 9 aa, Staphylococcus
RDLGANESQ

SEQ ID NO: 1862693 - protein, 6 aa, Staphylococcus
RDLSDF

SEQ ID NO: 1862694 - protein, 10 aa, Staphylococcus
RDNGSGIDDD

SEQ ID NO: 1862695 - protein, 12 aa, Staphylococcus
RDNISDDQKVQY

SEQ ID NO: 1862696 - protein, 27 aa, Staphylococcus
RDNQSVKNATIDAKEPTGTNSELEREI

SEQ ID NO: 1862697 - protein, 7 aa, Staphylococcus
RDQHNNL

SEQ ID NO: 1862698 - protein, 7 aa, Staphylococcus
RDQTPVG

SEQ ID NO: 1862699 - protein, 12 aa, Staphylococcus
RDRIGEKQSRKV

SEQ ID NO: 1862700 - protein, 5 aa, Staphylococcus
RDRQF

SEQ ID NO: 1862701 - protein, 13 aa, Staphylococcus
RDRVKDKQSGRKT

SEQ ID NO: 1862702 - protein, 13 aa, Staphylococcus
RDRVKDQASGRKT

SEQ ID NO: 1862703 - protein, 16 aa, Staphylococcus
RDSIADANDIKQTSNY

SEQ ID NO: 1862704 - protein, 7 aa, Staphylococcus
RDSSLPF

SEQ ID NO: 1862705 - protein, 7 aa, Staphylococcus
RDSSLSF

SEQ ID NO: 1862706 - protein, 6 aa, Staphylococcus
RDSSLT

SEQ ID NO: 1862707 - protein, 4 aa, Staphylococcus
RDTG

SEQ ID NO: 1862708 - protein, 6 aa, Staphylococcus
RDTLKE

SEQ ID NO: 1862709 - protein, 16 aa, Staphylococcus
RDTQKIRDALGSSLKP

SEQ ID NO: 1862710 - protein, 7 aa, Staphylococcus
RDVSSPD

SEQ ID NO: 1862711 - protein, 12 aa, Staphylococcus
RDYAEQNVEHRN

SEQ ID NO: 1862712 - protein, 8 aa, Staphylococcus
RDYKRGTG

SEQ ID NO: 1862713 - protein, 14 aa, Staphylococcus
RDYNGSNITGIASA

SEQ ID NO: 1862714 - protein, 11 aa, Staphylococcus
RDYNQRQNEPH

SEQ ID NO: 1862715 - protein, 4 aa, Staphylococcus
RDYT

SEQ ID NO: 1862716 - protein, 5 aa, Staphylococcus
READT

SEQ ID NO: 1862717 - protein, 9 aa, Staphylococcus
REAEATTAI

SEQ ID NO: 1862718 - protein, 6 aa, Staphylococcus
REAGAD

SEQ ID NO: 1862719 - protein, 15 aa, Staphylococcus
REAINQSSSRNRAKF

SEQ ID NO: 1862720 - protein, 20 aa, Staphylococcus
REANNIQGNDIHNGQRLVIP

SEQ ID NO: 1862721 - protein, 6 aa, Staphylococcus
REDAKE

SEQ ID NO: 1862722 - protein, 12 aa, Staphylococcus
REDKGEYRGGPA

SEQ ID NO: 1862723 - protein, 10 aa, Staphylococcus
REDNQTKNLK

SEQ ID NO: 1862724 - protein, 5 aa, Staphylococcus
REDVY

SEQ ID NO: 1862725 - protein, 6 aa, Staphylococcus
REEAEA

SEQ ID NO: 1862726 - protein, 10 aa, Staphylococcus
REEEAAADKL

SEQ ID NO: 1862727 - protein, 9 aa, Staphylococcus
REEHRENKH

SEQ ID NO: 1862728 - protein, 11 aa, Staphylococcus
REEIPNSQSQL

SEQ ID NO: 1862729 - protein, 12 aa, Staphylococcus
REEKGEYRGGPA

SEQ ID NO: 1862730 - protein, 10 aa, Staphylococcus
REEKGQFNNV

SEQ ID NO: 1862731 - protein, 12 aa, Staphylococcus
REESDIKQSEIE

SEQ ID NO: 1862732 - protein, 4 aa, Staphylococcus
REET

SEQ ID NO: 1862733 - protein, 6 aa, Staphylococcus
REEYLG

SEQ ID NO: 1862734 - protein, 13 aa, Staphylococcus
REFGSGNTGATNS

SEQ ID NO: 1862735 - protein, 5 aa, Staphylococcus
REGAN

SEQ ID NO: 1862736 - protein, 6 aa, Staphylococcus
REGGAD

SEQ ID NO: 1862737 - protein, 7 aa, Staphylococcus
REGKDYL

SEQ ID NO: 1862738 - protein, 8 aa, Staphylococcus
REGKKKID

SEQ ID NO: 1862739 - protein, 7 aa, Staphylococcus
REGLGEA

SEQ ID NO: 1862740 - protein, 5 aa, Staphylococcus
REGNL

SEQ ID NO: 1862741 - protein, 11 aa, Staphylococcus
REGQSTTGIGE

SEQ ID NO: 1862742 - protein, 7 aa, Staphylococcus
REHAKGK

SEQ ID NO: 1862743 - protein, 12 aa, Staphylococcus
REHEIEASKAMD

SEQ ID NO: 1862744 - protein, 16 aa, Staphylococcus
REHVGYDDNNRVKKEI

SEQ ID NO: 1862745 - protein, 10 aa, Staphylococcus
REISNNTEDI

SEQ ID NO: 1862746 - protein, 16 aa, Staphylococcus
REKDVQSHIGQTESYK

SEQ ID NO: 1862747 - protein, 6 aa, Staphylococcus
REKEVD

SEQ ID NO: 1862748 - protein, 6 aa, Staphylococcus
REKGWS

SEQ ID NO: 1862749 - protein, 5 aa, Staphylococcus
REKLR

SEQ ID NO: 1862750 - protein, 6 aa, Staphylococcus
REKPTW

SEQ ID NO: 1862751 - protein, 12 aa, Staphylococcus
REKYYSPNGKYR

SEQ ID NO: 1862752 - protein, 12 aa, Staphylococcus
RELEEQQRKDEV

SEQ ID NO: 1862753 - protein, 11 aa, Staphylococcus
RELGPDKSTAY

SEQ ID NO: 1862754 - protein, 13 aa, Staphylococcus
RENINYNEIVWAS

SEQ ID NO: 1862755 - protein, 10 aa, Staphylococcus
RENKKSGQPA

SEQ ID NO: 1862756 - protein, 6 aa, Staphylococcus
RENRQI

SEQ ID NO: 1862757 - protein, 21 aa, Staphylococcus
RENSNNTLLPPVDTGESIGLD

SEQ ID NO: 1862758 - protein, 8 aa, Staphylococcus
REPDMERP

SEQ ID NO: 1862759 - protein, 6 aa, Staphylococcus
REPDND

SEQ ID NO: 1862760 - protein, 7 aa, Staphylococcus
REPTDTI

SEQ ID NO: 1862761 - protein, 5 aa, Staphylococcus
REPTE

SEQ ID NO: 1862762 - protein, 12 aa, Staphylococcus
REQRAESREHRG

SEQ ID NO: 1862763 - protein, 4 aa, Staphylococcus
RERL

SEQ ID NO: 1862764 - protein, 4 aa, Staphylococcus
RESG

SEQ ID NO: 1862765 - protein, 8 aa, Staphylococcus
RESGISRG

SEQ ID NO: 1862766 - protein, 11 aa, Staphylococcus
RESKSVSTLKS

SEQ ID NO: 1862767 - protein, 11 aa, Staphylococcus
RESLPQSAHES

SEQ ID NO: 1862768 - protein, 10 aa, Staphylococcus
RESTYGSRQQ

SEQ ID NO: 1862769 - protein, 5 aa, Staphylococcus
RETEF

SEQ ID NO: 1862770 - protein, 8 aa, Staphylococcus
RETSYPNE

SEQ ID NO: 1862771 - protein, 4 aa, Staphylococcus
RETV

SEQ ID NO: 1862772 - protein, 18 aa, Staphylococcus
REVGQLPAKLDRAEKEVY

SEQ ID NO: 1862773 - protein, 10 aa, Staphylococcus
REVPKETLTS

SEQ ID NO: 1862774 - protein, 21 aa, Staphylococcus
REVSDNNLADQSPEAREIQEA

SEQ ID NO: 1862775 - protein, 20 aa, Staphylococcus
REVSDNNLSDQSPEAQEIQE

SEQ ID NO: 1862776 - protein, 8 aa, Staphylococcus
REVSNPDL

SEQ ID NO: 1862777 - protein, 12 aa, Staphylococcus
REYRKKKEFLKK

SEQ ID NO: 1862778 - protein, 9 aa, Staphylococcus
RFASGTKKK

SEQ ID NO: 1862779 - protein, 8 aa, Staphylococcus
RFNKQHQS

SEQ ID NO: 1862780 - protein, 11 aa, Staphylococcus
RFQEVPKDDRT

SEQ ID NO: 1862781 - protein, 6 aa, Staphylococcus
RFSKKS

SEQ ID NO: 1862782 - protein, 5 aa, Staphylococcus
RFSPE

SEQ ID NO: 1862783 - protein, 5 aa, Staphylococcus
RFSPR

SEQ ID NO: 1862784 - protein, 5 aa, Staphylococcus
RFTSR

SEQ ID NO: 1862785 - protein, 6 aa, Staphylococcus
RGAATG

SEQ ID NO: 1862786 - protein, 8 aa, Staphylococcus
RGAATGAA

SEQ ID NO: 1862787 - protein, 7 aa, Staphylococcus
RGAATGI

SEQ ID NO: 1862788 - protein, 11 aa, Staphylococcus
RGASGYAPEHT

SEQ ID NO: 1862789 - protein, 13 aa, Staphylococcus
RGATTITGEGQLE

SEQ ID NO: 1862790 - protein, 6 aa, Staphylococcus
RGDDKW

SEQ ID NO: 1862791 - protein, 13 aa, Staphylococcus
RGDDVKGIEGSKA

SEQ ID NO: 1862792 - protein, 6 aa, Staphylococcus
RGDGVD

SEQ ID NO: 1862793 - protein, 7 aa, Staphylococcus
RGDINPA

SEQ ID NO: 1862794 - protein, 9 aa, Staphylococcus
RGDLKQNLS

SEQ ID NO: 1862795 - protein, 20 aa, Staphylococcus
RGDRSGNKEENEEKLSPGKA

SEQ ID NO: 1862796 - protein, 9 aa, Staphylococcus
RGDTATNIQ

SEQ ID NO: 1862797 - protein, 4 aa, Staphylococcus
RGEE

SEQ ID NO: 1862798 - protein, 4 aa, Staphylococcus
RGET

SEQ ID NO: 1862799 - protein, 6 aa, Staphylococcus
RGETLG

SEQ ID NO: 1862800 - protein, 7 aa, Staphylococcus
RGGKAYV

SEQ ID NO: 1862801 - protein, 10 aa, Staphylococcus
RGHPDSNYTV

SEQ ID NO: 1862802 - protein, 5 aa, Staphylococcus
RGHVA

SEQ ID NO: 1862803 - protein, 4 aa, Staphylococcus
RGIS

SEQ ID NO: 1862804 - protein, 12 aa, Staphylococcus
RGITGSNGHVNI

SEQ ID NO: 1862805 - protein, 9 aa, Staphylococcus
RGKAGQKPE

SEQ ID NO: 1862806 - protein, 9 aa, Staphylococcus
RGKGGSNVK

SEQ ID NO: 1862807 - protein, 18 aa, Staphylococcus
RGKKKEMKYTTDKSGRVI

SEQ ID NO: 1862808 - protein, 18 aa, Staphylococcus
RGKKKQMKYTTDKSGKVI

SEQ ID NO: 1862809 - protein, 13 aa, Staphylococcus
RGKPVEKRFSKEE

SEQ ID NO: 1862810 - protein, 11 aa, Staphylococcus
RGKRYGKKKRS

SEQ ID NO: 1862811 - protein, 14 aa, Staphylococcus
RGKSTKSQEAGVGS

SEQ ID NO: 1862812 - protein, 7 aa, Staphylococcus
RGKTPSL

SEQ ID NO: 1862813 - protein, 14 aa, Staphylococcus
RGLGPQPLTKTNHH

SEQ ID NO: 1862814 - protein, 7 aa, Staphylococcus
RGLPDSN

SEQ ID NO: 1862815 - protein, 8 aa, Staphylococcus
RGLPDSNY

SEQ ID NO: 1862816 - protein, 4 aa, Staphylococcus
RGMT

SEQ ID NO: 1862817 - protein, 8 aa, Staphylococcus
RGNFSPRE

SEQ ID NO: 1862818 - protein, 4 aa, Staphylococcus
RGNI

SEQ ID NO: 1862819 - protein, 9 aa, Staphylococcus
RGNPDSNYT

SEQ ID NO: 1862820 - protein, 13 aa, Staphylococcus
RGNYLSTEGATGK

SEQ ID NO: 1862821 - protein, 4 aa, Staphylococcus
RGPI

SEQ ID NO: 1862822 - protein, 5 aa, Staphylococcus
RGPIG

SEQ ID NO: 1862823 - protein, 12 aa, Staphylococcus
RGQEASNKVLPG

SEQ ID NO: 1862824 - protein, 5 aa, Staphylococcus
RGQEI

SEQ ID NO: 1862825 - protein, 8 aa, Staphylococcus
RGQEVSNK

SEQ ID NO: 1862826 - protein, 7 aa, Staphylococcus
RGQFEPS

SEQ ID NO: 1862827 - protein, 8 aa, Staphylococcus
RGQFSPRE

SEQ ID NO: 1862828 - protein, 9 aa, Staphylococcus
RGQPDSNYS

SEQ ID NO: 1862829 - protein, 11 aa, Staphylococcus
RGQRLPTDGDF

SEQ ID NO: 1862830 - protein, 9 aa, Staphylococcus
RGQRTDKYG

SEQ ID NO: 1862831 - protein, 5 aa, Staphylococcus
RGRKM

SEQ ID NO: 1862832 - protein, 10 aa, Staphylococcus
RGRQESPKEL

SEQ ID NO: 1862833 - protein, 11 aa, Staphylococcus
RGSEEPRKYTG

SEQ ID NO: 1862834 - protein, 10 aa, Staphylococcus
RGSEQAKESL

SEQ ID NO: 1862835 - protein, 5 aa, Staphylococcus
RGSLS

SEQ ID NO: 1862836 - protein, 5 aa, Staphylococcus
RGSLT

SEQ ID NO: 1862837 - protein, 7 aa, Staphylococcus
RGSVEKD

SEQ ID NO: 1862838 - protein, 8 aa, Staphylococcus
RGTFTSDG

SEQ ID NO: 1862839 - protein, 5 aa, Staphylococcus
RGTLT

SEQ ID NO: 1862840 - protein, 7 aa, Staphylococcus
RGTQKTL

SEQ ID NO: 1862841 - protein, 9 aa, Staphylococcus
RGTSETARV

SEQ ID NO: 1862842 - protein, 4 aa, Staphylococcus
RGVE

SEQ ID NO: 1862843 - protein, 5 aa, Staphylococcus
RGVIS

SEQ ID NO: 1862844 - protein, 5 aa, Staphylococcus
RHDEI

SEQ ID NO: 1862845 - protein, 6 aa, Staphylococcus
RHDEIG

SEQ ID NO: 1862846 - protein, 7 aa, Staphylococcus
RHGVTPS

SEQ ID NO: 1862847 - protein, 4 aa, Staphylococcus
RHHT

SEQ ID NO: 1862848 - protein, 5 aa, Staphylococcus
RHHTK

SEQ ID NO: 1862849 - protein, 7 aa, Staphylococcus
RHKETRS

SEQ ID NO: 1862850 - protein, 8 aa, Staphylococcus
RHKKRNSI

SEQ ID NO: 1862851 - protein, 40 aa, Staphylococcus
RHKRDTSSFRSAPENNVSNDPLKANEVNPEIQNGNFSQVS

SEQ ID NO: 1862852 - protein, 14 aa, Staphylococcus
RHNEVDEAERSSED

SEQ ID NO: 1862853 - protein, 16 aa, Staphylococcus
RHNKNRKQQKNQNKEV

SEQ ID NO: 1862854 - protein, 11 aa, Staphylococcus
RHPSSNHQTWK

SEQ ID NO: 1862855 - protein, 19 aa, Staphylococcus
RHQPTYQATQNSEEYKERV

SEQ ID NO: 1862856 - protein, 13 aa, Staphylococcus
RHQYGEAAAPLEQ

SEQ ID NO: 1862857 - protein, 4 aa, Staphylococcus
RHRD

SEQ ID NO: 1862858 - protein, 5 aa, Staphylococcus
RHSET

SEQ ID NO: 1862859 - protein, 13 aa, Staphylococcus
RHTPAKSAVNTKS

SEQ ID NO: 1862860 - protein, 18 aa, Staphylococcus
RHYRNDEEQINKAPKELK

SEQ ID NO: 1862861 - protein, 4 aa, Staphylococcus
RIDT

SEQ ID NO: 1862862 - protein, 52 aa, Staphylococcus
RIENKVEDNVYKNNKETNLESKNENVNKDDKVNTSSSTSIEKPEDNATRSNL

SEQ ID NO: 1862863 - protein, 17 aa, Staphylococcus
RIESTNNRINDTLRSTN

SEQ ID NO: 1862864 - protein, 19 aa, Staphylococcus
RIETDDQDISIGMRKGREK

SEQ ID NO: 1862865 - protein, 7 aa, Staphylococcus
RIGAQEA

SEQ ID NO: 1862866 - protein, 5 aa, Staphylococcus
RIGKN

SEQ ID NO: 1862867 - protein, 4 aa, Staphylococcus
RIKR

SEQ ID NO: 1862868 - protein, 5 aa, Staphylococcus
RIKSY

SEQ ID NO: 1862869 - protein, 4 aa, Staphylococcus
RINP

SEQ ID NO: 1862870 - protein, 27 aa, Staphylococcus
RINTKMNKDMTDRLNNESDDSNQAVET

SEQ ID NO: 1862871 - protein, 5 aa, Staphylococcus
RISEY

SEQ ID NO: 1862872 - protein, 4 aa, Staphylococcus
RISK

SEQ ID NO: 1862873 - protein, 6 aa, Staphylococcus
RISKGQ

SEQ ID NO: 1862874 - protein, 5 aa, Staphylococcus
RISQY

SEQ ID NO: 1862875 - protein, 5 aa, Staphylococcus
RITIN

SEQ ID NO: 1862876 - protein, 4 aa, Staphylococcus
RITQ

SEQ ID NO: 1862877 - protein, 7 aa, Staphylococcus
RKAEDQN

SEQ ID NO: 1862878 - protein, 5 aa, Staphylococcus
RKAPA

SEQ ID NO: 1862879 - protein, 20 aa, Staphylococcus
RKAQTLAKTSIPDEIETDVK

SEQ ID NO: 1862880 - protein, 7 aa, Staphylococcus
RKAYSPL

SEQ ID NO: 1862881 - protein, 8 aa, Staphylococcus
RKDEPGLV

SEQ ID NO: 1862882 - protein, 10 aa, Staphylococcus
RKDETHKGDY

SEQ ID NO: 1862883 - protein, 6 aa, Staphylococcus
RKDEYA

SEQ ID NO: 1862884 - protein, 6 aa, Staphylococcus
RKDEYS

SEQ ID NO: 1862885 - protein, 8 aa, Staphylococcus
RKDISNEA

SEQ ID NO: 1862886 - protein, 6 aa, Staphylococcus
RKDKRQ

SEQ ID NO: 1862887 - protein, 14 aa, Staphylococcus
RKDNISKKTAESVL

SEQ ID NO: 1862888 - protein, 6 aa, Staphylococcus
RKDPNI

SEQ ID NO: 1862889 - protein, 27 aa, Staphylococcus
RKDSHHSVNQSSFEQQRYTDRKELRNN

SEQ ID NO: 1862890 - protein, 93 aa, Staphylococcus
RKDSREKLKNEYDKYKENPESYKQNAKDLASQIASNASETFNEVKENPKEYAEKVKQDPKGFVKEQKERFSNGNQDASAPTLDDAKQSDEPRH

SEQ ID NO: 1862891 - protein, 11 aa, Staphylococcus
RKDTLSSSSIN

SEQ ID NO: 1862892 - protein, 4 aa, Staphylococcus
RKDV

SEQ ID NO: 1862893 - protein, 7 aa, Staphylococcus
RKDVPKQ

SEQ ID NO: 1862894 - protein, 12 aa, Staphylococcus
RKDYNDSVNEYN

SEQ ID NO: 1862895 - protein, 21 aa, Staphylococcus
RKEALKNRKLRAARRKEITEA

SEQ ID NO: 1862896 - protein, 15 aa, Staphylococcus
RKEDGAGGDEGRQLR

SEQ ID NO: 1862897 - protein, 15 aa, Staphylococcus
RKEDGAGGDFGRQER

SEQ ID NO: 1862898 - protein, 8 aa, Staphylococcus
RKEGDQQA

SEQ ID NO: 1862899 - protein, 4 aa, Staphylococcus
RKEK

SEQ ID NO: 1862900 - protein, 6 aa, Staphylococcus
RKEKSY

SEQ ID NO: 1862901 - protein, 8 aa, Staphylococcus
RKENRDKL

SEQ ID NO: 1862902 - protein, 16 aa, Staphylococcus
RKEPDKYHYPKERVQI

SEQ ID NO: 1862903 - protein, 12 aa, Staphylococcus
RKEPEHGDTLKR

SEQ ID NO: 1862904 - protein, 7 aa, Staphylococcus
RKEPEYG

SEQ ID NO: 1862905 - protein, 16 aa, Staphylococcus
RKEPKKFSYPKERIQI

SEQ ID NO: 1862906 - protein, 4 aa, Staphylococcus
RKEQ

SEQ ID NO: 1862907 - protein, 23 aa, Staphylococcus
RKESEKATIAMEDEKDLERELED

SEQ ID NO: 1862908 - protein, 52 aa, Staphylococcus
RKESRDKLKDQYNQYKENPESYKANAKDFANQISSKANETIQDVKSNPKGYV

SEQ ID NO: 1862909 - protein, 96 aa, Staphylococcus
RKESRDKLKEQYNKYKEDPEGYKENARGLASQLSSKANETIQEVRNNPQDYANRLKNDPKSFLEEEKSKFTNLDANKEDSLEEGKFDDEGGATVNN

SEQ ID NO: 1862910 - protein, 4 aa, Staphylococcus
RKET

SEQ ID NO: 1862911 - protein, 7 aa, Staphylococcus
RKETHFP

SEQ ID NO: 1862912 - protein, 9 aa, Staphylococcus
RKETHKSSV

SEQ ID NO: 1862913 - protein, 6 aa, Staphylococcus
RKETNQ

SEQ ID NO: 1862914 - protein, 6 aa, Staphylococcus
RKETTS

SEQ ID NO: 1862915 - protein, 24 aa, Staphylococcus
RKEVEEKFGKSDGKVDSSNYTYEK

SEQ ID NO: 1862916 - protein, 15 aa, Staphylococcus
RKGDHKQHRYDEQQP

SEQ ID NO: 1862917 - protein, 7 aa, Staphylococcus
RKGEPGL

SEQ ID NO: 1862918 - protein, 8 aa, Staphylococcus
RKGEPGLI

SEQ ID NO: 1862919 - protein, 8 aa, Staphylococcus
RKGEPGLL

SEQ ID NO: 1862920 - protein, 17 aa, Staphylococcus
RKGEREPTISYKPYHKK

SEQ ID NO: 1862921 - protein, 7 aa, Staphylococcus
RKGHATQ

SEQ ID NO: 1862922 - protein, 9 aa, Staphylococcus
RKGKGTEEL

SEQ ID NO: 1862923 - protein, 6 aa, Staphylococcus
RKGNIG

SEQ ID NO: 1862924 - protein, 7 aa, Staphylococcus
RKGTGRT

SEQ ID NO: 1862925 - protein, 8 aa, Staphylococcus
RKHPEKAD

SEQ ID NO: 1862926 - protein, 10 aa, Staphylococcus
RKHPEKADIT

SEQ ID NO: 1862927 - protein, 6 aa, Staphylococcus
RKHSDT

SEQ ID NO: 1862928 - protein, 15 aa, Staphylococcus
RKINQEQQELEQQQS

SEQ ID NO: 1862929 - protein, 11 aa, Staphylococcus
RKIVEEAEERK

SEQ ID NO: 1862930 - protein, 12 aa, Staphylococcus
RKIVEQAEERKL

SEQ ID NO: 1862931 - protein, 21 aa, Staphylococcus
RKKDKEEETIIEEDNKKAIPV

SEQ ID NO: 1862932 - protein, 10 aa, Staphylococcus
RKKEEEDETV

SEQ ID NO: 1862933 - protein, 10 aa, Staphylococcus
RKKEKTKGYK

SEQ ID NO: 1862934 - protein, 7 aa, Staphylococcus
RKKGGHV

SEQ ID NO: 1862935 - protein, 9 aa, Staphylococcus
RKKGTPPVE

SEQ ID NO: 1862936 - protein, 16 aa, Staphylococcus
RKKIENDGVTIDDYKK

SEQ ID NO: 1862937 - protein, 12 aa, Staphylococcus
RKKKDNKENKDE

SEQ ID NO: 1862938 - protein, 26 aa, Staphylococcus
RKKNKNKGQFKEQRNLQDSKSQQSKF

SEQ ID NO: 1862939 - protein, 8 aa, Staphylococcus
RKKNNDQL

SEQ ID NO: 1862940 - protein, 17 aa, Staphylococcus
RKKQANKKKTHIGMTRR

SEQ ID NO: 1862941 - protein, 9 aa, Staphylococcus
RKKRERGFA

SEQ ID NO: 1862942 - protein, 26 aa, Staphylococcus
RKKRKNQAKGQHVNEESKSQSNPSKF

SEQ ID NO: 1862943 - protein, 7 aa, Staphylococcus
RKKSLSP

SEQ ID NO: 1862944 - protein, 4 aa, Staphylococcus
RKKY

SEQ ID NO: 1862945 - protein, 8 aa, Staphylococcus
RKLEKTNQ

SEQ ID NO: 1862946 - protein, 9 aa, Staphylococcus
RKLKDNNLK

SEQ ID NO: 1862947 - protein, 6 aa, Staphylococcus
RKLNGD

SEQ ID NO: 1862948 - protein, 14 aa, Staphylococcus
RKLSGNSKLLGTPS

SEQ ID NO: 1862949 - protein, 5 aa, Staphylococcus
RKNDL

SEQ ID NO: 1862950 - protein, 7 aa, Staphylococcus
RKNEPGL

SEQ ID NO: 1862951 - protein, 8 aa, Staphylococcus
RKNEPGLL

SEQ ID NO: 1862952 - protein, 4 aa, Staphylococcus
RKNI

SEQ ID NO: 1862953 - protein, 7 aa, Staphylococcus
RKNPELH

SEQ ID NO: 1862954 - protein, 8 aa, Staphylococcus
RKNPELHK

SEQ ID NO: 1862955 - protein, 5 aa, Staphylococcus
RKNPF

SEQ ID NO: 1862956 - protein, 8 aa, Staphylococcus
RKNPKTQK

SEQ ID NO: 1862957 - protein, 17 aa, Staphylococcus
RKNQNKNNQTPASITEA

SEQ ID NO: 1862958 - protein, 10 aa, Staphylococcus
RKNRKKEERL

SEQ ID NO: 1862959 - protein, 5 aa, Staphylococcus
RKNTK

SEQ ID NO: 1862960 - protein, 13 aa, Staphylococcus
RKNYKNANTTVNR

SEQ ID NO: 1862961 - protein, 21 aa, Staphylococcus
RKPANTRRKTSNKKKQQGDHP

SEQ ID NO: 1862962 - protein, 9 aa, Staphylococcus
RKPAPIAAE

SEQ ID NO: 1862963 - protein, 6 aa, Staphylococcus
RKPELR

SEQ ID NO: 1862964 - protein, 7 aa, Staphylococcus
RKPGTQA

SEQ ID NO: 1862965 - protein, 5 aa, Staphylococcus
RKPIN

SEQ ID NO: 1862966 - protein, 6 aa, Staphylococcus
RKPKNT

SEQ ID NO: 1862967 - protein, 8 aa, Staphylococcus
RKPKPKIA

SEQ ID NO: 1862968 - protein, 10 aa, Staphylococcus
RKPKPKVAVP

SEQ ID NO: 1862969 - protein, 4 aa, Staphylococcus
RKPL

SEQ ID NO: 1862970 - protein, 10 aa, Staphylococcus
RKPPFSPPTK

SEQ ID NO: 1862971 - protein, 11 aa, Staphylococcus
RKPPKSRNQKR

SEQ ID NO: 1862972 - protein, 15 aa, Staphylococcus
RKPTADEIEASESMD

SEQ ID NO: 1862973 - protein, 8 aa, Staphylococcus
RKQGEYIT

SEQ ID NO: 1862974 - protein, 28 aa, Staphylococcus
RKQIKRQNQHASNDSKHEKPSFKHTQDK

SEQ ID NO: 1862975 - protein, 7 aa, Staphylococcus
RKQKAKI

SEQ ID NO: 1862976 - protein, 7 aa, Staphylococcus
RKQKLIP

SEQ ID NO: 1862977 - protein, 7 aa, Staphylococcus
RKQNGKA

SEQ ID NO: 1862978 - protein, 8 aa, Staphylococcus
RKQPDNGH

SEQ ID NO: 1862979 - protein, 9 aa, Staphylococcus
RKQPDNGSL

SEQ ID NO: 1862980 - protein, 9 aa, Staphylococcus
RKQPESGSL

SEQ ID NO: 1862981 - protein, 9 aa, Staphylococcus
RKQPQNGSL

SEQ ID NO: 1862982 - protein, 14 aa, Staphylococcus
RKREHESGIDMEGI

SEQ ID NO: 1862983 - protein, 11 aa, Staphylococcus
RKREISKEKQY

SEQ ID NO: 1862984 - protein, 8 aa, Staphylococcus
RKRGLEPV

SEQ ID NO: 1862985 - protein, 6 aa, Staphylococcus
RKRKRL

SEQ ID NO: 1862986 - protein, 15 aa, Staphylococcus
RKSASKPSSDRYSDF

SEQ ID NO: 1862987 - protein, 6 aa, Staphylococcus
RKSELK

SEQ ID NO: 1862988 - protein, 15 aa, Staphylococcus
RKSENMSQEKLAEKL

SEQ ID NO: 1862989 - protein, 4 aa, Staphylococcus
RKSG

SEQ ID NO: 1862990 - protein, 6 aa, Staphylococcus
RKSIVG

SEQ ID NO: 1862991 - protein, 11 aa, Staphylococcus
RKSKNMSQEKL

SEQ ID NO: 1862992 - protein, 20 aa, Staphylococcus
RKSNATRKNSKRKKQNESPL

SEQ ID NO: 1862993 - protein, 21 aa, Staphylococcus
RKSNTTRKKSTTKKKQTESPL

SEQ ID NO: 1862994 - protein, 8 aa, Staphylococcus
RKTAKSQR

SEQ ID NO: 1862995 - protein, 9 aa, Staphylococcus
RKTAKSQRT

SEQ ID NO: 1862996 - protein, 11 aa, Staphylococcus
RKTATQSGDYN

SEQ ID NO: 1862997 - protein, 6 aa, Staphylococcus
RKTSKE

SEQ ID NO: 1862998 - protein, 8 aa, Staphylococcus
RKTTKSQR

SEQ ID NO: 1862999 - protein, 8 aa, Staphylococcus
RKVAHQSV

SEQ ID NO: 1863000 - protein, 6 aa, Staphylococcus
RKVKIG

SEQ ID NO: 1863001 - protein, 13 aa, Staphylococcus
RKVRQGEKGQVTE

SEQ ID NO: 1863002 - protein, 6 aa, Staphylococcus
RKVSGT

SEQ ID NO: 1863003 - protein, 4 aa, Staphylococcus
RKYF

SEQ ID NO: 1863004 - protein, 6 aa, Staphylococcus
RKYTDQ

SEQ ID NO: 1863005 - protein, 10 aa, Staphylococcus
RLAKEAKTSI

SEQ ID NO: 1863006 - protein, 13 aa, Staphylococcus
RLAREAKTSIKRR

SEQ ID NO: 1863007 - protein, 5 aa, Staphylococcus
RLEGG

SEQ ID NO: 1863008 - protein, 4 aa, Staphylococcus
RLEK

SEQ ID NO: 1863009 - protein, 12 aa, Staphylococcus
RLENSSKSNQQL

SEQ ID NO: 1863010 - protein, 7 aa, Staphylococcus
RLESTNQ

SEQ ID NO: 1863011 - protein, 14 aa, Staphylococcus
RLGEGSTFKVTFID

SEQ ID NO: 1863012 - protein, 11 aa, Staphylococcus
RLGNNEASQIA

SEQ ID NO: 1863013 - protein, 12 aa, Staphylococcus
RLGNNEASQIAK

SEQ ID NO: 1863014 - protein, 10 aa, Staphylococcus
RLGNNNEYIS

SEQ ID NO: 1863015 - protein, 10 aa, Staphylococcus
RLGQNEAATI

SEQ ID NO: 1863016 - protein, 4 aa, Staphylococcus
RLGS

SEQ ID NO: 1863017 - protein, 4 aa, Staphylococcus
RLGY

SEQ ID NO: 1863018 - protein, 9 aa, Staphylococcus
RLKKEPPLA

SEQ ID NO: 1863019 - protein, 8 aa, Staphylococcus
RLKTSTRY

SEQ ID NO: 1863020 - protein, 8 aa, Staphylococcus
RLNNTDRE

SEQ ID NO: 1863021 - protein, 14 aa, Staphylococcus
RLNNTQLQDSNLTK

SEQ ID NO: 1863022 - protein, 10 aa, Staphylococcus
RLPKYNDSNY

SEQ ID NO: 1863023 - protein, 9 aa, Staphylococcus
RLPNDVTDR

SEQ ID NO: 1863024 - protein, 8 aa, Staphylococcus
RLPNGQDY

SEQ ID NO: 1863025 - protein, 5 aa, Staphylococcus
RLPSG

SEQ ID NO: 1863026 - protein, 10 aa, Staphylococcus
RLQDKYKNPL

SEQ ID NO: 1863027 - protein, 5 aa, Staphylococcus
RLSNT

SEQ ID NO: 1863028 - protein, 4 aa, Staphylococcus
RLSQ

SEQ ID NO: 1863029 - protein, 4 aa, Staphylococcus
RLSR

SEQ ID NO: 1863030 - protein, 5 aa, Staphylococcus
RLSSA

SEQ ID NO: 1863031 - protein, 9 aa, Staphylococcus
RLTEDIQDK

SEQ ID NO: 1863032 - protein, 15 aa, Staphylococcus
RLTEDIQDKSDRLNS

SEQ ID NO: 1863033 - protein, 11 aa, Staphylococcus
RLTEDIQGKVD

SEQ ID NO: 1863034 - protein, 10 aa, Staphylococcus
RLTQQVGTTG

SEQ ID NO: 1863035 - protein, 6 aa, Staphylococcus
RLTTTQ

SEQ ID NO: 1863036 - protein, 5 aa, Staphylococcus
RMDND

SEQ ID NO: 1863037 - protein, 6 aa, Staphylococcus
RMDNDE

SEQ ID NO: 1863038 - protein, 7 aa, Staphylococcus
RMGHEEV

SEQ ID NO: 1863039 - protein, 7 aa, Staphylococcus
RMPGDST

SEQ ID NO: 1863040 - protein, 17 aa, Staphylococcus
RMPGKSKEEKQKLEQTR

SEQ ID NO: 1863041 - protein, 17 aa, Staphylococcus
RMPRKSKEEKQKLEQTR

SEQ ID NO: 1863042 - protein, 8 aa, Staphylococcus
RMRGPLGG

SEQ ID NO: 1863043 - protein, 13 aa, Staphylococcus
RMSEDGNTSEQDI

SEQ ID NO: 1863044 - protein, 7 aa, Staphylococcus
RMSGDTS

SEQ ID NO: 1863045 - protein, 13 aa, Staphylococcus
RNAATDTHLTGSS

SEQ ID NO: 1863046 - protein, 10 aa, Staphylococcus
RNAEDNSNGL

SEQ ID NO: 1863047 - protein, 13 aa, Staphylococcus
RNAQNKKNERNVT

SEQ ID NO: 1863048 - protein, 8 aa, Staphylococcus
RNDEVTNA

SEQ ID NO: 1863049 - protein, 4 aa, Staphylococcus
RNDS

SEQ ID NO: 1863050 - protein, 12 aa, Staphylococcus
RNDSKKTSVSYR

SEQ ID NO: 1863051 - protein, 4 aa, Staphylococcus
RNDT

SEQ ID NO: 1863052 - protein, 7 aa, Staphylococcus
RNDVRRD

SEQ ID NO: 1863053 - protein, 7 aa, Staphylococcus
RNDYDYR

SEQ ID NO: 1863054 - protein, 4 aa, Staphylococcus
RNEA

SEQ ID NO: 1863055 - protein, 4 aa, Staphylococcus
RNEC

SEQ ID NO: 1863056 - protein, 28 aa, Staphylococcus
RNEDLKEKVDNLENELTEVKNRQVEYRN

SEQ ID NO: 1863057 - protein, 6 aa, Staphylococcus
RNEDNV

SEQ ID NO: 1863058 - protein, 8 aa, Staphylococcus
RNEEKRLP

SEQ ID NO: 1863059 - protein, 6 aa, Staphylococcus
RNEGDV

SEQ ID NO: 1863060 - protein, 6 aa, Staphylococcus
RNEPNV

SEQ ID NO: 1863061 - protein, 15 aa, Staphylococcus
RNEVTGKDNIMTIIK

SEQ ID NO: 1863062 - protein, 7 aa, Staphylococcus
RNGEETM

SEQ ID NO: 1863063 - protein, 73 aa, Staphylococcus
RNGESIETTKVKKNKKSKQPIDNELESKQSKASNSVTNTTEKTKSNVTEQSENMQDKVKDETSDLKNNLNKTD

SEQ ID NO: 1863064 - protein, 6 aa, Staphylococcus
RNGGEE

SEQ ID NO: 1863065 - protein, 8 aa, Staphylococcus
RNGKGTAH

SEQ ID NO: 1863066 - protein, 12 aa, Staphylococcus
RNGKLKDITIKL

SEQ ID NO: 1863067 - protein, 4 aa, Staphylococcus
RNGL

SEQ ID NO: 1863068 - protein, 6 aa, Staphylococcus
RNGNLG

SEQ ID NO: 1863069 - protein, 14 aa, Staphylococcus
RNGTTLTQTEKNTV

SEQ ID NO: 1863070 - protein, 12 aa, Staphylococcus
RNHIDDESADLY

SEQ ID NO: 1863071 - protein, 4 aa, Staphylococcus
RNHV

SEQ ID NO: 1863072 - protein, 17 aa, Staphylococcus
RNIEENKIDNDTNHAEM

SEQ ID NO: 1863073 - protein, 4 aa, Staphylococcus
RNIS

SEQ ID NO: 1863074 - protein, 7 aa, Staphylococcus
RNKDLKR

SEQ ID NO: 1863075 - protein, 9 aa, Staphylococcus
RNKGGHAES

SEQ ID NO: 1863076 - protein, 56 aa, Staphylococcus
RNKKQASRKLEQRQARYNRNQTSKFKASDLDKQPSRSSEEKMTEQQSDEQHHTESV

SEQ ID NO: 1863077 - protein, 7 aa, Staphylococcus
RNKKSKK

SEQ ID NO: 1863078 - protein, 6 aa, Staphylococcus
RNKKTK

SEQ ID NO: 1863079 - protein, 12 aa, Staphylococcus
RNKRDKFKNSIK

SEQ ID NO: 1863080 - protein, 27 aa, Staphylococcus
RNKSKLNQSKGQQVNEESKSQNNPSKF

SEQ ID NO: 1863081 - protein, 7 aa, Staphylococcus
RNKTHSK

SEQ ID NO: 1863082 - protein, 6 aa, Staphylococcus
RNKTKS

SEQ ID NO: 1863083 - protein, 10 aa, Staphylococcus
RNLKSGGSGL

SEQ ID NO: 1863084 - protein, 7 aa, Staphylococcus
RNMDENQ

SEQ ID NO: 1863085 - protein, 15 aa, Staphylococcus
RNNAKDSGNYPVTTT

SEQ ID NO: 1863086 - protein, 16 aa, Staphylococcus
RNNDRRKKERDMQNKK

SEQ ID NO: 1863087 - protein, 4 aa, Staphylococcus
RNNG

SEQ ID NO: 1863088 - protein, 8 aa, Staphylococcus
RNNKDYNM

SEQ ID NO: 1863089 - protein, 4 aa, Staphylococcus
RNNL

SEQ ID NO: 1863090 - protein, 4 aa, Staphylococcus
RNNP

SEQ ID NO: 1863091 - protein, 15 aa, Staphylococcus
RNNRGEDKHDPLTNR

SEQ ID NO: 1863092 - protein, 4 aa, Staphylococcus
RNNS

SEQ ID NO: 1863093 - protein, 4 aa, Staphylococcus
RNNT

SEQ ID NO: 1863094 - protein, 7 aa, Staphylococcus
RNPEKKK

SEQ ID NO: 1863095 - protein, 8 aa, Staphylococcus
RNPELHKD

SEQ ID NO: 1863096 - protein, 9 aa, Staphylococcus
RNPGTIDEK

SEQ ID NO: 1863097 - protein, 9 aa, Staphylococcus
RNPKTGSLI

SEQ ID NO: 1863098 - protein, 4 aa, Staphylococcus
RNPL

SEQ ID NO: 1863099 - protein, 13 aa, Staphylococcus
RNQAQKVSQGDYS

SEQ ID NO: 1863100 - protein, 14 aa, Staphylococcus
RNQATDPHPTGSSL

SEQ ID NO: 1863101 - protein, 29 aa, Staphylococcus
RNRELNNEEHLSNHDANHKDKNKISTDDA

SEQ ID NO: 1863102 - protein, 4 aa, Staphylococcus
RNRK

SEQ ID NO: 1863103 - protein, 10 aa, Staphylococcus
RNRKETNFPQ

SEQ ID NO: 1863104 - protein, 10 aa, Staphylococcus
RNRKTTQQEM

SEQ ID NO: 1863105 - protein, 5 aa, Staphylococcus
RNRQF

SEQ ID NO: 1863106 - protein, 26 aa, Staphylococcus
RNRRKGNRNKDKSNQNAKELTTEAQQ

SEQ ID NO: 1863107 - protein, 7 aa, Staphylococcus
RNRSSKA

SEQ ID NO: 1863108 - protein, 8 aa, Staphylococcus
RNRTQHEI

SEQ ID NO: 1863109 - protein, 4 aa, Staphylococcus
RNSA

SEQ ID NO: 1863110 - protein, 4 aa, Staphylococcus
RNSD

SEQ ID NO: 1863111 - protein, 10 aa, Staphylococcus
RNSDKFENYT

SEQ ID NO: 1863112 - protein, 21 aa, Staphylococcus
RNSDNQLITSSTPKSKTSPEF

SEQ ID NO: 1863113 - protein, 31 aa, Staphylococcus
RNSDTSEESRENMPRKEATPEAPGIEASEEH

SEQ ID NO: 1863114 - protein, 4 aa, Staphylococcus
RNSG

SEQ ID NO: 1863115 - protein, 15 aa, Staphylococcus
RNSIIGEGYSPVNNG

SEQ ID NO: 1863116 - protein, 8 aa, Staphylococcus
RNSIQSKA

SEQ ID NO: 1863117 - protein, 15 aa, Staphylococcus
RNSSINEEFRSKPRR

SEQ ID NO: 1863118 - protein, 11 aa, Staphylococcus
RNTEKKREGIS

SEQ ID NO: 1863119 - protein, 6 aa, Staphylococcus
RNTMSG

SEQ ID NO: 1863120 - protein, 14 aa, Staphylococcus
RNTNLQKDDYVDTE

SEQ ID NO: 1863121 - protein, 4 aa, Staphylococcus
RNTS

SEQ ID NO: 1863122 - protein, 13 aa, Staphylococcus
RNTSNKQNEENVT

SEQ ID NO: 1863123 - protein, 30 aa, Staphylococcus
RNTSSSGVEQNQQSPFDGSTSSDKSFSLSP

SEQ ID NO: 1863124 - protein, 8 aa, Staphylococcus
RNTTDQPK

SEQ ID NO: 1863125 - protein, 12 aa, Staphylococcus
RNVAQSAVNAAK

SEQ ID NO: 1863126 - protein, 4 aa, Staphylococcus
RNVE

SEQ ID NO: 1863127 - protein, 8 aa, Staphylococcus
RNVEKGEA

SEQ ID NO: 1863128 - protein, 13 aa, Staphylococcus
RNVKDTKGTASVL

SEQ ID NO: 1863129 - protein, 6 aa, Staphylococcus
RNVQPS

SEQ ID NO: 1863130 - protein, 13 aa, Staphylococcus
RNVRDTKGTTSVI

SEQ ID NO: 1863131 - protein, 10 aa, Staphylococcus
RNYDEGKYGQ

SEQ ID NO: 1863132 - protein, 11 aa, Staphylococcus
RNYNNTNIREA

SEQ ID NO: 1863133 - protein, 13 aa, Staphylococcus
RNYNPKEDEEKKQ

SEQ ID NO: 1863134 - protein, 7 aa, Staphylococcus
RNYPNSG

SEQ ID NO: 1863135 - protein, 4 aa, Staphylococcus
RNYV

SEQ ID NO: 1863136 - protein, 5 aa, Staphylococcus
RPADW

SEQ ID NO: 1863137 - protein, 11 aa, Staphylococcus
RPANGAAADLS

SEQ ID NO: 1863138 - protein, 9 aa, Staphylococcus
RPDATDDEI

SEQ ID NO: 1863139 - protein, 9 aa, Staphylococcus
RPDATDEEV

SEQ ID NO: 1863140 - protein, 8 aa, Staphylococcus
RPDATEAE

SEQ ID NO: 1863141 - protein, 9 aa, Staphylococcus
RPDATEEEI

SEQ ID NO: 1863142 - protein, 9 aa, Staphylococcus
RPDATEEEV

SEQ ID NO: 1863143 - protein, 6 aa, Staphylococcus
RPDDVA

SEQ ID NO: 1863144 - protein, 6 aa, Staphylococcus
RPDLDA

SEQ ID NO: 1863145 - protein, 6 aa, Staphylococcus
RPDQVI

SEQ ID NO: 1863146 - protein, 11 aa, Staphylococcus
RPDRLPKQAHE

SEQ ID NO: 1863147 - protein, 5 aa, Staphylococcus
RPEGL

SEQ ID NO: 1863148 - protein, 7 aa, Staphylococcus
RPEKRAS

SEQ ID NO: 1863149 - protein, 4 aa, Staphylococcus
RPES

SEQ ID NO: 1863150 - protein, 12 aa, Staphylococcus
RPGRSFNSDANE

SEQ ID NO: 1863151 - protein, 5 aa, Staphylococcus
RPGVT

SEQ ID NO: 1863152 - protein, 7 aa, Staphylococcus
RPHTRYA

SEQ ID NO: 1863153 - protein, 37 aa, Staphylococcus
RPIPEGDVTAKATDNAEHPNSSTSQPKKATDTTPPIV

SEQ ID NO: 1863154 - protein, 8 aa, Staphylococcus
RPIPEGNV

SEQ ID NO: 1863155 - protein, 5 aa, Staphylococcus
RPITT

SEQ ID NO: 1863156 - protein, 9 aa, Staphylococcus
RPKEKGVNK

SEQ ID NO: 1863157 - protein, 9 aa, Staphylococcus
RPKKKGVNK

SEQ ID NO: 1863158 - protein, 14 aa, Staphylococcus
RPKKNRDLKDEKIT

SEQ ID NO: 1863159 - protein, 14 aa, Staphylococcus
RPKKNRDLKNEKIT

SEQ ID NO: 1863160 - protein, 6 aa, Staphylococcus
RPKNNT

SEQ ID NO: 1863161 - protein, 11 aa, Staphylococcus
RPKPSWDGSAL

SEQ ID NO: 1863162 - protein, 13 aa, Staphylococcus
RPKQSWDGSTLTD

SEQ ID NO: 1863163 - protein, 5 aa, Staphylococcus
RPKVF

SEQ ID NO: 1863164 - protein, 6 aa, Staphylococcus
RPMSAK

SEQ ID NO: 1863165 - protein, 9 aa, Staphylococcus
RPNATDEEV

SEQ ID NO: 1863166 - protein, 13 aa, Staphylococcus
RPNEGSTFRVTFF

SEQ ID NO: 1863167 - protein, 6 aa, Staphylococcus
RPNYRK

SEQ ID NO: 1863168 - protein, 6 aa, Staphylococcus
RPPIDN

SEQ ID NO: 1863169 - protein, 5 aa, Staphylococcus
RPQVF

SEQ ID NO: 1863170 - protein, 10 aa, Staphylococcus
RPREGKDIPM

SEQ ID NO: 1863171 - protein, 4 aa, Staphylococcus
RPRF

SEQ ID NO: 1863172 - protein, 4 aa, Staphylococcus
RPRP

SEQ ID NO: 1863173 - protein, 9 aa, Staphylococcus
RPSDKNYNA

SEQ ID NO: 1863174 - protein, 10 aa, Staphylococcus
RPSEREATLQ

SEQ ID NO: 1863175 - protein, 22 aa, Staphylococcus
RPTFGEDQDENEDKKDNNDESR

SEQ ID NO: 1863176 - protein, 6 aa, Staphylococcus
RPTFND

SEQ ID NO: 1863177 - protein, 6 aa, Staphylococcus
RPTSGH

SEQ ID NO: 1863178 - protein, 9 aa, Staphylococcus
RPTSNHAAK

SEQ ID NO: 1863179 - protein, 4 aa, Staphylococcus
RPVT

SEQ ID NO: 1863180 - protein, 4 aa, Staphylococcus
RPYE

SEQ ID NO: 1863181 - protein, 17 aa, Staphylococcus
RQADAQTPSKRRNKKKL

SEQ ID NO: 1863182 - protein, 10 aa, Staphylococcus
RQAISKEKAY

SEQ ID NO: 1863183 - protein, 26 aa, Staphylococcus
RQAKYNKKANKKSQFDNTSDEESYDF

SEQ ID NO: 1863184 - protein, 6 aa, Staphylococcus
RQAMTP

SEQ ID NO: 1863185 - protein, 7 aa, Staphylococcus
RQATDNI

SEQ ID NO: 1863186 - protein, 12 aa, Staphylococcus
RQATDVKDNKIT

SEQ ID NO: 1863187 - protein, 29 aa, Staphylococcus
RQATTEEKDEALNQLKQEETKANNAIDSA

SEQ ID NO: 1863188 - protein, 8 aa, Staphylococcus
RQDEYSAA

SEQ ID NO: 1863189 - protein, 18 aa, Staphylococcus
RQDINSKDNTQVERFNGN

SEQ ID NO: 1863190 - protein, 4 aa, Staphylococcus
RQDN

SEQ ID NO: 1863191 - protein, 13 aa, Staphylococcus
RQDVSMDEIRHHN

SEQ ID NO: 1863192 - protein, 8 aa, Staphylococcus
RQEEQIQQ

SEQ ID NO: 1863193 - protein, 28 aa, Staphylococcus
RQEKYNYKQKKQNETQADAQNVEDDFGN

SEQ ID NO: 1863194 - protein, 4 aa, Staphylococcus
RQEQ

SEQ ID NO: 1863195 - protein, 5 aa, Staphylococcus
RQFKN

SEQ ID NO: 1863196 - protein, 6 aa, Staphylococcus
RQGIRK

SEQ ID NO: 1863197 - protein, 5 aa, Staphylococcus
RQGPL

SEQ ID NO: 1863198 - protein, 10 aa, Staphylococcus
RQHHNKKELK

SEQ ID NO: 1863199 - protein, 9 aa, Staphylococcus
RQIDKNGEL

SEQ ID NO: 1863200 - protein, 18 aa, Staphylococcus
RQIGEGTLNTKERDGKFV

SEQ ID NO: 1863201 - protein, 113 aa, Staphylococcus
RQIPKNENHEETEHDAKQESDYRNVEDGSSVDRREPRYNNHDERNNESYDSRDNRQEHTRHDDRRESRNGNYQDDRYTDRREPRYENHEDRRYHDNRQPRYDYRDDARPTNRV

SEQ ID NO: 1863202 - protein, 6 aa, Staphylococcus
RQKGGH

SEQ ID NO: 1863203 - protein, 6 aa, Staphylococcus
RQKNNT

SEQ ID NO: 1863204 - protein, 6 aa, Staphylococcus
RQKSPA

SEQ ID NO: 1863205 - protein, 7 aa, Staphylococcus
RQLASNQ

SEQ ID NO: 1863206 - protein, 18 aa, Staphylococcus
RQLDEATAEQDPTPGMTE

SEQ ID NO: 1863207 - protein, 38 aa, Staphylococcus
RQLDTNNGNEKHAREAGANTGLSQDVAEKVKKAHNEVD

SEQ ID NO: 1863208 - protein, 4 aa, Staphylococcus
RQLS

SEQ ID NO: 1863209 - protein, 7 aa, Staphylococcus
RQMPKEQ

SEQ ID NO: 1863210 - protein, 5 aa, Staphylococcus
RQNPF

SEQ ID NO: 1863211 - protein, 8 aa, Staphylococcus
RQNSPEFN

SEQ ID NO: 1863212 - protein, 23 aa, Staphylococcus
RQPHLNDEQKSTMKDQVNQATTL

SEQ ID NO: 1863213 - protein, 4 aa, Staphylococcus
RQPK

SEQ ID NO: 1863214 - protein, 10 aa, Staphylococcus
RQQADNQSAT

SEQ ID NO: 1863215 - protein, 6 aa, Staphylococcus
RQQAQD

SEQ ID NO: 1863216 - protein, 6 aa, Staphylococcus
RQQATD

SEQ ID NO: 1863217 - protein, 5 aa, Staphylococcus
RQQQR

SEQ ID NO: 1863218 - protein, 4 aa, Staphylococcus
RQQY

SEQ ID NO: 1863219 - protein, 13 aa, Staphylococcus
RQRKEGKKPIFKP

SEQ ID NO: 1863220 - protein, 7 aa, Staphylococcus
RQRLSDL

SEQ ID NO: 1863221 - protein, 8 aa, Staphylococcus
RQSATYGG

SEQ ID NO: 1863222 - protein, 18 aa, Staphylococcus
RQSGTTIPSKRRKKKKLR

SEQ ID NO: 1863223 - protein, 4 aa, Staphylococcus
RQSH

SEQ ID NO: 1863224 - protein, 13 aa, Staphylococcus
RQSKDKKGTTSVI

SEQ ID NO: 1863225 - protein, 4 aa, Staphylococcus
RQSM

SEQ ID NO: 1863226 - protein, 7 aa, Staphylococcus
RQSQNEL

SEQ ID NO: 1863227 - protein, 15 aa, Staphylococcus
RQSVSKWESGKNYPS

SEQ ID NO: 1863228 - protein, 12 aa, Staphylococcus
RQTDSNRRYYTD

SEQ ID NO: 1863229 - protein, 25 aa, Staphylococcus
RQTVQTKSKNNLDFGDPFGGGFGFF

SEQ ID NO: 1863230 - protein, 7 aa, Staphylococcus
RQTVSTW

SEQ ID NO: 1863231 - protein, 14 aa, Staphylococcus
RQWGSTSNKQLNTS

SEQ ID NO: 1863232 - protein, 10 aa, Staphylococcus
RQYDTDGVSA

SEQ ID NO: 1863233 - protein, 11 aa, Staphylococcus
RQYEKGIYSKR

SEQ ID NO: 1863234 - protein, 5 aa, Staphylococcus
RQYPE

SEQ ID NO: 1863235 - protein, 7 aa, Staphylococcus
RRAAYKE

SEQ ID NO: 1863236 - protein, 8 aa, Staphylococcus
RRAPFSGK

SEQ ID NO: 1863237 - protein, 9 aa, Staphylococcus
RRASGSTKG

SEQ ID NO: 1863238 - protein, 16 aa, Staphylococcus
RRASLQQRRQSFQSKR

SEQ ID NO: 1863239 - protein, 8 aa, Staphylococcus
RRDKKAVS

SEQ ID NO: 1863240 - protein, 10 aa, Staphylococcus
RRDNLSKKAV

SEQ ID NO: 1863241 - protein, 6 aa, Staphylococcus
RRDSTA

SEQ ID NO: 1863242 - protein, 16 aa, Staphylococcus
RREPDKFHYPKERVQI

SEQ ID NO: 1863243 - protein, 16 aa, Staphylococcus
RREPDKYHYPKERIQI

SEQ ID NO: 1863244 - protein, 14 aa, Staphylococcus
RRERHGWKTKGSND

SEQ ID NO: 1863245 - protein, 16 aa, Staphylococcus
RRERKEKQLEKEMKKY

SEQ ID NO: 1863246 - protein, 13 aa, Staphylococcus
RRERKKKQLEKDM

SEQ ID NO: 1863247 - protein, 12 aa, Staphylococcus
RRERKKKQLEKE

SEQ ID NO: 1863248 - protein, 30 aa, Staphylococcus
RRERKKNKLEKEIRKYEDDDDFKKSRHRFR

SEQ ID NO: 1863249 - protein, 14 aa, Staphylococcus
RRERQSASTLKSSV

SEQ ID NO: 1863250 - protein, 8 aa, Staphylococcus
RRFGTGKD

SEQ ID NO: 1863251 - protein, 4 aa, Staphylococcus
RRGI

SEQ ID NO: 1863252 - protein, 6 aa, Staphylococcus
RRGINS

SEQ ID NO: 1863253 - protein, 15 aa, Staphylococcus
RRGKDYISANPPFYD

SEQ ID NO: 1863254 - protein, 6 aa, Staphylococcus
RRGNIK

SEQ ID NO: 1863255 - protein, 6 aa, Staphylococcus
RRGNVR

SEQ ID NO: 1863256 - protein, 16 aa, Staphylococcus
RRGQDYHSANPPLYDS

SEQ ID NO: 1863257 - protein, 6 aa, Staphylococcus
RRGVES

SEQ ID NO: 1863258 - protein, 22 aa, Staphylococcus
RRITPAKSPKDVKLHLGNQSAQ

SEQ ID NO: 1863259 - protein, 13 aa, Staphylococcus
RRKDGWKTERSNN

SEQ ID NO: 1863260 - protein, 16 aa, Staphylococcus
RRKKEEEEEKLNGKKN

SEQ ID NO: 1863261 - protein, 7 aa, Staphylococcus
RRKRQKR

SEQ ID NO: 1863262 - protein, 8 aa, Staphylococcus
RRKSKEFL

SEQ ID NO: 1863263 - protein, 6 aa, Staphylococcus
RRKSPA

SEQ ID NO: 1863264 - protein, 4 aa, Staphylococcus
RRMN

SEQ ID NO: 1863265 - protein, 9 aa, Staphylococcus
RRNIGPKGK

SEQ ID NO: 1863266 - protein, 7 aa, Staphylococcus
RRNKDLR

SEQ ID NO: 1863267 - protein, 5 aa, Staphylococcus
RRNLK

SEQ ID NO: 1863268 - protein, 16 aa, Staphylococcus
RRQGRKNKPARAHKGG

SEQ ID NO: 1863269 - protein, 15 aa, Staphylococcus
RRQPLSIQKEEQKPK

SEQ ID NO: 1863270 - protein, 6 aa, Staphylococcus
RRQPSL

SEQ ID NO: 1863271 - protein, 14 aa, Staphylococcus
RRQTAITKQQSNTK

SEQ ID NO: 1863272 - protein, 8 aa, Staphylococcus
RRQTEATK

SEQ ID NO: 1863273 - protein, 6 aa, Staphylococcus
RRRNIK

SEQ ID NO: 1863274 - protein, 30 aa, Staphylococcus
RRSRREKKAKKEIRKRGGIPKDEIENYREK

SEQ ID NO: 1863275 - protein, 7 aa, Staphylococcus
RRSRTEY

SEQ ID NO: 1863276 - protein, 6 aa, Staphylococcus
RRSSTA

SEQ ID NO: 1863277 - protein, 4 aa, Staphylococcus
RRTG

SEQ ID NO: 1863278 - protein, 7 aa, Staphylococcus
RRTPFDG

SEQ ID NO: 1863279 - protein, 19 aa, Staphylococcus
RRYNKPTDIERMKRQDGES

SEQ ID NO: 1863280 - protein, 9 aa, Staphylococcus
RSAGHSEYF

SEQ ID NO: 1863281 - protein, 27 aa, Staphylococcus
RSAQSGVTTYNNNTGVANYNDKSEKYH

SEQ ID NO: 1863282 - protein, 4 aa, Staphylococcus
RSAY

SEQ ID NO: 1863283 - protein, 14 aa, Staphylococcus
RSDNKEVKKYEDTH

SEQ ID NO: 1863284 - protein, 11 aa, Staphylococcus
RSDYNKADNNV

SEQ ID NO: 1863285 - protein, 7 aa, Staphylococcus
RSEEAAR

SEQ ID NO: 1863286 - protein, 4 aa, Staphylococcus
RSEG

SEQ ID NO: 1863287 - protein, 8 aa, Staphylococcus
RSEKAARD

SEQ ID NO: 1863288 - protein, 4 aa, Staphylococcus
RSEY

SEQ ID NO: 1863289 - protein, 15 aa, Staphylococcus
RSFGSKPEDGTQRKM

SEQ ID NO: 1863290 - protein, 34 aa, Staphylococcus
RSFSQSKPEDTEQPSNDKTPQESVEEKTDENKEE

SEQ ID NO: 1863291 - protein, 9 aa, Staphylococcus
RSGATTRLS

SEQ ID NO: 1863292 - protein, 28 aa, Staphylococcus
RSGKSGSTTYNNNTGVANYNDDSKKYHY

SEQ ID NO: 1863293 - protein, 27 aa, Staphylococcus
RSGKSGSTTYNNNTGVANYNDESKKYH

SEQ ID NO: 1863294 - protein, 5 aa, Staphylococcus
RSGNI

SEQ ID NO: 1863295 - protein, 6 aa, Staphylococcus
RSGNIG

SEQ ID NO: 1863296 - protein, 7 aa, Staphylococcus
RSGQGVD

SEQ ID NO: 1863297 - protein, 7 aa, Staphylococcus
RSGQSRF

SEQ ID NO: 1863298 - protein, 27 aa, Staphylococcus
RSGRGGATTYNNNTGVANYNNDSEKYH

SEQ ID NO: 1863299 - protein, 18 aa, Staphylococcus
RSIEDNKIEQNANSNELD

SEQ ID NO: 1863300 - protein, 11 aa, Staphylococcus
RSIEGETVGIN

SEQ ID NO: 1863301 - protein, 6 aa, Staphylococcus
RSIQSN

SEQ ID NO: 1863302 - protein, 7 aa, Staphylococcus
RSKAENE

SEQ ID NO: 1863303 - protein, 8 aa, Staphylococcus
RSKAVNTK

SEQ ID NO: 1863304 - protein, 8 aa, Staphylococcus
RSKFAESK

SEQ ID NO: 1863305 - protein, 9 aa, Staphylococcus
RSKGHSEYF

SEQ ID NO: 1863306 - protein, 14 aa, Staphylococcus
RSKKDKNKDRKNNE

SEQ ID NO: 1863307 - protein, 6 aa, Staphylococcus
RSKKNR

SEQ ID NO: 1863308 - protein, 10 aa, Staphylococcus
RSKQAEATIY

SEQ ID NO: 1863309 - protein, 16 aa, Staphylococcus
RSKRDASKTAKKNNRH

SEQ ID NO: 1863310 - protein, 25 aa, Staphylococcus
RSKYKDANDTVSRHQLDGQGGIQDD

SEQ ID NO: 1863311 - protein, 14 aa, Staphylococcus
RSLDNNDKAKKYIK

SEQ ID NO: 1863312 - protein, 5 aa, Staphylococcus
RSLGS

SEQ ID NO: 1863313 - protein, 10 aa, Staphylococcus
RSLKDNDKAI

SEQ ID NO: 1863314 - protein, 6 aa, Staphylococcus
RSLKSD

SEQ ID NO: 1863315 - protein, 22 aa, Staphylococcus
RSLNKNNNEHQALNMKTRLMGG

SEQ ID NO: 1863316 - protein, 28 aa, Staphylococcus
RSLSDDKKALKYAKKAAKSDPSNTNYKN

SEQ ID NO: 1863317 - protein, 4 aa, Staphylococcus
RSMG

SEQ ID NO: 1863318 - protein, 5 aa, Staphylococcus
RSMGA

SEQ ID NO: 1863319 - protein, 5 aa, Staphylococcus
RSMNN

SEQ ID NO: 1863320 - protein, 10 aa, Staphylococcus
RSMSKNNISA

SEQ ID NO: 1863321 - protein, 10 aa, Staphylococcus
RSMSKSNISA

SEQ ID NO: 1863322 - protein, 11 aa, Staphylococcus
RSMSQSHRSAV

SEQ ID NO: 1863323 - protein, 17 aa, Staphylococcus
RSNGTTTSTKKTKKRIK

SEQ ID NO: 1863324 - protein, 12 aa, Staphylococcus
RSNLSRTLEDAS

SEQ ID NO: 1863325 - protein, 12 aa, Staphylococcus
RSNLSRTLEDSS

SEQ ID NO: 1863326 - protein, 13 aa, Staphylococcus
RSNNRRKKRNQNR

SEQ ID NO: 1863327 - protein, 5 aa, Staphylococcus
RSNQK

SEQ ID NO: 1863328 - protein, 10 aa, Staphylococcus
RSNRNNRKRR

SEQ ID NO: 1863329 - protein, 14 aa, Staphylococcus
RSNYKGANKTVNRY

SEQ ID NO: 1863330 - protein, 5 aa, Staphylococcus
RSPGS

SEQ ID NO: 1863331 - protein, 9 aa, Staphylococcus
RSPQENEAF

SEQ ID NO: 1863332 - protein, 5 aa, Staphylococcus
RSPQF

SEQ ID NO: 1863333 - protein, 13 aa, Staphylococcus
RSQHQDEEQQQRK

SEQ ID NO: 1863334 - protein, 16 aa, Staphylococcus
RSQSEIPNEAPQETPV

SEQ ID NO: 1863335 - protein, 4 aa, Staphylococcus
RSRE

SEQ ID NO: 1863336 - protein, 8 aa, Staphylococcus
RSRPYNHL

SEQ ID NO: 1863337 - protein, 8 aa, Staphylococcus
RSRRDGFN

SEQ ID NO: 1863338 - protein, 13 aa, Staphylococcus
RSRSKKEEEARIE

SEQ ID NO: 1863339 - protein, 5 aa, Staphylococcus
RSSLT

SEQ ID NO: 1863340 - protein, 10 aa, Staphylococcus
RSTDDNSNGL

SEQ ID NO: 1863341 - protein, 49 aa, Staphylococcus
RSTKSGTATYNNNTGVANYNDETEKYRYTNLSEDENRSTNMQDSIPSTY

SEQ ID NO: 1863342 - protein, 7 aa, Staphylococcus
RSTLKNS

SEQ ID NO: 1863343 - protein, 5 aa, Staphylococcus
RSTLT

SEQ ID NO: 1863344 - protein, 13 aa, Staphylococcus
RSTQGKCGSCDTD

SEQ ID NO: 1863345 - protein, 35 aa, Staphylococcus
RSTQSASSTLKEKREANKIRREERLREKEEQRQAL

SEQ ID NO: 1863346 - protein, 6 aa, Staphylococcus
RSVDQR

SEQ ID NO: 1863347 - protein, 11 aa, Staphylococcus
RSVGDGATSVL

SEQ ID NO: 1863348 - protein, 7 aa, Staphylococcus
RSVSDEE

SEQ ID NO: 1863349 - protein, 12 aa, Staphylococcus
RSVSTNDEEKEA

SEQ ID NO: 1863350 - protein, 6 aa, Staphylococcus
RTASTA

SEQ ID NO: 1863351 - protein, 14 aa, Staphylococcus
RTATATANPDKGHE

SEQ ID NO: 1863352 - protein, 7 aa, Staphylococcus
RTDEGTV

SEQ ID NO: 1863353 - protein, 10 aa, Staphylococcus
RTDKTEAALY

SEQ ID NO: 1863354 - protein, 8 aa, Staphylococcus
RTEGVDSA

SEQ ID NO: 1863355 - protein, 10 aa, Staphylococcus
RTEISKKLKE

SEQ ID NO: 1863356 - protein, 8 aa, Staphylococcus
RTETEDGI

SEQ ID NO: 1863357 - protein, 4 aa, Staphylococcus
RTGD

SEQ ID NO: 1863358 - protein, 6 aa, Staphylococcus
RTGKKR

SEQ ID NO: 1863359 - protein, 6 aa, Staphylococcus
RTGKVT

SEQ ID NO: 1863360 - protein, 6 aa, Staphylococcus
RTKDGQ

SEQ ID NO: 1863361 - protein, 7 aa, Staphylococcus
RTKLEDK

SEQ ID NO: 1863362 - protein, 8 aa, Staphylococcus
RTKQPDNI

SEQ ID NO: 1863363 - protein, 9 aa, Staphylococcus
RTKRTEKHI

SEQ ID NO: 1863364 - protein, 7 aa, Staphylococcus
RTLEDSS

SEQ ID NO: 1863365 - protein, 6 aa, Staphylococcus
RTLGHK

SEQ ID NO: 1863366 - protein, 12 aa, Staphylococcus
RTLISNAEERKV

SEQ ID NO: 1863367 - protein, 12 aa, Staphylococcus
RTLKNADSLEER

SEQ ID NO: 1863368 - protein, 6 aa, Staphylococcus
RTNGIS

SEQ ID NO: 1863369 - protein, 9 aa, Staphylococcus
RTNIGPKGK

SEQ ID NO: 1863370 - protein, 14 aa, Staphylococcus
RTNIQADSGKGHQV

SEQ ID NO: 1863371 - protein, 4 aa, Staphylococcus
RTNT

SEQ ID NO: 1863372 - protein, 14 aa, Staphylococcus
RTNYSEEEINTGLS

SEQ ID NO: 1863373 - protein, 6 aa, Staphylococcus
RTPEKL

SEQ ID NO: 1863374 - protein, 5 aa, Staphylococcus
RTPID

SEQ ID NO: 1863375 - protein, 5 aa, Staphylococcus
RTPLD

SEQ ID NO: 1863376 - protein, 4 aa, Staphylococcus
RTPM

SEQ ID NO: 1863377 - protein, 5 aa, Staphylococcus
RTPVD

SEQ ID NO: 1863378 - protein, 9 aa, Staphylococcus
RTQKTKMND

SEQ ID NO: 1863379 - protein, 9 aa, Staphylococcus
RTQKTRMKD

SEQ ID NO: 1863380 - protein, 8 aa, Staphylococcus
RTQNTRMS

SEQ ID NO: 1863381 - protein, 10 aa, Staphylococcus
RTQPDKNGNI

SEQ ID NO: 1863382 - protein, 4 aa, Staphylococcus
RTQV

SEQ ID NO: 1863383 - protein, 15 aa, Staphylococcus
RTRHQDSDLKRGQRQ

SEQ ID NO: 1863384 - protein, 4 aa, Staphylococcus
RTRL

SEQ ID NO: 1863385 - protein, 10 aa, Staphylococcus
RTSGNITGDA

SEQ ID NO: 1863386 - protein, 5 aa, Staphylococcus
RTSKA

SEQ ID NO: 1863387 - protein, 6 aa, Staphylococcus
RTSKSS

SEQ ID NO: 1863388 - protein, 7 aa, Staphylococcus
RTSNQFG

SEQ ID NO: 1863389 - protein, 9 aa, Staphylococcus
RTSQEMANE

SEQ ID NO: 1863390 - protein, 9 aa, Staphylococcus
RTSQEMTNE

SEQ ID NO: 1863391 - protein, 10 aa, Staphylococcus
RTSQEMTNEI

SEQ ID NO: 1863392 - protein, 18 aa, Staphylococcus
RTSQEMTNEIRENYESYS

SEQ ID NO: 1863393 - protein, 6 aa, Staphylococcus
RTSRTK

SEQ ID NO: 1863394 - protein, 5 aa, Staphylococcus
RTSTA

SEQ ID NO: 1863395 - protein, 6 aa, Staphylococcus
RTSYGQ

SEQ ID NO: 1863396 - protein, 10 aa, Staphylococcus
RTTETENRIY

SEQ ID NO: 1863397 - protein, 10 aa, Staphylococcus
RTTNPKADIP

SEQ ID NO: 1863398 - protein, 10 aa, Staphylococcus
RTTNPKADVP

SEQ ID NO: 1863399 - protein, 11 aa, Staphylococcus
RTTNPKADYQG

SEQ ID NO: 1863400 - protein, 9 aa, Staphylococcus
RTTNPRADY

SEQ ID NO: 1863401 - protein, 9 aa, Staphylococcus
RTTTKDNYI

SEQ ID NO: 1863402 - protein, 6 aa, Staphylococcus
RTVDKG

SEQ ID NO: 1863403 - protein, 5 aa, Staphylococcus
RTWDY

SEQ ID NO: 1863404 - protein, 5 aa, Staphylococcus
RTYEQ

SEQ ID NO: 1863405 - protein, 8 aa, Staphylococcus
RVAEDESQ

SEQ ID NO: 1863406 - protein, 5 aa, Staphylococcus
RVEGY

SEQ ID NO: 1863407 - protein, 9 aa, Staphylococcus
RVENNQKIY

SEQ ID NO: 1863408 - protein, 4 aa, Staphylococcus
RVET

SEQ ID NO: 1863409 - protein, 9 aa, Staphylococcus
RVETEEYAK

SEQ ID NO: 1863410 - protein, 5 aa, Staphylococcus
RVETV

SEQ ID NO: 1863411 - protein, 79 aa, Staphylococcus
RVGDYQDATGRAQNVNNDVNQGLRQQGARQQSAHNKQHDEGHSYQSGIKTQSLSTSGDNESNQSNELVSSNDVKSMNTA

SEQ ID NO: 1863412 - protein, 42 aa, Staphylococcus
RVGDYQEAAGRAQDANNNINSRLQQGSVSQQSTQTSSNGVPY

SEQ ID NO: 1863413 - protein, 38 aa, Staphylococcus
RVGDYQEATRRAQAVNGNVNNNLRQQSATTNDNGMPQY

SEQ ID NO: 1863414 - protein, 9 aa, Staphylococcus
RVGKTESIV

SEQ ID NO: 1863415 - protein, 4 aa, Staphylococcus
RVGN

SEQ ID NO: 1863416 - protein, 25 aa, Staphylococcus
RVKSEQFNNKASQHSKWHTNPTQET

SEQ ID NO: 1863417 - protein, 10 aa, Staphylococcus
RVKSKRGAEI

SEQ ID NO: 1863418 - protein, 4 aa, Staphylococcus
RVNE

SEQ ID NO: 1863419 - protein, 6 aa, Staphylococcus
RVNQPI

SEQ ID NO: 1863420 - protein, 6 aa, Staphylococcus
RVNSSL

SEQ ID NO: 1863421 - protein, 7 aa, Staphylococcus
RVPSQNN

SEQ ID NO: 1863422 - protein, 10 aa, Staphylococcus
RVPTKEEARE

SEQ ID NO: 1863423 - protein, 9 aa, Staphylococcus
RVSKDKKDV

SEQ ID NO: 1863424 - protein, 5 aa, Staphylococcus
RVSKG

SEQ ID NO: 1863425 - protein, 5 aa, Staphylococcus
RVSNP

SEQ ID NO: 1863426 - protein, 9 aa, Staphylococcus
RVTGEGTHD

SEQ ID NO: 1863427 - protein, 9 aa, Staphylococcus
RVTKEGNTI

SEQ ID NO: 1863428 - protein, 12 aa, Staphylococcus
RVTKNQITDYNQ

SEQ ID NO: 1863429 - protein, 4 aa, Staphylococcus
RWNA

SEQ ID NO: 1863430 - protein, 4 aa, Staphylococcus
RWPN

SEQ ID NO: 1863431 - protein, 23 aa, Staphylococcus
RYDESQAHEDTEETSSHITPQEN

SEQ ID NO: 1863432 - protein, 41 aa, Staphylococcus
RYDNQYQNHRSQSEEREYRNQSQYRDQNEFNDPEQHPERYY

SEQ ID NO: 1863433 - protein, 5 aa, Staphylococcus
RYDPS

SEQ ID NO: 1863434 - protein, 25 aa, Staphylococcus
RYEDKNGKIDTADEGNDDIPPFRVI

SEQ ID NO: 1863435 - protein, 4 aa, Staphylococcus
RYGG

SEQ ID NO: 1863436 - protein, 5 aa, Staphylococcus
RYGGK

SEQ ID NO: 1863437 - protein, 13 aa, Staphylococcus
RYKQSKKERITHE

SEQ ID NO: 1863438 - protein, 8 aa, Staphylococcus
RYNEKTSF

SEQ ID NO: 1863439 - protein, 10 aa, Staphylococcus
RYNESKSFKV

SEQ ID NO: 1863440 - protein, 8 aa, Staphylococcus
RYNESPAF

SEQ ID NO: 1863441 - protein, 6 aa, Staphylococcus
RYNETR

SEQ ID NO: 1863442 - protein, 7 aa, Staphylococcus
RYNETRS

SEQ ID NO: 1863443 - protein, 8 aa, Staphylococcus
RYNETRSF

SEQ ID NO: 1863444 - protein, 12 aa, Staphylococcus
RYNTPNAQQRED

SEQ ID NO: 1863445 - protein, 7 aa, Staphylococcus
RYPNDYQ

SEQ ID NO: 1863446 - protein, 4 aa, Staphylococcus
RYRE

SEQ ID NO: 1863447 - protein, 8 aa, Staphylococcus
RYSEDKSF

SEQ ID NO: 1863448 - protein, 10 aa, Staphylococcus
RYTNPTFPNG

SEQ ID NO: 1863449 - protein, 19 aa, Staphylococcus
RYYGEDAGDYSIKQEEEIT

SEQ ID NO: 1863450 - protein, 19 aa, Staphylococcus
RYYGEDAGEYQLNKDQDYS

SEQ ID NO: 1863451 - protein, 8 aa, Staphylococcus
RYYTPAKE

SEQ ID NO: 1863452 - protein, 4 aa, Staphylococcus
SAAA

SEQ ID NO: 1863453 - protein, 46 aa, Staphylococcus
SAAAGDSQSQGDDGASSQGAEQQASASQSATTASSSQSSDSEVPSV

SEQ ID NO: 1863454 - protein, 16 aa, Staphylococcus
SAAANSDAVDNPKKNV

SEQ ID NO: 1863455 - protein, 25 aa, Staphylococcus
SAAEHIDEDSHETPSKASKSQREQS

SEQ ID NO: 1863456 - protein, 26 aa, Staphylococcus
SAAEHIDEDSHETPSKPSESQRKEST

SEQ ID NO: 1863457 - protein, 25 aa, Staphylococcus
SAAEHMDDDSTDTPSKASKSQREQS

SEQ ID NO: 1863458 - protein, 17 aa, Staphylococcus
SAAESYGEARTKSNQFG

SEQ ID NO: 1863459 - protein, 8 aa, Staphylococcus
SAAGGKGY

SEQ ID NO: 1863460 - protein, 20 aa, Staphylococcus
SAAGKAKNGAMAHERPDEVA

SEQ ID NO: 1863461 - protein, 8 aa, Staphylococcus
SAASGAWN

SEQ ID NO: 1863462 - protein, 4 aa, Staphylococcus
SAAT

SEQ ID NO: 1863463 - protein, 8 aa, Staphylococcus
SAATVGKA

SEQ ID NO: 1863464 - protein, 7 aa, Staphylococcus
SACTSED

SEQ ID NO: 1863465 - protein, 4 aa, Staphylococcus
SADD

SEQ ID NO: 1863466 - protein, 12 aa, Staphylococcus
SADGTKDYSGTA

SEQ ID NO: 1863467 - protein, 6 aa, Staphylococcus
SADMKG

SEQ ID NO: 1863468 - protein, 8 aa, Staphylococcus
SADNPPAS

SEQ ID NO: 1863469 - protein, 9 aa, Staphylococcus
SADNPPASV

SEQ ID NO: 1863470 - protein, 6 aa, Staphylococcus
SADSTY

SEQ ID NO: 1863471 - protein, 17 aa, Staphylococcus
SADTETQDGKKVLGANG

SEQ ID NO: 1863472 - protein, 7 aa, Staphylococcus
SADVPEA

SEQ ID NO: 1863473 - protein, 6 aa, Staphylococcus
SAEANI

SEQ ID NO: 1863474 - protein, 6 aa, Staphylococcus
SAEDQQ

SEQ ID NO: 1863475 - protein, 6 aa, Staphylococcus
SAEEQK

SEQ ID NO: 1863476 - protein, 10 aa, Staphylococcus
SAEESPNGKP

SEQ ID NO: 1863477 - protein, 8 aa, Staphylococcus
SAENPPAS

SEQ ID NO: 1863478 - protein, 4 aa, Staphylococcus
SAEQ

SEQ ID NO: 1863479 - protein, 4 aa, Staphylococcus
SAEY

SEQ ID NO: 1863480 - protein, 8 aa, Staphylococcus
SAEYQSKM

SEQ ID NO: 1863481 - protein, 4 aa, Staphylococcus
SAFG

SEQ ID NO: 1863482 - protein, 6 aa, Staphylococcus
SAFGSL

SEQ ID NO: 1863483 - protein, 4 aa, Staphylococcus
SAFH

SEQ ID NO: 1863484 - protein, 6 aa, Staphylococcus
SAGAFG

SEQ ID NO: 1863485 - protein, 4 aa, Staphylococcus
SAGD

SEQ ID NO: 1863486 - protein, 5 aa, Staphylococcus
SAGDW

SEQ ID NO: 1863487 - protein, 4 aa, Staphylococcus
SAGE

SEQ ID NO: 1863488 - protein, 7 aa, Staphylococcus
SAGNLGF

SEQ ID NO: 1863489 - protein, 6 aa, Staphylococcus
SAGNYR

SEQ ID NO: 1863490 - protein, 6 aa, Staphylococcus
SAGSTI

SEQ ID NO: 1863491 - protein, 9 aa, Staphylococcus
SAGSTLDPQ

SEQ ID NO: 1863492 - protein, 25 aa, Staphylococcus
SAGSTMNPQTIKNEDVSEKEYAAVS

SEQ ID NO: 1863493 - protein, 6 aa, Staphylococcus
SAHESG

SEQ ID NO: 1863494 - protein, 7 aa, Staphylococcus
SAHETDF

SEQ ID NO: 1863495 - protein, 6 aa, Staphylococcus
SAHSEH

SEQ ID NO: 1863496 - protein, 5 aa, Staphylococcus
SAHST

SEQ ID NO: 1863497 - protein, 17 aa, Staphylococcus
SAIAATSPVIKAKESEV

SEQ ID NO: 1863498 - protein, 13 aa, Staphylococcus
SAIASPAGAAATI

SEQ ID NO: 1863499 - protein, 5 aa, Staphylococcus
SAIGS

SEQ ID NO: 1863500 - protein, 7 aa, Staphylococcus
SAIKPET

SEQ ID NO: 1863501 - protein, 6 aa, Staphylococcus
SAIPPK

SEQ ID NO: 1863502 - protein, 12 aa, Staphylococcus
SAISSVGNDNPY

SEQ ID NO: 1863503 - protein, 23 aa, Staphylococcus
SAITTHHQSKSLPATGQERTRSP

SEQ ID NO: 1863504 - protein, 34 aa, Staphylococcus
SAKAEQDAKDAAEKVEQDNKVDKTELNKSIAKAE

SEQ ID NO: 1863505 - protein, 6 aa, Staphylococcus
SAKDQK

SEQ ID NO: 1863506 - protein, 21 aa, Staphylococcus
SAKEHEEHGKGKNGEKDKQIK

SEQ ID NO: 1863507 - protein, 34 aa, Staphylococcus
SAKEQAKQSIKDLAQRKRDAINNNPDLTDQQKAH

SEQ ID NO: 1863508 - protein, 20 aa, Staphylococcus
SAKEQVGGTANIEKTAPNML

SEQ ID NO: 1863509 - protein, 6 aa, Staphylococcus
SAKETT

SEQ ID NO: 1863510 - protein, 7 aa, Staphylococcus
SAKETTL

SEQ ID NO: 1863511 - protein, 19 aa, Staphylococcus
SAKEYEEHKDDKNSDNKIK

SEQ ID NO: 1863512 - protein, 8 aa, Staphylococcus
SAKGEQDI

SEQ ID NO: 1863513 - protein, 37 aa, Staphylococcus
SAKKSQSGFKDTSNALGDMSDAESQLIDGNQQVTDGL

SEQ ID NO: 1863514 - protein, 6 aa, Staphylococcus
SAKLNN

SEQ ID NO: 1863515 - protein, 13 aa, Staphylococcus
SAKSIKEKYDYTP

SEQ ID NO: 1863516 - protein, 9 aa, Staphylococcus
SAKTEIANV

SEQ ID NO: 1863517 - protein, 21 aa, Staphylococcus
SALDPQTIKNEDVSDEEYAAV

SEQ ID NO: 1863518 - protein, 9 aa, Staphylococcus
SALDSNSDC

SEQ ID NO: 1863519 - protein, 27 aa, Staphylococcus
SALGKAKGKTFHAETKTIKARDLGNIN

SEQ ID NO: 1863520 - protein, 6 aa, Staphylococcus
SALGQQ

SEQ ID NO: 1863521 - protein, 12 aa, Staphylococcus
SALNAPDEEDED

SEQ ID NO: 1863522 - protein, 10 aa, Staphylococcus
SALPEGFNTS

SEQ ID NO: 1863523 - protein, 7 aa, Staphylococcus
SALSGGS

SEQ ID NO: 1863524 - protein, 8 aa, Staphylococcus
SALSTNEK

SEQ ID NO: 1863525 - protein, 6 aa, Staphylococcus
SALTPE

SEQ ID NO: 1863526 - protein, 6 aa, Staphylococcus
SALVGQ

SEQ ID NO: 1863527 - protein, 10 aa, Staphylococcus
SAMSSGMSRM

SEQ ID NO: 1863528 - protein, 11 aa, Staphylococcus
SANPNTKSLDG

SEQ ID NO: 1863529 - protein, 11 aa, Staphylococcus
SANQYAQHKSS

SEQ ID NO: 1863530 - protein, 9 aa, Staphylococcus
SAPASGEIK

SEQ ID NO: 1863531 - protein, 11 aa, Staphylococcus
SAPAVDKTKPG

SEQ ID NO: 1863532 - protein, 8 aa, Staphylococcus
SAPDDTAI

SEQ ID NO: 1863533 - protein, 6 aa, Staphylococcus
SAPQKR

SEQ ID NO: 1863534 - protein, 7 aa, Staphylococcus
SAPSDNW

SEQ ID NO: 1863535 - protein, 6 aa, Staphylococcus
SAQAFN

SEQ ID NO: 1863536 - protein, 7 aa, Staphylococcus
SAQAFNG

SEQ ID NO: 1863537 - protein, 5 aa, Staphylococcus
SAQEQ

SEQ ID NO: 1863538 - protein, 8 aa, Staphylococcus
SAQKKIPS

SEQ ID NO: 1863539 - protein, 8 aa, Staphylococcus
SAQPNNAI

SEQ ID NO: 1863540 - protein, 4 aa, Staphylococcus
SAQS

SEQ ID NO: 1863541 - protein, 6 aa, Staphylococcus
SASEKV

SEQ ID NO: 1863542 - protein, 7 aa, Staphylococcus
SASGEIF

SEQ ID NO: 1863543 - protein, 6 aa, Staphylococcus
SASIGT

SEQ ID NO: 1863544 - protein, 8 aa, Staphylococcus
SASKNIRD

SEQ ID NO: 1863545 - protein, 140 aa, Staphylococcus
SASLSGSSSVIASESLSTLDSESSSHSMSTSISDSESSSVSDSISNSNSTPPSESTSGSNSGSVSLPPSESTSTSVSESIVSSNSTSTSMSESASMETVSSASTSTSISTSESISNSEFASSSMSQSVSTEMHTSNSEMV

SEQ ID NO: 1863546 - protein, 164 aa, Staphylococcus
SASLSTSTSMRESLSASGSGSADTDVSVSASSSESTSASLSTSASDRDSISISQSDSLAASTSVSDASSMSMSDSMSSSTSLSLSNSADTSTSMSDSAETSNSNSVSQSNVLSESTSSSESTSTSLSTSASDSTSNSESKSASLSTSTSESTSSSESTSESVSI

SEQ ID NO: 1863547 - protein, 7 aa, Staphylococcus
SASNPLG

SEQ ID NO: 1863548 - protein, 11 aa, Staphylococcus
SASQKGNTINT

SEQ ID NO: 1863549 - protein, 13 aa, Staphylococcus
SASQSGDKVKATI

SEQ ID NO: 1863550 - protein, 7 aa, Staphylococcus
SASQSNE

SEQ ID NO: 1863551 - protein, 23 aa, Staphylococcus
SASRSGDKIKTTIQQIDNSGNFV

SEQ ID NO: 1863552 - protein, 7 aa, Staphylococcus
SASSNAA

SEQ ID NO: 1863553 - protein, 8 aa, Staphylococcus
SASSPFEV

SEQ ID NO: 1863554 - protein, 9 aa, Staphylococcus
SASSSTATL

SEQ ID NO: 1863555 - protein, 7 aa, Staphylococcus
SASTVGK

SEQ ID NO: 1863556 - protein, 13 aa, Staphylococcus
SASYTDERNEFAE

SEQ ID NO: 1863557 - protein, 4 aa, Staphylococcus
SATA

SEQ ID NO: 1863558 - protein, 5 aa, Staphylococcus
SATDV

SEQ ID NO: 1863559 - protein, 13 aa, Staphylococcus
SATESLKACGANK

SEQ ID NO: 1863560 - protein, 5 aa, Staphylococcus
SATGH

SEQ ID NO: 1863561 - protein, 8 aa, Staphylococcus
SATLPTQM

SEQ ID NO: 1863562 - protein, 4 aa, Staphylococcus
SATQ

SEQ ID NO: 1863563 - protein, 8 aa, Staphylococcus
SATQSGDI

SEQ ID NO: 1863564 - protein, 10 aa, Staphylococcus
SATTRSAGLQ

SEQ ID NO: 1863565 - protein, 10 aa, Staphylococcus
SAVAKAKNGA

SEQ ID NO: 1863566 - protein, 10 aa, Staphylococcus
SAVDAQTEEA

SEQ ID NO: 1863567 - protein, 8 aa, Staphylococcus
SAVEGFGN

SEQ ID NO: 1863568 - protein, 9 aa, Staphylococcus
SAVKSPAIA

SEQ ID NO: 1863569 - protein, 12 aa, Staphylococcus
SAVNDGFSKMDN

SEQ ID NO: 1863570 - protein, 22 aa, Staphylococcus
SAVSALSGIGGAATAAAGGAIG

SEQ ID NO: 1863571 - protein, 9 aa, Staphylococcus
SAVSSPDNA

SEQ ID NO: 1863572 - protein, 4 aa, Staphylococcus
SAVT

SEQ ID NO: 1863573 - protein, 23 aa, Staphylococcus
SAYGREGDISALGAQKEFTEEEM

SEQ ID NO: 1863574 - protein, 25 aa, Staphylococcus
SAYTREGDISALGSQKEFKASEMPS

SEQ ID NO: 1863575 - protein, 15 aa, Staphylococcus
SAYTSVGEHPNDVYS

SEQ ID NO: 1863576 - protein, 9 aa, Staphylococcus
SDAAKKHHN

SEQ ID NO: 1863577 - protein, 11 aa, Staphylococcus
SDAATNAAGLT

SEQ ID NO: 1863578 - protein, 9 aa, Staphylococcus
SDADDNKMR

SEQ ID NO: 1863579 - protein, 7 aa, Staphylococcus
SDADSRI

SEQ ID NO: 1863580 - protein, 9 aa, Staphylococcus
SDAGPDLSE

SEQ ID NO: 1863581 - protein, 14 aa, Staphylococcus
SDAGVNTSNASEVD

SEQ ID NO: 1863582 - protein, 14 aa, Staphylococcus
SDALSNGSTGQAQA

SEQ ID NO: 1863583 - protein, 4 aa, Staphylococcus
SDAN

SEQ ID NO: 1863584 - protein, 8 aa, Staphylococcus
SDANDSNS

SEQ ID NO: 1863585 - protein, 9 aa, Staphylococcus
SDANTRLNH

SEQ ID NO: 1863586 - protein, 19 aa, Staphylococcus
SDASQEKVENKISTNTTHV

SEQ ID NO: 1863587 - protein, 13 aa, Staphylococcus
SDAVAENCNLEEV

SEQ ID NO: 1863588 - protein, 15 aa, Staphylococcus
SDAYQGIDDKQIAEA

SEQ ID NO: 1863589 - protein, 23 aa, Staphylococcus
SDDATEDDKQDDDVNNQHLPKDS

SEQ ID NO: 1863590 - protein, 29 aa, Staphylococcus
SDDEQHNAHAEDTVNHNDRDVNNQHLSKD

SEQ ID NO: 1863591 - protein, 4 aa, Staphylococcus
SDDF

SEQ ID NO: 1863592 - protein, 17 aa, Staphylococcus
SDDIKSEKTQYSAKKGV

SEQ ID NO: 1863593 - protein, 9 aa, Staphylococcus
SDDKNTKEL

SEQ ID NO: 1863594 - protein, 12 aa, Staphylococcus
SDDLKSPLDREQ

SEQ ID NO: 1863595 - protein, 72 aa, Staphylococcus
SDDNNNDNTDKISEEKNKSKKTEDTNKNNTSKESKKKYNENEQSVSQNNSIKKSEEKDKDNDESDIGTTNKI

SEQ ID NO: 1863596 - protein, 5 aa, Staphylococcus
SDDNR

SEQ ID NO: 1863597 - protein, 5 aa, Staphylococcus
SDDRK

SEQ ID NO: 1863598 - protein, 5 aa, Staphylococcus
SDDRR

SEQ ID NO: 1863599 - protein, 10 aa, Staphylococcus
SDDSGVELTE

SEQ ID NO: 1863600 - protein, 14 aa, Staphylococcus
SDDTKGKPFSRSQY

SEQ ID NO: 1863601 - protein, 7 aa, Staphylococcus
SDDTPKI

SEQ ID NO: 1863602 - protein, 8 aa, Staphylococcus
SDDYSPRA

SEQ ID NO: 1863603 - protein, 6 aa, Staphylococcus
SDEDMK

SEQ ID NO: 1863604 - protein, 8 aa, Staphylococcus
SDEEIDRE

SEQ ID NO: 1863605 - protein, 5 aa, Staphylococcus
SDEID

SEQ ID NO: 1863606 - protein, 10 aa, Staphylococcus
SDEKPRPSNK

SEQ ID NO: 1863607 - protein, 6 aa, Staphylococcus
SDELEE

SEQ ID NO: 1863608 - protein, 7 aa, Staphylococcus
SDEMNGN

SEQ ID NO: 1863609 - protein, 7 aa, Staphylococcus
SDENKYT

SEQ ID NO: 1863610 - protein, 8 aa, Staphylococcus
SDENVENL

SEQ ID NO: 1863611 - protein, 5 aa, Staphylococcus
SDETI

SEQ ID NO: 1863612 - protein, 6 aa, Staphylococcus
SDEYER

SEQ ID NO: 1863613 - protein, 4 aa, Staphylococcus
SDFK

SEQ ID NO: 1863614 - protein, 7 aa, Staphylococcus
SDFKEQL

SEQ ID NO: 1863615 - protein, 6 aa, Staphylococcus
SDFKLP

SEQ ID NO: 1863616 - protein, 13 aa, Staphylococcus
SDFPEVSTEPEDI

SEQ ID NO: 1863617 - protein, 12 aa, Staphylococcus
SDFSTTTSNSQL

SEQ ID NO: 1863618 - protein, 6 aa, Staphylococcus
SDGDII

SEQ ID NO: 1863619 - protein, 16 aa, Staphylococcus
SDGGNETTSIKSPPLT

SEQ ID NO: 1863620 - protein, 9 aa, Staphylococcus
SDGIGGVKE

SEQ ID NO: 1863621 - protein, 10 aa, Staphylococcus
SDGKPSGKNV

SEQ ID NO: 1863622 - protein, 14 aa, Staphylococcus
SDGNLSLPATGEAI

SEQ ID NO: 1863623 - protein, 67 aa, Staphylococcus
SDGRTATISKGDKGDTGAQGLKGDKGDTGAQGAKGDKGDTGATGAAGKDAKPLTVTSESKDANGNTV

SEQ ID NO: 1863624 - protein, 8 aa, Staphylococcus
SDGSATVD

SEQ ID NO: 1863625 - protein, 27 aa, Staphylococcus
SDGSTATISKGDKGDKGNTGDKGDSIT

SEQ ID NO: 1863626 - protein, 32 aa, Staphylococcus
SDGTSVTVNKGDRGEAGAKGEKGDRGESGTSI

SEQ ID NO: 1863627 - protein, 4 aa, Staphylococcus
SDGV

SEQ ID NO: 1863628 - protein, 12 aa, Staphylococcus
SDHLEGNDQSVE

SEQ ID NO: 1863629 - protein, 8 aa, Staphylococcus
SDHQGTQV

SEQ ID NO: 1863630 - protein, 6 aa, Staphylococcus
SDHTGL

SEQ ID NO: 1863631 - protein, 21 aa, Staphylococcus
SDIDAKDTNDDITKVKESALK

SEQ ID NO: 1863632 - protein, 10 aa, Staphylococcus
SDIDRDSPFF

SEQ ID NO: 1863633 - protein, 17 aa, Staphylococcus
SDIDSTDDSIVKTASKR

SEQ ID NO: 1863634 - protein, 14 aa, Staphylococcus
SDIDSTNDSIVKTA

SEQ ID NO: 1863635 - protein, 16 aa, Staphylococcus
SDIDSTNDSVIKTATK

SEQ ID NO: 1863636 - protein, 16 aa, Staphylococcus
SDIDSTNDSVVKTATK

SEQ ID NO: 1863637 - protein, 16 aa, Staphylococcus
SDIDSTSDSVIKTASK

SEQ ID NO: 1863638 - protein, 10 aa, Staphylococcus
SDIEKQGYNT

SEQ ID NO: 1863639 - protein, 21 aa, Staphylococcus
SDIKQGSAKQEFKQETNQPTV

SEQ ID NO: 1863640 - protein, 6 aa, Staphylococcus
SDIMSS

SEQ ID NO: 1863641 - protein, 14 aa, Staphylococcus
SDINETKSYVNNAN

SEQ ID NO: 1863642 - protein, 10 aa, Staphylococcus
SDISTHAKGV

SEQ ID NO: 1863643 - protein, 10 aa, Staphylococcus
SDKAGYTPKD

SEQ ID NO: 1863644 - protein, 8 aa, Staphylococcus
SDKEKQKL

SEQ ID NO: 1863645 - protein, 11 aa, Staphylococcus
SDKEYEKAKKI

SEQ ID NO: 1863646 - protein, 10 aa, Staphylococcus
SDKEYNAAKK

SEQ ID NO: 1863647 - protein, 14 aa, Staphylococcus
SDKGPNKYGAEPEV

SEQ ID NO: 1863648 - protein, 8 aa, Staphylococcus
SDKIRKDY

SEQ ID NO: 1863649 - protein, 9 aa, Staphylococcus
SDKNEPLKG

SEQ ID NO: 1863650 - protein, 7 aa, Staphylococcus
SDKNKFH

SEQ ID NO: 1863651 - protein, 9 aa, Staphylococcus
SDKPDEFKE

SEQ ID NO: 1863652 - protein, 8 aa, Staphylococcus
SDKPEEFE

SEQ ID NO: 1863653 - protein, 10 aa, Staphylococcus
SDKPTEFKEP

SEQ ID NO: 1863654 - protein, 10 aa, Staphylococcus
SDKPTQFKEP

SEQ ID NO: 1863655 - protein, 11 aa, Staphylococcus
SDKSDENLKKN

SEQ ID NO: 1863656 - protein, 10 aa, Staphylococcus
SDKSEALKGD

SEQ ID NO: 1863657 - protein, 7 aa, Staphylococcus
SDKSINK

SEQ ID NO: 1863658 - protein, 13 aa, Staphylococcus
SDKSVQGGSTITQ

SEQ ID NO: 1863659 - protein, 5 aa, Staphylococcus
SDKYI

SEQ ID NO: 1863660 - protein, 8 aa, Staphylococcus
SDLGAGKW

SEQ ID NO: 1863661 - protein, 11 aa, Staphylococcus
SDLGPKMTPIG

SEQ ID NO: 1863662 - protein, 9 aa, Staphylococcus
SDLNPSERR

SEQ ID NO: 1863663 - protein, 14 aa, Staphylococcus
SDLQTQLGAKYTPT

SEQ ID NO: 1863664 - protein, 16 aa, Staphylococcus
SDLSKAETLAKKGNQN

SEQ ID NO: 1863665 - protein, 9 aa, Staphylococcus
SDLSQTYDQ

SEQ ID NO: 1863666 - protein, 23 aa, Staphylococcus
SDLTGEATTTDPVEVTTDPNTKV

SEQ ID NO: 1863667 - protein, 22 aa, Staphylococcus
SDLTGKATTTDPVEVTTDPNTH

SEQ ID NO: 1863668 - protein, 8 aa, Staphylococcus
SDLYSGKQ

SEQ ID NO: 1863669 - protein, 10 aa, Staphylococcus
SDMKSGDIPG

SEQ ID NO: 1863670 - protein, 4 aa, Staphylococcus
SDMQ

SEQ ID NO: 1863671 - protein, 25 aa, Staphylococcus
SDMRYKDDEYFKSNQHTNEDHQFED

SEQ ID NO: 1863672 - protein, 7 aa, Staphylococcus
SDMTEEA

SEQ ID NO: 1863673 - protein, 6 aa, Staphylococcus
SDNAAK

SEQ ID NO: 1863674 - protein, 7 aa, Staphylococcus
SDNEGQL

SEQ ID NO: 1863675 - protein, 7 aa, Staphylococcus
SDNGKVN

SEQ ID NO: 1863676 - protein, 8 aa, Staphylococcus
SDNKEKKR

SEQ ID NO: 1863677 - protein, 10 aa, Staphylococcus
SDNLKREKDS

SEQ ID NO: 1863678 - protein, 6 aa, Staphylococcus
SDNNTG

SEQ ID NO: 1863679 - protein, 5 aa, Staphylococcus
SDNPL

SEQ ID NO: 1863680 - protein, 6 aa, Staphylococcus
SDNPNY

SEQ ID NO: 1863681 - protein, 8 aa, Staphylococcus
SDNRQAPK

SEQ ID NO: 1863682 - protein, 9 aa, Staphylococcus
SDNTLSGKL

SEQ ID NO: 1863683 - protein, 11 aa, Staphylococcus
SDNTSTAYESF

SEQ ID NO: 1863684 - protein, 5 aa, Staphylococcus
SDPLN

SEQ ID NO: 1863685 - protein, 23 aa, Staphylococcus
SDQGSNRITVSENAELRTGPNAA

SEQ ID NO: 1863686 - protein, 11 aa, Staphylococcus
SDQIKNKQEQV

SEQ ID NO: 1863687 - protein, 12 aa, Staphylococcus
SDQLTKEKYESR

SEQ ID NO: 1863688 - protein, 7 aa, Staphylococcus
SDQQTNK

SEQ ID NO: 1863689 - protein, 5 aa, Staphylococcus
SDQRQ

SEQ ID NO: 1863690 - protein, 14 aa, Staphylococcus
SDQRQGTTNAPTQS

SEQ ID NO: 1863691 - protein, 4 aa, Staphylococcus
SDQS

SEQ ID NO: 1863692 - protein, 5 aa, Staphylococcus
SDQYS

SEQ ID NO: 1863693 - protein, 12 aa, Staphylococcus
SDRGKESTYRNA

SEQ ID NO: 1863694 - protein, 4 aa, Staphylococcus
SDRK

SEQ ID NO: 1863695 - protein, 10 aa, Staphylococcus
SDRNEQLKGD

SEQ ID NO: 1863696 - protein, 13 aa, Staphylococcus
SDSDIDIADEDFD

SEQ ID NO: 1863697 - protein, 8 aa, Staphylococcus
SDSDNGIV

SEQ ID NO: 1863698 - protein, 10 aa, Staphylococcus
SDSGASDKIA

SEQ ID NO: 1863699 - protein, 8 aa, Staphylococcus
SDSGVNAS

SEQ ID NO: 1863700 - protein, 9 aa, Staphylococcus
SDSGVNSSM

SEQ ID NO: 1863701 - protein, 6 aa, Staphylococcus
SDSIQT

SEQ ID NO: 1863702 - protein, 9 aa, Staphylococcus
SDSKIITTT

SEQ ID NO: 1863703 - protein, 110 aa, Staphylococcus
SDSKSHSISNSDSNTTSDSASASTSISDSSSTSTSDSNASHSFSTSHSVSESNSMSTSHSQFDSISTSESMSGTDSTSLSTSLSHSASTSNSTSMTTSESQSNNDSQMHS

SEQ ID NO: 1863704 - protein, 9 aa, Staphylococcus
SDSNETMKG

SEQ ID NO: 1863705 - protein, 14 aa, Staphylococcus
SDSNKISKSLGTRH

SEQ ID NO: 1863706 - protein, 10 aa, Staphylococcus
SDSQKASSVA

SEQ ID NO: 1863707 - protein, 15 aa, Staphylococcus
SDSSKISKSLGTRHR

SEQ ID NO: 1863708 - protein, 8 aa, Staphylococcus
SDSVGRKK

SEQ ID NO: 1863709 - protein, 6 aa, Staphylococcus
SDTDTE

SEQ ID NO: 1863710 - protein, 6 aa, Staphylococcus
SDTHRS

SEQ ID NO: 1863711 - protein, 12 aa, Staphylococcus
SDTIGGDETTAI

SEQ ID NO: 1863712 - protein, 12 aa, Staphylococcus
SDTKQPKTMSDI

SEQ ID NO: 1863713 - protein, 7 aa, Staphylococcus
SDTQRVK

SEQ ID NO: 1863714 - protein, 6 aa, Staphylococcus
SDTTPK

SEQ ID NO: 1863715 - protein, 5 aa, Staphylococcus
SDTVE

SEQ ID NO: 1863716 - protein, 14 aa, Staphylococcus
SDVDATNDSVFTTA

SEQ ID NO: 1863717 - protein, 7 aa, Staphylococcus
SDVEENL

SEQ ID NO: 1863718 - protein, 7 aa, Staphylococcus
SDVPQTQ

SEQ ID NO: 1863719 - protein, 6 aa, Staphylococcus
SDVQNV

SEQ ID NO: 1863720 - protein, 6 aa, Staphylococcus
SDVQSV

SEQ ID NO: 1863721 - protein, 33 aa, Staphylococcus
SDVSNQANSNNDSVNTNNQQTQIETIETTDNTV

SEQ ID NO: 1863722 - protein, 11 aa, Staphylococcus
SDVTPDGQGHN

SEQ ID NO: 1863723 - protein, 8 aa, Staphylococcus
SDVVSTGQ

SEQ ID NO: 1863724 - protein, 9 aa, Staphylococcus
SDYKGMNKQ

SEQ ID NO: 1863725 - protein, 14 aa, Staphylococcus
SDYPKASDVKSELN

SEQ ID NO: 1863726 - protein, 17 aa, Staphylococcus
SDYQKIKTHAKKKDKIV

SEQ ID NO: 1863727 - protein, 9 aa, Staphylococcus
SDYQNDNEW

SEQ ID NO: 1863728 - protein, 8 aa, Staphylococcus
SEADAQQC

SEQ ID NO: 1863729 - protein, 16 aa, Staphylococcus
SEADTNTPSPAQVANE

SEQ ID NO: 1863730 - protein, 10 aa, Staphylococcus
SEAEKKYITE

SEQ ID NO: 1863731 - protein, 4 aa, Staphylococcus
SEAG

SEQ ID NO: 1863732 - protein, 12 aa, Staphylococcus
SEAIKPNVHQGD

SEQ ID NO: 1863733 - protein, 12 aa, Staphylococcus
SEAIKPSVHQGD

SEQ ID NO: 1863734 - protein, 7 aa, Staphylococcus
SEAIPAS

SEQ ID NO: 1863735 - protein, 14 aa, Staphylococcus
SEALKNKLNDTNNQ

SEQ ID NO: 1863736 - protein, 5 aa, Staphylococcus
SEANK

SEQ ID NO: 1863737 - protein, 7 aa, Staphylococcus
SEAQEDV

SEQ ID NO: 1863738 - protein, 19 aa, Staphylococcus
SEDADIEKPNTGDSTVDGY

SEQ ID NO: 1863739 - protein, 16 aa, Staphylococcus
SEDAMSSVPNKIREGA

SEQ ID NO: 1863740 - protein, 16 aa, Staphylococcus
SEDAMSSVPNKMREGA

SEQ ID NO: 1863741 - protein, 19 aa, Staphylococcus
SEDASIDKPNTGDSTVDGY

SEQ ID NO: 1863742 - protein, 13 aa, Staphylococcus
SEDEATAKESFKQ

SEQ ID NO: 1863743 - protein, 16 aa, Staphylococcus
SEDEVESMVEEPANHK

SEQ ID NO: 1863744 - protein, 11 aa, Staphylococcus
SEDEVHDGLAG

SEQ ID NO: 1863745 - protein, 14 aa, Staphylococcus
SEDEVNDMMNEDKN

SEQ ID NO: 1863746 - protein, 9 aa, Staphylococcus
SEDEVTSPQ

SEQ ID NO: 1863747 - protein, 5 aa, Staphylococcus
SEDKI

SEQ ID NO: 1863748 - protein, 8 aa, Staphylococcus
SEDNRNEK

SEQ ID NO: 1863749 - protein, 84 aa, Staphylococcus
SEDSKAIANIQPSTDVKDRAKADVVAKSNEKQNEIVNNTEATTEEKEVASQQLQQVTDRTNNSIGLAQDTDQVNVEKNKGIESI

SEQ ID NO: 1863750 - protein, 9 aa, Staphylococcus
SEDSPTGKP

SEQ ID NO: 1863751 - protein, 5 aa, Staphylococcus
SEDSY

SEQ ID NO: 1863752 - protein, 5 aa, Staphylococcus
SEDTG

SEQ ID NO: 1863753 - protein, 6 aa, Staphylococcus
SEDTGG

SEQ ID NO: 1863754 - protein, 7 aa, Staphylococcus
SEEAYYQ

SEQ ID NO: 1863755 - protein, 28 aa, Staphylococcus
SEEEHHKDSGDDHHYDDSGNEKKVGPKA

SEQ ID NO: 1863756 - protein, 7 aa, Staphylococcus
SEEGAET

SEQ ID NO: 1863757 - protein, 14 aa, Staphylococcus
SEEKSIGRKAQEAY

SEQ ID NO: 1863758 - protein, 4 aa, Staphylococcus
SEEN

SEQ ID NO: 1863759 - protein, 7 aa, Staphylococcus
SEETGSI

SEQ ID NO: 1863760 - protein, 6 aa, Staphylococcus
SEGGDQ

SEQ ID NO: 1863761 - protein, 5 aa, Staphylococcus
SEGGY

SEQ ID NO: 1863762 - protein, 7 aa, Staphylococcus
SEGIGGV

SEQ ID NO: 1863763 - protein, 4 aa, Staphylococcus
SEGM

SEQ ID NO: 1863764 - protein, 14 aa, Staphylococcus
SEGQENGQTPQSKI

SEQ ID NO: 1863765 - protein, 8 aa, Staphylococcus
SEGVNPTI

SEQ ID NO: 1863766 - protein, 10 aa, Staphylococcus
SEGVTPKVGS

SEQ ID NO: 1863767 - protein, 10 aa, Staphylococcus
SEGYDDRREY

SEQ ID NO: 1863768 - protein, 5 aa, Staphylococcus
SEIAD

SEQ ID NO: 1863769 - protein, 25 aa, Staphylococcus
SEIDNDHSATIEEKNETKAKIDEIA

SEQ ID NO: 1863770 - protein, 36 aa, Staphylococcus
SEIEQATNQINTTKNALDGENKLHTDQQNANREIEG

SEQ ID NO: 1863771 - protein, 5 aa, Staphylococcus
SEIEV

SEQ ID NO: 1863772 - protein, 7 aa, Staphylococcus
SEIKTSQ

SEQ ID NO: 1863773 - protein, 13 aa, Staphylococcus
SEIPNEAPKETPV

SEQ ID NO: 1863774 - protein, 11 aa, Staphylococcus
SEIPNNPPQEI

SEQ ID NO: 1863775 - protein, 6 aa, Staphylococcus
SEIPQS

SEQ ID NO: 1863776 - protein, 4 aa, Staphylococcus
SEIQ

SEQ ID NO: 1863777 - protein, 5 aa, Staphylococcus
SEIQE

SEQ ID NO: 1863778 - protein, 7 aa, Staphylococcus
SEIQSSP

SEQ ID NO: 1863779 - protein, 17 aa, Staphylococcus
SEITASEVHGNSDHSKL

SEQ ID NO: 1863780 - protein, 7 aa, Staphylococcus
SEKAARD

SEQ ID NO: 1863781 - protein, 10 aa, Staphylococcus
SEKANYSPKD

SEQ ID NO: 1863782 - protein, 5 aa, Staphylococcus
SEKAR

SEQ ID NO: 1863783 - protein, 9 aa, Staphylococcus
SEKDEKIEK

SEQ ID NO: 1863784 - protein, 10 aa, Staphylococcus
SEKDEKIEKN

SEQ ID NO: 1863785 - protein, 7 aa, Staphylococcus
SEKDKAI

SEQ ID NO: 1863786 - protein, 23 aa, Staphylococcus
SEKDQKVEKNVKLPKDTDANVHK

SEQ ID NO: 1863787 - protein, 6 aa, Staphylococcus
SEKEDA

SEQ ID NO: 1863788 - protein, 13 aa, Staphylococcus
SEKEVEDMVDDTY

SEQ ID NO: 1863789 - protein, 14 aa, Staphylococcus
SEKGIQTNEAETNL

SEQ ID NO: 1863790 - protein, 4 aa, Staphylococcus
SEKH

SEQ ID NO: 1863791 - protein, 10 aa, Staphylococcus
SEKIKDTVTR

SEQ ID NO: 1863792 - protein, 6 aa, Staphylococcus
SEKISE

SEQ ID NO: 1863793 - protein, 4 aa, Staphylococcus
SEKK

SEQ ID NO: 1863794 - protein, 13 aa, Staphylococcus
SEKKLSKKDAERM

SEQ ID NO: 1863795 - protein, 5 aa, Staphylococcus
SEKKV

SEQ ID NO: 1863796 - protein, 14 aa, Staphylococcus
SEKLGNPKEGDKIL

SEQ ID NO: 1863797 - protein, 14 aa, Staphylococcus
SEKLGNPKSGDAIL

SEQ ID NO: 1863798 - protein, 13 aa, Staphylococcus
SEKLPGRKTTTQA

SEQ ID NO: 1863799 - protein, 62 aa, Staphylococcus
SEKNDEKVNHKDAQNNKSNQFDDKESLRKNLKTEEGQFNEIKNENSHLKESKQSTQQDMSSN

SEQ ID NO: 1863800 - protein, 9 aa, Staphylococcus
SEKQGASPY

SEQ ID NO: 1863801 - protein, 5 aa, Staphylococcus
SEKRG

SEQ ID NO: 1863802 - protein, 5 aa, Staphylococcus
SEKVI

SEQ ID NO: 1863803 - protein, 4 aa, Staphylococcus
SEKY

SEQ ID NO: 1863804 - protein, 15 aa, Staphylococcus
SELEEVPNETSNQQL

SEQ ID NO: 1863805 - protein, 7 aa, Staphylococcus
SELKDKF

SEQ ID NO: 1863806 - protein, 16 aa, Staphylococcus
SELNKGTAFSIYFPKN

SEQ ID NO: 1863807 - protein, 25 aa, Staphylococcus
SELNNKMANQVKDKAKSMQDNHHDS

SEQ ID NO: 1863808 - protein, 6 aa, Staphylococcus
SELPSL

SEQ ID NO: 1863809 - protein, 60 aa, Staphylococcus
SELPTSYEDSLQGQGNAGGASGMQGAGDASDDGQAGGGGQASNPVVNDVGGKGNSNDASK

SEQ ID NO: 1863810 - protein, 11 aa, Staphylococcus
SELRTGPNAAY

SEQ ID NO: 1863811 - protein, 5 aa, Staphylococcus
SELTK

SEQ ID NO: 1863812 - protein, 9 aa, Staphylococcus
SEMDSGHIP

SEQ ID NO: 1863813 - protein, 7 aa, Staphylococcus
SENEKAN

SEQ ID NO: 1863814 - protein, 13 aa, Staphylococcus
SENEVEDMVDEPK

SEQ ID NO: 1863815 - protein, 7 aa, Staphylococcus
SENGERI

SEQ ID NO: 1863816 - protein, 23 aa, Staphylococcus
SENIKKHKPMGMANNEGNTGEAL

SEQ ID NO: 1863817 - protein, 8 aa, Staphylococcus
SENKRVTF

SEQ ID NO: 1863818 - protein, 13 aa, Staphylococcus
SENNDATDEEKAV

SEQ ID NO: 1863819 - protein, 23 aa, Staphylococcus
SENRENEARYQSVEENTKTIPIN

SEQ ID NO: 1863820 - protein, 7 aa, Staphylococcus
SENSRLS

SEQ ID NO: 1863821 - protein, 8 aa, Staphylococcus
SENSRLSR

SEQ ID NO: 1863822 - protein, 6 aa, Staphylococcus
SENSSP

SEQ ID NO: 1863823 - protein, 9 aa, Staphylococcus
SENTNLQKD

SEQ ID NO: 1863824 - protein, 116 aa, Staphylococcus
SENTPSPSSNDSTKVDAKHSDSRANSAVEASTEKAHPESDQDEVKVNSRYTSNRQSSVVSDARTTIDEESDESSRHLSSESDDVTQQDNQPLDTADSSNADYERSPFDLKSKRGHR

SEQ ID NO: 1863825 - protein, 5 aa, Staphylococcus
SENVP

SEQ ID NO: 1863826 - protein, 5 aa, Staphylococcus
SEPFT

SEQ ID NO: 1863827 - protein, 9 aa, Staphylococcus
SEQDNHQRD

SEQ ID NO: 1863828 - protein, 8 aa, Staphylococcus
SEQEINDG

SEQ ID NO: 1863829 - protein, 6 aa, Staphylococcus
SEQEMK

SEQ ID NO: 1863830 - protein, 9 aa, Staphylococcus
SEQEVTSPQ

SEQ ID NO: 1863831 - protein, 6 aa, Staphylococcus
SEQEYP

SEQ ID NO: 1863832 - protein, 8 aa, Staphylococcus
SEQGQNQI

SEQ ID NO: 1863833 - protein, 12 aa, Staphylococcus
SEQIRGKQEQNA

SEQ ID NO: 1863834 - protein, 8 aa, Staphylococcus
SEQKTLGA

SEQ ID NO: 1863835 - protein, 13 aa, Staphylococcus
SEQLGNPKNGDAI

SEQ ID NO: 1863836 - protein, 13 aa, Staphylococcus
SEQLTDDEGMTYQ

SEQ ID NO: 1863837 - protein, 5 aa, Staphylococcus
SEQQH

SEQ ID NO: 1863838 - protein, 18 aa, Staphylococcus
SEQRLEDVQSQIDSNKRH

SEQ ID NO: 1863839 - protein, 7 aa, Staphylococcus
SEQRTLG

SEQ ID NO: 1863840 - protein, 10 aa, Staphylococcus
SEQVGKSEGF

SEQ ID NO: 1863841 - protein, 9 aa, Staphylococcus
SERKETLQQ

SEQ ID NO: 1863842 - protein, 37 aa, Staphylococcus
SERKTNKYGASHKYGNHIKSSTNTYANQDAPIHEDTN

SEQ ID NO: 1863843 - protein, 17 aa, Staphylococcus
SESAPKSLGKANRHGVP

SEQ ID NO: 1863844 - protein, 5 aa, Staphylococcus
SESAT

SEQ ID NO: 1863845 - protein, 4 aa, Staphylococcus
SESE

SEQ ID NO: 1863846 - protein, 15 aa, Staphylococcus
SESFGSNPKDGTERK

SEQ ID NO: 1863847 - protein, 15 aa, Staphylococcus
SESFGSTPKDGTERK

SEQ ID NO: 1863848 - protein, 184 aa, Staphylococcus
SESISASTSMSSSESLSTSTSDSLSDSTSTSVSLSNSDSTSNSQSISDSNSSSTSSSESVSMSGRTSSSDSMSTSISTSTSMSNSESVSASDSNSTSTSESISASTSTSGNTSNSVSTSDSTSTSDSDSASMSTSSSESFSTSTSTSNSDSSNHQGSLVDPSGFKPSHQNPGEQHLSGSMDSSE

SEQ ID NO: 1863849 - protein, 9 aa, Staphylococcus
SESLEQTQN

SEQ ID NO: 1863850 - protein, 11 aa, Staphylococcus
SESLPEGFNTS

SEQ ID NO: 1863851 - protein, 7 aa, Staphylococcus
SESNGQY

SEQ ID NO: 1863852 - protein, 13 aa, Staphylococcus
SESQFVNKTGKDY

SEQ ID NO: 1863853 - protein, 7 aa, Staphylococcus
SESQSNY

SEQ ID NO: 1863854 - protein, 17 aa, Staphylococcus
SESSKKDSTDIINSNLG

SEQ ID NO: 1863855 - protein, 4 aa, Staphylococcus
SEST

SEQ ID NO: 1863856 - protein, 7 aa, Staphylococcus
SESTGRM

SEQ ID NO: 1863857 - protein, 8 aa, Staphylococcus
SESVAQSP

SEQ ID NO: 1863858 - protein, 5 aa, Staphylococcus
SESYG

SEQ ID NO: 1863859 - protein, 15 aa, Staphylococcus
SETALEKKKEYNQQK

SEQ ID NO: 1863860 - protein, 8 aa, Staphylococcus
SETALTAA

SEQ ID NO: 1863861 - protein, 28 aa, Staphylococcus
SETALTAANRTKFQTAAKNGDRKAKGLS

SEQ ID NO: 1863862 - protein, 8 aa, Staphylococcus
SETAMTQT

SEQ ID NO: 1863863 - protein, 5 aa, Staphylococcus
SETKQ

SEQ ID NO: 1863864 - protein, 6 aa, Staphylococcus
SETLRN

SEQ ID NO: 1863865 - protein, 8 aa, Staphylococcus
SETNKIQL

SEQ ID NO: 1863866 - protein, 8 aa, Staphylococcus
SETNPELN

SEQ ID NO: 1863867 - protein, 9 aa, Staphylococcus
SETNPNLTQ

SEQ ID NO: 1863868 - protein, 5 aa, Staphylococcus
SETSY

SEQ ID NO: 1863869 - protein, 8 aa, Staphylococcus
SETSYTSS

SEQ ID NO: 1863870 - protein, 53 aa, Staphylococcus
SETTSEGQMSSQNLNSERNQSNQNSDYQQYNRSNQYTSQENNQIAKDEEQDER

SEQ ID NO: 1863871 - protein, 56 aa, Staphylococcus
SETTVPSALTPKTYDTTEPFSDDDDEVAVDDAKSGGHYTDVPEEERDNSDEKALVE

SEQ ID NO: 1863872 - protein, 28 aa, Staphylococcus
SETYSDSVKKNNVISQSPKSKSIDEGST

SEQ ID NO: 1863873 - protein, 24 aa, Staphylococcus
SEVAENEARLREARIKEREAVSHE

SEQ ID NO: 1863874 - protein, 24 aa, Staphylococcus
SEVAETEKRLRDARIKEREAVSHE

SEQ ID NO: 1863875 - protein, 5 aa, Staphylococcus
SEVGP

SEQ ID NO: 1863876 - protein, 28 aa, Staphylococcus
SEYEEPKNKNMNSKRNDVSKNEGNSKVS

SEQ ID NO: 1863877 - protein, 12 aa, Staphylococcus
SEYFEDSDNEIH

SEQ ID NO: 1863878 - protein, 5 aa, Staphylococcus
SEYNG

SEQ ID NO: 1863879 - protein, 5 aa, Staphylococcus
SEYPK

SEQ ID NO: 1863880 - protein, 5 aa, Staphylococcus
SFADK

SEQ ID NO: 1863881 - protein, 19 aa, Staphylococcus
SFAPSKYKKTENTTTTARD

SEQ ID NO: 1863882 - protein, 4 aa, Staphylococcus
SFAS

SEQ ID NO: 1863883 - protein, 11 aa, Staphylococcus
SFDPKSPEHNA

SEQ ID NO: 1863884 - protein, 11 aa, Staphylococcus
SFDPKSSDYNA

SEQ ID NO: 1863885 - protein, 11 aa, Staphylococcus
SFDPKSSEHNA

SEQ ID NO: 1863886 - protein, 11 aa, Staphylococcus
SFDPKSSEYNA

SEQ ID NO: 1863887 - protein, 5 aa, Staphylococcus
SFEPE

SEQ ID NO: 1863888 - protein, 19 aa, Staphylococcus
SFETKDINQVDEKNKIPKG

SEQ ID NO: 1863889 - protein, 6 aa, Staphylococcus
SFETSY

SEQ ID NO: 1863890 - protein, 7 aa, Staphylococcus
SFETTQG

SEQ ID NO: 1863891 - protein, 11 aa, Staphylococcus
SFGKTNKSGVP

SEQ ID NO: 1863892 - protein, 5 aa, Staphylococcus
SFGTP

SEQ ID NO: 1863893 - protein, 5 aa, Staphylococcus
SFIGS

SEQ ID NO: 1863894 - protein, 12 aa, Staphylococcus
SFKPDMQELPSE

SEQ ID NO: 1863895 - protein, 11 aa, Staphylococcus
SFKPDSSEYNA

SEQ ID NO: 1863896 - protein, 18 aa, Staphylococcus
SFKSSQIKGSNGEMKLPK

SEQ ID NO: 1863897 - protein, 4 aa, Staphylococcus
SFNN

SEQ ID NO: 1863898 - protein, 11 aa, Staphylococcus
SFNPKSSEHNA

SEQ ID NO: 1863899 - protein, 5 aa, Staphylococcus
SFNQQ

SEQ ID NO: 1863900 - protein, 11 aa, Staphylococcus
SFPEGLQGQNI

SEQ ID NO: 1863901 - protein, 4 aa, Staphylococcus
SFPI

SEQ ID NO: 1863902 - protein, 11 aa, Staphylococcus
SFPSGHAMGST

SEQ ID NO: 1863903 - protein, 9 aa, Staphylococcus
SFPSGHSLS

SEQ ID NO: 1863904 - protein, 11 aa, Staphylococcus
SFPSGHSNAST

SEQ ID NO: 1863905 - protein, 5 aa, Staphylococcus
SFPTG

SEQ ID NO: 1863906 - protein, 6 aa, Staphylococcus
SFPTGK

SEQ ID NO: 1863907 - protein, 14 aa, Staphylococcus
SFQESTTQKGIYDR

SEQ ID NO: 1863908 - protein, 5 aa, Staphylococcus
SFQKD

SEQ ID NO: 1863909 - protein, 10 aa, Staphylococcus
SFQTNEPVTQ

SEQ ID NO: 1863910 - protein, 5 aa, Staphylococcus
SFSAG

SEQ ID NO: 1863911 - protein, 16 aa, Staphylococcus
SFSDPNQYANTGTRSD

SEQ ID NO: 1863912 - protein, 6 aa, Staphylococcus
SFSPEA

SEQ ID NO: 1863913 - protein, 5 aa, Staphylococcus
SFSQG

SEQ ID NO: 1863914 - protein, 5 aa, Staphylococcus
SFSSY

SEQ ID NO: 1863915 - protein, 12 aa, Staphylococcus
SFSTKGDNRGLG

SEQ ID NO: 1863916 - protein, 7 aa, Staphylococcus
SGAAQRI

SEQ ID NO: 1863917 - protein, 11 aa, Staphylococcus
SGAEGSRVEDT

SEQ ID NO: 1863918 - protein, 12 aa, Staphylococcus
SGAEGTRVEDTM

SEQ ID NO: 1863919 - protein, 11 aa, Staphylococcus
SGAEGTRVEGT

SEQ ID NO: 1863920 - protein, 9 aa, Staphylococcus
SGAESLSSY

SEQ ID NO: 1863921 - protein, 4 aa, Staphylococcus
SGAF

SEQ ID NO: 1863922 - protein, 5 aa, Staphylococcus
SGAFE

SEQ ID NO: 1863923 - protein, 6 aa, Staphylococcus
SGAGAS

SEQ ID NO: 1863924 - protein, 13 aa, Staphylococcus
SGAINKPISIPDT

SEQ ID NO: 1863925 - protein, 14 aa, Staphylococcus
SGAINKPVSIPDTY

SEQ ID NO: 1863926 - protein, 13 aa, Staphylococcus
SGAINKPVSIPNT

SEQ ID NO: 1863927 - protein, 7 aa, Staphylococcus
SGAITAG

SEQ ID NO: 1863928 - protein, 8 aa, Staphylococcus
SGAPTTIV

SEQ ID NO: 1863929 - protein, 4 aa, Staphylococcus
SGAQ

SEQ ID NO: 1863930 - protein, 9 aa, Staphylococcus
SGAQAEIDD

SEQ ID NO: 1863931 - protein, 10 aa, Staphylococcus
SGAQSDIDDA

SEQ ID NO: 1863932 - protein, 10 aa, Staphylococcus
SGASEIDKDT

SEQ ID NO: 1863933 - protein, 5 aa, Staphylococcus
SGASF

SEQ ID NO: 1863934 - protein, 6 aa, Staphylococcus
SGASFG

SEQ ID NO: 1863935 - protein, 12 aa, Staphylococcus
SGASGPLSDRLG

SEQ ID NO: 1863936 - protein, 7 aa, Staphylococcus
SGASLGS

SEQ ID NO: 1863937 - protein, 7 aa, Staphylococcus
SGATFEE

SEQ ID NO: 1863938 - protein, 6 aa, Staphylococcus
SGATFG

SEQ ID NO: 1863939 - protein, 5 aa, Staphylococcus
SGATG

SEQ ID NO: 1863940 - protein, 10 aa, Staphylococcus
SGAWKDGALA

SEQ ID NO: 1863941 - protein, 10 aa, Staphylococcus
SGAWKDGELA

SEQ ID NO: 1863942 - protein, 5 aa, Staphylococcus
SGCNS

SEQ ID NO: 1863943 - protein, 4 aa, Staphylococcus
SGDA

SEQ ID NO: 1863944 - protein, 5 aa, Staphylococcus
SGDEV

SEQ ID NO: 1863945 - protein, 4 aa, Staphylococcus
SGDG

SEQ ID NO: 1863946 - protein, 6 aa, Staphylococcus
SGDGYK

SEQ ID NO: 1863947 - protein, 4 aa, Staphylococcus
SGDI

SEQ ID NO: 1863948 - protein, 11 aa, Staphylococcus
SGDKHAGETLS

SEQ ID NO: 1863949 - protein, 25 aa, Staphylococcus
SGDKSFEADATGSVSANQSDDGSIT

SEQ ID NO: 1863950 - protein, 7 aa, Staphylococcus
SGDLNQQ

SEQ ID NO: 1863951 - protein, 38 aa, Staphylococcus
SGDNESCPNCGQSLSRNKKRKNKTKQQSSQSQNNNATN

SEQ ID NO: 1863952 - protein, 8 aa, Staphylococcus
SGDSIPAD

SEQ ID NO: 1863953 - protein, 21 aa, Staphylococcus
SGDSKKIDSRIDNAANPSNLI

SEQ ID NO: 1863954 - protein, 7 aa, Staphylococcus
SGDVSAT

SEQ ID NO: 1863955 - protein, 9 aa, Staphylococcus
SGEDGTFGE

SEQ ID NO: 1863956 - protein, 6 aa, Staphylococcus
SGEING

SEQ ID NO: 1863957 - protein, 8 aa, Staphylococcus
SGENYKTL

SEQ ID NO: 1863958 - protein, 15 aa, Staphylococcus
SGESNNKADPFSPSD

SEQ ID NO: 1863959 - protein, 6 aa, Staphylococcus
SGFSSS

SEQ ID NO: 1863960 - protein, 17 aa, Staphylococcus
SGGDPGEDGAGAGSSTG

SEQ ID NO: 1863961 - protein, 5 aa, Staphylococcus
SGGHA

SEQ ID NO: 1863962 - protein, 6 aa, Staphylococcus
SGGHAK

SEQ ID NO: 1863963 - protein, 6 aa, Staphylococcus
SGGKAK

SEQ ID NO: 1863964 - protein, 38 aa, Staphylococcus
SGGNWTNEGNIKGPKGDRGERGETGPKGDKGENGTSIG

SEQ ID NO: 1863965 - protein, 10 aa, Staphylococcus
SGGPGTQGKT

SEQ ID NO: 1863966 - protein, 12 aa, Staphylococcus
SGGQGPDEPIPE

SEQ ID NO: 1863967 - protein, 11 aa, Staphylococcus
SGGQGPDEPIS

SEQ ID NO: 1863968 - protein, 12 aa, Staphylococcus
SGGQGPDEPISE

SEQ ID NO: 1863969 - protein, 7 aa, Staphylococcus
SGGRDYK

SEQ ID NO: 1863970 - protein, 15 aa, Staphylococcus
SGGRGGIGAFAGPSA

SEQ ID NO: 1863971 - protein, 8 aa, Staphylococcus
SGGRNYKD

SEQ ID NO: 1863972 - protein, 6 aa, Staphylococcus
SGGRTE

SEQ ID NO: 1863973 - protein, 6 aa, Staphylococcus
SGGSGF

SEQ ID NO: 1863974 - protein, 5 aa, Staphylococcus
SGGSI

SEQ ID NO: 1863975 - protein, 4 aa, Staphylococcus
SGHA

SEQ ID NO: 1863976 - protein, 9 aa, Staphylococcus
SGIGTGGGT

SEQ ID NO: 1863977 - protein, 6 aa, Staphylococcus
SGIGTS

SEQ ID NO: 1863978 - protein, 9 aa, Staphylococcus
SGIKAAATG

SEQ ID NO: 1863979 - protein, 7 aa, Staphylococcus
SGIKGKD

SEQ ID NO: 1863980 - protein, 21 aa, Staphylococcus
SGIKPGKNKHNDDDPKQLKHH

SEQ ID NO: 1863981 - protein, 4 aa, Staphylococcus
SGIP

SEQ ID NO: 1863982 - protein, 27 aa, Staphylococcus
SGKEDSSDSEEKEGTSASSDDVKQVTE

SEQ ID NO: 1863983 - protein, 4 aa, Staphylococcus
SGKK

SEQ ID NO: 1863984 - protein, 4 aa, Staphylococcus
SGKN

SEQ ID NO: 1863985 - protein, 12 aa, Staphylococcus
SGKNEGKSEEEI

SEQ ID NO: 1863986 - protein, 7 aa, Staphylococcus
SGKNTAA

SEQ ID NO: 1863987 - protein, 26 aa, Staphylococcus
SGKQEGKSEEQISQELGNPKSIAKEL

SEQ ID NO: 1863988 - protein, 5 aa, Staphylococcus
SGKQV

SEQ ID NO: 1863989 - protein, 8 aa, Staphylococcus
SGKSEDDI

SEQ ID NO: 1863990 - protein, 8 aa, Staphylococcus
SGKTDGAI

SEQ ID NO: 1863991 - protein, 5 aa, Staphylococcus
SGKVK

SEQ ID NO: 1863992 - protein, 5 aa, Staphylococcus
SGLGS

SEQ ID NO: 1863993 - protein, 9 aa, Staphylococcus
SGLGSGAAN

SEQ ID NO: 1863994 - protein, 4 aa, Staphylococcus
SGLN

SEQ ID NO: 1863995 - protein, 12 aa, Staphylococcus
SGLNDAQRQKAI

SEQ ID NO: 1863996 - protein, 4 aa, Staphylococcus
SGLP

SEQ ID NO: 1863997 - protein, 11 aa, Staphylococcus
SGLTKDERQAM

SEQ ID NO: 1863998 - protein, 11 aa, Staphylococcus
SGLTKDERQEI

SEQ ID NO: 1863999 - protein, 11 aa, Staphylococcus
SGLTKEERQEM

SEQ ID NO: 1864000 - protein, 6 aa, Staphylococcus
SGLTRT

SEQ ID NO: 1864001 - protein, 5 aa, Staphylococcus
SGLTS

SEQ ID NO: 1864002 - protein, 6 aa, Staphylococcus
SGLTYT

SEQ ID NO: 1864003 - protein, 9 aa, Staphylococcus
SGMKAEYEQ

SEQ ID NO: 1864004 - protein, 6 aa, Staphylococcus
SGMKGK

SEQ ID NO: 1864005 - protein, 4 aa, Staphylococcus
SGNA

SEQ ID NO: 1864006 - protein, 5 aa, Staphylococcus
SGNAY

SEQ ID NO: 1864007 - protein, 5 aa, Staphylococcus
SGNEN

SEQ ID NO: 1864008 - protein, 7 aa, Staphylococcus
SGNHSES

SEQ ID NO: 1864009 - protein, 11 aa, Staphylococcus
SGNLNAASEAS

SEQ ID NO: 1864010 - protein, 10 aa, Staphylococcus
SGNQSADTSL

SEQ ID NO: 1864011 - protein, 4 aa, Staphylococcus
SGNS

SEQ ID NO: 1864012 - protein, 8 aa, Staphylococcus
SGNSKMKT

SEQ ID NO: 1864013 - protein, 7 aa, Staphylococcus
SGNSNVQ

SEQ ID NO: 1864014 - protein, 11 aa, Staphylococcus
SGNTGEQTTGS

SEQ ID NO: 1864015 - protein, 6 aa, Staphylococcus
SGNVDK

SEQ ID NO: 1864016 - protein, 12 aa, Staphylococcus
SGNYPKKQNEIA

SEQ ID NO: 1864017 - protein, 22 aa, Staphylococcus
SGNYVNADDATKQAYDNAIKEA

SEQ ID NO: 1864018 - protein, 37 aa, Staphylococcus
SGPSLESIKGTVKKVEDEIKDVSGTANVKSDLTQTYD

SEQ ID NO: 1864019 - protein, 7 aa, Staphylococcus
SGPSSGI

SEQ ID NO: 1864020 - protein, 8 aa, Staphylococcus
SGPSSGIS

SEQ ID NO: 1864021 - protein, 10 aa, Staphylococcus
SGQISAGNSI

SEQ ID NO: 1864022 - protein, 5 aa, Staphylococcus
SGQKG

SEQ ID NO: 1864023 - protein, 9 aa, Staphylococcus
SGQNQQQYK

SEQ ID NO: 1864024 - protein, 11 aa, Staphylococcus
SGQNSTITGTL

SEQ ID NO: 1864025 - protein, 4 aa, Staphylococcus
SGQS

SEQ ID NO: 1864026 - protein, 5 aa, Staphylococcus
SGQSI

SEQ ID NO: 1864027 - protein, 47 aa, Staphylococcus
SGQSQSGSSDDQSGSEMSSTGDNASSSSSQSQMSNQSQASNGEMPSV

SEQ ID NO: 1864028 - protein, 5 aa, Staphylococcus
SGREL

SEQ ID NO: 1864029 - protein, 6 aa, Staphylococcus
SGRLGT

SEQ ID NO: 1864030 - protein, 5 aa, Staphylococcus
SGRLP

SEQ ID NO: 1864031 - protein, 7 aa, Staphylococcus
SGRPVGE

SEQ ID NO: 1864032 - protein, 8 aa, Staphylococcus
SGSDSSIG

SEQ ID NO: 1864033 - protein, 4 aa, Staphylococcus
SGSG

SEQ ID NO: 1864034 - protein, 7 aa, Staphylococcus
SGSGDGF

SEQ ID NO: 1864035 - protein, 4 aa, Staphylococcus
SGSI

SEQ ID NO: 1864036 - protein, 5 aa, Staphylococcus
SGSIP

SEQ ID NO: 1864037 - protein, 4 aa, Staphylococcus
SGSL

SEQ ID NO: 1864038 - protein, 5 aa, Staphylococcus
SGSLP

SEQ ID NO: 1864039 - protein, 20 aa, Staphylococcus
SGSNLEARTIENAELNKNKK

SEQ ID NO: 1864040 - protein, 12 aa, Staphylococcus
SGSSAGGAAKAV

SEQ ID NO: 1864041 - protein, 10 aa, Staphylococcus
SGSTGQPKGV

SEQ ID NO: 1864042 - protein, 9 aa, Staphylococcus
SGSTKSITP

SEQ ID NO: 1864043 - protein, 12 aa, Staphylococcus
SGTFDEKSAQSI

SEQ ID NO: 1864044 - protein, 5 aa, Staphylococcus
SGTFG

SEQ ID NO: 1864045 - protein, 6 aa, Staphylococcus
SGTGDY

SEQ ID NO: 1864046 - protein, 9 aa, Staphylococcus
SGTKNEKMI

SEQ ID NO: 1864047 - protein, 12 aa, Staphylococcus
SGTKQEKEMSKE

SEQ ID NO: 1864048 - protein, 6 aa, Staphylococcus
SGTKYP

SEQ ID NO: 1864049 - protein, 16 aa, Staphylococcus
SGTQISQDKIDEISKK

SEQ ID NO: 1864050 - protein, 4 aa, Staphylococcus
SGTS

SEQ ID NO: 1864051 - protein, 6 aa, Staphylococcus
SGTTQI

SEQ ID NO: 1864052 - protein, 7 aa, Staphylococcus
SGTTSTF

SEQ ID NO: 1864053 - protein, 6 aa, Staphylococcus
SGVEAD

SEQ ID NO: 1864054 - protein, 6 aa, Staphylococcus
SGVESD

SEQ ID NO: 1864055 - protein, 11 aa, Staphylococcus
SGVGDRVAHGG

SEQ ID NO: 1864056 - protein, 8 aa, Staphylococcus
SGVGTQVD

SEQ ID NO: 1864057 - protein, 12 aa, Staphylococcus
SGVNYAEKHAKD

SEQ ID NO: 1864058 - protein, 6 aa, Staphylococcus
SGVNYP

SEQ ID NO: 1864059 - protein, 6 aa, Staphylococcus
SGVPTE

SEQ ID NO: 1864060 - protein, 5 aa, Staphylococcus
SGYGG

SEQ ID NO: 1864061 - protein, 6 aa, Staphylococcus
SGYGQG

SEQ ID NO: 1864062 - protein, 5 aa, Staphylococcus
SGYMT

SEQ ID NO: 1864063 - protein, 14 aa, Staphylococcus
SGYSTKETQTENHG

SEQ ID NO: 1864064 - protein, 5 aa, Staphylococcus
SHAVH

SEQ ID NO: 1864065 - protein, 7 aa, Staphylococcus
SHDTQLE

SEQ ID NO: 1864066 - protein, 6 aa, Staphylococcus
SHEGEL

SEQ ID NO: 1864067 - protein, 10 aa, Staphylococcus
SHEGGEINDS

SEQ ID NO: 1864068 - protein, 6 aa, Staphylococcus
SHEGNL

SEQ ID NO: 1864069 - protein, 15 aa, Staphylococcus
SHEKTKKIVTPPEAE

SEQ ID NO: 1864070 - protein, 4 aa, Staphylococcus
SHFR

SEQ ID NO: 1864071 - protein, 7 aa, Staphylococcus
SHFSEKE

SEQ ID NO: 1864072 - protein, 7 aa, Staphylococcus
SHGDNPL

SEQ ID NO: 1864073 - protein, 7 aa, Staphylococcus
SHGEGGN

SEQ ID NO: 1864074 - protein, 7 aa, Staphylococcus
SHGGGGN

SEQ ID NO: 1864075 - protein, 6 aa, Staphylococcus
SHGGIT

SEQ ID NO: 1864076 - protein, 4 aa, Staphylococcus
SHGL

SEQ ID NO: 1864077 - protein, 8 aa, Staphylococcus
SHHDSNHH

SEQ ID NO: 1864078 - protein, 19 aa, Staphylococcus
SHITDTQTGPNATQTEVEN

SEQ ID NO: 1864079 - protein, 8 aa, Staphylococcus
SHKAMKDY

SEQ ID NO: 1864080 - protein, 9 aa, Staphylococcus
SHKNGKREY

SEQ ID NO: 1864081 - protein, 7 aa, Staphylococcus
SHKPSTN

SEQ ID NO: 1864082 - protein, 8 aa, Staphylococcus
SHNNPSVL

SEQ ID NO: 1864083 - protein, 15 aa, Staphylococcus
SHNTTGEHVSKAPAL

SEQ ID NO: 1864084 - protein, 8 aa, Staphylococcus
SHPKAKAI

SEQ ID NO: 1864085 - protein, 21 aa, Staphylococcus
SHQETPMVQNETKQETTNKQM

SEQ ID NO: 1864086 - protein, 10 aa, Staphylococcus
SHQQQNEFAS

SEQ ID NO: 1864087 - protein, 7 aa, Staphylococcus
SHQQSTV

SEQ ID NO: 1864088 - protein, 7 aa, Staphylococcus
SHQSGDA

SEQ ID NO: 1864089 - protein, 9 aa, Staphylococcus
SHRNAPKYH

SEQ ID NO: 1864090 - protein, 8 aa, Staphylococcus
SHRNDGAA

SEQ ID NO: 1864091 - protein, 49 aa, Staphylococcus
SHSASTSASTSVSDRDSISDAASLSDSTSLSNLNSDSTSASLSASTSLT

SEQ ID NO: 1864092 - protein, 4 aa, Staphylococcus
SHSE

SEQ ID NO: 1864093 - protein, 4 aa, Staphylococcus
SHSH

SEQ ID NO: 1864094 - protein, 4 aa, Staphylococcus
SHSI

SEQ ID NO: 1864095 - protein, 8 aa, Staphylococcus
SHSNDSKQ

SEQ ID NO: 1864096 - protein, 5 aa, Staphylococcus
SHSNE

SEQ ID NO: 1864097 - protein, 21 aa, Staphylococcus
SHSNKGTEATTDLANNIKQQT

SEQ ID NO: 1864098 - protein, 6 aa, Staphylococcus
SHSSEL

SEQ ID NO: 1864099 - protein, 8 aa, Staphylococcus
SHSSQVQQ

SEQ ID NO: 1864100 - protein, 6 aa, Staphylococcus
SHTEGE

SEQ ID NO: 1864101 - protein, 8 aa, Staphylococcus
SHTEHPHT

SEQ ID NO: 1864102 - protein, 5 aa, Staphylococcus
SHTIQ

SEQ ID NO: 1864103 - protein, 10 aa, Staphylococcus
SHTKSRKLSQ

SEQ ID NO: 1864104 - protein, 7 aa, Staphylococcus
SHTQSSK

SEQ ID NO: 1864105 - protein, 6 aa, Staphylococcus
SHVNPE

SEQ ID NO: 1864106 - protein, 4 aa, Staphylococcus
SHVS

SEQ ID NO: 1864107 - protein, 8 aa, Staphylococcus
SHVSQDGV

SEQ ID NO: 1864108 - protein, 9 aa, Staphylococcus
SHYNKKGDK

SEQ ID NO: 1864109 - protein, 6 aa, Staphylococcus
SIADKV

SEQ ID NO: 1864110 - protein, 32 aa, Staphylococcus
SIANQDQVKSESKYLNEDPTVKANYDQAVQRA

SEQ ID NO: 1864111 - protein, 9 aa, Staphylococcus
SIAPADTEF

SEQ ID NO: 1864112 - protein, 22 aa, Staphylococcus
SIAPSEGANNDKKQVNSAKSAI

SEQ ID NO: 1864113 - protein, 5 aa, Staphylococcus
SIAPT

SEQ ID NO: 1864114 - protein, 4 aa, Staphylococcus
SIAT

SEQ ID NO: 1864115 - protein, 6 aa, Staphylococcus
SIDDTN

SEQ ID NO: 1864116 - protein, 19 aa, Staphylococcus
SIDGSKYSADLDADATKAR

SEQ ID NO: 1864117 - protein, 6 aa, Staphylococcus
SIDIPS

SEQ ID NO: 1864118 - protein, 12 aa, Staphylococcus
SIDKGQTEAARS

SEQ ID NO: 1864119 - protein, 7 aa, Staphylococcus
SIDKSST

SEQ ID NO: 1864120 - protein, 28 aa, Staphylococcus
SIDLGSAEHARGNEISSEAKQLTANTLP

SEQ ID NO: 1864121 - protein, 28 aa, Staphylococcus
SIDLGSAEHARGTEISQKAKEMTASTLP

SEQ ID NO: 1864122 - protein, 25 aa, Staphylococcus
SIDLGSAEHSRGSEITKEAKNLTAH

SEQ ID NO: 1864123 - protein, 28 aa, Staphylococcus
SIDLGSAENSRGSEISSQAKDLTANTLP

SEQ ID NO: 1864124 - protein, 28 aa, Staphylococcus
SIDLGSAESSRGSEIASQAKDMAANTLP

SEQ ID NO: 1864125 - protein, 5 aa, Staphylococcus
SIDNN

SEQ ID NO: 1864126 - protein, 7 aa, Staphylococcus
SIDPGEI

SEQ ID NO: 1864127 - protein, 6 aa, Staphylococcus
SIDQTG

SEQ ID NO: 1864128 - protein, 8 aa, Staphylococcus
SIDSRDSK

SEQ ID NO: 1864129 - protein, 8 aa, Staphylococcus
SIDTNKKI

SEQ ID NO: 1864130 - protein, 8 aa, Staphylococcus
SIEDEETL

SEQ ID NO: 1864131 - protein, 4 aa, Staphylococcus
SIEG

SEQ ID NO: 1864132 - protein, 9 aa, Staphylococcus
SIENEKERL

SEQ ID NO: 1864133 - protein, 12 aa, Staphylococcus
SIENGKTTAEIR

SEQ ID NO: 1864134 - protein, 19 aa, Staphylococcus
SIENTKAVGPSIAPTNAKD

SEQ ID NO: 1864135 - protein, 6 aa, Staphylococcus
SIEPTF

SEQ ID NO: 1864136 - protein, 8 aa, Staphylococcus
SIEQEKER

SEQ ID NO: 1864137 - protein, 14 aa, Staphylococcus
SIETGAGSTLGETG

SEQ ID NO: 1864138 - protein, 7 aa, Staphylococcus
SIGAEPY

SEQ ID NO: 1864139 - protein, 10 aa, Staphylococcus
SIGDKFSGDE

SEQ ID NO: 1864140 - protein, 14 aa, Staphylococcus
SIGDQHKGKALAKG

SEQ ID NO: 1864141 - protein, 4 aa, Staphylococcus
SIGG

SEQ ID NO: 1864142 - protein, 14 aa, Staphylococcus
SIGGPKKSFDEKYS

SEQ ID NO: 1864143 - protein, 4 aa, Staphylococcus
SIGL

SEQ ID NO: 1864144 - protein, 4 aa, Staphylococcus
SIGT

SEQ ID NO: 1864145 - protein, 4 aa, Staphylococcus
SIGY

SEQ ID NO: 1864146 - protein, 5 aa, Staphylococcus
SIGYG

SEQ ID NO: 1864147 - protein, 4 aa, Staphylococcus
SIID

SEQ ID NO: 1864148 - protein, 5 aa, Staphylococcus
SIIDE

SEQ ID NO: 1864149 - protein, 13 aa, Staphylococcus
SIIGTSAGLQRTA

SEQ ID NO: 1864150 - protein, 6 aa, Staphylococcus
SIKDDS

SEQ ID NO: 1864151 - protein, 37 aa, Staphylococcus
SIKDDVDSLRSNESSSTSQSDKKTSNQSDNKERQNQI

SEQ ID NO: 1864152 - protein, 16 aa, Staphylococcus
SIKDSEYNNVNDNKAY

SEQ ID NO: 1864153 - protein, 7 aa, Staphylococcus
SIKDVKD

SEQ ID NO: 1864154 - protein, 10 aa, Staphylococcus
SIKDVKDNNL

SEQ ID NO: 1864155 - protein, 24 aa, Staphylococcus
SIKEPLDRDHSQLRQKNLKDGDPM

SEQ ID NO: 1864156 - protein, 56 aa, Staphylococcus
SIKNDIDSAKKDIESSKENDSNQLPSDENSTEEETTESSSIQDAPTTENTTHSNSN

SEQ ID NO: 1864157 - protein, 24 aa, Staphylococcus
SIKNNANLSNDKRSEETKKYNDKL

SEQ ID NO: 1864158 - protein, 7 aa, Staphylococcus
SIKPESQ

SEQ ID NO: 1864159 - protein, 24 aa, Staphylococcus
SIKQSSNYINEDPASQNAYNDALQ

SEQ ID NO: 1864160 - protein, 6 aa, Staphylococcus
SIKRFG

SEQ ID NO: 1864161 - protein, 9 aa, Staphylococcus
SIKSGLQSV

SEQ ID NO: 1864162 - protein, 10 aa, Staphylococcus
SIKTPDNAYP

SEQ ID NO: 1864163 - protein, 15 aa, Staphylococcus
SINNEELNDQPGQQF

SEQ ID NO: 1864164 - protein, 15 aa, Staphylococcus
SINNTNNTYGLGDKK

SEQ ID NO: 1864165 - protein, 15 aa, Staphylococcus
SINPDPSFKVNGKQY

SEQ ID NO: 1864166 - protein, 15 aa, Staphylococcus
SINPDPSIKVNGQSY

SEQ ID NO: 1864167 - protein, 16 aa, Staphylococcus
SINPEPRLKANGKEYD

SEQ ID NO: 1864168 - protein, 15 aa, Staphylococcus
SINPEPTIQSNGKTY

SEQ ID NO: 1864169 - protein, 7 aa, Staphylococcus
SINQETI

SEQ ID NO: 1864170 - protein, 6 aa, Staphylococcus
SINTEL

SEQ ID NO: 1864171 - protein, 12 aa, Staphylococcus
SIPDAKKKVASM

SEQ ID NO: 1864172 - protein, 12 aa, Staphylococcus
SIPEDRQGSALG

SEQ ID NO: 1864173 - protein, 6 aa, Staphylococcus
SIPEHK

SEQ ID NO: 1864174 - protein, 9 aa, Staphylococcus
SIPEIGETV

SEQ ID NO: 1864175 - protein, 6 aa, Staphylococcus
SIPERT

SEQ ID NO: 1864176 - protein, 17 aa, Staphylococcus
SIPKEQPKTQTETKTVT

SEQ ID NO: 1864177 - protein, 12 aa, Staphylococcus
SIPNAKKQVSNL

SEQ ID NO: 1864178 - protein, 5 aa, Staphylococcus
SIPNN

SEQ ID NO: 1864179 - protein, 6 aa, Staphylococcus
SIPNVT

SEQ ID NO: 1864180 - protein, 5 aa, Staphylococcus
SIPPG

SEQ ID NO: 1864181 - protein, 12 aa, Staphylococcus
SIPPNEKEETLR

SEQ ID NO: 1864182 - protein, 8 aa, Staphylococcus
SIPQTSDI

SEQ ID NO: 1864183 - protein, 6 aa, Staphylococcus
SIQAPH

SEQ ID NO: 1864184 - protein, 6 aa, Staphylococcus
SIQPSV

SEQ ID NO: 1864185 - protein, 7 aa, Staphylococcus
SIQQRKS

SEQ ID NO: 1864186 - protein, 8 aa, Staphylococcus
SIQTGEPV

SEQ ID NO: 1864187 - protein, 13 aa, Staphylococcus
SIQYQKESRIEAS

SEQ ID NO: 1864188 - protein, 20 aa, Staphylococcus
SIREEGPESHMKKTGTPTMG

SEQ ID NO: 1864189 - protein, 8 aa, Staphylococcus
SIRSSKNQ

SEQ ID NO: 1864190 - protein, 8 aa, Staphylococcus
SISGSLGG

SEQ ID NO: 1864191 - protein, 7 aa, Staphylococcus
SISKIAS

SEQ ID NO: 1864192 - protein, 10 aa, Staphylococcus
SISKKDNDLK

SEQ ID NO: 1864193 - protein, 7 aa, Staphylococcus
SISLTGP

SEQ ID NO: 1864194 - protein, 6 aa, Staphylococcus
SISNPI

SEQ ID NO: 1864195 - protein, 4 aa, Staphylococcus
SISP

SEQ ID NO: 1864196 - protein, 9 aa, Staphylococcus
SISQETSKV

SEQ ID NO: 1864197 - protein, 8 aa, Staphylococcus
SISSDGWD

SEQ ID NO: 1864198 - protein, 30 aa, Staphylococcus
SISSGTTSSISTNQQKVNVNTAKESELTSI

SEQ ID NO: 1864199 - protein, 9 aa, Staphylococcus
SISSISQDQ

SEQ ID NO: 1864200 - protein, 6 aa, Staphylococcus
SITDNE

SEQ ID NO: 1864201 - protein, 5 aa, Staphylococcus
SITDT

SEQ ID NO: 1864202 - protein, 23 aa, Staphylococcus
SITESSTYGDNDTPAPPTKDIGG

SEQ ID NO: 1864203 - protein, 7 aa, Staphylococcus
SITGRGI

SEQ ID NO: 1864204 - protein, 7 aa, Staphylococcus
SITNGTS

SEQ ID NO: 1864205 - protein, 7 aa, Staphylococcus
SITNSYR

SEQ ID NO: 1864206 - protein, 5 aa, Staphylococcus
SITPT

SEQ ID NO: 1864207 - protein, 6 aa, Staphylococcus
SITQSY

SEQ ID NO: 1864208 - protein, 11 aa, Staphylococcus
SITSGKGNGAM

SEQ ID NO: 1864209 - protein, 5 aa, Staphylococcus
SITSS

SEQ ID NO: 1864210 - protein, 13 aa, Staphylococcus
SITVPKGQDGHSI

SEQ ID NO: 1864211 - protein, 29 aa, Staphylococcus
SITVPKGQDGQNGTSITVTNTELDKDGNT

SEQ ID NO: 1864212 - protein, 5 aa, Staphylococcus
SIVDE

SEQ ID NO: 1864213 - protein, 5 aa, Staphylococcus
SIYGA

SEQ ID NO: 1864214 - protein, 33 aa, Staphylococcus
SIYPSSSGDITYEYNGKKRTTTVTEDDEKTLGT

SEQ ID NO: 1864215 - protein, 12 aa, Staphylococcus
SKAAKKYLNHQT

SEQ ID NO: 1864216 - protein, 16 aa, Staphylococcus
SKADGTASKVSPNLSQ

SEQ ID NO: 1864217 - protein, 15 aa, Staphylococcus
SKADSATKVSPKPAI

SEQ ID NO: 1864218 - protein, 29 aa, Staphylococcus
SKAEKLLSDEPETPKINEEKGKEFTTIST

SEQ ID NO: 1864219 - protein, 9 aa, Staphylococcus
SKAEQRLND

SEQ ID NO: 1864220 - protein, 6 aa, Staphylococcus
SKAGAE

SEQ ID NO: 1864221 - protein, 6 aa, Staphylococcus
SKAGGM

SEQ ID NO: 1864222 - protein, 7 aa, Staphylococcus
SKAINNL

SEQ ID NO: 1864223 - protein, 8 aa, Staphylococcus
SKAKDEVA

SEQ ID NO: 1864224 - protein, 9 aa, Staphylococcus
SKAKDKPAY

SEQ ID NO: 1864225 - protein, 10 aa, Staphylococcus
SKAKDKPAYH

SEQ ID NO: 1864226 - protein, 7 aa, Staphylococcus
SKAKDKV

SEQ ID NO: 1864227 - protein, 14 aa, Staphylococcus
SKAKMYDNKKRRVR

SEQ ID NO: 1864228 - protein, 13 aa, Staphylococcus
SKAKMYDNQKRRV

SEQ ID NO: 1864229 - protein, 14 aa, Staphylococcus
SKAKMYDSQKKRVR

SEQ ID NO: 1864230 - protein, 13 aa, Staphylococcus
SKAKMYDSSKRRV

SEQ ID NO: 1864231 - protein, 19 aa, Staphylococcus
SKANVDDLKTIKDKSTYVP

SEQ ID NO: 1864232 - protein, 7 aa, Staphylococcus
SKAPDTL

SEQ ID NO: 1864233 - protein, 13 aa, Staphylococcus
SKAPNGSKAMGAL

SEQ ID NO: 1864234 - protein, 14 aa, Staphylococcus
SKAPRIYEKSPQHH

SEQ ID NO: 1864235 - protein, 10 aa, Staphylococcus
SKARPKPDFE

SEQ ID NO: 1864236 - protein, 6 aa, Staphylococcus
SKASKT

SEQ ID NO: 1864237 - protein, 6 aa, Staphylococcus
SKAVHT

SEQ ID NO: 1864238 - protein, 16 aa, Staphylococcus
SKDDDDKAPEKKPKRS

SEQ ID NO: 1864239 - protein, 8 aa, Staphylococcus
SKDDDYYP

SEQ ID NO: 1864240 - protein, 12 aa, Staphylococcus
SKDDENSKELER

SEQ ID NO: 1864241 - protein, 6 aa, Staphylococcus
SKDESV

SEQ ID NO: 1864242 - protein, 40 aa, Staphylococcus
SKDFESYAKGKSSLEAEDSGNTLTGEINSTVNVSDSNLSD

SEQ ID NO: 1864243 - protein, 4 aa, Staphylococcus
SKDH

SEQ ID NO: 1864244 - protein, 10 aa, Staphylococcus
SKDHNDTVPF

SEQ ID NO: 1864245 - protein, 4 aa, Staphylococcus
SKDI

SEQ ID NO: 1864246 - protein, 8 aa, Staphylococcus
SKDIPKSE

SEQ ID NO: 1864247 - protein, 7 aa, Staphylococcus
SKDKAAI

SEQ ID NO: 1864248 - protein, 6 aa, Staphylococcus
SKDQTL

SEQ ID NO: 1864249 - protein, 6 aa, Staphylococcus
SKDSKL

SEQ ID NO: 1864250 - protein, 5 aa, Staphylococcus
SKDSL

SEQ ID NO: 1864251 - protein, 15 aa, Staphylococcus
SKDSQGNTTVQFSDN

SEQ ID NO: 1864252 - protein, 6 aa, Staphylococcus
SKDSRL

SEQ ID NO: 1864253 - protein, 9 aa, Staphylococcus
SKDSSVKNY

SEQ ID NO: 1864254 - protein, 13 aa, Staphylococcus
SKDSVSDETKQKL

SEQ ID NO: 1864255 - protein, 9 aa, Staphylococcus
SKDTDGNSV

SEQ ID NO: 1864256 - protein, 6 aa, Staphylococcus
SKDTLE

SEQ ID NO: 1864257 - protein, 20 aa, Staphylococcus
SKDTVSEQQKQKLKASLSTI

SEQ ID NO: 1864258 - protein, 11 aa, Staphylococcus
SKDVGGTSQTV

SEQ ID NO: 1864259 - protein, 7 aa, Staphylococcus
SKDYDNV

SEQ ID NO: 1864260 - protein, 9 aa, Staphylococcus
SKEAGSANG

SEQ ID NO: 1864261 - protein, 10 aa, Staphylococcus
SKEANSDNQL

SEQ ID NO: 1864262 - protein, 9 aa, Staphylococcus
SKEATTDNK

SEQ ID NO: 1864263 - protein, 8 aa, Staphylococcus
SKEDLPEG

SEQ ID NO: 1864264 - protein, 9 aa, Staphylococcus
SKEDTSLNS

SEQ ID NO: 1864265 - protein, 15 aa, Staphylococcus
SKEEDKTDEKPPKRS

SEQ ID NO: 1864266 - protein, 4 aa, Staphylococcus
SKEG

SEQ ID NO: 1864267 - protein, 4 aa, Staphylococcus
SKEH

SEQ ID NO: 1864268 - protein, 7 aa, Staphylococcus
SKEHDDL

SEQ ID NO: 1864269 - protein, 17 aa, Staphylococcus
SKEKFKKVTEKISKKRD

SEQ ID NO: 1864270 - protein, 6 aa, Staphylococcus
SKEKNA

SEQ ID NO: 1864271 - protein, 13 aa, Staphylococcus
SKELTEERYNQRS

SEQ ID NO: 1864272 - protein, 8 aa, Staphylococcus
SKEPIGAQ

SEQ ID NO: 1864273 - protein, 9 aa, Staphylococcus
SKESGTANG

SEQ ID NO: 1864274 - protein, 7 aa, Staphylococcus
SKESYNT

SEQ ID NO: 1864275 - protein, 15 aa, Staphylococcus
SKETARKQLKNGKSL

SEQ ID NO: 1864276 - protein, 7 aa, Staphylococcus
SKETTMN

SEQ ID NO: 1864277 - protein, 7 aa, Staphylococcus
SKEYVDE

SEQ ID NO: 1864278 - protein, 15 aa, Staphylococcus
SKEYVDELKGELEFY

SEQ ID NO: 1864279 - protein, 15 aa, Staphylococcus
SKEYVDELKSDLEFY

SEQ ID NO: 1864280 - protein, 15 aa, Staphylococcus
SKEYVDELKSELEFY

SEQ ID NO: 1864281 - protein, 7 aa, Staphylococcus
SKFAENE

SEQ ID NO: 1864282 - protein, 9 aa, Staphylococcus
SKFDEDQSE

SEQ ID NO: 1864283 - protein, 11 aa, Staphylococcus
SKFIDDDKQKY

SEQ ID NO: 1864284 - protein, 8 aa, Staphylococcus
SKFPAKNK

SEQ ID NO: 1864285 - protein, 8 aa, Staphylococcus
SKFPAQNK

SEQ ID NO: 1864286 - protein, 8 aa, Staphylococcus
SKFPASNK

SEQ ID NO: 1864287 - protein, 10 aa, Staphylococcus
SKGADKAKNF

SEQ ID NO: 1864288 - protein, 5 aa, Staphylococcus
SKGAE

SEQ ID NO: 1864289 - protein, 42 aa, Staphylococcus
SKGAPKSDDDKEDEEKNADDKDKDDKESKDDEPATKDYTETY

SEQ ID NO: 1864290 - protein, 5 aa, Staphylococcus
SKGAS

SEQ ID NO: 1864291 - protein, 6 aa, Staphylococcus
SKGASL

SEQ ID NO: 1864292 - protein, 5 aa, Staphylococcus
SKGDG

SEQ ID NO: 1864293 - protein, 8 aa, Staphylococcus
SKGDINPA

SEQ ID NO: 1864294 - protein, 16 aa, Staphylococcus
SKGDQTEGMEATKQNI

SEQ ID NO: 1864295 - protein, 7 aa, Staphylococcus
SKGDSLD

SEQ ID NO: 1864296 - protein, 19 aa, Staphylococcus
SKGDYSKQTSVSTKDEIGE

SEQ ID NO: 1864297 - protein, 29 aa, Staphylococcus
SKGEDTDSDEDKNDEDGDSDDVKTHSETV

SEQ ID NO: 1864298 - protein, 11 aa, Staphylococcus
SKGEHNINGKT

SEQ ID NO: 1864299 - protein, 10 aa, Staphylococcus
SKGEQKINGK

SEQ ID NO: 1864300 - protein, 8 aa, Staphylococcus
SKGEVDAM

SEQ ID NO: 1864301 - protein, 6 aa, Staphylococcus
SKGFGS

SEQ ID NO: 1864302 - protein, 10 aa, Staphylococcus
SKGFKDGPRT

SEQ ID NO: 1864303 - protein, 10 aa, Staphylococcus
SKGHTNPKQI

SEQ ID NO: 1864304 - protein, 7 aa, Staphylococcus
SKGIQQG

SEQ ID NO: 1864305 - protein, 36 aa, Staphylococcus
SKGKQAHKFEQQLDKNNIKHDKHTYESINPKTVKDN

SEQ ID NO: 1864306 - protein, 38 aa, Staphylococcus
SKGKSGEDDDDSDDSDVKSTSETVKVPYSGSKGKSQTV

SEQ ID NO: 1864307 - protein, 7 aa, Staphylococcus
SKGKSIA

SEQ ID NO: 1864308 - protein, 8 aa, Staphylococcus
SKGKYKKE

SEQ ID NO: 1864309 - protein, 9 aa, Staphylococcus
SKGLGQAGT

SEQ ID NO: 1864310 - protein, 10 aa, Staphylococcus
SKGLSKAGTW

SEQ ID NO: 1864311 - protein, 9 aa, Staphylococcus
SKGNINPSS

SEQ ID NO: 1864312 - protein, 7 aa, Staphylococcus
SKGNTAE

SEQ ID NO: 1864313 - protein, 4 aa, Staphylococcus
SKGP

SEQ ID NO: 1864314 - protein, 8 aa, Staphylococcus
SKGPEKIN

SEQ ID NO: 1864315 - protein, 7 aa, Staphylococcus
SKGRKKR

SEQ ID NO: 1864316 - protein, 6 aa, Staphylococcus
SKGRTI

SEQ ID NO: 1864317 - protein, 6 aa, Staphylococcus
SKGRTL

SEQ ID NO: 1864318 - protein, 7 aa, Staphylococcus
SKGSEHR

SEQ ID NO: 1864319 - protein, 9 aa, Staphylococcus
SKGSINPSG

SEQ ID NO: 1864320 - protein, 8 aa, Staphylococcus
SKGSNEKI

SEQ ID NO: 1864321 - protein, 7 aa, Staphylococcus
SKGSSYP

SEQ ID NO: 1864322 - protein, 4 aa, Staphylococcus
SKGT

SEQ ID NO: 1864323 - protein, 15 aa, Staphylococcus
SKGTVAIGASQSEVT

SEQ ID NO: 1864324 - protein, 5 aa, Staphylococcus
SKGVH

SEQ ID NO: 1864325 - protein, 9 aa, Staphylococcus
SKGVKSTGS

SEQ ID NO: 1864326 - protein, 7 aa, Staphylococcus
SKGVKSV

SEQ ID NO: 1864327 - protein, 8 aa, Staphylococcus
SKHHKKYG

SEQ ID NO: 1864328 - protein, 17 aa, Staphylococcus
SKHKNGYERVEENEQTE

SEQ ID NO: 1864329 - protein, 9 aa, Staphylococcus
SKHSQLNNE

SEQ ID NO: 1864330 - protein, 7 aa, Staphylococcus
SKHTQAE

SEQ ID NO: 1864331 - protein, 15 aa, Staphylococcus
SKHYSPDMSNYDGMK

SEQ ID NO: 1864332 - protein, 12 aa, Staphylococcus
SKIDPNSTADLK

SEQ ID NO: 1864333 - protein, 8 aa, Staphylococcus
SKIEGTPD

SEQ ID NO: 1864334 - protein, 11 aa, Staphylococcus
SKIKNTQLNSL

SEQ ID NO: 1864335 - protein, 14 aa, Staphylococcus
SKIKTNKNFTVGDS

SEQ ID NO: 1864336 - protein, 8 aa, Staphylococcus
SKIKTSEG

SEQ ID NO: 1864337 - protein, 4 aa, Staphylococcus
SKIN

SEQ ID NO: 1864338 - protein, 12 aa, Staphylococcus
SKINDHKENLQK

SEQ ID NO: 1864339 - protein, 5 aa, Staphylococcus
SKISK

SEQ ID NO: 1864340 - protein, 21 aa, Staphylococcus
SKISKSLSKDRADDNQYTKEE

SEQ ID NO: 1864341 - protein, 8 aa, Staphylococcus
SKITDKDE

SEQ ID NO: 1864342 - protein, 9 aa, Staphylococcus
SKITDKNDL

SEQ ID NO: 1864343 - protein, 14 aa, Staphylococcus
SKITRREEDEKDKT

SEQ ID NO: 1864344 - protein, 17 aa, Staphylococcus
SKKAEMKEKVESGEIPA

SEQ ID NO: 1864345 - protein, 20 aa, Staphylococcus
SKKAEMKEKVESGEVPAQQA

SEQ ID NO: 1864346 - protein, 7 aa, Staphylococcus
SKKAKYN

SEQ ID NO: 1864347 - protein, 186 aa, Staphylococcus
SKKANERLNNETKQEQKDKKDKDDKEKKEKSSDKKSDEKQNTQQKPSQQQTRQQPTTQQQPSTQQPKSQQPKTQQKPKVDNKTKEAPTKEKPSKQEKPSTQEKPSTQEKPSTQEKPSTQEKPSTQQKPSTQEKPSTQQKPSTQEKPSAQQSTQNNSNNNTQRSASQQSNNRQSSQSQNSSSNNKSD

SEQ ID NO: 1864348 - protein, 8 aa, Staphylococcus
SKKARYDV

SEQ ID NO: 1864349 - protein, 7 aa, Staphylococcus
SKKARYN

SEQ ID NO: 1864350 - protein, 8 aa, Staphylococcus
SKKARYNV

SEQ ID NO: 1864351 - protein, 10 aa, Staphylococcus
SKKATSHKEN

SEQ ID NO: 1864352 - protein, 4 aa, Staphylococcus
SKKE

SEQ ID NO: 1864353 - protein, 16 aa, Staphylococcus
SKKEAFNQLEKGKSVG

SEQ ID NO: 1864354 - protein, 6 aa, Staphylococcus
SKKEEI

SEQ ID NO: 1864355 - protein, 14 aa, Staphylococcus
SKKETNKYGPSTKF

SEQ ID NO: 1864356 - protein, 7 aa, Staphylococcus
SKKGDYN

SEQ ID NO: 1864357 - protein, 14 aa, Staphylococcus
SKKGKITLIENIDQ

SEQ ID NO: 1864358 - protein, 249 aa, Staphylococcus
SKKGSERLSQEQKKEKQEKKEKKEKKEREEKKKKDEEKKRKEKQRQEEEWANQQAAEQERQNNLNAQREQAARQEQQNQNVQKQQPKNNKAQQEQSKKQQEQARKDQEAAQKQAEEQQKKNEEVAKERQQQAKEQADKAMEQQKQQEQQKAQDDKQKQQQQQQQQEQQKSNQNQQQKQQQNSQNQQSNNKPRPGQEQQQQQPTVKNTPSSNQSNTQSSSGSNQAQSKQTPSNSSNNSAQKPSSNNQSSQ

SEQ ID NO: 1864359 - protein, 8 aa, Staphylococcus
SKKHKGKA

SEQ ID NO: 1864360 - protein, 6 aa, Staphylococcus
SKKHLQ

SEQ ID NO: 1864361 - protein, 5 aa, Staphylococcus
SKKID

SEQ ID NO: 1864362 - protein, 6 aa, Staphylococcus
SKKIPS

SEQ ID NO: 1864363 - protein, 48 aa, Staphylococcus
SKKKAQEKVEAQYKSREQQLSDEHEEELEKERIENKKTVTKQKEEYTA

SEQ ID NO: 1864364 - protein, 57 aa, Staphylococcus
SKKKIKNQTEAQYKEKEQHMKESHEEALEKERVENKKAVTKQKEDFDATVSSKDREI

SEQ ID NO: 1864365 - protein, 7 aa, Staphylococcus
SKKLNVN

SEQ ID NO: 1864366 - protein, 6 aa, Staphylococcus
SKKQYI

SEQ ID NO: 1864367 - protein, 10 aa, Staphylococcus
SKKSAEHKDN

SEQ ID NO: 1864368 - protein, 6 aa, Staphylococcus
SKKSQQ

SEQ ID NO: 1864369 - protein, 7 aa, Staphylococcus
SKKSQQV

SEQ ID NO: 1864370 - protein, 5 aa, Staphylococcus
SKKTY

SEQ ID NO: 1864371 - protein, 12 aa, Staphylococcus
SKKVQNPKSVDQ

SEQ ID NO: 1864372 - protein, 5 aa, Staphylococcus
SKKWG

SEQ ID NO: 1864373 - protein, 7 aa, Staphylococcus
SKLAESI

SEQ ID NO: 1864374 - protein, 8 aa, Staphylococcus
SKLANSEV

SEQ ID NO: 1864375 - protein, 8 aa, Staphylococcus
SKLAPAKF

SEQ ID NO: 1864376 - protein, 8 aa, Staphylococcus
SKLAPKHL

SEQ ID NO: 1864377 - protein, 8 aa, Staphylococcus
SKLEPPLD

SEQ ID NO: 1864378 - protein, 6 aa, Staphylococcus
SKLERK

SEQ ID NO: 1864379 - protein, 9 aa, Staphylococcus
SKLETPSEM

SEQ ID NO: 1864380 - protein, 8 aa, Staphylococcus
SKLGQGTT

SEQ ID NO: 1864381 - protein, 6 aa, Staphylococcus
SKLGSN

SEQ ID NO: 1864382 - protein, 8 aa, Staphylococcus
SKLNEGTT

SEQ ID NO: 1864383 - protein, 5 aa, Staphylococcus
SKLSD

SEQ ID NO: 1864384 - protein, 15 aa, Staphylococcus
SKLSDKTKVQLEDEN

SEQ ID NO: 1864385 - protein, 21 aa, Staphylococcus
SKLSEKTTAQLDEEDDTLARQ

SEQ ID NO: 1864386 - protein, 12 aa, Staphylococcus
SKLSKEKSHSWD

SEQ ID NO: 1864387 - protein, 7 aa, Staphylococcus
SKLSKKA

SEQ ID NO: 1864388 - protein, 10 aa, Staphylococcus
SKLSYDGGAH

SEQ ID NO: 1864389 - protein, 11 aa, Staphylococcus
SKLSYEPAKQE

SEQ ID NO: 1864390 - protein, 11 aa, Staphylococcus
SKLSYEPASQE

SEQ ID NO: 1864391 - protein, 81 aa, Staphylococcus
SKLTDANNGLGQVNDGLGKMDSQVKPYTDPSRVQQTMQQASQSPQQAGQQATQQATEMSKGLEQSQQGINKVQNGQTQIQD

SEQ ID NO: 1864392 - protein, 17 aa, Staphylococcus
SKMPKKSAKEKQKLERT

SEQ ID NO: 1864393 - protein, 7 aa, Staphylococcus
SKMRSSR

SEQ ID NO: 1864394 - protein, 9 aa, Staphylococcus
SKMSNETRD

SEQ ID NO: 1864395 - protein, 11 aa, Staphylococcus
SKNAGKPGHLE

SEQ ID NO: 1864396 - protein, 8 aa, Staphylococcus
SKNAKDIT

SEQ ID NO: 1864397 - protein, 5 aa, Staphylococcus
SKNAL

SEQ ID NO: 1864398 - protein, 11 aa, Staphylococcus
SKNAPTPHKNQ

SEQ ID NO: 1864399 - protein, 6 aa, Staphylococcus
SKNDDV

SEQ ID NO: 1864400 - protein, 17 aa, Staphylococcus
SKNDLEKEPEMQRESKN

SEQ ID NO: 1864401 - protein, 7 aa, Staphylococcus
SKNEALN

SEQ ID NO: 1864402 - protein, 9 aa, Staphylococcus
SKNETISDK

SEQ ID NO: 1864403 - protein, 25 aa, Staphylococcus
SKNEVAKVKDTISKKFGNDPTVNTV

SEQ ID NO: 1864404 - protein, 9 aa, Staphylococcus
SKNFGSNSG

SEQ ID NO: 1864405 - protein, 4 aa, Staphylococcus
SKNG

SEQ ID NO: 1864406 - protein, 6 aa, Staphylococcus
SKNGTR

SEQ ID NO: 1864407 - protein, 8 aa, Staphylococcus
SKNKQGLA

SEQ ID NO: 1864408 - protein, 57 aa, Staphylococcus
SKNNIKQKTKEEYDLKEKQMKASHDEALEKERIQNKKQVTKQKEDFDATVSGKDREI

SEQ ID NO: 1864409 - protein, 57 aa, Staphylococcus
SKNNMKHKASEEYNLKEQQLKSSHEEALEKERIENKKQVTKQKEEFEATVNGKEREI

SEQ ID NO: 1864410 - protein, 18 aa, Staphylococcus
SKNNNHSSKTLCEHLSIA

SEQ ID NO: 1864411 - protein, 9 aa, Staphylococcus
SKNRWSSPK

SEQ ID NO: 1864412 - protein, 11 aa, Staphylococcus
SKNSHIDSDEA

SEQ ID NO: 1864413 - protein, 17 aa, Staphylococcus
SKNVSFTNPQDVNNIPG

SEQ ID NO: 1864414 - protein, 7 aa, Staphylococcus
SKPDEIA

SEQ ID NO: 1864415 - protein, 9 aa, Staphylococcus
SKPDEVAKA

SEQ ID NO: 1864416 - protein, 9 aa, Staphylococcus
SKPDQVAKA

SEQ ID NO: 1864417 - protein, 8 aa, Staphylococcus
SKPEEVAK

SEQ ID NO: 1864418 - protein, 13 aa, Staphylococcus
SKPGGSLDGDELP

SEQ ID NO: 1864419 - protein, 35 aa, Staphylococcus
SKPKDYVPYQANRDDREELDKEEKANQARRIKEMN

SEQ ID NO: 1864420 - protein, 9 aa, Staphylococcus
SKPNTLPDF

SEQ ID NO: 1864421 - protein, 8 aa, Staphylococcus
SKPPTKHY

SEQ ID NO: 1864422 - protein, 9 aa, Staphylococcus
SKPPTKNYT

SEQ ID NO: 1864423 - protein, 5 aa, Staphylococcus
SKPSE

SEQ ID NO: 1864424 - protein, 6 aa, Staphylococcus
SKPVKA

SEQ ID NO: 1864425 - protein, 16 aa, Staphylococcus
SKQADTQVEGNQSDLA

SEQ ID NO: 1864426 - protein, 14 aa, Staphylococcus
SKQARPTVNDRISN

SEQ ID NO: 1864427 - protein, 4 aa, Staphylococcus
SKQE

SEQ ID NO: 1864428 - protein, 7 aa, Staphylococcus
SKQGKCA

SEQ ID NO: 1864429 - protein, 6 aa, Staphylococcus
SKQHSH

SEQ ID NO: 1864430 - protein, 4 aa, Staphylococcus
SKQM

SEQ ID NO: 1864431 - protein, 9 aa, Staphylococcus
SKQMPEEQR

SEQ ID NO: 1864432 - protein, 5 aa, Staphylococcus
SKQNP

SEQ ID NO: 1864433 - protein, 14 aa, Staphylococcus
SKQNRPTVNDRISD

SEQ ID NO: 1864434 - protein, 9 aa, Staphylococcus
SKQPGVNQA

SEQ ID NO: 1864435 - protein, 17 aa, Staphylococcus
SKQQGTTIEVHIPRGEQ

SEQ ID NO: 1864436 - protein, 32 aa, Staphylococcus
SKQQPEEVSPTSDIAKDDVEVASTTNETNGYL

SEQ ID NO: 1864437 - protein, 6 aa, Staphylococcus
SKQSQR

SEQ ID NO: 1864438 - protein, 8 aa, Staphylococcus
SKQSTRSL

SEQ ID NO: 1864439 - protein, 5 aa, Staphylococcus
SKQTT

SEQ ID NO: 1864440 - protein, 6 aa, Staphylococcus
SKRAMR

SEQ ID NO: 1864441 - protein, 7 aa, Staphylococcus
SKRARRL

SEQ ID NO: 1864442 - protein, 4 aa, Staphylococcus
SKRD

SEQ ID NO: 1864443 - protein, 6 aa, Staphylococcus
SKREAP

SEQ ID NO: 1864444 - protein, 4 aa, Staphylococcus
SKRH

SEQ ID NO: 1864445 - protein, 13 aa, Staphylococcus
SKRKMEKHNGKEL

SEQ ID NO: 1864446 - protein, 14 aa, Staphylococcus
SKRKMEKNNGKELD

SEQ ID NO: 1864447 - protein, 15 aa, Staphylococcus
SKRKMEKNNGKELDT

SEQ ID NO: 1864448 - protein, 4 aa, Staphylococcus
SKRL

SEQ ID NO: 1864449 - protein, 12 aa, Staphylococcus
SKRNKTSEVESN

SEQ ID NO: 1864450 - protein, 9 aa, Staphylococcus
SKRNRAIGR

SEQ ID NO: 1864451 - protein, 20 aa, Staphylococcus
SKRNVDPKIEADTKRATTNL

SEQ ID NO: 1864452 - protein, 8 aa, Staphylococcus
SKRQRSEQ

SEQ ID NO: 1864453 - protein, 5 aa, Staphylococcus
SKRTA

SEQ ID NO: 1864454 - protein, 10 aa, Staphylococcus
SKSAVRYSEV

SEQ ID NO: 1864455 - protein, 5 aa, Staphylococcus
SKSDY

SEQ ID NO: 1864456 - protein, 16 aa, Staphylococcus
SKSEDVAKAIGEQVGR

SEQ ID NO: 1864457 - protein, 14 aa, Staphylococcus
SKSENGNRESIKTR

SEQ ID NO: 1864458 - protein, 9 aa, Staphylococcus
SKSETDSHK

SEQ ID NO: 1864459 - protein, 11 aa, Staphylococcus
SKSEYHASDSL

SEQ ID NO: 1864460 - protein, 13 aa, Staphylococcus
SKSGGSLDGTELP

SEQ ID NO: 1864461 - protein, 7 aa, Staphylococcus
SKSIQNN

SEQ ID NO: 1864462 - protein, 9 aa, Staphylococcus
SKSKEERQM

SEQ ID NO: 1864463 - protein, 5 aa, Staphylococcus
SKSKV

SEQ ID NO: 1864464 - protein, 9 aa, Staphylococcus
SKSMPAEQR

SEQ ID NO: 1864465 - protein, 10 aa, Staphylococcus
SKSMTQENLA

SEQ ID NO: 1864466 - protein, 8 aa, Staphylococcus
SKSNDDMN

SEQ ID NO: 1864467 - protein, 4 aa, Staphylococcus
SKSR

SEQ ID NO: 1864468 - protein, 18 aa, Staphylococcus
SKSRATNKSIPKQDNQFK

SEQ ID NO: 1864469 - protein, 8 aa, Staphylococcus
SKSSQDAY

SEQ ID NO: 1864470 - protein, 4 aa, Staphylococcus
SKST

SEQ ID NO: 1864471 - protein, 10 aa, Staphylococcus
SKSTERKREY

SEQ ID NO: 1864472 - protein, 11 aa, Staphylococcus
SKSTYHASDSL

SEQ ID NO: 1864473 - protein, 6 aa, Staphylococcus
SKSTYL

SEQ ID NO: 1864474 - protein, 4 aa, Staphylococcus
SKSV

SEQ ID NO: 1864475 - protein, 11 aa, Staphylococcus
SKSYKGVNVKG

SEQ ID NO: 1864476 - protein, 10 aa, Staphylococcus
SKSYKGVTVK

SEQ ID NO: 1864477 - protein, 9 aa, Staphylococcus
SKTANQKLD

SEQ ID NO: 1864478 - protein, 7 aa, Staphylococcus
SKTDSIY

SEQ ID NO: 1864479 - protein, 6 aa, Staphylococcus
SKTDVS

SEQ ID NO: 1864480 - protein, 5 aa, Staphylococcus
SKTEL

SEQ ID NO: 1864481 - protein, 23 aa, Staphylococcus
SKTHVHKDAKPLTGKSPETPYKL

SEQ ID NO: 1864482 - protein, 19 aa, Staphylococcus
SKTLIDQKQVDKNISSRMT

SEQ ID NO: 1864483 - protein, 14 aa, Staphylococcus
SKTNANWAAPKERG

SEQ ID NO: 1864484 - protein, 14 aa, Staphylococcus
SKTNANWAAPRERG

SEQ ID NO: 1864485 - protein, 5 aa, Staphylococcus
SKTNG

SEQ ID NO: 1864486 - protein, 6 aa, Staphylococcus
SKTNGV

SEQ ID NO: 1864487 - protein, 7 aa, Staphylococcus
SKTPSEM

SEQ ID NO: 1864488 - protein, 12 aa, Staphylococcus
SKTQGGTPTAKP

SEQ ID NO: 1864489 - protein, 8 aa, Staphylococcus
SKTSYHVS

SEQ ID NO: 1864490 - protein, 6 aa, Staphylococcus
SKTTAA

SEQ ID NO: 1864491 - protein, 9 aa, Staphylococcus
SKTTSGDYT

SEQ ID NO: 1864492 - protein, 9 aa, Staphylococcus
SKTTSGNYT

SEQ ID NO: 1864493 - protein, 11 aa, Staphylococcus
SKTVKNNHNSQ

SEQ ID NO: 1864494 - protein, 9 aa, Staphylococcus
SKTVREGDV

SEQ ID NO: 1864495 - protein, 4 aa, Staphylococcus
SKTY

SEQ ID NO: 1864496 - protein, 9 aa, Staphylococcus
SKVDPMKGV

SEQ ID NO: 1864497 - protein, 10 aa, Staphylococcus
SKVEDKLKPG

SEQ ID NO: 1864498 - protein, 6 aa, Staphylococcus
SKVETV

SEQ ID NO: 1864499 - protein, 8 aa, Staphylococcus
SKVKENFN

SEQ ID NO: 1864500 - protein, 6 aa, Staphylococcus
SKVKSK

SEQ ID NO: 1864501 - protein, 14 aa, Staphylococcus
SKVNAAVQDKTWEE

SEQ ID NO: 1864502 - protein, 13 aa, Staphylococcus
SKVPNDAPQETPV

SEQ ID NO: 1864503 - protein, 11 aa, Staphylococcus
SKVPNDAPRVD

SEQ ID NO: 1864504 - protein, 7 aa, Staphylococcus
SKYGRKR

SEQ ID NO: 1864505 - protein, 6 aa, Staphylococcus
SKYKTP

SEQ ID NO: 1864506 - protein, 5 aa, Staphylococcus
SKYNI

SEQ ID NO: 1864507 - protein, 7 aa, Staphylococcus
SLADKVG

SEQ ID NO: 1864508 - protein, 13 aa, Staphylococcus
SLAEDDESLDQQN

SEQ ID NO: 1864509 - protein, 4 aa, Staphylococcus
SLAG

SEQ ID NO: 1864510 - protein, 11 aa, Staphylococcus
SLAGKSNDYTA

SEQ ID NO: 1864511 - protein, 28 aa, Staphylococcus
SLAQANQSINQAHSTEEVKRAKGDGINS

SEQ ID NO: 1864512 - protein, 5 aa, Staphylococcus
SLAQN

SEQ ID NO: 1864513 - protein, 4 aa, Staphylococcus
SLAY

SEQ ID NO: 1864514 - protein, 5 aa, Staphylococcus
SLAYG

SEQ ID NO: 1864515 - protein, 21 aa, Staphylococcus
SLDAEETPNLNKEQSSEKTHQ

SEQ ID NO: 1864516 - protein, 5 aa, Staphylococcus
SLDET

SEQ ID NO: 1864517 - protein, 18 aa, Staphylococcus
SLDEVNNSVSFNSNSSIK

SEQ ID NO: 1864518 - protein, 8 aa, Staphylococcus
SLDGSKPQ

SEQ ID NO: 1864519 - protein, 6 aa, Staphylococcus
SLDGSL

SEQ ID NO: 1864520 - protein, 11 aa, Staphylococcus
SLDKDKKGNIT

SEQ ID NO: 1864521 - protein, 10 aa, Staphylococcus
SLDSHNANGA

SEQ ID NO: 1864522 - protein, 9 aa, Staphylococcus
SLDSPNANG

SEQ ID NO: 1864523 - protein, 11 aa, Staphylococcus
SLDSPNANGAT

SEQ ID NO: 1864524 - protein, 10 aa, Staphylococcus
SLDSSNANGA

SEQ ID NO: 1864525 - protein, 15 aa, Staphylococcus
SLDTDVKNNQQKQKL

SEQ ID NO: 1864526 - protein, 20 aa, Staphylococcus
SLDTNDKISKEFHQDSEKAS

SEQ ID NO: 1864527 - protein, 20 aa, Staphylococcus
SLDTNDKITKEFHQDSQKAS

SEQ ID NO: 1864528 - protein, 20 aa, Staphylococcus
SLDTNDKMSKEFHQDSEKAS

SEQ ID NO: 1864529 - protein, 20 aa, Staphylococcus
SLDTNEKIEDEFNQDSEKAQ

SEQ ID NO: 1864530 - protein, 9 aa, Staphylococcus
SLDTNEKIN

SEQ ID NO: 1864531 - protein, 5 aa, Staphylococcus
SLEAK

SEQ ID NO: 1864532 - protein, 6 aa, Staphylococcus
SLEERE

SEQ ID NO: 1864533 - protein, 7 aa, Staphylococcus
SLEERRI

SEQ ID NO: 1864534 - protein, 4 aa, Staphylococcus
SLEK

SEQ ID NO: 1864535 - protein, 5 aa, Staphylococcus
SLEKV

SEQ ID NO: 1864536 - protein, 4 aa, Staphylococcus
SLEN

SEQ ID NO: 1864537 - protein, 7 aa, Staphylococcus
SLENVTP

SEQ ID NO: 1864538 - protein, 9 aa, Staphylococcus
SLGEANSHN

SEQ ID NO: 1864539 - protein, 9 aa, Staphylococcus
SLGESNSHN

SEQ ID NO: 1864540 - protein, 6 aa, Staphylococcus
SLGETN

SEQ ID NO: 1864541 - protein, 8 aa, Staphylococcus
SLGGGGVE

SEQ ID NO: 1864542 - protein, 5 aa, Staphylococcus
SLGNS

SEQ ID NO: 1864543 - protein, 8 aa, Staphylococcus
SLGNSVGS

SEQ ID NO: 1864544 - protein, 4 aa, Staphylococcus
SLGP

SEQ ID NO: 1864545 - protein, 8 aa, Staphylococcus
SLGQAKNR

SEQ ID NO: 1864546 - protein, 8 aa, Staphylococcus
SLGQPNDH

SEQ ID NO: 1864547 - protein, 6 aa, Staphylococcus
SLGQSN

SEQ ID NO: 1864548 - protein, 9 aa, Staphylococcus
SLGQSNSHN

SEQ ID NO: 1864549 - protein, 9 aa, Staphylococcus
SLGSKQPTL

SEQ ID NO: 1864550 - protein, 10 aa, Staphylococcus
SLIPDKDPLE

SEQ ID NO: 1864551 - protein, 11 aa, Staphylococcus
SLKASGANKTK

SEQ ID NO: 1864552 - protein, 17 aa, Staphylococcus
SLKGKEDTAESKSALGK

SEQ ID NO: 1864553 - protein, 16 aa, Staphylococcus
SLKGKNERSTKDPNFS

SEQ ID NO: 1864554 - protein, 7 aa, Staphylococcus
SLKTTVK

SEQ ID NO: 1864555 - protein, 8 aa, Staphylococcus
SLLSKENL

SEQ ID NO: 1864556 - protein, 12 aa, Staphylococcus
SLLSNRGVRQQN

SEQ ID NO: 1864557 - protein, 13 aa, Staphylococcus
SLMGGGDSISTSP

SEQ ID NO: 1864558 - protein, 11 aa, Staphylococcus
SLNDPQKTAEI

SEQ ID NO: 1864559 - protein, 9 aa, Staphylococcus
SLNDSNPVH

SEQ ID NO: 1864560 - protein, 17 aa, Staphylococcus
SLNDTNPSHLKEAEKDL

SEQ ID NO: 1864561 - protein, 12 aa, Staphylococcus
SLNEKELTDLPQ

SEQ ID NO: 1864562 - protein, 9 aa, Staphylococcus
SLNNEKGDV

SEQ ID NO: 1864563 - protein, 5 aa, Staphylococcus
SLNNG

SEQ ID NO: 1864564 - protein, 16 aa, Staphylococcus
SLNNGSSKIINQGAKV

SEQ ID NO: 1864565 - protein, 4 aa, Staphylococcus
SLNP

SEQ ID NO: 1864566 - protein, 7 aa, Staphylococcus
SLNPGQV

SEQ ID NO: 1864567 - protein, 35 aa, Staphylococcus
SLNPQQISAEKNQVNQATTRTDVAQDLASAKALND

SEQ ID NO: 1864568 - protein, 4 aa, Staphylococcus
SLNQ

SEQ ID NO: 1864569 - protein, 36 aa, Staphylococcus
SLNQPQRKKLEDNLNNATTLDGLSQELQKAKELNNA

SEQ ID NO: 1864570 - protein, 11 aa, Staphylococcus
SLNQSSTAIGQ

SEQ ID NO: 1864571 - protein, 4 aa, Staphylococcus
SLNT

SEQ ID NO: 1864572 - protein, 32 aa, Staphylococcus
SLPEKDNNQTDNSVYSNNINQNNAPTANTQYH

SEQ ID NO: 1864573 - protein, 17 aa, Staphylococcus
SLPKSTNIEDLATPQSV

SEQ ID NO: 1864574 - protein, 18 aa, Staphylococcus
SLPSLDTLPQAAKDLQPA

SEQ ID NO: 1864575 - protein, 4 aa, Staphylococcus
SLQA

SEQ ID NO: 1864576 - protein, 7 aa, Staphylococcus
SLQQSSN

SEQ ID NO: 1864577 - protein, 7 aa, Staphylococcus
SLQRGSN

SEQ ID NO: 1864578 - protein, 8 aa, Staphylococcus
SLSASEKY

SEQ ID NO: 1864579 - protein, 9 aa, Staphylococcus
SLSASQAGL

SEQ ID NO: 1864580 - protein, 7 aa, Staphylococcus
SLSEAGA

SEQ ID NO: 1864581 - protein, 54 aa, Staphylococcus
SLSEKVDTHQQNGDMKSEQDSTNNNENSQISSGQSASSQNNKNQINDKNDDTSI

SEQ ID NO: 1864582 - protein, 4 aa, Staphylococcus
SLSG

SEQ ID NO: 1864583 - protein, 5 aa, Staphylococcus
SLSGK

SEQ ID NO: 1864584 - protein, 251 aa, Staphylococcus
SLSGSLSTSTSKSTSDSTVVSESHSASDSVSEADSNSLATSLSESTSQSVEASNSNSASLSASMSDSTVVSESRSTSLSQSESTSTSESDSNVISTSQSSSSSILESASQSTSLAESMSNSTETSNSRSISLSESQSGSEAESTTESMSVSESLSASTSLSEANSTSASDSAVASTSLSESSSTSLADSMNASTSTSSINSESLSTSLSTSTAASDSSSVSLSESISASTSDSTAESNSISASSSESDVAS

SEQ ID NO: 1864585 - protein, 15 aa, Staphylococcus
SLSKQLKNQLTEEDF

SEQ ID NO: 1864586 - protein, 10 aa, Staphylococcus
SLSNPFGANG

SEQ ID NO: 1864587 - protein, 7 aa, Staphylococcus
SLSNSEK

SEQ ID NO: 1864588 - protein, 23 aa, Staphylococcus
SLSPNREISGSEGFAINGNPEKI

SEQ ID NO: 1864589 - protein, 5 aa, Staphylococcus
SLSPT

SEQ ID NO: 1864590 - protein, 17 aa, Staphylococcus
SLSRKIAKNELTIDEAK

SEQ ID NO: 1864591 - protein, 17 aa, Staphylococcus
SLSRKIANNQLTIDEAK

SEQ ID NO: 1864592 - protein, 13 aa, Staphylococcus
SLSRYQSTNGRQN

SEQ ID NO: 1864593 - protein, 20 aa, Staphylococcus
SLSSTTDIQDGKKVLAPSGG

SEQ ID NO: 1864594 - protein, 4 aa, Staphylococcus
SLST

SEQ ID NO: 1864595 - protein, 13 aa, Staphylococcus
SLTDDGEITESTA

SEQ ID NO: 1864596 - protein, 10 aa, Staphylococcus
SLTEEIRNDI

SEQ ID NO: 1864597 - protein, 8 aa, Staphylococcus
SLTESIRS

SEQ ID NO: 1864598 - protein, 9 aa, Staphylococcus
SLTESIRSD

SEQ ID NO: 1864599 - protein, 10 aa, Staphylococcus
SLTESIRSDI

SEQ ID NO: 1864600 - protein, 9 aa, Staphylococcus
SLTGRGKEG

SEQ ID NO: 1864601 - protein, 5 aa, Staphylococcus
SLTGT

SEQ ID NO: 1864602 - protein, 6 aa, Staphylococcus
SLTGTS

SEQ ID NO: 1864603 - protein, 11 aa, Staphylococcus
SLTSPQSGDIA

SEQ ID NO: 1864604 - protein, 11 aa, Staphylococcus
SLVPHGDTQLR

SEQ ID NO: 1864605 - protein, 5 aa, Staphylococcus
SLYGA

SEQ ID NO: 1864606 - protein, 10 aa, Staphylococcus
SLYNNPNTNQ

SEQ ID NO: 1864607 - protein, 6 aa, Staphylococcus
SLYSSD

SEQ ID NO: 1864608 - protein, 7 aa, Staphylococcus
SMGPTAV

SEQ ID NO: 1864609 - protein, 8 aa, Staphylococcus
SMKGPIGG

SEQ ID NO: 1864610 - protein, 21 aa, Staphylococcus
SMKTPSGDSYQQHRHTENYTQ

SEQ ID NO: 1864611 - protein, 5 aa, Staphylococcus
SMNGN

SEQ ID NO: 1864612 - protein, 23 aa, Staphylococcus
SMPGATPETVKEDVSDKIDDQIR

SEQ ID NO: 1864613 - protein, 8 aa, Staphylococcus
SMPPEQKQ

SEQ ID NO: 1864614 - protein, 5 aa, Staphylococcus
SMPQM

SEQ ID NO: 1864615 - protein, 7 aa, Staphylococcus
SMQTQND

SEQ ID NO: 1864616 - protein, 13 aa, Staphylococcus
SMSASTSDSEVES

SEQ ID NO: 1864617 - protein, 10 aa, Staphylococcus
SMSDSTANVL

SEQ ID NO: 1864618 - protein, 13 aa, Staphylococcus
SMSFNDKKQDLNQ

SEQ ID NO: 1864619 - protein, 7 aa, Staphylococcus
SMSGNRE

SEQ ID NO: 1864620 - protein, 19 aa, Staphylococcus
SMSMEGGHGNAAAYGKTLE

SEQ ID NO: 1864621 - protein, 18 aa, Staphylococcus
SMSMEGGHGNAAAYGQTL

SEQ ID NO: 1864622 - protein, 8 aa, Staphylococcus
SMSRGTGF

SEQ ID NO: 1864623 - protein, 5 aa, Staphylococcus
SMTPD

SEQ ID NO: 1864624 - protein, 24 aa, Staphylococcus
SNADDAKERKAKEEKFQKQQDEEI

SEQ ID NO: 1864625 - protein, 8 aa, Staphylococcus
SNADIGSS

SEQ ID NO: 1864626 - protein, 8 aa, Staphylococcus
SNAIASSM

SEQ ID NO: 1864627 - protein, 23 aa, Staphylococcus
SNAKEVEADTNALQSDVDKTKDV

SEQ ID NO: 1864628 - protein, 9 aa, Staphylococcus
SNAPSGSQF

SEQ ID NO: 1864629 - protein, 5 aa, Staphylococcus
SNAQP

SEQ ID NO: 1864630 - protein, 15 aa, Staphylococcus
SNAQRKSENDGERSD

SEQ ID NO: 1864631 - protein, 12 aa, Staphylococcus
SNASNSVANEND

SEQ ID NO: 1864632 - protein, 6 aa, Staphylococcus
SNDEQV

SEQ ID NO: 1864633 - protein, 5 aa, Staphylococcus
SNDHS

SEQ ID NO: 1864634 - protein, 7 aa, Staphylococcus
SNDIPAQ

SEQ ID NO: 1864635 - protein, 6 aa, Staphylococcus
SNDMQE

SEQ ID NO: 1864636 - protein, 8 aa, Staphylococcus
SNDNFKGT

SEQ ID NO: 1864637 - protein, 6 aa, Staphylococcus
SNDSQV

SEQ ID NO: 1864638 - protein, 8 aa, Staphylococcus
SNDTGKGL

SEQ ID NO: 1864639 - protein, 8 aa, Staphylococcus
SNDTSIQN

SEQ ID NO: 1864640 - protein, 16 aa, Staphylococcus
SNDTSIQNLENSMNNN

SEQ ID NO: 1864641 - protein, 8 aa, Staphylococcus
SNDVPAQF

SEQ ID NO: 1864642 - protein, 8 aa, Staphylococcus
SNDVPQQF

SEQ ID NO: 1864643 - protein, 7 aa, Staphylococcus
SNDYHRS

SEQ ID NO: 1864644 - protein, 12 aa, Staphylococcus
SNEDVKSMNSGL

SEQ ID NO: 1864645 - protein, 4 aa, Staphylococcus
SNEK

SEQ ID NO: 1864646 - protein, 6 aa, Staphylococcus
SNEKRY

SEQ ID NO: 1864647 - protein, 10 aa, Staphylococcus
SNEKTYSRKA

SEQ ID NO: 1864648 - protein, 5 aa, Staphylococcus
SNENG

SEQ ID NO: 1864649 - protein, 6 aa, Staphylococcus
SNENGL

SEQ ID NO: 1864650 - protein, 8 aa, Staphylococcus
SNEPIRDN

SEQ ID NO: 1864651 - protein, 9 aa, Staphylococcus
SNEPNDGET

SEQ ID NO: 1864652 - protein, 23 aa, Staphylococcus
SNEQINQAKTDAAVNQIKDQTIQ

SEQ ID NO: 1864653 - protein, 6 aa, Staphylococcus
SNETGG

SEQ ID NO: 1864654 - protein, 15 aa, Staphylococcus
SNETISIHGSSGDNP

SEQ ID NO: 1864655 - protein, 13 aa, Staphylococcus
SNFKKDKDNEVYT

SEQ ID NO: 1864656 - protein, 4 aa, Staphylococcus
SNFQ

SEQ ID NO: 1864657 - protein, 24 aa, Staphylococcus
SNFSSNPASPNYGGKHKEPRSFTA

SEQ ID NO: 1864658 - protein, 6 aa, Staphylococcus
SNGDIY

SEQ ID NO: 1864659 - protein, 8 aa, Staphylococcus
SNGDNEEN

SEQ ID NO: 1864660 - protein, 8 aa, Staphylococcus
SNGDSEEN

SEQ ID NO: 1864661 - protein, 6 aa, Staphylococcus
SNGDYI

SEQ ID NO: 1864662 - protein, 15 aa, Staphylococcus
SNGEAPSYRSKSKET

SEQ ID NO: 1864663 - protein, 6 aa, Staphylococcus
SNGGPV

SEQ ID NO: 1864664 - protein, 5 aa, Staphylococcus
SNGHV

SEQ ID NO: 1864665 - protein, 17 aa, Staphylococcus
SNGITSATPTQGEPTSL

SEQ ID NO: 1864666 - protein, 9 aa, Staphylococcus
SNGSDNNLL

SEQ ID NO: 1864667 - protein, 9 aa, Staphylococcus
SNGSINPAS

SEQ ID NO: 1864668 - protein, 6 aa, Staphylococcus
SNGSPL

SEQ ID NO: 1864669 - protein, 11 aa, Staphylococcus
SNGSSGKSEAI

SEQ ID NO: 1864670 - protein, 17 aa, Staphylococcus
SNHDETTRYSVDTSQAA

SEQ ID NO: 1864671 - protein, 30 aa, Staphylococcus
SNHNYNPYQDQYAQQGQYNQAQQQNGQQHF

SEQ ID NO: 1864672 - protein, 7 aa, Staphylococcus
SNIGASG

SEQ ID NO: 1864673 - protein, 6 aa, Staphylococcus
SNIGEG

SEQ ID NO: 1864674 - protein, 14 aa, Staphylococcus
SNIIGSSTTDDTGH

SEQ ID NO: 1864675 - protein, 12 aa, Staphylococcus
SNIKPDQQSKVE

SEQ ID NO: 1864676 - protein, 8 aa, Staphylococcus
SNINGSKS

SEQ ID NO: 1864677 - protein, 7 aa, Staphylococcus
SNITQSA

SEQ ID NO: 1864678 - protein, 10 aa, Staphylococcus
SNKAEFVNNK

SEQ ID NO: 1864679 - protein, 174 aa, Staphylococcus
SNKANERLADQKQEEKDKKEKQKTKEEKDKKDKEKSTQESQQTQQTQQTVQTQQQTQQTQQTQQTQQPATTERRTTEEKSPEKTKEATTEERTTEERSTEEKTREPSTEEKTTEEKTSEPSTEEKTSEPSTEEKKPEPSTQQRSSQNNTQERSAQSNNNSSSTNERSSDSSSED

SEQ ID NO: 1864680 - protein, 22 aa, Staphylococcus
SNKANSKKKKTNKTTNENINQS

SEQ ID NO: 1864681 - protein, 7 aa, Staphylococcus
SNKDNDF

SEQ ID NO: 1864682 - protein, 26 aa, Staphylococcus
SNKDQSSFIGQTNGSNGGKGKNLYAT

SEQ ID NO: 1864683 - protein, 6 aa, Staphylococcus
SNKEAE

SEQ ID NO: 1864684 - protein, 8 aa, Staphylococcus
SNKGAPYL

SEQ ID NO: 1864685 - protein, 10 aa, Staphylococcus
SNKGLKDSNT

SEQ ID NO: 1864686 - protein, 26 aa, Staphylococcus
SNKKVAAQKGTEQEKIAQQEIENADI

SEQ ID NO: 1864687 - protein, 14 aa, Staphylococcus
SNKKYNSNDLHNPI

SEQ ID NO: 1864688 - protein, 6 aa, Staphylococcus
SNKNLD

SEQ ID NO: 1864689 - protein, 4 aa, Staphylococcus
SNKP

SEQ ID NO: 1864690 - protein, 16 aa, Staphylococcus
SNKQERTQSMNKPSYQ

SEQ ID NO: 1864691 - protein, 11 aa, Staphylococcus
SNKQSKPDLLS

SEQ ID NO: 1864692 - protein, 5 aa, Staphylococcus
SNKVE

SEQ ID NO: 1864693 - protein, 9 aa, Staphylococcus
SNKVGGDMS

SEQ ID NO: 1864694 - protein, 6 aa, Staphylococcus
SNKVTQ

SEQ ID NO: 1864695 - protein, 6 aa, Staphylococcus
SNLATK

SEQ ID NO: 1864696 - protein, 13 aa, Staphylococcus
SNLGDSKKIGSYG

SEQ ID NO: 1864697 - protein, 6 aa, Staphylococcus
SNLGEK

SEQ ID NO: 1864698 - protein, 11 aa, Staphylococcus
SNLNTPQKEAI

SEQ ID NO: 1864699 - protein, 11 aa, Staphylococcus
SNLTDAQKQKV

SEQ ID NO: 1864700 - protein, 9 aa, Staphylococcus
SNNEEKTSI

SEQ ID NO: 1864701 - protein, 13 aa, Staphylococcus
SNNETKRTELDKT

SEQ ID NO: 1864702 - protein, 5 aa, Staphylococcus
SNNFK

SEQ ID NO: 1864703 - protein, 7 aa, Staphylococcus
SNNGGPY

SEQ ID NO: 1864704 - protein, 4 aa, Staphylococcus
SNNK

SEQ ID NO: 1864705 - protein, 8 aa, Staphylococcus
SNNKAGEV

SEQ ID NO: 1864706 - protein, 6 aa, Staphylococcus
SNNMRG

SEQ ID NO: 1864707 - protein, 20 aa, Staphylococcus
SNNNKGTRDQLTGNASHSQH

SEQ ID NO: 1864708 - protein, 8 aa, Staphylococcus
SNNNSSDI

SEQ ID NO: 1864709 - protein, 6 aa, Staphylococcus
SNNPVH

SEQ ID NO: 1864710 - protein, 14 aa, Staphylococcus
SNNQYQEALTQLNQ

SEQ ID NO: 1864711 - protein, 5 aa, Staphylococcus
SNNRL

SEQ ID NO: 1864712 - protein, 4 aa, Staphylococcus
SNNY

SEQ ID NO: 1864713 - protein, 6 aa, Staphylococcus
SNPDVT

SEQ ID NO: 1864714 - protein, 5 aa, Staphylococcus
SNPEI

SEQ ID NO: 1864715 - protein, 8 aa, Staphylococcus
SNPFGADG

SEQ ID NO: 1864716 - protein, 7 aa, Staphylococcus
SNPGPGI

SEQ ID NO: 1864717 - protein, 7 aa, Staphylococcus
SNPGPGL

SEQ ID NO: 1864718 - protein, 5 aa, Staphylococcus
SNPGY

SEQ ID NO: 1864719 - protein, 6 aa, Staphylococcus
SNPNAL

SEQ ID NO: 1864720 - protein, 5 aa, Staphylococcus
SNPTD

SEQ ID NO: 1864721 - protein, 8 aa, Staphylococcus
SNPTDEDM

SEQ ID NO: 1864722 - protein, 8 aa, Staphylococcus
SNPTDEKM

SEQ ID NO: 1864723 - protein, 8 aa, Staphylococcus
SNPTDENM

SEQ ID NO: 1864724 - protein, 8 aa, Staphylococcus
SNPTDETM

SEQ ID NO: 1864725 - protein, 5 aa, Staphylococcus
SNPVK

SEQ ID NO: 1864726 - protein, 4 aa, Staphylococcus
SNPY

SEQ ID NO: 1864727 - protein, 17 aa, Staphylococcus
SNPYESGQVNSEGDTAI

SEQ ID NO: 1864728 - protein, 7 aa, Staphylococcus
SNQAESQ

SEQ ID NO: 1864729 - protein, 15 aa, Staphylococcus
SNQAIAEKDFNPSID

SEQ ID NO: 1864730 - protein, 15 aa, Staphylococcus
SNQDGIQDYEERGIE

SEQ ID NO: 1864731 - protein, 22 aa, Staphylococcus
SNQDNEITNQPNKSTQTNDANN

SEQ ID NO: 1864732 - protein, 4 aa, Staphylococcus
SNQE

SEQ ID NO: 1864733 - protein, 10 aa, Staphylococcus
SNQHPNNHSI

SEQ ID NO: 1864734 - protein, 7 aa, Staphylococcus
SNQINEL

SEQ ID NO: 1864735 - protein, 13 aa, Staphylococcus
SNQKAKKMVDTSN

SEQ ID NO: 1864736 - protein, 8 aa, Staphylococcus
SNQKWYPA

SEQ ID NO: 1864737 - protein, 5 aa, Staphylococcus
SNQQI

SEQ ID NO: 1864738 - protein, 42 aa, Staphylococcus
SNQQRPKTDHAVNNHQEDISKKDEWDPEKELKEHQQKDKPYT

SEQ ID NO: 1864739 - protein, 45 aa, Staphylococcus
SNQSEDKSAYIESTTHNYADKDNQNEKNGNKTTPTSQEVGKKDNQ

SEQ ID NO: 1864740 - protein, 5 aa, Staphylococcus
SNQSG

SEQ ID NO: 1864741 - protein, 14 aa, Staphylococcus
SNQTATQSISHAKP

SEQ ID NO: 1864742 - protein, 15 aa, Staphylococcus
SNQTDKQAQATQQDI

SEQ ID NO: 1864743 - protein, 8 aa, Staphylococcus
SNQTNDQD

SEQ ID NO: 1864744 - protein, 160 aa, Staphylococcus
SNRANERLNKQSTEEKKEGSKKKDNKTNEQKKKQPTQETQQTQQQIPQTQQTPQTTQQPPATQQKPRKPSTEERNTQEKNTKEPSTEENNQPDKTKEPATQEKSKESNSRNDNKTPTRESSGQQRSNKPSAQQPSSNQNGQQNKQRNSHQSNTSQSTSKA

SEQ ID NO: 1864745 - protein, 10 aa, Staphylococcus
SNRAQKGRNV

SEQ ID NO: 1864746 - protein, 12 aa, Staphylococcus
SNRGIESKDNNV

SEQ ID NO: 1864747 - protein, 5 aa, Staphylococcus
SNRIE

SEQ ID NO: 1864748 - protein, 7 aa, Staphylococcus
SNRPTEF

SEQ ID NO: 1864749 - protein, 8 aa, Staphylococcus
SNRPTEYN

SEQ ID NO: 1864750 - protein, 194 aa, Staphylococcus
SNRSSERLNNQSTEEHKDKNDKKDKEDKDKKDKSDKDKKTSEDSSNVTQENVTQQTAQTQQRQTQQATPSTQQRTKQQPLTEEKQRTKEAQTKEEKTQERTTKEEATTEEARTKEQATQESNSNNSSDSNSSESNTDKSNSNQTSNQTRTQQSPQTQQRSTTQSSTQQSTTRQTSQRSSTSSQSQSSQKSSNSN

SEQ ID NO: 1864751 - protein, 213 aa, Staphylococcus
SNRVNERLNNQSTEEHKDKKDKDTKSNKKNEESTQENTTSENNTNNSKENKLDNVKNPNVTDNYSNEQNNSIKVQPTNQGKTAQTQQSSKETSTKQPNTNQIQSTQQKENSQTQQKENAPTQEKATQEETDKSNENTQSSQSSRSNDSTETSQHKSSNNDTTTTQERANTNQSSQTQKSTMQPSTTEPKTQSSSSTTSESKSNTQQSQRSSNE

SEQ ID NO: 1864752 - protein, 5 aa, Staphylococcus
SNSAY

SEQ ID NO: 1864753 - protein, 14 aa, Staphylococcus
SNSESVSASTSLND

SEQ ID NO: 1864754 - protein, 15 aa, Staphylococcus
SNSETSGKMSHIKVK

SEQ ID NO: 1864755 - protein, 20 aa, Staphylococcus
SNSGDKFTEEEAQYAVDNLD

SEQ ID NO: 1864756 - protein, 8 aa, Staphylococcus
SNSGETAE

SEQ ID NO: 1864757 - protein, 15 aa, Staphylococcus
SNSGQTTSENAVGTI

SEQ ID NO: 1864758 - protein, 8 aa, Staphylococcus
SNSKAMTG

SEQ ID NO: 1864759 - protein, 5 aa, Staphylococcus
SNSKV

SEQ ID NO: 1864760 - protein, 4 aa, Staphylococcus
SNSN

SEQ ID NO: 1864761 - protein, 8 aa, Staphylococcus
SNSNGTAV

SEQ ID NO: 1864762 - protein, 7 aa, Staphylococcus
SNSNQAD

SEQ ID NO: 1864763 - protein, 11 aa, Staphylococcus
SNSVGAQFGQD

SEQ ID NO: 1864764 - protein, 47 aa, Staphylococcus
SNTDDNSNANLSTNDDSTLINEQSTNSKTIATNNDNAKSVKNDKKGS

SEQ ID NO: 1864765 - protein, 11 aa, Staphylococcus
SNTEQKELNNA

SEQ ID NO: 1864766 - protein, 14 aa, Staphylococcus
SNTERKELDNAHRN

SEQ ID NO: 1864767 - protein, 14 aa, Staphylococcus
SNTERQELNNAHSN

SEQ ID NO: 1864768 - protein, 9 aa, Staphylococcus
SNTFGNKGG

SEQ ID NO: 1864769 - protein, 12 aa, Staphylococcus
SNTIAESLKTQY

SEQ ID NO: 1864770 - protein, 13 aa, Staphylococcus
SNTIAESLNTQYN

SEQ ID NO: 1864771 - protein, 7 aa, Staphylococcus
SNTKAFT

SEQ ID NO: 1864772 - protein, 8 aa, Staphylococcus
SNTKAFTG

SEQ ID NO: 1864773 - protein, 10 aa, Staphylococcus
SNTLTDSRRY

SEQ ID NO: 1864774 - protein, 6 aa, Staphylococcus
SNTNKT

SEQ ID NO: 1864775 - protein, 6 aa, Staphylococcus
SNTNYV

SEQ ID NO: 1864776 - protein, 11 aa, Staphylococcus
SNTPHFDEEPD

SEQ ID NO: 1864777 - protein, 12 aa, Staphylococcus
SNTPHFDEEPDK

SEQ ID NO: 1864778 - protein, 12 aa, Staphylococcus
SNTPHFEEEPDK

SEQ ID NO: 1864779 - protein, 8 aa, Staphylococcus
SNTPKNTY

SEQ ID NO: 1864780 - protein, 8 aa, Staphylococcus
SNTREDTK

SEQ ID NO: 1864781 - protein, 5 aa, Staphylococcus
SNTRG

SEQ ID NO: 1864782 - protein, 14 aa, Staphylococcus
SNTTMKGTDGETDL

SEQ ID NO: 1864783 - protein, 10 aa, Staphylococcus
SNTVEPNGDR

SEQ ID NO: 1864784 - protein, 10 aa, Staphylococcus
SNTVEPNGNR

SEQ ID NO: 1864785 - protein, 4 aa, Staphylococcus
SNVG

SEQ ID NO: 1864786 - protein, 14 aa, Staphylococcus
SNVGDTKTIGRYGG

SEQ ID NO: 1864787 - protein, 9 aa, Staphylococcus
SNVNQGERD

SEQ ID NO: 1864788 - protein, 10 aa, Staphylococcus
SNVSNTFKDQ

SEQ ID NO: 1864789 - protein, 52 aa, Staphylococcus
SNVTSNATSNSASTGESTNSSNVVQQSNHKDNSDENKELPETGNSNDANNTN

SEQ ID NO: 1864790 - protein, 4 aa, Staphylococcus
SNYG

SEQ ID NO: 1864791 - protein, 6 aa, Staphylococcus
SNYKGL

SEQ ID NO: 1864792 - protein, 6 aa, Staphylococcus
SNYRGF

SEQ ID NO: 1864793 - protein, 9 aa, Staphylococcus
SNYRNVTSN

SEQ ID NO: 1864794 - protein, 16 aa, Staphylococcus
SNYYQNTRTSGTIEHS

SEQ ID NO: 1864795 - protein, 10 aa, Staphylococcus
SPAKDKAKNF

SEQ ID NO: 1864796 - protein, 5 aa, Staphylococcus
SPALF

SEQ ID NO: 1864797 - protein, 20 aa, Staphylococcus
SPAQTEYQANSTSATSPNVN

SEQ ID NO: 1864798 - protein, 6 aa, Staphylococcus
SPAYKL

SEQ ID NO: 1864799 - protein, 11 aa, Staphylococcus
SPDEYKSQRKV

SEQ ID NO: 1864800 - protein, 5 aa, Staphylococcus
SPDGE

SEQ ID NO: 1864801 - protein, 5 aa, Staphylococcus
SPDGS

SEQ ID NO: 1864802 - protein, 9 aa, Staphylococcus
SPDKAHSVS

SEQ ID NO: 1864803 - protein, 9 aa, Staphylococcus
SPDKEHDVG

SEQ ID NO: 1864804 - protein, 5 aa, Staphylococcus
SPDNF

SEQ ID NO: 1864805 - protein, 13 aa, Staphylococcus
SPDTWKNTIGESE

SEQ ID NO: 1864806 - protein, 11 aa, Staphylococcus
SPEDNNAKEMK

SEQ ID NO: 1864807 - protein, 8 aa, Staphylococcus
SPEDTAQN

SEQ ID NO: 1864808 - protein, 5 aa, Staphylococcus
SPEFD

SEQ ID NO: 1864809 - protein, 7 aa, Staphylococcus
SPEGQIK

SEQ ID NO: 1864810 - protein, 5 aa, Staphylococcus
SPEKR

SEQ ID NO: 1864811 - protein, 9 aa, Staphylococcus
SPEKYQSLA

SEQ ID NO: 1864812 - protein, 16 aa, Staphylococcus
SPEQAKGDKTNETTDI

SEQ ID NO: 1864813 - protein, 12 aa, Staphylococcus
SPEQAKGESTDM

SEQ ID NO: 1864814 - protein, 15 aa, Staphylococcus
SPEQAKGETTNEATD

SEQ ID NO: 1864815 - protein, 16 aa, Staphylococcus
SPEQARGESTDNGTDI

SEQ ID NO: 1864816 - protein, 10 aa, Staphylococcus
SPEQVSSEYG

SEQ ID NO: 1864817 - protein, 4 aa, Staphylococcus
SPER

SEQ ID NO: 1864818 - protein, 4 aa, Staphylococcus
SPFE

SEQ ID NO: 1864819 - protein, 4 aa, Staphylococcus
SPFT

SEQ ID NO: 1864820 - protein, 5 aa, Staphylococcus
SPGKY

SEQ ID NO: 1864821 - protein, 4 aa, Staphylococcus
SPGL

SEQ ID NO: 1864822 - protein, 10 aa, Staphylococcus
SPGPGRPSDY

SEQ ID NO: 1864823 - protein, 18 aa, Staphylococcus
SPHPSYPAGYGLSSRPTI

SEQ ID NO: 1864824 - protein, 9 aa, Staphylococcus
SPIKQNKYS

SEQ ID NO: 1864825 - protein, 7 aa, Staphylococcus
SPISGKL

SEQ ID NO: 1864826 - protein, 7 aa, Staphylococcus
SPIYGKG

SEQ ID NO: 1864827 - protein, 8 aa, Staphylococcus
SPKDEGKY

SEQ ID NO: 1864828 - protein, 9 aa, Staphylococcus
SPKEEGTYS

SEQ ID NO: 1864829 - protein, 7 aa, Staphylococcus
SPKERLG

SEQ ID NO: 1864830 - protein, 7 aa, Staphylococcus
SPKFDSD

SEQ ID NO: 1864831 - protein, 5 aa, Staphylococcus
SPKGT

SEQ ID NO: 1864832 - protein, 6 aa, Staphylococcus
SPKGTF

SEQ ID NO: 1864833 - protein, 6 aa, Staphylococcus
SPKSQR

SEQ ID NO: 1864834 - protein, 5 aa, Staphylococcus
SPLSH

SEQ ID NO: 1864835 - protein, 35 aa, Staphylococcus
SPMHPTSEAQQHDNNKPHSEALPDTGEDDNQSKGL

SEQ ID NO: 1864836 - protein, 17 aa, Staphylococcus
SPMKQSPAEKAGIQPKD

SEQ ID NO: 1864837 - protein, 7 aa, Staphylococcus
SPNEAQQ

SEQ ID NO: 1864838 - protein, 6 aa, Staphylococcus
SPNEDY

SEQ ID NO: 1864839 - protein, 6 aa, Staphylococcus
SPNNIE

SEQ ID NO: 1864840 - protein, 4 aa, Staphylococcus
SPNR

SEQ ID NO: 1864841 - protein, 5 aa, Staphylococcus
SPNTH

SEQ ID NO: 1864842 - protein, 6 aa, Staphylococcus
SPNYKD

SEQ ID NO: 1864843 - protein, 6 aa, Staphylococcus
SPPDNP

SEQ ID NO: 1864844 - protein, 10 aa, Staphylococcus
SPPQMSKDND

SEQ ID NO: 1864845 - protein, 13 aa, Staphylococcus
SPPTASKETEAAL

SEQ ID NO: 1864846 - protein, 8 aa, Staphylococcus
SPQERKEQ

SEQ ID NO: 1864847 - protein, 7 aa, Staphylococcus
SPQKRLG

SEQ ID NO: 1864848 - protein, 4 aa, Staphylococcus
SPQQ

SEQ ID NO: 1864849 - protein, 5 aa, Staphylococcus
SPREI

SEQ ID NO: 1864850 - protein, 11 aa, Staphylococcus
SPRIASGDSWG

SEQ ID NO: 1864851 - protein, 4 aa, Staphylococcus
SPRK

SEQ ID NO: 1864852 - protein, 5 aa, Staphylococcus
SPRSM

SEQ ID NO: 1864853 - protein, 4 aa, Staphylococcus
SPRY

SEQ ID NO: 1864854 - protein, 4 aa, Staphylococcus
SPSA

SEQ ID NO: 1864855 - protein, 5 aa, Staphylococcus
SPSEI

SEQ ID NO: 1864856 - protein, 6 aa, Staphylococcus
SPSGMA

SEQ ID NO: 1864857 - protein, 6 aa, Staphylococcus
SPSTTA

SEQ ID NO: 1864858 - protein, 10 aa, Staphylococcus
SPTERQTTLQ

SEQ ID NO: 1864859 - protein, 4 aa, Staphylococcus
SPTF

SEQ ID NO: 1864860 - protein, 7 aa, Staphylococcus
SPTSQNY

SEQ ID NO: 1864861 - protein, 5 aa, Staphylococcus
SPTYT

SEQ ID NO: 1864862 - protein, 5 aa, Staphylococcus
SPVGG

SEQ ID NO: 1864863 - protein, 6 aa, Staphylococcus
SPYKET

SEQ ID NO: 1864864 - protein, 4 aa, Staphylococcus
SPYQ

SEQ ID NO: 1864865 - protein, 10 aa, Staphylococcus
SQAARDNIEY

SEQ ID NO: 1864866 - protein, 5 aa, Staphylococcus
SQAGQ

SEQ ID NO: 1864867 - protein, 8 aa, Staphylococcus
SQAKREQL

SEQ ID NO: 1864868 - protein, 9 aa, Staphylococcus
SQAKRHNIT

SEQ ID NO: 1864869 - protein, 6 aa, Staphylococcus
SQAKVE

SEQ ID NO: 1864870 - protein, 16 aa, Staphylococcus
SQAMPRIPRTKGERGY

SEQ ID NO: 1864871 - protein, 7 aa, Staphylococcus
SQAPDAE

SEQ ID NO: 1864872 - protein, 10 aa, Staphylococcus
SQAQTEVDEA

SEQ ID NO: 1864873 - protein, 10 aa, Staphylococcus
SQATDLKPTN

SEQ ID NO: 1864874 - protein, 6 aa, Staphylococcus
SQATGI

SEQ ID NO: 1864875 - protein, 8 aa, Staphylococcus
SQDANTVQ

SEQ ID NO: 1864876 - protein, 11 aa, Staphylococcus
SQDAPTLASTL

SEQ ID NO: 1864877 - protein, 14 aa, Staphylococcus
SQDAPTLASTLNQS

SEQ ID NO: 1864878 - protein, 17 aa, Staphylococcus
SQDDDGNNTTEKPPKRS

SEQ ID NO: 1864879 - protein, 11 aa, Staphylococcus
SQDDHKSQRKV

SEQ ID NO: 1864880 - protein, 5 aa, Staphylococcus
SQDKA

SEQ ID NO: 1864881 - protein, 10 aa, Staphylococcus
SQDNTKTEKK

SEQ ID NO: 1864882 - protein, 14 aa, Staphylococcus
SQDSQKHKKHVPKA

SEQ ID NO: 1864883 - protein, 4 aa, Staphylococcus
SQED

SEQ ID NO: 1864884 - protein, 6 aa, Staphylococcus
SQEEVA

SEQ ID NO: 1864885 - protein, 26 aa, Staphylococcus
SQEIEPDNKPNNSEQELISEDSSNNK

SEQ ID NO: 1864886 - protein, 8 aa, Staphylococcus
SQEPISTI

SEQ ID NO: 1864887 - protein, 5 aa, Staphylococcus
SQETL

SEQ ID NO: 1864888 - protein, 4 aa, Staphylococcus
SQEV

SEQ ID NO: 1864889 - protein, 5 aa, Staphylococcus
SQEVD

SEQ ID NO: 1864890 - protein, 7 aa, Staphylococcus
SQFSERP

SEQ ID NO: 1864891 - protein, 31 aa, Staphylococcus
SQGAFESSFNDSDSSRKSNIRDSKVNPSKDP

SEQ ID NO: 1864892 - protein, 9 aa, Staphylococcus
SQGDINPSS

SEQ ID NO: 1864893 - protein, 29 aa, Staphylococcus
SQGDQLDEGATFKKVSEKQAKTQVQNEKL

SEQ ID NO: 1864894 - protein, 4 aa, Staphylococcus
SQGF

SEQ ID NO: 1864895 - protein, 6 aa, Staphylococcus
SQGGDQ

SEQ ID NO: 1864896 - protein, 7 aa, Staphylococcus
SQGSSLQ

SEQ ID NO: 1864897 - protein, 8 aa, Staphylococcus
SQHFSPKM

SEQ ID NO: 1864898 - protein, 5 aa, Staphylococcus
SQHPL

SEQ ID NO: 1864899 - protein, 11 aa, Staphylococcus
SQHTKQANPNF

SEQ ID NO: 1864900 - protein, 6 aa, Staphylococcus
SQIDDK

SEQ ID NO: 1864901 - protein, 9 aa, Staphylococcus
SQIDSENKI

SEQ ID NO: 1864902 - protein, 5 aa, Staphylococcus
SQIGT

SEQ ID NO: 1864903 - protein, 4 aa, Staphylococcus
SQIK

SEQ ID NO: 1864904 - protein, 14 aa, Staphylococcus
SQINNAKSEANSIL

SEQ ID NO: 1864905 - protein, 12 aa, Staphylococcus
SQIREEESKLDT

SEQ ID NO: 1864906 - protein, 15 aa, Staphylococcus
SQKEQQCNTKHTDIT

SEQ ID NO: 1864907 - protein, 6 aa, Staphylococcus
SQKFTT

SEQ ID NO: 1864908 - protein, 15 aa, Staphylococcus
SQKGQQYKTKHTDIT

SEQ ID NO: 1864909 - protein, 17 aa, Staphylococcus
SQKKEELYKKSGKNPIL

SEQ ID NO: 1864910 - protein, 17 aa, Staphylococcus
SQKKSTLYKKAGKNPIL

SEQ ID NO: 1864911 - protein, 10 aa, Staphylococcus
SQKKVVDEPL

SEQ ID NO: 1864912 - protein, 9 aa, Staphylococcus
SQKQAPPFF

SEQ ID NO: 1864913 - protein, 17 aa, Staphylococcus
SQKVEPVDSIPKSGNNI

SEQ ID NO: 1864914 - protein, 4 aa, Staphylococcus
SQLA

SEQ ID NO: 1864915 - protein, 9 aa, Staphylococcus
SQLADKGEI

SEQ ID NO: 1864916 - protein, 8 aa, Staphylococcus
SQLEQASG

SEQ ID NO: 1864917 - protein, 8 aa, Staphylococcus
SQLGQTVQ

SEQ ID NO: 1864918 - protein, 6 aa, Staphylococcus
SQLGTE

SEQ ID NO: 1864919 - protein, 10 aa, Staphylococcus
SQNAPAETAD

SEQ ID NO: 1864920 - protein, 10 aa, Staphylococcus
SQNAPAETAS

SEQ ID NO: 1864921 - protein, 10 aa, Staphylococcus
SQNATQQEVE

SEQ ID NO: 1864922 - protein, 9 aa, Staphylococcus
SQNEAKQAM

SEQ ID NO: 1864923 - protein, 7 aa, Staphylococcus
SQNHSES

SEQ ID NO: 1864924 - protein, 15 aa, Staphylococcus
SQNITSREKIMTVIK

SEQ ID NO: 1864925 - protein, 5 aa, Staphylococcus
SQNIV

SEQ ID NO: 1864926 - protein, 5 aa, Staphylococcus
SQNPI

SEQ ID NO: 1864927 - protein, 9 aa, Staphylococcus
SQNSEEPLS

SEQ ID NO: 1864928 - protein, 6 aa, Staphylococcus
SQNVGY

SEQ ID NO: 1864929 - protein, 27 aa, Staphylococcus
SQNVNPGDKVKVNDSNIELTESLGTKQ

SEQ ID NO: 1864930 - protein, 6 aa, Staphylococcus
SQPNQL

SEQ ID NO: 1864931 - protein, 18 aa, Staphylococcus
SQPQLEKSNISAQDTSKV

SEQ ID NO: 1864932 - protein, 10 aa, Staphylococcus
SQPQMSKNND

SEQ ID NO: 1864933 - protein, 9 aa, Staphylococcus
SQQAEEHHE

SEQ ID NO: 1864934 - protein, 8 aa, Staphylococcus
SQQDYEED

SEQ ID NO: 1864935 - protein, 23 aa, Staphylococcus
SQQKQHKNSELPNSGHSEPHNSP

SEQ ID NO: 1864936 - protein, 9 aa, Staphylococcus
SQQLRDELT

SEQ ID NO: 1864937 - protein, 4 aa, Staphylococcus
SQQP

SEQ ID NO: 1864938 - protein, 6 aa, Staphylococcus
SQQRER

SEQ ID NO: 1864939 - protein, 5 aa, Staphylococcus
SQQTQ

SEQ ID NO: 1864940 - protein, 9 aa, Staphylococcus
SQQTSPNTE

SEQ ID NO: 1864941 - protein, 5 aa, Staphylococcus
SQRYT

SEQ ID NO: 1864942 - protein, 6 aa, Staphylococcus
SQSEQL

SEQ ID NO: 1864943 - protein, 7 aa, Staphylococcus
SQSFEEE

SEQ ID NO: 1864944 - protein, 9 aa, Staphylococcus
SQSKAQAEK

SEQ ID NO: 1864945 - protein, 13 aa, Staphylococcus
SQSKLAETLNASI

SEQ ID NO: 1864946 - protein, 6 aa, Staphylococcus
SQSLAG

SEQ ID NO: 1864947 - protein, 5 aa, Staphylococcus
SQSNL

SEQ ID NO: 1864948 - protein, 10 aa, Staphylococcus
SQSNRDSIEY

SEQ ID NO: 1864949 - protein, 6 aa, Staphylococcus
SQSSDL

SEQ ID NO: 1864950 - protein, 9 aa, Staphylococcus
SQSSNVYPT

SEQ ID NO: 1864951 - protein, 7 aa, Staphylococcus
SQSSSHM

SEQ ID NO: 1864952 - protein, 8 aa, Staphylococcus
SQSSSTYE

SEQ ID NO: 1864953 - protein, 7 aa, Staphylococcus
SQSTNTF

SEQ ID NO: 1864954 - protein, 9 aa, Staphylococcus
SQSTRDNIR

SEQ ID NO: 1864955 - protein, 9 aa, Staphylococcus
SQSTRDNIT

SEQ ID NO: 1864956 - protein, 9 aa, Staphylococcus
SQSTRDNLT

SEQ ID NO: 1864957 - protein, 8 aa, Staphylococcus
SQSTRDRL

SEQ ID NO: 1864958 - protein, 8 aa, Staphylococcus
SQSVTQSP

SEQ ID NO: 1864959 - protein, 5 aa, Staphylococcus
SQTAT

SEQ ID NO: 1864960 - protein, 6 aa, Staphylococcus
SQTFKR

SEQ ID NO: 1864961 - protein, 6 aa, Staphylococcus
SQTIDN

SEQ ID NO: 1864962 - protein, 14 aa, Staphylococcus
SQTLDASRHNGSTG

SEQ ID NO: 1864963 - protein, 4 aa, Staphylococcus
SQTN

SEQ ID NO: 1864964 - protein, 6 aa, Staphylococcus
SQTSTL

SEQ ID NO: 1864965 - protein, 5 aa, Staphylococcus
SQTTS

SEQ ID NO: 1864966 - protein, 4 aa, Staphylococcus
SQTV

SEQ ID NO: 1864967 - protein, 7 aa, Staphylococcus
SQVAEDA

SEQ ID NO: 1864968 - protein, 14 aa, Staphylococcus
SQVKAAQAKINEAK

SEQ ID NO: 1864969 - protein, 7 aa, Staphylococcus
SQVTKQS

SEQ ID NO: 1864970 - protein, 8 aa, Staphylococcus
SQYDDLKG

SEQ ID NO: 1864971 - protein, 7 aa, Staphylococcus
SQYKMPG

SEQ ID NO: 1864972 - protein, 12 aa, Staphylococcus
SRAKRKKDVGTA

SEQ ID NO: 1864973 - protein, 12 aa, Staphylococcus
SRAKSKKDVGTA

SEQ ID NO: 1864974 - protein, 10 aa, Staphylococcus
SRALEDGGTL

SEQ ID NO: 1864975 - protein, 39 aa, Staphylococcus
SRANEKKHSIEEDETNTVSIDRQDIKSKIKEENEQKQIA

SEQ ID NO: 1864976 - protein, 22 aa, Staphylococcus
SRARTIDPYATTTKTLTDSSYY

SEQ ID NO: 1864977 - protein, 10 aa, Staphylococcus
SRASNSGVTG

SEQ ID NO: 1864978 - protein, 5 aa, Staphylococcus
SRCCK

SEQ ID NO: 1864979 - protein, 5 aa, Staphylococcus
SRCEK

SEQ ID NO: 1864980 - protein, 4 aa, Staphylococcus
SRDT

SEQ ID NO: 1864981 - protein, 5 aa, Staphylococcus
SRDTN

SEQ ID NO: 1864982 - protein, 5 aa, Staphylococcus
SRDYP

SEQ ID NO: 1864983 - protein, 12 aa, Staphylococcus
SRDYSDDYPENK

SEQ ID NO: 1864984 - protein, 8 aa, Staphylococcus
SREKDDQE

SEQ ID NO: 1864985 - protein, 5 aa, Staphylococcus
SRETL

SEQ ID NO: 1864986 - protein, 7 aa, Staphylococcus
SRETNDQ

SEQ ID NO: 1864987 - protein, 12 aa, Staphylococcus
SREYSDKYPENK

SEQ ID NO: 1864988 - protein, 4 aa, Staphylococcus
SRFV

SEQ ID NO: 1864989 - protein, 12 aa, Staphylococcus
SRGEKGRASSAL

SEQ ID NO: 1864990 - protein, 5 aa, Staphylococcus
SRGIS

SEQ ID NO: 1864991 - protein, 6 aa, Staphylococcus
SRGRTI

SEQ ID NO: 1864992 - protein, 6 aa, Staphylococcus
SRGTDV

SEQ ID NO: 1864993 - protein, 5 aa, Staphylococcus
SRGVE

SEQ ID NO: 1864994 - protein, 4 aa, Staphylococcus
SRGY

SEQ ID NO: 1864995 - protein, 9 aa, Staphylococcus
SRIDDVEKE

SEQ ID NO: 1864996 - protein, 10 aa, Staphylococcus
SRIEATTQYN

SEQ ID NO: 1864997 - protein, 10 aa, Staphylococcus
SRIQENQQDI

SEQ ID NO: 1864998 - protein, 6 aa, Staphylococcus
SRISDS

SEQ ID NO: 1864999 - protein, 21 aa, Staphylococcus
SRKDFKSTKSQTQSKNDLVPE

SEQ ID NO: 1865000 - protein, 11 aa, Staphylococcus
SRKDGEPDKER

SEQ ID NO: 1865001 - protein, 7 aa, Staphylococcus
SRKDGFN

SEQ ID NO: 1865002 - protein, 52 aa, Staphylococcus
SRKDSRDKLKNEYNKYKENPESYKANAKDFASQIGNKANETIQEVRNNPRDY

SEQ ID NO: 1865003 - protein, 17 aa, Staphylococcus
SRKEEGAGGDSGRQLRQ

SEQ ID NO: 1865004 - protein, 31 aa, Staphylococcus
SRKEVTPDSPVIEASKERASVKVTPKGESTK

SEQ ID NO: 1865005 - protein, 4 aa, Staphylococcus
SRKI

SEQ ID NO: 1865006 - protein, 14 aa, Staphylococcus
SRKISRNELTIDEA

SEQ ID NO: 1865007 - protein, 119 aa, Staphylococcus
SRKKAKGQKAEQRSTKDSKNQSYQSKFKASDLDKQSESNNASSRVRNHSDNIEDDKRKHHFESTKEGDQRSSNATHSESRYDDYPGSLRRSDQHEEENVEKHDNQNNHSTESNEESDEV

SEQ ID NO: 1865008 - protein, 6 aa, Staphylococcus
SRKLGD

SEQ ID NO: 1865009 - protein, 11 aa, Staphylococcus
SRKNNAKTGWS

SEQ ID NO: 1865010 - protein, 13 aa, Staphylococcus
SRKVRSNPDNYTK

SEQ ID NO: 1865011 - protein, 15 aa, Staphylococcus
SRKYDRHDNEEKAQA

SEQ ID NO: 1865012 - protein, 16 aa, Staphylococcus
SRKYDRNNNEDKAQAI

SEQ ID NO: 1865013 - protein, 16 aa, Staphylococcus
SRKYDRTNENDKAQAI

SEQ ID NO: 1865014 - protein, 13 aa, Staphylococcus
SRKYNRHSFTEKA

SEQ ID NO: 1865015 - protein, 12 aa, Staphylococcus
SRKYSDKYPENQ

SEQ ID NO: 1865016 - protein, 12 aa, Staphylococcus
SRLEATSKSNQQ

SEQ ID NO: 1865017 - protein, 11 aa, Staphylococcus
SRLENATKYNQ

SEQ ID NO: 1865018 - protein, 7 aa, Staphylococcus
SRLGEGT

SEQ ID NO: 1865019 - protein, 8 aa, Staphylococcus
SRLKSNAV

SEQ ID NO: 1865020 - protein, 8 aa, Staphylococcus
SRLSENKN

SEQ ID NO: 1865021 - protein, 8 aa, Staphylococcus
SRLSKQMD

SEQ ID NO: 1865022 - protein, 12 aa, Staphylococcus
SRLTEERYEQRS

SEQ ID NO: 1865023 - protein, 8 aa, Staphylococcus
SRMNSNSI

SEQ ID NO: 1865024 - protein, 11 aa, Staphylococcus
SRNASDKNGWS

SEQ ID NO: 1865025 - protein, 5 aa, Staphylococcus
SRNGE

SEQ ID NO: 1865026 - protein, 4 aa, Staphylococcus
SRNI

SEQ ID NO: 1865027 - protein, 9 aa, Staphylococcus
SRNNPELHK

SEQ ID NO: 1865028 - protein, 4 aa, Staphylococcus
SRNS

SEQ ID NO: 1865029 - protein, 27 aa, Staphylococcus
SRNTSSSGVETEVDEETSNPNGIELNP

SEQ ID NO: 1865030 - protein, 6 aa, Staphylococcus
SRPDEV

SEQ ID NO: 1865031 - protein, 14 aa, Staphylococcus
SRQISDKNEQTSYI

SEQ ID NO: 1865032 - protein, 8 aa, Staphylococcus
SRQKSNTF

SEQ ID NO: 1865033 - protein, 39 aa, Staphylococcus
SRQRTIDPYSTTINTLSDPSYYNDTTAKKINSIKEHHDD

SEQ ID NO: 1865034 - protein, 5 aa, Staphylococcus
SRQTL

SEQ ID NO: 1865035 - protein, 16 aa, Staphylococcus
SRQVSYAGLGSSGLTA

SEQ ID NO: 1865036 - protein, 6 aa, Staphylococcus
SRREQP

SEQ ID NO: 1865037 - protein, 4 aa, Staphylococcus
SRRF

SEQ ID NO: 1865038 - protein, 19 aa, Staphylococcus
SRRNPELHKQSTYKLPGGK

SEQ ID NO: 1865039 - protein, 5 aa, Staphylococcus
SRRQR

SEQ ID NO: 1865040 - protein, 5 aa, Staphylococcus
SRRSI

SEQ ID NO: 1865041 - protein, 4 aa, Staphylococcus
SRSA

SEQ ID NO: 1865042 - protein, 7 aa, Staphylococcus
SRSDGFN

SEQ ID NO: 1865043 - protein, 5 aa, Staphylococcus
SRSEF

SEQ ID NO: 1865044 - protein, 7 aa, Staphylococcus
SRSESQS

SEQ ID NO: 1865045 - protein, 6 aa, Staphylococcus
SRSMSQ

SEQ ID NO: 1865046 - protein, 7 aa, Staphylococcus
SRSSAIK

SEQ ID NO: 1865047 - protein, 10 aa, Staphylococcus
SRSSELKTGD

SEQ ID NO: 1865048 - protein, 7 aa, Staphylococcus
SRSYKNM

SEQ ID NO: 1865049 - protein, 8 aa, Staphylococcus
SRTDNTIK

SEQ ID NO: 1865050 - protein, 5 aa, Staphylococcus
SRTGA

SEQ ID NO: 1865051 - protein, 7 aa, Staphylococcus
SRTGAVS

SEQ ID NO: 1865052 - protein, 5 aa, Staphylococcus
SRTGS

SEQ ID NO: 1865053 - protein, 4 aa, Staphylococcus
SRTK

SEQ ID NO: 1865054 - protein, 9 aa, Staphylococcus
SRTKLKGRK

SEQ ID NO: 1865055 - protein, 4 aa, Staphylococcus
SRTQ

SEQ ID NO: 1865056 - protein, 10 aa, Staphylococcus
SRTTNNEKNG

SEQ ID NO: 1865057 - protein, 16 aa, Staphylococcus
SRTYDRKDEDSKAQAI

SEQ ID NO: 1865058 - protein, 4 aa, Staphylococcus
SRYG

SEQ ID NO: 1865059 - protein, 14 aa, Staphylococcus
SRYPKIGEKNYTEK

SEQ ID NO: 1865060 - protein, 12 aa, Staphylococcus
SRYPKLGEKNYA

SEQ ID NO: 1865061 - protein, 15 aa, Staphylococcus
SSAEALKASGANKTK

SEQ ID NO: 1865062 - protein, 5 aa, Staphylococcus
SSAEY

SEQ ID NO: 1865063 - protein, 4 aa, Staphylococcus
SSAI

SEQ ID NO: 1865064 - protein, 8 aa, Staphylococcus
SSAKVPKN

SEQ ID NO: 1865065 - protein, 11 aa, Staphylococcus
SSAMGQGIAKA

SEQ ID NO: 1865066 - protein, 12 aa, Staphylococcus
SSAMGQGIAKTG

SEQ ID NO: 1865067 - protein, 12 aa, Staphylococcus
SSAMGQGISKAG

SEQ ID NO: 1865068 - protein, 6 aa, Staphylococcus
SSANHS

SEQ ID NO: 1865069 - protein, 10 aa, Staphylococcus
SSAPKAKIGS

SEQ ID NO: 1865070 - protein, 10 aa, Staphylococcus
SSAPSETSSI

SEQ ID NO: 1865071 - protein, 6 aa, Staphylococcus
SSATGH

SEQ ID NO: 1865072 - protein, 15 aa, Staphylococcus
SSAVRNGISGAYNAV

SEQ ID NO: 1865073 - protein, 7 aa, Staphylococcus
SSCQSNK

SEQ ID NO: 1865074 - protein, 11 aa, Staphylococcus
SSDDDGSGYPI

SEQ ID NO: 1865075 - protein, 14 aa, Staphylococcus
SSDEVGSSRNRMSG

SEQ ID NO: 1865076 - protein, 6 aa, Staphylococcus
SSDFTH

SEQ ID NO: 1865077 - protein, 14 aa, Staphylococcus
SSDIPKSVADASKL

SEQ ID NO: 1865078 - protein, 9 aa, Staphylococcus
SSDKGARDI

SEQ ID NO: 1865079 - protein, 10 aa, Staphylococcus
SSDLGANPFT

SEQ ID NO: 1865080 - protein, 7 aa, Staphylococcus
SSDLKRA

SEQ ID NO: 1865081 - protein, 8 aa, Staphylococcus
SSDQNTKF

SEQ ID NO: 1865082 - protein, 7 aa, Staphylococcus
SSDQSDV

SEQ ID NO: 1865083 - protein, 6 aa, Staphylococcus
SSDQSV

SEQ ID NO: 1865084 - protein, 20 aa, Staphylococcus
SSDSEPYTPPQFDNNTTNKG

SEQ ID NO: 1865085 - protein, 18 aa, Staphylococcus
SSDSKNGTTFKILFPHIL

SEQ ID NO: 1865086 - protein, 12 aa, Staphylococcus
SSDSTPPTFGEP

SEQ ID NO: 1865087 - protein, 10 aa, Staphylococcus
SSEAIPKKNI

SEQ ID NO: 1865088 - protein, 4 aa, Staphylococcus
SSEG

SEQ ID NO: 1865089 - protein, 4 aa, Staphylococcus
SSEI

SEQ ID NO: 1865090 - protein, 6 aa, Staphylococcus
SSEINK

SEQ ID NO: 1865091 - protein, 13 aa, Staphylococcus
SSEKAKRSGAMSS

SEQ ID NO: 1865092 - protein, 8 aa, Staphylococcus
SSEKDNNE

SEQ ID NO: 1865093 - protein, 8 aa, Staphylococcus
SSEKQINE

SEQ ID NO: 1865094 - protein, 9 aa, Staphylococcus
SSEKSNRQL

SEQ ID NO: 1865095 - protein, 11 aa, Staphylococcus
SSELEKDDPFN

SEQ ID NO: 1865096 - protein, 12 aa, Staphylococcus
SSELEKDDPFNP

SEQ ID NO: 1865097 - protein, 13 aa, Staphylococcus
SSELGKDDPFNPA

SEQ ID NO: 1865098 - protein, 13 aa, Staphylococcus
SSELGKDDPFNPG

SEQ ID NO: 1865099 - protein, 13 aa, Staphylococcus
SSELNKEDPFNPG

SEQ ID NO: 1865100 - protein, 5 aa, Staphylococcus
SSENN

SEQ ID NO: 1865101 - protein, 9 aa, Staphylococcus
SSENNTFEQ

SEQ ID NO: 1865102 - protein, 6 aa, Staphylococcus
SSEPIS

SEQ ID NO: 1865103 - protein, 8 aa, Staphylococcus
SSETSIQN

SEQ ID NO: 1865104 - protein, 6 aa, Staphylococcus
SSFDEQ

SEQ ID NO: 1865105 - protein, 8 aa, Staphylococcus
SSFDTNYG

SEQ ID NO: 1865106 - protein, 4 aa, Staphylococcus
SSFE

SEQ ID NO: 1865107 - protein, 7 aa, Staphylococcus
SSFETSY

SEQ ID NO: 1865108 - protein, 4 aa, Staphylococcus
SSFG

SEQ ID NO: 1865109 - protein, 7 aa, Staphylococcus
SSFNTDM

SEQ ID NO: 1865110 - protein, 7 aa, Staphylococcus
SSFSSDG

SEQ ID NO: 1865111 - protein, 5 aa, Staphylococcus
SSFST

SEQ ID NO: 1865112 - protein, 7 aa, Staphylococcus
SSGAAGG

SEQ ID NO: 1865113 - protein, 7 aa, Staphylococcus
SSGASQH

SEQ ID NO: 1865114 - protein, 8 aa, Staphylococcus
SSGASQKA

SEQ ID NO: 1865115 - protein, 7 aa, Staphylococcus
SSGASQQ

SEQ ID NO: 1865116 - protein, 8 aa, Staphylococcus
SSGASQQS

SEQ ID NO: 1865117 - protein, 9 aa, Staphylococcus
SSGASSLTG

SEQ ID NO: 1865118 - protein, 6 aa, Staphylococcus
SSGDNT

SEQ ID NO: 1865119 - protein, 10 aa, Staphylococcus
SSGKHNKYHH

SEQ ID NO: 1865120 - protein, 15 aa, Staphylococcus
SSGKNNKYHLPNRET

SEQ ID NO: 1865121 - protein, 9 aa, Staphylococcus
SSGKNNTFH

SEQ ID NO: 1865122 - protein, 5 aa, Staphylococcus
SSGQA

SEQ ID NO: 1865123 - protein, 8 aa, Staphylococcus
SSGSSQSI

SEQ ID NO: 1865124 - protein, 9 aa, Staphylococcus
SSGSTLDPQ

SEQ ID NO: 1865125 - protein, 23 aa, Staphylococcus
SSGTRADIETNQSLTQGKVEKAV

SEQ ID NO: 1865126 - protein, 23 aa, Staphylococcus
SSGTRVDLDSDTKLSQTKVERTI

SEQ ID NO: 1865127 - protein, 7 aa, Staphylococcus
SSHENSV

SEQ ID NO: 1865128 - protein, 4 aa, Staphylococcus
SSHM

SEQ ID NO: 1865129 - protein, 6 aa, Staphylococcus
SSHNLP

SEQ ID NO: 1865130 - protein, 6 aa, Staphylococcus
SSHNSN

SEQ ID NO: 1865131 - protein, 4 aa, Staphylococcus
SSHS

SEQ ID NO: 1865132 - protein, 9 aa, Staphylococcus
SSHSSAPIN

SEQ ID NO: 1865133 - protein, 7 aa, Staphylococcus
SSHVNDE

SEQ ID NO: 1865134 - protein, 6 aa, Staphylococcus
SSIADK

SEQ ID NO: 1865135 - protein, 4 aa, Staphylococcus
SSIG

SEQ ID NO: 1865136 - protein, 8 aa, Staphylococcus
SSIGAPHG

SEQ ID NO: 1865137 - protein, 6 aa, Staphylococcus
SSIKSE

SEQ ID NO: 1865138 - protein, 7 aa, Staphylococcus
SSINLTE

SEQ ID NO: 1865139 - protein, 4 aa, Staphylococcus
SSIP

SEQ ID NO: 1865140 - protein, 8 aa, Staphylococcus
SSIPALNE

SEQ ID NO: 1865141 - protein, 5 aa, Staphylococcus
SSISN

SEQ ID NO: 1865142 - protein, 8 aa, Staphylococcus
SSISVGAS

SEQ ID NO: 1865143 - protein, 10 aa, Staphylococcus
SSKADQTKEI

SEQ ID NO: 1865144 - protein, 41 aa, Staphylococcus
SSKDFTSYAKAHSSLKAEKSGKMLKGDIDSTVNVSDSNFSD

SEQ ID NO: 1865145 - protein, 8 aa, Staphylococcus
SSKDNLTA

SEQ ID NO: 1865146 - protein, 8 aa, Staphylococcus
SSKDTPTY

SEQ ID NO: 1865147 - protein, 8 aa, Staphylococcus
SSKIPSDF

SEQ ID NO: 1865148 - protein, 8 aa, Staphylococcus
SSKIPSGF

SEQ ID NO: 1865149 - protein, 4 aa, Staphylococcus
SSKK

SEQ ID NO: 1865150 - protein, 220 aa, Staphylococcus
SSKKANERLNSDKTEQNDKKKDDKKDKEKDKNKDNDKDKSKDTKVNKTQQAPQQTQQTQQTRQTQQTQETQQTKQSTQKSPSTSEKTQQTPTQQRNTQERQKTKQQKAEPRSSQQTQEAQTDEKTTEQSKSENKNDNKTQEQPSSEEKSSSQQPSSQQPSSQQDNRKQQSQSNSNTSNSSNQSVQKNTSQTQQSSNQSSSTQERSSNQSSSNNSSQNSKE

SEQ ID NO: 1865151 - protein, 58 aa, Staphylococcus
SSKKKAQQQAEEQYEAKEKSLKDNYEDELEKERVEHKKTVTKQRADFDATVDSKDREI

SEQ ID NO: 1865152 - protein, 8 aa, Staphylococcus
SSKNKMSN

SEQ ID NO: 1865153 - protein, 10 aa, Staphylococcus
SSKNPELHKA

SEQ ID NO: 1865154 - protein, 9 aa, Staphylococcus
SSKQKHEIN

SEQ ID NO: 1865155 - protein, 24 aa, Staphylococcus
SSKRTIGPYSTTMSTITDPSYYNT

SEQ ID NO: 1865156 - protein, 5 aa, Staphylococcus
SSKTI

SEQ ID NO: 1865157 - protein, 7 aa, Staphylococcus
SSKTLNT

SEQ ID NO: 1865158 - protein, 15 aa, Staphylococcus
SSKVSSTFDKGTSYN

SEQ ID NO: 1865159 - protein, 6 aa, Staphylococcus
SSLAQQ

SEQ ID NO: 1865160 - protein, 7 aa, Staphylococcus
SSLETPN

SEQ ID NO: 1865161 - protein, 5 aa, Staphylococcus
SSLGQ

SEQ ID NO: 1865162 - protein, 12 aa, Staphylococcus
SSLNISEELEVG

SEQ ID NO: 1865163 - protein, 6 aa, Staphylococcus
SSLPGP

SEQ ID NO: 1865164 - protein, 7 aa, Staphylococcus
SSLSARE

SEQ ID NO: 1865165 - protein, 9 aa, Staphylococcus
SSLSPKTQG

SEQ ID NO: 1865166 - protein, 8 aa, Staphylococcus
SSLSTENT

SEQ ID NO: 1865167 - protein, 5 aa, Staphylococcus
SSLSY

SEQ ID NO: 1865168 - protein, 4 aa, Staphylococcus
SSNA

SEQ ID NO: 1865169 - protein, 16 aa, Staphylococcus
SSNADKQAKASQSDVK

SEQ ID NO: 1865170 - protein, 8 aa, Staphylococcus
SSNDTYKF

SEQ ID NO: 1865171 - protein, 10 aa, Staphylococcus
SSNHDNSNGL

SEQ ID NO: 1865172 - protein, 8 aa, Staphylococcus
SSNNANNA

SEQ ID NO: 1865173 - protein, 9 aa, Staphylococcus
SSNNKEKGW

SEQ ID NO: 1865174 - protein, 5 aa, Staphylococcus
SSNPL

SEQ ID NO: 1865175 - protein, 9 aa, Staphylococcus
SSNPSDGIE

SEQ ID NO: 1865176 - protein, 15 aa, Staphylococcus
SSNSDNQAKATQSDI

SEQ ID NO: 1865177 - protein, 20 aa, Staphylococcus
SSNSEPYTPPQFDNNTTNKE

SEQ ID NO: 1865178 - protein, 4 aa, Staphylococcus
SSNV

SEQ ID NO: 1865179 - protein, 4 aa, Staphylococcus
SSNY

SEQ ID NO: 1865180 - protein, 6 aa, Staphylococcus
SSPAED

SEQ ID NO: 1865181 - protein, 9 aa, Staphylococcus
SSPDEGAYT

SEQ ID NO: 1865182 - protein, 6 aa, Staphylococcus
SSPFEV

SEQ ID NO: 1865183 - protein, 9 aa, Staphylococcus
SSPKGTHDI

SEQ ID NO: 1865184 - protein, 4 aa, Staphylococcus
SSPL

SEQ ID NO: 1865185 - protein, 18 aa, Staphylococcus
SSPQDVNFSKTESAQKYE

SEQ ID NO: 1865186 - protein, 7 aa, Staphylococcus
SSPSYKL

SEQ ID NO: 1865187 - protein, 9 aa, Staphylococcus
SSPYSSLDG

SEQ ID NO: 1865188 - protein, 9 aa, Staphylococcus
SSPYTSLEH

SEQ ID NO: 1865189 - protein, 16 aa, Staphylococcus
SSPYTSLENNNEDVYS

SEQ ID NO: 1865190 - protein, 22 aa, Staphylococcus
SSQEDKEVQSEHGDLPYEQNSN

SEQ ID NO: 1865191 - protein, 14 aa, Staphylococcus
SSQSYNDKEATHHE

SEQ ID NO: 1865192 - protein, 9 aa, Staphylococcus
SSQTDSRTI

SEQ ID NO: 1865193 - protein, 20 aa, Staphylococcus
SSQTDSRTIIDSGGADKLLG

SEQ ID NO: 1865194 - protein, 20 aa, Staphylococcus
SSQTDSRTIIGSGGADKLLG

SEQ ID NO: 1865195 - protein, 18 aa, Staphylococcus
SSRINSLASGNNKNAIAA

SEQ ID NO: 1865196 - protein, 15 aa, Staphylococcus
SSRQSQHRQEGDRHE

SEQ ID NO: 1865197 - protein, 6 aa, Staphylococcus
SSRREH

SEQ ID NO: 1865198 - protein, 14 aa, Staphylococcus
SSRTKEKANQFADT

SEQ ID NO: 1865199 - protein, 14 aa, Staphylococcus
SSSANNGSGFEGLG

SEQ ID NO: 1865200 - protein, 6 aa, Staphylococcus
SSSATI

SEQ ID NO: 1865201 - protein, 9 aa, Staphylococcus
SSSDNGIVS

SEQ ID NO: 1865202 - protein, 6 aa, Staphylococcus
SSSEGG

SEQ ID NO: 1865203 - protein, 7 aa, Staphylococcus
SSSEGGL

SEQ ID NO: 1865204 - protein, 22 aa, Staphylococcus
SSSGQTKDIVNSTQLAKEKGAK

SEQ ID NO: 1865205 - protein, 7 aa, Staphylococcus
SSSGTTV

SEQ ID NO: 1865206 - protein, 4 aa, Staphylococcus
SSSH

SEQ ID NO: 1865207 - protein, 8 aa, Staphylococcus
SSSIGTTS

SEQ ID NO: 1865208 - protein, 5 aa, Staphylococcus
SSSKP

SEQ ID NO: 1865209 - protein, 12 aa, Staphylococcus
SSSLGEADGGSI

SEQ ID NO: 1865210 - protein, 5 aa, Staphylococcus
SSSLP

SEQ ID NO: 1865211 - protein, 6 aa, Staphylococcus
SSSLTE

SEQ ID NO: 1865212 - protein, 6 aa, Staphylococcus
SSSSHL

SEQ ID NO: 1865213 - protein, 12 aa, Staphylococcus
SSSSKNSRQHSA

SEQ ID NO: 1865214 - protein, 8 aa, Staphylococcus
SSSTGRDY

SEQ ID NO: 1865215 - protein, 11 aa, Staphylococcus
SSSTPADAGIK

SEQ ID NO: 1865216 - protein, 11 aa, Staphylococcus
SSSTPSQAGIK

SEQ ID NO: 1865217 - protein, 13 aa, Staphylococcus
SSSTPSQAGIKGA

SEQ ID NO: 1865218 - protein, 14 aa, Staphylococcus
SSSTPSQAGIKGAL

SEQ ID NO: 1865219 - protein, 6 aa, Staphylococcus
SSSVGY

SEQ ID NO: 1865220 - protein, 8 aa, Staphylococcus
SSTARAGA

SEQ ID NO: 1865221 - protein, 7 aa, Staphylococcus
SSTEPPG

SEQ ID NO: 1865222 - protein, 6 aa, Staphylococcus
SSTGSL

SEQ ID NO: 1865223 - protein, 5 aa, Staphylococcus
SSTGT

SEQ ID NO: 1865224 - protein, 17 aa, Staphylococcus
SSTLHEGTTFDIHFPEN

SEQ ID NO: 1865225 - protein, 4 aa, Staphylococcus
SSTN

SEQ ID NO: 1865226 - protein, 4 aa, Staphylococcus
SSTP

SEQ ID NO: 1865227 - protein, 7 aa, Staphylococcus
SSTPDVK

SEQ ID NO: 1865228 - protein, 5 aa, Staphylococcus
SSTQV

SEQ ID NO: 1865229 - protein, 9 aa, Staphylococcus
SSTRNIEGY

SEQ ID NO: 1865230 - protein, 9 aa, Staphylococcus
SSTTAGIDR

SEQ ID NO: 1865231 - protein, 7 aa, Staphylococcus
SSTTPKV

SEQ ID NO: 1865232 - protein, 23 aa, Staphylococcus
SSTTTGTYSSTIVPEDRKGEGIG

SEQ ID NO: 1865233 - protein, 10 aa, Staphylococcus
SSTVAAISST

SEQ ID NO: 1865234 - protein, 5 aa, Staphylococcus
SSTYT

SEQ ID NO: 1865235 - protein, 5 aa, Staphylococcus
SSVGA

SEQ ID NO: 1865236 - protein, 8 aa, Staphylococcus
SSVGKGTT

SEQ ID NO: 1865237 - protein, 6 aa, Staphylococcus
SSVGTA

SEQ ID NO: 1865238 - protein, 4 aa, Staphylococcus
SSVP

SEQ ID NO: 1865239 - protein, 7 aa, Staphylococcus
SSVPQKG

SEQ ID NO: 1865240 - protein, 4 aa, Staphylococcus
SSVT

SEQ ID NO: 1865241 - protein, 15 aa, Staphylococcus
SSYDYKKGDQIGTPG

SEQ ID NO: 1865242 - protein, 7 aa, Staphylococcus
SSYGTAP

SEQ ID NO: 1865243 - protein, 15 aa, Staphylococcus
SSYNFKQGDKIGTPG

SEQ ID NO: 1865244 - protein, 8 aa, Staphylococcus
SSYNSDIG

SEQ ID NO: 1865245 - protein, 15 aa, Staphylococcus
SSYNYKKGDEIGTPG

SEQ ID NO: 1865246 - protein, 10 aa, Staphylococcus
STADNEKDRT

SEQ ID NO: 1865247 - protein, 4 aa, Staphylococcus
STAG

SEQ ID NO: 1865248 - protein, 7 aa, Staphylococcus
STAGGNA

SEQ ID NO: 1865249 - protein, 7 aa, Staphylococcus
STAGGNS

SEQ ID NO: 1865250 - protein, 9 aa, Staphylococcus
STAGGNSEI

SEQ ID NO: 1865251 - protein, 5 aa, Staphylococcus
STAGK

SEQ ID NO: 1865252 - protein, 28 aa, Staphylococcus
STAGKSLKGSYPNVDNEEDRKYYEENPK

SEQ ID NO: 1865253 - protein, 5 aa, Staphylococcus
STALS

SEQ ID NO: 1865254 - protein, 6 aa, Staphylococcus
STAQQA

SEQ ID NO: 1865255 - protein, 12 aa, Staphylococcus
STASDLNNSMSE

SEQ ID NO: 1865256 - protein, 5 aa, Staphylococcus
STASI

SEQ ID NO: 1865257 - protein, 8 aa, Staphylococcus
STATGTIS

SEQ ID NO: 1865258 - protein, 4 aa, Staphylococcus
STDA

SEQ ID NO: 1865259 - protein, 12 aa, Staphylococcus
STDADGNRTDTK

SEQ ID NO: 1865260 - protein, 11 aa, Staphylococcus
STDADGNRTET

SEQ ID NO: 1865261 - protein, 10 aa, Staphylococcus
STDADGNSIE

SEQ ID NO: 1865262 - protein, 11 aa, Staphylococcus
STDADGNSIET

SEQ ID NO: 1865263 - protein, 11 aa, Staphylococcus
STDAEGNSTDT

SEQ ID NO: 1865264 - protein, 13 aa, Staphylococcus
STDAEGNSTETKF

SEQ ID NO: 1865265 - protein, 8 aa, Staphylococcus
STDASYPI

SEQ ID NO: 1865266 - protein, 6 aa, Staphylococcus
STDDPI

SEQ ID NO: 1865267 - protein, 7 aa, Staphylococcus
STDEGTV

SEQ ID NO: 1865268 - protein, 5 aa, Staphylococcus
STDGE

SEQ ID NO: 1865269 - protein, 23 aa, Staphylococcus
STDGNSNKTSFDSEDANAMDSSL

SEQ ID NO: 1865270 - protein, 7 aa, Staphylococcus
STDPNFD

SEQ ID NO: 1865271 - protein, 7 aa, Staphylococcus
STDPNTK

SEQ ID NO: 1865272 - protein, 12 aa, Staphylococcus
STDTEGNSVETK

SEQ ID NO: 1865273 - protein, 7 aa, Staphylococcus
STEDQEI

SEQ ID NO: 1865274 - protein, 4 aa, Staphylococcus
STEE

SEQ ID NO: 1865275 - protein, 6 aa, Staphylococcus
STEIQK

SEQ ID NO: 1865276 - protein, 7 aa, Staphylococcus
STFNESK

SEQ ID NO: 1865277 - protein, 17 aa, Staphylococcus
STFSKNNLEEAARTGNP

SEQ ID NO: 1865278 - protein, 4 aa, Staphylococcus
STGA

SEQ ID NO: 1865279 - protein, 13 aa, Staphylococcus
STGASNDFERATQ

SEQ ID NO: 1865280 - protein, 6 aa, Staphylococcus
STGCEA

SEQ ID NO: 1865281 - protein, 7 aa, Staphylococcus
STGGEYA

SEQ ID NO: 1865282 - protein, 8 aa, Staphylococcus
STGGSGIK

SEQ ID NO: 1865283 - protein, 7 aa, Staphylococcus
STGIGGV

SEQ ID NO: 1865284 - protein, 10 aa, Staphylococcus
STGLVSPPYG

SEQ ID NO: 1865285 - protein, 7 aa, Staphylococcus
STGNALA

SEQ ID NO: 1865286 - protein, 8 aa, Staphylococcus
STGNEGYR

SEQ ID NO: 1865287 - protein, 6 aa, Staphylococcus
STGPAI

SEQ ID NO: 1865288 - protein, 9 aa, Staphylococcus
STGPNDGME

SEQ ID NO: 1865289 - protein, 11 aa, Staphylococcus
STGRKNVDADL

SEQ ID NO: 1865290 - protein, 7 aa, Staphylococcus
STGSATV

SEQ ID NO: 1865291 - protein, 16 aa, Staphylococcus
STGSQLVENKNRGKAL

SEQ ID NO: 1865292 - protein, 7 aa, Staphylococcus
STGVPNS

SEQ ID NO: 1865293 - protein, 6 aa, Staphylococcus
STGYGE

SEQ ID NO: 1865294 - protein, 4 aa, Staphylococcus
STHP

SEQ ID NO: 1865295 - protein, 7 aa, Staphylococcus
STIATGT

SEQ ID NO: 1865296 - protein, 13 aa, Staphylococcus
STIEAAKDQPAYG

SEQ ID NO: 1865297 - protein, 8 aa, Staphylococcus
STINGKAN

SEQ ID NO: 1865298 - protein, 6 aa, Staphylococcus
STINSE

SEQ ID NO: 1865299 - protein, 5 aa, Staphylococcus
STIRA

SEQ ID NO: 1865300 - protein, 8 aa, Staphylococcus
STISVGAS

SEQ ID NO: 1865301 - protein, 6 aa, Staphylococcus
STKASV

SEQ ID NO: 1865302 - protein, 14 aa, Staphylococcus
STKDNKVDPDEAKE

SEQ ID NO: 1865303 - protein, 14 aa, Staphylococcus
STKDNKVDPDEASA

SEQ ID NO: 1865304 - protein, 8 aa, Staphylococcus
STKEDIRK

SEQ ID NO: 1865305 - protein, 23 aa, Staphylococcus
STKEEEVASIKSSLEKVVREVGN

SEQ ID NO: 1865306 - protein, 12 aa, Staphylococcus
STKEEEVEGIKS

SEQ ID NO: 1865307 - protein, 12 aa, Staphylococcus
STKEEEVESIKS

SEQ ID NO: 1865308 - protein, 24 aa, Staphylococcus
STKEEEVESIKSSLEKVVREVGEN

SEQ ID NO: 1865309 - protein, 13 aa, Staphylococcus
STKEEEVESIKTS

SEQ ID NO: 1865310 - protein, 18 aa, Staphylococcus
STKESNKKGGDDAQGYDI

SEQ ID NO: 1865311 - protein, 10 aa, Staphylococcus
STKGSNVDGD

SEQ ID NO: 1865312 - protein, 7 aa, Staphylococcus
STKKITP

SEQ ID NO: 1865313 - protein, 4 aa, Staphylococcus
STKQ

SEQ ID NO: 1865314 - protein, 47 aa, Staphylococcus
STKSSSHHVGATNYGSVVSEETNHLNTSNNKETSELPKSGQTETNTT

SEQ ID NO: 1865315 - protein, 4 aa, Staphylococcus
STLG

SEQ ID NO: 1865316 - protein, 6 aa, Staphylococcus
STLGGT

SEQ ID NO: 1865317 - protein, 4 aa, Staphylococcus
STLN

SEQ ID NO: 1865318 - protein, 8 aa, Staphylococcus
STLNKNGS

SEQ ID NO: 1865319 - protein, 23 aa, Staphylococcus
STLNPQTIKNSGVTDKEYAAVSQ

SEQ ID NO: 1865320 - protein, 6 aa, Staphylococcus
STLPGI

SEQ ID NO: 1865321 - protein, 5 aa, Staphylococcus
STLQT

SEQ ID NO: 1865322 - protein, 12 aa, Staphylococcus
STLRSQGAKDMD

SEQ ID NO: 1865323 - protein, 12 aa, Staphylococcus
STMSGTAKTFRG

SEQ ID NO: 1865324 - protein, 8 aa, Staphylococcus
STNATSNI

SEQ ID NO: 1865325 - protein, 11 aa, Staphylococcus
STNAVAASGMT

SEQ ID NO: 1865326 - protein, 6 aa, Staphylococcus
STNDKR

SEQ ID NO: 1865327 - protein, 7 aa, Staphylococcus
STNEDME

SEQ ID NO: 1865328 - protein, 5 aa, Staphylococcus
STNFK

SEQ ID NO: 1865329 - protein, 10 aa, Staphylococcus
STNHADRTTL

SEQ ID NO: 1865330 - protein, 4 aa, Staphylococcus
STNK

SEQ ID NO: 1865331 - protein, 10 aa, Staphylococcus
STNKGISPHA

SEQ ID NO: 1865332 - protein, 7 aa, Staphylococcus
STNKNGV

SEQ ID NO: 1865333 - protein, 8 aa, Staphylococcus
STNKNGVP

SEQ ID NO: 1865334 - protein, 8 aa, Staphylococcus
STNKQGVP

SEQ ID NO: 1865335 - protein, 14 aa, Staphylococcus
STNLNSDEDKLISS

SEQ ID NO: 1865336 - protein, 4 aa, Staphylococcus
STNN

SEQ ID NO: 1865337 - protein, 15 aa, Staphylococcus
STNTEPSSHEKATYV

SEQ ID NO: 1865338 - protein, 5 aa, Staphylococcus
STNVL

SEQ ID NO: 1865339 - protein, 7 aa, Staphylococcus
STNYDEP

SEQ ID NO: 1865340 - protein, 8 aa, Staphylococcus
STNYDEPK

SEQ ID NO: 1865341 - protein, 8 aa, Staphylococcus
STNYEETD

SEQ ID NO: 1865342 - protein, 13 aa, Staphylococcus
STPAEGVPKELTE

SEQ ID NO: 1865343 - protein, 7 aa, Staphylococcus
STPDEVA

SEQ ID NO: 1865344 - protein, 4 aa, Staphylococcus
STPE

SEQ ID NO: 1865345 - protein, 12 aa, Staphylococcus
STPEDAEDALDR

SEQ ID NO: 1865346 - protein, 4 aa, Staphylococcus
STPF

SEQ ID NO: 1865347 - protein, 8 aa, Staphylococcus
STPPNAAV

SEQ ID NO: 1865348 - protein, 6 aa, Staphylococcus
STPYNT

SEQ ID NO: 1865349 - protein, 26 aa, Staphylococcus
STQAINVSNGDYSQKTTVNTKDEIGE

SEQ ID NO: 1865350 - protein, 4 aa, Staphylococcus
STQE

SEQ ID NO: 1865351 - protein, 7 aa, Staphylococcus
STQKNIR

SEQ ID NO: 1865352 - protein, 14 aa, Staphylococcus
STQNNSVDETEATA

SEQ ID NO: 1865353 - protein, 9 aa, Staphylococcus
STQSAISPH

SEQ ID NO: 1865354 - protein, 5 aa, Staphylococcus
STQSM

SEQ ID NO: 1865355 - protein, 14 aa, Staphylococcus
STRDNKVGGDEAET

SEQ ID NO: 1865356 - protein, 6 aa, Staphylococcus
STREKP

SEQ ID NO: 1865357 - protein, 4 aa, Staphylococcus
STRH

SEQ ID NO: 1865358 - protein, 4 aa, Staphylococcus
STRI

SEQ ID NO: 1865359 - protein, 7 aa, Staphylococcus
STRTQAE

SEQ ID NO: 1865360 - protein, 9 aa, Staphylococcus
STSAKSVNG

SEQ ID NO: 1865361 - protein, 179 aa, Staphylococcus
STSASDSNSTSTSDSTSTSLSESTSESTSGSISTSDSESASTSMSLSDSISESLSTSDSESTKESTSTSISTSDSTSTSDSESTSTSTSDSVSTSLSTSDSTSTSMSASNSESASLSDSTSTSLSTSTSLSDSTSGSLSDSTSGSTSISTSTSISDSTSMSTSESESESISSKSQFSSS

SEQ ID NO: 1865362 - protein, 7 aa, Staphylococcus
STSELNQ

SEQ ID NO: 1865363 - protein, 21 aa, Staphylococcus
STSGKSLKGSYPNVESDEEYE

SEQ ID NO: 1865364 - protein, 8 aa, Staphylococcus
STSKKDTY

SEQ ID NO: 1865365 - protein, 113 aa, Staphylococcus
STSLSTADSASLSDSTSISGSESLSSSESLSASYAASTSLSEQASESLSASHAASDSVSQSLSTSLSASHSESDSASESLSESLSSSHAASDSKSISTSSSLSTSYSGSMSDS

SEQ ID NO: 1865366 - protein, 8 aa, Staphylococcus
STSLTTRT

SEQ ID NO: 1865367 - protein, 9 aa, Staphylococcus
STSNDPVER

SEQ ID NO: 1865368 - protein, 6 aa, Staphylococcus
STSNKQ

SEQ ID NO: 1865369 - protein, 20 aa, Staphylococcus
STSNKSLRGSYPNVETQEDY

SEQ ID NO: 1865370 - protein, 5 aa, Staphylococcus
STSQH

SEQ ID NO: 1865371 - protein, 8 aa, Staphylococcus
STSQNVGY

SEQ ID NO: 1865372 - protein, 5 aa, Staphylococcus
STSQQ

SEQ ID NO: 1865373 - protein, 5 aa, Staphylococcus
STSRM

SEQ ID NO: 1865374 - protein, 7 aa, Staphylococcus
STSSSEA

SEQ ID NO: 1865375 - protein, 8 aa, Staphylococcus
STSSSEAV

SEQ ID NO: 1865376 - protein, 5 aa, Staphylococcus
STSSY

SEQ ID NO: 1865377 - protein, 4 aa, Staphylococcus
STST

SEQ ID NO: 1865378 - protein, 11 aa, Staphylococcus
STSTEGIPKEL

SEQ ID NO: 1865379 - protein, 16 aa, Staphylococcus
STSTKKDEREKSELNQ

SEQ ID NO: 1865380 - protein, 6 aa, Staphylococcus
STSTRN

SEQ ID NO: 1865381 - protein, 8 aa, Staphylococcus
STSVGQQM

SEQ ID NO: 1865382 - protein, 23 aa, Staphylococcus
STTEEETEGIKSSLEKVVREVGE

SEQ ID NO: 1865383 - protein, 7 aa, Staphylococcus
STTHDTR

SEQ ID NO: 1865384 - protein, 4 aa, Staphylococcus
STTI

SEQ ID NO: 1865385 - protein, 12 aa, Staphylococcus
STTKGKSIDGDN

SEQ ID NO: 1865386 - protein, 10 aa, Staphylococcus
STTNAGLDIT

SEQ ID NO: 1865387 - protein, 10 aa, Staphylococcus
STTPKANRKK

SEQ ID NO: 1865388 - protein, 10 aa, Staphylococcus
STTPKENKKK

SEQ ID NO: 1865389 - protein, 6 aa, Staphylococcus
STTRQA

SEQ ID NO: 1865390 - protein, 9 aa, Staphylococcus
STTTRSAGL

SEQ ID NO: 1865391 - protein, 8 aa, Staphylococcus
STVDGDTA

SEQ ID NO: 1865392 - protein, 7 aa, Staphylococcus
STVGQGT

SEQ ID NO: 1865393 - protein, 7 aa, Staphylococcus
STVNKGT

SEQ ID NO: 1865394 - protein, 6 aa, Staphylococcus
STVTNG
